United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 70

SEQ ID NO: 2523010 - RNA, 19 nt, Chlamydophila pneumoniae CWL029
acaaacaucgaaaccacag

SEQ ID NO: 2523011 - RNA, 13 nt, Chlamydophila pneumoniae CWL029
acaaacucuucca

SEQ ID NO: 2523012 - RNA, 15 nt, Chlamydophila pneumoniae CWL029
acaaagaucacugag

SEQ ID NO: 2523013 - RNA, 19 nt, Chlamydophila pneumoniae CWL029
acaaaggcauaagaucaua

SEQ ID NO: 2523014 - RNA, 18 nt, Chlamydophila pneumoniae CWL029
acaaaggguuucuuucca

SEQ ID NO: 2523015 - RNA, 20 nt, Chlamydophila pneumoniae CWL029
acaaaguaggauugauaaau

SEQ ID NO: 2523016 - RNA, 13 nt, Chlamydophila pneumoniae CWL029
acaaauaaaauga

SEQ ID NO: 2523017 - RNA, 15 nt, Chlamydophila pneumoniae CWL029
acaaauagcucugcg

SEQ ID NO: 2523018 - RNA, 23 nt, Chlamydophila pneumoniae CWL029
acaaaucacgacgucaucaccau

SEQ ID NO: 2523019 - RNA, 22 nt, Chlamydophila pneumoniae CWL029
acaaaucauuuaaagcugaaau

SEQ ID NO: 2523020 - RNA, 19 nt, Chlamydophila pneumoniae CWL029
acaaaugcgguaucuccgg

SEQ ID NO: 2523021 - RNA, 21 nt, Chlamydophila pneumoniae CWL029
acaaaugcgguaucuccggaa

SEQ ID NO: 2523022 - RNA, 19 nt, Chlamydophila pneumoniae CWL029
acaaaugugacgcaagaga

SEQ ID NO: 2523023 - RNA, 21 nt, Chlamydophila pneumoniae CWL029
acaaaugugacgcaagagaca

SEQ ID NO: 2523024 - RNA, 19 nt, Chlamydophila pneumoniae CWL029
acaaauuaccuugagacaa

SEQ ID NO: 2523025 - RNA, 21 nt, Chlamydophila pneumoniae CWL029
acaaauuuaucggcuaaagaa

SEQ ID NO: 2523026 - RNA, 19 nt, Chlamydophila pneumoniae CWL029
acaaauuuuugcagaguug

SEQ ID NO: 2523027 - RNA, 13 nt, Chlamydophila pneumoniae CWL029
acaacaaauugau

SEQ ID NO: 2523028 - RNA, 19 nt, Chlamydophila pneumoniae CWL029
acaacaacagcuuuaucuu

SEQ ID NO: 2523029 - RNA, 15 nt, Chlamydophila pneumoniae CWL029
acaacaacauaaaga

SEQ ID NO: 2523030 - RNA, 17 nt, Chlamydophila pneumoniae CWL029
acaacaacauaaagaag

SEQ ID NO: 2523031 - RNA, 18 nt, Chlamydophila pneumoniae CWL029
acaacaccacagaggucg

SEQ ID NO: 2523032 - RNA, 19 nt, Chlamydophila pneumoniae CWL029
acaacaccucccaccaagg

SEQ ID NO: 2523033 - RNA, 22 nt, Chlamydophila pneumoniae CWL029
acaacaguugcggagaugccau

SEQ ID NO: 2523034 - RNA, 15 nt, Chlamydophila pneumoniae CWL029
acaacauaacagggu

SEQ ID NO: 2523035 - RNA, 16 nt, Chlamydophila pneumoniae CWL029
acaacaucaugaaaua

SEQ ID NO: 2523036 - RNA, 13 nt, Chlamydophila pneumoniae CWL029
acaaccacuuccu

SEQ ID NO: 2523037 - RNA, 21 nt, Chlamydophila pneumoniae CWL029
acaacgccuacauggaucccu

SEQ ID NO: 2523038 - RNA, 22 nt, Chlamydophila pneumoniae CWL029
acaacgguguucauaaucagaa

SEQ ID NO: 2523039 - RNA, 22 nt, Chlamydophila pneumoniae CWL029
acaacuagguuauuaucaaagu

SEQ ID NO: 2523040 - RNA, 19 nt, Chlamydophila pneumoniae CWL029
acaacugugguuuuaaaaa

SEQ ID NO: 2523041 - RNA, 17 nt, Chlamydophila pneumoniae CWL029
acaacuucugacaauaa

SEQ ID NO: 2523042 - RNA, 15 nt, Chlamydophila pneumoniae CWL029
acaacuuugaggcaa

SEQ ID NO: 2523043 - RNA, 13 nt, Chlamydophila pneumoniae CWL029
acaagaaaacaaa

SEQ ID NO: 2523044 - RNA, 14 nt, Chlamydophila pneumoniae CWL029
acaagaaaacaaag

SEQ ID NO: 2523045 - RNA, 15 nt, Chlamydophila pneumoniae CWL029
acaagaacugaagag

SEQ ID NO: 2523046 - RNA, 16 nt, Chlamydophila pneumoniae CWL029
acaagaagaucaaaga

SEQ ID NO: 2523047 - RNA, 21 nt, Chlamydophila pneumoniae CWL029
acaagaagaucaaagauuccu

SEQ ID NO: 2523048 - RNA, 14 nt, Chlamydophila pneumoniae CWL029
acaagacgaaagca

SEQ ID NO: 2523049 - RNA, 14 nt, Chlamydophila pneumoniae CWL029
acaagagagagcug

SEQ ID NO: 2523050 - RNA, 13 nt, Chlamydophila pneumoniae CWL029
acaagauaguggu

SEQ ID NO: 2523051 - RNA, 23 nt, Chlamydophila pneumoniae CWL029
acaagauucucagcuucaucaga

SEQ ID NO: 2523052 - RNA, 15 nt, Chlamydophila pneumoniae CWL029
acaagcaaggaaaaa

SEQ ID NO: 2523053 - RNA, 17 nt, Chlamydophila pneumoniae CWL029
acaagcaaggaaaaaaa

SEQ ID NO: 2523054 - RNA, 20 nt, Chlamydophila pneumoniae CWL029
acaagcaauacuaagaagcu

SEQ ID NO: 2523055 - RNA, 23 nt, Chlamydophila pneumoniae CWL029
acaagcaguaacugcaaagagaa

SEQ ID NO: 2523056 - RNA, 22 nt, Chlamydophila pneumoniae CWL029
acaagcuucaucaaaacauaau

SEQ ID NO: 2523057 - RNA, 20 nt, Chlamydophila pneumoniae CWL029
acaagcuuccuuggucuuau

SEQ ID NO: 2523058 - RNA, 23 nt, Chlamydophila pneumoniae CWL029
acaagcuucguccugacacaacu

SEQ ID NO: 2523059 - RNA, 15 nt, Chlamydophila pneumoniae CWL029
acaagggaaagaaac

SEQ ID NO: 2523060 - RNA, 17 nt, Chlamydophila pneumoniae CWL029
acaagggauucuuguug

SEQ ID NO: 2523061 - RNA, 15 nt, Chlamydophila pneumoniae CWL029
acaaguaccaagaaa

SEQ ID NO: 2523062 - RNA, 16 nt, Chlamydophila pneumoniae CWL029
acaaguaccaagaaaa

SEQ ID NO: 2523063 - RNA, 21 nt, Chlamydophila pneumoniae CWL029
acaaguacgacgaaguuagcu

SEQ ID NO: 2523064 - RNA, 22 nt, Chlamydophila pneumoniae CWL029
acaaguacgacgaaguuagcua

SEQ ID NO: 2523065 - RNA, 12 nt, Chlamydophila pneumoniae CWL029
acaagucccccu

SEQ ID NO: 2523066 - RNA, 15 nt, Chlamydophila pneumoniae CWL029
acaaguucuaccuau

SEQ ID NO: 2523067 - RNA, 15 nt, Chlamydophila pneumoniae CWL029
acaaguugagagaga

SEQ ID NO: 2523068 - RNA, 13 nt, Chlamydophila pneumoniae CWL029
acaauaaaaaaga

SEQ ID NO: 2523069 - RNA, 15 nt, Chlamydophila pneumoniae CWL029
acaauaaaaaagaga

SEQ ID NO: 2523070 - RNA, 16 nt, Chlamydophila pneumoniae CWL029
acaauaagaaaauccu

SEQ ID NO: 2523071 - RNA, 23 nt, Chlamydophila pneumoniae CWL029
acaauaccaucucuuucuauuuc

SEQ ID NO: 2523072 - RNA, 21 nt, Chlamydophila pneumoniae CWL029
acaauaggcacccaaacugau

SEQ ID NO: 2523073 - RNA, 14 nt, Chlamydophila pneumoniae CWL029
acaauauaaaugcu

SEQ ID NO: 2523074 - RNA, 14 nt, Chlamydophila pneumoniae CWL029
acaauauaagcacc

SEQ ID NO: 2523075 - RNA, 17 nt, Chlamydophila pneumoniae CWL029
acaauccucacuauuaa

SEQ ID NO: 2523076 - RNA, 19 nt, Chlamydophila pneumoniae CWL029
acaauccucacuauuaaua

SEQ ID NO: 2523077 - RNA, 16 nt, Chlamydophila pneumoniae CWL029
acaaucguagccccau

SEQ ID NO: 2523078 - RNA, 20 nt, Chlamydophila pneumoniae CWL029
acaaucgugauugcugucag

SEQ ID NO: 2523079 - RNA, 22 nt, Chlamydophila pneumoniae CWL029
acaaucucuagggauaauuaaa

SEQ ID NO: 2523080 - RNA, 22 nt, Chlamydophila pneumoniae CWL029
acaaucucuuuaaaaauuaaag

SEQ ID NO: 2523081 - RNA, 22 nt, Chlamydophila pneumoniae CWL029
acaaugaagaacuacucucauu

SEQ ID NO: 2523082 - RNA, 19 nt, Chlamydophila pneumoniae CWL029
acaaugaagucuucuuucc

SEQ ID NO: 2523083 - RNA, 16 nt, Chlamydophila pneumoniae CWL029
acaaugaucuuucgaa

SEQ ID NO: 2523084 - RNA, 14 nt, Chlamydophila pneumoniae CWL029
acaaugcuaucucc

SEQ ID NO: 2523085 - RNA, 15 nt, Chlamydophila pneumoniae CWL029
acaaugcuaucucca

SEQ ID NO: 2523086 - RNA, 17 nt, Chlamydophila pneumoniae CWL029
acaaugcuaucuccaga

SEQ ID NO: 2523087 - RNA, 12 nt, Chlamydophila pneumoniae CWL029
acaauggaaaua

SEQ ID NO: 2523088 - RNA, 21 nt, Chlamydophila pneumoniae CWL029
acaauggaaauagagaaacuu

SEQ ID NO: 2523089 - RNA, 12 nt, Chlamydophila pneumoniae CWL029
acaauguuuaga

SEQ ID NO: 2523090 - RNA, 22 nt, Chlamydophila pneumoniae CWL029
acaauuccguacgcuauaaaua

SEQ ID NO: 2523091 - RNA, 13 nt, Chlamydophila pneumoniae CWL029
acaauuccuaaaa

SEQ ID NO: 2523092 - RNA, 20 nt, Chlamydophila pneumoniae CWL029
acaauuccuaaaacaagaag

SEQ ID NO: 2523093 - RNA, 15 nt, Chlamydophila pneumoniae CWL029
acaauuuaaaucugc

SEQ ID NO: 2523094 - RNA, 16 nt, Chlamydophila pneumoniae CWL029
acaauuugcuccucca

SEQ ID NO: 2523095 - RNA, 18 nt, Chlamydophila pneumoniae CWL029
acaauuugcuccuccaaa

SEQ ID NO: 2523096 - RNA, 12 nt, Chlamydophila pneumoniae CWL029
acaauuuuaaaa

SEQ ID NO: 2523097 - RNA, 12 nt, Chlamydophila pneumoniae CWL029
acacaaauagca

SEQ ID NO: 2523098 - RNA, 19 nt, Chlamydophila pneumoniae CWL029
acacaaauagcaagagcua

SEQ ID NO: 2523099 - RNA, 15 nt, Chlamydophila pneumoniae CWL029
acacaaguucuaccu

SEQ ID NO: 2523100 - RNA, 17 nt, Chlamydophila pneumoniae CWL029
acacacaugacaaauaa

SEQ ID NO: 2523101 - RNA, 20 nt, Chlamydophila pneumoniae CWL029
acacacuuucuuuaaagaau

SEQ ID NO: 2523102 - RNA, 21 nt, Chlamydophila pneumoniae CWL029
acacacuuucuuuaaagaaua

SEQ ID NO: 2523103 - RNA, 23 nt, Chlamydophila pneumoniae CWL029
acacagacuugaggaaucugaau

SEQ ID NO: 2523104 - RNA, 11 nt, Chlamydophila pneumoniae CWL029
acacagagaac

SEQ ID NO: 2523105 - RNA, 16 nt, Chlamydophila pneumoniae CWL029
acacagagaacaauaa

SEQ ID NO: 2523106 - RNA, 17 nt, Chlamydophila pneumoniae CWL029
acacagagaacaauaaa

SEQ ID NO: 2523107 - RNA, 20 nt, Chlamydophila pneumoniae CWL029
acacagagaugcuucuaaac

SEQ ID NO: 2523108 - RNA, 17 nt, Chlamydophila pneumoniae CWL029
acacaguagccuucuuc

SEQ ID NO: 2523109 - RNA, 16 nt, Chlamydophila pneumoniae CWL029
acacauugucucuuuu

SEQ ID NO: 2523110 - RNA, 16 nt, Chlamydophila pneumoniae CWL029
acaccaaaagaauacu

SEQ ID NO: 2523111 - RNA, 12 nt, Chlamydophila pneumoniae CWL029
acaccaaauccu

SEQ ID NO: 2523112 - RNA, 14 nt, Chlamydophila pneumoniae CWL029
acaccaaauccugc

SEQ ID NO: 2523113 - RNA, 17 nt, Chlamydophila pneumoniae CWL029
acaccagcucgagaucu

SEQ ID NO: 2523114 - RNA, 13 nt, Chlamydophila pneumoniae CWL029
acaccauaaaaca

SEQ ID NO: 2523115 - RNA, 14 nt, Chlamydophila pneumoniae CWL029
acaccauagaacug

SEQ ID NO: 2523116 - RNA, 16 nt, Chlamydophila pneumoniae CWL029
acaccaucacauccug

SEQ ID NO: 2523117 - RNA, 15 nt, Chlamydophila pneumoniae CWL029
acaccauuuuugaau

SEQ ID NO: 2523118 - RNA, 17 nt, Chlamydophila pneumoniae CWL029
acacccccgcagcuucu

SEQ ID NO: 2523119 - RNA, 20 nt, Chlamydophila pneumoniae CWL029
acacccugacagguagugcu

SEQ ID NO: 2523120 - RNA, 13 nt, Chlamydophila pneumoniae CWL029
acaccucuucucu

SEQ ID NO: 2523121 - RNA, 13 nt, Chlamydophila pneumoniae CWL029
acacgaauaauua

SEQ ID NO: 2523122 - RNA, 16 nt, Chlamydophila pneumoniae CWL029
acacgaauaauuaaau

SEQ ID NO: 2523123 - RNA, 20 nt, Chlamydophila pneumoniae CWL029
acacgaucuaaggcuuugcc

SEQ ID NO: 2523124 - RNA, 19 nt, Chlamydophila pneumoniae CWL029
acacgcacuugcuuaucca

SEQ ID NO: 2523125 - RNA, 19 nt, Chlamydophila pneumoniae CWL029
acacgccuccuucaaagau

SEQ ID NO: 2523126 - RNA, 16 nt, Chlamydophila pneumoniae CWL029
acacgcuauagcaaca

SEQ ID NO: 2523127 - RNA, 16 nt, Chlamydophila pneumoniae CWL029
acacggacacuauuau

SEQ ID NO: 2523128 - RNA, 22 nt, Chlamydophila pneumoniae CWL029
acacgucacuggggcauaagaa

SEQ ID NO: 2523129 - RNA, 22 nt, Chlamydophila pneumoniae CWL029
acacuauguguuuccuuuucuc

SEQ ID NO: 2523130 - RNA, 21 nt, Chlamydophila pneumoniae CWL029
acacucaaaucuuucaaggaa

SEQ ID NO: 2523131 - RNA, 17 nt, Chlamydophila pneumoniae CWL029
acacucagcucccaugu

SEQ ID NO: 2523132 - RNA, 13 nt, Chlamydophila pneumoniae CWL029
acacugcgagaga

SEQ ID NO: 2523133 - RNA, 17 nt, Chlamydophila pneumoniae CWL029
acacugcgcaaagaacu

SEQ ID NO: 2523134 - RNA, 20 nt, Chlamydophila pneumoniae CWL029
acacugguagcuaaauuuag

SEQ ID NO: 2523135 - RNA, 19 nt, Chlamydophila pneumoniae CWL029
acacuuaaagguaaaacua

SEQ ID NO: 2523136 - RNA, 20 nt, Chlamydophila pneumoniae CWL029
acacuuccuacggcaagaau

SEQ ID NO: 2523137 - RNA, 17 nt, Chlamydophila pneumoniae CWL029
acacuugcuuaaggaaa

SEQ ID NO: 2523138 - RNA, 19 nt, Chlamydophila pneumoniae CWL029
acacuuucuuuaaagaaua

SEQ ID NO: 2523139 - RNA, 23 nt, Chlamydophila pneumoniae CWL029
acacuuuuaaagauaaggaccag

SEQ ID NO: 2523140 - RNA, 19 nt, Chlamydophila pneumoniae CWL029
acagaaaagaaugugcuuu

SEQ ID NO: 2523141 - RNA, 20 nt, Chlamydophila pneumoniae CWL029
acagaaagagcuaaagaaac

SEQ ID NO: 2523142 - RNA, 15 nt, Chlamydophila pneumoniae CWL029
acagaaagauugugc

SEQ ID NO: 2523143 - RNA, 20 nt, Chlamydophila pneumoniae CWL029
acagaaaggcuuuucuuuuu

SEQ ID NO: 2523144 - RNA, 13 nt, Chlamydophila pneumoniae CWL029
acagaaguacgca

SEQ ID NO: 2523145 - RNA, 17 nt, Chlamydophila pneumoniae CWL029
acagaaugauaagaaag

SEQ ID NO: 2523146 - RNA, 17 nt, Chlamydophila pneumoniae CWL029
acagacaagcaaggaaa

SEQ ID NO: 2523147 - RNA, 15 nt, Chlamydophila pneumoniae CWL029
acagaccaaaucauc

SEQ ID NO: 2523148 - RNA, 19 nt, Chlamydophila pneumoniae CWL029
acagaccguccuccccaua

SEQ ID NO: 2523149 - RNA, 16 nt, Chlamydophila pneumoniae CWL029
acagacugaagucguu

SEQ ID NO: 2523150 - RNA, 14 nt, Chlamydophila pneumoniae CWL029
acagacuugaggaa

SEQ ID NO: 2523151 - RNA, 17 nt, Chlamydophila pneumoniae CWL029
acagagaccuucucuuc

SEQ ID NO: 2523152 - RNA, 21 nt, Chlamydophila pneumoniae CWL029
acagagcgucuauuagauuuc

SEQ ID NO: 2523153 - RNA, 18 nt, Chlamydophila pneumoniae CWL029
acagagucagaagcuauu

SEQ ID NO: 2523154 - RNA, 21 nt, Chlamydophila pneumoniae CWL029
acagaguucgcgaccugugau

SEQ ID NO: 2523155 - RNA, 16 nt, Chlamydophila pneumoniae CWL029
acagauaggaaccacu

SEQ ID NO: 2523156 - RNA, 21 nt, Chlamydophila pneumoniae CWL029
acagauaugcugaauuccucu

SEQ ID NO: 2523157 - RNA, 18 nt, Chlamydophila pneumoniae CWL029
acagaugcuucaaggcau

SEQ ID NO: 2523158 - RNA, 17 nt, Chlamydophila pneumoniae CWL029
acagauuucuucuucag

SEQ ID NO: 2523159 - RNA, 18 nt, Chlamydophila pneumoniae CWL029
acagauuucuucuucaga

SEQ ID NO: 2523160 - RNA, 12 nt, Chlamydophila pneumoniae CWL029
acagauuuuuca

SEQ ID NO: 2523161 - RNA, 13 nt, Chlamydophila pneumoniae CWL029
acagauuuuucaa

SEQ ID NO: 2523162 - RNA, 14 nt, Chlamydophila pneumoniae CWL029
acagcauaaaaauu

SEQ ID NO: 2523163 - RNA, 16 nt, Chlamydophila pneumoniae CWL029
acagcauaaaaauucu

SEQ ID NO: 2523164 - RNA, 22 nt, Chlamydophila pneumoniae CWL029
acagcaucaggauucucucugc

SEQ ID NO: 2523165 - RNA, 16 nt, Chlamydophila pneumoniae CWL029
acagcaucggcaacca

SEQ ID NO: 2523166 - RNA, 19 nt, Chlamydophila pneumoniae CWL029
acagcaucggcaaccaguu

SEQ ID NO: 2523167 - RNA, 21 nt, Chlamydophila pneumoniae CWL029
acagcauggacuccaagaaua

SEQ ID NO: 2523168 - RNA, 13 nt, Chlamydophila pneumoniae CWL029
acagccagcagaa

SEQ ID NO: 2523169 - RNA, 13 nt, Chlamydophila pneumoniae CWL029
acagccggagcuu

SEQ ID NO: 2523170 - RNA, 20 nt, Chlamydophila pneumoniae CWL029
acagccggagcuucuaagau

SEQ ID NO: 2523171 - RNA, 22 nt, Chlamydophila pneumoniae CWL029
acagcuaaucaauccaagaaua

SEQ ID NO: 2523172 - RNA, 20 nt, Chlamydophila pneumoniae CWL029
acagcuaaucauagccauca

SEQ ID NO: 2523173 - RNA, 18 nt, Chlamydophila pneumoniae CWL029
acagcuaucgagauaucg

SEQ ID NO: 2523174 - RNA, 17 nt, Chlamydophila pneumoniae CWL029
acagcuccauuuaaaug

SEQ ID NO: 2523175 - RNA, 20 nt, Chlamydophila pneumoniae CWL029
acagcugcuagagcagcugu

SEQ ID NO: 2523176 - RNA, 22 nt, Chlamydophila pneumoniae CWL029
acagcuucuucguaagcugcaa

SEQ ID NO: 2523177 - RNA, 16 nt, Chlamydophila pneumoniae CWL029
acagcuucuuuuccag

SEQ ID NO: 2523178 - RNA, 14 nt, Chlamydophila pneumoniae CWL029
acagcuuuaucuuc

SEQ ID NO: 2523179 - RNA, 12 nt, Chlamydophila pneumoniae CWL029
acaggaaagaau

SEQ ID NO: 2523180 - RNA, 17 nt, Chlamydophila pneumoniae CWL029
acaggagagagaaggcu

SEQ ID NO: 2523181 - RNA, 18 nt, Chlamydophila pneumoniae CWL029
acaggcaggccacuuccu

SEQ ID NO: 2523182 - RNA, 18 nt, Chlamydophila pneumoniae CWL029
acaggcuacauaguuuuu

SEQ ID NO: 2523183 - RNA, 17 nt, Chlamydophila pneumoniae CWL029
acaggcuccucugcuaa

SEQ ID NO: 2523184 - RNA, 23 nt, Chlamydophila pneumoniae CWL029
acaggcuccucugcuaagcacaa

SEQ ID NO: 2523185 - RNA, 22 nt, Chlamydophila pneumoniae CWL029
acagggccugagaccauaaaau

SEQ ID NO: 2523186 - RNA, 21 nt, Chlamydophila pneumoniae CWL029
acaggggaugugauguucugc

SEQ ID NO: 2523187 - RNA, 13 nt, Chlamydophila pneumoniae CWL029
acaguaauuauuu

SEQ ID NO: 2523188 - RNA, 23 nt, Chlamydophila pneumoniae CWL029
acaguagaggaauucuggaacau

SEQ ID NO: 2523189 - RNA, 18 nt, Chlamydophila pneumoniae CWL029
acaguauuccaucacagu

SEQ ID NO: 2523190 - RNA, 22 nt, Chlamydophila pneumoniae CWL029
acaguccucucccuuaaggaaa

SEQ ID NO: 2523191 - RNA, 23 nt, Chlamydophila pneumoniae CWL029
acaguccuuuaccaucgucucca

SEQ ID NO: 2523192 - RNA, 16 nt, Chlamydophila pneumoniae CWL029
acagugacacgcuuuc

SEQ ID NO: 2523193 - RNA, 22 nt, Chlamydophila pneumoniae CWL029
acagugauuuagaaaucucacu

SEQ ID NO: 2523194 - RNA, 21 nt, Chlamydophila pneumoniae CWL029
acaguugcgcgcccucuucua

SEQ ID NO: 2523195 - RNA, 15 nt, Chlamydophila pneumoniae CWL029
acaguuugagaaaga

SEQ ID NO: 2523196 - RNA, 16 nt, Chlamydophila pneumoniae CWL029
acaguuuguaaaaagc

SEQ ID NO: 2523197 - RNA, 19 nt, Chlamydophila pneumoniae CWL029
acaguuuguaaaaagccua

SEQ ID NO: 2523198 - RNA, 19 nt, Chlamydophila pneumoniae CWL029
acauaaagacccuucuuuc

SEQ ID NO: 2523199 - RNA, 13 nt, Chlamydophila pneumoniae CWL029
acauaaagaucuu

SEQ ID NO: 2523200 - RNA, 13 nt, Chlamydophila pneumoniae CWL029
acauaaaguuaua

SEQ ID NO: 2523201 - RNA, 19 nt, Chlamydophila pneumoniae CWL029
acauaaaucaacaucacaa

SEQ ID NO: 2523202 - RNA, 14 nt, Chlamydophila pneumoniae CWL029
acauaacaugagaa

SEQ ID NO: 2523203 - RNA, 19 nt, Chlamydophila pneumoniae CWL029
acauaaccucggucucgcu

SEQ ID NO: 2523204 - RNA, 18 nt, Chlamydophila pneumoniae CWL029
acauaacgggguugucuc

SEQ ID NO: 2523205 - RNA, 22 nt, Chlamydophila pneumoniae CWL029
acauaacgggguugucucuaca

SEQ ID NO: 2523206 - RNA, 22 nt, Chlamydophila pneumoniae CWL029
acauaagcacucuuaauuaaaa

SEQ ID NO: 2523207 - RNA, 22 nt, Chlamydophila pneumoniae CWL029
acauaauaagcaggaaaagcaa

SEQ ID NO: 2523208 - RNA, 12 nt, Chlamydophila pneumoniae CWL029
acauacaucaaa

SEQ ID NO: 2523209 - RNA, 14 nt, Chlamydophila pneumoniae CWL029
acauacaucaaaau

SEQ ID NO: 2523210 - RNA, 18 nt, Chlamydophila pneumoniae CWL029
acauacaucaaaaugcug

SEQ ID NO: 2523211 - RNA, 15 nt, Chlamydophila pneumoniae CWL029
acauacauucuauuc

SEQ ID NO: 2523212 - RNA, 16 nt, Chlamydophila pneumoniae CWL029
acauacauucuauucu

SEQ ID NO: 2523213 - RNA, 19 nt, Chlamydophila pneumoniae CWL029
acauacucgucaaauucau

SEQ ID NO: 2523214 - RNA, 24 nt, Chlamydophila pneumoniae CWL029
acauagagauucuacaaauuaccu

SEQ ID NO: 2523215 - RNA, 19 nt, Chlamydophila pneumoniae CWL029
acauagaggagauccuaag

SEQ ID NO: 2523216 - RNA, 20 nt, Chlamydophila pneumoniae CWL029
acauagguaaaaccagcaua

SEQ ID NO: 2523217 - RNA, 18 nt, Chlamydophila pneumoniae CWL029
acauaguuuaauaaaucu

SEQ ID NO: 2523218 - RNA, 18 nt, Chlamydophila pneumoniae CWL029
acauauacguggcuucca

SEQ ID NO: 2523219 - RNA, 22 nt, Chlamydophila pneumoniae CWL029
acauauacguggcuuccauaac

SEQ ID NO: 2523220 - RNA, 18 nt, Chlamydophila pneumoniae CWL029
acauauccaaugagagag

SEQ ID NO: 2523221 - RNA, 20 nt, Chlamydophila pneumoniae CWL029
acauaucgauaggauucgga

SEQ ID NO: 2523222 - RNA, 13 nt, Chlamydophila pneumoniae CWL029
acauauucuccuu

SEQ ID NO: 2523223 - RNA, 13 nt, Chlamydophila pneumoniae CWL029
acaucaaagaauu

SEQ ID NO: 2523224 - RNA, 19 nt, Chlamydophila pneumoniae CWL029
acaucaaagcaauuucucc

SEQ ID NO: 2523225 - RNA, 19 nt, Chlamydophila pneumoniae CWL029
acaucaaauaguucaucau

SEQ ID NO: 2523226 - RNA, 12 nt, Chlamydophila pneumoniae CWL029
acaucaagaauu

SEQ ID NO: 2523227 - RNA, 11 nt, Chlamydophila pneumoniae CWL029
acaucaaugau

SEQ ID NO: 2523228 - RNA, 13 nt, Chlamydophila pneumoniae CWL029
acaucaauuuuac

SEQ ID NO: 2523229 - RNA, 14 nt, Chlamydophila pneumoniae CWL029
acaucaccacugcu

SEQ ID NO: 2523230 - RNA, 22 nt, Chlamydophila pneumoniae CWL029
acaucacuuauauuuucuauuc

SEQ ID NO: 2523231 - RNA, 19 nt, Chlamydophila pneumoniae CWL029
acaucagacugaagagcaa

SEQ ID NO: 2523232 - RNA, 18 nt, Chlamydophila pneumoniae CWL029
acaucagcaacauaaagu

SEQ ID NO: 2523233 - RNA, 18 nt, Chlamydophila pneumoniae CWL029
acaucagcuguugcguuu

SEQ ID NO: 2523234 - RNA, 17 nt, Chlamydophila pneumoniae CWL029
acaucaugaaauacccg

SEQ ID NO: 2523235 - RNA, 19 nt, Chlamydophila pneumoniae CWL029
acaucaugauauugcguuu

SEQ ID NO: 2523236 - RNA, 15 nt, Chlamydophila pneumoniae CWL029
acaucauguagugcu

SEQ ID NO: 2523237 - RNA, 20 nt, Chlamydophila pneumoniae CWL029
acaucauuaucauaaauacg

SEQ ID NO: 2523238 - RNA, 12 nt, Chlamydophila pneumoniae CWL029
acauccauucuu

SEQ ID NO: 2523239 - RNA, 12 nt, Chlamydophila pneumoniae CWL029
acauccucacua

SEQ ID NO: 2523240 - RNA, 13 nt, Chlamydophila pneumoniae CWL029
acauccuucuuua

SEQ ID NO: 2523241 - RNA, 14 nt, Chlamydophila pneumoniae CWL029
acauccuuguagaa

SEQ ID NO: 2523242 - RNA, 17 nt, Chlamydophila pneumoniae CWL029
acauccuuguagaacuu

SEQ ID NO: 2523243 - RNA, 23 nt, Chlamydophila pneumoniae CWL029
acauccuuguagaacuucucaag

SEQ ID NO: 2523244 - RNA, 18 nt, Chlamydophila pneumoniae CWL029
acaucgaaaccacagcaa

SEQ ID NO: 2523245 - RNA, 13 nt, Chlamydophila pneumoniae CWL029
acaucguauauaa

SEQ ID NO: 2523246 - RNA, 17 nt, Chlamydophila pneumoniae CWL029
acaucucacagauacca

SEQ ID NO: 2523247 - RNA, 20 nt, Chlamydophila pneumoniae CWL029
acaucuccaagccaugcaau

SEQ ID NO: 2523248 - RNA, 10 nt, Chlamydophila pneumoniae CWL029
acaucuccag

SEQ ID NO: 2523249 - RNA, 16 nt, Chlamydophila pneumoniae CWL029
acaucuccugcagguu

SEQ ID NO: 2523250 - RNA, 19 nt, Chlamydophila pneumoniae CWL029
acaucuguaguaggcacuu

SEQ ID NO: 2523251 - RNA, 15 nt, Chlamydophila pneumoniae CWL029
acaucuguauauucu

SEQ ID NO: 2523252 - RNA, 13 nt, Chlamydophila pneumoniae CWL029
acaucuuaaaaac

SEQ ID NO: 2523253 - RNA, 15 nt, Chlamydophila pneumoniae CWL029
acaucuuaaaaacua

SEQ ID NO: 2523254 - RNA, 15 nt, Chlamydophila pneumoniae CWL029
acaucuugagcuuca

SEQ ID NO: 2523255 - RNA, 18 nt, Chlamydophila pneumoniae CWL029
acaucuugagcuucaaaa

SEQ ID NO: 2523256 - RNA, 14 nt, Chlamydophila pneumoniae CWL029
acaugacaaauaaa

SEQ ID NO: 2523257 - RNA, 19 nt, Chlamydophila pneumoniae CWL029
acaugacaaauaaacugac

SEQ ID NO: 2523258 - RNA, 13 nt, Chlamydophila pneumoniae CWL029
acaugagaaauac

SEQ ID NO: 2523259 - RNA, 12 nt, Chlamydophila pneumoniae CWL029
acaugaggauac

SEQ ID NO: 2523260 - RNA, 16 nt, Chlamydophila pneumoniae CWL029
acaugaggauacacuu

SEQ ID NO: 2523261 - RNA, 20 nt, Chlamydophila pneumoniae CWL029
acaugaggcacauguaggau

SEQ ID NO: 2523262 - RNA, 22 nt, Chlamydophila pneumoniae CWL029
acaugagggcaugccuaucuau

SEQ ID NO: 2523263 - RNA, 14 nt, Chlamydophila pneumoniae CWL029
acaugccaaaaguu

SEQ ID NO: 2523264 - RNA, 17 nt, Chlamydophila pneumoniae CWL029
acaugccuaaauagcuc

SEQ ID NO: 2523265 - RNA, 14 nt, Chlamydophila pneumoniae CWL029
acaugcuuuccuuc

SEQ ID NO: 2523266 - RNA, 14 nt, Chlamydophila pneumoniae CWL029
acauggccaaaaau

SEQ ID NO: 2523267 - RNA, 19 nt, Chlamydophila pneumoniae CWL029
acauggccaaaaaucuuau

SEQ ID NO: 2523268 - RNA, 13 nt, Chlamydophila pneumoniae CWL029
acauguaaacaaa

SEQ ID NO: 2523269 - RNA, 20 nt, Chlamydophila pneumoniae CWL029
acauguaaacaaaagcagac

SEQ ID NO: 2523270 - RNA, 13 nt, Chlamydophila pneumoniae CWL029
acauguuucacuu

SEQ ID NO: 2523271 - RNA, 13 nt, Chlamydophila pneumoniae CWL029
acauuaagaggaa

SEQ ID NO: 2523272 - RNA, 22 nt, Chlamydophila pneumoniae CWL029
acauuagcgacgacgacgccua

SEQ ID NO: 2523273 - RNA, 19 nt, Chlamydophila pneumoniae CWL029
acauucacccucauuaaga

SEQ ID NO: 2523274 - RNA, 14 nt, Chlamydophila pneumoniae CWL029
acauucauuuuuua

SEQ ID NO: 2523275 - RNA, 21 nt, Chlamydophila pneumoniae CWL029
acauucauuuuuuaauaaaau

SEQ ID NO: 2523276 - RNA, 23 nt, Chlamydophila pneumoniae CWL029
acauucauuuuuuaauaaaauuu

SEQ ID NO: 2523277 - RNA, 22 nt, Chlamydophila pneumoniae CWL029
acauuccaagaaaaauucuucg

SEQ ID NO: 2523278 - RNA, 18 nt, Chlamydophila pneumoniae CWL029
acauuccuuaauuacucg

SEQ ID NO: 2523279 - RNA, 16 nt, Chlamydophila pneumoniae CWL029
acauucgcaagaauga

SEQ ID NO: 2523280 - RNA, 15 nt, Chlamydophila pneumoniae CWL029
acauucuuaauaucu

SEQ ID NO: 2523281 - RNA, 17 nt, Chlamydophila pneumoniae CWL029
acauucuuaauaucuac

SEQ ID NO: 2523282 - RNA, 13 nt, Chlamydophila pneumoniae CWL029
acauucuucugau

SEQ ID NO: 2523283 - RNA, 17 nt, Chlamydophila pneumoniae CWL029
acauucuucugucugua

SEQ ID NO: 2523284 - RNA, 21 nt, Chlamydophila pneumoniae CWL029
acauucuucugucuguauuuc

SEQ ID NO: 2523285 - RNA, 18 nt, Chlamydophila pneumoniae CWL029
acauugaccuaaaggaau

SEQ ID NO: 2523286 - RNA, 20 nt, Chlamydophila pneumoniae CWL029
acauugaguugguuuuguaa

SEQ ID NO: 2523287 - RNA, 18 nt, Chlamydophila pneumoniae CWL029
acauugcgggcucaaaga

SEQ ID NO: 2523288 - RNA, 21 nt, Chlamydophila pneumoniae CWL029
acauugcugccaggcuuaaau

SEQ ID NO: 2523289 - RNA, 23 nt, Chlamydophila pneumoniae CWL029
acauugcugccaggcuuaaauau

SEQ ID NO: 2523290 - RNA, 23 nt, Chlamydophila pneumoniae CWL029
acauuguuuaaguccuucuuccc

SEQ ID NO: 2523291 - RNA, 20 nt, Chlamydophila pneumoniae CWL029
acauuuaagucauuagcaag

SEQ ID NO: 2523292 - RNA, 15 nt, Chlamydophila pneumoniae CWL029
acauuuagauaaaga

SEQ ID NO: 2523293 - RNA, 16 nt, Chlamydophila pneumoniae CWL029
acauuuccccaugaaa

SEQ ID NO: 2523294 - RNA, 22 nt, Chlamydophila pneumoniae CWL029
acauuuccccaugaaaauacaa

SEQ ID NO: 2523295 - RNA, 15 nt, Chlamydophila pneumoniae CWL029
acauuucguuuuuuc

SEQ ID NO: 2523296 - RNA, 18 nt, Chlamydophila pneumoniae CWL029
acauuugcagacacaaaa

SEQ ID NO: 2523297 - RNA, 18 nt, Chlamydophila pneumoniae CWL029
acauuugcuauuuucccu

SEQ ID NO: 2523298 - RNA, 20 nt, Chlamydophila pneumoniae CWL029
acauuuugccuuuagggaaa

SEQ ID NO: 2523299 - RNA, 14 nt, Chlamydophila pneumoniae CWL029
acauuuugguaucu

SEQ ID NO: 2523300 - RNA, 19 nt, Chlamydophila pneumoniae CWL029
acauuuuuauuuccuuauc

SEQ ID NO: 2523301 - RNA, 19 nt, Chlamydophila pneumoniae CWL029
acauuuuucaauaaccaga

SEQ ID NO: 2523302 - RNA, 16 nt, Chlamydophila pneumoniae CWL029
acauuuuucuauaaua

SEQ ID NO: 2523303 - RNA, 22 nt, Chlamydophila pneumoniae CWL029
accaaaaaaguaacuaucuaca

SEQ ID NO: 2523304 - RNA, 22 nt, Chlamydophila pneumoniae CWL029
accaaaaauuccguuaagaugu

SEQ ID NO: 2523305 - RNA, 19 nt, Chlamydophila pneumoniae CWL029
accaaaagaauuccuaaaa

SEQ ID NO: 2523306 - RNA, 18 nt, Chlamydophila pneumoniae CWL029
accaaaauuauguauaaa

SEQ ID NO: 2523307 - RNA, 21 nt, Chlamydophila pneumoniae CWL029
accaaacuuucuuuucuauau

SEQ ID NO: 2523308 - RNA, 22 nt, Chlamydophila pneumoniae CWL029
accaaacuuucuuuucuauauu

SEQ ID NO: 2523309 - RNA, 18 nt, Chlamydophila pneumoniae CWL029
accaaauaauuaaauaua

SEQ ID NO: 2523310 - RNA, 19 nt, Chlamydophila pneumoniae CWL029
accaaauagagaguaguga

SEQ ID NO: 2523311 - RNA, 15 nt, Chlamydophila pneumoniae CWL029
accaacaucaaagaa

SEQ ID NO: 2523312 - RNA, 16 nt, Chlamydophila pneumoniae CWL029
accaacaucaaagaau

SEQ ID NO: 2523313 - RNA, 16 nt, Chlamydophila pneumoniae CWL029
accaaccaguuucuug

SEQ ID NO: 2523314 - RNA, 13 nt, Chlamydophila pneumoniae CWL029
accaacuccucaa

SEQ ID NO: 2523315 - RNA, 18 nt, Chlamydophila pneumoniae CWL029
accaacuccucaaaagau

SEQ ID NO: 2523316 - RNA, 19 nt, Chlamydophila pneumoniae CWL029
accaacuccucaaaagaua

SEQ ID NO: 2523317 - RNA, 22 nt, Chlamydophila pneumoniae CWL029
accaacuccucaaaagauaucg

SEQ ID NO: 2523318 - RNA, 12 nt, Chlamydophila pneumoniae CWL029
accaacugagcu

SEQ ID NO: 2523319 - RNA, 12 nt, Chlamydophila pneumoniae CWL029
accaacuuccua

SEQ ID NO: 2523320 - RNA, 16 nt, Chlamydophila pneumoniae CWL029
accaagaaaucucagu

SEQ ID NO: 2523321 - RNA, 15 nt, Chlamydophila pneumoniae CWL029
accaagaugucucca

SEQ ID NO: 2523322 - RNA, 19 nt, Chlamydophila pneumoniae CWL029
accaagaugucuccaaaga

SEQ ID NO: 2523323 - RNA, 15 nt, Chlamydophila pneumoniae CWL029
accaaguuauuauau

SEQ ID NO: 2523324 - RNA, 22 nt, Chlamydophila pneumoniae CWL029
accaaguuauuauauauaagau

SEQ ID NO: 2523325 - RNA, 23 nt, Chlamydophila pneumoniae CWL029
accaauaaccgaaacuucucaga

SEQ ID NO: 2523326 - RNA, 15 nt, Chlamydophila pneumoniae CWL029
accaauaugcucugc

SEQ ID NO: 2523327 - RNA, 20 nt, Chlamydophila pneumoniae CWL029
accaauccggcauaaaaaag

SEQ ID NO: 2523328 - RNA, 18 nt, Chlamydophila pneumoniae CWL029
accaauucucucucugca

SEQ ID NO: 2523329 - RNA, 16 nt, Chlamydophila pneumoniae CWL029
accaauugcagucacu

SEQ ID NO: 2523330 - RNA, 24 nt, Chlamydophila pneumoniae CWL029
accacaauuccuaaaacaagaaga

SEQ ID NO: 2523331 - RNA, 19 nt, Chlamydophila pneumoniae CWL029
accacagaaugauaagaaa

SEQ ID NO: 2523332 - RNA, 21 nt, Chlamydophila pneumoniae CWL029
accacagcuguacagaacaau

SEQ ID NO: 2523333 - RNA, 18 nt, Chlamydophila pneumoniae CWL029
accacagugauuuagaaa

SEQ ID NO: 2523334 - RNA, 23 nt, Chlamydophila pneumoniae CWL029
accacagugauuuagaaaucuca

SEQ ID NO: 2523335 - RNA, 14 nt, Chlamydophila pneumoniae CWL029
accaccuuccccaa

SEQ ID NO: 2523336 - RNA, 15 nt, Chlamydophila pneumoniae CWL029
accacgaaauguuaa

SEQ ID NO: 2523337 - RNA, 15 nt, Chlamydophila pneumoniae CWL029
accacguccauuuca

SEQ ID NO: 2523338 - RNA, 17 nt, Chlamydophila pneumoniae CWL029
accacuaccgaauuuuc

SEQ ID NO: 2523339 - RNA, 20 nt, Chlamydophila pneumoniae CWL029
accacuaccgaauuuucaau

SEQ ID NO: 2523340 - RNA, 21 nt, Chlamydophila pneumoniae CWL029
accacuacugagcuucuauuu

SEQ ID NO: 2523341 - RNA, 15 nt, Chlamydophila pneumoniae CWL029
accacuauacccucu

SEQ ID NO: 2523342 - RNA, 22 nt, Chlamydophila pneumoniae CWL029
accacuguccaugcacgagauu

SEQ ID NO: 2523343 - RNA, 17 nt, Chlamydophila pneumoniae CWL029
accacuucauauaaaac

SEQ ID NO: 2523344 - RNA, 20 nt, Chlamydophila pneumoniae CWL029
accacuuuagaauuuucuuu

SEQ ID NO: 2523345 - RNA, 12 nt, Chlamydophila pneumoniae CWL029
accagaagacuc

SEQ ID NO: 2523346 - RNA, 13 nt, Chlamydophila pneumoniae CWL029
accagaagcaacu

SEQ ID NO: 2523347 - RNA, 16 nt, Chlamydophila pneumoniae CWL029
accagauaaagcaaag

SEQ ID NO: 2523348 - RNA, 15 nt, Chlamydophila pneumoniae CWL029
accagaugauuuuuu

SEQ ID NO: 2523349 - RNA, 18 nt, Chlamydophila pneumoniae CWL029
accagaugauuuuuugaa

SEQ ID NO: 2523350 - RNA, 15 nt, Chlamydophila pneumoniae CWL029
accagcauuaagaua

SEQ ID NO: 2523351 - RNA, 16 nt, Chlamydophila pneumoniae CWL029
accaggagcuccuccu

SEQ ID NO: 2523352 - RNA, 19 nt, Chlamydophila pneumoniae CWL029
accaggagcuccuccuuga

SEQ ID NO: 2523353 - RNA, 20 nt, Chlamydophila pneumoniae CWL029
accagguagagugucuuccu

SEQ ID NO: 2523354 - RNA, 12 nt, Chlamydophila pneumoniae CWL029
accauaaaacaa

SEQ ID NO: 2523355 - RNA, 17 nt, Chlamydophila pneumoniae CWL029
accauaaggagauuccu

SEQ ID NO: 2523356 - RNA, 19 nt, Chlamydophila pneumoniae CWL029
accauacacaaaucauuua

SEQ ID NO: 2523357 - RNA, 16 nt, Chlamydophila pneumoniae CWL029
accauauucucaggaa

SEQ ID NO: 2523358 - RNA, 18 nt, Chlamydophila pneumoniae CWL029
accaucaagguauuggaa

SEQ ID NO: 2523359 - RNA, 20 nt, Chlamydophila pneumoniae CWL029
accaucaagguauuggaauc

SEQ ID NO: 2523360 - RNA, 13 nt, Chlamydophila pneumoniae CWL029
accaucaccuucg

SEQ ID NO: 2523361 - RNA, 16 nt, Chlamydophila pneumoniae CWL029
accauccgacuuuccu

SEQ ID NO: 2523362 - RNA, 16 nt, Chlamydophila pneumoniae CWL029
accauccuguagcuuu

SEQ ID NO: 2523363 - RNA, 19 nt, Chlamydophila pneumoniae CWL029
accaucgucuccaaaaauu

SEQ ID NO: 2523364 - RNA, 22 nt, Chlamydophila pneumoniae CWL029
accaucgucuccaaaaauuccc

SEQ ID NO: 2523365 - RNA, 16 nt, Chlamydophila pneumoniae CWL029
accaucuguugaucuu

SEQ ID NO: 2523366 - RNA, 19 nt, Chlamydophila pneumoniae CWL029
accaugaagguagccgagg

SEQ ID NO: 2523367 - RNA, 14 nt, Chlamydophila pneumoniae CWL029
accauucuugaaga

SEQ ID NO: 2523368 - RNA, 17 nt, Chlamydophila pneumoniae CWL029
accauucuugaagaucu

SEQ ID NO: 2523369 - RNA, 16 nt, Chlamydophila pneumoniae CWL029
accauugcucuaaguu

SEQ ID NO: 2523370 - RNA, 23 nt, Chlamydophila pneumoniae CWL029
accauuuaccccaggaaucacug

SEQ ID NO: 2523371 - RNA, 19 nt, Chlamydophila pneumoniae CWL029
acccaaacugaugccaaga

SEQ ID NO: 2523372 - RNA, 16 nt, Chlamydophila pneumoniae CWL029
acccaaagaggggagc

SEQ ID NO: 2523373 - RNA, 14 nt, Chlamydophila pneumoniae CWL029
acccaacaguucuu

SEQ ID NO: 2523374 - RNA, 13 nt, Chlamydophila pneumoniae CWL029
acccaagagaccc

SEQ ID NO: 2523375 - RNA, 14 nt, Chlamydophila pneumoniae CWL029
acccaagagaccca

SEQ ID NO: 2523376 - RNA, 16 nt, Chlamydophila pneumoniae CWL029
acccacgcaugccucu

SEQ ID NO: 2523377 - RNA, 20 nt, Chlamydophila pneumoniae CWL029
acccacgcaugccucuuggu

SEQ ID NO: 2523378 - RNA, 13 nt, Chlamydophila pneumoniae CWL029
acccacuccagaa

SEQ ID NO: 2523379 - RNA, 11 nt, Chlamydophila pneumoniae CWL029
acccagcugcg

SEQ ID NO: 2523380 - RNA, 18 nt, Chlamydophila pneumoniae CWL029
acccauaaugguacaaua

SEQ ID NO: 2523381 - RNA, 20 nt, Chlamydophila pneumoniae CWL029
accccaaucaguucaucuag

SEQ ID NO: 2523382 - RNA, 13 nt, Chlamydophila pneumoniae CWL029
accccacaaucac

SEQ ID NO: 2523383 - RNA, 22 nt, Chlamydophila pneumoniae CWL029
accccacgcuaaacuaaaaugg

SEQ ID NO: 2523384 - RNA, 17 nt, Chlamydophila pneumoniae CWL029
accccaucagcaaugau

SEQ ID NO: 2523385 - RNA, 19 nt, Chlamydophila pneumoniae CWL029
acccccuggcugggcuaca

SEQ ID NO: 2523386 - RNA, 13 nt, Chlamydophila pneumoniae CWL029
accccuagaacuu

SEQ ID NO: 2523387 - RNA, 21 nt, Chlamydophila pneumoniae CWL029
acccucaaagaauacucuaag

SEQ ID NO: 2523388 - RNA, 16 nt, Chlamydophila pneumoniae CWL029
acccucaucauccuca

SEQ ID NO: 2523389 - RNA, 15 nt, Chlamydophila pneumoniae CWL029
acccucgaaccacug

SEQ ID NO: 2523390 - RNA, 16 nt, Chlamydophila pneumoniae CWL029
acccucggagacucag

SEQ ID NO: 2523391 - RNA, 21 nt, Chlamydophila pneumoniae CWL029
acccucggagacucagagaaa

SEQ ID NO: 2523392 - RNA, 18 nt, Chlamydophila pneumoniae CWL029
acccugggcucacucuaa

SEQ ID NO: 2523393 - RNA, 21 nt, Chlamydophila pneumoniae CWL029
acccuuuauacuguuuuucuu

SEQ ID NO: 2523394 - RNA, 19 nt, Chlamydophila pneumoniae CWL029
accgaaaaaccuucuccaa

SEQ ID NO: 2523395 - RNA, 13 nt, Chlamydophila pneumoniae CWL029
accgaaagucccg

SEQ ID NO: 2523396 - RNA, 20 nt, Chlamydophila pneumoniae CWL029
accgaaucucuccagcuuga

SEQ ID NO: 2523397 - RNA, 12 nt, Chlamydophila pneumoniae CWL029
accgacaagcau

SEQ ID NO: 2523398 - RNA, 13 nt, Chlamydophila pneumoniae CWL029
accgagacuauuu

SEQ ID NO: 2523399 - RNA, 21 nt, Chlamydophila pneumoniae CWL029
accgcaaaaagcuucuuucuu

SEQ ID NO: 2523400 - RNA, 16 nt, Chlamydophila pneumoniae CWL029
accguaaagaaaagca

SEQ ID NO: 2523401 - RNA, 17 nt, Chlamydophila pneumoniae CWL029
accguaaagaaaagcaa

SEQ ID NO: 2523402 - RNA, 21 nt, Chlamydophila pneumoniae CWL029
accguaacugaggcaaagauu

SEQ ID NO: 2523403 - RNA, 17 nt, Chlamydophila pneumoniae CWL029
accuaccugcuaccugu

SEQ ID NO: 2523404 - RNA, 18 nt, Chlamydophila pneumoniae CWL029
accuacugggaaaucuaa

SEQ ID NO: 2523405 - RNA, 13 nt, Chlamydophila pneumoniae CWL029
accuacuuauugu

SEQ ID NO: 2523406 - RNA, 15 nt, Chlamydophila pneumoniae CWL029
accuagaaucacaua

SEQ ID NO: 2523407 - RNA, 17 nt, Chlamydophila pneumoniae CWL029
accuaggagaaaucaca

SEQ ID NO: 2523408 - RNA, 21 nt, Chlamydophila pneumoniae CWL029
accuaggagaaaucacacuua

SEQ ID NO: 2523409 - RNA, 16 nt, Chlamydophila pneumoniae CWL029
accuagggucuucucg

SEQ ID NO: 2523410 - RNA, 14 nt, Chlamydophila pneumoniae CWL029
accuauauuuuuua

SEQ ID NO: 2523411 - RNA, 20 nt, Chlamydophila pneumoniae CWL029
accuaugacggauccuagaa

SEQ ID NO: 2523412 - RNA, 15 nt, Chlamydophila pneumoniae CWL029
accucaaagccaucu

SEQ ID NO: 2523413 - RNA, 19 nt, Chlamydophila pneumoniae CWL029
accucaagaugcauucuga

SEQ ID NO: 2523414 - RNA, 17 nt, Chlamydophila pneumoniae CWL029
accucaauaaaucuauu

SEQ ID NO: 2523415 - RNA, 12 nt, Chlamydophila pneumoniae CWL029
accucaucagaa

SEQ ID NO: 2523416 - RNA, 23 nt, Chlamydophila pneumoniae CWL029
accucaucagaaguggccuugcc

SEQ ID NO: 2523417 - RNA, 17 nt, Chlamydophila pneumoniae CWL029
accucaucucuggaaua

SEQ ID NO: 2523418 - RNA, 19 nt, Chlamydophila pneumoniae CWL029
accucauggagguucucaa

SEQ ID NO: 2523419 - RNA, 22 nt, Chlamydophila pneumoniae CWL029
accuccaccaggagcuccuccu

SEQ ID NO: 2523420 - RNA, 13 nt, Chlamydophila pneumoniae CWL029
accuccgcccccu

SEQ ID NO: 2523421 - RNA, 23 nt, Chlamydophila pneumoniae CWL029
accuccuagaagcgcuuuauguu

SEQ ID NO: 2523422 - RNA, 14 nt, Chlamydophila pneumoniae CWL029
accucgccucuugu

SEQ ID NO: 2523423 - RNA, 12 nt, Chlamydophila pneumoniae CWL029
accucuaauuug

SEQ ID NO: 2523424 - RNA, 18 nt, Chlamydophila pneumoniae CWL029
accucucaucaaagcaaa

SEQ ID NO: 2523425 - RNA, 14 nt, Chlamydophila pneumoniae CWL029
accucugcauguug

SEQ ID NO: 2523426 - RNA, 19 nt, Chlamydophila pneumoniae CWL029
accucugcauguugcaaag

SEQ ID NO: 2523427 - RNA, 12 nt, Chlamydophila pneumoniae CWL029
accucuuuucuu

SEQ ID NO: 2523428 - RNA, 13 nt, Chlamydophila pneumoniae CWL029
accucuuuucuua

SEQ ID NO: 2523429 - RNA, 23 nt, Chlamydophila pneumoniae CWL029
accucuuuucuuaucaugaaaag

SEQ ID NO: 2523430 - RNA, 16 nt, Chlamydophila pneumoniae CWL029
accugagaguguuguu

SEQ ID NO: 2523431 - RNA, 10 nt, Chlamydophila pneumoniae CWL029
accugggcaa

SEQ ID NO: 2523432 - RNA, 16 nt, Chlamydophila pneumoniae CWL029
accugggggacuucaa

SEQ ID NO: 2523433 - RNA, 21 nt, Chlamydophila pneumoniae CWL029
accugggggacuucaaaugaa

SEQ ID NO: 2523434 - RNA, 14 nt, Chlamydophila pneumoniae CWL029
accuguaaagacca

SEQ ID NO: 2523435 - RNA, 23 nt, Chlamydophila pneumoniae CWL029
accuguagcuacagauucuugua

SEQ ID NO: 2523436 - RNA, 17 nt, Chlamydophila pneumoniae CWL029
accugugaaaauuuucu

SEQ ID NO: 2523437 - RNA, 17 nt, Chlamydophila pneumoniae CWL029
accuguguaaugagcug

SEQ ID NO: 2523438 - RNA, 19 nt, Chlamydophila pneumoniae CWL029
accuguguaaugagcugga

SEQ ID NO: 2523439 - RNA, 14 nt, Chlamydophila pneumoniae CWL029
accugugugcuuua

SEQ ID NO: 2523440 - RNA, 13 nt, Chlamydophila pneumoniae CWL029
accuguuuucuuu

SEQ ID NO: 2523441 - RNA, 13 nt, Chlamydophila pneumoniae CWL029
accuucacaagaa

SEQ ID NO: 2523442 - RNA, 17 nt, Chlamydophila pneumoniae CWL029
accuuccccaagcucuc

SEQ ID NO: 2523443 - RNA, 14 nt, Chlamydophila pneumoniae CWL029
accuuccuuaucuu

SEQ ID NO: 2523444 - RNA, 18 nt, Chlamydophila pneumoniae CWL029
accuucgauuccaggcuc

SEQ ID NO: 2523445 - RNA, 21 nt, Chlamydophila pneumoniae CWL029
accuugagacaaagaaucccc

SEQ ID NO: 2523446 - RNA, 12 nt, Chlamydophila pneumoniae CWL029
accuuuaggaac

SEQ ID NO: 2523447 - RNA, 17 nt, Chlamydophila pneumoniae CWL029
accuuuaggaagcugua

SEQ ID NO: 2523448 - RNA, 23 nt, Chlamydophila pneumoniae CWL029
accuuuaggaagcuguacuugau

SEQ ID NO: 2523449 - RNA, 15 nt, Chlamydophila pneumoniae CWL029
accuuuccuaaaaua

SEQ ID NO: 2523450 - RNA, 15 nt, Chlamydophila pneumoniae CWL029
accuuuggauucaga

SEQ ID NO: 2523451 - RNA, 22 nt, Chlamydophila pneumoniae CWL029
accuuugguagaaagacaaaaa

SEQ ID NO: 2523452 - RNA, 18 nt, Chlamydophila pneumoniae CWL029
accuuuuucauugaugcu

SEQ ID NO: 2523453 - RNA, 16 nt, Chlamydophila pneumoniae CWL029
accuuuuuuuaaaaau

SEQ ID NO: 2523454 - RNA, 12 nt, Chlamydophila pneumoniae CWL029
acgaaaaggaga

SEQ ID NO: 2523455 - RNA, 18 nt, Chlamydophila pneumoniae CWL029
acgaaaaggagaauacaa

SEQ ID NO: 2523456 - RNA, 23 nt, Chlamydophila pneumoniae CWL029
acgaaaaucuacacgcuauagca

SEQ ID NO: 2523457 - RNA, 15 nt, Chlamydophila pneumoniae CWL029
acgaaagcagugugc

SEQ ID NO: 2523458 - RNA, 17 nt, Chlamydophila pneumoniae CWL029
acgaacaagacgaaagc

SEQ ID NO: 2523459 - RNA, 20 nt, Chlamydophila pneumoniae CWL029
acgaacaugccugaaaacaa

SEQ ID NO: 2523460 - RNA, 19 nt, Chlamydophila pneumoniae CWL029
acgaagaaaacgcaccuua

SEQ ID NO: 2523461 - RNA, 19 nt, Chlamydophila pneumoniae CWL029
acgaaguuagcuaacucgg

SEQ ID NO: 2523462 - RNA, 21 nt, Chlamydophila pneumoniae CWL029
acgaauacuguucgauaagaa

SEQ ID NO: 2523463 - RNA, 16 nt, Chlamydophila pneumoniae CWL029
acgaauccaaaaaaga

SEQ ID NO: 2523464 - RNA, 16 nt, Chlamydophila pneumoniae CWL029
acgaaucguuucucug

SEQ ID NO: 2523465 - RNA, 19 nt, Chlamydophila pneumoniae CWL029
acgaauuucaacagcuuca

SEQ ID NO: 2523466 - RNA, 20 nt, Chlamydophila pneumoniae CWL029
acgaauuucacacagcggua

SEQ ID NO: 2523467 - RNA, 13 nt, Chlamydophila pneumoniae CWL029
acgacaaaucacg

SEQ ID NO: 2523468 - RNA, 14 nt, Chlamydophila pneumoniae CWL029
acgacaaggacagg

SEQ ID NO: 2523469 - RNA, 13 nt, Chlamydophila pneumoniae CWL029
acgacauugaaga

SEQ ID NO: 2523470 - RNA, 14 nt, Chlamydophila pneumoniae CWL029
acgaccaacuccuc

SEQ ID NO: 2523471 - RNA, 13 nt, Chlamydophila pneumoniae CWL029
acgaccuauacca

SEQ ID NO: 2523472 - RNA, 11 nt, Chlamydophila pneumoniae CWL029
acgacgaggac

SEQ ID NO: 2523473 - RNA, 16 nt, Chlamydophila pneumoniae CWL029
acgacgucaucaccau

SEQ ID NO: 2523474 - RNA, 23 nt, Chlamydophila pneumoniae CWL029
acgacgucuucuuagaagagaaa

SEQ ID NO: 2523475 - RNA, 20 nt, Chlamydophila pneumoniae CWL029
acgacguuuaauuccuugga

SEQ ID NO: 2523476 - RNA, 21 nt, Chlamydophila pneumoniae CWL029
acgagaacaugaccuuuagga

SEQ ID NO: 2523477 - RNA, 19 nt, Chlamydophila pneumoniae CWL029
acgagaaguuugauaagcu

SEQ ID NO: 2523478 - RNA, 23 nt, Chlamydophila pneumoniae CWL029
acgagcaugcuaagcaucagaau

SEQ ID NO: 2523479 - RNA, 14 nt, Chlamydophila pneumoniae CWL029
acgagcgcuuucuu

SEQ ID NO: 2523480 - RNA, 13 nt, Chlamydophila pneumoniae CWL029
acgagcuguccag

SEQ ID NO: 2523481 - RNA, 15 nt, Chlamydophila pneumoniae CWL029
acgagucccuucuuu

SEQ ID NO: 2523482 - RNA, 23 nt, Chlamydophila pneumoniae CWL029
acgaguucucccgugaacaaaaa

SEQ ID NO: 2523483 - RNA, 17 nt, Chlamydophila pneumoniae CWL029
acgauaguacuuauccu

SEQ ID NO: 2523484 - RNA, 18 nt, Chlamydophila pneumoniae CWL029
acgauauuuagagagaaa

SEQ ID NO: 2523485 - RNA, 19 nt, Chlamydophila pneumoniae CWL029
acgaucaaauuccuucuca

SEQ ID NO: 2523486 - RNA, 22 nt, Chlamydophila pneumoniae CWL029
acgaucaaauuccuucucagaa

SEQ ID NO: 2523487 - RNA, 21 nt, Chlamydophila pneumoniae CWL029
acgaucacauuccaagaaaaa

SEQ ID NO: 2523488 - RNA, 14 nt, Chlamydophila pneumoniae CWL029
acgauccaucucau

SEQ ID NO: 2523489 - RNA, 16 nt, Chlamydophila pneumoniae CWL029
acgaucgcgauaagaa

SEQ ID NO: 2523490 - RNA, 17 nt, Chlamydophila pneumoniae CWL029
acgaucgcgauaagaag

SEQ ID NO: 2523491 - RNA, 21 nt, Chlamydophila pneumoniae CWL029
acgaucgucaguaaaacacaa

SEQ ID NO: 2523492 - RNA, 22 nt, Chlamydophila pneumoniae CWL029
acgaucuacguuggacugcaag

SEQ ID NO: 2523493 - RNA, 15 nt, Chlamydophila pneumoniae CWL029
acgcaacaucucaca

SEQ ID NO: 2523494 - RNA, 15 nt, Chlamydophila pneumoniae CWL029
acgcaaguaaagaaa

SEQ ID NO: 2523495 - RNA, 16 nt, Chlamydophila pneumoniae CWL029
acgcaaguaaagaaau

SEQ ID NO: 2523496 - RNA, 15 nt, Chlamydophila pneumoniae CWL029
acgcacauuuagaag

SEQ ID NO: 2523497 - RNA, 22 nt, Chlamydophila pneumoniae CWL029
acgcaguaucguaacuuccuuu

SEQ ID NO: 2523498 - RNA, 21 nt, Chlamydophila pneumoniae CWL029
acgcauaagagacauuucuug

SEQ ID NO: 2523499 - RNA, 14 nt, Chlamydophila pneumoniae CWL029
acgcauaggccaau

SEQ ID NO: 2523500 - RNA, 15 nt, Chlamydophila pneumoniae CWL029
acgcaugacgcuuuu

SEQ ID NO: 2523501 - RNA, 16 nt, Chlamydophila pneumoniae CWL029
acgccauacugauaua

SEQ ID NO: 2523502 - RNA, 18 nt, Chlamydophila pneumoniae CWL029
acgcccacggaaagcaca

SEQ ID NO: 2523503 - RNA, 13 nt, Chlamydophila pneumoniae CWL029
acgcccaugucuu

SEQ ID NO: 2523504 - RNA, 13 nt, Chlamydophila pneumoniae CWL029
acgccuucaaguc

SEQ ID NO: 2523505 - RNA, 19 nt, Chlamydophila pneumoniae CWL029
acgccuucaagucgagaaa

SEQ ID NO: 2523506 - RNA, 19 nt, Chlamydophila pneumoniae CWL029
acgcuacgguacuuuacaa

SEQ ID NO: 2523507 - RNA, 14 nt, Chlamydophila pneumoniae CWL029
acgcuauccuauug

SEQ ID NO: 2523508 - RNA, 17 nt, Chlamydophila pneumoniae CWL029
acgcuccucuaacuuca

SEQ ID NO: 2523509 - RNA, 21 nt, Chlamydophila pneumoniae CWL029
acgcucuaaacucucuuccuu

SEQ ID NO: 2523510 - RNA, 17 nt, Chlamydophila pneumoniae CWL029
acgcucuccauggcuuc

SEQ ID NO: 2523511 - RNA, 16 nt, Chlamydophila pneumoniae CWL029
acgcuguugaaaugca

SEQ ID NO: 2523512 - RNA, 22 nt, Chlamydophila pneumoniae CWL029
acgcuugugguuagaggaagca

SEQ ID NO: 2523513 - RNA, 17 nt, Chlamydophila pneumoniae CWL029
acgcuuucgucuaaaau

SEQ ID NO: 2523514 - RNA, 18 nt, Chlamydophila pneumoniae CWL029
acgcuuucgucuaaaaua

SEQ ID NO: 2523515 - RNA, 16 nt, Chlamydophila pneumoniae CWL029
acgcuuuucuucuuua

SEQ ID NO: 2523516 - RNA, 13 nt, Chlamydophila pneumoniae CWL029
acgcuuuuucuug

SEQ ID NO: 2523517 - RNA, 17 nt, Chlamydophila pneumoniae CWL029
acgcuuuuucuugaaaa

SEQ ID NO: 2523518 - RNA, 18 nt, Chlamydophila pneumoniae CWL029
acgcuuuuucuugaaaaa

SEQ ID NO: 2523519 - RNA, 21 nt, Chlamydophila pneumoniae CWL029
acggaaaauacagccagcaga

SEQ ID NO: 2523520 - RNA, 15 nt, Chlamydophila pneumoniae CWL029
acggaaaaucacacu

SEQ ID NO: 2523521 - RNA, 14 nt, Chlamydophila pneumoniae CWL029
acggaaagcacaua

SEQ ID NO: 2523522 - RNA, 21 nt, Chlamydophila pneumoniae CWL029
acggaacucauuaagaagaac

SEQ ID NO: 2523523 - RNA, 20 nt, Chlamydophila pneumoniae CWL029
acggacaaugcuaucuccag

SEQ ID NO: 2523524 - RNA, 14 nt, Chlamydophila pneumoniae CWL029
acggagagagauuc

SEQ ID NO: 2523525 - RNA, 20 nt, Chlamydophila pneumoniae CWL029
acggauccuagaauaggaau

SEQ ID NO: 2523526 - RNA, 17 nt, Chlamydophila pneumoniae CWL029
acggauucuaaaagagc

SEQ ID NO: 2523527 - RNA, 17 nt, Chlamydophila pneumoniae CWL029
acggcugauucucccaa

SEQ ID NO: 2523528 - RNA, 14 nt, Chlamydophila pneumoniae CWL029
acgggagcucuuuc

SEQ ID NO: 2523529 - RNA, 16 nt, Chlamydophila pneumoniae CWL029
acgggcaauauaucca

SEQ ID NO: 2523530 - RNA, 20 nt, Chlamydophila pneumoniae CWL029
acgggucaggagguggugga

SEQ ID NO: 2523531 - RNA, 22 nt, Chlamydophila pneumoniae CWL029
acgguaagaucucguagcucag

SEQ ID NO: 2523532 - RNA, 21 nt, Chlamydophila pneumoniae CWL029
acggugcuguuguaauaaaag

SEQ ID NO: 2523533 - RNA, 14 nt, Chlamydophila pneumoniae CWL029
acguaaaaagaaag

SEQ ID NO: 2523534 - RNA, 14 nt, Chlamydophila pneumoniae CWL029
acguaacguaguca

SEQ ID NO: 2523535 - RNA, 12 nt, Chlamydophila pneumoniae CWL029
acguaagguguc

SEQ ID NO: 2523536 - RNA, 14 nt, Chlamydophila pneumoniae CWL029
acguagcagaggca

SEQ ID NO: 2523537 - RNA, 17 nt, Chlamydophila pneumoniae CWL029
acguagcuacaaaauua

SEQ ID NO: 2523538 - RNA, 18 nt, Chlamydophila pneumoniae CWL029
acguagcuacaaaauuau

SEQ ID NO: 2523539 - RNA, 15 nt, Chlamydophila pneumoniae CWL029
acguagucaaaaauu

SEQ ID NO: 2523540 - RNA, 18 nt, Chlamydophila pneumoniae CWL029
acguaguccuuauuucaa

SEQ ID NO: 2523541 - RNA, 22 nt, Chlamydophila pneumoniae CWL029
acguauagguugaauaaauuuu

SEQ ID NO: 2523542 - RNA, 23 nt, Chlamydophila pneumoniae CWL029
acguauccuugauuuuaaaauga

SEQ ID NO: 2523543 - RNA, 22 nt, Chlamydophila pneumoniae CWL029
acgucacuggggcauaagaacu

SEQ ID NO: 2523544 - RNA, 14 nt, Chlamydophila pneumoniae CWL029
acgucagcuguccu

SEQ ID NO: 2523545 - RNA, 16 nt, Chlamydophila pneumoniae CWL029
acgucuaaagacgaag

SEQ ID NO: 2523546 - RNA, 18 nt, Chlamydophila pneumoniae CWL029
acgucuucuuagaagaga

SEQ ID NO: 2523547 - RNA, 15 nt, Chlamydophila pneumoniae CWL029
acgugcaucucuuca

SEQ ID NO: 2523548 - RNA, 16 nt, Chlamydophila pneumoniae CWL029
acgugcucucuacuuc

SEQ ID NO: 2523549 - RNA, 12 nt, Chlamydophila pneumoniae CWL029
acgugguuuuug

SEQ ID NO: 2523550 - RNA, 23 nt, Chlamydophila pneumoniae CWL029
acguuaauaaagaggcucccauc

SEQ ID NO: 2523551 - RNA, 21 nt, Chlamydophila pneumoniae CWL029
acguucgacaacaacauaaag

SEQ ID NO: 2523552 - RNA, 22 nt, Chlamydophila pneumoniae CWL029
acguucugcaacaaguugcauu

SEQ ID NO: 2523553 - RNA, 19 nt, Chlamydophila pneumoniae CWL029
acguugcgaacagcuccug

SEQ ID NO: 2523554 - RNA, 15 nt, Chlamydophila pneumoniae CWL029
acguuggacugcaag

SEQ ID NO: 2523555 - RNA, 20 nt, Chlamydophila pneumoniae CWL029
acguuuaauuccuuggauuc

SEQ ID NO: 2523556 - RNA, 19 nt, Chlamydophila pneumoniae CWL029
acguuuucucuucccuugu

SEQ ID NO: 2523557 - RNA, 18 nt, Chlamydophila pneumoniae CWL029
acguuuuucccuuuaaaa

SEQ ID NO: 2523558 - RNA, 14 nt, Chlamydophila pneumoniae CWL029
acuaaaaucucauu

SEQ ID NO: 2523559 - RNA, 17 nt, Chlamydophila pneumoniae CWL029
acuaaaccuucaaugau

SEQ ID NO: 2523560 - RNA, 23 nt, Chlamydophila pneumoniae CWL029
acuaaacuccauuguuguugcau

SEQ ID NO: 2523561 - RNA, 19 nt, Chlamydophila pneumoniae CWL029
acuaaagauacuuaucuuu

SEQ ID NO: 2523562 - RNA, 22 nt, Chlamydophila pneumoniae CWL029
acuaaaugacgaguugaaguuu

SEQ ID NO: 2523563 - RNA, 18 nt, Chlamydophila pneumoniae CWL029
acuaacaaaauuucuuau

SEQ ID NO: 2523564 - RNA, 21 nt, Chlamydophila pneumoniae CWL029
acuaacaaaauuucuuauaaa

SEQ ID NO: 2523565 - RNA, 21 nt, Chlamydophila pneumoniae CWL029
acuaagaagcucacucuuuaa

SEQ ID NO: 2523566 - RNA, 19 nt, Chlamydophila pneumoniae CWL029
acuaaguuuaggcaggaag

SEQ ID NO: 2523567 - RNA, 19 nt, Chlamydophila pneumoniae CWL029
acuaauaccuuucuaagaa

SEQ ID NO: 2523568 - RNA, 20 nt, Chlamydophila pneumoniae CWL029
acuaaucaccuuaggcuuaa

SEQ ID NO: 2523569 - RNA, 17 nt, Chlamydophila pneumoniae CWL029
acuacacgcacuugcuu

SEQ ID NO: 2523570 - RNA, 22 nt, Chlamydophila pneumoniae CWL029
acuacacgcacuugcuuaucca

SEQ ID NO: 2523571 - RNA, 12 nt, Chlamydophila pneumoniae CWL029
acuacagaggga

SEQ ID NO: 2523572 - RNA, 19 nt, Chlamydophila pneumoniae CWL029
acuacagagggcuucauuc

SEQ ID NO: 2523573 - RNA, 17 nt, Chlamydophila pneumoniae CWL029
acuacaggaauucucau

SEQ ID NO: 2523574 - RNA, 17 nt, Chlamydophila pneumoniae CWL029
acuacauucgcaagaau

SEQ ID NO: 2523575 - RNA, 18 nt, Chlamydophila pneumoniae CWL029
acuaccgaauuuucaauu

SEQ ID NO: 2523576 - RNA, 12 nt, Chlamydophila pneumoniae CWL029
acuacugaaaca

SEQ ID NO: 2523577 - RNA, 21 nt, Chlamydophila pneumoniae CWL029
acuacugagcuucuauuucua

SEQ ID NO: 2523578 - RNA, 14 nt, Chlamydophila pneumoniae CWL029
acuacuuaaagcuu

SEQ ID NO: 2523579 - RNA, 21 nt, Chlamydophila pneumoniae CWL029
acuacuuaaagcuugagaaaa

SEQ ID NO: 2523580 - RNA, 14 nt, Chlamydophila pneumoniae CWL029
acuacuuacaagaa

SEQ ID NO: 2523581 - RNA, 20 nt, Chlamydophila pneumoniae CWL029
acuagaaucaccaauuuuuu

SEQ ID NO: 2523582 - RNA, 14 nt, Chlamydophila pneumoniae CWL029
acuagagaaaaagc

SEQ ID NO: 2523583 - RNA, 17 nt, Chlamydophila pneumoniae CWL029
acuagauaguucacaag

SEQ ID NO: 2523584 - RNA, 17 nt, Chlamydophila pneumoniae CWL029
acuagaucccucaagcg

SEQ ID NO: 2523585 - RNA, 13 nt, Chlamydophila pneumoniae CWL029
acuagauuucuac

SEQ ID NO: 2523586 - RNA, 15 nt, Chlamydophila pneumoniae CWL029
acuagauuucuacaa

SEQ ID NO: 2523587 - RNA, 20 nt, Chlamydophila pneumoniae CWL029
acuagcucucuugcuauacc

SEQ ID NO: 2523588 - RNA, 22 nt, Chlamydophila pneumoniae CWL029
acuaggaaaagcauagucgucu

SEQ ID NO: 2523589 - RNA, 21 nt, Chlamydophila pneumoniae CWL029
acuagguuauuaucaaaguga

SEQ ID NO: 2523590 - RNA, 15 nt, Chlamydophila pneumoniae CWL029
acuaguucuucuuua

SEQ ID NO: 2523591 - RNA, 20 nt, Chlamydophila pneumoniae CWL029
acuauaaaagccagggcagc

SEQ ID NO: 2523592 - RNA, 15 nt, Chlamydophila pneumoniae CWL029
acuauagaaaaggau

SEQ ID NO: 2523593 - RNA, 18 nt, Chlamydophila pneumoniae CWL029
acuaucauggacaagcaa

SEQ ID NO: 2523594 - RNA, 23 nt, Chlamydophila pneumoniae CWL029
acuauccgcacucauaggguagu

SEQ ID NO: 2523595 - RNA, 16 nt, Chlamydophila pneumoniae CWL029
acuaucgcaaauuucc

SEQ ID NO: 2523596 - RNA, 19 nt, Chlamydophila pneumoniae CWL029
acuaucgguuuaaacagau

SEQ ID NO: 2523597 - RNA, 11 nt, Chlamydophila pneumoniae CWL029
acuaucuacac

SEQ ID NO: 2523598 - RNA, 15 nt, Chlamydophila pneumoniae CWL029
acuaugguaagcauu

SEQ ID NO: 2523599 - RNA, 18 nt, Chlamydophila pneumoniae CWL029
acuaugguaagcauuucu

SEQ ID NO: 2523600 - RNA, 15 nt, Chlamydophila pneumoniae CWL029
acuauguguuuccuu

SEQ ID NO: 2523601 - RNA, 15 nt, Chlamydophila pneumoniae CWL029
acuauuaauacuuug

SEQ ID NO: 2523602 - RNA, 16 nt, Chlamydophila pneumoniae CWL029
acuauuaggcuuuuuu

SEQ ID NO: 2523603 - RNA, 23 nt, Chlamydophila pneumoniae CWL029
acuauuaggcuuuuuucuauuuu

SEQ ID NO: 2523604 - RNA, 21 nt, Chlamydophila pneumoniae CWL029
acuauugggagguucgcagaa

SEQ ID NO: 2523605 - RNA, 18 nt, Chlamydophila pneumoniae CWL029
acuauuuuggaaagcucu

SEQ ID NO: 2523606 - RNA, 12 nt, Chlamydophila pneumoniae CWL029
acucaaacccuc

SEQ ID NO: 2523607 - RNA, 21 nt, Chlamydophila pneumoniae CWL029
acucaaaucuuucaaggaaca

SEQ ID NO: 2523608 - RNA, 16 nt, Chlamydophila pneumoniae CWL029
acucaaauucaaaaua

SEQ ID NO: 2523609 - RNA, 13 nt, Chlamydophila pneumoniae CWL029
acucaacuuuuuu

SEQ ID NO: 2523610 - RNA, 16 nt, Chlamydophila pneumoniae CWL029
acucaaggaguuuuaa

SEQ ID NO: 2523611 - RNA, 21 nt, Chlamydophila pneumoniae CWL029
acucacaaacaacagaaaugu

SEQ ID NO: 2523612 - RNA, 13 nt, Chlamydophila pneumoniae CWL029
acucacagaguuc

SEQ ID NO: 2523613 - RNA, 15 nt, Chlamydophila pneumoniae CWL029
acucagagaaaauca

SEQ ID NO: 2523614 - RNA, 12 nt, Chlamydophila pneumoniae CWL029
acucagagauug

SEQ ID NO: 2523615 - RNA, 14 nt, Chlamydophila pneumoniae CWL029
acucagagauugcc

SEQ ID NO: 2523616 - RNA, 16 nt, Chlamydophila pneumoniae CWL029
acucagcgcaucacga

SEQ ID NO: 2523617 - RNA, 22 nt, Chlamydophila pneumoniae CWL029
acucagcgcaucacgaaaagga

SEQ ID NO: 2523618 - RNA, 22 nt, Chlamydophila pneumoniae CWL029
acucagcguucgcucucuuuaa

SEQ ID NO: 2523619 - RNA, 21 nt, Chlamydophila pneumoniae CWL029
acucagcucccaugugcugaa

SEQ ID NO: 2523620 - RNA, 20 nt, Chlamydophila pneumoniae CWL029
acucaggauauauagagcag

SEQ ID NO: 2523621 - RNA, 12 nt, Chlamydophila pneumoniae CWL029
acucaucacaau

SEQ ID NO: 2523622 - RNA, 13 nt, Chlamydophila pneumoniae CWL029
acucaucacaauu

SEQ ID NO: 2523623 - RNA, 16 nt, Chlamydophila pneumoniae CWL029
acucaucuugaguaag

SEQ ID NO: 2523624 - RNA, 21 nt, Chlamydophila pneumoniae CWL029
acuccaaaauauucuuucaaa

SEQ ID NO: 2523625 - RNA, 14 nt, Chlamydophila pneumoniae CWL029
acuccacuuuuuuc

SEQ ID NO: 2523626 - RNA, 17 nt, Chlamydophila pneumoniae CWL029
acuccagagcccuuggu

SEQ ID NO: 2523627 - RNA, 16 nt, Chlamydophila pneumoniae CWL029
acuccaggggauaaaa

SEQ ID NO: 2523628 - RNA, 16 nt, Chlamydophila pneumoniae CWL029
acuccauucagauggu

SEQ ID NO: 2523629 - RNA, 22 nt, Chlamydophila pneumoniae CWL029
acucccuagguuuuaucuuuag

SEQ ID NO: 2523630 - RNA, 23 nt, Chlamydophila pneumoniae CWL029
acucccuagguuuuaucuuuaga

SEQ ID NO: 2523631 - RNA, 14 nt, Chlamydophila pneumoniae CWL029
acucccucaaaauu

SEQ ID NO: 2523632 - RNA, 17 nt, Chlamydophila pneumoniae CWL029
acucccucaaaauuuaa

SEQ ID NO: 2523633 - RNA, 13 nt, Chlamydophila pneumoniae CWL029
acuccucagaauc

SEQ ID NO: 2523634 - RNA, 14 nt, Chlamydophila pneumoniae CWL029
acuccugacucuua

SEQ ID NO: 2523635 - RNA, 13 nt, Chlamydophila pneumoniae CWL029
acuccuuaacaac

SEQ ID NO: 2523636 - RNA, 16 nt, Chlamydophila pneumoniae CWL029
acucgauuauuucuug

SEQ ID NO: 2523637 - RNA, 14 nt, Chlamydophila pneumoniae CWL029
acucgcgucaugca

SEQ ID NO: 2523638 - RNA, 16 nt, Chlamydophila pneumoniae CWL029
acucggaaaaaauaga

SEQ ID NO: 2523639 - RNA, 14 nt, Chlamydophila pneumoniae CWL029
acucgucaaauuca

SEQ ID NO: 2523640 - RNA, 19 nt, Chlamydophila pneumoniae CWL029
acucguguggaucacguaa

SEQ ID NO: 2523641 - RNA, 14 nt, Chlamydophila pneumoniae CWL029
acucuaagcgaaac

SEQ ID NO: 2523642 - RNA, 22 nt, Chlamydophila pneumoniae CWL029
acucuaaucugauucaauugag

SEQ ID NO: 2523643 - RNA, 12 nt, Chlamydophila pneumoniae CWL029
acucuacaagug

SEQ ID NO: 2523644 - RNA, 14 nt, Chlamydophila pneumoniae CWL029
acucuacaaguguc

SEQ ID NO: 2523645 - RNA, 21 nt, Chlamydophila pneumoniae CWL029
acucuacaguaguaaauaaua

SEQ ID NO: 2523646 - RNA, 19 nt, Chlamydophila pneumoniae CWL029
acucuacccccagcuucuu

SEQ ID NO: 2523647 - RNA, 14 nt, Chlamydophila pneumoniae CWL029
acucuagaaaauau

SEQ ID NO: 2523648 - RNA, 15 nt, Chlamydophila pneumoniae CWL029
acucuagaaaauauu

SEQ ID NO: 2523649 - RNA, 22 nt, Chlamydophila pneumoniae CWL029
acucuagaaaauauuccuggaa

SEQ ID NO: 2523650 - RNA, 17 nt, Chlamydophila pneumoniae CWL029
acucuagguuuucucuu

SEQ ID NO: 2523651 - RNA, 15 nt, Chlamydophila pneumoniae CWL029
acucuaguuuuucuu

SEQ ID NO: 2523652 - RNA, 17 nt, Chlamydophila pneumoniae CWL029
acucuaucgaagagccc

SEQ ID NO: 2523653 - RNA, 15 nt, Chlamydophila pneumoniae CWL029
acucucacugagugu

SEQ ID NO: 2523654 - RNA, 22 nt, Chlamydophila pneumoniae CWL029
acucucaguuaaagagcauccu

SEQ ID NO: 2523655 - RNA, 17 nt, Chlamydophila pneumoniae CWL029
acucuccaaaagcucua

SEQ ID NO: 2523656 - RNA, 20 nt, Chlamydophila pneumoniae CWL029
acucuccauccucagucucu

SEQ ID NO: 2523657 - RNA, 21 nt, Chlamydophila pneumoniae CWL029
acucucugcagggaauccugu

SEQ ID NO: 2523658 - RNA, 13 nt, Chlamydophila pneumoniae CWL029
acucucuuccuuc

SEQ ID NO: 2523659 - RNA, 14 nt, Chlamydophila pneumoniae CWL029
acucucuuccuucu

SEQ ID NO: 2523660 - RNA, 17 nt, Chlamydophila pneumoniae CWL029
acucucuuccuucuccu

SEQ ID NO: 2523661 - RNA, 18 nt, Chlamydophila pneumoniae CWL029
acucucuuccuucuccug

SEQ ID NO: 2523662 - RNA, 20 nt, Chlamydophila pneumoniae CWL029
acucucuuccuucuccugua

SEQ ID NO: 2523663 - RNA, 18 nt, Chlamydophila pneumoniae CWL029
acucugaaguacacuaca

SEQ ID NO: 2523664 - RNA, 17 nt, Chlamydophila pneumoniae CWL029
acucugggaauuguucu

SEQ ID NO: 2523665 - RNA, 15 nt, Chlamydophila pneumoniae CWL029
acucuguaauauuca

SEQ ID NO: 2523666 - RNA, 19 nt, Chlamydophila pneumoniae CWL029
acucuuaaagguaaagcuu

SEQ ID NO: 2523667 - RNA, 16 nt, Chlamydophila pneumoniae CWL029
acucuuauugcagaau

SEQ ID NO: 2523668 - RNA, 19 nt, Chlamydophila pneumoniae CWL029
acucuucaucgauaggaug

SEQ ID NO: 2523669 - RNA, 22 nt, Chlamydophila pneumoniae CWL029
acucuucaucgauaggaugaca

SEQ ID NO: 2523670 - RNA, 16 nt, Chlamydophila pneumoniae CWL029
acucuuccacaauguu

SEQ ID NO: 2523671 - RNA, 22 nt, Chlamydophila pneumoniae CWL029
acucuuccacaauguuuagaau

SEQ ID NO: 2523672 - RNA, 16 nt, Chlamydophila pneumoniae CWL029
acucuuccuucuacag

SEQ ID NO: 2523673 - RNA, 21 nt, Chlamydophila pneumoniae CWL029
acucuuccuucuacagauuga

SEQ ID NO: 2523674 - RNA, 14 nt, Chlamydophila pneumoniae CWL029
acucuucuuuuuau

SEQ ID NO: 2523675 - RNA, 13 nt, Chlamydophila pneumoniae CWL029
acucuugcuugcu

SEQ ID NO: 2523676 - RNA, 13 nt, Chlamydophila pneumoniae CWL029
acucuuuaaaaau

SEQ ID NO: 2523677 - RNA, 17 nt, Chlamydophila pneumoniae CWL029
acucuuuaaaaauagaa

SEQ ID NO: 2523678 - RNA, 20 nt, Chlamydophila pneumoniae CWL029
acucuuuaggucuugucuau

SEQ ID NO: 2523679 - RNA, 15 nt, Chlamydophila pneumoniae CWL029
acucuuucagaaaga

SEQ ID NO: 2523680 - RNA, 15 nt, Chlamydophila pneumoniae CWL029
acucuuuuaagacaa

SEQ ID NO: 2523681 - RNA, 16 nt, Chlamydophila pneumoniae CWL029
acucuuuuaagacaau

SEQ ID NO: 2523682 - RNA, 18 nt, Chlamydophila pneumoniae CWL029
acucuuuuaagacaauau

SEQ ID NO: 2523683 - RNA, 19 nt, Chlamydophila pneumoniae CWL029
acucuuuuauuuuaggaag

SEQ ID NO: 2523684 - RNA, 15 nt, Chlamydophila pneumoniae CWL029
acucuuuucuagaaa

SEQ ID NO: 2523685 - RNA, 17 nt, Chlamydophila pneumoniae CWL029
acugaaaccuucucucu

SEQ ID NO: 2523686 - RNA, 24 nt, Chlamydophila pneumoniae CWL029
acugaagagcaauuaagaaacuag

SEQ ID NO: 2523687 - RNA, 15 nt, Chlamydophila pneumoniae CWL029
acugaauaguagagu

SEQ ID NO: 2523688 - RNA, 21 nt, Chlamydophila pneumoniae CWL029
acugaauaguagaguugacaa

SEQ ID NO: 2523689 - RNA, 11 nt, Chlamydophila pneumoniae CWL029
acugaauauca

SEQ ID NO: 2523690 - RNA, 23 nt, Chlamydophila pneumoniae CWL029
acugacuucuaugauaucaccag

SEQ ID NO: 2523691 - RNA, 17 nt, Chlamydophila pneumoniae CWL029
acugacuuuaugaucuc

SEQ ID NO: 2523692 - RNA, 17 nt, Chlamydophila pneumoniae CWL029
acugaucugaaauagca

SEQ ID NO: 2523693 - RNA, 16 nt, Chlamydophila pneumoniae CWL029
acugaugccaagaaau

SEQ ID NO: 2523694 - RNA, 22 nt, Chlamydophila pneumoniae CWL029
acugaugugaagccauuuucua

SEQ ID NO: 2523695 - RNA, 21 nt, Chlamydophila pneumoniae CWL029
acugcaaaggaagggauguuu

SEQ ID NO: 2523696 - RNA, 22 nt, Chlamydophila pneumoniae CWL029
acugcaggaaauuauagaugau

SEQ ID NO: 2523697 - RNA, 18 nt, Chlamydophila pneumoniae CWL029
acugccagcgaucacaua

SEQ ID NO: 2523698 - RNA, 22 nt, Chlamydophila pneumoniae CWL029
acugccagcgaucacauagaaa

SEQ ID NO: 2523699 - RNA, 20 nt, Chlamydophila pneumoniae CWL029
acugcgaaggguuguugcca

SEQ ID NO: 2523700 - RNA, 22 nt, Chlamydophila pneumoniae CWL029
acugcgaaggguuguugccagu

SEQ ID NO: 2523701 - RNA, 15 nt, Chlamydophila pneumoniae CWL029
acugcgagagaaagu

SEQ ID NO: 2523702 - RNA, 21 nt, Chlamydophila pneumoniae CWL029
acugcuacuuuaaaguggcaa

SEQ ID NO: 2523703 - RNA, 13 nt, Chlamydophila pneumoniae CWL029
acugcuagagucc

SEQ ID NO: 2523704 - RNA, 14 nt, Chlamydophila pneumoniae CWL029
acugcucaaugaca

SEQ ID NO: 2523705 - RNA, 16 nt, Chlamydophila pneumoniae CWL029
acugcuucaaaacaua

SEQ ID NO: 2523706 - RNA, 19 nt, Chlamydophila pneumoniae CWL029
acugcuuggucacaccaaa

SEQ ID NO: 2523707 - RNA, 14 nt, Chlamydophila pneumoniae CWL029
acuggacuucguuu

SEQ ID NO: 2523708 - RNA, 21 nt, Chlamydophila pneumoniae CWL029
acuggaggcuguguaaaaguu

SEQ ID NO: 2523709 - RNA, 15 nt, Chlamydophila pneumoniae CWL029
acugggaaaucuaaa

SEQ ID NO: 2523710 - RNA, 15 nt, Chlamydophila pneumoniae CWL029
acuguaaauccggcu

SEQ ID NO: 2523711 - RNA, 13 nt, Chlamydophila pneumoniae CWL029
acuguacaaaugc

SEQ ID NO: 2523712 - RNA, 22 nt, Chlamydophila pneumoniae CWL029
acuguacaaaugcaucucuagc

SEQ ID NO: 2523713 - RNA, 18 nt, Chlamydophila pneumoniae CWL029
acuguauagaaacuguua

SEQ ID NO: 2523714 - RNA, 20 nt, Chlamydophila pneumoniae CWL029
acugucuagcaguugcaaua

SEQ ID NO: 2523715 - RNA, 17 nt, Chlamydophila pneumoniae CWL029
acugugccauaacgcau

SEQ ID NO: 2523716 - RNA, 15 nt, Chlamydophila pneumoniae CWL029
acuguguaugaauca

SEQ ID NO: 2523717 - RNA, 15 nt, Chlamydophila pneumoniae CWL029
acuguucauaaucca

SEQ ID NO: 2523718 - RNA, 22 nt, Chlamydophila pneumoniae CWL029
acuguucgauaagaacuuuagg

SEQ ID NO: 2523719 - RNA, 15 nt, Chlamydophila pneumoniae CWL029
acuguugauccuucu

SEQ ID NO: 2523720 - RNA, 19 nt, Chlamydophila pneumoniae CWL029
acuguugauccuucuuaug

SEQ ID NO: 2523721 - RNA, 16 nt, Chlamydophila pneumoniae CWL029
acuguugcauuagaua

SEQ ID NO: 2523722 - RNA, 19 nt, Chlamydophila pneumoniae CWL029
acuguuguaauaaaaucau

SEQ ID NO: 2523723 - RNA, 20 nt, Chlamydophila pneumoniae CWL029
acuguuguaauaaaaucaug

SEQ ID NO: 2523724 - RNA, 21 nt, Chlamydophila pneumoniae CWL029
acuguuuguuuauuaucuaca

SEQ ID NO: 2523725 - RNA, 13 nt, Chlamydophila pneumoniae CWL029
acuguuuuucuuc

SEQ ID NO: 2523726 - RNA, 15 nt, Chlamydophila pneumoniae CWL029
acuguuuuucuucca

SEQ ID NO: 2523727 - RNA, 16 nt, Chlamydophila pneumoniae CWL029
acuuaaagacuugcuu

SEQ ID NO: 2523728 - RNA, 17 nt, Chlamydophila pneumoniae CWL029
acuuaaagguaaaacua

SEQ ID NO: 2523729 - RNA, 21 nt, Chlamydophila pneumoniae CWL029
acuuaagauacuucuccacag

SEQ ID NO: 2523730 - RNA, 20 nt, Chlamydophila pneumoniae CWL029
acuuaaguugaccuuuuuca

SEQ ID NO: 2523731 - RNA, 14 nt, Chlamydophila pneumoniae CWL029
acuuaauccuguag

SEQ ID NO: 2523732 - RNA, 21 nt, Chlamydophila pneumoniae CWL029
acuuacuaaaggugaaaguac

SEQ ID NO: 2523733 - RNA, 19 nt, Chlamydophila pneumoniae CWL029
acuuagaacuauaggaagc

SEQ ID NO: 2523734 - RNA, 20 nt, Chlamydophila pneumoniae CWL029
acuuagagucuucgacaagg

SEQ ID NO: 2523735 - RNA, 20 nt, Chlamydophila pneumoniae CWL029
acuuagaucuuuucuacuuc

SEQ ID NO: 2523736 - RNA, 15 nt, Chlamydophila pneumoniae CWL029
acuuaggaauuuuuc

SEQ ID NO: 2523737 - RNA, 22 nt, Chlamydophila pneumoniae CWL029
acuuaggguucucaaagaucau

SEQ ID NO: 2523738 - RNA, 24 nt, Chlamydophila pneumoniae CWL029
acuuaggguucucaaagaucaucu

SEQ ID NO: 2523739 - RNA, 17 nt, Chlamydophila pneumoniae CWL029
acuuagguaauguaguc

SEQ ID NO: 2523740 - RNA, 16 nt, Chlamydophila pneumoniae CWL029
acuuaguuuugaaaag

SEQ ID NO: 2523741 - RNA, 20 nt, Chlamydophila pneumoniae CWL029
acuuauaccaccccaaagca

SEQ ID NO: 2523742 - RNA, 14 nt, Chlamydophila pneumoniae CWL029
acuuaucgaaugcu

SEQ ID NO: 2523743 - RNA, 18 nt, Chlamydophila pneumoniae CWL029
acuuaucgaaugcugcac

SEQ ID NO: 2523744 - RNA, 14 nt, Chlamydophila pneumoniae CWL029
acuuauuguucuug

SEQ ID NO: 2523745 - RNA, 14 nt, Chlamydophila pneumoniae CWL029
acuucaaaugaaau

SEQ ID NO: 2523746 - RNA, 21 nt, Chlamydophila pneumoniae CWL029
acuucaacaaaggcuccaaac

SEQ ID NO: 2523747 - RNA, 22 nt, Chlamydophila pneumoniae CWL029
acuucaacaaaggcuccaaacg

SEQ ID NO: 2523748 - RNA, 17 nt, Chlamydophila pneumoniae CWL029
acuucaacuucuccaac

SEQ ID NO: 2523749 - RNA, 18 nt, Chlamydophila pneumoniae CWL029
acuucaagccaaaaccaa

SEQ ID NO: 2523750 - RNA, 16 nt, Chlamydophila pneumoniae CWL029
acuucaaugaagaaaa

SEQ ID NO: 2523751 - RNA, 13 nt, Chlamydophila pneumoniae CWL029
acuucacaaagaa

SEQ ID NO: 2523752 - RNA, 14 nt, Chlamydophila pneumoniae CWL029
acuucacaaagaac

SEQ ID NO: 2523753 - RNA, 22 nt, Chlamydophila pneumoniae CWL029
acuucaccauauaauagauaua

SEQ ID NO: 2523754 - RNA, 16 nt, Chlamydophila pneumoniae CWL029
acuucaccuugaaguu

SEQ ID NO: 2523755 - RNA, 15 nt, Chlamydophila pneumoniae CWL029
acuucagcaagaaaa

SEQ ID NO: 2523756 - RNA, 16 nt, Chlamydophila pneumoniae CWL029
acuucagcaagaaaau

SEQ ID NO: 2523757 - RNA, 15 nt, Chlamydophila pneumoniae CWL029
acuucagcuuugcuu

SEQ ID NO: 2523758 - RNA, 19 nt, Chlamydophila pneumoniae CWL029
acuucccgaacagcggcaa

SEQ ID NO: 2523759 - RNA, 18 nt, Chlamydophila pneumoniae CWL029
acuuccucuucaauuucu

SEQ ID NO: 2523760 - RNA, 13 nt, Chlamydophila pneumoniae CWL029
acuuccuuuuucu

SEQ ID NO: 2523761 - RNA, 20 nt, Chlamydophila pneumoniae CWL029
acuucgacacgaacuuugac

SEQ ID NO: 2523762 - RNA, 22 nt, Chlamydophila pneumoniae CWL029
acuucgauuggaagcaaagaaa

SEQ ID NO: 2523763 - RNA, 16 nt, Chlamydophila pneumoniae CWL029
acuucgcaaauuuuuc

SEQ ID NO: 2523764 - RNA, 17 nt, Chlamydophila pneumoniae CWL029
acuucgcaaauuuuucg

SEQ ID NO: 2523765 - RNA, 15 nt, Chlamydophila pneumoniae CWL029
acuucggaugagauc

SEQ ID NO: 2523766 - RNA, 23 nt, Chlamydophila pneumoniae CWL029
acuucguuagaaaccaugaugca

SEQ ID NO: 2523767 - RNA, 15 nt, Chlamydophila pneumoniae CWL029
acuucuaaaagcaag

SEQ ID NO: 2523768 - RNA, 14 nt, Chlamydophila pneumoniae CWL029
acuucuaacuguac

SEQ ID NO: 2523769 - RNA, 14 nt, Chlamydophila pneumoniae CWL029
acuucucaaagaca

SEQ ID NO: 2523770 - RNA, 16 nt, Chlamydophila pneumoniae CWL029
acuucucaaagacaau

SEQ ID NO: 2523771 - RNA, 12 nt, Chlamydophila pneumoniae CWL029
acuucucagaua

SEQ ID NO: 2523772 - RNA, 15 nt, Chlamydophila pneumoniae CWL029
acuucucagauaaaa

SEQ ID NO: 2523773 - RNA, 23 nt, Chlamydophila pneumoniae CWL029
acuucuccacagcuucuucguaa

SEQ ID NO: 2523774 - RNA, 14 nt, Chlamydophila pneumoniae CWL029
acuucugaaggaaa

SEQ ID NO: 2523775 - RNA, 23 nt, Chlamydophila pneumoniae CWL029
acuucugaugacguuaauaaaga

SEQ ID NO: 2523776 - RNA, 19 nt, Chlamydophila pneumoniae CWL029
acuucugguccaaacccug

SEQ ID NO: 2523777 - RNA, 20 nt, Chlamydophila pneumoniae CWL029
acuucugguccaaacccugg

SEQ ID NO: 2523778 - RNA, 16 nt, Chlamydophila pneumoniae CWL029
acuucuuccacgagau

SEQ ID NO: 2523779 - RNA, 23 nt, Chlamydophila pneumoniae CWL029
acuucuucucgguuuaaggcaau

SEQ ID NO: 2523780 - RNA, 22 nt, Chlamydophila pneumoniae CWL029
acuucuuguccuguuaagaugu

SEQ ID NO: 2523781 - RNA, 18 nt, Chlamydophila pneumoniae CWL029
acuucuugugauccuugc

SEQ ID NO: 2523782 - RNA, 13 nt, Chlamydophila pneumoniae CWL029
acuucuuucuugc

SEQ ID NO: 2523783 - RNA, 15 nt, Chlamydophila pneumoniae CWL029
acuucuuucuugcuc

SEQ ID NO: 2523784 - RNA, 18 nt, Chlamydophila pneumoniae CWL029
acuugcaagcuucuuguu

SEQ ID NO: 2523785 - RNA, 19 nt, Chlamydophila pneumoniae CWL029
acuugcauggauccuucau

SEQ ID NO: 2523786 - RNA, 18 nt, Chlamydophila pneumoniae CWL029
acuugccaaucuuccuua

SEQ ID NO: 2523787 - RNA, 17 nt, Chlamydophila pneumoniae CWL029
acuugcucuuuaauaag

SEQ ID NO: 2523788 - RNA, 13 nt, Chlamydophila pneumoniae CWL029
acuugggaugcua

SEQ ID NO: 2523789 - RNA, 21 nt, Chlamydophila pneumoniae CWL029
acuuguuaggaaaauucuuaa

SEQ ID NO: 2523790 - RNA, 18 nt, Chlamydophila pneumoniae CWL029
acuuguucagcuagagca

SEQ ID NO: 2523791 - RNA, 18 nt, Chlamydophila pneumoniae CWL029
acuuguucuucauuauua

SEQ ID NO: 2523792 - RNA, 22 nt, Chlamydophila pneumoniae CWL029
acuuguuucuccuauuggugua

SEQ ID NO: 2523793 - RNA, 14 nt, Chlamydophila pneumoniae CWL029
acuuuaacgaagaa

SEQ ID NO: 2523794 - RNA, 12 nt, Chlamydophila pneumoniae CWL029
acuuuaagaagc

SEQ ID NO: 2523795 - RNA, 22 nt, Chlamydophila pneumoniae CWL029
acuuuaagaagcacuucuuuag

SEQ ID NO: 2523796 - RNA, 23 nt, Chlamydophila pneumoniae CWL029
acuuuagaaauuccaauuuuugc

SEQ ID NO: 2523797 - RNA, 14 nt, Chlamydophila pneumoniae CWL029
acuuuauucucuuc

SEQ ID NO: 2523798 - RNA, 20 nt, Chlamydophila pneumoniae CWL029
acuuuauucucuucacuauu

SEQ ID NO: 2523799 - RNA, 16 nt, Chlamydophila pneumoniae CWL029
acuuucaagauugugc

SEQ ID NO: 2523800 - RNA, 17 nt, Chlamydophila pneumoniae CWL029
acuuuccguagccuuac

SEQ ID NO: 2523801 - RNA, 14 nt, Chlamydophila pneumoniae CWL029
acuuuccucaaagc

SEQ ID NO: 2523802 - RNA, 17 nt, Chlamydophila pneumoniae CWL029
acuuuccucucuuuaua

SEQ ID NO: 2523803 - RNA, 18 nt, Chlamydophila pneumoniae CWL029
acuuuccuggguaagcau

SEQ ID NO: 2523804 - RNA, 22 nt, Chlamydophila pneumoniae CWL029
acuuucgaagcgcucuacaaau

SEQ ID NO: 2523805 - RNA, 17 nt, Chlamydophila pneumoniae CWL029
acuuucguguacagacc

SEQ ID NO: 2523806 - RNA, 21 nt, Chlamydophila pneumoniae CWL029
acuuucugagccccuugcaaa

SEQ ID NO: 2523807 - RNA, 14 nt, Chlamydophila pneumoniae CWL029
acuuucuucucuag

SEQ ID NO: 2523808 - RNA, 15 nt, Chlamydophila pneumoniae CWL029
acuuucuucucuagg

SEQ ID NO: 2523809 - RNA, 17 nt, Chlamydophila pneumoniae CWL029
acuuucuuuuugagaua

SEQ ID NO: 2523810 - RNA, 21 nt, Chlamydophila pneumoniae CWL029
acuuugaccagaugauuuuuu

SEQ ID NO: 2523811 - RNA, 24 nt, Chlamydophila pneumoniae CWL029
acuuugauuguauagcuuacuuag

SEQ ID NO: 2523812 - RNA, 18 nt, Chlamydophila pneumoniae CWL029
acuuuggucuucuguaau

SEQ ID NO: 2523813 - RNA, 13 nt, Chlamydophila pneumoniae CWL029
acuuuguuuuuca

SEQ ID NO: 2523814 - RNA, 21 nt, Chlamydophila pneumoniae CWL029
acuuuuaauauuugagaagau

SEQ ID NO: 2523815 - RNA, 17 nt, Chlamydophila pneumoniae CWL029
acuuuuaauccuuucac

SEQ ID NO: 2523816 - RNA, 16 nt, Chlamydophila pneumoniae CWL029
acuuuuacugaaauua

SEQ ID NO: 2523817 - RNA, 21 nt, Chlamydophila pneumoniae CWL029
acuuuugaagauccugaguau

SEQ ID NO: 2523818 - RNA, 15 nt, Chlamydophila pneumoniae CWL029
acuuuuguacacaga

SEQ ID NO: 2523819 - RNA, 18 nt, Chlamydophila pneumoniae CWL029
acuuuuguacacagagau

SEQ ID NO: 2523820 - RNA, 22 nt, Chlamydophila pneumoniae CWL029
acuuuuguacacagagaugcuu

SEQ ID NO: 2523821 - RNA, 18 nt, Chlamydophila pneumoniae CWL029
acuuuuuuucuucucuaa

SEQ ID NO: 2523822 - RNA, 13 nt, Chlamydophila pneumoniae CWL029
agaaaaagaacau

SEQ ID NO: 2523823 - RNA, 14 nt, Chlamydophila pneumoniae CWL029
agaaaaagaaucuc

SEQ ID NO: 2523824 - RNA, 13 nt, Chlamydophila pneumoniae CWL029
agaaaaaucuaac

SEQ ID NO: 2523825 - RNA, 22 nt, Chlamydophila pneumoniae CWL029
agaaaaauucuucgagagcaug

SEQ ID NO: 2523826 - RNA, 21 nt, Chlamydophila pneumoniae CWL029
agaaaaauucuuuagggaggc

SEQ ID NO: 2523827 - RNA, 14 nt, Chlamydophila pneumoniae CWL029
agaaaacaaaguca

SEQ ID NO: 2523828 - RNA, 13 nt, Chlamydophila pneumoniae CWL029
agaaaacauagag

SEQ ID NO: 2523829 - RNA, 21 nt, Chlamydophila pneumoniae CWL029
agaaaacauagagauucuaca

SEQ ID NO: 2523830 - RNA, 14 nt, Chlamydophila pneumoniae CWL029
agaaaagaaaagug

SEQ ID NO: 2523831 - RNA, 17 nt, Chlamydophila pneumoniae CWL029
agaaaagaaaaguguga

SEQ ID NO: 2523832 - RNA, 18 nt, Chlamydophila pneumoniae CWL029
agaaaagaaaagugugag

SEQ ID NO: 2523833 - RNA, 13 nt, Chlamydophila pneumoniae CWL029
agaaaagauaaaa

SEQ ID NO: 2523834 - RNA, 15 nt, Chlamydophila pneumoniae CWL029
agaaaagauaaaaca

SEQ ID NO: 2523835 - RNA, 15 nt, Chlamydophila pneumoniae CWL029
agaaaauaaagaucu

SEQ ID NO: 2523836 - RNA, 19 nt, Chlamydophila pneumoniae CWL029
agaaaauaaagaucuucau

SEQ ID NO: 2523837 - RNA, 13 nt, Chlamydophila pneumoniae CWL029
agaaaauaagaag

SEQ ID NO: 2523838 - RNA, 14 nt, Chlamydophila pneumoniae CWL029
agaaaauaucaccu

SEQ ID NO: 2523839 - RNA, 23 nt, Chlamydophila pneumoniae CWL029
agaaaaucucuaagaaucuauag

SEQ ID NO: 2523840 - RNA, 12 nt, Chlamydophila pneumoniae CWL029
agaaacaacuug

SEQ ID NO: 2523841 - RNA, 13 nt, Chlamydophila pneumoniae CWL029
agaaacacugaac

SEQ ID NO: 2523842 - RNA, 12 nt, Chlamydophila pneumoniae CWL029
agaaacaucgga

SEQ ID NO: 2523843 - RNA, 17 nt, Chlamydophila pneumoniae CWL029
agaaacccgcaacucuu

SEQ ID NO: 2523844 - RNA, 21 nt, Chlamydophila pneumoniae CWL029
agaaacccgcaacucuuuagg

SEQ ID NO: 2523845 - RNA, 20 nt, Chlamydophila pneumoniae CWL029
agaaacuagggagaucuuau

SEQ ID NO: 2523846 - RNA, 17 nt, Chlamydophila pneumoniae CWL029
agaaacuaguucuucuu

SEQ ID NO: 2523847 - RNA, 14 nt, Chlamydophila pneumoniae CWL029
agaaacuccaaaau

SEQ ID NO: 2523848 - RNA, 14 nt, Chlamydophila pneumoniae CWL029
agaaacugcuccug

SEQ ID NO: 2523849 - RNA, 18 nt, Chlamydophila pneumoniae CWL029
agaaacuuaguuuugaaa

SEQ ID NO: 2523850 - RNA, 22 nt, Chlamydophila pneumoniae CWL029
agaaacuuaguuuugaaaagau

SEQ ID NO: 2523851 - RNA, 13 nt, Chlamydophila pneumoniae CWL029
agaaacuucucua

SEQ ID NO: 2523852 - RNA, 14 nt, Chlamydophila pneumoniae CWL029
agaaacuucugacc

SEQ ID NO: 2523853 - RNA, 23 nt, Chlamydophila pneumoniae CWL029
agaaacuucugacccuguagcga

SEQ ID NO: 2523854 - RNA, 13 nt, Chlamydophila pneumoniae CWL029
agaaacuuuaaaa

SEQ ID NO: 2523855 - RNA, 11 nt, Chlamydophila pneumoniae CWL029
agaaagaagcc

SEQ ID NO: 2523856 - RNA, 17 nt, Chlamydophila pneumoniae CWL029
agaaagaagccuuccuu

SEQ ID NO: 2523857 - RNA, 22 nt, Chlamydophila pneumoniae CWL029
agaaagaauuguaguucuuuga

SEQ ID NO: 2523858 - RNA, 18 nt, Chlamydophila pneumoniae CWL029
agaaagacaaaaaaucug

SEQ ID NO: 2523859 - RNA, 14 nt, Chlamydophila pneumoniae CWL029
agaaagacauccuu

SEQ ID NO: 2523860 - RNA, 22 nt, Chlamydophila pneumoniae CWL029
agaaagagucucacucuuuucu

SEQ ID NO: 2523861 - RNA, 13 nt, Chlamydophila pneumoniae CWL029
agaaagauauccc

SEQ ID NO: 2523862 - RNA, 19 nt, Chlamydophila pneumoniae CWL029
agaaagauaucccaaagcu

SEQ ID NO: 2523863 - RNA, 20 nt, Chlamydophila pneumoniae CWL029
agaaagauuuauuuugucuu

SEQ ID NO: 2523864 - RNA, 20 nt, Chlamydophila pneumoniae CWL029
agaaaggagauccacagacu

SEQ ID NO: 2523865 - RNA, 18 nt, Chlamydophila pneumoniae CWL029
agaaaggauuggaugaga

SEQ ID NO: 2523866 - RNA, 19 nt, Chlamydophila pneumoniae CWL029
agaaaggcuuuuuccaaaa

SEQ ID NO: 2523867 - RNA, 15 nt, Chlamydophila pneumoniae CWL029
agaaaguagagacau

SEQ ID NO: 2523868 - RNA, 18 nt, Chlamydophila pneumoniae CWL029
agaaaguauuccucuuag

SEQ ID NO: 2523869 - RNA, 17 nt, Chlamydophila pneumoniae CWL029
agaaauacgcuuuucuu

SEQ ID NO: 2523870 - RNA, 18 nt, Chlamydophila pneumoniae CWL029
agaaauacgcuuuucuuc

SEQ ID NO: 2523871 - RNA, 22 nt, Chlamydophila pneumoniae CWL029
agaaauauacucuugcuugcua

SEQ ID NO: 2523872 - RNA, 16 nt, Chlamydophila pneumoniae CWL029
agaaauauacugccag

SEQ ID NO: 2523873 - RNA, 14 nt, Chlamydophila pneumoniae CWL029
agaaaucacacuua

SEQ ID NO: 2523874 - RNA, 15 nt, Chlamydophila pneumoniae CWL029
agaaaucaguccuaa

SEQ ID NO: 2523875 - RNA, 21 nt, Chlamydophila pneumoniae CWL029
agaaaucuacucuuuaaaaau

SEQ ID NO: 2523876 - RNA, 20 nt, Chlamydophila pneumoniae CWL029
agaaaucuuuugauuaggcu

SEQ ID NO: 2523877 - RNA, 15 nt, Chlamydophila pneumoniae CWL029
agaaaugaagccaaa

SEQ ID NO: 2523878 - RNA, 21 nt, Chlamydophila pneumoniae CWL029
agaaaugcucuucugcagcgu

SEQ ID NO: 2523879 - RNA, 17 nt, Chlamydophila pneumoniae CWL029
agaaauguaagaaggca

SEQ ID NO: 2523880 - RNA, 16 nt, Chlamydophila pneumoniae CWL029
agaaauguugauaggu

SEQ ID NO: 2523881 - RNA, 15 nt, Chlamydophila pneumoniae CWL029
agaaauguuuuuaaa

SEQ ID NO: 2523882 - RNA, 16 nt, Chlamydophila pneumoniae CWL029
agaaauguuuuuaaac

SEQ ID NO: 2523883 - RNA, 21 nt, Chlamydophila pneumoniae CWL029
agaaauuagaguaugaggaga

SEQ ID NO: 2523884 - RNA, 17 nt, Chlamydophila pneumoniae CWL029
agaaauucaugccuuug

SEQ ID NO: 2523885 - RNA, 19 nt, Chlamydophila pneumoniae CWL029
agaaauuccaauuuuugca

SEQ ID NO: 2523886 - RNA, 12 nt, Chlamydophila pneumoniae CWL029
agaaauuccuaa

SEQ ID NO: 2523887 - RNA, 22 nt, Chlamydophila pneumoniae CWL029
agaaauuccuaaaauuuccgcu

SEQ ID NO: 2523888 - RNA, 13 nt, Chlamydophila pneumoniae CWL029
agaaauucuaaga

SEQ ID NO: 2523889 - RNA, 13 nt, Chlamydophila pneumoniae CWL029
agaaauucugacu

SEQ ID NO: 2523890 - RNA, 17 nt, Chlamydophila pneumoniae CWL029
agaacaaaaaaucaauc

SEQ ID NO: 2523891 - RNA, 13 nt, Chlamydophila pneumoniae CWL029
agaacaacgcugc

SEQ ID NO: 2523892 - RNA, 16 nt, Chlamydophila pneumoniae CWL029
agaacaauaucagcag

SEQ ID NO: 2523893 - RNA, 13 nt, Chlamydophila pneumoniae CWL029
agaacaccaucac

SEQ ID NO: 2523894 - RNA, 17 nt, Chlamydophila pneumoniae CWL029
agaacaccucuucucua

SEQ ID NO: 2523895 - RNA, 17 nt, Chlamydophila pneumoniae CWL029
agaacacgccugcgaaa

SEQ ID NO: 2523896 - RNA, 16 nt, Chlamydophila pneumoniae CWL029
agaacacucagagaug

SEQ ID NO: 2523897 - RNA, 21 nt, Chlamydophila pneumoniae CWL029
agaacacucagagauguggca

SEQ ID NO: 2523898 - RNA, 18 nt, Chlamydophila pneumoniae CWL029
agaacagaggaucuagaa

SEQ ID NO: 2523899 - RNA, 21 nt, Chlamydophila pneumoniae CWL029
agaacagaggaucuagaaaau

SEQ ID NO: 2523900 - RNA, 24 nt, Chlamydophila pneumoniae CWL029
agaacagaggaucuagaaaaugaa

SEQ ID NO: 2523901 - RNA, 22 nt, Chlamydophila pneumoniae CWL029
agaacagcacucucugcaggga

SEQ ID NO: 2523902 - RNA, 21 nt, Chlamydophila pneumoniae CWL029
agaacagcauggacuccaaga

SEQ ID NO: 2523903 - RNA, 20 nt, Chlamydophila pneumoniae CWL029
agaacaucuucccaccccug

SEQ ID NO: 2523904 - RNA, 15 nt, Chlamydophila pneumoniae CWL029
agaacaugcccccac

SEQ ID NO: 2523905 - RNA, 20 nt, Chlamydophila pneumoniae CWL029
agaacauguuucuaagcuga

SEQ ID NO: 2523906 - RNA, 17 nt, Chlamydophila pneumoniae CWL029
agaaccuguuuuucuaa

SEQ ID NO: 2523907 - RNA, 19 nt, Chlamydophila pneumoniae CWL029
agaaccuucacaagaaaac

SEQ ID NO: 2523908 - RNA, 20 nt, Chlamydophila pneumoniae CWL029
agaaccuucacaagaaaaca

SEQ ID NO: 2523909 - RNA, 21 nt, Chlamydophila pneumoniae CWL029
agaaccuucacaagaaaacaa

SEQ ID NO: 2523910 - RNA, 24 nt, Chlamydophila pneumoniae CWL029
agaaccuucacaagaaaacaaagu

SEQ ID NO: 2523911 - RNA, 19 nt, Chlamydophila pneumoniae CWL029
agaacgaauuucaacagcu

SEQ ID NO: 2523912 - RNA, 13 nt, Chlamydophila pneumoniae CWL029
agaacguaagcuu

SEQ ID NO: 2523913 - RNA, 18 nt, Chlamydophila pneumoniae CWL029
agaacgucaccauuaaau

SEQ ID NO: 2523914 - RNA, 18 nt, Chlamydophila pneumoniae CWL029
agaacgucuaaagacgaa

SEQ ID NO: 2523915 - RNA, 17 nt, Chlamydophila pneumoniae CWL029
agaacucaacuuuuuua

SEQ ID NO: 2523916 - RNA, 14 nt, Chlamydophila pneumoniae CWL029
agaacuccuuugag

SEQ ID NO: 2523917 - RNA, 13 nt, Chlamydophila pneumoniae CWL029
agaacucuccucg

SEQ ID NO: 2523918 - RNA, 18 nt, Chlamydophila pneumoniae CWL029
agaacucuuaaagguaaa

SEQ ID NO: 2523919 - RNA, 22 nt, Chlamydophila pneumoniae CWL029
agaacucuuaaagguaaagcuu

SEQ ID NO: 2523920 - RNA, 14 nt, Chlamydophila pneumoniae CWL029
agaacuuagcaaug

SEQ ID NO: 2523921 - RNA, 12 nt, Chlamydophila pneumoniae CWL029
agaacuucaaca

SEQ ID NO: 2523922 - RNA, 16 nt, Chlamydophila pneumoniae CWL029
agaacuuccugauucu

SEQ ID NO: 2523923 - RNA, 15 nt, Chlamydophila pneumoniae CWL029
agaacuuuacaauua

SEQ ID NO: 2523924 - RNA, 16 nt, Chlamydophila pneumoniae CWL029
agaacuuuagggaaga

SEQ ID NO: 2523925 - RNA, 20 nt, Chlamydophila pneumoniae CWL029
agaacuuucgucuuugcuuu

SEQ ID NO: 2523926 - RNA, 19 nt, Chlamydophila pneumoniae CWL029
agaacuuuugaauuaaaag

SEQ ID NO: 2523927 - RNA, 17 nt, Chlamydophila pneumoniae CWL029
agaagaaauuagaggga

SEQ ID NO: 2523928 - RNA, 16 nt, Chlamydophila pneumoniae CWL029
agaagaagcaaaagau

SEQ ID NO: 2523929 - RNA, 16 nt, Chlamydophila pneumoniae CWL029
agaagaaggacaacua

SEQ ID NO: 2523930 - RNA, 21 nt, Chlamydophila pneumoniae CWL029
agaagacaggagcuacugaaa

SEQ ID NO: 2523931 - RNA, 21 nt, Chlamydophila pneumoniae CWL029
agaagacgcucuuagccuagg

SEQ ID NO: 2523932 - RNA, 18 nt, Chlamydophila pneumoniae CWL029
agaagacuagcuuuucau

SEQ ID NO: 2523933 - RNA, 14 nt, Chlamydophila pneumoniae CWL029
agaagagaaacaca

SEQ ID NO: 2523934 - RNA, 14 nt, Chlamydophila pneumoniae CWL029
agaagagaaaguag

SEQ ID NO: 2523935 - RNA, 17 nt, Chlamydophila pneumoniae CWL029
agaagagguaauaauag

SEQ ID NO: 2523936 - RNA, 14 nt, Chlamydophila pneumoniae CWL029
agaagaucaaagau

SEQ ID NO: 2523937 - RNA, 23 nt, Chlamydophila pneumoniae CWL029
agaagaucucgucuuggaaugcu

SEQ ID NO: 2523938 - RNA, 19 nt, Chlamydophila pneumoniae CWL029
agaagaugauuggacaagu

SEQ ID NO: 2523939 - RNA, 14 nt, Chlamydophila pneumoniae CWL029
agaagauucuuuaa

SEQ ID NO: 2523940 - RNA, 13 nt, Chlamydophila pneumoniae CWL029
agaagcaaaggua

SEQ ID NO: 2523941 - RNA, 15 nt, Chlamydophila pneumoniae CWL029
agaagcaacuaaacu

SEQ ID NO: 2523942 - RNA, 17 nt, Chlamydophila pneumoniae CWL029
agaagcaacuaaacucu

SEQ ID NO: 2523943 - RNA, 21 nt, Chlamydophila pneumoniae CWL029
agaagcacuucuuuaggagca

SEQ ID NO: 2523944 - RNA, 13 nt, Chlamydophila pneumoniae CWL029
agaagcaugaagc

SEQ ID NO: 2523945 - RNA, 21 nt, Chlamydophila pneumoniae CWL029
agaagcaugaagcagaaacuu

SEQ ID NO: 2523946 - RNA, 14 nt, Chlamydophila pneumoniae CWL029
agaagcauugagga

SEQ ID NO: 2523947 - RNA, 16 nt, Chlamydophila pneumoniae CWL029
agaagcggaagcaccg

SEQ ID NO: 2523948 - RNA, 19 nt, Chlamydophila pneumoniae CWL029
agaagcucacucuuuaaaa

SEQ ID NO: 2523949 - RNA, 20 nt, Chlamydophila pneumoniae CWL029
agaagcucacucuuuaaaaa

SEQ ID NO: 2523950 - RNA, 21 nt, Chlamydophila pneumoniae CWL029
agaagcucuaucuuugguaug

SEQ ID NO: 2523951 - RNA, 15 nt, Chlamydophila pneumoniae CWL029
agaagcuucaaugau

SEQ ID NO: 2523952 - RNA, 11 nt, Chlamydophila pneumoniae CWL029
agaaggaucug

SEQ ID NO: 2523953 - RNA, 15 nt, Chlamydophila pneumoniae CWL029
agaaggcaucccgaa

SEQ ID NO: 2523954 - RNA, 19 nt, Chlamydophila pneumoniae CWL029
agaaggcucucaaggucac

SEQ ID NO: 2523955 - RNA, 22 nt, Chlamydophila pneumoniae CWL029
agaagguccaugucuaaagauu

SEQ ID NO: 2523956 - RNA, 23 nt, Chlamydophila pneumoniae CWL029
agaagguccaugucuaaagauug

SEQ ID NO: 2523957 - RNA, 23 nt, Chlamydophila pneumoniae CWL029
agaagguguuuuggcugcuuuug

SEQ ID NO: 2523958 - RNA, 12 nt, Chlamydophila pneumoniae CWL029
agaagguuucua

SEQ ID NO: 2523959 - RNA, 19 nt, Chlamydophila pneumoniae CWL029
agaaguaauccuaauuccu

SEQ ID NO: 2523960 - RNA, 20 nt, Chlamydophila pneumoniae CWL029
agaaguauucgauuccugag

SEQ ID NO: 2523961 - RNA, 14 nt, Chlamydophila pneumoniae CWL029
agaagucacaaauu

SEQ ID NO: 2523962 - RNA, 22 nt, Chlamydophila pneumoniae CWL029
agaaguccuaucaaagcaaaag

SEQ ID NO: 2523963 - RNA, 23 nt, Chlamydophila pneumoniae CWL029
agaagucgcuagaucacaagaaa

SEQ ID NO: 2523964 - RNA, 23 nt, Chlamydophila pneumoniae CWL029
agaaguguauuuaaauucuggaa

SEQ ID NO: 2523965 - RNA, 20 nt, Chlamydophila pneumoniae CWL029
agaaguuugauaagcuaaca

SEQ ID NO: 2523966 - RNA, 17 nt, Chlamydophila pneumoniae CWL029
agaauaaaacuuucuuu

SEQ ID NO: 2523967 - RNA, 12 nt, Chlamydophila pneumoniae CWL029
agaauaacgcaa

SEQ ID NO: 2523968 - RNA, 13 nt, Chlamydophila pneumoniae CWL029
agaauaaucucuu

SEQ ID NO: 2523969 - RNA, 15 nt, Chlamydophila pneumoniae CWL029
agaauacaaacaaga

SEQ ID NO: 2523970 - RNA, 18 nt, Chlamydophila pneumoniae CWL029
agaauacaaacaagaagc

SEQ ID NO: 2523971 - RNA, 15 nt, Chlamydophila pneumoniae CWL029
agaauacaacccuuu

SEQ ID NO: 2523972 - RNA, 20 nt, Chlamydophila pneumoniae CWL029
agaauacaacccuuuauacu

SEQ ID NO: 2523973 - RNA, 23 nt, Chlamydophila pneumoniae CWL029
agaauaccguuuuaggaagguca

SEQ ID NO: 2523974 - RNA, 21 nt, Chlamydophila pneumoniae CWL029
agaauacucauauuuugucuu

SEQ ID NO: 2523975 - RNA, 22 nt, Chlamydophila pneumoniae CWL029
agaauacucuagguuuucucuu

SEQ ID NO: 2523976 - RNA, 13 nt, Chlamydophila pneumoniae CWL029
agaauagcaagca

SEQ ID NO: 2523977 - RNA, 15 nt, Chlamydophila pneumoniae CWL029
agaauagcaugaagg

SEQ ID NO: 2523978 - RNA, 18 nt, Chlamydophila pneumoniae CWL029
agaauagccauaauuaga

SEQ ID NO: 2523979 - RNA, 19 nt, Chlamydophila pneumoniae CWL029
agaauaggaacaaagcucu

SEQ ID NO: 2523980 - RNA, 13 nt, Chlamydophila pneumoniae CWL029
agaauaucaucuu

SEQ ID NO: 2523981 - RNA, 14 nt, Chlamydophila pneumoniae CWL029
agaauaucaucuuc

SEQ ID NO: 2523982 - RNA, 14 nt, Chlamydophila pneumoniae CWL029
agaauaucuuuuga

SEQ ID NO: 2523983 - RNA, 15 nt, Chlamydophila pneumoniae CWL029
agaauaugaacugcc

SEQ ID NO: 2523984 - RNA, 21 nt, Chlamydophila pneumoniae CWL029
agaauauggccuagcuuucuu

SEQ ID NO: 2523985 - RNA, 18 nt, Chlamydophila pneumoniae CWL029
agaaucauugagaugaaa

SEQ ID NO: 2523986 - RNA, 19 nt, Chlamydophila pneumoniae CWL029
agaauccacuacugucaau

SEQ ID NO: 2523987 - RNA, 15 nt, Chlamydophila pneumoniae CWL029
agaauccauuuugcc

SEQ ID NO: 2523988 - RNA, 16 nt, Chlamydophila pneumoniae CWL029
agaauccauuuugccc

SEQ ID NO: 2523989 - RNA, 19 nt, Chlamydophila pneumoniae CWL029
agaauccucuauccaucau

SEQ ID NO: 2523990 - RNA, 17 nt, Chlamydophila pneumoniae CWL029
agaauccugaguaaaau

SEQ ID NO: 2523991 - RNA, 20 nt, Chlamydophila pneumoniae CWL029
agaauccugaguaaaaucau

SEQ ID NO: 2523992 - RNA, 21 nt, Chlamydophila pneumoniae CWL029
agaauccugaguaaaaucaua

SEQ ID NO: 2523993 - RNA, 23 nt, Chlamydophila pneumoniae CWL029
agaaucguucuuagcgcauguau

SEQ ID NO: 2523994 - RNA, 16 nt, Chlamydophila pneumoniae CWL029
agaaucuccucaucag

SEQ ID NO: 2523995 - RNA, 18 nt, Chlamydophila pneumoniae CWL029
agaaucucugaccaucaa

SEQ ID NO: 2523996 - RNA, 20 nt, Chlamydophila pneumoniae CWL029
agaaucucugaccaucaaug

SEQ ID NO: 2523997 - RNA, 12 nt, Chlamydophila pneumoniae CWL029
agaaucucugcc

SEQ ID NO: 2523998 - RNA, 12 nt, Chlamydophila pneumoniae CWL029
agaaucuuugug

SEQ ID NO: 2523999 - RNA, 14 nt, Chlamydophila pneumoniae CWL029
agaaucuuuucuag

SEQ ID NO: 2524000 - RNA, 19 nt, Chlamydophila pneumoniae CWL029
agaaucuuuucuagaaaac

SEQ ID NO: 2524001 - RNA, 17 nt, Chlamydophila pneumoniae CWL029
agaaugaacaauagaaa

SEQ ID NO: 2524002 - RNA, 21 nt, Chlamydophila pneumoniae CWL029
agaaugacacagagaacaaua

SEQ ID NO: 2524003 - RNA, 16 nt, Chlamydophila pneumoniae CWL029
agaaugcaucuugagg

SEQ ID NO: 2524004 - RNA, 18 nt, Chlamydophila pneumoniae CWL029
agaaugcccuuuagggaa

SEQ ID NO: 2524005 - RNA, 20 nt, Chlamydophila pneumoniae CWL029
agaauguacauagaggagau

SEQ ID NO: 2524006 - RNA, 21 nt, Chlamydophila pneumoniae CWL029
agaauguaugugaaagauuau

SEQ ID NO: 2524007 - RNA, 16 nt, Chlamydophila pneumoniae CWL029
agaauuccuaaaacga

SEQ ID NO: 2524008 - RNA, 15 nt, Chlamydophila pneumoniae CWL029
agaauugcaaaguac

SEQ ID NO: 2524009 - RNA, 16 nt, Chlamydophila pneumoniae CWL029
agaauuucgucuucau

SEQ ID NO: 2524010 - RNA, 13 nt, Chlamydophila pneumoniae CWL029
agaauuuguccuu

SEQ ID NO: 2524011 - RNA, 21 nt, Chlamydophila pneumoniae CWL029
agaauuuucaugauauuuuua

SEQ ID NO: 2524012 - RNA, 22 nt, Chlamydophila pneumoniae CWL029
agacaaaaaagggaucuccuuc

SEQ ID NO: 2524013 - RNA, 13 nt, Chlamydophila pneumoniae CWL029
agacaaagccaca

SEQ ID NO: 2524014 - RNA, 18 nt, Chlamydophila pneumoniae CWL029
agacaaccuagaaucaca

SEQ ID NO: 2524015 - RNA, 19 nt, Chlamydophila pneumoniae CWL029
agacaaccuagaaucacau

SEQ ID NO: 2524016 - RNA, 19 nt, Chlamydophila pneumoniae CWL029
agacaacgcaggaagaaca

SEQ ID NO: 2524017 - RNA, 21 nt, Chlamydophila pneumoniae CWL029
agacaacuauguuauccauac

SEQ ID NO: 2524018 - RNA, 13 nt, Chlamydophila pneumoniae CWL029
agacaagaaaaua

SEQ ID NO: 2524019 - RNA, 12 nt, Chlamydophila pneumoniae CWL029
agacaagacacc

SEQ ID NO: 2524020 - RNA, 13 nt, Chlamydophila pneumoniae CWL029
agacaagagaaga

SEQ ID NO: 2524021 - RNA, 23 nt, Chlamydophila pneumoniae CWL029
agacaaguaaacagcaaaguaau

SEQ ID NO: 2524022 - RNA, 17 nt, Chlamydophila pneumoniae CWL029
agacaaguucaucaaau

SEQ ID NO: 2524023 - RNA, 20 nt, Chlamydophila pneumoniae CWL029
agacaauaccagauaaagca

SEQ ID NO: 2524024 - RNA, 22 nt, Chlamydophila pneumoniae CWL029
agacaaugcaaccuguaaagac

SEQ ID NO: 2524025 - RNA, 21 nt, Chlamydophila pneumoniae CWL029
agacaaugcgccuuguuuaga

SEQ ID NO: 2524026 - RNA, 16 nt, Chlamydophila pneumoniae CWL029
agacacacuuucuuua

SEQ ID NO: 2524027 - RNA, 16 nt, Chlamydophila pneumoniae CWL029
agacacgccuccuuca

SEQ ID NO: 2524028 - RNA, 22 nt, Chlamydophila pneumoniae CWL029
agacacgccuccuucaaagaua

SEQ ID NO: 2524029 - RNA, 23 nt, Chlamydophila pneumoniae CWL029
agacacgccuccuucaaagauau

SEQ ID NO: 2524030 - RNA, 19 nt, Chlamydophila pneumoniae CWL029
agacauauccaaugagaga

SEQ ID NO: 2524031 - RNA, 17 nt, Chlamydophila pneumoniae CWL029
agacaugcgaagggagg

SEQ ID NO: 2524032 - RNA, 12 nt, Chlamydophila pneumoniae CWL029
agacauuccaca

SEQ ID NO: 2524033 - RNA, 21 nt, Chlamydophila pneumoniae CWL029
agacauuucuugauccaucug

SEQ ID NO: 2524034 - RNA, 20 nt, Chlamydophila pneumoniae CWL029
agaccaaacuuucuuuucua

SEQ ID NO: 2524035 - RNA, 21 nt, Chlamydophila pneumoniae CWL029
agaccaaaucaucgcaaucaa

SEQ ID NO: 2524036 - RNA, 20 nt, Chlamydophila pneumoniae CWL029
agaccaauaaauccaaaaaa

SEQ ID NO: 2524037 - RNA, 19 nt, Chlamydophila pneumoniae CWL029
agaccaauugguggagcuc

SEQ ID NO: 2524038 - RNA, 14 nt, Chlamydophila pneumoniae CWL029
agaccacgaaaugu

SEQ ID NO: 2524039 - RNA, 22 nt, Chlamydophila pneumoniae CWL029
agaccacgaaauguuaaaggaa

SEQ ID NO: 2524040 - RNA, 13 nt, Chlamydophila pneumoniae CWL029
agaccagggaucu

SEQ ID NO: 2524041 - RNA, 19 nt, Chlamydophila pneumoniae CWL029
agaccauaaaaucaacaag

SEQ ID NO: 2524042 - RNA, 15 nt, Chlamydophila pneumoniae CWL029
agaccauacacaaau

SEQ ID NO: 2524043 - RNA, 18 nt, Chlamydophila pneumoniae CWL029
agacccaacaguucuuuc

SEQ ID NO: 2524044 - RNA, 21 nt, Chlamydophila pneumoniae CWL029
agacccuccguggcggauaau

SEQ ID NO: 2524045 - RNA, 13 nt, Chlamydophila pneumoniae CWL029
agacccuucuuuc

SEQ ID NO: 2524046 - RNA, 19 nt, Chlamydophila pneumoniae CWL029
agacccuucuuuccauaaa

SEQ ID NO: 2524047 - RNA, 21 nt, Chlamydophila pneumoniae CWL029
agaccgagaagcuucaaugau

SEQ ID NO: 2524048 - RNA, 23 nt, Chlamydophila pneumoniae CWL029
agaccggaucccguaaaagaacg

SEQ ID NO: 2524049 - RNA, 22 nt, Chlamydophila pneumoniae CWL029
agaccguugccagcuugcccuu

SEQ ID NO: 2524050 - RNA, 18 nt, Chlamydophila pneumoniae CWL029
agaccuaacgcaacaucc

SEQ ID NO: 2524051 - RNA, 15 nt, Chlamydophila pneumoniae CWL029
agaccugccaagaua

SEQ ID NO: 2524052 - RNA, 16 nt, Chlamydophila pneumoniae CWL029
agacgaccuuuaagau

SEQ ID NO: 2524053 - RNA, 21 nt, Chlamydophila pneumoniae CWL029
agacgugcucucuacuucugu

SEQ ID NO: 2524054 - RNA, 22 nt, Chlamydophila pneumoniae CWL029
agacgugcucucuucuucucag

SEQ ID NO: 2524055 - RNA, 22 nt, Chlamydophila pneumoniae CWL029
agacguuaucuaagacuucugg

SEQ ID NO: 2524056 - RNA, 21 nt, Chlamydophila pneumoniae CWL029
agacguucgacaacaacauaa

SEQ ID NO: 2524057 - RNA, 15 nt, Chlamydophila pneumoniae CWL029
agacuaaaaaagaga

SEQ ID NO: 2524058 - RNA, 15 nt, Chlamydophila pneumoniae CWL029
agacuaaaagaauaa

SEQ ID NO: 2524059 - RNA, 18 nt, Chlamydophila pneumoniae CWL029
agacuagagucacuagca

SEQ ID NO: 2524060 - RNA, 13 nt, Chlamydophila pneumoniae CWL029
agacucagagaaa

SEQ ID NO: 2524061 - RNA, 18 nt, Chlamydophila pneumoniae CWL029
agacucagagaaaaucaa

SEQ ID NO: 2524062 - RNA, 19 nt, Chlamydophila pneumoniae CWL029
agacucaugaaauaguguu

SEQ ID NO: 2524063 - RNA, 19 nt, Chlamydophila pneumoniae CWL029
agacucuaguuuuucuuua

SEQ ID NO: 2524064 - RNA, 13 nt, Chlamydophila pneumoniae CWL029
agacucucaucag

SEQ ID NO: 2524065 - RNA, 15 nt, Chlamydophila pneumoniae CWL029
agacucucaucagca

SEQ ID NO: 2524066 - RNA, 19 nt, Chlamydophila pneumoniae CWL029
agacucucaucagcaaaac

SEQ ID NO: 2524067 - RNA, 19 nt, Chlamydophila pneumoniae CWL029
agacucucuuccaaaagua

SEQ ID NO: 2524068 - RNA, 13 nt, Chlamydophila pneumoniae CWL029
agacugaaaagau

SEQ ID NO: 2524069 - RNA, 18 nt, Chlamydophila pneumoniae CWL029
agacugcaaaggaaggga

SEQ ID NO: 2524070 - RNA, 22 nt, Chlamydophila pneumoniae CWL029
agacuguguuuuauccaccaag

SEQ ID NO: 2524071 - RNA, 21 nt, Chlamydophila pneumoniae CWL029
agacuuaaaguacguccugau

SEQ ID NO: 2524072 - RNA, 19 nt, Chlamydophila pneumoniae CWL029
agacuuccucuucaauuuc

SEQ ID NO: 2524073 - RNA, 20 nt, Chlamydophila pneumoniae CWL029
agacuucgaugucuuuccag

SEQ ID NO: 2524074 - RNA, 14 nt, Chlamydophila pneumoniae CWL029
agacuuguauucuu

SEQ ID NO: 2524075 - RNA, 18 nt, Chlamydophila pneumoniae CWL029
agacuuguauucuugaga

SEQ ID NO: 2524076 - RNA, 17 nt, Chlamydophila pneumoniae CWL029
agacuuuccucucuuua

SEQ ID NO: 2524077 - RNA, 14 nt, Chlamydophila pneumoniae CWL029
agagaacaggaggu

SEQ ID NO: 2524078 - RNA, 15 nt, Chlamydophila pneumoniae CWL029
agagaacgaacaguu

SEQ ID NO: 2524079 - RNA, 14 nt, Chlamydophila pneumoniae CWL029
agagaacuccauuc

SEQ ID NO: 2524080 - RNA, 22 nt, Chlamydophila pneumoniae CWL029
agagaacucuuaaagguaaagc

SEQ ID NO: 2524081 - RNA, 20 nt, Chlamydophila pneumoniae CWL029
agagaacuuuaacgaagaag

SEQ ID NO: 2524082 - RNA, 16 nt, Chlamydophila pneumoniae CWL029
agagaacuuuugaauu

SEQ ID NO: 2524083 - RNA, 18 nt, Chlamydophila pneumoniae CWL029
agagaacuuuugaauuaa

SEQ ID NO: 2524084 - RNA, 20 nt, Chlamydophila pneumoniae CWL029
agagaagagguguccauaau

SEQ ID NO: 2524085 - RNA, 17 nt, Chlamydophila pneumoniae CWL029
agagaagauuucuauag

SEQ ID NO: 2524086 - RNA, 23 nt, Chlamydophila pneumoniae CWL029
agagaauacauugcugccaggcu

SEQ ID NO: 2524087 - RNA, 22 nt, Chlamydophila pneumoniae CWL029
agagaauacucuagguuuucuc

SEQ ID NO: 2524088 - RNA, 21 nt, Chlamydophila pneumoniae CWL029
agagaauccuuuuuaggaaag

SEQ ID NO: 2524089 - RNA, 18 nt, Chlamydophila pneumoniae CWL029
agagaaucuccucaucag

SEQ ID NO: 2524090 - RNA, 15 nt, Chlamydophila pneumoniae CWL029
agagacaagaaaaua

SEQ ID NO: 2524091 - RNA, 18 nt, Chlamydophila pneumoniae CWL029
agagacaagaaaauauca

SEQ ID NO: 2524092 - RNA, 15 nt, Chlamydophila pneumoniae CWL029
agagacacagaagga

SEQ ID NO: 2524093 - RNA, 20 nt, Chlamydophila pneumoniae CWL029
agagacagccuguuuucuuc

SEQ ID NO: 2524094 - RNA, 13 nt, Chlamydophila pneumoniae CWL029
agagagaacagga

SEQ ID NO: 2524095 - RNA, 14 nt, Chlamydophila pneumoniae CWL029
agagagcaagauaa

SEQ ID NO: 2524096 - RNA, 22 nt, Chlamydophila pneumoniae CWL029
agagagcuugucacacugcgag

SEQ ID NO: 2524097 - RNA, 15 nt, Chlamydophila pneumoniae CWL029
agagaggguaagcug

SEQ ID NO: 2524098 - RNA, 17 nt, Chlamydophila pneumoniae CWL029
agagagucggcuuuaga

SEQ ID NO: 2524099 - RNA, 22 nt, Chlamydophila pneumoniae CWL029
agagagucggcuuuagaaaagu

SEQ ID NO: 2524100 - RNA, 20 nt, Chlamydophila pneumoniae CWL029
agagagugcguacucuucuu

SEQ ID NO: 2524101 - RNA, 23 nt, Chlamydophila pneumoniae CWL029
agagaguucuuguaauaaaagaa

SEQ ID NO: 2524102 - RNA, 18 nt, Chlamydophila pneumoniae CWL029
agagaguuuguaacucaa

SEQ ID NO: 2524103 - RNA, 23 nt, Chlamydophila pneumoniae CWL029
agagauagggggacaccugaaga

SEQ ID NO: 2524104 - RNA, 14 nt, Chlamydophila pneumoniae CWL029
agagaucacaggga

SEQ ID NO: 2524105 - RNA, 19 nt, Chlamydophila pneumoniae CWL029
agagaucuuuuuauuaaaa

SEQ ID NO: 2524106 - RNA, 22 nt, Chlamydophila pneumoniae CWL029
agagaugcaaauccuguagaaa

SEQ ID NO: 2524107 - RNA, 19 nt, Chlamydophila pneumoniae CWL029
agagauuaccgaagagccc

SEQ ID NO: 2524108 - RNA, 12 nt, Chlamydophila pneumoniae CWL029
agagauuuuucu

SEQ ID NO: 2524109 - RNA, 19 nt, Chlamydophila pneumoniae CWL029
agagauuuuucuaggaauc

SEQ ID NO: 2524110 - RNA, 23 nt, Chlamydophila pneumoniae CWL029
agagauuuuucuaggaaucuuuu

SEQ ID NO: 2524111 - RNA, 16 nt, Chlamydophila pneumoniae CWL029
agagauuuuuucauac

SEQ ID NO: 2524112 - RNA, 17 nt, Chlamydophila pneumoniae CWL029
agagcaaacaucaaaga

SEQ ID NO: 2524113 - RNA, 18 nt, Chlamydophila pneumoniae CWL029
agagcaauuaagaaacua

SEQ ID NO: 2524114 - RNA, 14 nt, Chlamydophila pneumoniae CWL029
agagcacauagaaa

SEQ ID NO: 2524115 - RNA, 22 nt, Chlamydophila pneumoniae CWL029
agagcacuuuuaauauuugaga

SEQ ID NO: 2524116 - RNA, 13 nt, Chlamydophila pneumoniae CWL029
agagcagaccucu

SEQ ID NO: 2524117 - RNA, 23 nt, Chlamydophila pneumoniae CWL029
agagcagcuuccugcuccucuuc

SEQ ID NO: 2524118 - RNA, 17 nt, Chlamydophila pneumoniae CWL029
agagcaugcuugaggaa

SEQ ID NO: 2524119 - RNA, 15 nt, Chlamydophila pneumoniae CWL029
agagccgucuacuuu

SEQ ID NO: 2524120 - RNA, 22 nt, Chlamydophila pneumoniae CWL029
agagccuuuucagauuuuuuaa

SEQ ID NO: 2524121 - RNA, 16 nt, Chlamydophila pneumoniae CWL029
agagcgaucgcaauca

SEQ ID NO: 2524122 - RNA, 16 nt, Chlamydophila pneumoniae CWL029
agagcgcguuucaaau

SEQ ID NO: 2524123 - RNA, 17 nt, Chlamydophila pneumoniae CWL029
agagcgcguuucaaaua

SEQ ID NO: 2524124 - RNA, 23 nt, Chlamydophila pneumoniae CWL029
agagcgcguuucaaauaggaucu

SEQ ID NO: 2524125 - RNA, 12 nt, Chlamydophila pneumoniae CWL029
agagcuaaagaa

SEQ ID NO: 2524126 - RNA, 21 nt, Chlamydophila pneumoniae CWL029
agagcuaaagaaacuucugac

SEQ ID NO: 2524127 - RNA, 18 nt, Chlamydophila pneumoniae CWL029
agagcuaacagcacguaa

SEQ ID NO: 2524128 - RNA, 15 nt, Chlamydophila pneumoniae CWL029
agagcuaugaugaga

SEQ ID NO: 2524129 - RNA, 19 nt, Chlamydophila pneumoniae CWL029
agagcucguaauccuucuu

SEQ ID NO: 2524130 - RNA, 14 nt, Chlamydophila pneumoniae CWL029
agagcuucuaaaaa

SEQ ID NO: 2524131 - RNA, 18 nt, Chlamydophila pneumoniae CWL029
agagcuucuaaaaacucu

SEQ ID NO: 2524132 - RNA, 15 nt, Chlamydophila pneumoniae CWL029
agagcuucuuuaucu

SEQ ID NO: 2524133 - RNA, 16 nt, Chlamydophila pneumoniae CWL029
agagcuugguuuucuc

SEQ ID NO: 2524134 - RNA, 19 nt, Chlamydophila pneumoniae CWL029
agagcuugguuuucuccuu

SEQ ID NO: 2524135 - RNA, 17 nt, Chlamydophila pneumoniae CWL029
agagcuuucagaaaaga

SEQ ID NO: 2524136 - RNA, 17 nt, Chlamydophila pneumoniae CWL029
agaggaaucuaagaacu

SEQ ID NO: 2524137 - RNA, 13 nt, Chlamydophila pneumoniae CWL029
agaggaaugaaga

SEQ ID NO: 2524138 - RNA, 18 nt, Chlamydophila pneumoniae CWL029
agaggaaugaagagaguu

SEQ ID NO: 2524139 - RNA, 21 nt, Chlamydophila pneumoniae CWL029
agaggacucccucaaaauuua

SEQ ID NO: 2524140 - RNA, 22 nt, Chlamydophila pneumoniae CWL029
agaggagacucuaguuuuucuu

SEQ ID NO: 2524141 - RNA, 12 nt, Chlamydophila pneumoniae CWL029
agaggagauccu

SEQ ID NO: 2524142 - RNA, 16 nt, Chlamydophila pneumoniae CWL029
agaggaucuagaaaau

SEQ ID NO: 2524143 - RNA, 13 nt, Chlamydophila pneumoniae CWL029
agaggccaccaaa

SEQ ID NO: 2524144 - RNA, 15 nt, Chlamydophila pneumoniae CWL029
agaggccaccaaaaa

SEQ ID NO: 2524145 - RNA, 16 nt, Chlamydophila pneumoniae CWL029
agaggcuguccuugca

SEQ ID NO: 2524146 - RNA, 17 nt, Chlamydophila pneumoniae CWL029
agaggcuuuaaauuuuu

SEQ ID NO: 2524147 - RNA, 14 nt, Chlamydophila pneumoniae CWL029
agagggaaggaaua

SEQ ID NO: 2524148 - RNA, 21 nt, Chlamydophila pneumoniae CWL029
agagggaucauguagcagagc

SEQ ID NO: 2524149 - RNA, 16 nt, Chlamydophila pneumoniae CWL029
agagggauuuguagga

SEQ ID NO: 2524150 - RNA, 20 nt, Chlamydophila pneumoniae CWL029
agaggggaaccaaggacgua

SEQ ID NO: 2524151 - RNA, 23 nt, Chlamydophila pneumoniae CWL029
agaggguuuuuuugcugcgaaug

SEQ ID NO: 2524152 - RNA, 21 nt, Chlamydophila pneumoniae CWL029
agaggucgaagauucaaagaa

SEQ ID NO: 2524153 - RNA, 17 nt, Chlamydophila pneumoniae CWL029
agaggucuuugaguagc

SEQ ID NO: 2524154 - RNA, 22 nt, Chlamydophila pneumoniae CWL029
agagguucuugcuuauugucuu

SEQ ID NO: 2524155 - RNA, 13 nt, Chlamydophila pneumoniae CWL029
agaguaaagagua

SEQ ID NO: 2524156 - RNA, 17 nt, Chlamydophila pneumoniae CWL029
agaguagacaagagaga

SEQ ID NO: 2524157 - RNA, 19 nt, Chlamydophila pneumoniae CWL029
agaguagcucaucuagaaa

SEQ ID NO: 2524158 - RNA, 16 nt, Chlamydophila pneumoniae CWL029
agaguauuagcgagua

SEQ ID NO: 2524159 - RNA, 19 nt, Chlamydophila pneumoniae CWL029
agaguauuagcgaguacuu

SEQ ID NO: 2524160 - RNA, 14 nt, Chlamydophila pneumoniae CWL029
agagucacuagcag

SEQ ID NO: 2524161 - RNA, 16 nt, Chlamydophila pneumoniae CWL029
agaguccugggguucu

SEQ ID NO: 2524162 - RNA, 23 nt, Chlamydophila pneumoniae CWL029
agagucucacucuuuucuagaaa

SEQ ID NO: 2524163 - RNA, 21 nt, Chlamydophila pneumoniae CWL029
agagucucuuucagcucaagu

SEQ ID NO: 2524164 - RNA, 14 nt, Chlamydophila pneumoniae CWL029
agagucugcagcag

SEQ ID NO: 2524165 - RNA, 23 nt, Chlamydophila pneumoniae CWL029
agagucuucguuucuuugaguua

SEQ ID NO: 2524166 - RNA, 23 nt, Chlamydophila pneumoniae CWL029
agagucuugcagacggggaucua

SEQ ID NO: 2524167 - RNA, 18 nt, Chlamydophila pneumoniae CWL029
agagucuuugaugcuaaa

SEQ ID NO: 2524168 - RNA, 16 nt, Chlamydophila pneumoniae CWL029
agagugaccauagcau

SEQ ID NO: 2524169 - RNA, 20 nt, Chlamydophila pneumoniae CWL029
agagugaccauagcauagag

SEQ ID NO: 2524170 - RNA, 16 nt, Chlamydophila pneumoniae CWL029
agagugacucaucagu

SEQ ID NO: 2524171 - RNA, 20 nt, Chlamydophila pneumoniae CWL029
agaguggucauugccuugcu

SEQ ID NO: 2524172 - RNA, 15 nt, Chlamydophila pneumoniae CWL029
agagugugccagaau

SEQ ID NO: 2524173 - RNA, 20 nt, Chlamydophila pneumoniae CWL029
agaguguuguuggagcagaa

SEQ ID NO: 2524174 - RNA, 20 nt, Chlamydophila pneumoniae CWL029
agaguuccaagacaauaaaa

SEQ ID NO: 2524175 - RNA, 17 nt, Chlamydophila pneumoniae CWL029
agaguuccgcaaauaca

SEQ ID NO: 2524176 - RNA, 21 nt, Chlamydophila pneumoniae CWL029
agaguucgcacuaauuuccuu

SEQ ID NO: 2524177 - RNA, 23 nt, Chlamydophila pneumoniae CWL029
agaguucgcacuaauuuccuuca

SEQ ID NO: 2524178 - RNA, 21 nt, Chlamydophila pneumoniae CWL029
agaguuggaucauucuuuaua

SEQ ID NO: 2524179 - RNA, 21 nt, Chlamydophila pneumoniae CWL029
agaguuucuuuugauugaaac

SEQ ID NO: 2524180 - RNA, 14 nt, Chlamydophila pneumoniae CWL029
agaguuuuucccuc

SEQ ID NO: 2524181 - RNA, 20 nt, Chlamydophila pneumoniae CWL029
agaguuuuuguguuugacug

SEQ ID NO: 2524182 - RNA, 13 nt, Chlamydophila pneumoniae CWL029
agauaaacauaca

SEQ ID NO: 2524183 - RNA, 13 nt, Chlamydophila pneumoniae CWL029
agauaaagaauuc

SEQ ID NO: 2524184 - RNA, 17 nt, Chlamydophila pneumoniae CWL029
agauaaagcaaagauaa

SEQ ID NO: 2524185 - RNA, 12 nt, Chlamydophila pneumoniae CWL029
agauaaaggcau

SEQ ID NO: 2524186 - RNA, 14 nt, Chlamydophila pneumoniae CWL029
agauaaaggcauaa

SEQ ID NO: 2524187 - RNA, 23 nt, Chlamydophila pneumoniae CWL029
agauaaauccccaccaacaaugc

SEQ ID NO: 2524188 - RNA, 13 nt, Chlamydophila pneumoniae CWL029
agauaagauaaac

SEQ ID NO: 2524189 - RNA, 19 nt, Chlamydophila pneumoniae CWL029
agauaaguuacuuucugau

SEQ ID NO: 2524190 - RNA, 12 nt, Chlamydophila pneumoniae CWL029
agauaauagaga

SEQ ID NO: 2524191 - RNA, 13 nt, Chlamydophila pneumoniae CWL029
agauaauuaugua

SEQ ID NO: 2524192 - RNA, 13 nt, Chlamydophila pneumoniae CWL029
agauaccaucaag

SEQ ID NO: 2524193 - RNA, 15 nt, Chlamydophila pneumoniae CWL029
agauacgcuuacaaa

SEQ ID NO: 2524194 - RNA, 19 nt, Chlamydophila pneumoniae CWL029
agauacgcuuacaaauaac

SEQ ID NO: 2524195 - RNA, 15 nt, Chlamydophila pneumoniae CWL029
agauacggaggauua

SEQ ID NO: 2524196 - RNA, 17 nt, Chlamydophila pneumoniae CWL029
agauacggguucguuuc

SEQ ID NO: 2524197 - RNA, 15 nt, Chlamydophila pneumoniae CWL029
agauacguuuccccc

SEQ ID NO: 2524198 - RNA, 16 nt, Chlamydophila pneumoniae CWL029
agauacuuaucuuuaa

SEQ ID NO: 2524199 - RNA, 18 nt, Chlamydophila pneumoniae CWL029
agauacuucuccacagcu

SEQ ID NO: 2524200 - RNA, 18 nt, Chlamydophila pneumoniae CWL029
agauacuuugcaauacac

SEQ ID NO: 2524201 - RNA, 12 nt, Chlamydophila pneumoniae CWL029
agauagagcgac

SEQ ID NO: 2524202 - RNA, 18 nt, Chlamydophila pneumoniae CWL029
agauagcgacgucaucau

SEQ ID NO: 2524203 - RNA, 14 nt, Chlamydophila pneumoniae CWL029
agauagcucuugcg

SEQ ID NO: 2524204 - RNA, 22 nt, Chlamydophila pneumoniae CWL029
agauaggaacucacaaacaaca

SEQ ID NO: 2524205 - RNA, 23 nt, Chlamydophila pneumoniae CWL029
agauaggaacucacaaacaacag

SEQ ID NO: 2524206 - RNA, 18 nt, Chlamydophila pneumoniae CWL029
agauaggauggaguacuu

SEQ ID NO: 2524207 - RNA, 17 nt, Chlamydophila pneumoniae CWL029
agauaggguaagauugc

SEQ ID NO: 2524208 - RNA, 11 nt, Chlamydophila pneumoniae CWL029
agauagucuug

SEQ ID NO: 2524209 - RNA, 15 nt, Chlamydophila pneumoniae CWL029
agauaguuauuaaua

SEQ ID NO: 2524210 - RNA, 19 nt, Chlamydophila pneumoniae CWL029
agauaguucacaagugcau

SEQ ID NO: 2524211 - RNA, 21 nt, Chlamydophila pneumoniae CWL029
agauaguucacaagugcauua

SEQ ID NO: 2524212 - RNA, 14 nt, Chlamydophila pneumoniae CWL029
agauauagauucau

SEQ ID NO: 2524213 - RNA, 19 nt, Chlamydophila pneumoniae CWL029
agauauagcguacaggaag

SEQ ID NO: 2524214 - RNA, 16 nt, Chlamydophila pneumoniae CWL029
agauauauuuuuaaag

SEQ ID NO: 2524215 - RNA, 15 nt, Chlamydophila pneumoniae CWL029
agauaugaagagacg

SEQ ID NO: 2524216 - RNA, 19 nt, Chlamydophila pneumoniae CWL029
agauaugccucaggucugc

SEQ ID NO: 2524217 - RNA, 23 nt, Chlamydophila pneumoniae CWL029
agauaugccucaggucugcugag

SEQ ID NO: 2524218 - RNA, 13 nt, Chlamydophila pneumoniae CWL029
agaucaaaaauag

SEQ ID NO: 2524219 - RNA, 14 nt, Chlamydophila pneumoniae CWL029
agaucacaagaaag

SEQ ID NO: 2524220 - RNA, 14 nt, Chlamydophila pneumoniae CWL029
agaucacaucaaga

SEQ ID NO: 2524221 - RNA, 17 nt, Chlamydophila pneumoniae CWL029
agaucacaucaagauag

SEQ ID NO: 2524222 - RNA, 20 nt, Chlamydophila pneumoniae CWL029
agaucagaggaaucuaagaa

SEQ ID NO: 2524223 - RNA, 12 nt, Chlamydophila pneumoniae CWL029
agaucagcuccc

SEQ ID NO: 2524224 - RNA, 15 nt, Chlamydophila pneumoniae CWL029
agaucauaaacagca

SEQ ID NO: 2524225 - RNA, 13 nt, Chlamydophila pneumoniae CWL029
agaucauaucuua

SEQ ID NO: 2524226 - RNA, 22 nt, Chlamydophila pneumoniae CWL029
agaucaucuacgauguuuucuu

SEQ ID NO: 2524227 - RNA, 18 nt, Chlamydophila pneumoniae CWL029
agaucauuagcaucaucu

SEQ ID NO: 2524228 - RNA, 19 nt, Chlamydophila pneumoniae CWL029
agaucauuagcaucaucuc

SEQ ID NO: 2524229 - RNA, 13 nt, Chlamydophila pneumoniae CWL029
agauccaaaaauu

SEQ ID NO: 2524230 - RNA, 15 nt, Chlamydophila pneumoniae CWL029
agauccaaagacgua

SEQ ID NO: 2524231 - RNA, 13 nt, Chlamydophila pneumoniae CWL029
agauccaugaaca

SEQ ID NO: 2524232 - RNA, 17 nt, Chlamydophila pneumoniae CWL029
agauccaugaacagcau

SEQ ID NO: 2524233 - RNA, 13 nt, Chlamydophila pneumoniae CWL029
agaucccagaaga

SEQ ID NO: 2524234 - RNA, 15 nt, Chlamydophila pneumoniae CWL029
agauccgauauacuu

SEQ ID NO: 2524235 - RNA, 21 nt, Chlamydophila pneumoniae CWL029
agauccgauauacuuauacca

SEQ ID NO: 2524236 - RNA, 19 nt, Chlamydophila pneumoniae CWL029
agauccuaagagauuuucc

SEQ ID NO: 2524237 - RNA, 16 nt, Chlamydophila pneumoniae CWL029
agauccuagagaaugu

SEQ ID NO: 2524238 - RNA, 15 nt, Chlamydophila pneumoniae CWL029
agauccugaaaguac

SEQ ID NO: 2524239 - RNA, 17 nt, Chlamydophila pneumoniae CWL029
agauccuuuaaagauuc

SEQ ID NO: 2524240 - RNA, 21 nt, Chlamydophila pneumoniae CWL029
agauccuuuaaagauucccca

SEQ ID NO: 2524241 - RNA, 18 nt, Chlamydophila pneumoniae CWL029
agaucgagaucauuagca

SEQ ID NO: 2524242 - RNA, 13 nt, Chlamydophila pneumoniae CWL029
agaucguuaucaa

SEQ ID NO: 2524243 - RNA, 14 nt, Chlamydophila pneumoniae CWL029
agaucuacaucaaa

SEQ ID NO: 2524244 - RNA, 15 nt, Chlamydophila pneumoniae CWL029
agaucuacaucaaau

SEQ ID NO: 2524245 - RNA, 20 nt, Chlamydophila pneumoniae CWL029
agaucucgucuuggaaugcu

SEQ ID NO: 2524246 - RNA, 19 nt, Chlamydophila pneumoniae CWL029
agaucucuugaagcacuuu

SEQ ID NO: 2524247 - RNA, 13 nt, Chlamydophila pneumoniae CWL029
agaucucuuuagc

SEQ ID NO: 2524248 - RNA, 20 nt, Chlamydophila pneumoniae CWL029
agaucugcaaacgcaaugau

SEQ ID NO: 2524249 - RNA, 22 nt, Chlamydophila pneumoniae CWL029
agaucugcaaacgcaaugauuu

SEQ ID NO: 2524250 - RNA, 17 nt, Chlamydophila pneumoniae CWL029
agaucugcauaauuuuu

SEQ ID NO: 2524251 - RNA, 13 nt, Chlamydophila pneumoniae CWL029
agaucuucauaac

SEQ ID NO: 2524252 - RNA, 13 nt, Chlamydophila pneumoniae CWL029
agaucuucaucac

SEQ ID NO: 2524253 - RNA, 21 nt, Chlamydophila pneumoniae CWL029
agaucuucaucacaaaauuca

SEQ ID NO: 2524254 - RNA, 16 nt, Chlamydophila pneumoniae CWL029
agaucuucugaaauca

SEQ ID NO: 2524255 - RNA, 18 nt, Chlamydophila pneumoniae CWL029
agaucuucugaaaucaaa

SEQ ID NO: 2524256 - RNA, 15 nt, Chlamydophila pneumoniae CWL029
agaucuugaacagag

SEQ ID NO: 2524257 - RNA, 16 nt, Chlamydophila pneumoniae CWL029
agaucuuuagaauaag

SEQ ID NO: 2524258 - RNA, 19 nt, Chlamydophila pneumoniae CWL029
agaucuuuaucauugcuau

SEQ ID NO: 2524259 - RNA, 21 nt, Chlamydophila pneumoniae CWL029
agaucuuuauuuuuaaaaaua

SEQ ID NO: 2524260 - RNA, 23 nt, Chlamydophila pneumoniae CWL029
agaucuuuucuacuucaggaaau

SEQ ID NO: 2524261 - RNA, 14 nt, Chlamydophila pneumoniae CWL029
agaucuuuuugcca

SEQ ID NO: 2524262 - RNA, 15 nt, Chlamydophila pneumoniae CWL029
agaucuuuuugccag

SEQ ID NO: 2524263 - RNA, 13 nt, Chlamydophila pneumoniae CWL029
agaugaagaaacu

SEQ ID NO: 2524264 - RNA, 12 nt, Chlamydophila pneumoniae CWL029
agaugaagagug

SEQ ID NO: 2524265 - RNA, 18 nt, Chlamydophila pneumoniae CWL029
agaugaauaccagaagca

SEQ ID NO: 2524266 - RNA, 23 nt, Chlamydophila pneumoniae CWL029
agaugaauaccagaagcaaaggu

SEQ ID NO: 2524267 - RNA, 20 nt, Chlamydophila pneumoniae CWL029
agaugagaaaaucugcagca

SEQ ID NO: 2524268 - RNA, 22 nt, Chlamydophila pneumoniae CWL029
agaugcaaauccuguagaaaca

SEQ ID NO: 2524269 - RNA, 20 nt, Chlamydophila pneumoniae CWL029
agaugcuauuuacugaaaca

SEQ ID NO: 2524270 - RNA, 22 nt, Chlamydophila pneumoniae CWL029
agaugcuauuuacugaaacauu

SEQ ID NO: 2524271 - RNA, 23 nt, Chlamydophila pneumoniae CWL029
agaugcuucuaaacaauuucaau

SEQ ID NO: 2524272 - RNA, 16 nt, Chlamydophila pneumoniae CWL029
agaugggcuaacuuau

SEQ ID NO: 2524273 - RNA, 13 nt, Chlamydophila pneumoniae CWL029
agaugucuagaaa

SEQ ID NO: 2524274 - RNA, 13 nt, Chlamydophila pneumoniae CWL029
agaugucuugguu

SEQ ID NO: 2524275 - RNA, 17 nt, Chlamydophila pneumoniae CWL029
agauuaugaugccucau

SEQ ID NO: 2524276 - RNA, 13 nt, Chlamydophila pneumoniae CWL029
agauucaaagaag

SEQ ID NO: 2524277 - RNA, 19 nt, Chlamydophila pneumoniae CWL029
agauucaccaagaacaaua

SEQ ID NO: 2524278 - RNA, 16 nt, Chlamydophila pneumoniae CWL029
agauucauaaaacugu

SEQ ID NO: 2524279 - RNA, 21 nt, Chlamydophila pneumoniae CWL029
agauucaugaaaugcuuucag

SEQ ID NO: 2524280 - RNA, 15 nt, Chlamydophila pneumoniae CWL029
agauucauuaauguu

SEQ ID NO: 2524281 - RNA, 16 nt, Chlamydophila pneumoniae CWL029
agauucuaaaucaacu

SEQ ID NO: 2524282 - RNA, 14 nt, Chlamydophila pneumoniae CWL029
agauucugaagaga

SEQ ID NO: 2524283 - RNA, 16 nt, Chlamydophila pneumoniae CWL029
agauucugaagagaga

SEQ ID NO: 2524284 - RNA, 16 nt, Chlamydophila pneumoniae CWL029
agauugaaucccauca

SEQ ID NO: 2524285 - RNA, 16 nt, Chlamydophila pneumoniae CWL029
agauugaauucaucca

SEQ ID NO: 2524286 - RNA, 17 nt, Chlamydophila pneumoniae CWL029
agauugaggauaaguuc

SEQ ID NO: 2524287 - RNA, 23 nt, Chlamydophila pneumoniae CWL029
agauugaugcugacagcuccauu

SEQ ID NO: 2524288 - RNA, 17 nt, Chlamydophila pneumoniae CWL029
agauugauuucuugcuu

SEQ ID NO: 2524289 - RNA, 23 nt, Chlamydophila pneumoniae CWL029
agauugcacuugcgguuuuggau

SEQ ID NO: 2524290 - RNA, 19 nt, Chlamydophila pneumoniae CWL029
agauugccaggagagcuaa

SEQ ID NO: 2524291 - RNA, 17 nt, Chlamydophila pneumoniae CWL029
agauugguaaggagagu

SEQ ID NO: 2524292 - RNA, 15 nt, Chlamydophila pneumoniae CWL029
agauuguaauuuccu

SEQ ID NO: 2524293 - RNA, 16 nt, Chlamydophila pneumoniae CWL029
agauuguaauuuccuu

SEQ ID NO: 2524294 - RNA, 19 nt, Chlamydophila pneumoniae CWL029
agauugugcucaauacaga

SEQ ID NO: 2524295 - RNA, 17 nt, Chlamydophila pneumoniae CWL029
agauuguucaaaaauag

SEQ ID NO: 2524296 - RNA, 18 nt, Chlamydophila pneumoniae CWL029
agauuguucaaaaauaga

SEQ ID NO: 2524297 - RNA, 23 nt, Chlamydophila pneumoniae CWL029
agauuguucaaaaauagauaaga

SEQ ID NO: 2524298 - RNA, 18 nt, Chlamydophila pneumoniae CWL029
agauuguuucaggccugg

SEQ ID NO: 2524299 - RNA, 16 nt, Chlamydophila pneumoniae CWL029
agauuuauuuugucuu

SEQ ID NO: 2524300 - RNA, 20 nt, Chlamydophila pneumoniae CWL029
agauuuccuuaagcuucuga

SEQ ID NO: 2524301 - RNA, 14 nt, Chlamydophila pneumoniae CWL029
agauuucuaauccu

SEQ ID NO: 2524302 - RNA, 17 nt, Chlamydophila pneumoniae CWL029
agauuucuaauccucca

SEQ ID NO: 2524303 - RNA, 16 nt, Chlamydophila pneumoniae CWL029
agauuuguuagagcuu

SEQ ID NO: 2524304 - RNA, 14 nt, Chlamydophila pneumoniae CWL029
agauuuuaaagccu

SEQ ID NO: 2524305 - RNA, 22 nt, Chlamydophila pneumoniae CWL029
agauuuuaaagccuccucaaga

SEQ ID NO: 2524306 - RNA, 22 nt, Chlamydophila pneumoniae CWL029
agauuuuaggggguuuuucuau

SEQ ID NO: 2524307 - RNA, 19 nt, Chlamydophila pneumoniae CWL029
agauuuugagaaugaacaa

SEQ ID NO: 2524308 - RNA, 18 nt, Chlamydophila pneumoniae CWL029
agauuuuggagacacacu

SEQ ID NO: 2524309 - RNA, 22 nt, Chlamydophila pneumoniae CWL029
agauuuuggagacacacuuucu

SEQ ID NO: 2524310 - RNA, 22 nt, Chlamydophila pneumoniae CWL029
agauuuuuuaaccucuuuucuu

SEQ ID NO: 2524311 - RNA, 14 nt, Chlamydophila pneumoniae CWL029
agauuuuuucuugg

SEQ ID NO: 2524312 - RNA, 17 nt, Chlamydophila pneumoniae CWL029
agcaaaaauuguuuuug

SEQ ID NO: 2524313 - RNA, 23 nt, Chlamydophila pneumoniae CWL029
agcaaaacuguguucaauagcaa

SEQ ID NO: 2524314 - RNA, 17 nt, Chlamydophila pneumoniae CWL029
agcaaacaucaaagaga

SEQ ID NO: 2524315 - RNA, 18 nt, Chlamydophila pneumoniae CWL029
agcaaacggaacuaaaga

SEQ ID NO: 2524316 - RNA, 15 nt, Chlamydophila pneumoniae CWL029
agcaaacggagagca

SEQ ID NO: 2524317 - RNA, 21 nt, Chlamydophila pneumoniae CWL029
agcaaagaacacccccgcagc

SEQ ID NO: 2524318 - RNA, 16 nt, Chlamydophila pneumoniae CWL029
agcaaagagcaaggaa

SEQ ID NO: 2524319 - RNA, 15 nt, Chlamydophila pneumoniae CWL029
agcaaagauaaagaa

SEQ ID NO: 2524320 - RNA, 17 nt, Chlamydophila pneumoniae CWL029
agcaaagauaaagaagu

SEQ ID NO: 2524321 - RNA, 14 nt, Chlamydophila pneumoniae CWL029
agcaaagcggcucu

SEQ ID NO: 2524322 - RNA, 17 nt, Chlamydophila pneumoniae CWL029
agcaaagguaaauugac

SEQ ID NO: 2524323 - RNA, 22 nt, Chlamydophila pneumoniae CWL029
agcaaaguuaaugcaagcaacu

SEQ ID NO: 2524324 - RNA, 19 nt, Chlamydophila pneumoniae CWL029
agcaaaucuaaaaccugac

SEQ ID NO: 2524325 - RNA, 15 nt, Chlamydophila pneumoniae CWL029
agcaacaaccaaaag

SEQ ID NO: 2524326 - RNA, 19 nt, Chlamydophila pneumoniae CWL029
agcaacaguaauuauuuuc

SEQ ID NO: 2524327 - RNA, 16 nt, Chlamydophila pneumoniae CWL029
agcaacccgaauuccu

SEQ ID NO: 2524328 - RNA, 14 nt, Chlamydophila pneumoniae CWL029
agcaaccuuuccua

SEQ ID NO: 2524329 - RNA, 15 nt, Chlamydophila pneumoniae CWL029
agcaacgcaugacgc

SEQ ID NO: 2524330 - RNA, 19 nt, Chlamydophila pneumoniae CWL029
agcaacgcaugacgcuuuu

SEQ ID NO: 2524331 - RNA, 20 nt, Chlamydophila pneumoniae CWL029
agcaacuacagagggcuuca

SEQ ID NO: 2524332 - RNA, 22 nt, Chlamydophila pneumoniae CWL029
agcaacuucccgaacagcggca

SEQ ID NO: 2524333 - RNA, 19 nt, Chlamydophila pneumoniae CWL029
agcaagaaaauaggugacu

SEQ ID NO: 2524334 - RNA, 14 nt, Chlamydophila pneumoniae CWL029
agcaagaacauaac

SEQ ID NO: 2524335 - RNA, 15 nt, Chlamydophila pneumoniae CWL029
agcaagaaucacugc

SEQ ID NO: 2524336 - RNA, 18 nt, Chlamydophila pneumoniae CWL029
agcaagagcuauaccuau

SEQ ID NO: 2524337 - RNA, 17 nt, Chlamydophila pneumoniae CWL029
agcaagagcucuugaga

SEQ ID NO: 2524338 - RNA, 19 nt, Chlamydophila pneumoniae CWL029
agcaagauaaucauuaaga

SEQ ID NO: 2524339 - RNA, 12 nt, Chlamydophila pneumoniae CWL029
agcaagauggca

SEQ ID NO: 2524340 - RNA, 17 nt, Chlamydophila pneumoniae CWL029
agcaagauuuuguagga

SEQ ID NO: 2524341 - RNA, 17 nt, Chlamydophila pneumoniae CWL029
agcaaggaaaaaaaauc

SEQ ID NO: 2524342 - RNA, 17 nt, Chlamydophila pneumoniae CWL029
agcaagguaacauccau

SEQ ID NO: 2524343 - RNA, 18 nt, Chlamydophila pneumoniae CWL029
agcaagguaacauccaua

SEQ ID NO: 2524344 - RNA, 23 nt, Chlamydophila pneumoniae CWL029
agcaagguaacauccauagagaa

SEQ ID NO: 2524345 - RNA, 22 nt, Chlamydophila pneumoniae CWL029
agcaauccauaguccuagcaga

SEQ ID NO: 2524346 - RNA, 21 nt, Chlamydophila pneumoniae CWL029
agcaaucccccagcauucacu

SEQ ID NO: 2524347 - RNA, 15 nt, Chlamydophila pneumoniae CWL029
agcaaucgaauagcu

SEQ ID NO: 2524348 - RNA, 18 nt, Chlamydophila pneumoniae CWL029
agcaaucguguuuuccug

SEQ ID NO: 2524349 - RNA, 21 nt, Chlamydophila pneumoniae CWL029
agcaaucuguauccgacucug

SEQ ID NO: 2524350 - RNA, 20 nt, Chlamydophila pneumoniae CWL029
agcaaugccucuaauacguu

SEQ ID NO: 2524351 - RNA, 19 nt, Chlamydophila pneumoniae CWL029
agcaauggcuuuuuuuguc

SEQ ID NO: 2524352 - RNA, 14 nt, Chlamydophila pneumoniae CWL029
agcacauagagugu

SEQ ID NO: 2524353 - RNA, 13 nt, Chlamydophila pneumoniae CWL029
agcacauuuuucu

SEQ ID NO: 2524354 - RNA, 19 nt, Chlamydophila pneumoniae CWL029
agcaccacgaccuauacca

SEQ ID NO: 2524355 - RNA, 14 nt, Chlamydophila pneumoniae CWL029
agcaccauaaugga

SEQ ID NO: 2524356 - RNA, 18 nt, Chlamydophila pneumoniae CWL029
agcaccuaauaaagaagg

SEQ ID NO: 2524357 - RNA, 21 nt, Chlamydophila pneumoniae CWL029
agcaccuaauaaagaagguug

SEQ ID NO: 2524358 - RNA, 19 nt, Chlamydophila pneumoniae CWL029
agcacgagcgggagaauca

SEQ ID NO: 2524359 - RNA, 19 nt, Chlamydophila pneumoniae CWL029
agcacucacgcucucgcua

SEQ ID NO: 2524360 - RNA, 20 nt, Chlamydophila pneumoniae CWL029
agcacucacgcucucgcuaa

SEQ ID NO: 2524361 - RNA, 19 nt, Chlamydophila pneumoniae CWL029
agcacucuuaauuaaaaac

SEQ ID NO: 2524362 - RNA, 18 nt, Chlamydophila pneumoniae CWL029
agcacucuuuuucuaaga

SEQ ID NO: 2524363 - RNA, 12 nt, Chlamydophila pneumoniae CWL029
agcacugaugaa

SEQ ID NO: 2524364 - RNA, 15 nt, Chlamydophila pneumoniae CWL029
agcacugaugaaaaa

SEQ ID NO: 2524365 - RNA, 13 nt, Chlamydophila pneumoniae CWL029
agcacuuaaaaaa

SEQ ID NO: 2524366 - RNA, 17 nt, Chlamydophila pneumoniae CWL029
agcacuucuuuaggagc

SEQ ID NO: 2524367 - RNA, 13 nt, Chlamydophila pneumoniae CWL029
agcagaaacucca

SEQ ID NO: 2524368 - RNA, 15 nt, Chlamydophila pneumoniae CWL029
agcagaaacuccaaa

SEQ ID NO: 2524369 - RNA, 20 nt, Chlamydophila pneumoniae CWL029
agcagaaguccuaucaaagc

SEQ ID NO: 2524370 - RNA, 18 nt, Chlamydophila pneumoniae CWL029
agcagaaucauaaucugc

SEQ ID NO: 2524371 - RNA, 18 nt, Chlamydophila pneumoniae CWL029
agcagaccucucccuugg

SEQ ID NO: 2524372 - RNA, 16 nt, Chlamydophila pneumoniae CWL029
agcagacgaauaacua

SEQ ID NO: 2524373 - RNA, 17 nt, Chlamydophila pneumoniae CWL029
agcagaguuuuucccuc

SEQ ID NO: 2524374 - RNA, 16 nt, Chlamydophila pneumoniae CWL029
agcagauagagcuucu

SEQ ID NO: 2524375 - RNA, 21 nt, Chlamydophila pneumoniae CWL029
agcagauccugcuucuauaga

SEQ ID NO: 2524376 - RNA, 17 nt, Chlamydophila pneumoniae CWL029
agcagaugaaacuuuag

SEQ ID NO: 2524377 - RNA, 13 nt, Chlamydophila pneumoniae CWL029
agcagcaagaaca

SEQ ID NO: 2524378 - RNA, 14 nt, Chlamydophila pneumoniae CWL029
agcagcaagaacau

SEQ ID NO: 2524379 - RNA, 18 nt, Chlamydophila pneumoniae CWL029
agcagcccgcacaucaug

SEQ ID NO: 2524380 - RNA, 18 nt, Chlamydophila pneumoniae CWL029
agcaggaaaagcaaaaug

SEQ ID NO: 2524381 - RNA, 21 nt, Chlamydophila pneumoniae CWL029
agcaggaaggaauagagaaag

SEQ ID NO: 2524382 - RNA, 22 nt, Chlamydophila pneumoniae CWL029
agcaggaauaaucaaccaaaau

SEQ ID NO: 2524383 - RNA, 22 nt, Chlamydophila pneumoniae CWL029
agcaggauaaccaucaaucacu

SEQ ID NO: 2524384 - RNA, 19 nt, Chlamydophila pneumoniae CWL029
agcaguauagagaagauuu

SEQ ID NO: 2524385 - RNA, 17 nt, Chlamydophila pneumoniae CWL029
agcaguugcaauaccaa

SEQ ID NO: 2524386 - RNA, 14 nt, Chlamydophila pneumoniae CWL029
agcauaaacaaagc

SEQ ID NO: 2524387 - RNA, 17 nt, Chlamydophila pneumoniae CWL029
agcauaacuugaagaag

SEQ ID NO: 2524388 - RNA, 21 nt, Chlamydophila pneumoniae CWL029
agcauaacuugaagaaguaca

SEQ ID NO: 2524389 - RNA, 19 nt, Chlamydophila pneumoniae CWL029
agcauaaggauucugagaa

SEQ ID NO: 2524390 - RNA, 18 nt, Chlamydophila pneumoniae CWL029
agcauaaggggagucuug

SEQ ID NO: 2524391 - RNA, 15 nt, Chlamydophila pneumoniae CWL029
agcauaaucuuuaac

SEQ ID NO: 2524392 - RNA, 15 nt, Chlamydophila pneumoniae CWL029
agcauaccuuggaaa

SEQ ID NO: 2524393 - RNA, 13 nt, Chlamydophila pneumoniae CWL029
agcauagagagaa

SEQ ID NO: 2524394 - RNA, 23 nt, Chlamydophila pneumoniae CWL029
agcauagcccgaaauucauuaaa

SEQ ID NO: 2524395 - RNA, 22 nt, Chlamydophila pneumoniae CWL029
agcauaguguauaucagcaaaa

SEQ ID NO: 2524396 - RNA, 23 nt, Chlamydophila pneumoniae CWL029
agcaucacggaguguuugaagau

SEQ ID NO: 2524397 - RNA, 19 nt, Chlamydophila pneumoniae CWL029
agcaucaggauucucucug

SEQ ID NO: 2524398 - RNA, 22 nt, Chlamydophila pneumoniae CWL029
agcauccaaaaugucuuuuuca

SEQ ID NO: 2524399 - RNA, 13 nt, Chlamydophila pneumoniae CWL029
agcaucucaagag

SEQ ID NO: 2524400 - RNA, 14 nt, Chlamydophila pneumoniae CWL029
agcaucucucucca

SEQ ID NO: 2524401 - RNA, 22 nt, Chlamydophila pneumoniae CWL029
agcaucugagucauaagcucua

SEQ ID NO: 2524402 - RNA, 23 nt, Chlamydophila pneumoniae CWL029
agcaucugagucauaagcucuau

SEQ ID NO: 2524403 - RNA, 15 nt, Chlamydophila pneumoniae CWL029
agcaugaagcagaaa

SEQ ID NO: 2524404 - RNA, 15 nt, Chlamydophila pneumoniae CWL029
agcaugaugccauug

SEQ ID NO: 2524405 - RNA, 15 nt, Chlamydophila pneumoniae CWL029
agcauggacuccaag

SEQ ID NO: 2524406 - RNA, 17 nt, Chlamydophila pneumoniae CWL029
agcauggacuccaagaa

SEQ ID NO: 2524407 - RNA, 19 nt, Chlamydophila pneumoniae CWL029
agcauggacuccaagaaua

SEQ ID NO: 2524408 - RNA, 23 nt, Chlamydophila pneumoniae CWL029
agcauggagaauaaucucuuuca

SEQ ID NO: 2524409 - RNA, 15 nt, Chlamydophila pneumoniae CWL029
agcaugugcagaagg

SEQ ID NO: 2524410 - RNA, 22 nt, Chlamydophila pneumoniae CWL029
agcauguuauauagacaaugca

SEQ ID NO: 2524411 - RNA, 20 nt, Chlamydophila pneumoniae CWL029
agcauguucgauuuucucuu

SEQ ID NO: 2524412 - RNA, 18 nt, Chlamydophila pneumoniae CWL029
agcauuggacaacgcuuc

SEQ ID NO: 2524413 - RNA, 22 nt, Chlamydophila pneumoniae CWL029
agcauugucgaguauaauugac

SEQ ID NO: 2524414 - RNA, 22 nt, Chlamydophila pneumoniae CWL029
agcauuguuuguccuaggagag

SEQ ID NO: 2524415 - RNA, 21 nt, Chlamydophila pneumoniae CWL029
agcauuucucuaugagaacgu

SEQ ID NO: 2524416 - RNA, 16 nt, Chlamydophila pneumoniae CWL029
agcauuuuauccacug

SEQ ID NO: 2524417 - RNA, 13 nt, Chlamydophila pneumoniae CWL029
agcauuuucucug

SEQ ID NO: 2524418 - RNA, 16 nt, Chlamydophila pneumoniae CWL029
agcauuuucucugagc

SEQ ID NO: 2524419 - RNA, 20 nt, Chlamydophila pneumoniae CWL029
agccaaaaccaauuucuccg

SEQ ID NO: 2524420 - RNA, 17 nt, Chlamydophila pneumoniae CWL029
agccaaagucacucaaa

SEQ ID NO: 2524421 - RNA, 15 nt, Chlamydophila pneumoniae CWL029
agccaagaaaacaua

SEQ ID NO: 2524422 - RNA, 13 nt, Chlamydophila pneumoniae CWL029
agccacagagaau

SEQ ID NO: 2524423 - RNA, 15 nt, Chlamydophila pneumoniae CWL029
agccaccaucuguug

SEQ ID NO: 2524424 - RNA, 20 nt, Chlamydophila pneumoniae CWL029
agccauaauuagaacagcau

SEQ ID NO: 2524425 - RNA, 16 nt, Chlamydophila pneumoniae CWL029
agccauagaggaauga

SEQ ID NO: 2524426 - RNA, 18 nt, Chlamydophila pneumoniae CWL029
agccaucgcgaagcuuuc

SEQ ID NO: 2524427 - RNA, 14 nt, Chlamydophila pneumoniae CWL029
agccauuuuccagg

SEQ ID NO: 2524428 - RNA, 12 nt, Chlamydophila pneumoniae CWL029
agccccacccac

SEQ ID NO: 2524429 - RNA, 14 nt, Chlamydophila pneumoniae CWL029
agcccgaaauucau

SEQ ID NO: 2524430 - RNA, 19 nt, Chlamydophila pneumoniae CWL029
agcccucgguuauuuuucc

SEQ ID NO: 2524431 - RNA, 22 nt, Chlamydophila pneumoniae CWL029
agccgaggcgauuuucauggac

SEQ ID NO: 2524432 - RNA, 21 nt, Chlamydophila pneumoniae CWL029
agccguaggguagccauccac

SEQ ID NO: 2524433 - RNA, 12 nt, Chlamydophila pneumoniae CWL029
agccuagcaaaa

SEQ ID NO: 2524434 - RNA, 20 nt, Chlamydophila pneumoniae CWL029
agccuaugggaggaauuccu

SEQ ID NO: 2524435 - RNA, 22 nt, Chlamydophila pneumoniae CWL029
agccucacagaauuguuuuguu

SEQ ID NO: 2524436 - RNA, 19 nt, Chlamydophila pneumoniae CWL029
agccuccauuuagacaaga

SEQ ID NO: 2524437 - RNA, 20 nt, Chlamydophila pneumoniae CWL029
agccuccauuuagacaagac

SEQ ID NO: 2524438 - RNA, 23 nt, Chlamydophila pneumoniae CWL029
agccuccauuuagacaagacacc

SEQ ID NO: 2524439 - RNA, 19 nt, Chlamydophila pneumoniae CWL029
agccucccgaagacaaugu

SEQ ID NO: 2524440 - RNA, 20 nt, Chlamydophila pneumoniae CWL029
agccucccgaagacaauguc

SEQ ID NO: 2524441 - RNA, 16 nt, Chlamydophila pneumoniae CWL029
agccuccuccuucugc

SEQ ID NO: 2524442 - RNA, 18 nt, Chlamydophila pneumoniae CWL029
agccucugugguuuuuau

SEQ ID NO: 2524443 - RNA, 14 nt, Chlamydophila pneumoniae CWL029
agccucuucucuac

SEQ ID NO: 2524444 - RNA, 14 nt, Chlamydophila pneumoniae CWL029
agccugcaccagac

SEQ ID NO: 2524445 - RNA, 14 nt, Chlamydophila pneumoniae CWL029
agccugcgacuaca

SEQ ID NO: 2524446 - RNA, 18 nt, Chlamydophila pneumoniae CWL029
agccugcgacuacaagau

SEQ ID NO: 2524447 - RNA, 16 nt, Chlamydophila pneumoniae CWL029
agccuggcuaaaggau

SEQ ID NO: 2524448 - RNA, 12 nt, Chlamydophila pneumoniae CWL029
agccugucuaua

SEQ ID NO: 2524449 - RNA, 21 nt, Chlamydophila pneumoniae CWL029
agccugucuuaucuaaagaaa

SEQ ID NO: 2524450 - RNA, 20 nt, Chlamydophila pneumoniae CWL029
agccuguuguagugauggaa

SEQ ID NO: 2524451 - RNA, 23 nt, Chlamydophila pneumoniae CWL029
agccuuacggccccuggaauuuc

SEQ ID NO: 2524452 - RNA, 13 nt, Chlamydophila pneumoniae CWL029
agccuuagcagca

SEQ ID NO: 2524453 - RNA, 20 nt, Chlamydophila pneumoniae CWL029
agccuuagcagcacccauaa

SEQ ID NO: 2524454 - RNA, 12 nt, Chlamydophila pneumoniae CWL029
agccuuccuugu

SEQ ID NO: 2524455 - RNA, 15 nt, Chlamydophila pneumoniae CWL029
agccuucuucucgaa

SEQ ID NO: 2524456 - RNA, 21 nt, Chlamydophila pneumoniae CWL029
agccuugauugaacagucuug

SEQ ID NO: 2524457 - RNA, 22 nt, Chlamydophila pneumoniae CWL029
agccuuggcucuagaaauauac

SEQ ID NO: 2524458 - RNA, 21 nt, Chlamydophila pneumoniae CWL029
agccuuguaaauaguauacaa

SEQ ID NO: 2524459 - RNA, 11 nt, Chlamydophila pneumoniae CWL029
agccuuuccua

SEQ ID NO: 2524460 - RNA, 13 nt, Chlamydophila pneumoniae CWL029
agccuuuucagau

SEQ ID NO: 2524461 - RNA, 19 nt, Chlamydophila pneumoniae CWL029
agccuuuucagauuuuuua

SEQ ID NO: 2524462 - RNA, 17 nt, Chlamydophila pneumoniae CWL029
agcgaaagucaaagggc

SEQ ID NO: 2524463 - RNA, 15 nt, Chlamydophila pneumoniae CWL029
agcgaaccaaaguca

SEQ ID NO: 2524464 - RNA, 20 nt, Chlamydophila pneumoniae CWL029
agcgaaccaaagucaugucc

SEQ ID NO: 2524465 - RNA, 20 nt, Chlamydophila pneumoniae CWL029
agcgaccugcaaaugaaggg

SEQ ID NO: 2524466 - RNA, 13 nt, Chlamydophila pneumoniae CWL029
agcgauagcuaaa

SEQ ID NO: 2524467 - RNA, 14 nt, Chlamydophila pneumoniae CWL029
agcgauagcuaaac

SEQ ID NO: 2524468 - RNA, 15 nt, Chlamydophila pneumoniae CWL029
agcgaucacauagaa

SEQ ID NO: 2524469 - RNA, 17 nt, Chlamydophila pneumoniae CWL029
agcgaucucucuuccug

SEQ ID NO: 2524470 - RNA, 22 nt, Chlamydophila pneumoniae CWL029
agcgaucucucuuccugcugcu

SEQ ID NO: 2524471 - RNA, 18 nt, Chlamydophila pneumoniae CWL029
agcgauuucgacagcagc

SEQ ID NO: 2524472 - RNA, 14 nt, Chlamydophila pneumoniae CWL029
agcgcaucacgaaa

SEQ ID NO: 2524473 - RNA, 20 nt, Chlamydophila pneumoniae CWL029
agcgcaucacgaaaaggaga

SEQ ID NO: 2524474 - RNA, 14 nt, Chlamydophila pneumoniae CWL029
agcgcccgaaucuu

SEQ ID NO: 2524475 - RNA, 22 nt, Chlamydophila pneumoniae CWL029
agcgccuccaccugcagcgcag

SEQ ID NO: 2524476 - RNA, 15 nt, Chlamydophila pneumoniae CWL029
agcgcguuucaaaua

SEQ ID NO: 2524477 - RNA, 22 nt, Chlamydophila pneumoniae CWL029
agcgcuacuguauucuguaaga

SEQ ID NO: 2524478 - RNA, 23 nt, Chlamydophila pneumoniae CWL029
agcgcuagugcaagguucugcga

SEQ ID NO: 2524479 - RNA, 13 nt, Chlamydophila pneumoniae CWL029
agcgcuuccagcu

SEQ ID NO: 2524480 - RNA, 21 nt, Chlamydophila pneumoniae CWL029
agcgcuuuauguuuuguccuu

SEQ ID NO: 2524481 - RNA, 22 nt, Chlamydophila pneumoniae CWL029
agcgcuuucuuuuauuaaggga

SEQ ID NO: 2524482 - RNA, 21 nt, Chlamydophila pneumoniae CWL029
agcggaacguauccuugauuu

SEQ ID NO: 2524483 - RNA, 21 nt, Chlamydophila pneumoniae CWL029
agcggaagcaccgccugaccu

SEQ ID NO: 2524484 - RNA, 23 nt, Chlamydophila pneumoniae CWL029
agcggaguccuucuugcaaagau

SEQ ID NO: 2524485 - RNA, 15 nt, Chlamydophila pneumoniae CWL029
agcggcaacauaauc

SEQ ID NO: 2524486 - RNA, 18 nt, Chlamydophila pneumoniae CWL029
agcgguagcgucuagcua

SEQ ID NO: 2524487 - RNA, 16 nt, Chlamydophila pneumoniae CWL029
agcguacaggaagucc

SEQ ID NO: 2524488 - RNA, 20 nt, Chlamydophila pneumoniae CWL029
agcguauaggaaacugucau

SEQ ID NO: 2524489 - RNA, 22 nt, Chlamydophila pneumoniae CWL029
agcguauccgcugcccaugcuu

SEQ ID NO: 2524490 - RNA, 16 nt, Chlamydophila pneumoniae CWL029
agcgucguguuuucac

SEQ ID NO: 2524491 - RNA, 20 nt, Chlamydophila pneumoniae CWL029
agcgucucuucuuccucuac

SEQ ID NO: 2524492 - RNA, 15 nt, Chlamydophila pneumoniae CWL029
agcgugaauaucauc

SEQ ID NO: 2524493 - RNA, 12 nt, Chlamydophila pneumoniae CWL029
agcguuaacaac

SEQ ID NO: 2524494 - RNA, 19 nt, Chlamydophila pneumoniae CWL029
agcguucgcucucuuuaaa

SEQ ID NO: 2524495 - RNA, 15 nt, Chlamydophila pneumoniae CWL029
agcguuucgauaauu

SEQ ID NO: 2524496 - RNA, 20 nt, Chlamydophila pneumoniae CWL029
agcguuucgauaauuuucac

SEQ ID NO: 2524497 - RNA, 21 nt, Chlamydophila pneumoniae CWL029
agcguuuuuugaaaauuuucc

SEQ ID NO: 2524498 - RNA, 13 nt, Chlamydophila pneumoniae CWL029
agcuaaaucaaaa

SEQ ID NO: 2524499 - RNA, 21 nt, Chlamydophila pneumoniae CWL029
agcuaaguaacaguccucucc

SEQ ID NO: 2524500 - RNA, 18 nt, Chlamydophila pneumoniae CWL029
agcuaagucuccauaauu

SEQ ID NO: 2524501 - RNA, 19 nt, Chlamydophila pneumoniae CWL029
agcuaauaagauccaaaaa

SEQ ID NO: 2524502 - RNA, 17 nt, Chlamydophila pneumoniae CWL029
agcuaauacaucaccac

SEQ ID NO: 2524503 - RNA, 17 nt, Chlamydophila pneumoniae CWL029
agcuaauuuaaaugccu

SEQ ID NO: 2524504 - RNA, 20 nt, Chlamydophila pneumoniae CWL029
agcuacaagaacugaagagu

SEQ ID NO: 2524505 - RNA, 16 nt, Chlamydophila pneumoniae CWL029
agcuacagaaagagcu

SEQ ID NO: 2524506 - RNA, 17 nt, Chlamydophila pneumoniae CWL029
agcuacagaaagagcua

SEQ ID NO: 2524507 - RNA, 21 nt, Chlamydophila pneumoniae CWL029
agcuacggagagguuauguac

SEQ ID NO: 2524508 - RNA, 17 nt, Chlamydophila pneumoniae CWL029
agcuacuaaucaccuua

SEQ ID NO: 2524509 - RNA, 19 nt, Chlamydophila pneumoniae CWL029
agcuagagauccaaugaca

SEQ ID NO: 2524510 - RNA, 15 nt, Chlamydophila pneumoniae CWL029
agcuagagcauuccg

SEQ ID NO: 2524511 - RNA, 14 nt, Chlamydophila pneumoniae CWL029
agcuagucuucuua

SEQ ID NO: 2524512 - RNA, 14 nt, Chlamydophila pneumoniae CWL029
agcuauagaaagag

SEQ ID NO: 2524513 - RNA, 18 nt, Chlamydophila pneumoniae CWL029
agcuaucaaccauaaaga

SEQ ID NO: 2524514 - RNA, 15 nt, Chlamydophila pneumoniae CWL029
agcuaugaugagaac

SEQ ID NO: 2524515 - RNA, 17 nt, Chlamydophila pneumoniae CWL029
agcuaugaugagaacgu

SEQ ID NO: 2524516 - RNA, 13 nt, Chlamydophila pneumoniae CWL029
agcuauuucucua

SEQ ID NO: 2524517 - RNA, 15 nt, Chlamydophila pneumoniae CWL029
agcuauuucucuauc

SEQ ID NO: 2524518 - RNA, 20 nt, Chlamydophila pneumoniae CWL029
agcuauuucucuaucaucaa

SEQ ID NO: 2524519 - RNA, 14 nt, Chlamydophila pneumoniae CWL029
agcuauuugaaaua

SEQ ID NO: 2524520 - RNA, 12 nt, Chlamydophila pneumoniae CWL029
agcucaaaaagu

SEQ ID NO: 2524521 - RNA, 14 nt, Chlamydophila pneumoniae CWL029
agcucaaaaaguuc

SEQ ID NO: 2524522 - RNA, 19 nt, Chlamydophila pneumoniae CWL029
agcucacgcaccauuccuu

SEQ ID NO: 2524523 - RNA, 18 nt, Chlamydophila pneumoniae CWL029
agcucacucuuuaaaaac

SEQ ID NO: 2524524 - RNA, 21 nt, Chlamydophila pneumoniae CWL029
agcucaggaaaacuuaauaag

SEQ ID NO: 2524525 - RNA, 12 nt, Chlamydophila pneumoniae CWL029
agcucauaagaa

SEQ ID NO: 2524526 - RNA, 17 nt, Chlamydophila pneumoniae CWL029
agcucaucagcaaccuu

SEQ ID NO: 2524527 - RNA, 19 nt, Chlamydophila pneumoniae CWL029
agcucaucuagaaagauuu

SEQ ID NO: 2524528 - RNA, 14 nt, Chlamydophila pneumoniae CWL029
agcucauuaucaag

SEQ ID NO: 2524529 - RNA, 13 nt, Chlamydophila pneumoniae CWL029
agcuccaaaauaa

SEQ ID NO: 2524530 - RNA, 14 nt, Chlamydophila pneumoniae CWL029
agcuccauuuaaau

SEQ ID NO: 2524531 - RNA, 13 nt, Chlamydophila pneumoniae CWL029
agcucccucuaga

SEQ ID NO: 2524532 - RNA, 18 nt, Chlamydophila pneumoniae CWL029
agcuccgaggcuucugag

SEQ ID NO: 2524533 - RNA, 15 nt, Chlamydophila pneumoniae CWL029
agcuccguaauggag

SEQ ID NO: 2524534 - RNA, 20 nt, Chlamydophila pneumoniae CWL029
agcuccucacaucuccuuuc

SEQ ID NO: 2524535 - RNA, 13 nt, Chlamydophila pneumoniae CWL029
agcuccuggauau

SEQ ID NO: 2524536 - RNA, 21 nt, Chlamydophila pneumoniae CWL029
agcucgaaucacgaauaaggc

SEQ ID NO: 2524537 - RNA, 19 nt, Chlamydophila pneumoniae CWL029
agcucgagaucuuuuugcc

SEQ ID NO: 2524538 - RNA, 21 nt, Chlamydophila pneumoniae CWL029
agcucgaggucuuuucuuuuu

SEQ ID NO: 2524539 - RNA, 18 nt, Chlamydophila pneumoniae CWL029
agcucuaaaaaagauaaa

SEQ ID NO: 2524540 - RNA, 22 nt, Chlamydophila pneumoniae CWL029
agcucuaaaaaagauaaagcua

SEQ ID NO: 2524541 - RNA, 16 nt, Chlamydophila pneumoniae CWL029
agcucuauuucugccu

SEQ ID NO: 2524542 - RNA, 16 nt, Chlamydophila pneumoniae CWL029
agcucuccauuaaagg

SEQ ID NO: 2524543 - RNA, 15 nt, Chlamydophila pneumoniae CWL029
agcucucuccaucua

SEQ ID NO: 2524544 - RNA, 12 nt, Chlamydophila pneumoniae CWL029
agcucuggagau

SEQ ID NO: 2524545 - RNA, 23 nt, Chlamydophila pneumoniae CWL029
agcucuggagauugcuaagcauu

SEQ ID NO: 2524546 - RNA, 16 nt, Chlamydophila pneumoniae CWL029
agcucuugagaaagcu

SEQ ID NO: 2524547 - RNA, 15 nt, Chlamydophila pneumoniae CWL029
agcucuuucauaaga

SEQ ID NO: 2524548 - RNA, 16 nt, Chlamydophila pneumoniae CWL029
agcucuuucuuggauu

SEQ ID NO: 2524549 - RNA, 16 nt, Chlamydophila pneumoniae CWL029
agcugaaaucauggaa

SEQ ID NO: 2524550 - RNA, 15 nt, Chlamydophila pneumoniae CWL029
agcugacuccuugua

SEQ ID NO: 2524551 - RNA, 14 nt, Chlamydophila pneumoniae CWL029
agcugagagauuuu

SEQ ID NO: 2524552 - RNA, 19 nt, Chlamydophila pneumoniae CWL029
agcugagagauuuuuucau

SEQ ID NO: 2524553 - RNA, 20 nt, Chlamydophila pneumoniae CWL029
agcugagcuaucuucaaguu

SEQ ID NO: 2524554 - RNA, 23 nt, Chlamydophila pneumoniae CWL029
agcugagguagcaucucucucca

SEQ ID NO: 2524555 - RNA, 15 nt, Chlamydophila pneumoniae CWL029
agcugcaaacacaau

SEQ ID NO: 2524556 - RNA, 15 nt, Chlamydophila pneumoniae CWL029
agcugcgucaauaag

SEQ ID NO: 2524557 - RNA, 18 nt, Chlamydophila pneumoniae CWL029
agcugcugagcagcaaaa

SEQ ID NO: 2524558 - RNA, 15 nt, Chlamydophila pneumoniae CWL029
agcugcuuuuucuac

SEQ ID NO: 2524559 - RNA, 15 nt, Chlamydophila pneumoniae CWL029
agcuggaucuucuga

SEQ ID NO: 2524560 - RNA, 12 nt, Chlamydophila pneumoniae CWL029
agcuggauucug

SEQ ID NO: 2524561 - RNA, 13 nt, Chlamydophila pneumoniae CWL029
agcuggcaaugau

SEQ ID NO: 2524562 - RNA, 20 nt, Chlamydophila pneumoniae CWL029
agcuggggauggucuucccc

SEQ ID NO: 2524563 - RNA, 22 nt, Chlamydophila pneumoniae CWL029
agcuguaaccaacaucaaagaa

SEQ ID NO: 2524564 - RNA, 15 nt, Chlamydophila pneumoniae CWL029
agcuguacagaacaa

SEQ ID NO: 2524565 - RNA, 16 nt, Chlamydophila pneumoniae CWL029
agcuguacagaacaau

SEQ ID NO: 2524566 - RNA, 21 nt, Chlamydophila pneumoniae CWL029
agcuguagugauacuuuagaa

SEQ ID NO: 2524567 - RNA, 15 nt, Chlamydophila pneumoniae CWL029
agcuguccagucuau

SEQ ID NO: 2524568 - RNA, 14 nt, Chlamydophila pneumoniae CWL029
agcuguccuccgag

SEQ ID NO: 2524569 - RNA, 12 nt, Chlamydophila pneumoniae CWL029
agcugugcauuu

SEQ ID NO: 2524570 - RNA, 14 nt, Chlamydophila pneumoniae CWL029
agcugugcauuuuc

SEQ ID NO: 2524571 - RNA, 12 nt, Chlamydophila pneumoniae CWL029
agcugugguggu

SEQ ID NO: 2524572 - RNA, 21 nt, Chlamydophila pneumoniae CWL029
agcuguugcguuugagcuaag

SEQ ID NO: 2524573 - RNA, 16 nt, Chlamydophila pneumoniae CWL029
agcuguuucucuguau

SEQ ID NO: 2524574 - RNA, 18 nt, Chlamydophila pneumoniae CWL029
agcuuacguguugcauga

SEQ ID NO: 2524575 - RNA, 22 nt, Chlamydophila pneumoniae CWL029
agcuucaaguuucuuuugcaaa

SEQ ID NO: 2524576 - RNA, 12 nt, Chlamydophila pneumoniae CWL029
agcuucaucaaa

SEQ ID NO: 2524577 - RNA, 20 nt, Chlamydophila pneumoniae CWL029
agcuucaucagaagguaaau

SEQ ID NO: 2524578 - RNA, 21 nt, Chlamydophila pneumoniae CWL029
agcuuccgucugaauguaacu

SEQ ID NO: 2524579 - RNA, 12 nt, Chlamydophila pneumoniae CWL029
agcuucuaaaaa

SEQ ID NO: 2524580 - RNA, 13 nt, Chlamydophila pneumoniae CWL029
agcuucuaaaaac

SEQ ID NO: 2524581 - RNA, 13 nt, Chlamydophila pneumoniae CWL029
agcuucuugaugu

SEQ ID NO: 2524582 - RNA, 19 nt, Chlamydophila pneumoniae CWL029
agcuucuuucuuacuaaag

SEQ ID NO: 2524583 - RNA, 22 nt, Chlamydophila pneumoniae CWL029
agcuugccagcagaaguuccuu

SEQ ID NO: 2524584 - RNA, 22 nt, Chlamydophila pneumoniae CWL029
agcuugcccuucguaacgcuuu

SEQ ID NO: 2524585 - RNA, 13 nt, Chlamydophila pneumoniae CWL029
agcuugguuuucu

SEQ ID NO: 2524586 - RNA, 19 nt, Chlamydophila pneumoniae CWL029
agcuugguuuucuccuucu

SEQ ID NO: 2524587 - RNA, 13 nt, Chlamydophila pneumoniae CWL029
agcuugucacacu

SEQ ID NO: 2524588 - RNA, 23 nt, Chlamydophila pneumoniae CWL029
agcuugucacacugcgagagaaa

SEQ ID NO: 2524589 - RNA, 19 nt, Chlamydophila pneumoniae CWL029
agcuuguucuguaacacuu

SEQ ID NO: 2524590 - RNA, 20 nt, Chlamydophila pneumoniae CWL029
agcuuguuuuugcaaggcaa

SEQ ID NO: 2524591 - RNA, 18 nt, Chlamydophila pneumoniae CWL029
agcuuuaacaugccaaaa

SEQ ID NO: 2524592 - RNA, 18 nt, Chlamydophila pneumoniae CWL029
agcuuuauugauagcuga

SEQ ID NO: 2524593 - RNA, 15 nt, Chlamydophila pneumoniae CWL029
agcuuucuuggagaa

SEQ ID NO: 2524594 - RNA, 18 nt, Chlamydophila pneumoniae CWL029
agcuuuggcgucugcccu

SEQ ID NO: 2524595 - RNA, 16 nt, Chlamydophila pneumoniae CWL029
agcuuuucguauagag

SEQ ID NO: 2524596 - RNA, 12 nt, Chlamydophila pneumoniae CWL029
agcuuuuuucuc

SEQ ID NO: 2524597 - RNA, 14 nt, Chlamydophila pneumoniae CWL029
aggaaaagcaaaau

SEQ ID NO: 2524598 - RNA, 24 nt, Chlamydophila pneumoniae CWL029
aggaaaauucaguauaagaugcug

SEQ ID NO: 2524599 - RNA, 15 nt, Chlamydophila pneumoniae CWL029
aggaaacagugguau

SEQ ID NO: 2524600 - RNA, 21 nt, Chlamydophila pneumoniae CWL029
aggaaacagugguaugcuuuu

SEQ ID NO: 2524601 - RNA, 15 nt, Chlamydophila pneumoniae CWL029
aggaaacguucuuuc

SEQ ID NO: 2524602 - RNA, 18 nt, Chlamydophila pneumoniae CWL029
aggaaacuagauuucuac

SEQ ID NO: 2524603 - RNA, 18 nt, Chlamydophila pneumoniae CWL029
aggaaaguucacaagcag

SEQ ID NO: 2524604 - RNA, 21 nt, Chlamydophila pneumoniae CWL029
aggaaaguugcaacucucuuu

SEQ ID NO: 2524605 - RNA, 19 nt, Chlamydophila pneumoniae CWL029
aggaaaucacagagucugg

SEQ ID NO: 2524606 - RNA, 22 nt, Chlamydophila pneumoniae CWL029
aggaaaucccgagauaugaaga

SEQ ID NO: 2524607 - RNA, 18 nt, Chlamydophila pneumoniae CWL029
aggaaaucgcauuacaaa

SEQ ID NO: 2524608 - RNA, 14 nt, Chlamydophila pneumoniae CWL029
aggaacaauguaaa

SEQ ID NO: 2524609 - RNA, 17 nt, Chlamydophila pneumoniae CWL029
aggaacgcacgccaaga

SEQ ID NO: 2524610 - RNA, 19 nt, Chlamydophila pneumoniae CWL029
aggaacucuuuaaaagggc

SEQ ID NO: 2524611 - RNA, 17 nt, Chlamydophila pneumoniae CWL029
aggaacuugaauaccaa

SEQ ID NO: 2524612 - RNA, 15 nt, Chlamydophila pneumoniae CWL029
aggaagauaguauuu

SEQ ID NO: 2524613 - RNA, 19 nt, Chlamydophila pneumoniae CWL029
aggaagauauccuuuugaa

SEQ ID NO: 2524614 - RNA, 14 nt, Chlamydophila pneumoniae CWL029
aggaagccugcggc

SEQ ID NO: 2524615 - RNA, 16 nt, Chlamydophila pneumoniae CWL029
aggaagcucuucuacu

SEQ ID NO: 2524616 - RNA, 14 nt, Chlamydophila pneumoniae CWL029
aggaaggaauagag

SEQ ID NO: 2524617 - RNA, 18 nt, Chlamydophila pneumoniae CWL029
aggaagguucucaaagcu

SEQ ID NO: 2524618 - RNA, 19 nt, Chlamydophila pneumoniae CWL029
aggaagguucucaaagcua

SEQ ID NO: 2524619 - RNA, 19 nt, Chlamydophila pneumoniae CWL029
aggaaguaguggacuauag

SEQ ID NO: 2524620 - RNA, 23 nt, Chlamydophila pneumoniae CWL029
aggaagucaccuuacauccaauu

SEQ ID NO: 2524621 - RNA, 21 nt, Chlamydophila pneumoniae CWL029
aggaaguccgauagcaaugau

SEQ ID NO: 2524622 - RNA, 17 nt, Chlamydophila pneumoniae CWL029
aggaauaaucaaccaaa

SEQ ID NO: 2524623 - RNA, 19 nt, Chlamydophila pneumoniae CWL029
aggaauaaucaaccaaaau

SEQ ID NO: 2524624 - RNA, 14 nt, Chlamydophila pneumoniae CWL029
aggaauagaaagac

SEQ ID NO: 2524625 - RNA, 21 nt, Chlamydophila pneumoniae CWL029
aggaaucauaaccaaaagaau

SEQ ID NO: 2524626 - RNA, 19 nt, Chlamydophila pneumoniae CWL029
aggaaucccugcacucuuu

SEQ ID NO: 2524627 - RNA, 13 nt, Chlamydophila pneumoniae CWL029
aggaaucuaagaa

SEQ ID NO: 2524628 - RNA, 20 nt, Chlamydophila pneumoniae CWL029
aggaaucuugaugaccucua

SEQ ID NO: 2524629 - RNA, 14 nt, Chlamydophila pneumoniae CWL029
aggaaugaagagag

SEQ ID NO: 2524630 - RNA, 14 nt, Chlamydophila pneumoniae CWL029
aggaaugagcggca

SEQ ID NO: 2524631 - RNA, 14 nt, Chlamydophila pneumoniae CWL029
aggaauuaaaauau

SEQ ID NO: 2524632 - RNA, 20 nt, Chlamydophila pneumoniae CWL029
aggaauuagagaaauuuuua

SEQ ID NO: 2524633 - RNA, 13 nt, Chlamydophila pneumoniae CWL029
aggaauuccucuc

SEQ ID NO: 2524634 - RNA, 16 nt, Chlamydophila pneumoniae CWL029
aggaauuccucucaca

SEQ ID NO: 2524635 - RNA, 20 nt, Chlamydophila pneumoniae CWL029
aggaauucuuuaugagagag

SEQ ID NO: 2524636 - RNA, 13 nt, Chlamydophila pneumoniae CWL029
aggacaaaucucc

SEQ ID NO: 2524637 - RNA, 21 nt, Chlamydophila pneumoniae CWL029
aggacaaucaacauucuucug

SEQ ID NO: 2524638 - RNA, 15 nt, Chlamydophila pneumoniae CWL029
aggacagcacauaga

SEQ ID NO: 2524639 - RNA, 16 nt, Chlamydophila pneumoniae CWL029
aggacaguauucccuc

SEQ ID NO: 2524640 - RNA, 13 nt, Chlamydophila pneumoniae CWL029
aggaccaggugua

SEQ ID NO: 2524641 - RNA, 20 nt, Chlamydophila pneumoniae CWL029
aggaccagguguagguuccu

SEQ ID NO: 2524642 - RNA, 23 nt, Chlamydophila pneumoniae CWL029
aggaccagguguagguuccugcu

SEQ ID NO: 2524643 - RNA, 19 nt, Chlamydophila pneumoniae CWL029
aggaccuuggacucuaggg

SEQ ID NO: 2524644 - RNA, 19 nt, Chlamydophila pneumoniae CWL029
aggacgcacauuuagaagu

SEQ ID NO: 2524645 - RNA, 16 nt, Chlamydophila pneumoniae CWL029
aggacguaaaaagaaa

SEQ ID NO: 2524646 - RNA, 22 nt, Chlamydophila pneumoniae CWL029
aggacucccucaaaauuuaaau

SEQ ID NO: 2524647 - RNA, 22 nt, Chlamydophila pneumoniae CWL029
aggacuguuuguuuauuaucua

SEQ ID NO: 2524648 - RNA, 12 nt, Chlamydophila pneumoniae CWL029
aggagaacaaua

SEQ ID NO: 2524649 - RNA, 22 nt, Chlamydophila pneumoniae CWL029
aggagaacaauaucagcagcuu

SEQ ID NO: 2524650 - RNA, 20 nt, Chlamydophila pneumoniae CWL029
aggagaccuuuauagauaug

SEQ ID NO: 2524651 - RNA, 16 nt, Chlamydophila pneumoniae CWL029
aggagacuaaaagaau

SEQ ID NO: 2524652 - RNA, 17 nt, Chlamydophila pneumoniae CWL029
aggagacuaaaagaaua

SEQ ID NO: 2524653 - RNA, 21 nt, Chlamydophila pneumoniae CWL029
aggagacucuaguuuuucuuu

SEQ ID NO: 2524654 - RNA, 12 nt, Chlamydophila pneumoniae CWL029
aggagagagaag

SEQ ID NO: 2524655 - RNA, 12 nt, Chlamydophila pneumoniae CWL029
aggagagcacuu

SEQ ID NO: 2524656 - RNA, 20 nt, Chlamydophila pneumoniae CWL029
aggagagcuucuucuguaaa

SEQ ID NO: 2524657 - RNA, 17 nt, Chlamydophila pneumoniae CWL029
aggagaguaaggucauu

SEQ ID NO: 2524658 - RNA, 21 nt, Chlamydophila pneumoniae CWL029
aggagauaaagauguagaaua

SEQ ID NO: 2524659 - RNA, 16 nt, Chlamydophila pneumoniae CWL029
aggagauccacagacu

SEQ ID NO: 2524660 - RNA, 15 nt, Chlamydophila pneumoniae CWL029
aggagcauagacucu

SEQ ID NO: 2524661 - RNA, 16 nt, Chlamydophila pneumoniae CWL029
aggagccuccauaaug

SEQ ID NO: 2524662 - RNA, 16 nt, Chlamydophila pneumoniae CWL029
aggagcuacugaaaga

SEQ ID NO: 2524663 - RNA, 13 nt, Chlamydophila pneumoniae CWL029
aggagcuccuccu

SEQ ID NO: 2524664 - RNA, 16 nt, Chlamydophila pneumoniae CWL029
aggagcuccuccuuga

SEQ ID NO: 2524665 - RNA, 15 nt, Chlamydophila pneumoniae CWL029
aggagcuuuuaccuu

SEQ ID NO: 2524666 - RNA, 10 nt, Chlamydophila pneumoniae CWL029
aggaggagca

SEQ ID NO: 2524667 - RNA, 13 nt, Chlamydophila pneumoniae CWL029
aggaggaggagca

SEQ ID NO: 2524668 - RNA, 18 nt, Chlamydophila pneumoniae CWL029
aggaguauagcaugaucu

SEQ ID NO: 2524669 - RNA, 23 nt, Chlamydophila pneumoniae CWL029
aggaguccccuggcguucaggau

SEQ ID NO: 2524670 - RNA, 20 nt, Chlamydophila pneumoniae CWL029
aggagucgugcaggagaaca

SEQ ID NO: 2524671 - RNA, 23 nt, Chlamydophila pneumoniae CWL029
aggagucgugcaggagaacaaua

SEQ ID NO: 2524672 - RNA, 19 nt, Chlamydophila pneumoniae CWL029
aggaguuuucaagucugua

SEQ ID NO: 2524673 - RNA, 20 nt, Chlamydophila pneumoniae CWL029
aggauaaccaucaaucacuc

SEQ ID NO: 2524674 - RNA, 16 nt, Chlamydophila pneumoniae CWL029
aggauacgaauaaguu

SEQ ID NO: 2524675 - RNA, 20 nt, Chlamydophila pneumoniae CWL029
aggauagaccccccauucca

SEQ ID NO: 2524676 - RNA, 22 nt, Chlamydophila pneumoniae CWL029
aggauagaccccccauuccaaa

SEQ ID NO: 2524677 - RNA, 21 nt, Chlamydophila pneumoniae CWL029
aggauagcaauucgguagagc

SEQ ID NO: 2524678 - RNA, 22 nt, Chlamydophila pneumoniae CWL029
aggauagguccguuuuuucaga

SEQ ID NO: 2524679 - RNA, 15 nt, Chlamydophila pneumoniae CWL029
aggaucugcauggau

SEQ ID NO: 2524680 - RNA, 15 nt, Chlamydophila pneumoniae CWL029
aggaucugguugagg

SEQ ID NO: 2524681 - RNA, 14 nt, Chlamydophila pneumoniae CWL029
aggaucuucuauuu

SEQ ID NO: 2524682 - RNA, 23 nt, Chlamydophila pneumoniae CWL029
aggaugacacucacuauccggaa

SEQ ID NO: 2524683 - RNA, 16 nt, Chlamydophila pneumoniae CWL029
aggaugcuuagcaaag

SEQ ID NO: 2524684 - RNA, 18 nt, Chlamydophila pneumoniae CWL029
aggaugcuugugagauga

SEQ ID NO: 2524685 - RNA, 16 nt, Chlamydophila pneumoniae CWL029
aggauggaaucaggga

SEQ ID NO: 2524686 - RNA, 17 nt, Chlamydophila pneumoniae CWL029
aggaugucgcuuuugcu

SEQ ID NO: 2524687 - RNA, 14 nt, Chlamydophila pneumoniae CWL029
aggauguuccuugu

SEQ ID NO: 2524688 - RNA, 17 nt, Chlamydophila pneumoniae CWL029
aggauguuguggaucag

SEQ ID NO: 2524689 - RNA, 19 nt, Chlamydophila pneumoniae CWL029
aggauucuaaaaagaaaag

SEQ ID NO: 2524690 - RNA, 18 nt, Chlamydophila pneumoniae CWL029
aggauucuauaacuacaa

SEQ ID NO: 2524691 - RNA, 17 nt, Chlamydophila pneumoniae CWL029
aggauucucucugccua

SEQ ID NO: 2524692 - RNA, 17 nt, Chlamydophila pneumoniae CWL029
aggauugcacucaucuu

SEQ ID NO: 2524693 - RNA, 13 nt, Chlamydophila pneumoniae CWL029
aggauuuagacua

SEQ ID NO: 2524694 - RNA, 21 nt, Chlamydophila pneumoniae CWL029
aggauuucuugcaaggagcuu

SEQ ID NO: 2524695 - RNA, 12 nt, Chlamydophila pneumoniae CWL029
aggcaaagauca

SEQ ID NO: 2524696 - RNA, 16 nt, Chlamydophila pneumoniae CWL029
aggcaaagaucaguuu

SEQ ID NO: 2524697 - RNA, 14 nt, Chlamydophila pneumoniae CWL029
aggcaaagauuucc

SEQ ID NO: 2524698 - RNA, 19 nt, Chlamydophila pneumoniae CWL029
aggcaacgcgauuuucaac

SEQ ID NO: 2524699 - RNA, 16 nt, Chlamydophila pneumoniae CWL029
aggcaagauuaugaug

SEQ ID NO: 2524700 - RNA, 23 nt, Chlamydophila pneumoniae CWL029
aggcaagauuaugaugccucauu

SEQ ID NO: 2524701 - RNA, 17 nt, Chlamydophila pneumoniae CWL029
aggcaaggagagcuucu

SEQ ID NO: 2524702 - RNA, 18 nt, Chlamydophila pneumoniae CWL029
aggcaauuuuuauaauau

SEQ ID NO: 2524703 - RNA, 19 nt, Chlamydophila pneumoniae CWL029
aggcaauuuuuauaauauu

SEQ ID NO: 2524704 - RNA, 23 nt, Chlamydophila pneumoniae CWL029
aggcacccaaacugaugccaaga

SEQ ID NO: 2524705 - RNA, 18 nt, Chlamydophila pneumoniae CWL029
aggcacuccaaaacucaa

SEQ ID NO: 2524706 - RNA, 21 nt, Chlamydophila pneumoniae CWL029
aggcagauagacaaccuagaa

SEQ ID NO: 2524707 - RNA, 16 nt, Chlamydophila pneumoniae CWL029
aggcauaacugugcuc

SEQ ID NO: 2524708 - RNA, 14 nt, Chlamydophila pneumoniae CWL029
aggcauaagaucau

SEQ ID NO: 2524709 - RNA, 15 nt, Chlamydophila pneumoniae CWL029
aggcauaaucuccaa

SEQ ID NO: 2524710 - RNA, 15 nt, Chlamydophila pneumoniae CWL029
aggcaucuagagucu

SEQ ID NO: 2524711 - RNA, 17 nt, Chlamydophila pneumoniae CWL029
aggcaucuucuuugcca

SEQ ID NO: 2524712 - RNA, 16 nt, Chlamydophila pneumoniae CWL029
aggcaugccuacaggc

SEQ ID NO: 2524713 - RNA, 17 nt, Chlamydophila pneumoniae CWL029
aggcauggcacaguccu

SEQ ID NO: 2524714 - RNA, 16 nt, Chlamydophila pneumoniae CWL029
aggcauuaauaacuuu

SEQ ID NO: 2524715 - RNA, 17 nt, Chlamydophila pneumoniae CWL029
aggcauuacacaacucu

SEQ ID NO: 2524716 - RNA, 14 nt, Chlamydophila pneumoniae CWL029
aggccaaagaacag

SEQ ID NO: 2524717 - RNA, 17 nt, Chlamydophila pneumoniae CWL029
aggccaaagaacagcac

SEQ ID NO: 2524718 - RNA, 18 nt, Chlamydophila pneumoniae CWL029
aggccaaagaacagcacu

SEQ ID NO: 2524719 - RNA, 14 nt, Chlamydophila pneumoniae CWL029
aggccaggagacua

SEQ ID NO: 2524720 - RNA, 22 nt, Chlamydophila pneumoniae CWL029
aggcccaccagggguuucuaaa

SEQ ID NO: 2524721 - RNA, 23 nt, Chlamydophila pneumoniae CWL029
aggccgggauuuuaauucaaaaa

SEQ ID NO: 2524722 - RNA, 18 nt, Chlamydophila pneumoniae CWL029
aggcgcauaugcuccaga

SEQ ID NO: 2524723 - RNA, 20 nt, Chlamydophila pneumoniae CWL029
aggcgcauaugcuccagaaa

SEQ ID NO: 2524724 - RNA, 14 nt, Chlamydophila pneumoniae CWL029
aggcggaaaggaag

SEQ ID NO: 2524725 - RNA, 21 nt, Chlamydophila pneumoniae CWL029
aggcuccuccuuugacacccu

SEQ ID NO: 2524726 - RNA, 13 nt, Chlamydophila pneumoniae CWL029
aggcucucgacac

SEQ ID NO: 2524727 - RNA, 21 nt, Chlamydophila pneumoniae CWL029
aggcucuuaucgugacucuua

SEQ ID NO: 2524728 - RNA, 14 nt, Chlamydophila pneumoniae CWL029
aggcucuuuuagag

SEQ ID NO: 2524729 - RNA, 16 nt, Chlamydophila pneumoniae CWL029
aggcugcacacauccu

SEQ ID NO: 2524730 - RNA, 21 nt, Chlamydophila pneumoniae CWL029
aggcugccagagauucuucac

SEQ ID NO: 2524731 - RNA, 21 nt, Chlamydophila pneumoniae CWL029
aggcuguccuugcagcccugc

SEQ ID NO: 2524732 - RNA, 19 nt, Chlamydophila pneumoniae CWL029
aggcugucguuaccguuuc

SEQ ID NO: 2524733 - RNA, 17 nt, Chlamydophila pneumoniae CWL029
aggcuuaauaaacauca

SEQ ID NO: 2524734 - RNA, 15 nt, Chlamydophila pneumoniae CWL029
aggcuuuaaauuuuu

SEQ ID NO: 2524735 - RNA, 16 nt, Chlamydophila pneumoniae CWL029
aggcuuuucuuuuucu

SEQ ID NO: 2524736 - RNA, 14 nt, Chlamydophila pneumoniae CWL029
aggcuuuuuucuau

SEQ ID NO: 2524737 - RNA, 23 nt, Chlamydophila pneumoniae CWL029
agggaaaccauauugcaaagcau

SEQ ID NO: 2524738 - RNA, 21 nt, Chlamydophila pneumoniae CWL029
agggaaaggucggggagaaca

SEQ ID NO: 2524739 - RNA, 22 nt, Chlamydophila pneumoniae CWL029
agggaaauccacagauacguuu

SEQ ID NO: 2524740 - RNA, 15 nt, Chlamydophila pneumoniae CWL029
agggaagaaauuaac

SEQ ID NO: 2524741 - RNA, 13 nt, Chlamydophila pneumoniae CWL029
agggaagagaaaa

SEQ ID NO: 2524742 - RNA, 14 nt, Chlamydophila pneumoniae CWL029
agggacaaguacga

SEQ ID NO: 2524743 - RNA, 17 nt, Chlamydophila pneumoniae CWL029
agggacguuguaucccu

SEQ ID NO: 2524744 - RNA, 19 nt, Chlamydophila pneumoniae CWL029
agggacguuguaucccugu

SEQ ID NO: 2524745 - RNA, 12 nt, Chlamydophila pneumoniae CWL029
agggaucccaaa

SEQ ID NO: 2524746 - RNA, 16 nt, Chlamydophila pneumoniae CWL029
agggaucuucaucccu

SEQ ID NO: 2524747 - RNA, 13 nt, Chlamydophila pneumoniae CWL029
agggaugaagaua

SEQ ID NO: 2524748 - RNA, 17 nt, Chlamydophila pneumoniae CWL029
agggaugaagauaaaau

SEQ ID NO: 2524749 - RNA, 15 nt, Chlamydophila pneumoniae CWL029
agggaugcagaucau

SEQ ID NO: 2524750 - RNA, 15 nt, Chlamydophila pneumoniae CWL029
agggaugcucuagaa

SEQ ID NO: 2524751 - RNA, 18 nt, Chlamydophila pneumoniae CWL029
agggauguuuaauacaaa

SEQ ID NO: 2524752 - RNA, 12 nt, Chlamydophila pneumoniae CWL029
agggcaucuuuu

SEQ ID NO: 2524753 - RNA, 20 nt, Chlamydophila pneumoniae CWL029
agggcaucuuuuacagacug

SEQ ID NO: 2524754 - RNA, 17 nt, Chlamydophila pneumoniae CWL029
agggcauguaguuagag

SEQ ID NO: 2524755 - RNA, 17 nt, Chlamydophila pneumoniae CWL029
agggcgcuucccuauaa

SEQ ID NO: 2524756 - RNA, 19 nt, Chlamydophila pneumoniae CWL029
agggcuauccacaacuaaa

SEQ ID NO: 2524757 - RNA, 16 nt, Chlamydophila pneumoniae CWL029
agggcugcgucaugag

SEQ ID NO: 2524758 - RNA, 14 nt, Chlamydophila pneumoniae CWL029
agggcuucauuccu

SEQ ID NO: 2524759 - RNA, 14 nt, Chlamydophila pneumoniae CWL029
aggggaagaggaau

SEQ ID NO: 2524760 - RNA, 14 nt, Chlamydophila pneumoniae CWL029
aggggcaguuccua

SEQ ID NO: 2524761 - RNA, 23 nt, Chlamydophila pneumoniae CWL029
aggggcgcauggcggucuuuguu

SEQ ID NO: 2524762 - RNA, 17 nt, Chlamydophila pneumoniae CWL029
agggggaucuucagaga

SEQ ID NO: 2524763 - RNA, 18 nt, Chlamydophila pneumoniae CWL029
agggggaucuucagagag

SEQ ID NO: 2524764 - RNA, 14 nt, Chlamydophila pneumoniae CWL029
agggggccugccau

SEQ ID NO: 2524765 - RNA, 18 nt, Chlamydophila pneumoniae CWL029
agggguuucuaaauacuu

SEQ ID NO: 2524766 - RNA, 14 nt, Chlamydophila pneumoniae CWL029
aggguaaagaaaua

SEQ ID NO: 2524767 - RNA, 18 nt, Chlamydophila pneumoniae CWL029
aggguaaagaaauauuaa

SEQ ID NO: 2524768 - RNA, 20 nt, Chlamydophila pneumoniae CWL029
aggguagcgcuuuuuuaaag

SEQ ID NO: 2524769 - RNA, 20 nt, Chlamydophila pneumoniae CWL029
aggguauccugcuccaaaau

SEQ ID NO: 2524770 - RNA, 21 nt, Chlamydophila pneumoniae CWL029
aggguauccugcuccaaaaug

SEQ ID NO: 2524771 - RNA, 15 nt, Chlamydophila pneumoniae CWL029
aggguguuugcauag

SEQ ID NO: 2524772 - RNA, 20 nt, Chlamydophila pneumoniae CWL029
aggguucaauuccuuucucc

SEQ ID NO: 2524773 - RNA, 12 nt, Chlamydophila pneumoniae CWL029
aggguucaucug

SEQ ID NO: 2524774 - RNA, 21 nt, Chlamydophila pneumoniae CWL029
aggguugugucucugaagacc

SEQ ID NO: 2524775 - RNA, 17 nt, Chlamydophila pneumoniae CWL029
agguaaaacuacaggaa

SEQ ID NO: 2524776 - RNA, 16 nt, Chlamydophila pneumoniae CWL029
agguaaaauaaagagc

SEQ ID NO: 2524777 - RNA, 16 nt, Chlamydophila pneumoniae CWL029
agguaaauuuuuaaaa

SEQ ID NO: 2524778 - RNA, 19 nt, Chlamydophila pneumoniae CWL029
agguaaauuuuuaaaacuc

SEQ ID NO: 2524779 - RNA, 15 nt, Chlamydophila pneumoniae CWL029
agguaagaagcuguc

SEQ ID NO: 2524780 - RNA, 18 nt, Chlamydophila pneumoniae CWL029
agguaaugucguaccccg

SEQ ID NO: 2524781 - RNA, 20 nt, Chlamydophila pneumoniae CWL029
agguacgcuuuuucuugaaa

SEQ ID NO: 2524782 - RNA, 13 nt, Chlamydophila pneumoniae CWL029
agguacuuuauag

SEQ ID NO: 2524783 - RNA, 16 nt, Chlamydophila pneumoniae CWL029
agguagaguccacagu

SEQ ID NO: 2524784 - RNA, 20 nt, Chlamydophila pneumoniae CWL029
agguagcauaggcuaagacu

SEQ ID NO: 2524785 - RNA, 22 nt, Chlamydophila pneumoniae CWL029
agguaucaauaaugacucuaga

SEQ ID NO: 2524786 - RNA, 14 nt, Chlamydophila pneumoniae CWL029
agguaucagcaaga

SEQ ID NO: 2524787 - RNA, 16 nt, Chlamydophila pneumoniae CWL029
agguaucccacgauau

SEQ ID NO: 2524788 - RNA, 20 nt, Chlamydophila pneumoniae CWL029
agguauugcaaauuucauuu

SEQ ID NO: 2524789 - RNA, 16 nt, Chlamydophila pneumoniae CWL029
aggucacagcauuuuc

SEQ ID NO: 2524790 - RNA, 20 nt, Chlamydophila pneumoniae CWL029
aggucacagcauuuucucug

SEQ ID NO: 2524791 - RNA, 21 nt, Chlamydophila pneumoniae CWL029
aggucagcaaggggaguuuuc

SEQ ID NO: 2524792 - RNA, 15 nt, Chlamydophila pneumoniae CWL029
aggucagcccugccu

SEQ ID NO: 2524793 - RNA, 19 nt, Chlamydophila pneumoniae CWL029
aggucgaagauucaaagaa

SEQ ID NO: 2524794 - RNA, 20 nt, Chlamydophila pneumoniae CWL029
aggucgaagauucaaagaag

SEQ ID NO: 2524795 - RNA, 16 nt, Chlamydophila pneumoniae CWL029
aggucgcaucaaugac

SEQ ID NO: 2524796 - RNA, 13 nt, Chlamydophila pneumoniae CWL029
aggucguaaacgg

SEQ ID NO: 2524797 - RNA, 18 nt, Chlamydophila pneumoniae CWL029
aggucugcucuauauauc

SEQ ID NO: 2524798 - RNA, 21 nt, Chlamydophila pneumoniae CWL029
aggucugcucuauauauccug

SEQ ID NO: 2524799 - RNA, 21 nt, Chlamydophila pneumoniae CWL029
aggucuguuggucucuauuua

SEQ ID NO: 2524800 - RNA, 17 nt, Chlamydophila pneumoniae CWL029
aggucuuccaucucuuu

SEQ ID NO: 2524801 - RNA, 15 nt, Chlamydophila pneumoniae CWL029
aggugauauuuucuu

SEQ ID NO: 2524802 - RNA, 17 nt, Chlamydophila pneumoniae CWL029
aggugcggaacucauca

SEQ ID NO: 2524803 - RNA, 16 nt, Chlamydophila pneumoniae CWL029
agguggguagccagga

SEQ ID NO: 2524804 - RNA, 22 nt, Chlamydophila pneumoniae CWL029
agguguuuuggcugcuuuuguu

SEQ ID NO: 2524805 - RNA, 18 nt, Chlamydophila pneumoniae CWL029
agguuauuaucaaaguga

SEQ ID NO: 2524806 - RNA, 21 nt, Chlamydophila pneumoniae CWL029
agguuauuuaauccaaaaacu

SEQ ID NO: 2524807 - RNA, 22 nt, Chlamydophila pneumoniae CWL029
agguucuuuucggaucagaaug

SEQ ID NO: 2524808 - RNA, 15 nt, Chlamydophila pneumoniae CWL029
agguugcuuuucuag

SEQ ID NO: 2524809 - RNA, 23 nt, Chlamydophila pneumoniae CWL029
agguuugcaauuuucucaauagu

SEQ ID NO: 2524810 - RNA, 18 nt, Chlamydophila pneumoniae CWL029
agguuugcugcucuccaa

SEQ ID NO: 2524811 - RNA, 21 nt, Chlamydophila pneumoniae CWL029
agguuugggugcuaaguuguu

SEQ ID NO: 2524812 - RNA, 22 nt, Chlamydophila pneumoniae CWL029
agguuuuaaaaugugucuugcu

SEQ ID NO: 2524813 - RNA, 14 nt, Chlamydophila pneumoniae CWL029
agguuuuuccaacu

SEQ ID NO: 2524814 - RNA, 20 nt, Chlamydophila pneumoniae CWL029
agguuuuuccaacuucaacu

SEQ ID NO: 2524815 - RNA, 21 nt, Chlamydophila pneumoniae CWL029
agguuuuuccaacuucaacuu

SEQ ID NO: 2524816 - RNA, 13 nt, Chlamydophila pneumoniae CWL029
aguaaaacacaaa

SEQ ID NO: 2524817 - RNA, 20 nt, Chlamydophila pneumoniae CWL029
aguaaaaucauaggcuauaa

SEQ ID NO: 2524818 - RNA, 22 nt, Chlamydophila pneumoniae CWL029
aguaaaauuucuguagugagau

SEQ ID NO: 2524819 - RNA, 18 nt, Chlamydophila pneumoniae CWL029
aguaaacccucagaacac

SEQ ID NO: 2524820 - RNA, 20 nt, Chlamydophila pneumoniae CWL029
aguaaagaaauucuggaguc

SEQ ID NO: 2524821 - RNA, 19 nt, Chlamydophila pneumoniae CWL029
aguaaagaaucacucucua

SEQ ID NO: 2524822 - RNA, 12 nt, Chlamydophila pneumoniae CWL029
aguaaagccaca

SEQ ID NO: 2524823 - RNA, 19 nt, Chlamydophila pneumoniae CWL029
aguaaauauuuuaccauug

SEQ ID NO: 2524824 - RNA, 23 nt, Chlamydophila pneumoniae CWL029
aguaaccaauacagcauaaaaau

SEQ ID NO: 2524825 - RNA, 19 nt, Chlamydophila pneumoniae CWL029
aguaacuuaaucaauccua

SEQ ID NO: 2524826 - RNA, 21 nt, Chlamydophila pneumoniae CWL029
aguaagcgauuucgacagcag

SEQ ID NO: 2524827 - RNA, 17 nt, Chlamydophila pneumoniae CWL029
aguaaucacuucagcac

SEQ ID NO: 2524828 - RNA, 23 nt, Chlamydophila pneumoniae CWL029
aguaaucuggaagcaaucuguau

SEQ ID NO: 2524829 - RNA, 23 nt, Chlamydophila pneumoniae CWL029
aguaauuccaaaauaaaaggagc

SEQ ID NO: 2524830 - RNA, 15 nt, Chlamydophila pneumoniae CWL029
aguacaggcuccauc

SEQ ID NO: 2524831 - RNA, 18 nt, Chlamydophila pneumoniae CWL029
aguacauuaucacagcaa

SEQ ID NO: 2524832 - RNA, 21 nt, Chlamydophila pneumoniae CWL029
aguacauuaucacagcaaucu

SEQ ID NO: 2524833 - RNA, 14 nt, Chlamydophila pneumoniae CWL029
aguaccaagaaaau

SEQ ID NO: 2524834 - RNA, 18 nt, Chlamydophila pneumoniae CWL029
aguaccaagaaaauagua

SEQ ID NO: 2524835 - RNA, 16 nt, Chlamydophila pneumoniae CWL029
aguaccuaggaucuac

SEQ ID NO: 2524836 - RNA, 18 nt, Chlamydophila pneumoniae CWL029
aguaccuaggaucuacau

SEQ ID NO: 2524837 - RNA, 22 nt, Chlamydophila pneumoniae CWL029
aguaccuucucgucauucugca

SEQ ID NO: 2524838 - RNA, 23 nt, Chlamydophila pneumoniae CWL029
aguaccuucucgucauucugcaa

SEQ ID NO: 2524839 - RNA, 18 nt, Chlamydophila pneumoniae CWL029
aguacgaccaacuccuca

SEQ ID NO: 2524840 - RNA, 23 nt, Chlamydophila pneumoniae CWL029
aguacgaccaacuccucaaaaga

SEQ ID NO: 2524841 - RNA, 14 nt, Chlamydophila pneumoniae CWL029
aguacgcaaaguac

SEQ ID NO: 2524842 - RNA, 15 nt, Chlamydophila pneumoniae CWL029
aguacuacaauaacc

SEQ ID NO: 2524843 - RNA, 15 nt, Chlamydophila pneumoniae CWL029
aguacuucuuacccu

SEQ ID NO: 2524844 - RNA, 16 nt, Chlamydophila pneumoniae CWL029
aguagaacugcgaagg

SEQ ID NO: 2524845 - RNA, 12 nt, Chlamydophila pneumoniae CWL029
aguagagaaugu

SEQ ID NO: 2524846 - RNA, 15 nt, Chlamydophila pneumoniae CWL029
aguagaucuucugaa

SEQ ID NO: 2524847 - RNA, 21 nt, Chlamydophila pneumoniae CWL029
aguagaucuucugaaaucaaa

SEQ ID NO: 2524848 - RNA, 22 nt, Chlamydophila pneumoniae CWL029
aguagaucuucugaaaucaaaa

SEQ ID NO: 2524849 - RNA, 21 nt, Chlamydophila pneumoniae CWL029
aguagauuaaaggcauagaua

SEQ ID NO: 2524850 - RNA, 21 nt, Chlamydophila pneumoniae CWL029
aguagccagacuggucuaacu

SEQ ID NO: 2524851 - RNA, 18 nt, Chlamydophila pneumoniae CWL029
aguagcuauucucaaauu

SEQ ID NO: 2524852 - RNA, 20 nt, Chlamydophila pneumoniae CWL029
aguagcuugugcuaaagcag

SEQ ID NO: 2524853 - RNA, 12 nt, Chlamydophila pneumoniae CWL029
aguaggaauuuu

SEQ ID NO: 2524854 - RNA, 15 nt, Chlamydophila pneumoniae CWL029
aguaggcgaugcaaa

SEQ ID NO: 2524855 - RNA, 20 nt, Chlamydophila pneumoniae CWL029
aguaggcgaugcaaauucca

SEQ ID NO: 2524856 - RNA, 18 nt, Chlamydophila pneumoniae CWL029
aguaggguguauucugaa

SEQ ID NO: 2524857 - RNA, 18 nt, Chlamydophila pneumoniae CWL029
aguaggucucccuggucu

SEQ ID NO: 2524858 - RNA, 18 nt, Chlamydophila pneumoniae CWL029
aguaguaaugcagccaca

SEQ ID NO: 2524859 - RNA, 17 nt, Chlamydophila pneumoniae CWL029
aguagucgauugccgug

SEQ ID NO: 2524860 - RNA, 13 nt, Chlamydophila pneumoniae CWL029
aguauaagaugcu

SEQ ID NO: 2524861 - RNA, 11 nt, Chlamydophila pneumoniae CWL029
aguauagagaa

SEQ ID NO: 2524862 - RNA, 17 nt, Chlamydophila pneumoniae CWL029
aguaucgggauuuuguc

SEQ ID NO: 2524863 - RNA, 17 nt, Chlamydophila pneumoniae CWL029
aguaucuagcuuugucu

SEQ ID NO: 2524864 - RNA, 17 nt, Chlamydophila pneumoniae CWL029
aguaugaggagauaaag

SEQ ID NO: 2524865 - RNA, 19 nt, Chlamydophila pneumoniae CWL029
aguaugaggagauaaagau

SEQ ID NO: 2524866 - RNA, 22 nt, Chlamydophila pneumoniae CWL029
aguauggcguuuuuuuugauuu

SEQ ID NO: 2524867 - RNA, 15 nt, Chlamydophila pneumoniae CWL029
aguauuaaagaugaa

SEQ ID NO: 2524868 - RNA, 15 nt, Chlamydophila pneumoniae CWL029
aguauuaaucuuauu

SEQ ID NO: 2524869 - RNA, 18 nt, Chlamydophila pneumoniae CWL029
aguauuauaaauagaaau

SEQ ID NO: 2524870 - RNA, 20 nt, Chlamydophila pneumoniae CWL029
aguauucccuccgcaguugu

SEQ ID NO: 2524871 - RNA, 21 nt, Chlamydophila pneumoniae CWL029
aguauucuguggaauaucagg

SEQ ID NO: 2524872 - RNA, 22 nt, Chlamydophila pneumoniae CWL029
aguauucuguggaauaucagga

SEQ ID NO: 2524873 - RNA, 14 nt, Chlamydophila pneumoniae CWL029
aguauuuuuaaaua

SEQ ID NO: 2524874 - RNA, 21 nt, Chlamydophila pneumoniae CWL029
aguauuuuuaaauacagauuc

SEQ ID NO: 2524875 - RNA, 13 nt, Chlamydophila pneumoniae CWL029
agucaaaaauucu

SEQ ID NO: 2524876 - RNA, 16 nt, Chlamydophila pneumoniae CWL029
agucaaaaauucuucg

SEQ ID NO: 2524877 - RNA, 12 nt, Chlamydophila pneumoniae CWL029
agucaaacauca

SEQ ID NO: 2524878 - RNA, 17 nt, Chlamydophila pneumoniae CWL029
agucaaaggauccauaa

SEQ ID NO: 2524879 - RNA, 20 nt, Chlamydophila pneumoniae CWL029
agucaaaggauccauaaccu

SEQ ID NO: 2524880 - RNA, 16 nt, Chlamydophila pneumoniae CWL029
agucaaauacuucucc

SEQ ID NO: 2524881 - RNA, 22 nt, Chlamydophila pneumoniae CWL029
agucaaauacuucuccugaacc

SEQ ID NO: 2524882 - RNA, 16 nt, Chlamydophila pneumoniae CWL029
agucacaaauuuuugc

SEQ ID NO: 2524883 - RNA, 16 nt, Chlamydophila pneumoniae CWL029
agucaccuuacaucca

SEQ ID NO: 2524884 - RNA, 22 nt, Chlamydophila pneumoniae CWL029
agucacuaaagauacuuaucuu

SEQ ID NO: 2524885 - RNA, 19 nt, Chlamydophila pneumoniae CWL029
agucacuuucagccuguaa

SEQ ID NO: 2524886 - RNA, 17 nt, Chlamydophila pneumoniae CWL029
agucagguaaagagcuu

SEQ ID NO: 2524887 - RNA, 18 nt, Chlamydophila pneumoniae CWL029
agucauacauuugauuca

SEQ ID NO: 2524888 - RNA, 16 nt, Chlamydophila pneumoniae CWL029
agucauuagcaagagc

SEQ ID NO: 2524889 - RNA, 14 nt, Chlamydophila pneumoniae CWL029
aguccaagaucaaa

SEQ ID NO: 2524890 - RNA, 16 nt, Chlamydophila pneumoniae CWL029
aguccaagaucaaacg

SEQ ID NO: 2524891 - RNA, 23 nt, Chlamydophila pneumoniae CWL029
aguccaucggggcggacuauguu

SEQ ID NO: 2524892 - RNA, 18 nt, Chlamydophila pneumoniae CWL029
aguccaugaaucugguuc

SEQ ID NO: 2524893 - RNA, 16 nt, Chlamydophila pneumoniae CWL029
agucccccuaagggcu

SEQ ID NO: 2524894 - RNA, 23 nt, Chlamydophila pneumoniae CWL029
agucccccuaagggcucuagaua

SEQ ID NO: 2524895 - RNA, 18 nt, Chlamydophila pneumoniae CWL029
agucccuaaccucgccuc

SEQ ID NO: 2524896 - RNA, 17 nt, Chlamydophila pneumoniae CWL029
aguccgauagcaaugau

SEQ ID NO: 2524897 - RNA, 21 nt, Chlamydophila pneumoniae CWL029
aguccuccauguacaguuugu

SEQ ID NO: 2524898 - RNA, 15 nt, Chlamydophila pneumoniae CWL029
aguccucuaugguuu

SEQ ID NO: 2524899 - RNA, 15 nt, Chlamydophila pneumoniae CWL029
aguccugauuuuuca

SEQ ID NO: 2524900 - RNA, 19 nt, Chlamydophila pneumoniae CWL029
aguccugcaggcuucacca

SEQ ID NO: 2524901 - RNA, 21 nt, Chlamydophila pneumoniae CWL029
aguccuggauuuuaaagcaaa

SEQ ID NO: 2524902 - RNA, 16 nt, Chlamydophila pneumoniae CWL029
aguccugggguucucu

SEQ ID NO: 2524903 - RNA, 18 nt, Chlamydophila pneumoniae CWL029
aguccuguauauucugaa

SEQ ID NO: 2524904 - RNA, 18 nt, Chlamydophila pneumoniae CWL029
aguccuguuugaaaauau

SEQ ID NO: 2524905 - RNA, 20 nt, Chlamydophila pneumoniae CWL029
aguccuuauuucaaagaaga

SEQ ID NO: 2524906 - RNA, 13 nt, Chlamydophila pneumoniae CWL029
aguccuucuuccc

SEQ ID NO: 2524907 - RNA, 22 nt, Chlamydophila pneumoniae CWL029
aguccuucuucccagccuugau

SEQ ID NO: 2524908 - RNA, 14 nt, Chlamydophila pneumoniae CWL029
aguccuugaauuag

SEQ ID NO: 2524909 - RNA, 21 nt, Chlamydophila pneumoniae CWL029
agucgagaaacaaaaucuuuu

SEQ ID NO: 2524910 - RNA, 14 nt, Chlamydophila pneumoniae CWL029
agucgauaaaaacu

SEQ ID NO: 2524911 - RNA, 22 nt, Chlamydophila pneumoniae CWL029
agucgauacccaaagaggggag

SEQ ID NO: 2524912 - RNA, 19 nt, Chlamydophila pneumoniae CWL029
agucgugagaagcaucuuc

SEQ ID NO: 2524913 - RNA, 14 nt, Chlamydophila pneumoniae CWL029
agucgugcaggaga

SEQ ID NO: 2524914 - RNA, 15 nt, Chlamydophila pneumoniae CWL029
agucguuaacaucaa

SEQ ID NO: 2524915 - RNA, 23 nt, Chlamydophila pneumoniae CWL029
agucuauagccucuucuacacca

SEQ ID NO: 2524916 - RNA, 17 nt, Chlamydophila pneumoniae CWL029
agucuauaucuacagcu

SEQ ID NO: 2524917 - RNA, 18 nt, Chlamydophila pneumoniae CWL029
agucuauaucuacagcua

SEQ ID NO: 2524918 - RNA, 17 nt, Chlamydophila pneumoniae CWL029
agucuauuugaaaagaa

SEQ ID NO: 2524919 - RNA, 20 nt, Chlamydophila pneumoniae CWL029
agucucacucuuuucuagaa

SEQ ID NO: 2524920 - RNA, 16 nt, Chlamydophila pneumoniae CWL029
agucucaguugagaac

SEQ ID NO: 2524921 - RNA, 18 nt, Chlamydophila pneumoniae CWL029
agucuccauaauucugca

SEQ ID NO: 2524922 - RNA, 18 nt, Chlamydophila pneumoniae CWL029
agucuccuggaacaguau

SEQ ID NO: 2524923 - RNA, 15 nt, Chlamydophila pneumoniae CWL029
agucucucuaaggga

SEQ ID NO: 2524924 - RNA, 23 nt, Chlamydophila pneumoniae CWL029
agucucuuucagcucaaguuggc

SEQ ID NO: 2524925 - RNA, 12 nt, Chlamydophila pneumoniae CWL029
agucugaacauu

SEQ ID NO: 2524926 - RNA, 15 nt, Chlamydophila pneumoniae CWL029
agucugauguaggug

SEQ ID NO: 2524927 - RNA, 17 nt, Chlamydophila pneumoniae CWL029
agucugcagcagaugaa

SEQ ID NO: 2524928 - RNA, 15 nt, Chlamydophila pneumoniae CWL029
agucuggcauaaguc

SEQ ID NO: 2524929 - RNA, 21 nt, Chlamydophila pneumoniae CWL029
agucugguuuuucuccugacu

SEQ ID NO: 2524930 - RNA, 16 nt, Chlamydophila pneumoniae CWL029
agucuucccucuccuu

SEQ ID NO: 2524931 - RNA, 15 nt, Chlamydophila pneumoniae CWL029
agucuucgacaagga

SEQ ID NO: 2524932 - RNA, 17 nt, Chlamydophila pneumoniae CWL029
agucuugaguucuuuug

SEQ ID NO: 2524933 - RNA, 20 nt, Chlamydophila pneumoniae CWL029
agucuugaguucuuuuguuu

SEQ ID NO: 2524934 - RNA, 20 nt, Chlamydophila pneumoniae CWL029
agucuugcgccagcaaagau

SEQ ID NO: 2524935 - RNA, 21 nt, Chlamydophila pneumoniae CWL029
agucuugcgccagcaaagauu

SEQ ID NO: 2524936 - RNA, 14 nt, Chlamydophila pneumoniae CWL029
agucuuuuucagaa

SEQ ID NO: 2524937 - RNA, 20 nt, Chlamydophila pneumoniae CWL029
agugaacucuucaagagcuu

SEQ ID NO: 2524938 - RNA, 16 nt, Chlamydophila pneumoniae CWL029
agugaagacaaguaaa

SEQ ID NO: 2524939 - RNA, 13 nt, Chlamydophila pneumoniae CWL029
agugaauccuucc

SEQ ID NO: 2524940 - RNA, 14 nt, Chlamydophila pneumoniae CWL029
agugaaugagcuuc

SEQ ID NO: 2524941 - RNA, 17 nt, Chlamydophila pneumoniae CWL029
agugaauuucuugacuu

SEQ ID NO: 2524942 - RNA, 17 nt, Chlamydophila pneumoniae CWL029
agugacaccaacaacaa

SEQ ID NO: 2524943 - RNA, 16 nt, Chlamydophila pneumoniae CWL029
agugacuuuucuucuu

SEQ ID NO: 2524944 - RNA, 15 nt, Chlamydophila pneumoniae CWL029
agugauaaggaagaa

SEQ ID NO: 2524945 - RNA, 13 nt, Chlamydophila pneumoniae CWL029
agugaucagaaau

SEQ ID NO: 2524946 - RNA, 19 nt, Chlamydophila pneumoniae CWL029
agugaucuugagaaaagaa

SEQ ID NO: 2524947 - RNA, 14 nt, Chlamydophila pneumoniae CWL029
agugauggggauua

SEQ ID NO: 2524948 - RNA, 21 nt, Chlamydophila pneumoniae CWL029
agugauuacggcgugccuuuu

SEQ ID NO: 2524949 - RNA, 18 nt, Chlamydophila pneumoniae CWL029
agugccaagagcaucaca

SEQ ID NO: 2524950 - RNA, 15 nt, Chlamydophila pneumoniae CWL029
agugcuagaugaaga

SEQ ID NO: 2524951 - RNA, 15 nt, Chlamydophila pneumoniae CWL029
agugcucaguaaaua

SEQ ID NO: 2524952 - RNA, 19 nt, Chlamydophila pneumoniae CWL029
agugcucaguaaauauuuu

SEQ ID NO: 2524953 - RNA, 13 nt, Chlamydophila pneumoniae CWL029
agugcugccauga

SEQ ID NO: 2524954 - RNA, 19 nt, Chlamydophila pneumoniae CWL029
aguggaaauugugaaaaaa

SEQ ID NO: 2524955 - RNA, 19 nt, Chlamydophila pneumoniae CWL029
aguggacuauagaugccau

SEQ ID NO: 2524956 - RNA, 13 nt, Chlamydophila pneumoniae CWL029
aguggcgacugca

SEQ ID NO: 2524957 - RNA, 18 nt, Chlamydophila pneumoniae CWL029
aguggcuuauagagagaa

SEQ ID NO: 2524958 - RNA, 20 nt, Chlamydophila pneumoniae CWL029
agugguaugcuuuuccuucu

SEQ ID NO: 2524959 - RNA, 14 nt, Chlamydophila pneumoniae CWL029
aguggucaauugca

SEQ ID NO: 2524960 - RNA, 15 nt, Chlamydophila pneumoniae CWL029
aguguauaacguaga

SEQ ID NO: 2524961 - RNA, 19 nt, Chlamydophila pneumoniae CWL029
aguguauaacguagauguc

SEQ ID NO: 2524962 - RNA, 17 nt, Chlamydophila pneumoniae CWL029
aguguauaucagcaaaa

SEQ ID NO: 2524963 - RNA, 22 nt, Chlamydophila pneumoniae CWL029
aguguauuguuugcuauacaga

SEQ ID NO: 2524964 - RNA, 16 nt, Chlamydophila pneumoniae CWL029
agugucauacgcagca

SEQ ID NO: 2524965 - RNA, 20 nt, Chlamydophila pneumoniae CWL029
agugucaucggcuucuccaa

SEQ ID NO: 2524966 - RNA, 21 nt, Chlamydophila pneumoniae CWL029
agugucaucggcuucuccaac

SEQ ID NO: 2524967 - RNA, 14 nt, Chlamydophila pneumoniae CWL029
agugucccauggcu

SEQ ID NO: 2524968 - RNA, 15 nt, Chlamydophila pneumoniae CWL029
agugucuaagauaua

SEQ ID NO: 2524969 - RNA, 23 nt, Chlamydophila pneumoniae CWL029
agugucuaagauauagagagagu

SEQ ID NO: 2524970 - RNA, 14 nt, Chlamydophila pneumoniae CWL029
agugugacugcaga

SEQ ID NO: 2524971 - RNA, 15 nt, Chlamydophila pneumoniae CWL029
agugugaggagacuu

SEQ ID NO: 2524972 - RNA, 14 nt, Chlamydophila pneumoniae CWL029
agugugcucuguau

SEQ ID NO: 2524973 - RNA, 21 nt, Chlamydophila pneumoniae CWL029
agugugguuuaccuuguuuuc

SEQ ID NO: 2524974 - RNA, 11 nt, Chlamydophila pneumoniae CWL029
aguguguuuca

SEQ ID NO: 2524975 - RNA, 15 nt, Chlamydophila pneumoniae CWL029
aguguguuucaaaca

SEQ ID NO: 2524976 - RNA, 18 nt, Chlamydophila pneumoniae CWL029
aguguucgagcaucucaa

SEQ ID NO: 2524977 - RNA, 18 nt, Chlamydophila pneumoniae CWL029
aguguugccagcccaugu

SEQ ID NO: 2524978 - RNA, 22 nt, Chlamydophila pneumoniae CWL029
aguguuguuggagcagaaacuc

SEQ ID NO: 2524979 - RNA, 16 nt, Chlamydophila pneumoniae CWL029
aguguuucuuuaucua

SEQ ID NO: 2524980 - RNA, 16 nt, Chlamydophila pneumoniae CWL029
aguuaaagagcauccu

SEQ ID NO: 2524981 - RNA, 16 nt, Chlamydophila pneumoniae CWL029
aguuacggaacucauu

SEQ ID NO: 2524982 - RNA, 18 nt, Chlamydophila pneumoniae CWL029
aguuacugucugcaaaga

SEQ ID NO: 2524983 - RNA, 16 nt, Chlamydophila pneumoniae CWL029
aguuagaagagucauu

SEQ ID NO: 2524984 - RNA, 18 nt, Chlamydophila pneumoniae CWL029
aguuagagacacagaagg

SEQ ID NO: 2524985 - RNA, 23 nt, Chlamydophila pneumoniae CWL029
aguuagccuggcuaaaggaucau

SEQ ID NO: 2524986 - RNA, 15 nt, Chlamydophila pneumoniae CWL029
aguuaggaucccuga

SEQ ID NO: 2524987 - RNA, 23 nt, Chlamydophila pneumoniae CWL029
aguuaggaucccugauuccuugg

SEQ ID NO: 2524988 - RNA, 20 nt, Chlamydophila pneumoniae CWL029
aguuagguagauagaaauuc

SEQ ID NO: 2524989 - RNA, 17 nt, Chlamydophila pneumoniae CWL029
aguucauaaccugggca

SEQ ID NO: 2524990 - RNA, 22 nt, Chlamydophila pneumoniae CWL029
aguucauguugcucauccuuua

SEQ ID NO: 2524991 - RNA, 19 nt, Chlamydophila pneumoniae CWL029
aguucauuagcuaaaucaa

SEQ ID NO: 2524992 - RNA, 18 nt, Chlamydophila pneumoniae CWL029
aguuccaaaucucaaucg

SEQ ID NO: 2524993 - RNA, 18 nt, Chlamydophila pneumoniae CWL029
aguuccaagacaauaaaa

SEQ ID NO: 2524994 - RNA, 21 nt, Chlamydophila pneumoniae CWL029
aguuccaagacaauaaaaaag

SEQ ID NO: 2524995 - RNA, 23 nt, Chlamydophila pneumoniae CWL029
aguuccaagacaauaaaaaagag

SEQ ID NO: 2524996 - RNA, 18 nt, Chlamydophila pneumoniae CWL029
aguuccauagaguaucua

SEQ ID NO: 2524997 - RNA, 20 nt, Chlamydophila pneumoniae CWL029
aguuccauagaguaucuaaa

SEQ ID NO: 2524998 - RNA, 15 nt, Chlamydophila pneumoniae CWL029
aguuccgaauaggca

SEQ ID NO: 2524999 - RNA, 20 nt, Chlamydophila pneumoniae CWL029
aguuccgcggccaucauuaa

SEQ ID NO: 2525000 - RNA, 19 nt, Chlamydophila pneumoniae CWL029
aguucgcgaccugugauuu

SEQ ID NO: 2525001 - RNA, 20 nt, Chlamydophila pneumoniae CWL029
aguucgggcuaaucauuaga

SEQ ID NO: 2525002 - RNA, 17 nt, Chlamydophila pneumoniae CWL029
aguucguuggcccagag

SEQ ID NO: 2525003 - RNA, 20 nt, Chlamydophila pneumoniae CWL029
aguucucccgugaacaaaaa

SEQ ID NO: 2525004 - RNA, 22 nt, Chlamydophila pneumoniae CWL029
aguucucccgugaacaaaaacu

SEQ ID NO: 2525005 - RNA, 13 nt, Chlamydophila pneumoniae CWL029
aguucuucauucc

SEQ ID NO: 2525006 - RNA, 23 nt, Chlamydophila pneumoniae CWL029
aguucuucauuccaggauucuau

SEQ ID NO: 2525007 - RNA, 15 nt, Chlamydophila pneumoniae CWL029
aguucuuccaaagcu

SEQ ID NO: 2525008 - RNA, 10 nt, Chlamydophila pneumoniae CWL029
aguucuuccu

SEQ ID NO: 2525009 - RNA, 14 nt, Chlamydophila pneumoniae CWL029
aguucuuccuucuu

SEQ ID NO: 2525010 - RNA, 17 nt, Chlamydophila pneumoniae CWL029
aguucuuccuucuucuu

SEQ ID NO: 2525011 - RNA, 14 nt, Chlamydophila pneumoniae CWL029
aguucuucuuuacu

SEQ ID NO: 2525012 - RNA, 21 nt, Chlamydophila pneumoniae CWL029
aguucuucuuuacucaagugu

SEQ ID NO: 2525013 - RNA, 17 nt, Chlamydophila pneumoniae CWL029
aguucuugaaacucuau

SEQ ID NO: 2525014 - RNA, 18 nt, Chlamydophila pneumoniae CWL029
aguucuugccaauguggu

SEQ ID NO: 2525015 - RNA, 16 nt, Chlamydophila pneumoniae CWL029
aguucuuggaaaaaag

SEQ ID NO: 2525016 - RNA, 19 nt, Chlamydophila pneumoniae CWL029
aguucuuguaauaaaagaa

SEQ ID NO: 2525017 - RNA, 15 nt, Chlamydophila pneumoniae CWL029
aguucuuguuaaagu

SEQ ID NO: 2525018 - RNA, 18 nt, Chlamydophila pneumoniae CWL029
aguucuuuagcuacagaa

SEQ ID NO: 2525019 - RNA, 13 nt, Chlamydophila pneumoniae CWL029
aguucuuucugcu

SEQ ID NO: 2525020 - RNA, 22 nt, Chlamydophila pneumoniae CWL029
aguucuuuuugcagaucuuuua

SEQ ID NO: 2525021 - RNA, 20 nt, Chlamydophila pneumoniae CWL029
aguugagaaccuucacaaga

SEQ ID NO: 2525022 - RNA, 22 nt, Chlamydophila pneumoniae CWL029
aguugagaaccuucacaagaaa

SEQ ID NO: 2525023 - RNA, 16 nt, Chlamydophila pneumoniae CWL029
aguugaggaaaggagg

SEQ ID NO: 2525024 - RNA, 14 nt, Chlamydophila pneumoniae CWL029
aguugauuguagag

SEQ ID NO: 2525025 - RNA, 17 nt, Chlamydophila pneumoniae CWL029
aguugauuguagagaca

SEQ ID NO: 2525026 - RNA, 19 nt, Chlamydophila pneumoniae CWL029
aguugauuuagaaucuuuu

SEQ ID NO: 2525027 - RNA, 22 nt, Chlamydophila pneumoniae CWL029
aguugauuuagaaucuuuucua

SEQ ID NO: 2525028 - RNA, 21 nt, Chlamydophila pneumoniae CWL029
aguuggaucaaggaguacucu

SEQ ID NO: 2525029 - RNA, 17 nt, Chlamydophila pneumoniae CWL029
aguuggcguuuucuaga

SEQ ID NO: 2525030 - RNA, 23 nt, Chlamydophila pneumoniae CWL029
aguugguugcagucguauucagg

SEQ ID NO: 2525031 - RNA, 13 nt, Chlamydophila pneumoniae CWL029
aguuguaauuucu

SEQ ID NO: 2525032 - RNA, 14 nt, Chlamydophila pneumoniae CWL029
aguuguaauuucuu

SEQ ID NO: 2525033 - RNA, 18 nt, Chlamydophila pneumoniae CWL029
aguuguauccagcucaag

SEQ ID NO: 2525034 - RNA, 19 nt, Chlamydophila pneumoniae CWL029
aguuguauccagcucaagg

SEQ ID NO: 2525035 - RNA, 19 nt, Chlamydophila pneumoniae CWL029
aguuguuuuuugagauaca

SEQ ID NO: 2525036 - RNA, 22 nt, Chlamydophila pneumoniae CWL029
aguuguuuuuugagauacagcu

SEQ ID NO: 2525037 - RNA, 18 nt, Chlamydophila pneumoniae CWL029
aguuuaaacgucuuauga

SEQ ID NO: 2525038 - RNA, 15 nt, Chlamydophila pneumoniae CWL029
aguuuacaaauaaaa

SEQ ID NO: 2525039 - RNA, 18 nt, Chlamydophila pneumoniae CWL029
aguuuacaaauaaaauga

SEQ ID NO: 2525040 - RNA, 20 nt, Chlamydophila pneumoniae CWL029
aguuuacaaauaaaaugauu

SEQ ID NO: 2525041 - RNA, 21 nt, Chlamydophila pneumoniae CWL029
aguuuaccugaaaaaacagua

SEQ ID NO: 2525042 - RNA, 18 nt, Chlamydophila pneumoniae CWL029
aguuuaugacacagcuaa

SEQ ID NO: 2525043 - RNA, 18 nt, Chlamydophila pneumoniae CWL029
aguuucacauaguuuaau

SEQ ID NO: 2525044 - RNA, 20 nt, Chlamydophila pneumoniae CWL029
aguuuccaagugaucagaaa

SEQ ID NO: 2525045 - RNA, 17 nt, Chlamydophila pneumoniae CWL029
aguuucuaucuaaucaa

SEQ ID NO: 2525046 - RNA, 18 nt, Chlamydophila pneumoniae CWL029
aguuucuaucuaaucaau

SEQ ID NO: 2525047 - RNA, 15 nt, Chlamydophila pneumoniae CWL029
aguuucuuuugcaaa

SEQ ID NO: 2525048 - RNA, 18 nt, Chlamydophila pneumoniae CWL029
aguuugcaugcaacggag

SEQ ID NO: 2525049 - RNA, 16 nt, Chlamydophila pneumoniae CWL029
aguuugccuucuuauc

SEQ ID NO: 2525050 - RNA, 15 nt, Chlamydophila pneumoniae CWL029
aguuuggauguuuau

SEQ ID NO: 2525051 - RNA, 17 nt, Chlamydophila pneumoniae CWL029
aguuuguagcagcaaga

SEQ ID NO: 2525052 - RNA, 21 nt, Chlamydophila pneumoniae CWL029
aguuuguagcauuucuuucuc

SEQ ID NO: 2525053 - RNA, 17 nt, Chlamydophila pneumoniae CWL029
aguuuguucacauuuuc

SEQ ID NO: 2525054 - RNA, 13 nt, Chlamydophila pneumoniae CWL029
aguuuucaaaaau

SEQ ID NO: 2525055 - RNA, 16 nt, Chlamydophila pneumoniae CWL029
aguuuucaaacugauu

SEQ ID NO: 2525056 - RNA, 16 nt, Chlamydophila pneumoniae CWL029
aguuuucaagucugua

SEQ ID NO: 2525057 - RNA, 13 nt, Chlamydophila pneumoniae CWL029
aguuuucauaauc

SEQ ID NO: 2525058 - RNA, 19 nt, Chlamydophila pneumoniae CWL029
aguuuucauaauccaagaa

SEQ ID NO: 2525059 - RNA, 14 nt, Chlamydophila pneumoniae CWL029
aguuuuccauccac

SEQ ID NO: 2525060 - RNA, 19 nt, Chlamydophila pneumoniae CWL029
aguuuucgauacacaagau

SEQ ID NO: 2525061 - RNA, 15 nt, Chlamydophila pneumoniae CWL029
aguuuugaaaucaaa

SEQ ID NO: 2525062 - RNA, 23 nt, Chlamydophila pneumoniae CWL029
aguuuugguuuuagaaauguuuu

SEQ ID NO: 2525063 - RNA, 18 nt, Chlamydophila pneumoniae CWL029
aguuuuuaauuuucuguu

SEQ ID NO: 2525064 - RNA, 22 nt, Chlamydophila pneumoniae CWL029
aguuuuuuaaauaccuagagcu

SEQ ID NO: 2525065 - RNA, 22 nt, Chlamydophila pneumoniae CWL029
aguuuuuuaagugcuuuuagau

SEQ ID NO: 2525066 - RNA, 16 nt, Chlamydophila pneumoniae CWL029
aguuuuuucaauccuu

SEQ ID NO: 2525067 - RNA, 14 nt, Chlamydophila pneumoniae CWL029
auaaaaaaacccuc

SEQ ID NO: 2525068 - RNA, 13 nt, Chlamydophila pneumoniae CWL029
auaaaaaagagag

SEQ ID NO: 2525069 - RNA, 23 nt, Chlamydophila pneumoniae CWL029
auaaaaauaccaguagagaaugu

SEQ ID NO: 2525070 - RNA, 22 nt, Chlamydophila pneumoniae CWL029
auaaaacgcuauuguuuguccu

SEQ ID NO: 2525071 - RNA, 13 nt, Chlamydophila pneumoniae CWL029
auaaaagaaagaa

SEQ ID NO: 2525072 - RNA, 19 nt, Chlamydophila pneumoniae CWL029
auaaaagaacgauaaaauu

SEQ ID NO: 2525073 - RNA, 17 nt, Chlamydophila pneumoniae CWL029
auaaaagagcucaaaaa

SEQ ID NO: 2525074 - RNA, 17 nt, Chlamydophila pneumoniae CWL029
auaaaaggguagcgaau

SEQ ID NO: 2525075 - RNA, 20 nt, Chlamydophila pneumoniae CWL029
auaaaaggguagcgaaugaa

SEQ ID NO: 2525076 - RNA, 12 nt, Chlamydophila pneumoniae CWL029
auaaaauagccc

SEQ ID NO: 2525077 - RNA, 12 nt, Chlamydophila pneumoniae CWL029
auaaaauaggaa

SEQ ID NO: 2525078 - RNA, 16 nt, Chlamydophila pneumoniae CWL029
auaaaaucaagccaca

SEQ ID NO: 2525079 - RNA, 21 nt, Chlamydophila pneumoniae CWL029
auaaaaucaagccacagagaa

SEQ ID NO: 2525080 - RNA, 23 nt, Chlamydophila pneumoniae CWL029
auaaaaucguuuuauuuuaggag

SEQ ID NO: 2525081 - RNA, 16 nt, Chlamydophila pneumoniae CWL029
auaaaaugagcucacg

SEQ ID NO: 2525082 - RNA, 13 nt, Chlamydophila pneumoniae CWL029
auaaaauggccuc

SEQ ID NO: 2525083 - RNA, 14 nt, Chlamydophila pneumoniae CWL029
auaaaauuggcuuu

SEQ ID NO: 2525084 - RNA, 17 nt, Chlamydophila pneumoniae CWL029
auaaaauuuaaaaaaau

SEQ ID NO: 2525085 - RNA, 15 nt, Chlamydophila pneumoniae CWL029
auaaacauacaugcu

SEQ ID NO: 2525086 - RNA, 14 nt, Chlamydophila pneumoniae CWL029
auaaaccuuugguu

SEQ ID NO: 2525087 - RNA, 15 nt, Chlamydophila pneumoniae CWL029
auaaaccuuugguuu

SEQ ID NO: 2525088 - RNA, 19 nt, Chlamydophila pneumoniae CWL029
auaaacuccacgaauucuu

SEQ ID NO: 2525089 - RNA, 13 nt, Chlamydophila pneumoniae CWL029
auaaagaauuccc

SEQ ID NO: 2525090 - RNA, 12 nt, Chlamydophila pneumoniae CWL029
auaaagagcuga

SEQ ID NO: 2525091 - RNA, 12 nt, Chlamydophila pneumoniae CWL029
auaaagaggcuc

SEQ ID NO: 2525092 - RNA, 21 nt, Chlamydophila pneumoniae CWL029
auaaagauaaucuguaagaaa

SEQ ID NO: 2525093 - RNA, 14 nt, Chlamydophila pneumoniae CWL029
auaaagaucuucau

SEQ ID NO: 2525094 - RNA, 15 nt, Chlamydophila pneumoniae CWL029
auaaagaucuuuuau

SEQ ID NO: 2525095 - RNA, 14 nt, Chlamydophila pneumoniae CWL029
auaaaggcauaacu

SEQ ID NO: 2525096 - RNA, 16 nt, Chlamydophila pneumoniae CWL029
auaaaggcucuuuuag

SEQ ID NO: 2525097 - RNA, 17 nt, Chlamydophila pneumoniae CWL029
auaaagguuacaagcaa

SEQ ID NO: 2525098 - RNA, 11 nt, Chlamydophila pneumoniae CWL029
auaaaguauau

SEQ ID NO: 2525099 - RNA, 13 nt, Chlamydophila pneumoniae CWL029
auaaauacaggag

SEQ ID NO: 2525100 - RNA, 16 nt, Chlamydophila pneumoniae CWL029
auaaauacaggagaau

SEQ ID NO: 2525101 - RNA, 22 nt, Chlamydophila pneumoniae CWL029
auaaauacgugcuugaauauuu

SEQ ID NO: 2525102 - RNA, 15 nt, Chlamydophila pneumoniae CWL029
auaaauccaaaaaau

SEQ ID NO: 2525103 - RNA, 17 nt, Chlamydophila pneumoniae CWL029
auaaauccccaccaaca

SEQ ID NO: 2525104 - RNA, 17 nt, Chlamydophila pneumoniae CWL029
auaaaucccgaacaauc

SEQ ID NO: 2525105 - RNA, 21 nt, Chlamydophila pneumoniae CWL029
auaaauccgcagagucuauau

SEQ ID NO: 2525106 - RNA, 19 nt, Chlamydophila pneumoniae CWL029
auaaaucuauauccacaau

SEQ ID NO: 2525107 - RNA, 17 nt, Chlamydophila pneumoniae CWL029
auaaaucuauuccccuc

SEQ ID NO: 2525108 - RNA, 21 nt, Chlamydophila pneumoniae CWL029
auaaaugcuauuuuccucuau

SEQ ID NO: 2525109 - RNA, 17 nt, Chlamydophila pneumoniae CWL029
auaaauggaggauacuc

SEQ ID NO: 2525110 - RNA, 20 nt, Chlamydophila pneumoniae CWL029
auaaauggaggauacucaca

SEQ ID NO: 2525111 - RNA, 19 nt, Chlamydophila pneumoniae CWL029
auaaauucaggacccuuuu

SEQ ID NO: 2525112 - RNA, 13 nt, Chlamydophila pneumoniae CWL029
auaaauuuauaaa

SEQ ID NO: 2525113 - RNA, 16 nt, Chlamydophila pneumoniae CWL029
auaaauuuaucugcuu

SEQ ID NO: 2525114 - RNA, 12 nt, Chlamydophila pneumoniae CWL029
auaaauuugcuu

SEQ ID NO: 2525115 - RNA, 17 nt, Chlamydophila pneumoniae CWL029
auaacaaacgccgcucu

SEQ ID NO: 2525116 - RNA, 14 nt, Chlamydophila pneumoniae CWL029
auaacaccaaaaga

SEQ ID NO: 2525117 - RNA, 16 nt, Chlamydophila pneumoniae CWL029
auaacacuucuuucuu

SEQ ID NO: 2525118 - RNA, 21 nt, Chlamydophila pneumoniae CWL029
auaacaugcgcagaauaaaau

SEQ ID NO: 2525119 - RNA, 16 nt, Chlamydophila pneumoniae CWL029
auaacauugcuugcua

SEQ ID NO: 2525120 - RNA, 20 nt, Chlamydophila pneumoniae CWL029
auaacauuucguuuuuucuu

SEQ ID NO: 2525121 - RNA, 21 nt, Chlamydophila pneumoniae CWL029
auaaccaaaagaauuaagaag

SEQ ID NO: 2525122 - RNA, 21 nt, Chlamydophila pneumoniae CWL029
auaaccaacuuccuauaaaaa

SEQ ID NO: 2525123 - RNA, 18 nt, Chlamydophila pneumoniae CWL029
auaaccaaguaaaucaga

SEQ ID NO: 2525124 - RNA, 20 nt, Chlamydophila pneumoniae CWL029
auaaccaaguaaaucagacu

SEQ ID NO: 2525125 - RNA, 15 nt, Chlamydophila pneumoniae CWL029
auaaccagaagacuc

SEQ ID NO: 2525126 - RNA, 19 nt, Chlamydophila pneumoniae CWL029
auaaccaggggcuuuccuu

SEQ ID NO: 2525127 - RNA, 20 nt, Chlamydophila pneumoniae CWL029
auaaccaggggcuuuccuuc

SEQ ID NO: 2525128 - RNA, 15 nt, Chlamydophila pneumoniae CWL029
auaaccuaaggcaug

SEQ ID NO: 2525129 - RNA, 20 nt, Chlamydophila pneumoniae CWL029
auaaccuaaggcauggcaca

SEQ ID NO: 2525130 - RNA, 17 nt, Chlamydophila pneumoniae CWL029
auaaccuccauagaauc

SEQ ID NO: 2525131 - RNA, 21 nt, Chlamydophila pneumoniae CWL029
auaaccuuugacaacaccaca

SEQ ID NO: 2525132 - RNA, 20 nt, Chlamydophila pneumoniae CWL029
auaacgggguugucucuaca

SEQ ID NO: 2525133 - RNA, 16 nt, Chlamydophila pneumoniae CWL029
auaacuauugggaaug

SEQ ID NO: 2525134 - RNA, 21 nt, Chlamydophila pneumoniae CWL029
auaacuccacuaccaaggcag

SEQ ID NO: 2525135 - RNA, 19 nt, Chlamydophila pneumoniae CWL029
auaacugugcuccauagca

SEQ ID NO: 2525136 - RNA, 20 nt, Chlamydophila pneumoniae CWL029
auaacuugagccaacagguu

SEQ ID NO: 2525137 - RNA, 16 nt, Chlamydophila pneumoniae CWL029
auaacuuuaucauaga

SEQ ID NO: 2525138 - RNA, 18 nt, Chlamydophila pneumoniae CWL029
auaagaaaucaguccuaa

SEQ ID NO: 2525139 - RNA, 17 nt, Chlamydophila pneumoniae CWL029
auaagaaccucuaauuu

SEQ ID NO: 2525140 - RNA, 14 nt, Chlamydophila pneumoniae CWL029
auaagaacucuauu

SEQ ID NO: 2525141 - RNA, 17 nt, Chlamydophila pneumoniae CWL029
auaagaacuuuagggaa

SEQ ID NO: 2525142 - RNA, 22 nt, Chlamydophila pneumoniae CWL029
auaagaagcucuaucuuuggua

SEQ ID NO: 2525143 - RNA, 20 nt, Chlamydophila pneumoniae CWL029
auaagaaugguuauuucuug

SEQ ID NO: 2525144 - RNA, 14 nt, Chlamydophila pneumoniae CWL029
auaagaccagaaag

SEQ ID NO: 2525145 - RNA, 15 nt, Chlamydophila pneumoniae CWL029
auaagaccagaaagg

SEQ ID NO: 2525146 - RNA, 16 nt, Chlamydophila pneumoniae CWL029
auaagagacauuucuu

SEQ ID NO: 2525147 - RNA, 15 nt, Chlamydophila pneumoniae CWL029
auaagauauucaaga

SEQ ID NO: 2525148 - RNA, 13 nt, Chlamydophila pneumoniae CWL029
auaagaucaauau

SEQ ID NO: 2525149 - RNA, 15 nt, Chlamydophila pneumoniae CWL029
auaagauccaaaaau

SEQ ID NO: 2525150 - RNA, 23 nt, Chlamydophila pneumoniae CWL029
auaagaucucgugaauuacaggc

SEQ ID NO: 2525151 - RNA, 20 nt, Chlamydophila pneumoniae CWL029
auaagaucuuucauuuuaug

SEQ ID NO: 2525152 - RNA, 22 nt, Chlamydophila pneumoniae CWL029
auaagcaccacgaccuauacca

SEQ ID NO: 2525153 - RNA, 20 nt, Chlamydophila pneumoniae CWL029
auaagcaggaaaagcaaaau

SEQ ID NO: 2525154 - RNA, 18 nt, Chlamydophila pneumoniae CWL029
auaagcauauuuaaauau

SEQ ID NO: 2525155 - RNA, 20 nt, Chlamydophila pneumoniae CWL029
auaagcauauuuaaauauaa

SEQ ID NO: 2525156 - RNA, 15 nt, Chlamydophila pneumoniae CWL029
auaagcuugccagca

SEQ ID NO: 2525157 - RNA, 17 nt, Chlamydophila pneumoniae CWL029
auaagcuugccagcaga

SEQ ID NO: 2525158 - RNA, 18 nt, Chlamydophila pneumoniae CWL029
auaagcuugccagcagaa

SEQ ID NO: 2525159 - RNA, 19 nt, Chlamydophila pneumoniae CWL029
auaagcuugccagcagaag

SEQ ID NO: 2525160 - RNA, 18 nt, Chlamydophila pneumoniae CWL029
auaaggagauuccuaaac

SEQ ID NO: 2525161 - RNA, 21 nt, Chlamydophila pneumoniae CWL029
auaaggauguuguggaucaga

SEQ ID NO: 2525162 - RNA, 14 nt, Chlamydophila pneumoniae CWL029
auaaggcuugagga

SEQ ID NO: 2525163 - RNA, 19 nt, Chlamydophila pneumoniae CWL029
auaaguagauuaaaggcau

SEQ ID NO: 2525164 - RNA, 16 nt, Chlamydophila pneumoniae CWL029
auaagucaaaaugugc

SEQ ID NO: 2525165 - RNA, 16 nt, Chlamydophila pneumoniae CWL029
auaagugacuuuucuu

SEQ ID NO: 2525166 - RNA, 23 nt, Chlamydophila pneumoniae CWL029
auaaguuacuuucugauugagaa

SEQ ID NO: 2525167 - RNA, 20 nt, Chlamydophila pneumoniae CWL029
auaaguuuugauuuugcagu

SEQ ID NO: 2525168 - RNA, 15 nt, Chlamydophila pneumoniae CWL029
auaauaaaagcaccc

SEQ ID NO: 2525169 - RNA, 13 nt, Chlamydophila pneumoniae CWL029
auaauaauggcau

SEQ ID NO: 2525170 - RNA, 14 nt, Chlamydophila pneumoniae CWL029
auaauagagaagaa

SEQ ID NO: 2525171 - RNA, 19 nt, Chlamydophila pneumoniae CWL029
auaauagagaagaagcaaa

SEQ ID NO: 2525172 - RNA, 21 nt, Chlamydophila pneumoniae CWL029
auaauagauauacgcccaugu

SEQ ID NO: 2525173 - RNA, 16 nt, Chlamydophila pneumoniae CWL029
auaauaggauaagaaa

SEQ ID NO: 2525174 - RNA, 18 nt, Chlamydophila pneumoniae CWL029
auaauaggauaagaaauu

SEQ ID NO: 2525175 - RNA, 22 nt, Chlamydophila pneumoniae CWL029
auaauagugagcucccugaugu

SEQ ID NO: 2525176 - RNA, 17 nt, Chlamydophila pneumoniae CWL029
auaauauaacugcauac

SEQ ID NO: 2525177 - RNA, 21 nt, Chlamydophila pneumoniae CWL029
auaauauuuuuuuaagaucuc

SEQ ID NO: 2525178 - RNA, 13 nt, Chlamydophila pneumoniae CWL029
auaaucaauccac

SEQ ID NO: 2525179 - RNA, 18 nt, Chlamydophila pneumoniae CWL029
auaaucacuuaauaaugu

SEQ ID NO: 2525180 - RNA, 20 nt, Chlamydophila pneumoniae CWL029
auaaucagaacaacgcugcu

SEQ ID NO: 2525181 - RNA, 21 nt, Chlamydophila pneumoniae CWL029
auaaucagaggagccuccaua

SEQ ID NO: 2525182 - RNA, 23 nt, Chlamydophila pneumoniae CWL029
auaaucauuaagacucaauacuu

SEQ ID NO: 2525183 - RNA, 14 nt, Chlamydophila pneumoniae CWL029
auaauccaagauac

SEQ ID NO: 2525184 - RNA, 16 nt, Chlamydophila pneumoniae CWL029
auaaucccuacccccu

SEQ ID NO: 2525185 - RNA, 18 nt, Chlamydophila pneumoniae CWL029
auaaucgcacuucuauuu

SEQ ID NO: 2525186 - RNA, 14 nt, Chlamydophila pneumoniae CWL029
auaaucuauaggau

SEQ ID NO: 2525187 - RNA, 19 nt, Chlamydophila pneumoniae CWL029
auaaucuccaaacauuuuu

SEQ ID NO: 2525188 - RNA, 21 nt, Chlamydophila pneumoniae CWL029
auaaucugcgugucguugguu

SEQ ID NO: 2525189 - RNA, 15 nt, Chlamydophila pneumoniae CWL029
auaaucuguaagaaa

SEQ ID NO: 2525190 - RNA, 17 nt, Chlamydophila pneumoniae CWL029
auaaucuguaagaaaau

SEQ ID NO: 2525191 - RNA, 20 nt, Chlamydophila pneumoniae CWL029
auaaucuguaagaaaaugag

SEQ ID NO: 2525192 - RNA, 14 nt, Chlamydophila pneumoniae CWL029
auaaucuucaaaag

SEQ ID NO: 2525193 - RNA, 18 nt, Chlamydophila pneumoniae CWL029
auaaugaagcagggaaaa

SEQ ID NO: 2525194 - RNA, 16 nt, Chlamydophila pneumoniae CWL029
auaaugacucuagagu

SEQ ID NO: 2525195 - RNA, 15 nt, Chlamydophila pneumoniae CWL029
auaaugcucacuucu

SEQ ID NO: 2525196 - RNA, 22 nt, Chlamydophila pneumoniae CWL029
auaaugguacaauacuggagag

SEQ ID NO: 2525197 - RNA, 17 nt, Chlamydophila pneumoniae CWL029
auaauguuuuaauagcu

SEQ ID NO: 2525198 - RNA, 23 nt, Chlamydophila pneumoniae CWL029
auaauuaaaucguauugacuuug

SEQ ID NO: 2525199 - RNA, 18 nt, Chlamydophila pneumoniae CWL029
auaauuauguagaucuac

SEQ ID NO: 2525200 - RNA, 18 nt, Chlamydophila pneumoniae CWL029
auaauucugcacauccgu

SEQ ID NO: 2525201 - RNA, 18 nt, Chlamydophila pneumoniae CWL029
auaauuucaaagaugcag

SEQ ID NO: 2525202 - RNA, 16 nt, Chlamydophila pneumoniae CWL029
auaauuuguuuagaaa

SEQ ID NO: 2525203 - RNA, 23 nt, Chlamydophila pneumoniae CWL029
auaauuuguuuagaaaaagaucu

SEQ ID NO: 2525204 - RNA, 13 nt, Chlamydophila pneumoniae CWL029
auaauuuucaguc

SEQ ID NO: 2525205 - RNA, 13 nt, Chlamydophila pneumoniae CWL029
auacaaaaaauaa

SEQ ID NO: 2525206 - RNA, 14 nt, Chlamydophila pneumoniae CWL029
auacaaaaaauaaa

SEQ ID NO: 2525207 - RNA, 17 nt, Chlamydophila pneumoniae CWL029
auacaaaacaaaagcca

SEQ ID NO: 2525208 - RNA, 18 nt, Chlamydophila pneumoniae CWL029
auacaaaacaaaagccau

SEQ ID NO: 2525209 - RNA, 15 nt, Chlamydophila pneumoniae CWL029
auacaaacaucgaaa

SEQ ID NO: 2525210 - RNA, 19 nt, Chlamydophila pneumoniae CWL029
auacaacgguauguauggu

SEQ ID NO: 2525211 - RNA, 18 nt, Chlamydophila pneumoniae CWL029
auacaauccagaaucucc

SEQ ID NO: 2525212 - RNA, 19 nt, Chlamydophila pneumoniae CWL029
auacagacaagcaaggaaa

SEQ ID NO: 2525213 - RNA, 20 nt, Chlamydophila pneumoniae CWL029
auacagacaagcaaggaaaa

SEQ ID NO: 2525214 - RNA, 20 nt, Chlamydophila pneumoniae CWL029
auacagauguuuucguaaau

SEQ ID NO: 2525215 - RNA, 16 nt, Chlamydophila pneumoniae CWL029
auacagcauaaaaauu

SEQ ID NO: 2525216 - RNA, 16 nt, Chlamydophila pneumoniae CWL029
auacagccagcagaag

SEQ ID NO: 2525217 - RNA, 21 nt, Chlamydophila pneumoniae CWL029
auacaggccugaugucuccau

SEQ ID NO: 2525218 - RNA, 22 nt, Chlamydophila pneumoniae CWL029
auacaggcuccucugcuaagca

SEQ ID NO: 2525219 - RNA, 16 nt, Chlamydophila pneumoniae CWL029
auacaguacgcaaagu

SEQ ID NO: 2525220 - RNA, 14 nt, Chlamydophila pneumoniae CWL029
auacaguagaaaca

SEQ ID NO: 2525221 - RNA, 15 nt, Chlamydophila pneumoniae CWL029
auacaguagaaacau

SEQ ID NO: 2525222 - RNA, 22 nt, Chlamydophila pneumoniae CWL029
auacaguuggcguuuucuagaa

SEQ ID NO: 2525223 - RNA, 13 nt, Chlamydophila pneumoniae CWL029
auacauagggaaa

SEQ ID NO: 2525224 - RNA, 15 nt, Chlamydophila pneumoniae CWL029
auacauagguaaaac

SEQ ID NO: 2525225 - RNA, 22 nt, Chlamydophila pneumoniae CWL029
auacauaucuccuuuaaauaaa

SEQ ID NO: 2525226 - RNA, 23 nt, Chlamydophila pneumoniae CWL029
auacaucaccacugcuccaauuu

SEQ ID NO: 2525227 - RNA, 22 nt, Chlamydophila pneumoniae CWL029
auacaucccauucaauaauuuc

SEQ ID NO: 2525228 - RNA, 18 nt, Chlamydophila pneumoniae CWL029
auacauccucacuagaga

SEQ ID NO: 2525229 - RNA, 17 nt, Chlamydophila pneumoniae CWL029
auacaucguauccaaau

SEQ ID NO: 2525230 - RNA, 22 nt, Chlamydophila pneumoniae CWL029
auacaucuuaagagcaaacauc

SEQ ID NO: 2525231 - RNA, 12 nt, Chlamydophila pneumoniae CWL029
auacauuccuag

SEQ ID NO: 2525232 - RNA, 14 nt, Chlamydophila pneumoniae CWL029
auacauucuauucu

SEQ ID NO: 2525233 - RNA, 23 nt, Chlamydophila pneumoniae CWL029
auacauugcugccaggcuuaaau

SEQ ID NO: 2525234 - RNA, 15 nt, Chlamydophila pneumoniae CWL029
auaccaaaauaccau

SEQ ID NO: 2525235 - RNA, 13 nt, Chlamydophila pneumoniae CWL029
auaccaaaauuau

SEQ ID NO: 2525236 - RNA, 16 nt, Chlamydophila pneumoniae CWL029
auaccaagaugaagaa

SEQ ID NO: 2525237 - RNA, 15 nt, Chlamydophila pneumoniae CWL029
auaccaaggcugcug

SEQ ID NO: 2525238 - RNA, 21 nt, Chlamydophila pneumoniae CWL029
auaccacagcuguacagaaca

SEQ ID NO: 2525239 - RNA, 22 nt, Chlamydophila pneumoniae CWL029
auaccacagcuguacagaacaa

SEQ ID NO: 2525240 - RNA, 14 nt, Chlamydophila pneumoniae CWL029
auaccagaagcaaa

SEQ ID NO: 2525241 - RNA, 17 nt, Chlamydophila pneumoniae CWL029
auaccagaagcaaaggu

SEQ ID NO: 2525242 - RNA, 17 nt, Chlamydophila pneumoniae CWL029
auaccaucucuuucuau

SEQ ID NO: 2525243 - RNA, 13 nt, Chlamydophila pneumoniae CWL029
auaccaucuuuaa

SEQ ID NO: 2525244 - RNA, 15 nt, Chlamydophila pneumoniae CWL029
auaccgcuguuuuau

SEQ ID NO: 2525245 - RNA, 23 nt, Chlamydophila pneumoniae CWL029
auaccggcaaauaaaguccucca

SEQ ID NO: 2525246 - RNA, 16 nt, Chlamydophila pneumoniae CWL029
auaccguuuuaggaag

SEQ ID NO: 2525247 - RNA, 22 nt, Chlamydophila pneumoniae CWL029
auaccuagagcucugaaauaaa

SEQ ID NO: 2525248 - RNA, 14 nt, Chlamydophila pneumoniae CWL029
auaccuccuccaau

SEQ ID NO: 2525249 - RNA, 19 nt, Chlamydophila pneumoniae CWL029
auaccuccuccaaucugcu

SEQ ID NO: 2525250 - RNA, 15 nt, Chlamydophila pneumoniae CWL029
auacgaacacagaua

SEQ ID NO: 2525251 - RNA, 19 nt, Chlamydophila pneumoniae CWL029
auacgccaaggucuucccg

SEQ ID NO: 2525252 - RNA, 20 nt, Chlamydophila pneumoniae CWL029
auacgccgggccacuucauc

SEQ ID NO: 2525253 - RNA, 18 nt, Chlamydophila pneumoniae CWL029
auacgcuagcucuuaaau

SEQ ID NO: 2525254 - RNA, 16 nt, Chlamydophila pneumoniae CWL029
auacgcuuacaaauaa

SEQ ID NO: 2525255 - RNA, 19 nt, Chlamydophila pneumoniae CWL029
auacgcuuacaaauaacua

SEQ ID NO: 2525256 - RNA, 13 nt, Chlamydophila pneumoniae CWL029
auacgcuuuucuu

SEQ ID NO: 2525257 - RNA, 14 nt, Chlamydophila pneumoniae CWL029
auacgcuuuucuuc

SEQ ID NO: 2525258 - RNA, 22 nt, Chlamydophila pneumoniae CWL029
auacgguauaccauguuaucaa

SEQ ID NO: 2525259 - RNA, 20 nt, Chlamydophila pneumoniae CWL029
auacguaauccagauuguuc

SEQ ID NO: 2525260 - RNA, 15 nt, Chlamydophila pneumoniae CWL029
auacguccagccugc

SEQ ID NO: 2525261 - RNA, 15 nt, Chlamydophila pneumoniae CWL029
auacgucguuacagc

SEQ ID NO: 2525262 - RNA, 17 nt, Chlamydophila pneumoniae CWL029
auacgugcuugaauauu

SEQ ID NO: 2525263 - RNA, 13 nt, Chlamydophila pneumoniae CWL029
auacguuuuuccc

SEQ ID NO: 2525264 - RNA, 19 nt, Chlamydophila pneumoniae CWL029
auacuaaaacuacaacagg

SEQ ID NO: 2525265 - RNA, 19 nt, Chlamydophila pneumoniae CWL029
auacuaagaagcucacucu

SEQ ID NO: 2525266 - RNA, 22 nt, Chlamydophila pneumoniae CWL029
auacuaagaagcucacucuuua

SEQ ID NO: 2525267 - RNA, 22 nt, Chlamydophila pneumoniae CWL029
auacuccacuuuuuucccucca

SEQ ID NO: 2525268 - RNA, 16 nt, Chlamydophila pneumoniae CWL029
auacucgucaaauuca

SEQ ID NO: 2525269 - RNA, 15 nt, Chlamydophila pneumoniae CWL029
auacucuuugcagug

SEQ ID NO: 2525270 - RNA, 16 nt, Chlamydophila pneumoniae CWL029
auacuguuaacaagua

SEQ ID NO: 2525271 - RNA, 17 nt, Chlamydophila pneumoniae CWL029
auacuguuuuucuucca

SEQ ID NO: 2525272 - RNA, 18 nt, Chlamydophila pneumoniae CWL029
auacuuaggaauuuuucu

SEQ ID NO: 2525273 - RNA, 15 nt, Chlamydophila pneumoniae CWL029
auacuucaggacgca

SEQ ID NO: 2525274 - RNA, 17 nt, Chlamydophila pneumoniae CWL029
auacuucaggacgcaca

SEQ ID NO: 2525275 - RNA, 20 nt, Chlamydophila pneumoniae CWL029
auacuucguuaugaagcuuc

SEQ ID NO: 2525276 - RNA, 15 nt, Chlamydophila pneumoniae CWL029
auacuucuccacagc

SEQ ID NO: 2525277 - RNA, 12 nt, Chlamydophila pneumoniae CWL029
auacuucuccug

SEQ ID NO: 2525278 - RNA, 15 nt, Chlamydophila pneumoniae CWL029
auacuucuccugaac

SEQ ID NO: 2525279 - RNA, 20 nt, Chlamydophila pneumoniae CWL029
auacuucuuccacgagauuc

SEQ ID NO: 2525280 - RNA, 21 nt, Chlamydophila pneumoniae CWL029
auacuuguaccguaaagaaaa

SEQ ID NO: 2525281 - RNA, 16 nt, Chlamydophila pneumoniae CWL029
auagaaaacauauccc

SEQ ID NO: 2525282 - RNA, 12 nt, Chlamydophila pneumoniae CWL029
auagaaaaggau

SEQ ID NO: 2525283 - RNA, 19 nt, Chlamydophila pneumoniae CWL029
auagaaaagguauuaggaa

SEQ ID NO: 2525284 - RNA, 15 nt, Chlamydophila pneumoniae CWL029
auagaaaaucuuguu

SEQ ID NO: 2525285 - RNA, 18 nt, Chlamydophila pneumoniae CWL029
auagaaagacauccuucu

SEQ ID NO: 2525286 - RNA, 20 nt, Chlamydophila pneumoniae CWL029
auagaaauaagcaucuagaa

SEQ ID NO: 2525287 - RNA, 22 nt, Chlamydophila pneumoniae CWL029
auagaaauucuguagauacuau

SEQ ID NO: 2525288 - RNA, 18 nt, Chlamydophila pneumoniae CWL029
auagaacucuccucgagg

SEQ ID NO: 2525289 - RNA, 15 nt, Chlamydophila pneumoniae CWL029
auagaagaucauuaa

SEQ ID NO: 2525290 - RNA, 15 nt, Chlamydophila pneumoniae CWL029
auagaagcugcugcu

SEQ ID NO: 2525291 - RNA, 14 nt, Chlamydophila pneumoniae CWL029
auagaagcuguaaa

SEQ ID NO: 2525292 - RNA, 22 nt, Chlamydophila pneumoniae CWL029
auagaaggcaucccgaacgcua

SEQ ID NO: 2525293 - RNA, 15 nt, Chlamydophila pneumoniae CWL029
auagaauacacagcu

SEQ ID NO: 2525294 - RNA, 17 nt, Chlamydophila pneumoniae CWL029
auagaauacacagcuau

SEQ ID NO: 2525295 - RNA, 21 nt, Chlamydophila pneumoniae CWL029
auagacacuugcuuaaggaaa

SEQ ID NO: 2525296 - RNA, 22 nt, Chlamydophila pneumoniae CWL029
auagacaggauggaaucaggga

SEQ ID NO: 2525297 - RNA, 14 nt, Chlamydophila pneumoniae CWL029
auagacauucccua

SEQ ID NO: 2525298 - RNA, 23 nt, Chlamydophila pneumoniae CWL029
auagaccggaucccguaaaagaa

SEQ ID NO: 2525299 - RNA, 20 nt, Chlamydophila pneumoniae CWL029
auagacucucacugaguguc

SEQ ID NO: 2525300 - RNA, 23 nt, Chlamydophila pneumoniae CWL029
auagacuuguauucuugagaguc

SEQ ID NO: 2525301 - RNA, 15 nt, Chlamydophila pneumoniae CWL029
auagacuuugaguuc

SEQ ID NO: 2525302 - RNA, 20 nt, Chlamydophila pneumoniae CWL029
auagagaacuccauucagau

SEQ ID NO: 2525303 - RNA, 11 nt, Chlamydophila pneumoniae CWL029
auagagaagau

SEQ ID NO: 2525304 - RNA, 18 nt, Chlamydophila pneumoniae CWL029
auagagagcgcagagucu

SEQ ID NO: 2525305 - RNA, 21 nt, Chlamydophila pneumoniae CWL029
auagagagcgccuaaacccac

SEQ ID NO: 2525306 - RNA, 17 nt, Chlamydophila pneumoniae CWL029
auagagauucuacaaau

SEQ ID NO: 2525307 - RNA, 23 nt, Chlamydophila pneumoniae CWL029
auagagccuccuccuucugcaau

SEQ ID NO: 2525308 - RNA, 21 nt, Chlamydophila pneumoniae CWL029
auagagcgguucuuucuagaa

SEQ ID NO: 2525309 - RNA, 15 nt, Chlamydophila pneumoniae CWL029
auagagcucuaaaaa

SEQ ID NO: 2525310 - RNA, 21 nt, Chlamydophila pneumoniae CWL029
auagagcuucuuuaucuagcu

SEQ ID NO: 2525311 - RNA, 15 nt, Chlamydophila pneumoniae CWL029
auagaggaaugaucc

SEQ ID NO: 2525312 - RNA, 14 nt, Chlamydophila pneumoniae CWL029
auagaggucuuuga

SEQ ID NO: 2525313 - RNA, 21 nt, Chlamydophila pneumoniae CWL029
auagaguagcucaucuagaaa

SEQ ID NO: 2525314 - RNA, 17 nt, Chlamydophila pneumoniae CWL029
auagaguaucuaaaacu

SEQ ID NO: 2525315 - RNA, 21 nt, Chlamydophila pneumoniae CWL029
auagaguaucuaaaacuucuu

SEQ ID NO: 2525316 - RNA, 13 nt, Chlamydophila pneumoniae CWL029
auagagucucuug

SEQ ID NO: 2525317 - RNA, 14 nt, Chlamydophila pneumoniae CWL029
auagagucucuuga

SEQ ID NO: 2525318 - RNA, 15 nt, Chlamydophila pneumoniae CWL029
auagauacaaacauc

SEQ ID NO: 2525319 - RNA, 22 nt, Chlamydophila pneumoniae CWL029
auagauagggccgugaagcaga

SEQ ID NO: 2525320 - RNA, 23 nt, Chlamydophila pneumoniae CWL029
auagauauacgcccaugucuuca

SEQ ID NO: 2525321 - RNA, 16 nt, Chlamydophila pneumoniae CWL029
auagaucacaucaaga

SEQ ID NO: 2525322 - RNA, 17 nt, Chlamydophila pneumoniae CWL029
auagaucacaucaagau

SEQ ID NO: 2525323 - RNA, 18 nt, Chlamydophila pneumoniae CWL029
auagauccaagaaugaau

SEQ ID NO: 2525324 - RNA, 16 nt, Chlamydophila pneumoniae CWL029
auagauucaugaaaug

SEQ ID NO: 2525325 - RNA, 18 nt, Chlamydophila pneumoniae CWL029
auagcaaacggaacuaaa

SEQ ID NO: 2525326 - RNA, 13 nt, Chlamydophila pneumoniae CWL029
auagcaaaucaau

SEQ ID NO: 2525327 - RNA, 17 nt, Chlamydophila pneumoniae CWL029
auagcaagcacuuucgc

SEQ ID NO: 2525328 - RNA, 15 nt, Chlamydophila pneumoniae CWL029
auagcaaugauguuu

SEQ ID NO: 2525329 - RNA, 23 nt, Chlamydophila pneumoniae CWL029
auagcaggaaggaauagagaaag

SEQ ID NO: 2525330 - RNA, 18 nt, Chlamydophila pneumoniae CWL029
auagcaucccuucuucuu

SEQ ID NO: 2525331 - RNA, 17 nt, Chlamydophila pneumoniae CWL029
auagcauggagaauaau

SEQ ID NO: 2525332 - RNA, 18 nt, Chlamydophila pneumoniae CWL029
auagcauguucgauuuuc

SEQ ID NO: 2525333 - RNA, 20 nt, Chlamydophila pneumoniae CWL029
auagcauguucgauuuucuc

SEQ ID NO: 2525334 - RNA, 16 nt, Chlamydophila pneumoniae CWL029
auagcauuauucccua

SEQ ID NO: 2525335 - RNA, 12 nt, Chlamydophila pneumoniae CWL029
auagccaaagac

SEQ ID NO: 2525336 - RNA, 15 nt, Chlamydophila pneumoniae CWL029
auagccaaagacucu

SEQ ID NO: 2525337 - RNA, 19 nt, Chlamydophila pneumoniae CWL029
auagccauaauuagaacag

SEQ ID NO: 2525338 - RNA, 18 nt, Chlamydophila pneumoniae CWL029
auagccaucauagcaaac

SEQ ID NO: 2525339 - RNA, 22 nt, Chlamydophila pneumoniae CWL029
auagccauuagaaucucugccc

SEQ ID NO: 2525340 - RNA, 15 nt, Chlamydophila pneumoniae CWL029
auagcccgaaauuca

SEQ ID NO: 2525341 - RNA, 16 nt, Chlamydophila pneumoniae CWL029
auagccgagaucuuug

SEQ ID NO: 2525342 - RNA, 13 nt, Chlamydophila pneumoniae CWL029
auagcgagaacac

SEQ ID NO: 2525343 - RNA, 19 nt, Chlamydophila pneumoniae CWL029
auagcuaagagcaucuuug

SEQ ID NO: 2525344 - RNA, 17 nt, Chlamydophila pneumoniae CWL029
auagcuaugaguugcuu

SEQ ID NO: 2525345 - RNA, 13 nt, Chlamydophila pneumoniae CWL029
auagcucagcucu

SEQ ID NO: 2525346 - RNA, 12 nt, Chlamydophila pneumoniae CWL029
auagcuccuugg

SEQ ID NO: 2525347 - RNA, 14 nt, Chlamydophila pneumoniae CWL029
auagcucuuuucau

SEQ ID NO: 2525348 - RNA, 19 nt, Chlamydophila pneumoniae CWL029
auagcugaggcaucuauug

SEQ ID NO: 2525349 - RNA, 21 nt, Chlamydophila pneumoniae CWL029
auagcuggcaaugauauccuc

SEQ ID NO: 2525350 - RNA, 17 nt, Chlamydophila pneumoniae CWL029
auagcuuccuguaguga

SEQ ID NO: 2525351 - RNA, 21 nt, Chlamydophila pneumoniae CWL029
auagcuucugacucuguugca

SEQ ID NO: 2525352 - RNA, 14 nt, Chlamydophila pneumoniae CWL029
auagcuuugaagag

SEQ ID NO: 2525353 - RNA, 23 nt, Chlamydophila pneumoniae CWL029
auaggaacaaagccaaauucucg

SEQ ID NO: 2525354 - RNA, 23 nt, Chlamydophila pneumoniae CWL029
auaggaacucacaaacaacagaa

SEQ ID NO: 2525355 - RNA, 13 nt, Chlamydophila pneumoniae CWL029
auaggaagcucuu

SEQ ID NO: 2525356 - RNA, 23 nt, Chlamydophila pneumoniae CWL029
auaggaauugcagcaaggagagu

SEQ ID NO: 2525357 - RNA, 19 nt, Chlamydophila pneumoniae CWL029
auaggagagcacuuuuaau

SEQ ID NO: 2525358 - RNA, 15 nt, Chlamydophila pneumoniae CWL029
auaggauaagaaauu

SEQ ID NO: 2525359 - RNA, 15 nt, Chlamydophila pneumoniae CWL029
auaggauccaggagu

SEQ ID NO: 2525360 - RNA, 14 nt, Chlamydophila pneumoniae CWL029
auaggaucugcaug

SEQ ID NO: 2525361 - RNA, 12 nt, Chlamydophila pneumoniae CWL029
auaggcauuaca

SEQ ID NO: 2525362 - RNA, 13 nt, Chlamydophila pneumoniae CWL029
auaggcauuacac

SEQ ID NO: 2525363 - RNA, 19 nt, Chlamydophila pneumoniae CWL029
auaggcauuacacaacucu

SEQ ID NO: 2525364 - RNA, 20 nt, Chlamydophila pneumoniae CWL029
auaggcauuacacaacucuu

SEQ ID NO: 2525365 - RNA, 20 nt, Chlamydophila pneumoniae CWL029
auaggccaagagcuugucuu

SEQ ID NO: 2525366 - RNA, 22 nt, Chlamydophila pneumoniae CWL029
auaggcucuuuagcaaacauuu

SEQ ID NO: 2525367 - RNA, 23 nt, Chlamydophila pneumoniae CWL029
auaggcugcacacauccuggagc

SEQ ID NO: 2525368 - RNA, 12 nt, Chlamydophila pneumoniae CWL029
auagggaauuuc

SEQ ID NO: 2525369 - RNA, 20 nt, Chlamydophila pneumoniae CWL029
auagggaucuccuugagaga

SEQ ID NO: 2525370 - RNA, 19 nt, Chlamydophila pneumoniae CWL029
auagggcaggcggaaagga

SEQ ID NO: 2525371 - RNA, 16 nt, Chlamydophila pneumoniae CWL029
auagggccauuagcaa

SEQ ID NO: 2525372 - RNA, 18 nt, Chlamydophila pneumoniae CWL029
auagguacgcuuuuucuu

SEQ ID NO: 2525373 - RNA, 15 nt, Chlamydophila pneumoniae CWL029
auagguagaggcaau

SEQ ID NO: 2525374 - RNA, 15 nt, Chlamydophila pneumoniae CWL029
auaguaaacagaagu

SEQ ID NO: 2525375 - RNA, 18 nt, Chlamydophila pneumoniae CWL029
auaguaaacagaagugcu

SEQ ID NO: 2525376 - RNA, 13 nt, Chlamydophila pneumoniae CWL029
auaguagaacugc

SEQ ID NO: 2525377 - RNA, 21 nt, Chlamydophila pneumoniae CWL029
auaguagacauauccaaugag

SEQ ID NO: 2525378 - RNA, 22 nt, Chlamydophila pneumoniae CWL029
auaguauaauagugagcucccu

SEQ ID NO: 2525379 - RNA, 13 nt, Chlamydophila pneumoniae CWL029
auaguauuuuuaa

SEQ ID NO: 2525380 - RNA, 14 nt, Chlamydophila pneumoniae CWL029
auaguauuuuuaaa

SEQ ID NO: 2525381 - RNA, 16 nt, Chlamydophila pneumoniae CWL029
auaguauuuuuaaaua

SEQ ID NO: 2525382 - RNA, 20 nt, Chlamydophila pneumoniae CWL029
auaguauuuuugaaaccaag

SEQ ID NO: 2525383 - RNA, 18 nt, Chlamydophila pneumoniae CWL029
auaguccuagcagagaaa

SEQ ID NO: 2525384 - RNA, 21 nt, Chlamydophila pneumoniae CWL029
auaguccuagcagagaaauua

SEQ ID NO: 2525385 - RNA, 21 nt, Chlamydophila pneumoniae CWL029
auagucuguuuuggaaagaag

SEQ ID NO: 2525386 - RNA, 23 nt, Chlamydophila pneumoniae CWL029
auaguguauaucagcaaaaaacu

SEQ ID NO: 2525387 - RNA, 23 nt, Chlamydophila pneumoniae CWL029
auaguguucgagcaucucaagag

SEQ ID NO: 2525388 - RNA, 19 nt, Chlamydophila pneumoniae CWL029
auaguuaaauuuccaaaga

SEQ ID NO: 2525389 - RNA, 19 nt, Chlamydophila pneumoniae CWL029
auaguuauuaauaaauuua

SEQ ID NO: 2525390 - RNA, 18 nt, Chlamydophila pneumoniae CWL029
auaguugcaugacuauuu

SEQ ID NO: 2525391 - RNA, 21 nt, Chlamydophila pneumoniae CWL029
auaguugcaugacuauuuuca

SEQ ID NO: 2525392 - RNA, 22 nt, Chlamydophila pneumoniae CWL029
auaguuugagcaguaauguuaa

SEQ ID NO: 2525393 - RNA, 16 nt, Chlamydophila pneumoniae CWL029
auaguuuuuauuuuua

SEQ ID NO: 2525394 - RNA, 17 nt, Chlamydophila pneumoniae CWL029
auaguuuuuauuuuuaa

SEQ ID NO: 2525395 - RNA, 19 nt, Chlamydophila pneumoniae CWL029
auaguuuuuauuuuuaaau

SEQ ID NO: 2525396 - RNA, 15 nt, Chlamydophila pneumoniae CWL029
auauaaaacuuauaa

SEQ ID NO: 2525397 - RNA, 19 nt, Chlamydophila pneumoniae CWL029
auauaaagguuacaagcaa

SEQ ID NO: 2525398 - RNA, 20 nt, Chlamydophila pneumoniae CWL029
auauaagauaauagagaaga

SEQ ID NO: 2525399 - RNA, 23 nt, Chlamydophila pneumoniae CWL029
auauaagcaccacgaccuauacc

SEQ ID NO: 2525400 - RNA, 16 nt, Chlamydophila pneumoniae CWL029
auauaauuccaauugc

SEQ ID NO: 2525401 - RNA, 13 nt, Chlamydophila pneumoniae CWL029
auauacaauccag

SEQ ID NO: 2525402 - RNA, 11 nt, Chlamydophila pneumoniae CWL029
auauaccacua

SEQ ID NO: 2525403 - RNA, 15 nt, Chlamydophila pneumoniae CWL029
auauaccacuacuga

SEQ ID NO: 2525404 - RNA, 22 nt, Chlamydophila pneumoniae CWL029
auauacugccagcgaucacaua

SEQ ID NO: 2525405 - RNA, 14 nt, Chlamydophila pneumoniae CWL029
auauacuuauacca

SEQ ID NO: 2525406 - RNA, 18 nt, Chlamydophila pneumoniae CWL029
auauacuuauaccacccc

SEQ ID NO: 2525407 - RNA, 20 nt, Chlamydophila pneumoniae CWL029
auauagagagcgcagagucu

SEQ ID NO: 2525408 - RNA, 19 nt, Chlamydophila pneumoniae CWL029
auauagggagacuuugcca

SEQ ID NO: 2525409 - RNA, 16 nt, Chlamydophila pneumoniae CWL029
auauagguuaagccaa

SEQ ID NO: 2525410 - RNA, 13 nt, Chlamydophila pneumoniae CWL029
auauauaagaucu

SEQ ID NO: 2525411 - RNA, 12 nt, Chlamydophila pneumoniae CWL029
auauauccugag

SEQ ID NO: 2525412 - RNA, 13 nt, Chlamydophila pneumoniae CWL029
auauauccugagu

SEQ ID NO: 2525413 - RNA, 14 nt, Chlamydophila pneumoniae CWL029
auauauuuuuaaag

SEQ ID NO: 2525414 - RNA, 16 nt, Chlamydophila pneumoniae CWL029
auaucaaagcauugca

SEQ ID NO: 2525415 - RNA, 16 nt, Chlamydophila pneumoniae CWL029
auaucaccuacaucag

SEQ ID NO: 2525416 - RNA, 16 nt, Chlamydophila pneumoniae CWL029
auaucagcaaaaaacu

SEQ ID NO: 2525417 - RNA, 16 nt, Chlamydophila pneumoniae CWL029
auaucagcagcuucua

SEQ ID NO: 2525418 - RNA, 13 nt, Chlamydophila pneumoniae CWL029
auaucagcuucuu

SEQ ID NO: 2525419 - RNA, 19 nt, Chlamydophila pneumoniae CWL029
auaucagcuucuugaugua

SEQ ID NO: 2525420 - RNA, 23 nt, Chlamydophila pneumoniae CWL029
auaucaguauggcguuuuuuuug

SEQ ID NO: 2525421 - RNA, 14 nt, Chlamydophila pneumoniae CWL029
auaucaucaaaaga

SEQ ID NO: 2525422 - RNA, 14 nt, Chlamydophila pneumoniae CWL029
auaucaucacuaag

SEQ ID NO: 2525423 - RNA, 20 nt, Chlamydophila pneumoniae CWL029
auaucaugcaauacuuuucu

SEQ ID NO: 2525424 - RNA, 17 nt, Chlamydophila pneumoniae CWL029
auaucauuaagaagauu

SEQ ID NO: 2525425 - RNA, 17 nt, Chlamydophila pneumoniae CWL029
auauccaaugagagaga

SEQ ID NO: 2525426 - RNA, 15 nt, Chlamydophila pneumoniae CWL029
auauccaccuuacca

SEQ ID NO: 2525427 - RNA, 12 nt, Chlamydophila pneumoniae CWL029
auauccagaaau

SEQ ID NO: 2525428 - RNA, 22 nt, Chlamydophila pneumoniae CWL029
auauccauggaauggcuacuuu

SEQ ID NO: 2525429 - RNA, 13 nt, Chlamydophila pneumoniae CWL029
auaucccaaagcu

SEQ ID NO: 2525430 - RNA, 17 nt, Chlamydophila pneumoniae CWL029
auaucgaccuuaaaauu

SEQ ID NO: 2525431 - RNA, 18 nt, Chlamydophila pneumoniae CWL029
auaucgaguucuuuuugc

SEQ ID NO: 2525432 - RNA, 13 nt, Chlamydophila pneumoniae CWL029
auaucgauaggau

SEQ ID NO: 2525433 - RNA, 19 nt, Chlamydophila pneumoniae CWL029
auaucgccguuaaagacuu

SEQ ID NO: 2525434 - RNA, 22 nt, Chlamydophila pneumoniae CWL029
auaucgccuuccuuaacaacau

SEQ ID NO: 2525435 - RNA, 16 nt, Chlamydophila pneumoniae CWL029
auaucgcguguaaaag

SEQ ID NO: 2525436 - RNA, 19 nt, Chlamydophila pneumoniae CWL029
auaucgcguguaaaagcuu

SEQ ID NO: 2525437 - RNA, 20 nt, Chlamydophila pneumoniae CWL029
auaucgguuucuuuuuuuug

SEQ ID NO: 2525438 - RNA, 18 nt, Chlamydophila pneumoniae CWL029
auaucguagacaacaagu

SEQ ID NO: 2525439 - RNA, 21 nt, Chlamydophila pneumoniae CWL029
auaucuccuuuaaauaaaauc

SEQ ID NO: 2525440 - RNA, 20 nt, Chlamydophila pneumoniae CWL029
auaucucuggcauaauccug

SEQ ID NO: 2525441 - RNA, 22 nt, Chlamydophila pneumoniae CWL029
auaucugcgccagcucucuuga

SEQ ID NO: 2525442 - RNA, 20 nt, Chlamydophila pneumoniae CWL029
auaucuucuggguucuccac

SEQ ID NO: 2525443 - RNA, 23 nt, Chlamydophila pneumoniae CWL029
auaucuucuggguucuccacaug

SEQ ID NO: 2525444 - RNA, 22 nt, Chlamydophila pneumoniae CWL029
auaugaaugacugcagauugca

SEQ ID NO: 2525445 - RNA, 15 nt, Chlamydophila pneumoniae CWL029
auaugauuuccacuu

SEQ ID NO: 2525446 - RNA, 22 nt, Chlamydophila pneumoniae CWL029
auaugcuccagaaacgcagcuu

SEQ ID NO: 2525447 - RNA, 17 nt, Chlamydophila pneumoniae CWL029
auaugcucgugcgacug

SEQ ID NO: 2525448 - RNA, 23 nt, Chlamydophila pneumoniae CWL029
auaugcucgugcgacugcucuuu

SEQ ID NO: 2525449 - RNA, 13 nt, Chlamydophila pneumoniae CWL029
auaugcucucccg

SEQ ID NO: 2525450 - RNA, 18 nt, Chlamydophila pneumoniae CWL029
auaugcucugccauuucu

SEQ ID NO: 2525451 - RNA, 19 nt, Chlamydophila pneumoniae CWL029
auaugcuuggcaauagcuu

SEQ ID NO: 2525452 - RNA, 21 nt, Chlamydophila pneumoniae CWL029
auauggaaggcggcuuuuugc

SEQ ID NO: 2525453 - RNA, 14 nt, Chlamydophila pneumoniae CWL029
auauggaauggcuu

SEQ ID NO: 2525454 - RNA, 23 nt, Chlamydophila pneumoniae CWL029
auauggguguaaauuuuuccuuc

SEQ ID NO: 2525455 - RNA, 15 nt, Chlamydophila pneumoniae CWL029
auaugucgcuuucau

SEQ ID NO: 2525456 - RNA, 19 nt, Chlamydophila pneumoniae CWL029
auauuacagauuucuucuu

SEQ ID NO: 2525457 - RNA, 21 nt, Chlamydophila pneumoniae CWL029
auauucuaaggugcuauuuua

SEQ ID NO: 2525458 - RNA, 23 nt, Chlamydophila pneumoniae CWL029
auauucuaaggugcuauuuuaaa

SEQ ID NO: 2525459 - RNA, 15 nt, Chlamydophila pneumoniae CWL029
auauucuccuuacca

SEQ ID NO: 2525460 - RNA, 17 nt, Chlamydophila pneumoniae CWL029
auauucucgaaaaauuu

SEQ ID NO: 2525461 - RNA, 23 nt, Chlamydophila pneumoniae CWL029
auauucugaaauuucugaaacaa

SEQ ID NO: 2525462 - RNA, 13 nt, Chlamydophila pneumoniae CWL029
auauugaucuuuc

SEQ ID NO: 2525463 - RNA, 19 nt, Chlamydophila pneumoniae CWL029
auauugcaaagcaucuugu

SEQ ID NO: 2525464 - RNA, 12 nt, Chlamydophila pneumoniae CWL029
auauugcucuug

SEQ ID NO: 2525465 - RNA, 17 nt, Chlamydophila pneumoniae CWL029
auauugucaagaggcug

SEQ ID NO: 2525466 - RNA, 18 nt, Chlamydophila pneumoniae CWL029
auauugucaagaggcugu

SEQ ID NO: 2525467 - RNA, 16 nt, Chlamydophila pneumoniae CWL029
auauuuacgaaaacau

SEQ ID NO: 2525468 - RNA, 15 nt, Chlamydophila pneumoniae CWL029
auauuuagagagaaa

SEQ ID NO: 2525469 - RNA, 18 nt, Chlamydophila pneumoniae CWL029
auauuuagagagaaacau

SEQ ID NO: 2525470 - RNA, 13 nt, Chlamydophila pneumoniae CWL029
auauuuuaccauu

SEQ ID NO: 2525471 - RNA, 13 nt, Chlamydophila pneumoniae CWL029
auauuuuuaaaga

SEQ ID NO: 2525472 - RNA, 16 nt, Chlamydophila pneumoniae CWL029
auauuuuuguccugca

SEQ ID NO: 2525473 - RNA, 21 nt, Chlamydophila pneumoniae CWL029
auauuuuuugagaaauauaaa

SEQ ID NO: 2525474 - RNA, 22 nt, Chlamydophila pneumoniae CWL029
aucaaaaacacugcgcaaagaa

SEQ ID NO: 2525475 - RNA, 22 nt, Chlamydophila pneumoniae CWL029
aucaaaaauagcaggauagcaa

SEQ ID NO: 2525476 - RNA, 16 nt, Chlamydophila pneumoniae CWL029
aucaaaacauaaugau

SEQ ID NO: 2525477 - RNA, 17 nt, Chlamydophila pneumoniae CWL029
aucaaagaacaauaaaa

SEQ ID NO: 2525478 - RNA, 12 nt, Chlamydophila pneumoniae CWL029
aucaaagaauua

SEQ ID NO: 2525479 - RNA, 16 nt, Chlamydophila pneumoniae CWL029
aucaaagaucugaauu

SEQ ID NO: 2525480 - RNA, 16 nt, Chlamydophila pneumoniae CWL029
aucaaagauuccuaag

SEQ ID NO: 2525481 - RNA, 14 nt, Chlamydophila pneumoniae CWL029
aucaaagcaaagag

SEQ ID NO: 2525482 - RNA, 17 nt, Chlamydophila pneumoniae CWL029
aucaaagcaaagagcaa

SEQ ID NO: 2525483 - RNA, 17 nt, Chlamydophila pneumoniae CWL029
aucaaagggucuuuacc

SEQ ID NO: 2525484 - RNA, 15 nt, Chlamydophila pneumoniae CWL029
aucaaaguauauauu

SEQ ID NO: 2525485 - RNA, 16 nt, Chlamydophila pneumoniae CWL029
aucaaaguauauauuu

SEQ ID NO: 2525486 - RNA, 20 nt, Chlamydophila pneumoniae CWL029
aucaaauucaaccaaacguc

SEQ ID NO: 2525487 - RNA, 21 nt, Chlamydophila pneumoniae CWL029
aucaaauuccuucucagaaag

SEQ ID NO: 2525488 - RNA, 14 nt, Chlamydophila pneumoniae CWL029
aucaacauucuucu

SEQ ID NO: 2525489 - RNA, 15 nt, Chlamydophila pneumoniae CWL029
aucaacauucuucug

SEQ ID NO: 2525490 - RNA, 22 nt, Chlamydophila pneumoniae CWL029
aucaacauucuucugucuguau

SEQ ID NO: 2525491 - RNA, 16 nt, Chlamydophila pneumoniae CWL029
aucaacuacaucucca

SEQ ID NO: 2525492 - RNA, 18 nt, Chlamydophila pneumoniae CWL029
aucaacuacaucuccaag

SEQ ID NO: 2525493 - RNA, 16 nt, Chlamydophila pneumoniae CWL029
aucaacucuccauccu

SEQ ID NO: 2525494 - RNA, 14 nt, Chlamydophila pneumoniae CWL029
aucaagaagagaaa

SEQ ID NO: 2525495 - RNA, 20 nt, Chlamydophila pneumoniae CWL029
aucaagaagagaaaagauag

SEQ ID NO: 2525496 - RNA, 17 nt, Chlamydophila pneumoniae CWL029
aucaagacgacacucaa

SEQ ID NO: 2525497 - RNA, 15 nt, Chlamydophila pneumoniae CWL029
aucaagagcucguaa

SEQ ID NO: 2525498 - RNA, 14 nt, Chlamydophila pneumoniae CWL029
aucaagaggaguga

SEQ ID NO: 2525499 - RNA, 16 nt, Chlamydophila pneumoniae CWL029
aucaagaggagugaaa

SEQ ID NO: 2525500 - RNA, 21 nt, Chlamydophila pneumoniae CWL029
aucaagaguuucgaauucaau

SEQ ID NO: 2525501 - RNA, 13 nt, Chlamydophila pneumoniae CWL029
aucaagccuaaau

SEQ ID NO: 2525502 - RNA, 15 nt, Chlamydophila pneumoniae CWL029
aucaaggaguacucu

SEQ ID NO: 2525503 - RNA, 22 nt, Chlamydophila pneumoniae CWL029
aucaauaaucggccgaguuucu

SEQ ID NO: 2525504 - RNA, 14 nt, Chlamydophila pneumoniae CWL029
aucaaugccuugcg

SEQ ID NO: 2525505 - RNA, 14 nt, Chlamydophila pneumoniae CWL029
aucaaugguuaaaa

SEQ ID NO: 2525506 - RNA, 14 nt, Chlamydophila pneumoniae CWL029
aucaauucgcucag

SEQ ID NO: 2525507 - RNA, 15 nt, Chlamydophila pneumoniae CWL029
aucacaauuuuaaaa

SEQ ID NO: 2525508 - RNA, 21 nt, Chlamydophila pneumoniae CWL029
aucacacuuaaagguaaaacu

SEQ ID NO: 2525509 - RNA, 16 nt, Chlamydophila pneumoniae CWL029
aucacagcaaucugca

SEQ ID NO: 2525510 - RNA, 23 nt, Chlamydophila pneumoniae CWL029
aucacagccaucgguucggucuc

SEQ ID NO: 2525511 - RNA, 18 nt, Chlamydophila pneumoniae CWL029
aucacaggcuucaucaca

SEQ ID NO: 2525512 - RNA, 14 nt, Chlamydophila pneumoniae CWL029
aucacauaaaucaa

SEQ ID NO: 2525513 - RNA, 17 nt, Chlamydophila pneumoniae CWL029
aucacauaaaucaacau

SEQ ID NO: 2525514 - RNA, 17 nt, Chlamydophila pneumoniae CWL029
aucacauagaaaacaua

SEQ ID NO: 2525515 - RNA, 15 nt, Chlamydophila pneumoniae CWL029
aucacaucaguuaac

SEQ ID NO: 2525516 - RNA, 19 nt, Chlamydophila pneumoniae CWL029
aucacauuaagcucaaaau

SEQ ID NO: 2525517 - RNA, 20 nt, Chlamydophila pneumoniae CWL029
aucaccuucggaucuuccca

SEQ ID NO: 2525518 - RNA, 15 nt, Chlamydophila pneumoniae CWL029
aucacgaaaaggaga

SEQ ID NO: 2525519 - RNA, 17 nt, Chlamydophila pneumoniae CWL029
aucacgaaaaggagaau

SEQ ID NO: 2525520 - RNA, 16 nt, Chlamydophila pneumoniae CWL029
aucacgacgucaucac

SEQ ID NO: 2525521 - RNA, 16 nt, Chlamydophila pneumoniae CWL029
aucacggaugguugcu

SEQ ID NO: 2525522 - RNA, 18 nt, Chlamydophila pneumoniae CWL029
aucacggaugguugcuuc

SEQ ID NO: 2525523 - RNA, 20 nt, Chlamydophila pneumoniae CWL029
aucacguaaggugucugcca

SEQ ID NO: 2525524 - RNA, 15 nt, Chlamydophila pneumoniae CWL029
aucacuaucauggac

SEQ ID NO: 2525525 - RNA, 16 nt, Chlamydophila pneumoniae CWL029
aucacuuauauuuucu

SEQ ID NO: 2525526 - RNA, 18 nt, Chlamydophila pneumoniae CWL029
aucacuuauauuuucuau

SEQ ID NO: 2525527 - RNA, 20 nt, Chlamydophila pneumoniae CWL029
aucagaaaaaaugcguuuug

SEQ ID NO: 2525528 - RNA, 12 nt, Chlamydophila pneumoniae CWL029
aucagaaaugaa

SEQ ID NO: 2525529 - RNA, 23 nt, Chlamydophila pneumoniae CWL029
aucagaacaacgcugcuucucua

SEQ ID NO: 2525530 - RNA, 21 nt, Chlamydophila pneumoniae CWL029
aucagaagguaaauuuuuaaa

SEQ ID NO: 2525531 - RNA, 19 nt, Chlamydophila pneumoniae CWL029
aucagaauccugaguaaaa

SEQ ID NO: 2525532 - RNA, 21 nt, Chlamydophila pneumoniae CWL029
aucagaauccugaguaaaauc

SEQ ID NO: 2525533 - RNA, 17 nt, Chlamydophila pneumoniae CWL029
aucagaaucguucccau

SEQ ID NO: 2525534 - RNA, 23 nt, Chlamydophila pneumoniae CWL029
aucagaaucguucccaucacaua

SEQ ID NO: 2525535 - RNA, 16 nt, Chlamydophila pneumoniae CWL029
aucagaaucuaaguaa

SEQ ID NO: 2525536 - RNA, 17 nt, Chlamydophila pneumoniae CWL029
aucagacugaagagcaa

SEQ ID NO: 2525537 - RNA, 16 nt, Chlamydophila pneumoniae CWL029
aucagaggagccucca

SEQ ID NO: 2525538 - RNA, 16 nt, Chlamydophila pneumoniae CWL029
aucagauccaugaaca

SEQ ID NO: 2525539 - RNA, 19 nt, Chlamydophila pneumoniae CWL029
aucagauccaugaacagca

SEQ ID NO: 2525540 - RNA, 20 nt, Chlamydophila pneumoniae CWL029
aucagauguaaagagcaaca

SEQ ID NO: 2525541 - RNA, 14 nt, Chlamydophila pneumoniae CWL029
aucagcaacauaaa

SEQ ID NO: 2525542 - RNA, 23 nt, Chlamydophila pneumoniae CWL029
aucagcaacaucguuaauauaau

SEQ ID NO: 2525543 - RNA, 14 nt, Chlamydophila pneumoniae CWL029
aucagcacacugcu

SEQ ID NO: 2525544 - RNA, 19 nt, Chlamydophila pneumoniae CWL029
aucagcuggguaaguccac

SEQ ID NO: 2525545 - RNA, 14 nt, Chlamydophila pneumoniae CWL029
aucagcuguugcgu

SEQ ID NO: 2525546 - RNA, 13 nt, Chlamydophila pneumoniae CWL029
aucaggaaaugaa

SEQ ID NO: 2525547 - RNA, 18 nt, Chlamydophila pneumoniae CWL029
aucaggagucucuggaag

SEQ ID NO: 2525548 - RNA, 16 nt, Chlamydophila pneumoniae CWL029
aucaguuaacugugua

SEQ ID NO: 2525549 - RNA, 17 nt, Chlamydophila pneumoniae CWL029
aucaguucauuuuggca

SEQ ID NO: 2525550 - RNA, 19 nt, Chlamydophila pneumoniae CWL029
aucaguuccauuuucaggc

SEQ ID NO: 2525551 - RNA, 15 nt, Chlamydophila pneumoniae CWL029
aucauaacuagggua

SEQ ID NO: 2525552 - RNA, 13 nt, Chlamydophila pneumoniae CWL029
aucauaccgacaa

SEQ ID NO: 2525553 - RNA, 16 nt, Chlamydophila pneumoniae CWL029
aucauaccgacaagca

SEQ ID NO: 2525554 - RNA, 19 nt, Chlamydophila pneumoniae CWL029
aucauagccaucauagcaa

SEQ ID NO: 2525555 - RNA, 20 nt, Chlamydophila pneumoniae CWL029
aucauagccaucauagcaaa

SEQ ID NO: 2525556 - RNA, 15 nt, Chlamydophila pneumoniae CWL029
aucauaggcuauaau

SEQ ID NO: 2525557 - RNA, 12 nt, Chlamydophila pneumoniae CWL029
aucauauuuuuc

SEQ ID NO: 2525558 - RNA, 17 nt, Chlamydophila pneumoniae CWL029
aucauauuuuucuugaa

SEQ ID NO: 2525559 - RNA, 19 nt, Chlamydophila pneumoniae CWL029
aucauauuuuuguccugca

SEQ ID NO: 2525560 - RNA, 18 nt, Chlamydophila pneumoniae CWL029
aucaucaaugguuaaaac

SEQ ID NO: 2525561 - RNA, 12 nt, Chlamydophila pneumoniae CWL029
aucaucagaaau

SEQ ID NO: 2525562 - RNA, 13 nt, Chlamydophila pneumoniae CWL029
aucaucagaaauc

SEQ ID NO: 2525563 - RNA, 15 nt, Chlamydophila pneumoniae CWL029
aucaucagaaaucaa

SEQ ID NO: 2525564 - RNA, 17 nt, Chlamydophila pneumoniae CWL029
aucaucgcaaucaaaga

SEQ ID NO: 2525565 - RNA, 21 nt, Chlamydophila pneumoniae CWL029
aucaucucccaaauagcuaca

SEQ ID NO: 2525566 - RNA, 16 nt, Chlamydophila pneumoniae CWL029
aucaucuccugaagcc

SEQ ID NO: 2525567 - RNA, 16 nt, Chlamydophila pneumoniae CWL029
aucaugagaauuuuca

SEQ ID NO: 2525568 - RNA, 17 nt, Chlamydophila pneumoniae CWL029
aucaugagaauuuucau

SEQ ID NO: 2525569 - RNA, 14 nt, Chlamydophila pneumoniae CWL029
aucaugauaaaaau

SEQ ID NO: 2525570 - RNA, 15 nt, Chlamydophila pneumoniae CWL029
aucaugauaaaaauu

SEQ ID NO: 2525571 - RNA, 16 nt, Chlamydophila pneumoniae CWL029
aucaugauauugcguu

SEQ ID NO: 2525572 - RNA, 16 nt, Chlamydophila pneumoniae CWL029
aucaugccgagauuuu

SEQ ID NO: 2525573 - RNA, 20 nt, Chlamydophila pneumoniae CWL029
aucauggacaagcaaaagca

SEQ ID NO: 2525574 - RNA, 21 nt, Chlamydophila pneumoniae CWL029
aucauggucccuauagaacau

SEQ ID NO: 2525575 - RNA, 14 nt, Chlamydophila pneumoniae CWL029
aucauguagcagag

SEQ ID NO: 2525576 - RNA, 16 nt, Chlamydophila pneumoniae CWL029
aucauuaagaagauuc

SEQ ID NO: 2525577 - RNA, 19 nt, Chlamydophila pneumoniae CWL029
aucauuaagaagauucuuu

SEQ ID NO: 2525578 - RNA, 12 nt, Chlamydophila pneumoniae CWL029
aucauuagcauc

SEQ ID NO: 2525579 - RNA, 12 nt, Chlamydophila pneumoniae CWL029
aucauuguugcu

SEQ ID NO: 2525580 - RNA, 13 nt, Chlamydophila pneumoniae CWL029
aucauuuuugcua

SEQ ID NO: 2525581 - RNA, 13 nt, Chlamydophila pneumoniae CWL029
auccaaaagcggc

SEQ ID NO: 2525582 - RNA, 13 nt, Chlamydophila pneumoniae CWL029
auccaaagccuga

SEQ ID NO: 2525583 - RNA, 15 nt, Chlamydophila pneumoniae CWL029
auccaagaaugaauc

SEQ ID NO: 2525584 - RNA, 18 nt, Chlamydophila pneumoniae CWL029
auccaauagccaaagacu

SEQ ID NO: 2525585 - RNA, 14 nt, Chlamydophila pneumoniae CWL029
auccaaugacaauc

SEQ ID NO: 2525586 - RNA, 16 nt, Chlamydophila pneumoniae CWL029
auccaaugacaauccg

SEQ ID NO: 2525587 - RNA, 13 nt, Chlamydophila pneumoniae CWL029
auccacagauacg

SEQ ID NO: 2525588 - RNA, 14 nt, Chlamydophila pneumoniae CWL029
auccacauccuugu

SEQ ID NO: 2525589 - RNA, 18 nt, Chlamydophila pneumoniae CWL029
auccacauccuuguagaa

SEQ ID NO: 2525590 - RNA, 23 nt, Chlamydophila pneumoniae CWL029
auccagaaucuccauuuagaaug

SEQ ID NO: 2525591 - RNA, 15 nt, Chlamydophila pneumoniae CWL029
auccagauuagaaaa

SEQ ID NO: 2525592 - RNA, 21 nt, Chlamydophila pneumoniae CWL029
auccagauuagaaaagauaaa

SEQ ID NO: 2525593 - RNA, 17 nt, Chlamydophila pneumoniae CWL029
auccagcaacaaccaaa

SEQ ID NO: 2525594 - RNA, 20 nt, Chlamydophila pneumoniae CWL029
auccagcaacaaccaaaaga

SEQ ID NO: 2525595 - RNA, 13 nt, Chlamydophila pneumoniae CWL029
auccagcucaagg

SEQ ID NO: 2525596 - RNA, 14 nt, Chlamydophila pneumoniae CWL029
auccagcuccauaa

SEQ ID NO: 2525597 - RNA, 19 nt, Chlamydophila pneumoniae CWL029
auccaggaauagaaagaca

SEQ ID NO: 2525598 - RNA, 20 nt, Chlamydophila pneumoniae CWL029
auccaggaauagaaagacau

SEQ ID NO: 2525599 - RNA, 17 nt, Chlamydophila pneumoniae CWL029
auccaucggcauuucuc

SEQ ID NO: 2525600 - RNA, 15 nt, Chlamydophila pneumoniae CWL029
auccaugaacagcau

SEQ ID NO: 2525601 - RNA, 12 nt, Chlamydophila pneumoniae CWL029
auccauucuuaa

SEQ ID NO: 2525602 - RNA, 16 nt, Chlamydophila pneumoniae CWL029
aucccacagaaauguc

SEQ ID NO: 2525603 - RNA, 16 nt, Chlamydophila pneumoniae CWL029
aucccaccgacaagau

SEQ ID NO: 2525604 - RNA, 22 nt, Chlamydophila pneumoniae CWL029
aucccagauuuuuuugguugcu

SEQ ID NO: 2525605 - RNA, 21 nt, Chlamydophila pneumoniae CWL029
aucccaucaaaggcaauagca

SEQ ID NO: 2525606 - RNA, 17 nt, Chlamydophila pneumoniae CWL029
auccccaccaacaaugc

SEQ ID NO: 2525607 - RNA, 18 nt, Chlamydophila pneumoniae CWL029
auccccgggauuguucuu

SEQ ID NO: 2525608 - RNA, 12 nt, Chlamydophila pneumoniae CWL029
auccccucagaa

SEQ ID NO: 2525609 - RNA, 18 nt, Chlamydophila pneumoniae CWL029
auccccucagaaaggaga

SEQ ID NO: 2525610 - RNA, 15 nt, Chlamydophila pneumoniae CWL029
auccccuucauucuu

SEQ ID NO: 2525611 - RNA, 15 nt, Chlamydophila pneumoniae CWL029
aucccgaacaaucaa

SEQ ID NO: 2525612 - RNA, 21 nt, Chlamydophila pneumoniae CWL029
aucccgccuuucuacccuucc

SEQ ID NO: 2525613 - RNA, 23 nt, Chlamydophila pneumoniae CWL029
aucccugcacucuuucagaaaga

SEQ ID NO: 2525614 - RNA, 15 nt, Chlamydophila pneumoniae CWL029
aucccuggauuucuu

SEQ ID NO: 2525615 - RNA, 17 nt, Chlamydophila pneumoniae CWL029
aucccuggauuucuucu

SEQ ID NO: 2525616 - RNA, 13 nt, Chlamydophila pneumoniae CWL029
aucccuucuucuu

SEQ ID NO: 2525617 - RNA, 14 nt, Chlamydophila pneumoniae CWL029
aucccuucuucuuu

SEQ ID NO: 2525618 - RNA, 18 nt, Chlamydophila pneumoniae CWL029
auccgaagacucaaagaa

SEQ ID NO: 2525619 - RNA, 22 nt, Chlamydophila pneumoniae CWL029
auccgacuuuccucaaagccga

SEQ ID NO: 2525620 - RNA, 12 nt, Chlamydophila pneumoniae CWL029
auccuaaaaagg

SEQ ID NO: 2525621 - RNA, 17 nt, Chlamydophila pneumoniae CWL029
auccuaaauuaaauauc

SEQ ID NO: 2525622 - RNA, 18 nt, Chlamydophila pneumoniae CWL029
auccuaagagauuuucca

SEQ ID NO: 2525623 - RNA, 22 nt, Chlamydophila pneumoniae CWL029
auccuagagaaugugcucggca

SEQ ID NO: 2525624 - RNA, 16 nt, Chlamydophila pneumoniae CWL029
auccuauuuuagcaua

SEQ ID NO: 2525625 - RNA, 12 nt, Chlamydophila pneumoniae CWL029
auccucaaagag

SEQ ID NO: 2525626 - RNA, 14 nt, Chlamydophila pneumoniae CWL029
auccucagucucuc

SEQ ID NO: 2525627 - RNA, 16 nt, Chlamydophila pneumoniae CWL029
auccucagucucucua

SEQ ID NO: 2525628 - RNA, 13 nt, Chlamydophila pneumoniae CWL029
auccucaucauca

SEQ ID NO: 2525629 - RNA, 15 nt, Chlamydophila pneumoniae CWL029
auccuccgccuguca

SEQ ID NO: 2525630 - RNA, 13 nt, Chlamydophila pneumoniae CWL029
auccucggaagau

SEQ ID NO: 2525631 - RNA, 16 nt, Chlamydophila pneumoniae CWL029
auccucggcaucuuug

SEQ ID NO: 2525632 - RNA, 19 nt, Chlamydophila pneumoniae CWL029
auccucggcaucuuuggca

SEQ ID NO: 2525633 - RNA, 23 nt, Chlamydophila pneumoniae CWL029
auccucugcugcgacacgaauuu

SEQ ID NO: 2525634 - RNA, 14 nt, Chlamydophila pneumoniae CWL029
auccugaaaguaca

SEQ ID NO: 2525635 - RNA, 18 nt, Chlamydophila pneumoniae CWL029
auccugcauacccuucuu

SEQ ID NO: 2525636 - RNA, 24 nt, Chlamydophila pneumoniae CWL029
auccugcucguaaaucuggaauga

SEQ ID NO: 2525637 - RNA, 11 nt, Chlamydophila pneumoniae CWL029
auccugggcaa

SEQ ID NO: 2525638 - RNA, 23 nt, Chlamydophila pneumoniae CWL029
auccuguaacacccucccucaua

SEQ ID NO: 2525639 - RNA, 15 nt, Chlamydophila pneumoniae CWL029
auccuguagagcaag

SEQ ID NO: 2525640 - RNA, 22 nt, Chlamydophila pneumoniae CWL029
auccuguagagcaagauucuuc

SEQ ID NO: 2525641 - RNA, 12 nt, Chlamydophila pneumoniae CWL029
auccugucuauu

SEQ ID NO: 2525642 - RNA, 21 nt, Chlamydophila pneumoniae CWL029
auccuuaucuugcugcccaaa

SEQ ID NO: 2525643 - RNA, 21 nt, Chlamydophila pneumoniae CWL029
auccuucacucguugccaauc

SEQ ID NO: 2525644 - RNA, 15 nt, Chlamydophila pneumoniae CWL029
auccuuccaagugcu

SEQ ID NO: 2525645 - RNA, 20 nt, Chlamydophila pneumoniae CWL029
auccuuccaagugcucagua

SEQ ID NO: 2525646 - RNA, 11 nt, Chlamydophila pneumoniae CWL029
auccuuccuua

SEQ ID NO: 2525647 - RNA, 17 nt, Chlamydophila pneumoniae CWL029
auccuuccuuauuggua

SEQ ID NO: 2525648 - RNA, 13 nt, Chlamydophila pneumoniae CWL029
auccuucuuuacc

SEQ ID NO: 2525649 - RNA, 22 nt, Chlamydophila pneumoniae CWL029
auccuugaaagacucgcucucc

SEQ ID NO: 2525650 - RNA, 19 nt, Chlamydophila pneumoniae CWL029
auccuugauuuuaaaauga

SEQ ID NO: 2525651 - RNA, 14 nt, Chlamydophila pneumoniae CWL029
auccuugcaaaaca

SEQ ID NO: 2525652 - RNA, 15 nt, Chlamydophila pneumoniae CWL029
auccuugcaaaacag

SEQ ID NO: 2525653 - RNA, 16 nt, Chlamydophila pneumoniae CWL029
auccuugcaaaacagc

SEQ ID NO: 2525654 - RNA, 17 nt, Chlamydophila pneumoniae CWL029
auccuuucacaaagaau

SEQ ID NO: 2525655 - RNA, 19 nt, Chlamydophila pneumoniae CWL029
auccuuucacaaagaauuc

SEQ ID NO: 2525656 - RNA, 15 nt, Chlamydophila pneumoniae CWL029
auccuuuccaagaag

SEQ ID NO: 2525657 - RNA, 18 nt, Chlamydophila pneumoniae CWL029
auccuuuccaagaaguca

SEQ ID NO: 2525658 - RNA, 19 nt, Chlamydophila pneumoniae CWL029
auccuuuuuguaguaagau

SEQ ID NO: 2525659 - RNA, 21 nt, Chlamydophila pneumoniae CWL029
aucgaaaaauaccucagaaau

SEQ ID NO: 2525660 - RNA, 17 nt, Chlamydophila pneumoniae CWL029
aucgaacagagaugcaa

SEQ ID NO: 2525661 - RNA, 20 nt, Chlamydophila pneumoniae CWL029
aucgaagaacuuagcaauga

SEQ ID NO: 2525662 - RNA, 20 nt, Chlamydophila pneumoniae CWL029
aucgaagagcccucuucacu

SEQ ID NO: 2525663 - RNA, 16 nt, Chlamydophila pneumoniae CWL029
aucgacaaguaccuuc

SEQ ID NO: 2525664 - RNA, 22 nt, Chlamydophila pneumoniae CWL029
aucgacucuuccaauuguaaau

SEQ ID NO: 2525665 - RNA, 17 nt, Chlamydophila pneumoniae CWL029
aucgacucuucgcccau

SEQ ID NO: 2525666 - RNA, 20 nt, Chlamydophila pneumoniae CWL029
aucgagcucuuuaagaacuu

SEQ ID NO: 2525667 - RNA, 23 nt, Chlamydophila pneumoniae CWL029
aucgaucucugugguuccuggau

SEQ ID NO: 2525668 - RNA, 20 nt, Chlamydophila pneumoniae CWL029
aucgccgcuugaggaggauu

SEQ ID NO: 2525669 - RNA, 14 nt, Chlamydophila pneumoniae CWL029
aucgcgaagcuuuc

SEQ ID NO: 2525670 - RNA, 15 nt, Chlamydophila pneumoniae CWL029
aucgcguguaaaagc

SEQ ID NO: 2525671 - RNA, 18 nt, Chlamydophila pneumoniae CWL029
aucgcuaucagcugggua

SEQ ID NO: 2525672 - RNA, 19 nt, Chlamydophila pneumoniae CWL029
aucgcucucuccaugagcu

SEQ ID NO: 2525673 - RNA, 19 nt, Chlamydophila pneumoniae CWL029
aucgcuguaaauucaguga

SEQ ID NO: 2525674 - RNA, 18 nt, Chlamydophila pneumoniae CWL029
aucggaguuaucaaaagg

SEQ ID NO: 2525675 - RNA, 15 nt, Chlamydophila pneumoniae CWL029
aucggaucuuuucuu

SEQ ID NO: 2525676 - RNA, 22 nt, Chlamydophila pneumoniae CWL029
aucggaucuuuucuuucuaaga

SEQ ID NO: 2525677 - RNA, 12 nt, Chlamydophila pneumoniae CWL029
aucggauuuuac

SEQ ID NO: 2525678 - RNA, 22 nt, Chlamydophila pneumoniae CWL029
aucguaagccggcgguggaaaa

SEQ ID NO: 2525679 - RNA, 18 nt, Chlamydophila pneumoniae CWL029
aucguaauagcgacauga

SEQ ID NO: 2525680 - RNA, 21 nt, Chlamydophila pneumoniae CWL029
aucguaauguauccuucuaca

SEQ ID NO: 2525681 - RNA, 16 nt, Chlamydophila pneumoniae CWL029
aucguacuucacuucu

SEQ ID NO: 2525682 - RNA, 17 nt, Chlamydophila pneumoniae CWL029
aucguagccccauagag

SEQ ID NO: 2525683 - RNA, 15 nt, Chlamydophila pneumoniae CWL029
aucguaucuuuuugc

SEQ ID NO: 2525684 - RNA, 15 nt, Chlamydophila pneumoniae CWL029
aucguccucaccgau

SEQ ID NO: 2525685 - RNA, 20 nt, Chlamydophila pneumoniae CWL029
aucgucgccuuuuccuaaau

SEQ ID NO: 2525686 - RNA, 15 nt, Chlamydophila pneumoniae CWL029
aucgucggaagacuu

SEQ ID NO: 2525687 - RNA, 16 nt, Chlamydophila pneumoniae CWL029
aucgucuccaaaaauu

SEQ ID NO: 2525688 - RNA, 18 nt, Chlamydophila pneumoniae CWL029
aucgugaaguacauuauc

SEQ ID NO: 2525689 - RNA, 19 nt, Chlamydophila pneumoniae CWL029
aucgugauugcugucagaa

SEQ ID NO: 2525690 - RNA, 23 nt, Chlamydophila pneumoniae CWL029
aucgugcuuagagccuucucauu

SEQ ID NO: 2525691 - RNA, 21 nt, Chlamydophila pneumoniae CWL029
aucguguuuuccugagcuuuu

SEQ ID NO: 2525692 - RNA, 18 nt, Chlamydophila pneumoniae CWL029
aucuaaaaacuucccauc

SEQ ID NO: 2525693 - RNA, 20 nt, Chlamydophila pneumoniae CWL029
aucuaaaaacuucccaucuu

SEQ ID NO: 2525694 - RNA, 20 nt, Chlamydophila pneumoniae CWL029
aucuaaaagcacuuaaaaaa

SEQ ID NO: 2525695 - RNA, 13 nt, Chlamydophila pneumoniae CWL029
aucuaaaaucaca

SEQ ID NO: 2525696 - RNA, 14 nt, Chlamydophila pneumoniae CWL029
aucuaaagaaaugu

SEQ ID NO: 2525697 - RNA, 14 nt, Chlamydophila pneumoniae CWL029
aucuaaaggaagau

SEQ ID NO: 2525698 - RNA, 17 nt, Chlamydophila pneumoniae CWL029
aucuaaauaagauuuua

SEQ ID NO: 2525699 - RNA, 16 nt, Chlamydophila pneumoniae CWL029
aucuaacgucagcugu

SEQ ID NO: 2525700 - RNA, 22 nt, Chlamydophila pneumoniae CWL029
aucuaagaacuagaaaaaaucc

SEQ ID NO: 2525701 - RNA, 15 nt, Chlamydophila pneumoniae CWL029
aucuaagaauaugga

SEQ ID NO: 2525702 - RNA, 18 nt, Chlamydophila pneumoniae CWL029
aucuaagauccugagacc

SEQ ID NO: 2525703 - RNA, 23 nt, Chlamydophila pneumoniae CWL029
aucuaagaugguuauuauugcuu

SEQ ID NO: 2525704 - RNA, 13 nt, Chlamydophila pneumoniae CWL029
aucuaaucaauuc

SEQ ID NO: 2525705 - RNA, 20 nt, Chlamydophila pneumoniae CWL029
aucuaauuuuagaacuucaa

SEQ ID NO: 2525706 - RNA, 21 nt, Chlamydophila pneumoniae CWL029
aucuacaaaaacuagaauaug

SEQ ID NO: 2525707 - RNA, 18 nt, Chlamydophila pneumoniae CWL029
aucuacaaacagauuuuu

SEQ ID NO: 2525708 - RNA, 22 nt, Chlamydophila pneumoniae CWL029
aucuacacacaugacaaauaaa

SEQ ID NO: 2525709 - RNA, 15 nt, Chlamydophila pneumoniae CWL029
aucuaccgugaagau

SEQ ID NO: 2525710 - RNA, 17 nt, Chlamydophila pneumoniae CWL029
aucuaccgugaagauuu

SEQ ID NO: 2525711 - RNA, 15 nt, Chlamydophila pneumoniae CWL029
aucuacgagcauuca

SEQ ID NO: 2525712 - RNA, 17 nt, Chlamydophila pneumoniae CWL029
aucuacgauguuuucuu

SEQ ID NO: 2525713 - RNA, 16 nt, Chlamydophila pneumoniae CWL029
aucuagaaagauuuau

SEQ ID NO: 2525714 - RNA, 21 nt, Chlamydophila pneumoniae CWL029
aucuagaagcauucucaauuc

SEQ ID NO: 2525715 - RNA, 16 nt, Chlamydophila pneumoniae CWL029
aucuagagucucuuuc

SEQ ID NO: 2525716 - RNA, 13 nt, Chlamydophila pneumoniae CWL029
aucuagaugauaa

SEQ ID NO: 2525717 - RNA, 13 nt, Chlamydophila pneumoniae CWL029
aucuagcucuuca

SEQ ID NO: 2525718 - RNA, 15 nt, Chlamydophila pneumoniae CWL029
aucuaggucgauauc

SEQ ID NO: 2525719 - RNA, 13 nt, Chlamydophila pneumoniae CWL029
aucuauaaaugua

SEQ ID NO: 2525720 - RNA, 23 nt, Chlamydophila pneumoniae CWL029
aucuauacagacaagcaaggaaa

SEQ ID NO: 2525721 - RNA, 18 nt, Chlamydophila pneumoniae CWL029
aucuauacccaguuguau

SEQ ID NO: 2525722 - RNA, 22 nt, Chlamydophila pneumoniae CWL029
aucuaucugcaauuccgaagaa

SEQ ID NO: 2525723 - RNA, 13 nt, Chlamydophila pneumoniae CWL029
aucucaaaaucaa

SEQ ID NO: 2525724 - RNA, 21 nt, Chlamydophila pneumoniae CWL029
aucucaagaguaggcaauaca

SEQ ID NO: 2525725 - RNA, 21 nt, Chlamydophila pneumoniae CWL029
aucucaaugcgauaaccacua

SEQ ID NO: 2525726 - RNA, 17 nt, Chlamydophila pneumoniae CWL029
aucucacaaaagucucu

SEQ ID NO: 2525727 - RNA, 14 nt, Chlamydophila pneumoniae CWL029
aucucacuggcucc

SEQ ID NO: 2525728 - RNA, 18 nt, Chlamydophila pneumoniae CWL029
aucucacuggcuccuaaa

SEQ ID NO: 2525729 - RNA, 22 nt, Chlamydophila pneumoniae CWL029
aucucaguaggagcagcggcac

SEQ ID NO: 2525730 - RNA, 12 nt, Chlamydophila pneumoniae CWL029
aucucagugaac

SEQ ID NO: 2525731 - RNA, 21 nt, Chlamydophila pneumoniae CWL029
aucucaucacguaaggugucu

SEQ ID NO: 2525732 - RNA, 20 nt, Chlamydophila pneumoniae CWL029
aucucaugcggacuuuauuc

SEQ ID NO: 2525733 - RNA, 21 nt, Chlamydophila pneumoniae CWL029
aucuccaaacauuuuuaagga

SEQ ID NO: 2525734 - RNA, 15 nt, Chlamydophila pneumoniae CWL029
aucuccaaagaucau

SEQ ID NO: 2525735 - RNA, 21 nt, Chlamydophila pneumoniae CWL029
aucuccaagccaugcaaugaa

SEQ ID NO: 2525736 - RNA, 17 nt, Chlamydophila pneumoniae CWL029
aucuccagaaauuuuua

SEQ ID NO: 2525737 - RNA, 18 nt, Chlamydophila pneumoniae CWL029
aucuccagaaauuuuuac

SEQ ID NO: 2525738 - RNA, 21 nt, Chlamydophila pneumoniae CWL029
aucuccauuuagaaugaccgc

SEQ ID NO: 2525739 - RNA, 20 nt, Chlamydophila pneumoniae CWL029
aucuccccauucacaaaucu

SEQ ID NO: 2525740 - RNA, 20 nt, Chlamydophila pneumoniae CWL029
aucuccgauagagauucuuu

SEQ ID NO: 2525741 - RNA, 12 nt, Chlamydophila pneumoniae CWL029
aucuccucucuc

SEQ ID NO: 2525742 - RNA, 16 nt, Chlamydophila pneumoniae CWL029
aucuccugcagguuug

SEQ ID NO: 2525743 - RNA, 17 nt, Chlamydophila pneumoniae CWL029
aucuccuuucaagagca

SEQ ID NO: 2525744 - RNA, 14 nt, Chlamydophila pneumoniae CWL029
aucucgcaguccuu

SEQ ID NO: 2525745 - RNA, 22 nt, Chlamydophila pneumoniae CWL029
aucucgcuauuccauaaaaaug

SEQ ID NO: 2525746 - RNA, 15 nt, Chlamydophila pneumoniae CWL029
aucucgggagaacau

SEQ ID NO: 2525747 - RNA, 13 nt, Chlamydophila pneumoniae CWL029
aucucuccagcuu

SEQ ID NO: 2525748 - RNA, 13 nt, Chlamydophila pneumoniae CWL029
aucucuccucccc

SEQ ID NO: 2525749 - RNA, 19 nt, Chlamydophila pneumoniae CWL029
aucucuccuugacaaauaa

SEQ ID NO: 2525750 - RNA, 19 nt, Chlamydophila pneumoniae CWL029
aucucucuuccugcugcuu

SEQ ID NO: 2525751 - RNA, 13 nt, Chlamydophila pneumoniae CWL029
aucucugcuuucc

SEQ ID NO: 2525752 - RNA, 19 nt, Chlamydophila pneumoniae CWL029
aucucuggaauacauuccu

SEQ ID NO: 2525753 - RNA, 20 nt, Chlamydophila pneumoniae CWL029
aucucuggcauaauccugaa

SEQ ID NO: 2525754 - RNA, 16 nt, Chlamydophila pneumoniae CWL029
aucucugugguuccug

SEQ ID NO: 2525755 - RNA, 17 nt, Chlamydophila pneumoniae CWL029
aucucuuaaaacaugag

SEQ ID NO: 2525756 - RNA, 14 nt, Chlamydophila pneumoniae CWL029
aucucuuaaaauau

SEQ ID NO: 2525757 - RNA, 15 nt, Chlamydophila pneumoniae CWL029
aucucuuaaaauauu

SEQ ID NO: 2525758 - RNA, 16 nt, Chlamydophila pneumoniae CWL029
aucucuuaaaauauua

SEQ ID NO: 2525759 - RNA, 19 nt, Chlamydophila pneumoniae CWL029
aucucuuaaaauauuaaau

SEQ ID NO: 2525760 - RNA, 22 nt, Chlamydophila pneumoniae CWL029
aucucuuaaaauauuaaauuca

SEQ ID NO: 2525761 - RNA, 15 nt, Chlamydophila pneumoniae CWL029
aucucuucuguagga

SEQ ID NO: 2525762 - RNA, 16 nt, Chlamydophila pneumoniae CWL029
aucucuucuguaggaa

SEQ ID NO: 2525763 - RNA, 17 nt, Chlamydophila pneumoniae CWL029
aucucuucuguaggaac

SEQ ID NO: 2525764 - RNA, 14 nt, Chlamydophila pneumoniae CWL029
aucucuuucacaaa

SEQ ID NO: 2525765 - RNA, 19 nt, Chlamydophila pneumoniae CWL029
aucucuuuuggaagaccuu

SEQ ID NO: 2525766 - RNA, 16 nt, Chlamydophila pneumoniae CWL029
aucugaauuuuagcuc

SEQ ID NO: 2525767 - RNA, 18 nt, Chlamydophila pneumoniae CWL029
aucugagcacauuuuucu

SEQ ID NO: 2525768 - RNA, 19 nt, Chlamydophila pneumoniae CWL029
aucugagcauaacuugaag

SEQ ID NO: 2525769 - RNA, 14 nt, Chlamydophila pneumoniae CWL029
aucugauagaacag

SEQ ID NO: 2525770 - RNA, 17 nt, Chlamydophila pneumoniae CWL029
aucugcauaauuuuucu

SEQ ID NO: 2525771 - RNA, 12 nt, Chlamydophila pneumoniae CWL029
aucugcauucca

SEQ ID NO: 2525772 - RNA, 15 nt, Chlamydophila pneumoniae CWL029
aucugcguuuaaggg

SEQ ID NO: 2525773 - RNA, 14 nt, Chlamydophila pneumoniae CWL029
aucugcguuucuuu

SEQ ID NO: 2525774 - RNA, 19 nt, Chlamydophila pneumoniae CWL029
aucugcguuucuuucugau

SEQ ID NO: 2525775 - RNA, 14 nt, Chlamydophila pneumoniae CWL029
aucugcugaaggga

SEQ ID NO: 2525776 - RNA, 18 nt, Chlamydophila pneumoniae CWL029
aucugcuuuuaucucaau

SEQ ID NO: 2525777 - RNA, 12 nt, Chlamydophila pneumoniae CWL029
aucuggagaugc

SEQ ID NO: 2525778 - RNA, 16 nt, Chlamydophila pneumoniae CWL029
aucuggggcuuccaga

SEQ ID NO: 2525779 - RNA, 17 nt, Chlamydophila pneumoniae CWL029
aucuguaagaaaaugag

SEQ ID NO: 2525780 - RNA, 21 nt, Chlamydophila pneumoniae CWL029
aucuguaagaaaaugaggaca

SEQ ID NO: 2525781 - RNA, 14 nt, Chlamydophila pneumoniae CWL029
aucuguaguaggca

SEQ ID NO: 2525782 - RNA, 17 nt, Chlamydophila pneumoniae CWL029
aucuguaguaggcacuu

SEQ ID NO: 2525783 - RNA, 14 nt, Chlamydophila pneumoniae CWL029
aucuguauccuucc

SEQ ID NO: 2525784 - RNA, 15 nt, Chlamydophila pneumoniae CWL029
aucugucauuaaaaa

SEQ ID NO: 2525785 - RNA, 16 nt, Chlamydophila pneumoniae CWL029
aucuguggcguaagca

SEQ ID NO: 2525786 - RNA, 15 nt, Chlamydophila pneumoniae CWL029
aucuguuaaaaacaa

SEQ ID NO: 2525787 - RNA, 23 nt, Chlamydophila pneumoniae CWL029
aucuuaagagcaaacaucaaaga

SEQ ID NO: 2525788 - RNA, 17 nt, Chlamydophila pneumoniae CWL029
aucuuaguccaugaauc

SEQ ID NO: 2525789 - RNA, 12 nt, Chlamydophila pneumoniae CWL029
aucuuauagaca

SEQ ID NO: 2525790 - RNA, 16 nt, Chlamydophila pneumoniae CWL029
aucuuauagacaggua

SEQ ID NO: 2525791 - RNA, 13 nt, Chlamydophila pneumoniae CWL029
aucuuauauaaaa

SEQ ID NO: 2525792 - RNA, 15 nt, Chlamydophila pneumoniae CWL029
aucuuaucaagagcu

SEQ ID NO: 2525793 - RNA, 15 nt, Chlamydophila pneumoniae CWL029
aucuuaugggagaag

SEQ ID NO: 2525794 - RNA, 20 nt, Chlamydophila pneumoniae CWL029
aucuuauugacuagcucucu

SEQ ID NO: 2525795 - RNA, 11 nt, Chlamydophila pneumoniae CWL029
aucuucaaaag

SEQ ID NO: 2525796 - RNA, 15 nt, Chlamydophila pneumoniae CWL029
aucuucaagaccacu

SEQ ID NO: 2525797 - RNA, 23 nt, Chlamydophila pneumoniae CWL029
aucuucaccacaaaccucuaaaa

SEQ ID NO: 2525798 - RNA, 17 nt, Chlamydophila pneumoniae CWL029
aucuucacgacauacau

SEQ ID NO: 2525799 - RNA, 22 nt, Chlamydophila pneumoniae CWL029
aucuucagagagaacaggaggu

SEQ ID NO: 2525800 - RNA, 23 nt, Chlamydophila pneumoniae CWL029
aucuucaucacaaaauucaugca

SEQ ID NO: 2525801 - RNA, 21 nt, Chlamydophila pneumoniae CWL029
aucuucauccccgagagagau

SEQ ID NO: 2525802 - RNA, 13 nt, Chlamydophila pneumoniae CWL029
aucuucccauuuc

SEQ ID NO: 2525803 - RNA, 15 nt, Chlamydophila pneumoniae CWL029
aucuuccccuaaaaa

SEQ ID NO: 2525804 - RNA, 17 nt, Chlamydophila pneumoniae CWL029
aucuuccccuaaaaauu

SEQ ID NO: 2525805 - RNA, 14 nt, Chlamydophila pneumoniae CWL029
aucuucuaaaacac

SEQ ID NO: 2525806 - RNA, 17 nt, Chlamydophila pneumoniae CWL029
aucuucuaaaacuucag

SEQ ID NO: 2525807 - RNA, 21 nt, Chlamydophila pneumoniae CWL029
aucuucucauccagacaagac

SEQ ID NO: 2525808 - RNA, 11 nt, Chlamydophila pneumoniae CWL029
aucuucucuau

SEQ ID NO: 2525809 - RNA, 17 nt, Chlamydophila pneumoniae CWL029
aucuucucuuaugaagu

SEQ ID NO: 2525810 - RNA, 13 nt, Chlamydophila pneumoniae CWL029
aucuucugaaauc

SEQ ID NO: 2525811 - RNA, 15 nt, Chlamydophila pneumoniae CWL029
aucuucugaaaucaa

SEQ ID NO: 2525812 - RNA, 16 nt, Chlamydophila pneumoniae CWL029
aucuucugaaaucaaa

SEQ ID NO: 2525813 - RNA, 15 nt, Chlamydophila pneumoniae CWL029
aucuucuuagccaaa

SEQ ID NO: 2525814 - RNA, 21 nt, Chlamydophila pneumoniae CWL029
aucuucuuagccaaaauuucc

SEQ ID NO: 2525815 - RNA, 22 nt, Chlamydophila pneumoniae CWL029
aucuucuucuggcugagagaag

SEQ ID NO: 2525816 - RNA, 23 nt, Chlamydophila pneumoniae CWL029
aucuucuuucuaucgauagccau

SEQ ID NO: 2525817 - RNA, 15 nt, Chlamydophila pneumoniae CWL029
aucuucuuugccaau

SEQ ID NO: 2525818 - RNA, 13 nt, Chlamydophila pneumoniae CWL029
aucuugaaaagau

SEQ ID NO: 2525819 - RNA, 13 nt, Chlamydophila pneumoniae CWL029
aucuugaaaguac

SEQ ID NO: 2525820 - RNA, 13 nt, Chlamydophila pneumoniae CWL029
aucuugaacagag

SEQ ID NO: 2525821 - RNA, 16 nt, Chlamydophila pneumoniae CWL029
aucuugagcauccaaa

SEQ ID NO: 2525822 - RNA, 14 nt, Chlamydophila pneumoniae CWL029
aucuugauaaaaga

SEQ ID NO: 2525823 - RNA, 16 nt, Chlamydophila pneumoniae CWL029
aucuugauaaaagaua

SEQ ID NO: 2525824 - RNA, 14 nt, Chlamydophila pneumoniae CWL029
aucuugauuaggaa

SEQ ID NO: 2525825 - RNA, 23 nt, Chlamydophila pneumoniae CWL029
aucuugcugcccaaauugagaaa

SEQ ID NO: 2525826 - RNA, 14 nt, Chlamydophila pneumoniae CWL029
aucuuguacauccu

SEQ ID NO: 2525827 - RNA, 17 nt, Chlamydophila pneumoniae CWL029
aucuuuaaaaggccgau

SEQ ID NO: 2525828 - RNA, 23 nt, Chlamydophila pneumoniae CWL029
aucuuuaaauucgccaaacgaau

SEQ ID NO: 2525829 - RNA, 16 nt, Chlamydophila pneumoniae CWL029
aucuuuaagauuuuua

SEQ ID NO: 2525830 - RNA, 17 nt, Chlamydophila pneumoniae CWL029
aucuuuaagauuuuuag

SEQ ID NO: 2525831 - RNA, 22 nt, Chlamydophila pneumoniae CWL029
aucuuuaguuuaccugaaaaaa

SEQ ID NO: 2525832 - RNA, 13 nt, Chlamydophila pneumoniae CWL029
aucuuuauuuaaa

SEQ ID NO: 2525833 - RNA, 14 nt, Chlamydophila pneumoniae CWL029
aucuuuauuuuuaa

SEQ ID NO: 2525834 - RNA, 14 nt, Chlamydophila pneumoniae CWL029
aucuuucaucaaug

SEQ ID NO: 2525835 - RNA, 22 nt, Chlamydophila pneumoniae CWL029
aucuuucaucaaugcgauuacu

SEQ ID NO: 2525836 - RNA, 16 nt, Chlamydophila pneumoniae CWL029
aucuuucauucccuuu

SEQ ID NO: 2525837 - RNA, 17 nt, Chlamydophila pneumoniae CWL029
aucuuuccucucaugaa

SEQ ID NO: 2525838 - RNA, 15 nt, Chlamydophila pneumoniae CWL029
aucuuucucuaaaau

SEQ ID NO: 2525839 - RNA, 14 nt, Chlamydophila pneumoniae CWL029
aucuuucuucuaga

SEQ ID NO: 2525840 - RNA, 17 nt, Chlamydophila pneumoniae CWL029
aucuuuggcacaauccu

SEQ ID NO: 2525841 - RNA, 18 nt, Chlamydophila pneumoniae CWL029
aucuuuggcacaauccuc

SEQ ID NO: 2525842 - RNA, 17 nt, Chlamydophila pneumoniae CWL029
aucuuuggguucuucca

SEQ ID NO: 2525843 - RNA, 20 nt, Chlamydophila pneumoniae CWL029
aucuuuggguucuuccauaa

SEQ ID NO: 2525844 - RNA, 16 nt, Chlamydophila pneumoniae CWL029
aucuuuuacagacuga

SEQ ID NO: 2525845 - RNA, 15 nt, Chlamydophila pneumoniae CWL029
aucuuuucaaaagaa

SEQ ID NO: 2525846 - RNA, 14 nt, Chlamydophila pneumoniae CWL029
aucuuuucuacuuc

SEQ ID NO: 2525847 - RNA, 15 nt, Chlamydophila pneumoniae CWL029
aucuuuucuagaaaa

SEQ ID NO: 2525848 - RNA, 22 nt, Chlamydophila pneumoniae CWL029
aucuuuucuagaaaacgccaac

SEQ ID NO: 2525849 - RNA, 22 nt, Chlamydophila pneumoniae CWL029
aucuuuucuuguaagacuaaaa

SEQ ID NO: 2525850 - RNA, 15 nt, Chlamydophila pneumoniae CWL029
aucuuuuuauuaaaa

SEQ ID NO: 2525851 - RNA, 22 nt, Chlamydophila pneumoniae CWL029
aucuuuuucauggcccgauaca

SEQ ID NO: 2525852 - RNA, 16 nt, Chlamydophila pneumoniae CWL029
aucuuuuugccaguuc

SEQ ID NO: 2525853 - RNA, 13 nt, Chlamydophila pneumoniae CWL029
aucuuuuuuaaag

SEQ ID NO: 2525854 - RNA, 16 nt, Chlamydophila pneumoniae CWL029
aucuuuuuuaaagcua

SEQ ID NO: 2525855 - RNA, 14 nt, Chlamydophila pneumoniae CWL029
augaaaaaagaaua

SEQ ID NO: 2525856 - RNA, 17 nt, Chlamydophila pneumoniae CWL029
augaaaaggauugcacu

SEQ ID NO: 2525857 - RNA, 14 nt, Chlamydophila pneumoniae CWL029
augaaagcuguauu

SEQ ID NO: 2525858 - RNA, 17 nt, Chlamydophila pneumoniae CWL029
augaaaggcucguagau

SEQ ID NO: 2525859 - RNA, 17 nt, Chlamydophila pneumoniae CWL029
augaaauacuccacuuu

SEQ ID NO: 2525860 - RNA, 18 nt, Chlamydophila pneumoniae CWL029
augaaauaguguuucuuu

SEQ ID NO: 2525861 - RNA, 18 nt, Chlamydophila pneumoniae CWL029
augaaauuucauucucac

SEQ ID NO: 2525862 - RNA, 23 nt, Chlamydophila pneumoniae CWL029
augaaauuucauucucacagcau

SEQ ID NO: 2525863 - RNA, 20 nt, Chlamydophila pneumoniae CWL029
augaaauuuucuaagagguu

SEQ ID NO: 2525864 - RNA, 22 nt, Chlamydophila pneumoniae CWL029
augaacagccucugugguuuuu

SEQ ID NO: 2525865 - RNA, 12 nt, Chlamydophila pneumoniae CWL029
augaacgugcau

SEQ ID NO: 2525866 - RNA, 12 nt, Chlamydophila pneumoniae CWL029
augaagaaaaau

SEQ ID NO: 2525867 - RNA, 18 nt, Chlamydophila pneumoniae CWL029
augaagaacuacucucau

SEQ ID NO: 2525868 - RNA, 19 nt, Chlamydophila pneumoniae CWL029
augaagagugguuccugaa

SEQ ID NO: 2525869 - RNA, 15 nt, Chlamydophila pneumoniae CWL029
augaagauaaaaucu

SEQ ID NO: 2525870 - RNA, 16 nt, Chlamydophila pneumoniae CWL029
augaagucuucuuucc

SEQ ID NO: 2525871 - RNA, 18 nt, Chlamydophila pneumoniae CWL029
augaagucuucuuucccc

SEQ ID NO: 2525872 - RNA, 14 nt, Chlamydophila pneumoniae CWL029
augaauaccagaag

SEQ ID NO: 2525873 - RNA, 20 nt, Chlamydophila pneumoniae CWL029
augaauaccagaagcaaagg

SEQ ID NO: 2525874 - RNA, 17 nt, Chlamydophila pneumoniae CWL029
augaaucacaucuaaag

SEQ ID NO: 2525875 - RNA, 20 nt, Chlamydophila pneumoniae CWL029
augaaucacaucuaaagauu

SEQ ID NO: 2525876 - RNA, 13 nt, Chlamydophila pneumoniae CWL029
augacaaacucua

SEQ ID NO: 2525877 - RNA, 14 nt, Chlamydophila pneumoniae CWL029
augacaacagagac

SEQ ID NO: 2525878 - RNA, 18 nt, Chlamydophila pneumoniae CWL029
augacaaguaucuacaca

SEQ ID NO: 2525879 - RNA, 19 nt, Chlamydophila pneumoniae CWL029
augacacagagaacaauaa

SEQ ID NO: 2525880 - RNA, 20 nt, Chlamydophila pneumoniae CWL029
augacacagagaacaauaaa

SEQ ID NO: 2525881 - RNA, 17 nt, Chlamydophila pneumoniae CWL029
augacagggaaagaaca

SEQ ID NO: 2525882 - RNA, 17 nt, Chlamydophila pneumoniae CWL029
augacaguguccacugc

SEQ ID NO: 2525883 - RNA, 16 nt, Chlamydophila pneumoniae CWL029
augacauugcaauaca

SEQ ID NO: 2525884 - RNA, 17 nt, Chlamydophila pneumoniae CWL029
augacauugcaauacau

SEQ ID NO: 2525885 - RNA, 16 nt, Chlamydophila pneumoniae CWL029
augaccaagaacauag

SEQ ID NO: 2525886 - RNA, 15 nt, Chlamydophila pneumoniae CWL029
augaccuuuaggaac

SEQ ID NO: 2525887 - RNA, 17 nt, Chlamydophila pneumoniae CWL029
augacggauccuagaau

SEQ ID NO: 2525888 - RNA, 22 nt, Chlamydophila pneumoniae CWL029
augacggauccuagaauaggaa

SEQ ID NO: 2525889 - RNA, 13 nt, Chlamydophila pneumoniae CWL029
augacuauuuuca

SEQ ID NO: 2525890 - RNA, 22 nt, Chlamydophila pneumoniae CWL029
augacuauuuucauuccaagau

SEQ ID NO: 2525891 - RNA, 18 nt, Chlamydophila pneumoniae CWL029
augacuggcgacuugcca

SEQ ID NO: 2525892 - RNA, 14 nt, Chlamydophila pneumoniae CWL029
augagaaaaagaau

SEQ ID NO: 2525893 - RNA, 20 nt, Chlamydophila pneumoniae CWL029
augagaaauacgcuuuucuu

SEQ ID NO: 2525894 - RNA, 17 nt, Chlamydophila pneumoniae CWL029
augagaauuuucaugau

SEQ ID NO: 2525895 - RNA, 14 nt, Chlamydophila pneumoniae CWL029
augagaguaaguuu

SEQ ID NO: 2525896 - RNA, 16 nt, Chlamydophila pneumoniae CWL029
augagaucagcuccca

SEQ ID NO: 2525897 - RNA, 13 nt, Chlamydophila pneumoniae CWL029
augagauccaaag

SEQ ID NO: 2525898 - RNA, 15 nt, Chlamydophila pneumoniae CWL029
augagauccaaagcc

SEQ ID NO: 2525899 - RNA, 13 nt, Chlamydophila pneumoniae CWL029
augagaugggcua

SEQ ID NO: 2525900 - RNA, 17 nt, Chlamydophila pneumoniae CWL029
augagcacauucaagau

SEQ ID NO: 2525901 - RNA, 23 nt, Chlamydophila pneumoniae CWL029
augagcaucugagucauaagcuc

SEQ ID NO: 2525902 - RNA, 20 nt, Chlamydophila pneumoniae CWL029
augagcgagguauucucugg

SEQ ID NO: 2525903 - RNA, 18 nt, Chlamydophila pneumoniae CWL029
augagcucaggcaacaac

SEQ ID NO: 2525904 - RNA, 20 nt, Chlamydophila pneumoniae CWL029
augagcuccaaaauaaucuc

SEQ ID NO: 2525905 - RNA, 15 nt, Chlamydophila pneumoniae CWL029
augagcucuauuucu

SEQ ID NO: 2525906 - RNA, 18 nt, Chlamydophila pneumoniae CWL029
augaggauacacuucuaa

SEQ ID NO: 2525907 - RNA, 15 nt, Chlamydophila pneumoniae CWL029
augaggcuccuccuu

SEQ ID NO: 2525908 - RNA, 20 nt, Chlamydophila pneumoniae CWL029
augaguggguucacuccuga

SEQ ID NO: 2525909 - RNA, 13 nt, Chlamydophila pneumoniae CWL029
augauaauuucau

SEQ ID NO: 2525910 - RNA, 20 nt, Chlamydophila pneumoniae CWL029
augauaccaagaugaagaaa

SEQ ID NO: 2525911 - RNA, 23 nt, Chlamydophila pneumoniae CWL029
augauauccucaauuuguuucuu

SEQ ID NO: 2525912 - RNA, 18 nt, Chlamydophila pneumoniae CWL029
augauauuuuuauuuaaa

SEQ ID NO: 2525913 - RNA, 19 nt, Chlamydophila pneumoniae CWL029
augauauuuuuauuuaaaa

SEQ ID NO: 2525914 - RNA, 21 nt, Chlamydophila pneumoniae CWL029
augauauuuuuauuuaaaauu

SEQ ID NO: 2525915 - RNA, 22 nt, Chlamydophila pneumoniae CWL029
augauccaauagccaaagacuc

SEQ ID NO: 2525916 - RNA, 16 nt, Chlamydophila pneumoniae CWL029
augauccgaaaacucu

SEQ ID NO: 2525917 - RNA, 17 nt, Chlamydophila pneumoniae CWL029
augaucgggguuucaga

SEQ ID NO: 2525918 - RNA, 16 nt, Chlamydophila pneumoniae CWL029
augaucuacagauagg

SEQ ID NO: 2525919 - RNA, 19 nt, Chlamydophila pneumoniae CWL029
augaucucuucaugaaaaa

SEQ ID NO: 2525920 - RNA, 15 nt, Chlamydophila pneumoniae CWL029
augaucuuuaggaaa

SEQ ID NO: 2525921 - RNA, 17 nt, Chlamydophila pneumoniae CWL029
augaugacauugcaaua

SEQ ID NO: 2525922 - RNA, 18 nt, Chlamydophila pneumoniae CWL029
augaugagaacguccuca

SEQ ID NO: 2525923 - RNA, 17 nt, Chlamydophila pneumoniae CWL029
augaugcauauugccuu

SEQ ID NO: 2525924 - RNA, 14 nt, Chlamydophila pneumoniae CWL029
augauguguugauu

SEQ ID NO: 2525925 - RNA, 15 nt, Chlamydophila pneumoniae CWL029
augauguuuuuuaac

SEQ ID NO: 2525926 - RNA, 15 nt, Chlamydophila pneumoniae CWL029
augauuacaucuaac

SEQ ID NO: 2525927 - RNA, 12 nt, Chlamydophila pneumoniae CWL029
augauucauaac

SEQ ID NO: 2525928 - RNA, 19 nt, Chlamydophila pneumoniae CWL029
augauuucuuuagcuuuau

SEQ ID NO: 2525929 - RNA, 22 nt, Chlamydophila pneumoniae CWL029
augauuucuuuagcuuuauuga

SEQ ID NO: 2525930 - RNA, 23 nt, Chlamydophila pneumoniae CWL029
augcaaaacaacaucacuaucau

SEQ ID NO: 2525931 - RNA, 17 nt, Chlamydophila pneumoniae CWL029
augcaaaauaauuacuu

SEQ ID NO: 2525932 - RNA, 18 nt, Chlamydophila pneumoniae CWL029
augcaaauccuguagaaa

SEQ ID NO: 2525933 - RNA, 14 nt, Chlamydophila pneumoniae CWL029
augcaaauuccaga

SEQ ID NO: 2525934 - RNA, 16 nt, Chlamydophila pneumoniae CWL029
augcaacggagaaauu

SEQ ID NO: 2525935 - RNA, 15 nt, Chlamydophila pneumoniae CWL029
augcaagcaacucuu

SEQ ID NO: 2525936 - RNA, 18 nt, Chlamydophila pneumoniae CWL029
augcaagugcgcuaccag

SEQ ID NO: 2525937 - RNA, 14 nt, Chlamydophila pneumoniae CWL029
augcaagugcuuuc

SEQ ID NO: 2525938 - RNA, 15 nt, Chlamydophila pneumoniae CWL029
augcaauacuuuucu

SEQ ID NO: 2525939 - RNA, 16 nt, Chlamydophila pneumoniae CWL029
augcaaugguugucuu

SEQ ID NO: 2525940 - RNA, 21 nt, Chlamydophila pneumoniae CWL029
augcacgcuuucgucuaaaau

SEQ ID NO: 2525941 - RNA, 22 nt, Chlamydophila pneumoniae CWL029
augcacgcuuucgucuaaaaua

SEQ ID NO: 2525942 - RNA, 12 nt, Chlamydophila pneumoniae CWL029
augcagaucaua

SEQ ID NO: 2525943 - RNA, 22 nt, Chlamydophila pneumoniae CWL029
augcagccugcgacuacaagau

SEQ ID NO: 2525944 - RNA, 14 nt, Chlamydophila pneumoniae CWL029
augcaguucuuguu

SEQ ID NO: 2525945 - RNA, 18 nt, Chlamydophila pneumoniae CWL029
augcauagaauaaagauu

SEQ ID NO: 2525946 - RNA, 21 nt, Chlamydophila pneumoniae CWL029
augcauagaauaaagauuuua

SEQ ID NO: 2525947 - RNA, 18 nt, Chlamydophila pneumoniae CWL029
augcauauugccuucuuc

SEQ ID NO: 2525948 - RNA, 13 nt, Chlamydophila pneumoniae CWL029
augcaucaagaga

SEQ ID NO: 2525949 - RNA, 14 nt, Chlamydophila pneumoniae CWL029
augcaucaagagau

SEQ ID NO: 2525950 - RNA, 15 nt, Chlamydophila pneumoniae CWL029
augcaucaaugaagu

SEQ ID NO: 2525951 - RNA, 16 nt, Chlamydophila pneumoniae CWL029
augcaucucuagccaa

SEQ ID NO: 2525952 - RNA, 15 nt, Chlamydophila pneumoniae CWL029
augcaucucuuaaaa

SEQ ID NO: 2525953 - RNA, 21 nt, Chlamydophila pneumoniae CWL029
augcaucucuuaaaacaugag

SEQ ID NO: 2525954 - RNA, 17 nt, Chlamydophila pneumoniae CWL029
augcauuuguuuggaaa

SEQ ID NO: 2525955 - RNA, 13 nt, Chlamydophila pneumoniae CWL029
augccaguuccua

SEQ ID NO: 2525956 - RNA, 16 nt, Chlamydophila pneumoniae CWL029
augccaguuccuaaag

SEQ ID NO: 2525957 - RNA, 17 nt, Chlamydophila pneumoniae CWL029
augccauugaucagaau

SEQ ID NO: 2525958 - RNA, 19 nt, Chlamydophila pneumoniae CWL029
augccauugaucagaaucu

SEQ ID NO: 2525959 - RNA, 13 nt, Chlamydophila pneumoniae CWL029
augcccaaggaaa

SEQ ID NO: 2525960 - RNA, 16 nt, Chlamydophila pneumoniae CWL029
augcccuuuagggaau

SEQ ID NO: 2525961 - RNA, 15 nt, Chlamydophila pneumoniae CWL029
augccgcaucuagaa

SEQ ID NO: 2525962 - RNA, 21 nt, Chlamydophila pneumoniae CWL029
augccuacaggcaaggagagc

SEQ ID NO: 2525963 - RNA, 21 nt, Chlamydophila pneumoniae CWL029
augccuauuaagucaccuuaa

SEQ ID NO: 2525964 - RNA, 23 nt, Chlamydophila pneumoniae CWL029
augccucaggucugcugaggaga

SEQ ID NO: 2525965 - RNA, 13 nt, Chlamydophila pneumoniae CWL029
augccucuuucau

SEQ ID NO: 2525966 - RNA, 19 nt, Chlamydophila pneumoniae CWL029
augccucuuucauacuaaa

SEQ ID NO: 2525967 - RNA, 22 nt, Chlamydophila pneumoniae CWL029
augccucuuucauacuaaaauc

SEQ ID NO: 2525968 - RNA, 21 nt, Chlamydophila pneumoniae CWL029
augccuggccaucaucaccag

SEQ ID NO: 2525969 - RNA, 17 nt, Chlamydophila pneumoniae CWL029
augccuuaaauguauug

SEQ ID NO: 2525970 - RNA, 17 nt, Chlamydophila pneumoniae CWL029
augcgaagggaggagaa

SEQ ID NO: 2525971 - RNA, 16 nt, Chlamydophila pneumoniae CWL029
augcggaccuuaagau

SEQ ID NO: 2525972 - RNA, 21 nt, Chlamydophila pneumoniae CWL029
augcuaaagagucuuccuaga

SEQ ID NO: 2525973 - RNA, 21 nt, Chlamydophila pneumoniae CWL029
augcuaaauuugucaucacau

SEQ ID NO: 2525974 - RNA, 16 nt, Chlamydophila pneumoniae CWL029
augcuaagcaucagaa

SEQ ID NO: 2525975 - RNA, 12 nt, Chlamydophila pneumoniae CWL029
augcuaucccac

SEQ ID NO: 2525976 - RNA, 21 nt, Chlamydophila pneumoniae CWL029
augcuaucuccagaaauuuuu

SEQ ID NO: 2525977 - RNA, 15 nt, Chlamydophila pneumoniae CWL029
augcuauuuuuccau

SEQ ID NO: 2525978 - RNA, 21 nt, Chlamydophila pneumoniae CWL029
augcuccuugggucuuuuuau

SEQ ID NO: 2525979 - RNA, 16 nt, Chlamydophila pneumoniae CWL029
augcugaaccuuuggu

SEQ ID NO: 2525980 - RNA, 17 nt, Chlamydophila pneumoniae CWL029
augcuuagcaaaggcaa

SEQ ID NO: 2525981 - RNA, 13 nt, Chlamydophila pneumoniae CWL029
augcuuaucuauc

SEQ ID NO: 2525982 - RNA, 20 nt, Chlamydophila pneumoniae CWL029
augcuucaaggcaucuucuu

SEQ ID NO: 2525983 - RNA, 14 nt, Chlamydophila pneumoniae CWL029
augcuucuuucaaa

SEQ ID NO: 2525984 - RNA, 15 nt, Chlamydophila pneumoniae CWL029
augcuuggcaauagc

SEQ ID NO: 2525985 - RNA, 20 nt, Chlamydophila pneumoniae CWL029
augcuugucgcgacaagaca

SEQ ID NO: 2525986 - RNA, 22 nt, Chlamydophila pneumoniae CWL029
auggaaagagucccugauucca

SEQ ID NO: 2525987 - RNA, 16 nt, Chlamydophila pneumoniae CWL029
auggaaauagagaaac

SEQ ID NO: 2525988 - RNA, 16 nt, Chlamydophila pneumoniae CWL029
auggaagagagcaaga

SEQ ID NO: 2525989 - RNA, 17 nt, Chlamydophila pneumoniae CWL029
auggaauggcuuuuguu

SEQ ID NO: 2525990 - RNA, 14 nt, Chlamydophila pneumoniae CWL029
auggacaagcaaaa

SEQ ID NO: 2525991 - RNA, 18 nt, Chlamydophila pneumoniae CWL029
auggagaaggacacuaga

SEQ ID NO: 2525992 - RNA, 20 nt, Chlamydophila pneumoniae CWL029
auggauccuucaucagcuuc

SEQ ID NO: 2525993 - RNA, 12 nt, Chlamydophila pneumoniae CWL029
auggaugaucuc

SEQ ID NO: 2525994 - RNA, 23 nt, Chlamydophila pneumoniae CWL029
auggaugucaccacgaacuucag

SEQ ID NO: 2525995 - RNA, 20 nt, Chlamydophila pneumoniae CWL029
auggauuucuccagcagcuu

SEQ ID NO: 2525996 - RNA, 19 nt, Chlamydophila pneumoniae CWL029
auggcagccuggaaagcuu

SEQ ID NO: 2525997 - RNA, 18 nt, Chlamydophila pneumoniae CWL029
auggcagcuuggauggga

SEQ ID NO: 2525998 - RNA, 21 nt, Chlamydophila pneumoniae CWL029
auggcagcuuggaugggaauc

SEQ ID NO: 2525999 - RNA, 16 nt, Chlamydophila pneumoniae CWL029
auggcaucuaagccag

SEQ ID NO: 2526000 - RNA, 20 nt, Chlamydophila pneumoniae CWL029
auggcauugggaaggaucug

SEQ ID NO: 2526001 - RNA, 15 nt, Chlamydophila pneumoniae CWL029
auggcccgauacaaa

SEQ ID NO: 2526002 - RNA, 16 nt, Chlamydophila pneumoniae CWL029
auggcgauaaaugcug

SEQ ID NO: 2526003 - RNA, 16 nt, Chlamydophila pneumoniae CWL029
auggcucaacuuaagu

SEQ ID NO: 2526004 - RNA, 22 nt, Chlamydophila pneumoniae CWL029
auggcucugucacuagagaaaa

SEQ ID NO: 2526005 - RNA, 18 nt, Chlamydophila pneumoniae CWL029
auggcugucacggaagaa

SEQ ID NO: 2526006 - RNA, 14 nt, Chlamydophila pneumoniae CWL029
augggaauaaaaau

SEQ ID NO: 2526007 - RNA, 12 nt, Chlamydophila pneumoniae CWL029
augggaaucuug

SEQ ID NO: 2526008 - RNA, 11 nt, Chlamydophila pneumoniae CWL029
augggaauuug

SEQ ID NO: 2526009 - RNA, 15 nt, Chlamydophila pneumoniae CWL029
augggaucggucuuu

SEQ ID NO: 2526010 - RNA, 19 nt, Chlamydophila pneumoniae CWL029
augggcuuugcuaacagaa

SEQ ID NO: 2526011 - RNA, 22 nt, Chlamydophila pneumoniae CWL029
auggggauuaucccaaacuucu

SEQ ID NO: 2526012 - RNA, 14 nt, Chlamydophila pneumoniae CWL029
augguaauuuuuca

SEQ ID NO: 2526013 - RNA, 15 nt, Chlamydophila pneumoniae CWL029
augguacaauacugg

SEQ ID NO: 2526014 - RNA, 22 nt, Chlamydophila pneumoniae CWL029
augguauucccuaacaggaaag

SEQ ID NO: 2526015 - RNA, 19 nt, Chlamydophila pneumoniae CWL029
auggucaggaagaaaggau

SEQ ID NO: 2526016 - RNA, 12 nt, Chlamydophila pneumoniae CWL029
augguccuaggc

SEQ ID NO: 2526017 - RNA, 22 nt, Chlamydophila pneumoniae CWL029
auggucucgaaauccuaaaaag

SEQ ID NO: 2526018 - RNA, 13 nt, Chlamydophila pneumoniae CWL029
auggucuuccccc

SEQ ID NO: 2526019 - RNA, 19 nt, Chlamydophila pneumoniae CWL029
auggucuuggguuuuaaau

SEQ ID NO: 2526020 - RNA, 22 nt, Chlamydophila pneumoniae CWL029
augguguucuucagcccacugu

SEQ ID NO: 2526021 - RNA, 12 nt, Chlamydophila pneumoniae CWL029
augguugcuucu

SEQ ID NO: 2526022 - RNA, 18 nt, Chlamydophila pneumoniae CWL029
augguugcuucuaagaaa

SEQ ID NO: 2526023 - RNA, 16 nt, Chlamydophila pneumoniae CWL029
auguaaaaaauuauuu

SEQ ID NO: 2526024 - RNA, 17 nt, Chlamydophila pneumoniae CWL029
auguaaaaaauuauuug

SEQ ID NO: 2526025 - RNA, 17 nt, Chlamydophila pneumoniae CWL029
auguaaucauaaaaaaa

SEQ ID NO: 2526026 - RNA, 19 nt, Chlamydophila pneumoniae CWL029
auguaaucccagauuuuuu

SEQ ID NO: 2526027 - RNA, 16 nt, Chlamydophila pneumoniae CWL029
auguacagaaaauaag

SEQ ID NO: 2526028 - RNA, 16 nt, Chlamydophila pneumoniae CWL029
auguacaguaaaguau

SEQ ID NO: 2526029 - RNA, 16 nt, Chlamydophila pneumoniae CWL029
auguacauagaggaga

SEQ ID NO: 2526030 - RNA, 15 nt, Chlamydophila pneumoniae CWL029
auguacugaugugaa

SEQ ID NO: 2526031 - RNA, 14 nt, Chlamydophila pneumoniae CWL029
auguagaucuacaa

SEQ ID NO: 2526032 - RNA, 13 nt, Chlamydophila pneumoniae CWL029
auguagcagagcc

SEQ ID NO: 2526033 - RNA, 16 nt, Chlamydophila pneumoniae CWL029
auguagcuguuccaag

SEQ ID NO: 2526034 - RNA, 16 nt, Chlamydophila pneumoniae CWL029
auguaggaugugaagg

SEQ ID NO: 2526035 - RNA, 12 nt, Chlamydophila pneumoniae CWL029
auguaguaaauu

SEQ ID NO: 2526036 - RNA, 13 nt, Chlamydophila pneumoniae CWL029
auguauaaaguuu

SEQ ID NO: 2526037 - RNA, 22 nt, Chlamydophila pneumoniae CWL029
auguaucggggauugcaaaauu

SEQ ID NO: 2526038 - RNA, 23 nt, Chlamydophila pneumoniae CWL029
auguauggugcgcgucuccuuga

SEQ ID NO: 2526039 - RNA, 20 nt, Chlamydophila pneumoniae CWL029
augucacucuagaaaauauu

SEQ ID NO: 2526040 - RNA, 17 nt, Chlamydophila pneumoniae CWL029
auguccauuaauauccc

SEQ ID NO: 2526041 - RNA, 21 nt, Chlamydophila pneumoniae CWL029
auguccgugagcaacaagcug

SEQ ID NO: 2526042 - RNA, 17 nt, Chlamydophila pneumoniae CWL029
auguccuccauggaaag

SEQ ID NO: 2526043 - RNA, 20 nt, Chlamydophila pneumoniae CWL029
auguccuccauggaaagaaa

SEQ ID NO: 2526044 - RNA, 16 nt, Chlamydophila pneumoniae CWL029
auguccuucaaaaugu

SEQ ID NO: 2526045 - RNA, 19 nt, Chlamydophila pneumoniae CWL029
auguccuucaaaauguuua

SEQ ID NO: 2526046 - RNA, 16 nt, Chlamydophila pneumoniae CWL029
augucgcgaaaguaaa

SEQ ID NO: 2526047 - RNA, 17 nt, Chlamydophila pneumoniae CWL029
augucgcuaccauaucu

SEQ ID NO: 2526048 - RNA, 22 nt, Chlamydophila pneumoniae CWL029
augucguaccccgcagcaaaaa

SEQ ID NO: 2526049 - RNA, 14 nt, Chlamydophila pneumoniae CWL029
augucuaaagauug

SEQ ID NO: 2526050 - RNA, 19 nt, Chlamydophila pneumoniae CWL029
augucuccaaagauacauu

SEQ ID NO: 2526051 - RNA, 19 nt, Chlamydophila pneumoniae CWL029
augucuucauaugcucucc

SEQ ID NO: 2526052 - RNA, 15 nt, Chlamydophila pneumoniae CWL029
augucuuugaauaua

SEQ ID NO: 2526053 - RNA, 16 nt, Chlamydophila pneumoniae CWL029
augucuuugaauauau

SEQ ID NO: 2526054 - RNA, 19 nt, Chlamydophila pneumoniae CWL029
augugcgcacaagggauuc

SEQ ID NO: 2526055 - RNA, 13 nt, Chlamydophila pneumoniae CWL029
augugcugaagac

SEQ ID NO: 2526056 - RNA, 13 nt, Chlamydophila pneumoniae CWL029
auguggcagaguc

SEQ ID NO: 2526057 - RNA, 24 nt, Chlamydophila pneumoniae CWL029
augugguucccccuaagguagcua

SEQ ID NO: 2526058 - RNA, 16 nt, Chlamydophila pneumoniae CWL029
augugucuugcugauu

SEQ ID NO: 2526059 - RNA, 13 nt, Chlamydophila pneumoniae CWL029
auguguuuccuuu

SEQ ID NO: 2526060 - RNA, 16 nt, Chlamydophila pneumoniae CWL029
auguguuuccuuuucu

SEQ ID NO: 2526061 - RNA, 21 nt, Chlamydophila pneumoniae CWL029
auguguuuccuuuucuccuuc

SEQ ID NO: 2526062 - RNA, 21 nt, Chlamydophila pneumoniae CWL029
auguuaagcguauagaauaga

SEQ ID NO: 2526063 - RNA, 18 nt, Chlamydophila pneumoniae CWL029
auguuaugaguuuuuaau

SEQ ID NO: 2526064 - RNA, 12 nt, Chlamydophila pneumoniae CWL029
auguuauggacu

SEQ ID NO: 2526065 - RNA, 16 nt, Chlamydophila pneumoniae CWL029
auguucccaaauagaa

SEQ ID NO: 2526066 - RNA, 17 nt, Chlamydophila pneumoniae CWL029
auguucccaaauagaaa

SEQ ID NO: 2526067 - RNA, 21 nt, Chlamydophila pneumoniae CWL029
auguuccuuuuuuuuuucuuc

SEQ ID NO: 2526068 - RNA, 14 nt, Chlamydophila pneumoniae CWL029
auguucgauuuucu

SEQ ID NO: 2526069 - RNA, 21 nt, Chlamydophila pneumoniae CWL029
auguucuaugagauaggaacu

SEQ ID NO: 2526070 - RNA, 12 nt, Chlamydophila pneumoniae CWL029
auguuuaaagca

SEQ ID NO: 2526071 - RNA, 22 nt, Chlamydophila pneumoniae CWL029
auguuuaugaaaaucugcucuc

SEQ ID NO: 2526072 - RNA, 15 nt, Chlamydophila pneumoniae CWL029
auguuucuuccugaa

SEQ ID NO: 2526073 - RNA, 20 nt, Chlamydophila pneumoniae CWL029
auguuuguaguguugaauaa

SEQ ID NO: 2526074 - RNA, 14 nt, Chlamydophila pneumoniae CWL029
auguuuugacauag

SEQ ID NO: 2526075 - RNA, 16 nt, Chlamydophila pneumoniae CWL029
auuaaacgaauacugu

SEQ ID NO: 2526076 - RNA, 23 nt, Chlamydophila pneumoniae CWL029
auuaaaguccaagaucaaacgaa

SEQ ID NO: 2526077 - RNA, 18 nt, Chlamydophila pneumoniae CWL029
auuaaaucguacuucacu

SEQ ID NO: 2526078 - RNA, 18 nt, Chlamydophila pneumoniae CWL029
auuaaauucuuuucuaca

SEQ ID NO: 2526079 - RNA, 22 nt, Chlamydophila pneumoniae CWL029
auuaaauuguauggaauucaaa

SEQ ID NO: 2526080 - RNA, 21 nt, Chlamydophila pneumoniae CWL029
auuaacagagcgccuccaccu

SEQ ID NO: 2526081 - RNA, 19 nt, Chlamydophila pneumoniae CWL029
auuaacuaagauauguccg

SEQ ID NO: 2526082 - RNA, 22 nt, Chlamydophila pneumoniae CWL029
auuaacuccucggcaacuacug

SEQ ID NO: 2526083 - RNA, 20 nt, Chlamydophila pneumoniae CWL029
auuaagaagaaccucauuuu

SEQ ID NO: 2526084 - RNA, 12 nt, Chlamydophila pneumoniae CWL029
auuaagaggagu

SEQ ID NO: 2526085 - RNA, 20 nt, Chlamydophila pneumoniae CWL029
auuaagauaaacagcacagg

SEQ ID NO: 2526086 - RNA, 16 nt, Chlamydophila pneumoniae CWL029
auuaaggauuccuuga

SEQ ID NO: 2526087 - RNA, 15 nt, Chlamydophila pneumoniae CWL029
auuaaggcuccagca

SEQ ID NO: 2526088 - RNA, 22 nt, Chlamydophila pneumoniae CWL029
auuaaggcuccagcauaaggau

SEQ ID NO: 2526089 - RNA, 13 nt, Chlamydophila pneumoniae CWL029
auuaagucaccuu

SEQ ID NO: 2526090 - RNA, 15 nt, Chlamydophila pneumoniae CWL029
auuaagucaccuuaa

SEQ ID NO: 2526091 - RNA, 14 nt, Chlamydophila pneumoniae CWL029
auuaauacuuugcc

SEQ ID NO: 2526092 - RNA, 20 nt, Chlamydophila pneumoniae CWL029
auuaauaucccaguuuuccc

SEQ ID NO: 2526093 - RNA, 22 nt, Chlamydophila pneumoniae CWL029
auuaauccuugagggcuaucca

SEQ ID NO: 2526094 - RNA, 23 nt, Chlamydophila pneumoniae CWL029
auuaauccuugagggcuauccac

SEQ ID NO: 2526095 - RNA, 12 nt, Chlamydophila pneumoniae CWL029
auuacagaaagg

SEQ ID NO: 2526096 - RNA, 21 nt, Chlamydophila pneumoniae CWL029
auuacagaaaggcuuuucuuu

SEQ ID NO: 2526097 - RNA, 22 nt, Chlamydophila pneumoniae CWL029
auuacagcaucuauagaauuuc

SEQ ID NO: 2526098 - RNA, 12 nt, Chlamydophila pneumoniae CWL029
auuacaggaaac

SEQ ID NO: 2526099 - RNA, 12 nt, Chlamydophila pneumoniae CWL029
auuacagggaaa

SEQ ID NO: 2526100 - RNA, 17 nt, Chlamydophila pneumoniae CWL029
auuacaucuaacucuaa

SEQ ID NO: 2526101 - RNA, 18 nt, Chlamydophila pneumoniae CWL029
auuacaucuaacucuaau

SEQ ID NO: 2526102 - RNA, 21 nt, Chlamydophila pneumoniae CWL029
auuaccguucccuaaaguaac

SEQ ID NO: 2526103 - RNA, 14 nt, Chlamydophila pneumoniae CWL029
auuaccugcuaaac

SEQ ID NO: 2526104 - RNA, 22 nt, Chlamydophila pneumoniae CWL029
auuaccugcuaaacuuuuuuuc

SEQ ID NO: 2526105 - RNA, 23 nt, Chlamydophila pneumoniae CWL029
auuaccugcuaaacuuuuuuuca

SEQ ID NO: 2526106 - RNA, 23 nt, Chlamydophila pneumoniae CWL029
auuacggcgugccuuuuuuucua

SEQ ID NO: 2526107 - RNA, 17 nt, Chlamydophila pneumoniae CWL029
auuacuagaucccucaa

SEQ ID NO: 2526108 - RNA, 17 nt, Chlamydophila pneumoniae CWL029
auuacucgcucugcacg

SEQ ID NO: 2526109 - RNA, 17 nt, Chlamydophila pneumoniae CWL029
auuagaaaagauaaaac

SEQ ID NO: 2526110 - RNA, 21 nt, Chlamydophila pneumoniae CWL029
auuagaaguaucuugauguuu

SEQ ID NO: 2526111 - RNA, 23 nt, Chlamydophila pneumoniae CWL029
auuagagagugcguacucuucuu

SEQ ID NO: 2526112 - RNA, 20 nt, Chlamydophila pneumoniae CWL029
auuagcccuacgaauccaaa

SEQ ID NO: 2526113 - RNA, 22 nt, Chlamydophila pneumoniae CWL029
auuagcccuacgaauccaaaaa

SEQ ID NO: 2526114 - RNA, 15 nt, Chlamydophila pneumoniae CWL029
auuagcgaguacuuu

SEQ ID NO: 2526115 - RNA, 19 nt, Chlamydophila pneumoniae CWL029
auuagcuaaaucaaaauuu

SEQ ID NO: 2526116 - RNA, 22 nt, Chlamydophila pneumoniae CWL029
auuagggaaaggucggggagaa

SEQ ID NO: 2526117 - RNA, 18 nt, Chlamydophila pneumoniae CWL029
auuaguaacuaaauucuu

SEQ ID NO: 2526118 - RNA, 20 nt, Chlamydophila pneumoniae CWL029
auuaguaacuaaauucuuaa

SEQ ID NO: 2526119 - RNA, 16 nt, Chlamydophila pneumoniae CWL029
auuaguuucacauagu

SEQ ID NO: 2526120 - RNA, 20 nt, Chlamydophila pneumoniae CWL029
auuauaaagauaaucuguaa

SEQ ID NO: 2526121 - RNA, 14 nt, Chlamydophila pneumoniae CWL029
auuauaaauagaaa

SEQ ID NO: 2526122 - RNA, 17 nt, Chlamydophila pneumoniae CWL029
auuauaaauagaaaucu

SEQ ID NO: 2526123 - RNA, 13 nt, Chlamydophila pneumoniae CWL029
auuaucaagaaau

SEQ ID NO: 2526124 - RNA, 15 nt, Chlamydophila pneumoniae CWL029
auuaucauaaauacg

SEQ ID NO: 2526125 - RNA, 19 nt, Chlamydophila pneumoniae CWL029
auuaucuucguaauaacua

SEQ ID NO: 2526126 - RNA, 23 nt, Chlamydophila pneumoniae CWL029
auuaucuuguaaacgagcuuuau

SEQ ID NO: 2526127 - RNA, 14 nt, Chlamydophila pneumoniae CWL029
auuaucuuguuucg

SEQ ID NO: 2526128 - RNA, 17 nt, Chlamydophila pneumoniae CWL029
auuaugcccaaggaaaa

SEQ ID NO: 2526129 - RNA, 18 nt, Chlamydophila pneumoniae CWL029
auuaugcccaaggaaaaa

SEQ ID NO: 2526130 - RNA, 18 nt, Chlamydophila pneumoniae CWL029
auuauguagaucauaaac

SEQ ID NO: 2526131 - RNA, 12 nt, Chlamydophila pneumoniae CWL029
auuauucuagag

SEQ ID NO: 2526132 - RNA, 13 nt, Chlamydophila pneumoniae CWL029
auuauugaauaag

SEQ ID NO: 2526133 - RNA, 18 nt, Chlamydophila pneumoniae CWL029
auuauuuguuucuuccau

SEQ ID NO: 2526134 - RNA, 21 nt, Chlamydophila pneumoniae CWL029
auuauuuguuucuuccauaca

SEQ ID NO: 2526135 - RNA, 13 nt, Chlamydophila pneumoniae CWL029
auucaaaauagaa

SEQ ID NO: 2526136 - RNA, 18 nt, Chlamydophila pneumoniae CWL029
auucaaaauagaagccac

SEQ ID NO: 2526137 - RNA, 18 nt, Chlamydophila pneumoniae CWL029
auucaaacuccuuuuaaa

SEQ ID NO: 2526138 - RNA, 21 nt, Chlamydophila pneumoniae CWL029
auucaaacuccuuuuaaaauu

SEQ ID NO: 2526139 - RNA, 13 nt, Chlamydophila pneumoniae CWL029
auucaaccaaacg

SEQ ID NO: 2526140 - RNA, 18 nt, Chlamydophila pneumoniae CWL029
auucacaaaucuuccccu

SEQ ID NO: 2526141 - RNA, 16 nt, Chlamydophila pneumoniae CWL029
auucacaucuuaaaaa

SEQ ID NO: 2526142 - RNA, 18 nt, Chlamydophila pneumoniae CWL029
auucacgccuauagauuc

SEQ ID NO: 2526143 - RNA, 12 nt, Chlamydophila pneumoniae CWL029
auucacuggaau

SEQ ID NO: 2526144 - RNA, 17 nt, Chlamydophila pneumoniae CWL029
auucagauccaaagacg

SEQ ID NO: 2526145 - RNA, 20 nt, Chlamydophila pneumoniae CWL029
auucagggggaaagccaaga

SEQ ID NO: 2526146 - RNA, 16 nt, Chlamydophila pneumoniae CWL029
auucaguuccucaucc

SEQ ID NO: 2526147 - RNA, 17 nt, Chlamydophila pneumoniae CWL029
auucaguuccucauccu

SEQ ID NO: 2526148 - RNA, 17 nt, Chlamydophila pneumoniae CWL029
auucauaaagaggaaug

SEQ ID NO: 2526149 - RNA, 23 nt, Chlamydophila pneumoniae CWL029
auucauaaagaggaaugaagaga

SEQ ID NO: 2526150 - RNA, 13 nt, Chlamydophila pneumoniae CWL029
auucauccagauu

SEQ ID NO: 2526151 - RNA, 23 nt, Chlamydophila pneumoniae CWL029
auucaucuaggggagcuauuacu

SEQ ID NO: 2526152 - RNA, 13 nt, Chlamydophila pneumoniae CWL029
auucaugcaaaac

SEQ ID NO: 2526153 - RNA, 18 nt, Chlamydophila pneumoniae CWL029
auucaugccgcauuucuu

SEQ ID NO: 2526154 - RNA, 20 nt, Chlamydophila pneumoniae CWL029
auucaugccgcauuucuuca

SEQ ID NO: 2526155 - RNA, 15 nt, Chlamydophila pneumoniae CWL029
auucauuaagaacau

SEQ ID NO: 2526156 - RNA, 19 nt, Chlamydophila pneumoniae CWL029
auucauuaagauccuuuaa

SEQ ID NO: 2526157 - RNA, 17 nt, Chlamydophila pneumoniae CWL029
auucauuuuuuaauaaa

SEQ ID NO: 2526158 - RNA, 17 nt, Chlamydophila pneumoniae CWL029
auuccaaaauaaaagga

SEQ ID NO: 2526159 - RNA, 23 nt, Chlamydophila pneumoniae CWL029
auuccaagaucuccgccuacaau

SEQ ID NO: 2526160 - RNA, 22 nt, Chlamydophila pneumoniae CWL029
auuccaagauugaauucaucca

SEQ ID NO: 2526161 - RNA, 14 nt, Chlamydophila pneumoniae CWL029
auuccaauuuuugc

SEQ ID NO: 2526162 - RNA, 15 nt, Chlamydophila pneumoniae CWL029
auuccaauuuuugca

SEQ ID NO: 2526163 - RNA, 17 nt, Chlamydophila pneumoniae CWL029
auuccagaaaaagaaca

SEQ ID NO: 2526164 - RNA, 21 nt, Chlamydophila pneumoniae CWL029
auuccagaaaaagaacauaag

SEQ ID NO: 2526165 - RNA, 18 nt, Chlamydophila pneumoniae CWL029
auuccagcugagcuaucu

SEQ ID NO: 2526166 - RNA, 23 nt, Chlamydophila pneumoniae CWL029
auuccagcugagcuaucuucaag

SEQ ID NO: 2526167 - RNA, 14 nt, Chlamydophila pneumoniae CWL029
auuccaggcucuag

SEQ ID NO: 2526168 - RNA, 19 nt, Chlamydophila pneumoniae CWL029
auuccauagguuagaaaug

SEQ ID NO: 2526169 - RNA, 22 nt, Chlamydophila pneumoniae CWL029
auuccauagguuagaaaugaaa

SEQ ID NO: 2526170 - RNA, 21 nt, Chlamydophila pneumoniae CWL029
auuccauccugucuauuucuu

SEQ ID NO: 2526171 - RNA, 20 nt, Chlamydophila pneumoniae CWL029
auuccaucgccgaccaucau

SEQ ID NO: 2526172 - RNA, 18 nt, Chlamydophila pneumoniae CWL029
auuccauuauacuuuuuu

SEQ ID NO: 2526173 - RNA, 20 nt, Chlamydophila pneumoniae CWL029
auucccaagaacuugagcac

SEQ ID NO: 2526174 - RNA, 14 nt, Chlamydophila pneumoniae CWL029
auuccccguguuug

SEQ ID NO: 2526175 - RNA, 19 nt, Chlamydophila pneumoniae CWL029
auuccccuuuaaagccugu

SEQ ID NO: 2526176 - RNA, 18 nt, Chlamydophila pneumoniae CWL029
auucccggaggcaaagau

SEQ ID NO: 2526177 - RNA, 22 nt, Chlamydophila pneumoniae CWL029
auucccggaggcaaagaucagu

SEQ ID NO: 2526178 - RNA, 20 nt, Chlamydophila pneumoniae CWL029
auucccugacacagagcuuc

SEQ ID NO: 2526179 - RNA, 21 nt, Chlamydophila pneumoniae CWL029
auuccgaauugcgaauccuga

SEQ ID NO: 2526180 - RNA, 23 nt, Chlamydophila pneumoniae CWL029
auuccguacgcuauaaauaauua

SEQ ID NO: 2526181 - RNA, 13 nt, Chlamydophila pneumoniae CWL029
auuccugagguug

SEQ ID NO: 2526182 - RNA, 15 nt, Chlamydophila pneumoniae CWL029
auuccugucauuccu

SEQ ID NO: 2526183 - RNA, 18 nt, Chlamydophila pneumoniae CWL029
auuccuucauacguuuuu

SEQ ID NO: 2526184 - RNA, 20 nt, Chlamydophila pneumoniae CWL029
auuccuucucagaaagauau

SEQ ID NO: 2526185 - RNA, 19 nt, Chlamydophila pneumoniae CWL029
auucgaauucucagaaagc

SEQ ID NO: 2526186 - RNA, 16 nt, Chlamydophila pneumoniae CWL029
auucgacucuccacga

SEQ ID NO: 2526187 - RNA, 16 nt, Chlamydophila pneumoniae CWL029
auucgagauauggaag

SEQ ID NO: 2526188 - RNA, 14 nt, Chlamydophila pneumoniae CWL029
auucgcauuuuugg

SEQ ID NO: 2526189 - RNA, 16 nt, Chlamydophila pneumoniae CWL029
auucgcuauagccuug

SEQ ID NO: 2526190 - RNA, 15 nt, Chlamydophila pneumoniae CWL029
auucggaccaaugau

SEQ ID NO: 2526191 - RNA, 22 nt, Chlamydophila pneumoniae CWL029
auucggcagaaggcuuguuucu

SEQ ID NO: 2526192 - RNA, 12 nt, Chlamydophila pneumoniae CWL029
auucuaaaaaga

SEQ ID NO: 2526193 - RNA, 22 nt, Chlamydophila pneumoniae CWL029
auucuaacgcuuuuucaaacug

SEQ ID NO: 2526194 - RNA, 17 nt, Chlamydophila pneumoniae CWL029
auucuagaccugccaag

SEQ ID NO: 2526195 - RNA, 18 nt, Chlamydophila pneumoniae CWL029
auucuaggccuaaagaau

SEQ ID NO: 2526196 - RNA, 19 nt, Chlamydophila pneumoniae CWL029
auucuaggccuaaagaauu

SEQ ID NO: 2526197 - RNA, 17 nt, Chlamydophila pneumoniae CWL029
auucucaaggaucuuau

SEQ ID NO: 2526198 - RNA, 16 nt, Chlamydophila pneumoniae CWL029
auucucaauucuguau

SEQ ID NO: 2526199 - RNA, 15 nt, Chlamydophila pneumoniae CWL029
auucucagaaagccu

SEQ ID NO: 2526200 - RNA, 15 nt, Chlamydophila pneumoniae CWL029
auucucagauugcuu

SEQ ID NO: 2526201 - RNA, 19 nt, Chlamydophila pneumoniae CWL029
auucucccaauauccagaa

SEQ ID NO: 2526202 - RNA, 15 nt, Chlamydophila pneumoniae CWL029
auucuccgccagagu

SEQ ID NO: 2526203 - RNA, 20 nt, Chlamydophila pneumoniae CWL029
auucuccgccagaguuuaaa

SEQ ID NO: 2526204 - RNA, 12 nt, Chlamydophila pneumoniae CWL029
auucucuucacu

SEQ ID NO: 2526205 - RNA, 14 nt, Chlamydophila pneumoniae CWL029
auucucuucauuuu

SEQ ID NO: 2526206 - RNA, 15 nt, Chlamydophila pneumoniae CWL029
auucugaagagagaa

SEQ ID NO: 2526207 - RNA, 16 nt, Chlamydophila pneumoniae CWL029
auucugaagagagaau

SEQ ID NO: 2526208 - RNA, 19 nt, Chlamydophila pneumoniae CWL029
auucugaagauauauuuuu

SEQ ID NO: 2526209 - RNA, 21 nt, Chlamydophila pneumoniae CWL029
auucugaagcugcaaacugau

SEQ ID NO: 2526210 - RNA, 20 nt, Chlamydophila pneumoniae CWL029
auucugauaaucagaggagc

SEQ ID NO: 2526211 - RNA, 18 nt, Chlamydophila pneumoniae CWL029
auucugcaaggcaaugau

SEQ ID NO: 2526212 - RNA, 14 nt, Chlamydophila pneumoniae CWL029
auucuguaauuuug

SEQ ID NO: 2526213 - RNA, 16 nt, Chlamydophila pneumoniae CWL029
auucuguauaaacaau

SEQ ID NO: 2526214 - RNA, 20 nt, Chlamydophila pneumoniae CWL029
auucuguauaaacaauaaga

SEQ ID NO: 2526215 - RNA, 11 nt, Chlamydophila pneumoniae CWL029
auucugucuau

SEQ ID NO: 2526216 - RNA, 20 nt, Chlamydophila pneumoniae CWL029
auucuuaaaaagcuaaacaa

SEQ ID NO: 2526217 - RNA, 15 nt, Chlamydophila pneumoniae CWL029
auucuuaacaauaua

SEQ ID NO: 2526218 - RNA, 12 nt, Chlamydophila pneumoniae CWL029
auucuuaauaua

SEQ ID NO: 2526219 - RNA, 19 nt, Chlamydophila pneumoniae CWL029
auucuuaauauaaaagaag

SEQ ID NO: 2526220 - RNA, 22 nt, Chlamydophila pneumoniae CWL029
auucuucacaaucuaaauaaga

SEQ ID NO: 2526221 - RNA, 14 nt, Chlamydophila pneumoniae CWL029
auucuucgagagca

SEQ ID NO: 2526222 - RNA, 18 nt, Chlamydophila pneumoniae CWL029
auucuucugauacaucau

SEQ ID NO: 2526223 - RNA, 12 nt, Chlamydophila pneumoniae CWL029
auucuucugucu

SEQ ID NO: 2526224 - RNA, 21 nt, Chlamydophila pneumoniae CWL029
auucuugagaguccugggguu

SEQ ID NO: 2526225 - RNA, 23 nt, Chlamydophila pneumoniae CWL029
auucuugagaguccugggguucu

SEQ ID NO: 2526226 - RNA, 14 nt, Chlamydophila pneumoniae CWL029
auucuuucgauauc

SEQ ID NO: 2526227 - RNA, 13 nt, Chlamydophila pneumoniae CWL029
auucuuuuccugc

SEQ ID NO: 2526228 - RNA, 14 nt, Chlamydophila pneumoniae CWL029
auucuuuuccugca

SEQ ID NO: 2526229 - RNA, 15 nt, Chlamydophila pneumoniae CWL029
auugaaacuuuuuuu

SEQ ID NO: 2526230 - RNA, 23 nt, Chlamydophila pneumoniae CWL029
auugaaacuuuuuuucuucucua

SEQ ID NO: 2526231 - RNA, 20 nt, Chlamydophila pneumoniae CWL029
auugaaagagcuuugauuca

SEQ ID NO: 2526232 - RNA, 23 nt, Chlamydophila pneumoniae CWL029
auugaacagucuugcgccagcaa

SEQ ID NO: 2526233 - RNA, 20 nt, Chlamydophila pneumoniae CWL029
auugaacguagcuacaaaau

SEQ ID NO: 2526234 - RNA, 13 nt, Chlamydophila pneumoniae CWL029
auugaaucagauu

SEQ ID NO: 2526235 - RNA, 21 nt, Chlamydophila pneumoniae CWL029
auugaaucccaucaaaggcaa

SEQ ID NO: 2526236 - RNA, 19 nt, Chlamydophila pneumoniae CWL029
auugacaacacgaucuaag

SEQ ID NO: 2526237 - RNA, 21 nt, Chlamydophila pneumoniae CWL029
auugacgacgacgucuucuua

SEQ ID NO: 2526238 - RNA, 19 nt, Chlamydophila pneumoniae CWL029
auugacuaucgcaaauuuc

SEQ ID NO: 2526239 - RNA, 16 nt, Chlamydophila pneumoniae CWL029
auugagaauaaaacuu

SEQ ID NO: 2526240 - RNA, 23 nt, Chlamydophila pneumoniae CWL029
auugaggacaacagcaacacucg

SEQ ID NO: 2526241 - RNA, 12 nt, Chlamydophila pneumoniae CWL029
auugaguguugu

SEQ ID NO: 2526242 - RNA, 20 nt, Chlamydophila pneumoniae CWL029
auugaguuccgaauaggcau

SEQ ID NO: 2526243 - RNA, 13 nt, Chlamydophila pneumoniae CWL029
auugaucagaauc

SEQ ID NO: 2526244 - RNA, 14 nt, Chlamydophila pneumoniae CWL029
auugaucuuuccuc

SEQ ID NO: 2526245 - RNA, 16 nt, Chlamydophila pneumoniae CWL029
auugaugcuuaagagu

SEQ ID NO: 2526246 - RNA, 17 nt, Chlamydophila pneumoniae CWL029
auugaugcuuaagaguu

SEQ ID NO: 2526247 - RNA, 17 nt, Chlamydophila pneumoniae CWL029
auugcaaaaaugaaaga

SEQ ID NO: 2526248 - RNA, 19 nt, Chlamydophila pneumoniae CWL029
auugcaaaaaugaaagaaa

SEQ ID NO: 2526249 - RNA, 14 nt, Chlamydophila pneumoniae CWL029
auugcaaaguacua

SEQ ID NO: 2526250 - RNA, 17 nt, Chlamydophila pneumoniae CWL029
auugcaaaguacuacaa

SEQ ID NO: 2526251 - RNA, 21 nt, Chlamydophila pneumoniae CWL029
auugcaaauuucauuuagaca

SEQ ID NO: 2526252 - RNA, 24 nt, Chlamydophila pneumoniae CWL029
auugcaacuuugggcucgagaaau

SEQ ID NO: 2526253 - RNA, 12 nt, Chlamydophila pneumoniae CWL029
auugcaauacau

SEQ ID NO: 2526254 - RNA, 20 nt, Chlamydophila pneumoniae CWL029
auugcaauacaucuuaagag

SEQ ID NO: 2526255 - RNA, 23 nt, Chlamydophila pneumoniae CWL029
auugcaauacaucuuaagagcaa

SEQ ID NO: 2526256 - RNA, 22 nt, Chlamydophila pneumoniae CWL029
auugcaaucugguuaagcacca

SEQ ID NO: 2526257 - RNA, 17 nt, Chlamydophila pneumoniae CWL029
auugcaauuuucuaaag

SEQ ID NO: 2526258 - RNA, 19 nt, Chlamydophila pneumoniae CWL029
auugcauuaagauaaacau

SEQ ID NO: 2526259 - RNA, 13 nt, Chlamydophila pneumoniae CWL029
auugccuucuucu

SEQ ID NO: 2526260 - RNA, 21 nt, Chlamydophila pneumoniae CWL029
auugccuucuucuuguucuuc

SEQ ID NO: 2526261 - RNA, 17 nt, Chlamydophila pneumoniae CWL029
auugcggaaauugaaua

SEQ ID NO: 2526262 - RNA, 15 nt, Chlamydophila pneumoniae CWL029
auugcuaagcauuuu

SEQ ID NO: 2526263 - RNA, 21 nt, Chlamydophila pneumoniae CWL029
auugcuaucaaagacucauga

SEQ ID NO: 2526264 - RNA, 20 nt, Chlamydophila pneumoniae CWL029
auugcucguauuagaguuuc

SEQ ID NO: 2526265 - RNA, 16 nt, Chlamydophila pneumoniae CWL029
auugcugaaaaugauu

SEQ ID NO: 2526266 - RNA, 20 nt, Chlamydophila pneumoniae CWL029
auugcugccaggcuuaaaua

SEQ ID NO: 2526267 - RNA, 23 nt, Chlamydophila pneumoniae CWL029
auugcugccaggcuuaaauauua

SEQ ID NO: 2526268 - RNA, 13 nt, Chlamydophila pneumoniae CWL029
auugcugucagaa

SEQ ID NO: 2526269 - RNA, 15 nt, Chlamydophila pneumoniae CWL029
auugcuucuuccaag

SEQ ID NO: 2526270 - RNA, 13 nt, Chlamydophila pneumoniae CWL029
auuggaagcaaag

SEQ ID NO: 2526271 - RNA, 20 nt, Chlamydophila pneumoniae CWL029
auuggaauucgcauuuuugg

SEQ ID NO: 2526272 - RNA, 13 nt, Chlamydophila pneumoniae CWL029
auuggaucuugau

SEQ ID NO: 2526273 - RNA, 14 nt, Chlamydophila pneumoniae CWL029
auuggcauagagcc

SEQ ID NO: 2526274 - RNA, 16 nt, Chlamydophila pneumoniae CWL029
auuguaauuuccuuag

SEQ ID NO: 2526275 - RNA, 22 nt, Chlamydophila pneumoniae CWL029
auuguaauuucuaaauagaaaa

SEQ ID NO: 2526276 - RNA, 19 nt, Chlamydophila pneumoniae CWL029
auugucucaacauuucuca

SEQ ID NO: 2526277 - RNA, 15 nt, Chlamydophila pneumoniae CWL029
auuguguguuuucau

SEQ ID NO: 2526278 - RNA, 15 nt, Chlamydophila pneumoniae CWL029
auuguucuugaaguu

SEQ ID NO: 2526279 - RNA, 19 nt, Chlamydophila pneumoniae CWL029
auuguuggaauugcauuaa

SEQ ID NO: 2526280 - RNA, 13 nt, Chlamydophila pneumoniae CWL029
auuguuguugcau

SEQ ID NO: 2526281 - RNA, 21 nt, Chlamydophila pneumoniae CWL029
auuuaaaagguuuugaagcuc

SEQ ID NO: 2526282 - RNA, 13 nt, Chlamydophila pneumoniae CWL029
auuuaaauaaaac

SEQ ID NO: 2526283 - RNA, 17 nt, Chlamydophila pneumoniae CWL029
auuuaaauauaaauuua

SEQ ID NO: 2526284 - RNA, 15 nt, Chlamydophila pneumoniae CWL029
auuuaaauauagaaa

SEQ ID NO: 2526285 - RNA, 21 nt, Chlamydophila pneumoniae CWL029
auuuaaaugccuuaaauguau

SEQ ID NO: 2526286 - RNA, 15 nt, Chlamydophila pneumoniae CWL029
auuuaacaacaugcg

SEQ ID NO: 2526287 - RNA, 17 nt, Chlamydophila pneumoniae CWL029
auuuaagggaaauguca

SEQ ID NO: 2526288 - RNA, 22 nt, Chlamydophila pneumoniae CWL029
auuuacuuuuaauccuuucaca

SEQ ID NO: 2526289 - RNA, 11 nt, Chlamydophila pneumoniae CWL029
auuuagaaauc

SEQ ID NO: 2526290 - RNA, 15 nt, Chlamydophila pneumoniae CWL029
auuuagagagaaaca

SEQ ID NO: 2526291 - RNA, 18 nt, Chlamydophila pneumoniae CWL029
auuuagauuaaagagacu

SEQ ID NO: 2526292 - RNA, 20 nt, Chlamydophila pneumoniae CWL029
auuuaggagggguaaaccaa

SEQ ID NO: 2526293 - RNA, 18 nt, Chlamydophila pneumoniae CWL029
auuuaggucgacuuccuu

SEQ ID NO: 2526294 - RNA, 16 nt, Chlamydophila pneumoniae CWL029
auuuauuaucuuguuu

SEQ ID NO: 2526295 - RNA, 15 nt, Chlamydophila pneumoniae CWL029
auuucaaagaagaca

SEQ ID NO: 2526296 - RNA, 20 nt, Chlamydophila pneumoniae CWL029
auuucagcguagguuugcug

SEQ ID NO: 2526297 - RNA, 23 nt, Chlamydophila pneumoniae CWL029
auuucaugaauugucaucucaua

SEQ ID NO: 2526298 - RNA, 16 nt, Chlamydophila pneumoniae CWL029
auuucauguaagaaug

SEQ ID NO: 2526299 - RNA, 17 nt, Chlamydophila pneumoniae CWL029
auuucauguaagaaugu

SEQ ID NO: 2526300 - RNA, 15 nt, Chlamydophila pneumoniae CWL029
auuucauguccucca

SEQ ID NO: 2526301 - RNA, 13 nt, Chlamydophila pneumoniae CWL029
auuucauuugaaa

SEQ ID NO: 2526302 - RNA, 15 nt, Chlamydophila pneumoniae CWL029
auuucauuugaaaua

SEQ ID NO: 2526303 - RNA, 16 nt, Chlamydophila pneumoniae CWL029
auuuccaaauucuugc

SEQ ID NO: 2526304 - RNA, 17 nt, Chlamydophila pneumoniae CWL029
auuuccaguauucugug

SEQ ID NO: 2526305 - RNA, 20 nt, Chlamydophila pneumoniae CWL029
auuuccauaggaucugcaug

SEQ ID NO: 2526306 - RNA, 19 nt, Chlamydophila pneumoniae CWL029
auuuccccaugaaaauaca

SEQ ID NO: 2526307 - RNA, 19 nt, Chlamydophila pneumoniae CWL029
auuuccggguucauuucca

SEQ ID NO: 2526308 - RNA, 21 nt, Chlamydophila pneumoniae CWL029
auuuccuaccuauauuuuuua

SEQ ID NO: 2526309 - RNA, 16 nt, Chlamydophila pneumoniae CWL029
auuuccuuaagcuucu

SEQ ID NO: 2526310 - RNA, 19 nt, Chlamydophila pneumoniae CWL029
auuuccuucaggauuuucc

SEQ ID NO: 2526311 - RNA, 20 nt, Chlamydophila pneumoniae CWL029
auuuccuucaggauuuucca

SEQ ID NO: 2526312 - RNA, 16 nt, Chlamydophila pneumoniae CWL029
auuuccuucuccagag

SEQ ID NO: 2526313 - RNA, 22 nt, Chlamydophila pneumoniae CWL029
auuucgauaacacuucuuucuu

SEQ ID NO: 2526314 - RNA, 21 nt, Chlamydophila pneumoniae CWL029
auuucggaguuggaucaagga

SEQ ID NO: 2526315 - RNA, 22 nt, Chlamydophila pneumoniae CWL029
auuucguauagcuggcaaugau

SEQ ID NO: 2526316 - RNA, 17 nt, Chlamydophila pneumoniae CWL029
auuucgucaaagguuuu

SEQ ID NO: 2526317 - RNA, 15 nt, Chlamydophila pneumoniae CWL029
auuucgugaacaaaa

SEQ ID NO: 2526318 - RNA, 23 nt, Chlamydophila pneumoniae CWL029
auuucuaaauagaaaacauagag

SEQ ID NO: 2526319 - RNA, 15 nt, Chlamydophila pneumoniae CWL029
auuucuaguuguccu

SEQ ID NO: 2526320 - RNA, 16 nt, Chlamydophila pneumoniae CWL029
auuucuccaguaucuu

SEQ ID NO: 2526321 - RNA, 22 nt, Chlamydophila pneumoniae CWL029
auuucuccaguaucuucucuua

SEQ ID NO: 2526322 - RNA, 16 nt, Chlamydophila pneumoniae CWL029
auuucucuaucaucaa

SEQ ID NO: 2526323 - RNA, 17 nt, Chlamydophila pneumoniae CWL029
auuucucuaucaucaau

SEQ ID NO: 2526324 - RNA, 21 nt, Chlamydophila pneumoniae CWL029
auuucuggagaaugccccuuc

SEQ ID NO: 2526325 - RNA, 21 nt, Chlamydophila pneumoniae CWL029
auuucuuaauuuccuucucca

SEQ ID NO: 2526326 - RNA, 16 nt, Chlamydophila pneumoniae CWL029
auuucuuacaagacaa

SEQ ID NO: 2526327 - RNA, 16 nt, Chlamydophila pneumoniae CWL029
auuucuuauaaaaaag

SEQ ID NO: 2526328 - RNA, 19 nt, Chlamydophila pneumoniae CWL029
auuucuucaauaggaauua

SEQ ID NO: 2526329 - RNA, 14 nt, Chlamydophila pneumoniae CWL029
auuucuucuagcuc

SEQ ID NO: 2526330 - RNA, 11 nt, Chlamydophila pneumoniae CWL029
auuucuucuuc

SEQ ID NO: 2526331 - RNA, 19 nt, Chlamydophila pneumoniae CWL029
auuucuucuucuauacgaa

SEQ ID NO: 2526332 - RNA, 19 nt, Chlamydophila pneumoniae CWL029
auuucuugagucugaacau

SEQ ID NO: 2526333 - RNA, 21 nt, Chlamydophila pneumoniae CWL029
auuucuuuuugccaauuuuca

SEQ ID NO: 2526334 - RNA, 13 nt, Chlamydophila pneumoniae CWL029
auuugaacaugag

SEQ ID NO: 2526335 - RNA, 16 nt, Chlamydophila pneumoniae CWL029
auuugaacaugaggau

SEQ ID NO: 2526336 - RNA, 21 nt, Chlamydophila pneumoniae CWL029
auuugaauaaaggacauagac

SEQ ID NO: 2526337 - RNA, 20 nt, Chlamydophila pneumoniae CWL029
auuugacguuguguugcaag

SEQ ID NO: 2526338 - RNA, 14 nt, Chlamydophila pneumoniae CWL029
auuugauucccgga

SEQ ID NO: 2526339 - RNA, 15 nt, Chlamydophila pneumoniae CWL029
auuugauuuuucaaa

SEQ ID NO: 2526340 - RNA, 19 nt, Chlamydophila pneumoniae CWL029
auuugcaacaaucuuucuu

SEQ ID NO: 2526341 - RNA, 22 nt, Chlamydophila pneumoniae CWL029
auuugcaacaaucuuucuucua

SEQ ID NO: 2526342 - RNA, 22 nt, Chlamydophila pneumoniae CWL029
auuugcauuaccuuaucgccaa

SEQ ID NO: 2526343 - RNA, 22 nt, Chlamydophila pneumoniae CWL029
auuugcgaaguccuggauuuua

SEQ ID NO: 2526344 - RNA, 17 nt, Chlamydophila pneumoniae CWL029
auuugcgacaccuacaa

SEQ ID NO: 2526345 - RNA, 17 nt, Chlamydophila pneumoniae CWL029
auuugcuauuuucccuu

SEQ ID NO: 2526346 - RNA, 15 nt, Chlamydophila pneumoniae CWL029
auuugcugcauccca

SEQ ID NO: 2526347 - RNA, 23 nt, Chlamydophila pneumoniae CWL029
auuugcuuccaacggacauuuuc

SEQ ID NO: 2526348 - RNA, 23 nt, Chlamydophila pneumoniae CWL029
auuugguaguuuuucagucucga

SEQ ID NO: 2526349 - RNA, 16 nt, Chlamydophila pneumoniae CWL029
auuuguagcucccaua

SEQ ID NO: 2526350 - RNA, 21 nt, Chlamydophila pneumoniae CWL029
auuuguagcucccauaaguuc

SEQ ID NO: 2526351 - RNA, 16 nt, Chlamydophila pneumoniae CWL029
auuugucaucacauca

SEQ ID NO: 2526352 - RNA, 17 nt, Chlamydophila pneumoniae CWL029
auuugucaucacaucag

SEQ ID NO: 2526353 - RNA, 23 nt, Chlamydophila pneumoniae CWL029
auuugucuagugaagcugcuucu

SEQ ID NO: 2526354 - RNA, 17 nt, Chlamydophila pneumoniae CWL029
auuugugcgucaucaac

SEQ ID NO: 2526355 - RNA, 22 nt, Chlamydophila pneumoniae CWL029
auuuguugucagcuuugcuuau

SEQ ID NO: 2526356 - RNA, 17 nt, Chlamydophila pneumoniae CWL029
auuuguuuagcauagag

SEQ ID NO: 2526357 - RNA, 18 nt, Chlamydophila pneumoniae CWL029
auuuuaaaaucuccucuc

SEQ ID NO: 2526358 - RNA, 18 nt, Chlamydophila pneumoniae CWL029
auuuuaaacuuacagcca

SEQ ID NO: 2526359 - RNA, 16 nt, Chlamydophila pneumoniae CWL029
auuuuaaagcaaaaau

SEQ ID NO: 2526360 - RNA, 17 nt, Chlamydophila pneumoniae CWL029
auuuuaaagccuccuca

SEQ ID NO: 2526361 - RNA, 13 nt, Chlamydophila pneumoniae CWL029
auuuuaaauuuug

SEQ ID NO: 2526362 - RNA, 15 nt, Chlamydophila pneumoniae CWL029
auuuuaaauuuuguu

SEQ ID NO: 2526363 - RNA, 20 nt, Chlamydophila pneumoniae CWL029
auuuuacgaaucuuuuucau

SEQ ID NO: 2526364 - RNA, 15 nt, Chlamydophila pneumoniae CWL029
auuuuacgaauuuca

SEQ ID NO: 2526365 - RNA, 21 nt, Chlamydophila pneumoniae CWL029
auuuuacuugcgauacaauaa

SEQ ID NO: 2526366 - RNA, 22 nt, Chlamydophila pneumoniae CWL029
auuuuacuugcgauacaauaaa

SEQ ID NO: 2526367 - RNA, 22 nt, Chlamydophila pneumoniae CWL029
auuuuaggaagcuuaucaagaa

SEQ ID NO: 2526368 - RNA, 17 nt, Chlamydophila pneumoniae CWL029
auuuuaguaagaucgcu

SEQ ID NO: 2526369 - RNA, 22 nt, Chlamydophila pneumoniae CWL029
auuuuaucugcgacaaaaaugc

SEQ ID NO: 2526370 - RNA, 18 nt, Chlamydophila pneumoniae CWL029
auuuuauuaguuuugaaa

SEQ ID NO: 2526371 - RNA, 17 nt, Chlamydophila pneumoniae CWL029
auuuucacgagcucaca

SEQ ID NO: 2526372 - RNA, 23 nt, Chlamydophila pneumoniae CWL029
auuuucagaagagaaacacaaau

SEQ ID NO: 2526373 - RNA, 14 nt, Chlamydophila pneumoniae CWL029
auuuucagcacuga

SEQ ID NO: 2526374 - RNA, 17 nt, Chlamydophila pneumoniae CWL029
auuuucaggagaccagg

SEQ ID NO: 2526375 - RNA, 20 nt, Chlamydophila pneumoniae CWL029
auuuucaggagaccagggau

SEQ ID NO: 2526376 - RNA, 16 nt, Chlamydophila pneumoniae CWL029
auuuucagucguuuag

SEQ ID NO: 2526377 - RNA, 19 nt, Chlamydophila pneumoniae CWL029
auuuucaugauauuuuuau

SEQ ID NO: 2526378 - RNA, 16 nt, Chlamydophila pneumoniae CWL029
auuuuccaggaccaaa

SEQ ID NO: 2526379 - RNA, 17 nt, Chlamydophila pneumoniae CWL029
auuuucccauuacagcc

SEQ ID NO: 2526380 - RNA, 17 nt, Chlamydophila pneumoniae CWL029
auuuucccuuugucuau

SEQ ID NO: 2526381 - RNA, 21 nt, Chlamydophila pneumoniae CWL029
auuuucucauagcuuccugua

SEQ ID NO: 2526382 - RNA, 17 nt, Chlamydophila pneumoniae CWL029
auuuucucugagcagcu

SEQ ID NO: 2526383 - RNA, 18 nt, Chlamydophila pneumoniae CWL029
auuuugacguaaugcaga

SEQ ID NO: 2526384 - RNA, 20 nt, Chlamydophila pneumoniae CWL029
auuuugacguaaugcagaua

SEQ ID NO: 2526385 - RNA, 17 nt, Chlamydophila pneumoniae CWL029
auuuugacuugucccaa

SEQ ID NO: 2526386 - RNA, 19 nt, Chlamydophila pneumoniae CWL029
auuuugcaaaugaaaagag

SEQ ID NO: 2526387 - RNA, 22 nt, Chlamydophila pneumoniae CWL029
auuuuggugagaucaucuccca

SEQ ID NO: 2526388 - RNA, 21 nt, Chlamydophila pneumoniae CWL029
auuuuguaggaacaugccaaa

SEQ ID NO: 2526389 - RNA, 12 nt, Chlamydophila pneumoniae CWL029
auuuuuaaaaug

SEQ ID NO: 2526390 - RNA, 12 nt, Chlamydophila pneumoniae CWL029
auuuuuaaauac

SEQ ID NO: 2526391 - RNA, 15 nt, Chlamydophila pneumoniae CWL029
auuuuuaaauacaga

SEQ ID NO: 2526392 - RNA, 15 nt, Chlamydophila pneumoniae CWL029
auuuuuaauuuuucu

SEQ ID NO: 2526393 - RNA, 18 nt, Chlamydophila pneumoniae CWL029
auuuuuaggaucuuuguu

SEQ ID NO: 2526394 - RNA, 16 nt, Chlamydophila pneumoniae CWL029
auuuuuauaauauuuu

SEQ ID NO: 2526395 - RNA, 14 nt, Chlamydophila pneumoniae CWL029
auuuuuauuuaaaa

SEQ ID NO: 2526396 - RNA, 13 nt, Chlamydophila pneumoniae CWL029
auuuuuccagaaa

SEQ ID NO: 2526397 - RNA, 15 nt, Chlamydophila pneumoniae CWL029
auuuuuccagaaaug

SEQ ID NO: 2526398 - RNA, 23 nt, Chlamydophila pneumoniae CWL029
auuuuuccauggcuauuuuuaaa

SEQ ID NO: 2526399 - RNA, 14 nt, Chlamydophila pneumoniae CWL029
auuuuucuauaaua

SEQ ID NO: 2526400 - RNA, 20 nt, Chlamydophila pneumoniae CWL029
auuuuucuuuuagagaaauc

SEQ ID NO: 2526401 - RNA, 13 nt, Chlamydophila pneumoniae CWL029
auuuuugcagagu

SEQ ID NO: 2526402 - RNA, 22 nt, Chlamydophila pneumoniae CWL029
auuuuugcuuuaaaauccagga

SEQ ID NO: 2526403 - RNA, 16 nt, Chlamydophila pneumoniae CWL029
auuuuuguagacaaua

SEQ ID NO: 2526404 - RNA, 23 nt, Chlamydophila pneumoniae CWL029
auuuuuuaaccgagcuuuuugcu

SEQ ID NO: 2526405 - RNA, 17 nt, Chlamydophila pneumoniae CWL029
auuuuuuaauaaaauuu

SEQ ID NO: 2526406 - RNA, 18 nt, Chlamydophila pneumoniae CWL029
auuuuuuaauaaaauuua

SEQ ID NO: 2526407 - RNA, 19 nt, Chlamydophila pneumoniae CWL029
auuuuuuacguucuuucuu

SEQ ID NO: 2526408 - RNA, 14 nt, Chlamydophila pneumoniae CWL029
auuuuuucauuguu

SEQ ID NO: 2526409 - RNA, 14 nt, Chlamydophila pneumoniae CWL029
auuuuuuccuuaau

SEQ ID NO: 2526410 - RNA, 16 nt, Chlamydophila pneumoniae CWL029
auuuuuucuguuccug

SEQ ID NO: 2526411 - RNA, 16 nt, Chlamydophila pneumoniae CWL029
auuuuuugagaaauau

SEQ ID NO: 2526412 - RNA, 21 nt, Chlamydophila pneumoniae CWL029
auuuuuugagaaauauaaaca

SEQ ID NO: 2526413 - RNA, 17 nt, Chlamydophila pneumoniae CWL029
auuuuuugugaauuuua

SEQ ID NO: 2526414 - RNA, 13 nt, Chlamydophila pneumoniae CWL029
caaaaaacgauga

SEQ ID NO: 2526415 - RNA, 12 nt, Chlamydophila pneumoniae CWL029
caaaaaagagcc

SEQ ID NO: 2526416 - RNA, 17 nt, Chlamydophila pneumoniae CWL029
caaaaaagggaucuccu

SEQ ID NO: 2526417 - RNA, 15 nt, Chlamydophila pneumoniae CWL029
caaaaaaguaacuau

SEQ ID NO: 2526418 - RNA, 13 nt, Chlamydophila pneumoniae CWL029
caaaaaaugcucc

SEQ ID NO: 2526419 - RNA, 23 nt, Chlamydophila pneumoniae CWL029
caaaaaauuuuauaggaauaaca

SEQ ID NO: 2526420 - RNA, 19 nt, Chlamydophila pneumoniae CWL029
caaaaacacugcgcaaaga

SEQ ID NO: 2526421 - RNA, 19 nt, Chlamydophila pneumoniae CWL029
caaaaacgauucgaaaaac

SEQ ID NO: 2526422 - RNA, 18 nt, Chlamydophila pneumoniae CWL029
caaaaagcuucuuucuua

SEQ ID NO: 2526423 - RNA, 21 nt, Chlamydophila pneumoniae CWL029
caaaaaggacucuuucuauag

SEQ ID NO: 2526424 - RNA, 20 nt, Chlamydophila pneumoniae CWL029
caaaaaguugaggaaaggag

SEQ ID NO: 2526425 - RNA, 16 nt, Chlamydophila pneumoniae CWL029
caaaaaguuucaaucu

SEQ ID NO: 2526426 - RNA, 22 nt, Chlamydophila pneumoniae CWL029
caaaaauaaacauauucuccuu

SEQ ID NO: 2526427 - RNA, 10 nt, Chlamydophila pneumoniae CWL029
caaaaauucc

SEQ ID NO: 2526428 - RNA, 17 nt, Chlamydophila pneumoniae CWL029
caaaaauucuucgugag

SEQ ID NO: 2526429 - RNA, 14 nt, Chlamydophila pneumoniae CWL029
caaaacaaaagcca

SEQ ID NO: 2526430 - RNA, 12 nt, Chlamydophila pneumoniae CWL029
caaaacaggaau

SEQ ID NO: 2526431 - RNA, 22 nt, Chlamydophila pneumoniae CWL029
caaaaccuggauugauccacag

SEQ ID NO: 2526432 - RNA, 21 nt, Chlamydophila pneumoniae CWL029
caaaacgauccuguuccccug

SEQ ID NO: 2526433 - RNA, 15 nt, Chlamydophila pneumoniae CWL029
caaaagaauuaagaa

SEQ ID NO: 2526434 - RNA, 21 nt, Chlamydophila pneumoniae CWL029
caaaagaauuaagaagaagcu

SEQ ID NO: 2526435 - RNA, 23 nt, Chlamydophila pneumoniae CWL029
caaaagaauuccuaaaacgagca

SEQ ID NO: 2526436 - RNA, 13 nt, Chlamydophila pneumoniae CWL029
caaaagaccaaaa

SEQ ID NO: 2526437 - RNA, 17 nt, Chlamydophila pneumoniae CWL029
caaaagccauuccauau

SEQ ID NO: 2526438 - RNA, 18 nt, Chlamydophila pneumoniae CWL029
caaaagccauuccauauc

SEQ ID NO: 2526439 - RNA, 20 nt, Chlamydophila pneumoniae CWL029
caaaaguaaucacuucagca

SEQ ID NO: 2526440 - RNA, 16 nt, Chlamydophila pneumoniae CWL029
caaaagucaugaggac

SEQ ID NO: 2526441 - RNA, 16 nt, Chlamydophila pneumoniae CWL029
caaaaguugucuuuga

SEQ ID NO: 2526442 - RNA, 19 nt, Chlamydophila pneumoniae CWL029
caaaaguuuugaggauuuc

SEQ ID NO: 2526443 - RNA, 12 nt, Chlamydophila pneumoniae CWL029
caaaauaaaaaa

SEQ ID NO: 2526444 - RNA, 17 nt, Chlamydophila pneumoniae CWL029
caaaauaaaaaaacccu

SEQ ID NO: 2526445 - RNA, 24 nt, Chlamydophila pneumoniae CWL029
caaaauaaaaaaacccucaaagaa

SEQ ID NO: 2526446 - RNA, 13 nt, Chlamydophila pneumoniae CWL029
caaaauaaaagga

SEQ ID NO: 2526447 - RNA, 23 nt, Chlamydophila pneumoniae CWL029
caaaaugucuuuuucaauugcuc

SEQ ID NO: 2526448 - RNA, 22 nt, Chlamydophila pneumoniae CWL029
caaaauguuuaucgacucuucc

SEQ ID NO: 2526449 - RNA, 21 nt, Chlamydophila pneumoniae CWL029
caaaauuaccguuuccuccuc

SEQ ID NO: 2526450 - RNA, 17 nt, Chlamydophila pneumoniae CWL029
caaaauuauguauaaac

SEQ ID NO: 2526451 - RNA, 18 nt, Chlamydophila pneumoniae CWL029
caaaauuauguauaaacu

SEQ ID NO: 2526452 - RNA, 14 nt, Chlamydophila pneumoniae CWL029
caaaauuuaaauau

SEQ ID NO: 2526453 - RNA, 19 nt, Chlamydophila pneumoniae CWL029
caaaauuucuuauaaaaaa

SEQ ID NO: 2526454 - RNA, 15 nt, Chlamydophila pneumoniae CWL029
caaacaucaaagaga

SEQ ID NO: 2526455 - RNA, 22 nt, Chlamydophila pneumoniae CWL029
caaacauggacaauauagagau

SEQ ID NO: 2526456 - RNA, 19 nt, Chlamydophila pneumoniae CWL029
caaacauuaccguucccua

SEQ ID NO: 2526457 - RNA, 12 nt, Chlamydophila pneumoniae CWL029
caaacauuuuua

SEQ ID NO: 2526458 - RNA, 12 nt, Chlamydophila pneumoniae CWL029
caaaccaaaaaa

SEQ ID NO: 2526459 - RNA, 23 nt, Chlamydophila pneumoniae CWL029
caaaccagguagagugucuuccu

SEQ ID NO: 2526460 - RNA, 19 nt, Chlamydophila pneumoniae CWL029
caaaccauccgacuuuccu

SEQ ID NO: 2526461 - RNA, 16 nt, Chlamydophila pneumoniae CWL029
caaacccucuccagaa

SEQ ID NO: 2526462 - RNA, 21 nt, Chlamydophila pneumoniae CWL029
caaacccugggcucacucuaa

SEQ ID NO: 2526463 - RNA, 13 nt, Chlamydophila pneumoniae CWL029
caaaccuccuaga

SEQ ID NO: 2526464 - RNA, 14 nt, Chlamydophila pneumoniae CWL029
caaaccuccuagaa

SEQ ID NO: 2526465 - RNA, 20 nt, Chlamydophila pneumoniae CWL029
caaacgcaaugauuucucua

SEQ ID NO: 2526466 - RNA, 21 nt, Chlamydophila pneumoniae CWL029
caaacgcaaugauuucucuaa

SEQ ID NO: 2526467 - RNA, 18 nt, Chlamydophila pneumoniae CWL029
caaacggaacuaaagaga

SEQ ID NO: 2526468 - RNA, 16 nt, Chlamydophila pneumoniae CWL029
caaacuaaaucaacua

SEQ ID NO: 2526469 - RNA, 19 nt, Chlamydophila pneumoniae CWL029
caaacuaacauagauaagg

SEQ ID NO: 2526470 - RNA, 16 nt, Chlamydophila pneumoniae CWL029
caaacucuauuuucau

SEQ ID NO: 2526471 - RNA, 20 nt, Chlamydophila pneumoniae CWL029
caaacugaugccaagaaaua

SEQ ID NO: 2526472 - RNA, 21 nt, Chlamydophila pneumoniae CWL029
caaacugauuaguuuguuuua

SEQ ID NO: 2526473 - RNA, 21 nt, Chlamydophila pneumoniae CWL029
caaacuuucuuuucuauauuc

SEQ ID NO: 2526474 - RNA, 13 nt, Chlamydophila pneumoniae CWL029
caaagaaagugaa

SEQ ID NO: 2526475 - RNA, 15 nt, Chlamydophila pneumoniae CWL029
caaagaacagcacuc

SEQ ID NO: 2526476 - RNA, 19 nt, Chlamydophila pneumoniae CWL029
caaagaacugcauaaucuc

SEQ ID NO: 2526477 - RNA, 23 nt, Chlamydophila pneumoniae CWL029
caaagaagucgcuagaucacaag

SEQ ID NO: 2526478 - RNA, 18 nt, Chlamydophila pneumoniae CWL029
caaagaauucagagaaag

SEQ ID NO: 2526479 - RNA, 13 nt, Chlamydophila pneumoniae CWL029
caaagacaggcuc

SEQ ID NO: 2526480 - RNA, 23 nt, Chlamydophila pneumoniae CWL029
caaagacaggcucaugaaauuuc

SEQ ID NO: 2526481 - RNA, 17 nt, Chlamydophila pneumoniae CWL029
caaagacaucuccugca

SEQ ID NO: 2526482 - RNA, 18 nt, Chlamydophila pneumoniae CWL029
caaagacuagagucacua

SEQ ID NO: 2526483 - RNA, 14 nt, Chlamydophila pneumoniae CWL029
caaagacucaugaa

SEQ ID NO: 2526484 - RNA, 16 nt, Chlamydophila pneumoniae CWL029
caaagacugagcuucu

SEQ ID NO: 2526485 - RNA, 13 nt, Chlamydophila pneumoniae CWL029
caaagacuuuugc

SEQ ID NO: 2526486 - RNA, 14 nt, Chlamydophila pneumoniae CWL029
caaagaguuuuuua

SEQ ID NO: 2526487 - RNA, 23 nt, Chlamydophila pneumoniae CWL029
caaagaguuuuuuagaggagcuu

SEQ ID NO: 2526488 - RNA, 14 nt, Chlamydophila pneumoniae CWL029
caaagauaaagaag

SEQ ID NO: 2526489 - RNA, 16 nt, Chlamydophila pneumoniae CWL029
caaagauaaagaaguu

SEQ ID NO: 2526490 - RNA, 11 nt, Chlamydophila pneumoniae CWL029
caaagaucagu

SEQ ID NO: 2526491 - RNA, 23 nt, Chlamydophila pneumoniae CWL029
caaagaucaguuuuuucuucuga

SEQ ID NO: 2526492 - RNA, 22 nt, Chlamydophila pneumoniae CWL029
caaagaugacgagcccuagaua

SEQ ID NO: 2526493 - RNA, 20 nt, Chlamydophila pneumoniae CWL029
caaagaugcagauacuaaac

SEQ ID NO: 2526494 - RNA, 16 nt, Chlamydophila pneumoniae CWL029
caaagaugcgcucgga

SEQ ID NO: 2526495 - RNA, 12 nt, Chlamydophila pneumoniae CWL029
caaagauugcua

SEQ ID NO: 2526496 - RNA, 20 nt, Chlamydophila pneumoniae CWL029
caaagauuucugcuguguua

SEQ ID NO: 2526497 - RNA, 21 nt, Chlamydophila pneumoniae CWL029
caaagauuucugcuguguuau

SEQ ID NO: 2526498 - RNA, 14 nt, Chlamydophila pneumoniae CWL029
caaagcaaagagca

SEQ ID NO: 2526499 - RNA, 19 nt, Chlamydophila pneumoniae CWL029
caaagcagauccugcuucu

SEQ ID NO: 2526500 - RNA, 17 nt, Chlamydophila pneumoniae CWL029
caaagccggcccacuca

SEQ ID NO: 2526501 - RNA, 14 nt, Chlamydophila pneumoniae CWL029
caaagccugaaaaa

SEQ ID NO: 2526502 - RNA, 15 nt, Chlamydophila pneumoniae CWL029
caaagccugaaaaau

SEQ ID NO: 2526503 - RNA, 21 nt, Chlamydophila pneumoniae CWL029
caaagcgaccugcaaaugaag

SEQ ID NO: 2526504 - RNA, 17 nt, Chlamydophila pneumoniae CWL029
caaagcucuccuucaga

SEQ ID NO: 2526505 - RNA, 22 nt, Chlamydophila pneumoniae CWL029
caaagcuuguuccacuugcucu

SEQ ID NO: 2526506 - RNA, 19 nt, Chlamydophila pneumoniae CWL029
caaaggaccacaauuccua

SEQ ID NO: 2526507 - RNA, 14 nt, Chlamydophila pneumoniae CWL029
caaaggagaaagaa

SEQ ID NO: 2526508 - RNA, 15 nt, Chlamydophila pneumoniae CWL029
caaaggagaaagaau

SEQ ID NO: 2526509 - RNA, 19 nt, Chlamydophila pneumoniae CWL029
caaaggagaaagaauugua

SEQ ID NO: 2526510 - RNA, 19 nt, Chlamydophila pneumoniae CWL029
caaaggagcgggauaggca

SEQ ID NO: 2526511 - RNA, 12 nt, Chlamydophila pneumoniae CWL029
caaaggcaacaa

SEQ ID NO: 2526512 - RNA, 23 nt, Chlamydophila pneumoniae CWL029
caaagguuauggaugcuaaauuu

SEQ ID NO: 2526513 - RNA, 14 nt, Chlamydophila pneumoniae CWL029
caaaguauauauuu

SEQ ID NO: 2526514 - RNA, 16 nt, Chlamydophila pneumoniae CWL029
caaagucaaauacuuc

SEQ ID NO: 2526515 - RNA, 17 nt, Chlamydophila pneumoniae CWL029
caaagucaaauacuucu

SEQ ID NO: 2526516 - RNA, 18 nt, Chlamydophila pneumoniae CWL029
caaagugacuuccuccaa

SEQ ID NO: 2526517 - RNA, 12 nt, Chlamydophila pneumoniae CWL029
caaaguuuauga

SEQ ID NO: 2526518 - RNA, 19 nt, Chlamydophila pneumoniae CWL029
caaaguuuaugacacagcu

SEQ ID NO: 2526519 - RNA, 14 nt, Chlamydophila pneumoniae CWL029
caaauaaagcaacu

SEQ ID NO: 2526520 - RNA, 19 nt, Chlamydophila pneumoniae CWL029
caaauaaguccuguuugaa

SEQ ID NO: 2526521 - RNA, 21 nt, Chlamydophila pneumoniae CWL029
caaauaaguccuguuugaaaa

SEQ ID NO: 2526522 - RNA, 22 nt, Chlamydophila pneumoniae CWL029
caaauaaguccuguuugaaaau

SEQ ID NO: 2526523 - RNA, 12 nt, Chlamydophila pneumoniae CWL029
caaauaauuaaa

SEQ ID NO: 2526524 - RNA, 20 nt, Chlamydophila pneumoniae CWL029
caaauaauuaaauauauaaa

SEQ ID NO: 2526525 - RNA, 19 nt, Chlamydophila pneumoniae CWL029
caaauagauuuuuacuugc

SEQ ID NO: 2526526 - RNA, 15 nt, Chlamydophila pneumoniae CWL029
caaauaggagagcac

SEQ ID NO: 2526527 - RNA, 20 nt, Chlamydophila pneumoniae CWL029
caaauauaguuuucauaauc

SEQ ID NO: 2526528 - RNA, 22 nt, Chlamydophila pneumoniae CWL029
caaauauaugaguuuacuaacu

SEQ ID NO: 2526529 - RNA, 18 nt, Chlamydophila pneumoniae CWL029
caaauauugcgaacuuuu

SEQ ID NO: 2526530 - RNA, 13 nt, Chlamydophila pneumoniae CWL029
caaaucaucaaaa

SEQ ID NO: 2526531 - RNA, 18 nt, Chlamydophila pneumoniae CWL029
caaaucauuuaaagcuga

SEQ ID NO: 2526532 - RNA, 21 nt, Chlamydophila pneumoniae CWL029
caaaucauuuaaagcugaaau

SEQ ID NO: 2526533 - RNA, 14 nt, Chlamydophila pneumoniae CWL029
caaaucccugaugc

SEQ ID NO: 2526534 - RNA, 21 nt, Chlamydophila pneumoniae CWL029
caaauccugcauacccuucuu

SEQ ID NO: 2526535 - RNA, 21 nt, Chlamydophila pneumoniae CWL029
caaaucuaucugcacuuucuu

SEQ ID NO: 2526536 - RNA, 19 nt, Chlamydophila pneumoniae CWL029
caaaucuuacauaaaccuu

SEQ ID NO: 2526537 - RNA, 23 nt, Chlamydophila pneumoniae CWL029
caaaucuucgaauuuuuguuuua

SEQ ID NO: 2526538 - RNA, 14 nt, Chlamydophila pneumoniae CWL029
caaaugaaaagaga

SEQ ID NO: 2526539 - RNA, 17 nt, Chlamydophila pneumoniae CWL029
caaaugcagucucagga

SEQ ID NO: 2526540 - RNA, 19 nt, Chlamydophila pneumoniae CWL029
caaaugcagucucaggaaa

SEQ ID NO: 2526541 - RNA, 13 nt, Chlamydophila pneumoniae CWL029
caaauguucucuc

SEQ ID NO: 2526542 - RNA, 15 nt, Chlamydophila pneumoniae CWL029
caaauguucucucca

SEQ ID NO: 2526543 - RNA, 22 nt, Chlamydophila pneumoniae CWL029
caaauguucucuccagcugugg

SEQ ID NO: 2526544 - RNA, 22 nt, Chlamydophila pneumoniae CWL029
caaauuaccuugagacaaagaa

SEQ ID NO: 2526545 - RNA, 15 nt, Chlamydophila pneumoniae CWL029
caaauucaaaauaga

SEQ ID NO: 2526546 - RNA, 18 nt, Chlamydophila pneumoniae CWL029
caaauucaccaaccaguu

SEQ ID NO: 2526547 - RNA, 21 nt, Chlamydophila pneumoniae CWL029
caaauucaccaaccaguuucu

SEQ ID NO: 2526548 - RNA, 13 nt, Chlamydophila pneumoniae CWL029
caaauucauuaag

SEQ ID NO: 2526549 - RNA, 22 nt, Chlamydophila pneumoniae CWL029
caaauuccuucucagaaagaua

SEQ ID NO: 2526550 - RNA, 18 nt, Chlamydophila pneumoniae CWL029
caaauugaugauuuuuua

SEQ ID NO: 2526551 - RNA, 17 nt, Chlamydophila pneumoniae CWL029
caaauugcaauuuucua

SEQ ID NO: 2526552 - RNA, 23 nt, Chlamydophila pneumoniae CWL029
caaauugcaauuuucuaaagauu

SEQ ID NO: 2526553 - RNA, 23 nt, Chlamydophila pneumoniae CWL029
caaauuuaucggcuaaagaaaag

SEQ ID NO: 2526554 - RNA, 19 nt, Chlamydophila pneumoniae CWL029
caaauuucauuuagacaau

SEQ ID NO: 2526555 - RNA, 16 nt, Chlamydophila pneumoniae CWL029
caaauuuuucgagaau

SEQ ID NO: 2526556 - RNA, 14 nt, Chlamydophila pneumoniae CWL029
caacaaaagggcau

SEQ ID NO: 2526557 - RNA, 22 nt, Chlamydophila pneumoniae CWL029
caacaaaugugacgcaagagac

SEQ ID NO: 2526558 - RNA, 18 nt, Chlamydophila pneumoniae CWL029
caacaagggaaagaaacu

SEQ ID NO: 2526559 - RNA, 22 nt, Chlamydophila pneumoniae CWL029
caacaaguucuuggaaaaaagg

SEQ ID NO: 2526560 - RNA, 22 nt, Chlamydophila pneumoniae CWL029
caacacggacacuauuaucugc

SEQ ID NO: 2526561 - RNA, 15 nt, Chlamydophila pneumoniae CWL029
caacagcaacacucg

SEQ ID NO: 2526562 - RNA, 16 nt, Chlamydophila pneumoniae CWL029
caacagcuaauacauc

SEQ ID NO: 2526563 - RNA, 23 nt, Chlamydophila pneumoniae CWL029
caacagcuaauacaucaccacug

SEQ ID NO: 2526564 - RNA, 13 nt, Chlamydophila pneumoniae CWL029
caacaguaauuau

SEQ ID NO: 2526565 - RNA, 15 nt, Chlamydophila pneumoniae CWL029
caacaguaauuauuu

SEQ ID NO: 2526566 - RNA, 22 nt, Chlamydophila pneumoniae CWL029
caacaguguagccuuucuuuuu

SEQ ID NO: 2526567 - RNA, 22 nt, Chlamydophila pneumoniae CWL029
caacaguucgacaaccaaaaca

SEQ ID NO: 2526568 - RNA, 15 nt, Chlamydophila pneumoniae CWL029
caacaguucuuucug

SEQ ID NO: 2526569 - RNA, 13 nt, Chlamydophila pneumoniae CWL029
caacauaaagaag

SEQ ID NO: 2526570 - RNA, 13 nt, Chlamydophila pneumoniae CWL029
caacauaacauga

SEQ ID NO: 2526571 - RNA, 17 nt, Chlamydophila pneumoniae CWL029
caacauaacaugagaaa

SEQ ID NO: 2526572 - RNA, 22 nt, Chlamydophila pneumoniae CWL029
caacauaaucauuauccauauc

SEQ ID NO: 2526573 - RNA, 22 nt, Chlamydophila pneumoniae CWL029
caacauacaccccaguuucuug

SEQ ID NO: 2526574 - RNA, 13 nt, Chlamydophila pneumoniae CWL029
caacaucaaagaa

SEQ ID NO: 2526575 - RNA, 14 nt, Chlamydophila pneumoniae CWL029
caacaucaaagaau

SEQ ID NO: 2526576 - RNA, 12 nt, Chlamydophila pneumoniae CWL029
caacaucaugaa

SEQ ID NO: 2526577 - RNA, 20 nt, Chlamydophila pneumoniae CWL029
caacauugaguugguuuugu

SEQ ID NO: 2526578 - RNA, 16 nt, Chlamydophila pneumoniae CWL029
caacauuuugccuuua

SEQ ID NO: 2526579 - RNA, 23 nt, Chlamydophila pneumoniae CWL029
caaccaaaaugcauuugccccua

SEQ ID NO: 2526580 - RNA, 18 nt, Chlamydophila pneumoniae CWL029
caaccacacaggauuguu

SEQ ID NO: 2526581 - RNA, 18 nt, Chlamydophila pneumoniae CWL029
caaccaucccauauggau

SEQ ID NO: 2526582 - RNA, 16 nt, Chlamydophila pneumoniae CWL029
caacccgaauuccucu

SEQ ID NO: 2526583 - RNA, 22 nt, Chlamydophila pneumoniae CWL029
caaccuucgauuccaggcucua

SEQ ID NO: 2526584 - RNA, 16 nt, Chlamydophila pneumoniae CWL029
caaccuuuccuaaaau

SEQ ID NO: 2526585 - RNA, 18 nt, Chlamydophila pneumoniae CWL029
caaccuuuccuaaaauaa

SEQ ID NO: 2526586 - RNA, 22 nt, Chlamydophila pneumoniae CWL029
caaccuuuccuaaaauaauuuu

SEQ ID NO: 2526587 - RNA, 16 nt, Chlamydophila pneumoniae CWL029
caacgaucgucaguaa

SEQ ID NO: 2526588 - RNA, 19 nt, Chlamydophila pneumoniae CWL029
caacgcaugacgcuuuucc

SEQ ID NO: 2526589 - RNA, 14 nt, Chlamydophila pneumoniae CWL029
caacggauaagacg

SEQ ID NO: 2526590 - RNA, 22 nt, Chlamydophila pneumoniae CWL029
caacgguguucauaaucagaac

SEQ ID NO: 2526591 - RNA, 14 nt, Chlamydophila pneumoniae CWL029
caacuaaacuggga

SEQ ID NO: 2526592 - RNA, 16 nt, Chlamydophila pneumoniae CWL029
caacuaaagcauacuu

SEQ ID NO: 2526593 - RNA, 21 nt, Chlamydophila pneumoniae CWL029
caacuacagagggcuucauuc

SEQ ID NO: 2526594 - RNA, 16 nt, Chlamydophila pneumoniae CWL029
caacuagaccaauaaa

SEQ ID NO: 2526595 - RNA, 21 nt, Chlamydophila pneumoniae CWL029
caacucauccuaaauuaaaua

SEQ ID NO: 2526596 - RNA, 13 nt, Chlamydophila pneumoniae CWL029
caacucuccaucc

SEQ ID NO: 2526597 - RNA, 14 nt, Chlamydophila pneumoniae CWL029
caacucuccauccu

SEQ ID NO: 2526598 - RNA, 22 nt, Chlamydophila pneumoniae CWL029
caacucucccauguaguaaauu

SEQ ID NO: 2526599 - RNA, 23 nt, Chlamydophila pneumoniae CWL029
caacucucuuuaaaccuggcauu

SEQ ID NO: 2526600 - RNA, 15 nt, Chlamydophila pneumoniae CWL029
caacucuugacaacg

SEQ ID NO: 2526601 - RNA, 14 nt, Chlamydophila pneumoniae CWL029
caacucuuuaauug

SEQ ID NO: 2526602 - RNA, 20 nt, Chlamydophila pneumoniae CWL029
caacucuuuaggucuugucu

SEQ ID NO: 2526603 - RNA, 20 nt, Chlamydophila pneumoniae CWL029
caacugauguuuuauagaua

SEQ ID NO: 2526604 - RNA, 14 nt, Chlamydophila pneumoniae CWL029
caacuucugacaau

SEQ ID NO: 2526605 - RNA, 14 nt, Chlamydophila pneumoniae CWL029
caagaaaaaccccu

SEQ ID NO: 2526606 - RNA, 23 nt, Chlamydophila pneumoniae CWL029
caagaaaauaggugacuucuuug

SEQ ID NO: 2526607 - RNA, 16 nt, Chlamydophila pneumoniae CWL029
caagaaaauaucaccu

SEQ ID NO: 2526608 - RNA, 14 nt, Chlamydophila pneumoniae CWL029
caagaaaugcccug

SEQ ID NO: 2526609 - RNA, 19 nt, Chlamydophila pneumoniae CWL029
caagaaauucuucccaggu

SEQ ID NO: 2526610 - RNA, 14 nt, Chlamydophila pneumoniae CWL029
caagaacaauaagu

SEQ ID NO: 2526611 - RNA, 16 nt, Chlamydophila pneumoniae CWL029
caagaacaauaaguag

SEQ ID NO: 2526612 - RNA, 20 nt, Chlamydophila pneumoniae CWL029
caagaaccuguuuuucuaaa

SEQ ID NO: 2526613 - RNA, 23 nt, Chlamydophila pneumoniae CWL029
caagaaccuguuuuucuaaaaug

SEQ ID NO: 2526614 - RNA, 15 nt, Chlamydophila pneumoniae CWL029
caagaacugaagagu

SEQ ID NO: 2526615 - RNA, 18 nt, Chlamydophila pneumoniae CWL029
caagaagagaaaagauag

SEQ ID NO: 2526616 - RNA, 22 nt, Chlamydophila pneumoniae CWL029
caagaagaugauuggacaagug

SEQ ID NO: 2526617 - RNA, 11 nt, Chlamydophila pneumoniae CWL029
caagaagaugu

SEQ ID NO: 2526618 - RNA, 17 nt, Chlamydophila pneumoniae CWL029
caagaagcguacuuuac

SEQ ID NO: 2526619 - RNA, 18 nt, Chlamydophila pneumoniae CWL029
caagaauagcaggaagga

SEQ ID NO: 2526620 - RNA, 21 nt, Chlamydophila pneumoniae CWL029
caagaauagccauaauuagaa

SEQ ID NO: 2526621 - RNA, 18 nt, Chlamydophila pneumoniae CWL029
caagaaugaaucgaagaa

SEQ ID NO: 2526622 - RNA, 15 nt, Chlamydophila pneumoniae CWL029
caagacaaaaaaggg

SEQ ID NO: 2526623 - RNA, 15 nt, Chlamydophila pneumoniae CWL029
caagacaauaaaaaa

SEQ ID NO: 2526624 - RNA, 21 nt, Chlamydophila pneumoniae CWL029
caagaccacuuaggguucuca

SEQ ID NO: 2526625 - RNA, 15 nt, Chlamydophila pneumoniae CWL029
caagacgaaagcaca

SEQ ID NO: 2526626 - RNA, 16 nt, Chlamydophila pneumoniae CWL029
caagacgcggaacucu

SEQ ID NO: 2526627 - RNA, 15 nt, Chlamydophila pneumoniae CWL029
caagacuauagaaaa

SEQ ID NO: 2526628 - RNA, 19 nt, Chlamydophila pneumoniae CWL029
caagacuauagaaaaggau

SEQ ID NO: 2526629 - RNA, 20 nt, Chlamydophila pneumoniae CWL029
caagacuauagaaaaggaug

SEQ ID NO: 2526630 - RNA, 17 nt, Chlamydophila pneumoniae CWL029
caagagacaagaaaaua

SEQ ID NO: 2526631 - RNA, 22 nt, Chlamydophila pneumoniae CWL029
caagaggcuguccuugcagccc

SEQ ID NO: 2526632 - RNA, 15 nt, Chlamydophila pneumoniae CWL029
caagaggucgaagau

SEQ ID NO: 2526633 - RNA, 21 nt, Chlamydophila pneumoniae CWL029
caagaggucgaagauucaaag

SEQ ID NO: 2526634 - RNA, 22 nt, Chlamydophila pneumoniae CWL029
caagaggucgaagauucaaaga

SEQ ID NO: 2526635 - RNA, 16 nt, Chlamydophila pneumoniae CWL029
caagauaaaucccacu

SEQ ID NO: 2526636 - RNA, 20 nt, Chlamydophila pneumoniae CWL029
caagauacuacuuacaagaa

SEQ ID NO: 2526637 - RNA, 14 nt, Chlamydophila pneumoniae CWL029
caagaucuccgccu

SEQ ID NO: 2526638 - RNA, 23 nt, Chlamydophila pneumoniae CWL029
caagaugucuccaaagauacauu

SEQ ID NO: 2526639 - RNA, 22 nt, Chlamydophila pneumoniae CWL029
caagauuaucuuuacgaaucac

SEQ ID NO: 2526640 - RNA, 17 nt, Chlamydophila pneumoniae CWL029
caagauuaugaugccuc

SEQ ID NO: 2526641 - RNA, 20 nt, Chlamydophila pneumoniae CWL029
caagauucccugcggacaga

SEQ ID NO: 2526642 - RNA, 15 nt, Chlamydophila pneumoniae CWL029
caagauucucagcuu

SEQ ID NO: 2526643 - RNA, 13 nt, Chlamydophila pneumoniae CWL029
caagauuuuguag

SEQ ID NO: 2526644 - RNA, 13 nt, Chlamydophila pneumoniae CWL029
caagcaacucuuc

SEQ ID NO: 2526645 - RNA, 16 nt, Chlamydophila pneumoniae CWL029
caagcaacucuucagc

SEQ ID NO: 2526646 - RNA, 21 nt, Chlamydophila pneumoniae CWL029
caagcaacugauguuuuauag

SEQ ID NO: 2526647 - RNA, 13 nt, Chlamydophila pneumoniae CWL029
caagcaaggaaaa

SEQ ID NO: 2526648 - RNA, 23 nt, Chlamydophila pneumoniae CWL029
caagcaauacuaagaagcucacu

SEQ ID NO: 2526649 - RNA, 16 nt, Chlamydophila pneumoniae CWL029
caagcacuuucgcaaa

SEQ ID NO: 2526650 - RNA, 21 nt, Chlamydophila pneumoniae CWL029
caagcagauagagcuucuuua

SEQ ID NO: 2526651 - RNA, 14 nt, Chlamydophila pneumoniae CWL029
caagcauaaacucc

SEQ ID NO: 2526652 - RNA, 22 nt, Chlamydophila pneumoniae CWL029
caagcauccuagaacuugggau

SEQ ID NO: 2526653 - RNA, 21 nt, Chlamydophila pneumoniae CWL029
caagcgcgcuaaaaaaaggcu

SEQ ID NO: 2526654 - RNA, 12 nt, Chlamydophila pneumoniae CWL029
caagcucgcgua

SEQ ID NO: 2526655 - RNA, 17 nt, Chlamydophila pneumoniae CWL029
caaggaaaaacaaaccu

SEQ ID NO: 2526656 - RNA, 11 nt, Chlamydophila pneumoniae CWL029
caaggaaaauu

SEQ ID NO: 2526657 - RNA, 19 nt, Chlamydophila pneumoniae CWL029
caaggacaggaccugugag

SEQ ID NO: 2526658 - RNA, 16 nt, Chlamydophila pneumoniae CWL029
caaggagagaaaauau

SEQ ID NO: 2526659 - RNA, 22 nt, Chlamydophila pneumoniae CWL029
caaggagagcuucuucuguaaa

SEQ ID NO: 2526660 - RNA, 19 nt, Chlamydophila pneumoniae CWL029
caaggagucacuggcauca

SEQ ID NO: 2526661 - RNA, 21 nt, Chlamydophila pneumoniae CWL029
caaggaguccaugcuaaaacu

SEQ ID NO: 2526662 - RNA, 20 nt, Chlamydophila pneumoniae CWL029
caaggaucuuauauaaaacu

SEQ ID NO: 2526663 - RNA, 15 nt, Chlamydophila pneumoniae CWL029
caaggauuaugaauc

SEQ ID NO: 2526664 - RNA, 17 nt, Chlamydophila pneumoniae CWL029
caaggauuaugaauccu

SEQ ID NO: 2526665 - RNA, 14 nt, Chlamydophila pneumoniae CWL029
caaggcaaaaaguu

SEQ ID NO: 2526666 - RNA, 22 nt, Chlamydophila pneumoniae CWL029
caaggcaucuucuuugccaaug

SEQ ID NO: 2526667 - RNA, 18 nt, Chlamydophila pneumoniae CWL029
caaggccuaaucuuguag

SEQ ID NO: 2526668 - RNA, 16 nt, Chlamydophila pneumoniae CWL029
caagguaacauccaua

SEQ ID NO: 2526669 - RNA, 15 nt, Chlamydophila pneumoniae CWL029
caagguacuuuauag

SEQ ID NO: 2526670 - RNA, 15 nt, Chlamydophila pneumoniae CWL029
caaguagcucucucc

SEQ ID NO: 2526671 - RNA, 19 nt, Chlamydophila pneumoniae CWL029
caagucagccaagacaaaa

SEQ ID NO: 2526672 - RNA, 14 nt, Chlamydophila pneumoniae CWL029
caagucauaaagau

SEQ ID NO: 2526673 - RNA, 20 nt, Chlamydophila pneumoniae CWL029
caaguccugcguuaaacccu

SEQ ID NO: 2526674 - RNA, 18 nt, Chlamydophila pneumoniae CWL029
caagucgagaaacaaaau

SEQ ID NO: 2526675 - RNA, 20 nt, Chlamydophila pneumoniae CWL029
caagucgagaaacaaaaucu

SEQ ID NO: 2526676 - RNA, 21 nt, Chlamydophila pneumoniae CWL029
caagucugcuugggacauuuc

SEQ ID NO: 2526677 - RNA, 12 nt, Chlamydophila pneumoniae CWL029
caagucuguaag

SEQ ID NO: 2526678 - RNA, 14 nt, Chlamydophila pneumoniae CWL029
caagugaagacaag

SEQ ID NO: 2526679 - RNA, 18 nt, Chlamydophila pneumoniae CWL029
caagugcauuaucuaaga

SEQ ID NO: 2526680 - RNA, 22 nt, Chlamydophila pneumoniae CWL029
caagugcucaguaaauauuuua

SEQ ID NO: 2526681 - RNA, 19 nt, Chlamydophila pneumoniae CWL029
caagugugcggucucaugu

SEQ ID NO: 2526682 - RNA, 13 nt, Chlamydophila pneumoniae CWL029
caaguucaucaaa

SEQ ID NO: 2526683 - RNA, 13 nt, Chlamydophila pneumoniae CWL029
caaguuucuuuug

SEQ ID NO: 2526684 - RNA, 23 nt, Chlamydophila pneumoniae CWL029
caauaaaaggcuauuguguuuuu

SEQ ID NO: 2526685 - RNA, 23 nt, Chlamydophila pneumoniae CWL029
caauaaacgagacugcaaaggaa

SEQ ID NO: 2526686 - RNA, 14 nt, Chlamydophila pneumoniae CWL029
caauaaauccaaaa

SEQ ID NO: 2526687 - RNA, 18 nt, Chlamydophila pneumoniae CWL029
caauaaauccaaaaaaug

SEQ ID NO: 2526688 - RNA, 19 nt, Chlamydophila pneumoniae CWL029
caauaaccgaaacuucuca

SEQ ID NO: 2526689 - RNA, 21 nt, Chlamydophila pneumoniae CWL029
caauaaccgaaacuucucaga

SEQ ID NO: 2526690 - RNA, 17 nt, Chlamydophila pneumoniae CWL029
caauaagaaaauccuaa

SEQ ID NO: 2526691 - RNA, 18 nt, Chlamydophila pneumoniae CWL029
caauaagcuugccagcag

SEQ ID NO: 2526692 - RNA, 19 nt, Chlamydophila pneumoniae CWL029
caauaagcuugccagcaga

SEQ ID NO: 2526693 - RNA, 19 nt, Chlamydophila pneumoniae CWL029
caauaauaacgcuccaaug

SEQ ID NO: 2526694 - RNA, 21 nt, Chlamydophila pneumoniae CWL029
caauaaucacuguuugauuau

SEQ ID NO: 2526695 - RNA, 23 nt, Chlamydophila pneumoniae CWL029
caauaaucggccgaguuucuccg

SEQ ID NO: 2526696 - RNA, 16 nt, Chlamydophila pneumoniae CWL029
caauaauuucaaagau

SEQ ID NO: 2526697 - RNA, 17 nt, Chlamydophila pneumoniae CWL029
caauacagauaucaaag

SEQ ID NO: 2526698 - RNA, 15 nt, Chlamydophila pneumoniae CWL029
caauacagauguaaa

SEQ ID NO: 2526699 - RNA, 16 nt, Chlamydophila pneumoniae CWL029
caauacagauguaaau

SEQ ID NO: 2526700 - RNA, 17 nt, Chlamydophila pneumoniae CWL029
caauacagcauaaaaau

SEQ ID NO: 2526701 - RNA, 18 nt, Chlamydophila pneumoniae CWL029
caauacagcauaaaaauu

SEQ ID NO: 2526702 - RNA, 17 nt, Chlamydophila pneumoniae CWL029
caauacuaaaacuacaa

SEQ ID NO: 2526703 - RNA, 17 nt, Chlamydophila pneumoniae CWL029
caauacuaagaagcuca

SEQ ID NO: 2526704 - RNA, 16 nt, Chlamydophila pneumoniae CWL029
caauagcaaagauuuc

SEQ ID NO: 2526705 - RNA, 13 nt, Chlamydophila pneumoniae CWL029
caauagcagcagc

SEQ ID NO: 2526706 - RNA, 12 nt, Chlamydophila pneumoniae CWL029
caauagcuucca

SEQ ID NO: 2526707 - RNA, 13 nt, Chlamydophila pneumoniae CWL029
caauaggcaccca

SEQ ID NO: 2526708 - RNA, 22 nt, Chlamydophila pneumoniae CWL029
caauaggccagaauguacauag

SEQ ID NO: 2526709 - RNA, 17 nt, Chlamydophila pneumoniae CWL029
caauauaaaugcuauuu

SEQ ID NO: 2526710 - RNA, 14 nt, Chlamydophila pneumoniae CWL029
caauauaagcacca

SEQ ID NO: 2526711 - RNA, 14 nt, Chlamydophila pneumoniae CWL029
caauauagaaaucg

SEQ ID NO: 2526712 - RNA, 16 nt, Chlamydophila pneumoniae CWL029
caauauagaagcugcu

SEQ ID NO: 2526713 - RNA, 13 nt, Chlamydophila pneumoniae CWL029
caaucaauaaaau

SEQ ID NO: 2526714 - RNA, 15 nt, Chlamydophila pneumoniae CWL029
caaucacacuacauu

SEQ ID NO: 2526715 - RNA, 15 nt, Chlamydophila pneumoniae CWL029
caaucacauaaagau

SEQ ID NO: 2526716 - RNA, 14 nt, Chlamydophila pneumoniae CWL029
caaucaguucaucu

SEQ ID NO: 2526717 - RNA, 16 nt, Chlamydophila pneumoniae CWL029
caauccaacaaagaug

SEQ ID NO: 2526718 - RNA, 18 nt, Chlamydophila pneumoniae CWL029
caauccaacaaagaugac

SEQ ID NO: 2526719 - RNA, 19 nt, Chlamydophila pneumoniae CWL029
caauccacgcuccucuaac

SEQ ID NO: 2526720 - RNA, 19 nt, Chlamydophila pneumoniae CWL029
caauccaguagaucuucug

SEQ ID NO: 2526721 - RNA, 17 nt, Chlamydophila pneumoniae CWL029
caaucccccagcauuca

SEQ ID NO: 2526722 - RNA, 19 nt, Chlamydophila pneumoniae CWL029
caauccccugcaucucugc

SEQ ID NO: 2526723 - RNA, 20 nt, Chlamydophila pneumoniae CWL029
caaucccgaguccuaaaauu

SEQ ID NO: 2526724 - RNA, 14 nt, Chlamydophila pneumoniae CWL029
caaucccucuaccc

SEQ ID NO: 2526725 - RNA, 19 nt, Chlamydophila pneumoniae CWL029
caauccuauggcagcagga

SEQ ID NO: 2526726 - RNA, 13 nt, Chlamydophila pneumoniae CWL029
caauccuuccuua

SEQ ID NO: 2526727 - RNA, 22 nt, Chlamydophila pneumoniae CWL029
caaucguagccccauagagccu

SEQ ID NO: 2526728 - RNA, 13 nt, Chlamydophila pneumoniae CWL029
caaucuaaaauca

SEQ ID NO: 2526729 - RNA, 14 nt, Chlamydophila pneumoniae CWL029
caaucuaaaaucac

SEQ ID NO: 2526730 - RNA, 19 nt, Chlamydophila pneumoniae CWL029
caaucuaaagguuuuaaau

SEQ ID NO: 2526731 - RNA, 19 nt, Chlamydophila pneumoniae CWL029
caaucucgcuauuccauaa

SEQ ID NO: 2526732 - RNA, 20 nt, Chlamydophila pneumoniae CWL029
caaucucgcuauuccauaaa

SEQ ID NO: 2526733 - RNA, 19 nt, Chlamydophila pneumoniae CWL029
caaucucuagggauaauua

SEQ ID NO: 2526734 - RNA, 14 nt, Chlamydophila pneumoniae CWL029
caaucucuuuaaaa

SEQ ID NO: 2526735 - RNA, 20 nt, Chlamydophila pneumoniae CWL029
caaucugagcacauuuuucu

SEQ ID NO: 2526736 - RNA, 17 nt, Chlamydophila pneumoniae CWL029
caaucugguuaagcacc

SEQ ID NO: 2526737 - RNA, 20 nt, Chlamydophila pneumoniae CWL029
caaucuuccuuaaccuccuc

SEQ ID NO: 2526738 - RNA, 19 nt, Chlamydophila pneumoniae CWL029
caaucuuucauucccuuuu

SEQ ID NO: 2526739 - RNA, 14 nt, Chlamydophila pneumoniae CWL029
caaucuuucuucua

SEQ ID NO: 2526740 - RNA, 20 nt, Chlamydophila pneumoniae CWL029
caaucuuucuucuagagcuu

SEQ ID NO: 2526741 - RNA, 10 nt, Chlamydophila pneumoniae CWL029
caaucuuuga

SEQ ID NO: 2526742 - RNA, 12 nt, Chlamydophila pneumoniae CWL029
caaugaagaaaa

SEQ ID NO: 2526743 - RNA, 14 nt, Chlamydophila pneumoniae CWL029
caaugaagaaaaau

SEQ ID NO: 2526744 - RNA, 21 nt, Chlamydophila pneumoniae CWL029
caaugacaauccgcauauuga

SEQ ID NO: 2526745 - RNA, 21 nt, Chlamydophila pneumoniae CWL029
caaugacuguaggaccugugu

SEQ ID NO: 2526746 - RNA, 15 nt, Chlamydophila pneumoniae CWL029
caaugauaauuucau

SEQ ID NO: 2526747 - RNA, 15 nt, Chlamydophila pneumoniae CWL029
caaugauauaaaagc

SEQ ID NO: 2526748 - RNA, 20 nt, Chlamydophila pneumoniae CWL029
caaugauauaaaagcugaau

SEQ ID NO: 2526749 - RNA, 15 nt, Chlamydophila pneumoniae CWL029
caaugauguuuuuua

SEQ ID NO: 2526750 - RNA, 16 nt, Chlamydophila pneumoniae CWL029
caaugcagcuaacgaa

SEQ ID NO: 2526751 - RNA, 14 nt, Chlamydophila pneumoniae CWL029
caaugcgauaacca

SEQ ID NO: 2526752 - RNA, 16 nt, Chlamydophila pneumoniae CWL029
caaugcuaucuccaga

SEQ ID NO: 2526753 - RNA, 15 nt, Chlamydophila pneumoniae CWL029
caaugcuucuucagc

SEQ ID NO: 2526754 - RNA, 20 nt, Chlamydophila pneumoniae CWL029
caaugcuugucgcgacaaga

SEQ ID NO: 2526755 - RNA, 21 nt, Chlamydophila pneumoniae CWL029
caaugcuugucgcgacaagac

SEQ ID NO: 2526756 - RNA, 17 nt, Chlamydophila pneumoniae CWL029
caauggaaauagagaaa

SEQ ID NO: 2526757 - RNA, 20 nt, Chlamydophila pneumoniae CWL029
caauggcuuuuuuuguccca

SEQ ID NO: 2526758 - RNA, 18 nt, Chlamydophila pneumoniae CWL029
caauguuaaucuaauuuu

SEQ ID NO: 2526759 - RNA, 20 nt, Chlamydophila pneumoniae CWL029
caauguuuagaauuuguccu

SEQ ID NO: 2526760 - RNA, 12 nt, Chlamydophila pneumoniae CWL029
caauuaaaaaau

SEQ ID NO: 2526761 - RNA, 18 nt, Chlamydophila pneumoniae CWL029
caauuaaaaaauuaucuc

SEQ ID NO: 2526762 - RNA, 14 nt, Chlamydophila pneumoniae CWL029
caauuacaggaaac

SEQ ID NO: 2526763 - RNA, 17 nt, Chlamydophila pneumoniae CWL029
caauuacaggaaacucu

SEQ ID NO: 2526764 - RNA, 18 nt, Chlamydophila pneumoniae CWL029
caauuaugcccaaggaaa

SEQ ID NO: 2526765 - RNA, 19 nt, Chlamydophila pneumoniae CWL029
caauuaugcccaaggaaaa

SEQ ID NO: 2526766 - RNA, 17 nt, Chlamydophila pneumoniae CWL029
caauuccccuuuaaagc

SEQ ID NO: 2526767 - RNA, 15 nt, Chlamydophila pneumoniae CWL029
caauuccgaagaaga

SEQ ID NO: 2526768 - RNA, 16 nt, Chlamydophila pneumoniae CWL029
caauuccgaagaagaa

SEQ ID NO: 2526769 - RNA, 18 nt, Chlamydophila pneumoniae CWL029
caauuccgaagaagaaag

SEQ ID NO: 2526770 - RNA, 20 nt, Chlamydophila pneumoniae CWL029
caauuccgaagaagaaagga

SEQ ID NO: 2526771 - RNA, 14 nt, Chlamydophila pneumoniae CWL029
caauucgcucagaa

SEQ ID NO: 2526772 - RNA, 15 nt, Chlamydophila pneumoniae CWL029
caauucgguagagcu

SEQ ID NO: 2526773 - RNA, 16 nt, Chlamydophila pneumoniae CWL029
caauucgguagagcua

SEQ ID NO: 2526774 - RNA, 15 nt, Chlamydophila pneumoniae CWL029
caauucuuaaaaagc

SEQ ID NO: 2526775 - RNA, 17 nt, Chlamydophila pneumoniae CWL029
caauucuuaaaaagcua

SEQ ID NO: 2526776 - RNA, 15 nt, Chlamydophila pneumoniae CWL029
caauucuucaugcug

SEQ ID NO: 2526777 - RNA, 20 nt, Chlamydophila pneumoniae CWL029
caauugaaucagauuagagu

SEQ ID NO: 2526778 - RNA, 22 nt, Chlamydophila pneumoniae CWL029
caauugaaucagauuagaguua

SEQ ID NO: 2526779 - RNA, 17 nt, Chlamydophila pneumoniae CWL029
caauugagccucgauuu

SEQ ID NO: 2526780 - RNA, 12 nt, Chlamydophila pneumoniae CWL029
caauugagcucu

SEQ ID NO: 2526781 - RNA, 16 nt, Chlamydophila pneumoniae CWL029
caauugagcucucuag

SEQ ID NO: 2526782 - RNA, 20 nt, Chlamydophila pneumoniae CWL029
caauugccaugcccacagac

SEQ ID NO: 2526783 - RNA, 17 nt, Chlamydophila pneumoniae CWL029
caauuggaggauaaaug

SEQ ID NO: 2526784 - RNA, 18 nt, Chlamydophila pneumoniae CWL029
caauuguaaauacaaaac

SEQ ID NO: 2526785 - RNA, 17 nt, Chlamydophila pneumoniae CWL029
caauuuccugcauggcu

SEQ ID NO: 2526786 - RNA, 15 nt, Chlamydophila pneumoniae CWL029
caauuugcuccucca

SEQ ID NO: 2526787 - RNA, 16 nt, Chlamydophila pneumoniae CWL029
caauuuggauuuaugu

SEQ ID NO: 2526788 - RNA, 23 nt, Chlamydophila pneumoniae CWL029
caauuuguuucuucugugcauca

SEQ ID NO: 2526789 - RNA, 18 nt, Chlamydophila pneumoniae CWL029
caauuuucucaauagugu

SEQ ID NO: 2526790 - RNA, 18 nt, Chlamydophila pneumoniae CWL029
caauuuucuucagcacuu

SEQ ID NO: 2526791 - RNA, 21 nt, Chlamydophila pneumoniae CWL029
caauuuuuguagacaauacca

SEQ ID NO: 2526792 - RNA, 13 nt, Chlamydophila pneumoniae CWL029
cacaaaaccugga

SEQ ID NO: 2526793 - RNA, 15 nt, Chlamydophila pneumoniae CWL029
cacaaaauaaaaccc

SEQ ID NO: 2526794 - RNA, 15 nt, Chlamydophila pneumoniae CWL029
cacaaacaacagaaa

SEQ ID NO: 2526795 - RNA, 16 nt, Chlamydophila pneumoniae CWL029
cacaaagaauucagag

SEQ ID NO: 2526796 - RNA, 20 nt, Chlamydophila pneumoniae CWL029
cacaaaucauuuaaagcuga

SEQ ID NO: 2526797 - RNA, 21 nt, Chlamydophila pneumoniae CWL029
cacaacccuuuaucaagcuau

SEQ ID NO: 2526798 - RNA, 15 nt, Chlamydophila pneumoniae CWL029
cacaacucauccuaa

SEQ ID NO: 2526799 - RNA, 21 nt, Chlamydophila pneumoniae CWL029
cacaagcuuuucgcagauacu

SEQ ID NO: 2526800 - RNA, 24 nt, Chlamydophila pneumoniae CWL029
cacaaggagagaaaauaucacauu

SEQ ID NO: 2526801 - RNA, 15 nt, Chlamydophila pneumoniae CWL029
cacaagugcauuauc

SEQ ID NO: 2526802 - RNA, 15 nt, Chlamydophila pneumoniae CWL029
cacaauauaaaugcu

SEQ ID NO: 2526803 - RNA, 23 nt, Chlamydophila pneumoniae CWL029
cacaauauaaaugcuauuuuccu

SEQ ID NO: 2526804 - RNA, 22 nt, Chlamydophila pneumoniae CWL029
cacaauccucacuauuaauacu

SEQ ID NO: 2526805 - RNA, 16 nt, Chlamydophila pneumoniae CWL029
cacaauuuuaaaaucu

SEQ ID NO: 2526806 - RNA, 15 nt, Chlamydophila pneumoniae CWL029
cacacgaucuucgga

SEQ ID NO: 2526807 - RNA, 15 nt, Chlamydophila pneumoniae CWL029
cacacgucuccaagc

SEQ ID NO: 2526808 - RNA, 13 nt, Chlamydophila pneumoniae CWL029
cacacuccauuuc

SEQ ID NO: 2526809 - RNA, 23 nt, Chlamydophila pneumoniae CWL029
cacacuuucuuuaaagaauagca

SEQ ID NO: 2526810 - RNA, 15 nt, Chlamydophila pneumoniae CWL029
cacagaaugauaaga

SEQ ID NO: 2526811 - RNA, 17 nt, Chlamydophila pneumoniae CWL029
cacagacugcaggaaau

SEQ ID NO: 2526812 - RNA, 21 nt, Chlamydophila pneumoniae CWL029
cacagacuugaggaaucugaa

SEQ ID NO: 2526813 - RNA, 15 nt, Chlamydophila pneumoniae CWL029
cacagagaacaauaa

SEQ ID NO: 2526814 - RNA, 21 nt, Chlamydophila pneumoniae CWL029
cacagagaacaauaaacgaga

SEQ ID NO: 2526815 - RNA, 14 nt, Chlamydophila pneumoniae CWL029
cacagagaauugca

SEQ ID NO: 2526816 - RNA, 16 nt, Chlamydophila pneumoniae CWL029
cacagagaccuucucu

SEQ ID NO: 2526817 - RNA, 18 nt, Chlamydophila pneumoniae CWL029
cacagagaugcuucuaaa

SEQ ID NO: 2526818 - RNA, 22 nt, Chlamydophila pneumoniae CWL029
cacagagaugcuucuaaacaau

SEQ ID NO: 2526819 - RNA, 19 nt, Chlamydophila pneumoniae CWL029
cacagauguaaucuugauc

SEQ ID NO: 2526820 - RNA, 13 nt, Chlamydophila pneumoniae CWL029
cacagcaugcacg

SEQ ID NO: 2526821 - RNA, 15 nt, Chlamydophila pneumoniae CWL029
cacagcauuuucucu

SEQ ID NO: 2526822 - RNA, 23 nt, Chlamydophila pneumoniae CWL029
cacagcauuuucucugagcagcu

SEQ ID NO: 2526823 - RNA, 18 nt, Chlamydophila pneumoniae CWL029
cacagcuaaucauagcca

SEQ ID NO: 2526824 - RNA, 19 nt, Chlamydophila pneumoniae CWL029
cacaggggaacgcucucua

SEQ ID NO: 2526825 - RNA, 23 nt, Chlamydophila pneumoniae CWL029
cacaguuaagacgcagaaacacu

SEQ ID NO: 2526826 - RNA, 13 nt, Chlamydophila pneumoniae CWL029
cacaguuugagaa

SEQ ID NO: 2526827 - RNA, 13 nt, Chlamydophila pneumoniae CWL029
cacauaaaauaau

SEQ ID NO: 2526828 - RNA, 17 nt, Chlamydophila pneumoniae CWL029
cacauaaagaucuuuau

SEQ ID NO: 2526829 - RNA, 17 nt, Chlamydophila pneumoniae CWL029
cacauacaguacgcaaa

SEQ ID NO: 2526830 - RNA, 20 nt, Chlamydophila pneumoniae CWL029
cacauacaguacgcaaagua

SEQ ID NO: 2526831 - RNA, 17 nt, Chlamydophila pneumoniae CWL029
cacauagaaacagucua

SEQ ID NO: 2526832 - RNA, 13 nt, Chlamydophila pneumoniae CWL029
cacauaguuuaau

SEQ ID NO: 2526833 - RNA, 21 nt, Chlamydophila pneumoniae CWL029
cacauaguuuaauaaaucuau

SEQ ID NO: 2526834 - RNA, 14 nt, Chlamydophila pneumoniae CWL029
cacaucaaagcaau

SEQ ID NO: 2526835 - RNA, 17 nt, Chlamydophila pneumoniae CWL029
cacaucuccuuucaaga

SEQ ID NO: 2526836 - RNA, 21 nt, Chlamydophila pneumoniae CWL029
cacaugacaaauaaacugacg

SEQ ID NO: 2526837 - RNA, 14 nt, Chlamydophila pneumoniae CWL029
cacauucuucugau

SEQ ID NO: 2526838 - RNA, 19 nt, Chlamydophila pneumoniae CWL029
cacauugcgggcucaaaga

SEQ ID NO: 2526839 - RNA, 21 nt, Chlamydophila pneumoniae CWL029
cacauuuagaaguaauccuaa

SEQ ID NO: 2526840 - RNA, 18 nt, Chlamydophila pneumoniae CWL029
cacauuugcuuuaacaga

SEQ ID NO: 2526841 - RNA, 15 nt, Chlamydophila pneumoniae CWL029
caccaaaaauuccgu

SEQ ID NO: 2526842 - RNA, 12 nt, Chlamydophila pneumoniae CWL029
caccaagacuga

SEQ ID NO: 2526843 - RNA, 21 nt, Chlamydophila pneumoniae CWL029
caccaaggggcguucuugaaa

SEQ ID NO: 2526844 - RNA, 17 nt, Chlamydophila pneumoniae CWL029
caccaaugauaauuuca

SEQ ID NO: 2526845 - RNA, 23 nt, Chlamydophila pneumoniae CWL029
caccacgaacuucagcaagaaaa

SEQ ID NO: 2526846 - RNA, 14 nt, Chlamydophila pneumoniae CWL029
caccagaagcaacu

SEQ ID NO: 2526847 - RNA, 19 nt, Chlamydophila pneumoniae CWL029
caccagaagcaacuaaacu

SEQ ID NO: 2526848 - RNA, 18 nt, Chlamydophila pneumoniae CWL029
caccagaagcauugagga

SEQ ID NO: 2526849 - RNA, 14 nt, Chlamydophila pneumoniae CWL029
caccagaaggaagg

SEQ ID NO: 2526850 - RNA, 21 nt, Chlamydophila pneumoniae CWL029
caccagaaggaagguucucaa

SEQ ID NO: 2526851 - RNA, 18 nt, Chlamydophila pneumoniae CWL029
caccaggagcuccuccuu

SEQ ID NO: 2526852 - RNA, 21 nt, Chlamydophila pneumoniae CWL029
caccaggaguuggagaauuga

SEQ ID NO: 2526853 - RNA, 15 nt, Chlamydophila pneumoniae CWL029
caccagguccuucug

SEQ ID NO: 2526854 - RNA, 13 nt, Chlamydophila pneumoniae CWL029
caccauaauauaa

SEQ ID NO: 2526855 - RNA, 19 nt, Chlamydophila pneumoniae CWL029
caccaucacauccuguagu

SEQ ID NO: 2526856 - RNA, 17 nt, Chlamydophila pneumoniae CWL029
caccauuuuugaauaug

SEQ ID NO: 2526857 - RNA, 15 nt, Chlamydophila pneumoniae CWL029
cacccgcaagcacuu

SEQ ID NO: 2526858 - RNA, 12 nt, Chlamydophila pneumoniae CWL029
cacccucccuca

SEQ ID NO: 2526859 - RNA, 22 nt, Chlamydophila pneumoniae CWL029
caccgcgcauagcaacuacaga

SEQ ID NO: 2526860 - RNA, 15 nt, Chlamydophila pneumoniae CWL029
caccuaaaaugcagg

SEQ ID NO: 2526861 - RNA, 18 nt, Chlamydophila pneumoniae CWL029
caccuaaaguuugagcua

SEQ ID NO: 2526862 - RNA, 22 nt, Chlamydophila pneumoniae CWL029
caccuaauaaagaagguugaga

SEQ ID NO: 2526863 - RNA, 15 nt, Chlamydophila pneumoniae CWL029
caccucuucaaagac

SEQ ID NO: 2526864 - RNA, 11 nt, Chlamydophila pneumoniae CWL029
caccucuucuc

SEQ ID NO: 2526865 - RNA, 13 nt, Chlamydophila pneumoniae CWL029
caccucuucucua

SEQ ID NO: 2526866 - RNA, 11 nt, Chlamydophila pneumoniae CWL029
caccugaagag

SEQ ID NO: 2526867 - RNA, 21 nt, Chlamydophila pneumoniae CWL029
caccugaagagcgcuauugcu

SEQ ID NO: 2526868 - RNA, 12 nt, Chlamydophila pneumoniae CWL029
caccugcccauu

SEQ ID NO: 2526869 - RNA, 20 nt, Chlamydophila pneumoniae CWL029
caccuuaauggcuccuacuc

SEQ ID NO: 2526870 - RNA, 14 nt, Chlamydophila pneumoniae CWL029
caccuuacauccaa

SEQ ID NO: 2526871 - RNA, 15 nt, Chlamydophila pneumoniae CWL029
caccuuacauccaau

SEQ ID NO: 2526872 - RNA, 22 nt, Chlamydophila pneumoniae CWL029
caccuuccccaagcucucucca

SEQ ID NO: 2526873 - RNA, 17 nt, Chlamydophila pneumoniae CWL029
caccuucggaucuuccc

SEQ ID NO: 2526874 - RNA, 18 nt, Chlamydophila pneumoniae CWL029
cacgaacuucagcaagaa

SEQ ID NO: 2526875 - RNA, 21 nt, Chlamydophila pneumoniae CWL029
cacgaccuauaccaucuuuaa

SEQ ID NO: 2526876 - RNA, 20 nt, Chlamydophila pneumoniae CWL029
cacgaccucgaauuccuccc

SEQ ID NO: 2526877 - RNA, 15 nt, Chlamydophila pneumoniae CWL029
cacgagauucugcuu

SEQ ID NO: 2526878 - RNA, 17 nt, Chlamydophila pneumoniae CWL029
cacgaggccauccuuuu

SEQ ID NO: 2526879 - RNA, 17 nt, Chlamydophila pneumoniae CWL029
cacgccuccuucaaaga

SEQ ID NO: 2526880 - RNA, 20 nt, Chlamydophila pneumoniae CWL029
cacgccuccuucaaagauau

SEQ ID NO: 2526881 - RNA, 19 nt, Chlamydophila pneumoniae CWL029
cacgcuuucgucuaaaaua

SEQ ID NO: 2526882 - RNA, 17 nt, Chlamydophila pneumoniae CWL029
cacggacuccgucuccu

SEQ ID NO: 2526883 - RNA, 11 nt, Chlamydophila pneumoniae CWL029
cacggauucua

SEQ ID NO: 2526884 - RNA, 13 nt, Chlamydophila pneumoniae CWL029
cacguaagguguc

SEQ ID NO: 2526885 - RNA, 14 nt, Chlamydophila pneumoniae CWL029
cacgucgaacauga

SEQ ID NO: 2526886 - RNA, 15 nt, Chlamydophila pneumoniae CWL029
cacguucugcaacaa

SEQ ID NO: 2526887 - RNA, 16 nt, Chlamydophila pneumoniae CWL029
cacguuugacaaauuu

SEQ ID NO: 2526888 - RNA, 14 nt, Chlamydophila pneumoniae CWL029
cacuaaaagggaag

SEQ ID NO: 2526889 - RNA, 17 nt, Chlamydophila pneumoniae CWL029
cacuaaaagggaagcuu

SEQ ID NO: 2526890 - RNA, 20 nt, Chlamydophila pneumoniae CWL029
cacuaaacgaucaaauuccu

SEQ ID NO: 2526891 - RNA, 22 nt, Chlamydophila pneumoniae CWL029
cacuaaagauacuuaucuuuaa

SEQ ID NO: 2526892 - RNA, 15 nt, Chlamydophila pneumoniae CWL029
cacuaaccgaugaua

SEQ ID NO: 2526893 - RNA, 17 nt, Chlamydophila pneumoniae CWL029
cacuaacggcaguaugc

SEQ ID NO: 2526894 - RNA, 17 nt, Chlamydophila pneumoniae CWL029
cacuaagauaucuccag

SEQ ID NO: 2526895 - RNA, 23 nt, Chlamydophila pneumoniae CWL029
cacuaaucucaggcauucuucau

SEQ ID NO: 2526896 - RNA, 17 nt, Chlamydophila pneumoniae CWL029
cacuacauuauaaucac

SEQ ID NO: 2526897 - RNA, 13 nt, Chlamydophila pneumoniae CWL029
cacuacuguucua

SEQ ID NO: 2526898 - RNA, 15 nt, Chlamydophila pneumoniae CWL029
cacuacuuaaagcuu

SEQ ID NO: 2526899 - RNA, 15 nt, Chlamydophila pneumoniae CWL029
cacuagaauaccguu

SEQ ID NO: 2526900 - RNA, 12 nt, Chlamydophila pneumoniae CWL029
cacuagcagaag

SEQ ID NO: 2526901 - RNA, 21 nt, Chlamydophila pneumoniae CWL029
cacuaggcaugguaggagccg

SEQ ID NO: 2526902 - RNA, 18 nt, Chlamydophila pneumoniae CWL029
cacuauacccucugcuua

SEQ ID NO: 2526903 - RNA, 12 nt, Chlamydophila pneumoniae CWL029
cacuaucuucua

SEQ ID NO: 2526904 - RNA, 12 nt, Chlamydophila pneumoniae CWL029
cacuauuaauac

SEQ ID NO: 2526905 - RNA, 16 nt, Chlamydophila pneumoniae CWL029
cacuauuaucugcaga

SEQ ID NO: 2526906 - RNA, 14 nt, Chlamydophila pneumoniae CWL029
cacuccaaaacuca

SEQ ID NO: 2526907 - RNA, 14 nt, Chlamydophila pneumoniae CWL029
cacuccugaaggga

SEQ ID NO: 2526908 - RNA, 18 nt, Chlamydophila pneumoniae CWL029
cacucgauuauuucuugu

SEQ ID NO: 2526909 - RNA, 14 nt, Chlamydophila pneumoniae CWL029
cacucuagaaaaua

SEQ ID NO: 2526910 - RNA, 19 nt, Chlamydophila pneumoniae CWL029
cacucuagaaaauauuccu

SEQ ID NO: 2526911 - RNA, 21 nt, Chlamydophila pneumoniae CWL029
cacucucugcagggaauccug

SEQ ID NO: 2526912 - RNA, 12 nt, Chlamydophila pneumoniae CWL029
cacucuuuaaaa

SEQ ID NO: 2526913 - RNA, 15 nt, Chlamydophila pneumoniae CWL029
cacugaacgccaucu

SEQ ID NO: 2526914 - RNA, 18 nt, Chlamydophila pneumoniae CWL029
cacugaacgccaucucca

SEQ ID NO: 2526915 - RNA, 20 nt, Chlamydophila pneumoniae CWL029
cacugaacgccaucuccaca

SEQ ID NO: 2526916 - RNA, 22 nt, Chlamydophila pneumoniae CWL029
cacugaacgccaucuccacagc

SEQ ID NO: 2526917 - RNA, 17 nt, Chlamydophila pneumoniae CWL029
cacugacuuuaugaucu

SEQ ID NO: 2526918 - RNA, 14 nt, Chlamydophila pneumoniae CWL029
cacugaugaaaaag

SEQ ID NO: 2526919 - RNA, 24 nt, Chlamydophila pneumoniae CWL029
cacuggaaugacauaagcacucuu

SEQ ID NO: 2526920 - RNA, 18 nt, Chlamydophila pneumoniae CWL029
cacugguagcuaaauuua

SEQ ID NO: 2526921 - RNA, 17 nt, Chlamydophila pneumoniae CWL029
cacuguaucagcaagcc

SEQ ID NO: 2526922 - RNA, 18 nt, Chlamydophila pneumoniae CWL029
cacuguaucagcaagccc

SEQ ID NO: 2526923 - RNA, 23 nt, Chlamydophila pneumoniae CWL029
cacuguugcauuagauacgcucu

SEQ ID NO: 2526924 - RNA, 18 nt, Chlamydophila pneumoniae CWL029
cacuguuuuccagaaauc

SEQ ID NO: 2526925 - RNA, 14 nt, Chlamydophila pneumoniae CWL029
cacuuaaagguaaa

SEQ ID NO: 2526926 - RNA, 18 nt, Chlamydophila pneumoniae CWL029
cacuuaaagguaaaacua

SEQ ID NO: 2526927 - RNA, 23 nt, Chlamydophila pneumoniae CWL029
cacuuaauaauguuuuaauagcu

SEQ ID NO: 2526928 - RNA, 16 nt, Chlamydophila pneumoniae CWL029
cacuuacuucaagaaa

SEQ ID NO: 2526929 - RNA, 13 nt, Chlamydophila pneumoniae CWL029
cacuuauguucua

SEQ ID NO: 2526930 - RNA, 18 nt, Chlamydophila pneumoniae CWL029
cacuucucagcaucucga

SEQ ID NO: 2526931 - RNA, 19 nt, Chlamydophila pneumoniae CWL029
cacuucuuuaggagcauag

SEQ ID NO: 2526932 - RNA, 22 nt, Chlamydophila pneumoniae CWL029
cacuucuuugccguauagauuu

SEQ ID NO: 2526933 - RNA, 12 nt, Chlamydophila pneumoniae CWL029
cacuucuuuuuc

SEQ ID NO: 2526934 - RNA, 20 nt, Chlamydophila pneumoniae CWL029
cacuugcauggauccuucau

SEQ ID NO: 2526935 - RNA, 18 nt, Chlamydophila pneumoniae CWL029
cacuugcgguuuuggaua

SEQ ID NO: 2526936 - RNA, 18 nt, Chlamydophila pneumoniae CWL029
cacuugcucuuuaggaua

SEQ ID NO: 2526937 - RNA, 16 nt, Chlamydophila pneumoniae CWL029
cacuugcuuaaggaaa

SEQ ID NO: 2526938 - RNA, 21 nt, Chlamydophila pneumoniae CWL029
cacuugguagcgucucuucuu

SEQ ID NO: 2526939 - RNA, 15 nt, Chlamydophila pneumoniae CWL029
cacuuucugauguga

SEQ ID NO: 2526940 - RNA, 14 nt, Chlamydophila pneumoniae CWL029
cagaaaaaucuaac

SEQ ID NO: 2526941 - RNA, 22 nt, Chlamydophila pneumoniae CWL029
cagaaaauguaaaaaauuauuu

SEQ ID NO: 2526942 - RNA, 14 nt, Chlamydophila pneumoniae CWL029
cagaaacaugaagu

SEQ ID NO: 2526943 - RNA, 18 nt, Chlamydophila pneumoniae CWL029
cagaaacgcaugaaccua

SEQ ID NO: 2526944 - RNA, 21 nt, Chlamydophila pneumoniae CWL029
cagaaacuagggagaucuuau

SEQ ID NO: 2526945 - RNA, 19 nt, Chlamydophila pneumoniae CWL029
cagaaacuggcggauugcu

SEQ ID NO: 2526946 - RNA, 17 nt, Chlamydophila pneumoniae CWL029
cagaaacuuuaaaagca

SEQ ID NO: 2526947 - RNA, 21 nt, Chlamydophila pneumoniae CWL029
cagaaagaaggucuuccaucu

SEQ ID NO: 2526948 - RNA, 18 nt, Chlamydophila pneumoniae CWL029
cagaaagauaucccaaag

SEQ ID NO: 2526949 - RNA, 15 nt, Chlamydophila pneumoniae CWL029
cagaaaggcuuuucu

SEQ ID NO: 2526950 - RNA, 20 nt, Chlamydophila pneumoniae CWL029
cagaaaggcuuuucuuuuuc

SEQ ID NO: 2526951 - RNA, 21 nt, Chlamydophila pneumoniae CWL029
cagaaauacguccagccugca

SEQ ID NO: 2526952 - RNA, 17 nt, Chlamydophila pneumoniae CWL029
cagaaaugaagccaaaa

SEQ ID NO: 2526953 - RNA, 20 nt, Chlamydophila pneumoniae CWL029
cagaaauggcauagggauga

SEQ ID NO: 2526954 - RNA, 15 nt, Chlamydophila pneumoniae CWL029
cagaaaugggcaaca

SEQ ID NO: 2526955 - RNA, 18 nt, Chlamydophila pneumoniae CWL029
cagaaauuacugugguau

SEQ ID NO: 2526956 - RNA, 18 nt, Chlamydophila pneumoniae CWL029
cagaaauugcuucuucca

SEQ ID NO: 2526957 - RNA, 19 nt, Chlamydophila pneumoniae CWL029
cagaacaacgcugcuucuc

SEQ ID NO: 2526958 - RNA, 20 nt, Chlamydophila pneumoniae CWL029
cagaacaacgcugcuucucu

SEQ ID NO: 2526959 - RNA, 22 nt, Chlamydophila pneumoniae CWL029
cagaacaccaucacauccugua

SEQ ID NO: 2526960 - RNA, 13 nt, Chlamydophila pneumoniae CWL029
cagaacuucucca

SEQ ID NO: 2526961 - RNA, 15 nt, Chlamydophila pneumoniae CWL029
cagaaggcuuguuuc

SEQ ID NO: 2526962 - RNA, 16 nt, Chlamydophila pneumoniae CWL029
cagaaggcuuguuucu

SEQ ID NO: 2526963 - RNA, 14 nt, Chlamydophila pneumoniae CWL029
cagaagguaaauuu

SEQ ID NO: 2526964 - RNA, 22 nt, Chlamydophila pneumoniae CWL029
cagaagguaaauuuuuaaaacu

SEQ ID NO: 2526965 - RNA, 15 nt, Chlamydophila pneumoniae CWL029
cagaagguuccacag

SEQ ID NO: 2526966 - RNA, 17 nt, Chlamydophila pneumoniae CWL029
cagaaguccuaucaaag

SEQ ID NO: 2526967 - RNA, 23 nt, Chlamydophila pneumoniae CWL029
cagaagugaucuugagaaaagaa

SEQ ID NO: 2526968 - RNA, 17 nt, Chlamydophila pneumoniae CWL029
cagaaguuccuucagga

SEQ ID NO: 2526969 - RNA, 19 nt, Chlamydophila pneumoniae CWL029
cagaaguuccuucaggauu

SEQ ID NO: 2526970 - RNA, 20 nt, Chlamydophila pneumoniae CWL029
cagaauaggaacaaagcucu

SEQ ID NO: 2526971 - RNA, 13 nt, Chlamydophila pneumoniae CWL029
cagaauccugagu

SEQ ID NO: 2526972 - RNA, 18 nt, Chlamydophila pneumoniae CWL029
cagaaucuaaguaaaacu

SEQ ID NO: 2526973 - RNA, 13 nt, Chlamydophila pneumoniae CWL029
cagaaucuccauu

SEQ ID NO: 2526974 - RNA, 16 nt, Chlamydophila pneumoniae CWL029
cagaaugauaagaaag

SEQ ID NO: 2526975 - RNA, 17 nt, Chlamydophila pneumoniae CWL029
cagaauugcaaaguacu

SEQ ID NO: 2526976 - RNA, 14 nt, Chlamydophila pneumoniae CWL029
cagaauuguuuugu

SEQ ID NO: 2526977 - RNA, 12 nt, Chlamydophila pneumoniae CWL029
cagaauuuucug

SEQ ID NO: 2526978 - RNA, 13 nt, Chlamydophila pneumoniae CWL029
cagacaagacacu

SEQ ID NO: 2526979 - RNA, 20 nt, Chlamydophila pneumoniae CWL029
cagacaagcaaggaaaaaaa

SEQ ID NO: 2526980 - RNA, 23 nt, Chlamydophila pneumoniae CWL029
cagacacaaaaagcuuuuuucuc

SEQ ID NO: 2526981 - RNA, 17 nt, Chlamydophila pneumoniae CWL029
cagacagucugugagaa

SEQ ID NO: 2526982 - RNA, 13 nt, Chlamydophila pneumoniae CWL029
cagaccuaaaaag

SEQ ID NO: 2526983 - RNA, 22 nt, Chlamydophila pneumoniae CWL029
cagaccuaaaaaggucagcccu

SEQ ID NO: 2526984 - RNA, 14 nt, Chlamydophila pneumoniae CWL029
cagacugaagagca

SEQ ID NO: 2526985 - RNA, 18 nt, Chlamydophila pneumoniae CWL029
cagacuucguaucuucga

SEQ ID NO: 2526986 - RNA, 16 nt, Chlamydophila pneumoniae CWL029
cagacuugaggaaucu

SEQ ID NO: 2526987 - RNA, 14 nt, Chlamydophila pneumoniae CWL029
cagacuuuccucuc

SEQ ID NO: 2526988 - RNA, 13 nt, Chlamydophila pneumoniae CWL029
cagagaaaaucaa

SEQ ID NO: 2526989 - RNA, 14 nt, Chlamydophila pneumoniae CWL029
cagagaaaaucaac

SEQ ID NO: 2526990 - RNA, 19 nt, Chlamydophila pneumoniae CWL029
cagagaaauuaacagagcg

SEQ ID NO: 2526991 - RNA, 15 nt, Chlamydophila pneumoniae CWL029
cagagaaauucaugc

SEQ ID NO: 2526992 - RNA, 14 nt, Chlamydophila pneumoniae CWL029
cagagaacaauaaa

SEQ ID NO: 2526993 - RNA, 22 nt, Chlamydophila pneumoniae CWL029
cagagaauugcauucuuaauag

SEQ ID NO: 2526994 - RNA, 17 nt, Chlamydophila pneumoniae CWL029
cagagaccuucucuuca

SEQ ID NO: 2526995 - RNA, 16 nt, Chlamydophila pneumoniae CWL029
cagagacuuccucuuc

SEQ ID NO: 2526996 - RNA, 16 nt, Chlamydophila pneumoniae CWL029
cagagaugcuucuaaa

SEQ ID NO: 2526997 - RNA, 12 nt, Chlamydophila pneumoniae CWL029
cagagauggucu

SEQ ID NO: 2526998 - RNA, 13 nt, Chlamydophila pneumoniae CWL029
cagagauucuuca

SEQ ID NO: 2526999 - RNA, 20 nt, Chlamydophila pneumoniae CWL029
cagagauugccaggagagcu

SEQ ID NO: 2527000 - RNA, 14 nt, Chlamydophila pneumoniae CWL029
cagagauuuuaaag

SEQ ID NO: 2527001 - RNA, 19 nt, Chlamydophila pneumoniae CWL029
cagagcauucgauuuguaa

SEQ ID NO: 2527002 - RNA, 16 nt, Chlamydophila pneumoniae CWL029
cagagccgucuacuuu

SEQ ID NO: 2527003 - RNA, 20 nt, Chlamydophila pneumoniae CWL029
cagagcgaucgcaaucagca

SEQ ID NO: 2527004 - RNA, 14 nt, Chlamydophila pneumoniae CWL029
cagagcgccuccac

SEQ ID NO: 2527005 - RNA, 17 nt, Chlamydophila pneumoniae CWL029
cagagcuucuaaaaacu

SEQ ID NO: 2527006 - RNA, 16 nt, Chlamydophila pneumoniae CWL029
cagaggaaucuaagaa

SEQ ID NO: 2527007 - RNA, 12 nt, Chlamydophila pneumoniae CWL029
cagaggagccuc

SEQ ID NO: 2527008 - RNA, 23 nt, Chlamydophila pneumoniae CWL029
cagaggaucuagaaaaugaagag

SEQ ID NO: 2527009 - RNA, 17 nt, Chlamydophila pneumoniae CWL029
cagaggccaccaaaaau

SEQ ID NO: 2527010 - RNA, 17 nt, Chlamydophila pneumoniae CWL029
cagaggcuagaaaauca

SEQ ID NO: 2527011 - RNA, 20 nt, Chlamydophila pneumoniae CWL029
cagagggcuucauuccuaca

SEQ ID NO: 2527012 - RNA, 21 nt, Chlamydophila pneumoniae CWL029
cagaguacgugaucucacgaa

SEQ ID NO: 2527013 - RNA, 20 nt, Chlamydophila pneumoniae CWL029
cagagucagaagcuauucca

SEQ ID NO: 2527014 - RNA, 22 nt, Chlamydophila pneumoniae CWL029
cagagucugggauguucaaagc

SEQ ID NO: 2527015 - RNA, 18 nt, Chlamydophila pneumoniae CWL029
cagaguggucauugccuu

SEQ ID NO: 2527016 - RNA, 16 nt, Chlamydophila pneumoniae CWL029
cagaguuuuucccucg

SEQ ID NO: 2527017 - RNA, 18 nt, Chlamydophila pneumoniae CWL029
cagauaccaaaauaccau

SEQ ID NO: 2527018 - RNA, 21 nt, Chlamydophila pneumoniae CWL029
cagauacguuucccccauaaa

SEQ ID NO: 2527019 - RNA, 15 nt, Chlamydophila pneumoniae CWL029
cagauacuaaacucc

SEQ ID NO: 2527020 - RNA, 18 nt, Chlamydophila pneumoniae CWL029
cagauagagcuucuuuau

SEQ ID NO: 2527021 - RNA, 20 nt, Chlamydophila pneumoniae CWL029
cagauaggauggaguacuuc

SEQ ID NO: 2527022 - RNA, 16 nt, Chlamydophila pneumoniae CWL029
cagauaggguaagauu

SEQ ID NO: 2527023 - RNA, 15 nt, Chlamydophila pneumoniae CWL029
cagauaucaaagcau

SEQ ID NO: 2527024 - RNA, 14 nt, Chlamydophila pneumoniae CWL029
cagaucaaugccuu

SEQ ID NO: 2527025 - RNA, 22 nt, Chlamydophila pneumoniae CWL029
cagaucauaucggcagcagcau

SEQ ID NO: 2527026 - RNA, 11 nt, Chlamydophila pneumoniae CWL029
cagauccugcu

SEQ ID NO: 2527027 - RNA, 14 nt, Chlamydophila pneumoniae CWL029
cagaucugcauaau

SEQ ID NO: 2527028 - RNA, 23 nt, Chlamydophila pneumoniae CWL029
cagaugagagguguacaguugcg

SEQ ID NO: 2527029 - RNA, 12 nt, Chlamydophila pneumoniae CWL029
cagaugauuuua

SEQ ID NO: 2527030 - RNA, 15 nt, Chlamydophila pneumoniae CWL029
cagaugauuuuaucu

SEQ ID NO: 2527031 - RNA, 14 nt, Chlamydophila pneumoniae CWL029
cagauggucagucu

SEQ ID NO: 2527032 - RNA, 18 nt, Chlamydophila pneumoniae CWL029
cagauuagaaaagauaaa

SEQ ID NO: 2527033 - RNA, 13 nt, Chlamydophila pneumoniae CWL029
cagauuagaguua

SEQ ID NO: 2527034 - RNA, 22 nt, Chlamydophila pneumoniae CWL029
cagauugaugcugacagcucca

SEQ ID NO: 2527035 - RNA, 15 nt, Chlamydophila pneumoniae CWL029
cagauugcacuugcg

SEQ ID NO: 2527036 - RNA, 17 nt, Chlamydophila pneumoniae CWL029
cagauugcacuugcggu

SEQ ID NO: 2527037 - RNA, 16 nt, Chlamydophila pneumoniae CWL029
cagauuguucaaaaau

SEQ ID NO: 2527038 - RNA, 20 nt, Chlamydophila pneumoniae CWL029
cagauuuuuuaaccucuuuu

SEQ ID NO: 2527039 - RNA, 13 nt, Chlamydophila pneumoniae CWL029
cagcaaauacucc

SEQ ID NO: 2527040 - RNA, 19 nt, Chlamydophila pneumoniae CWL029
cagcaacaucguuaauaua

SEQ ID NO: 2527041 - RNA, 19 nt, Chlamydophila pneumoniae CWL029
cagcaacuaaagcauacuu

SEQ ID NO: 2527042 - RNA, 17 nt, Chlamydophila pneumoniae CWL029
cagcaagaucuaacuuc

SEQ ID NO: 2527043 - RNA, 15 nt, Chlamydophila pneumoniae CWL029
cagcacucuuuuucu

SEQ ID NO: 2527044 - RNA, 18 nt, Chlamydophila pneumoniae CWL029
cagcacuuuuauuaugua

SEQ ID NO: 2527045 - RNA, 13 nt, Chlamydophila pneumoniae CWL029
cagcagaugaaac

SEQ ID NO: 2527046 - RNA, 20 nt, Chlamydophila pneumoniae CWL029
cagcagcgucccccccgggu

SEQ ID NO: 2527047 - RNA, 18 nt, Chlamydophila pneumoniae CWL029
cagcagcugucaauccaa

SEQ ID NO: 2527048 - RNA, 22 nt, Chlamydophila pneumoniae CWL029
cagcagcuucccaagcagaaga

SEQ ID NO: 2527049 - RNA, 16 nt, Chlamydophila pneumoniae CWL029
cagcagguucuugaau

SEQ ID NO: 2527050 - RNA, 22 nt, Chlamydophila pneumoniae CWL029
cagcauaaggauucugagaagu

SEQ ID NO: 2527051 - RNA, 18 nt, Chlamydophila pneumoniae CWL029
cagcauaaguuagccugg

SEQ ID NO: 2527052 - RNA, 22 nt, Chlamydophila pneumoniae CWL029
cagcaucacguauaauacguac

SEQ ID NO: 2527053 - RNA, 20 nt, Chlamydophila pneumoniae CWL029
cagcaucaggauucucucug

SEQ ID NO: 2527054 - RNA, 15 nt, Chlamydophila pneumoniae CWL029
cagcauggacuccaa

SEQ ID NO: 2527055 - RNA, 18 nt, Chlamydophila pneumoniae CWL029
cagcauggacuccaagaa

SEQ ID NO: 2527056 - RNA, 19 nt, Chlamydophila pneumoniae CWL029
cagcauggacuccaagaau

SEQ ID NO: 2527057 - RNA, 19 nt, Chlamydophila pneumoniae CWL029
cagcaugugcagaagguuc

SEQ ID NO: 2527058 - RNA, 23 nt, Chlamydophila pneumoniae CWL029
cagcauuaagauaaacagcacag

SEQ ID NO: 2527059 - RNA, 17 nt, Chlamydophila pneumoniae CWL029
cagcauugccuggggau

SEQ ID NO: 2527060 - RNA, 11 nt, Chlamydophila pneumoniae CWL029
cagccagcaga

SEQ ID NO: 2527061 - RNA, 12 nt, Chlamydophila pneumoniae CWL029
cagcccacuguu

SEQ ID NO: 2527062 - RNA, 13 nt, Chlamydophila pneumoniae CWL029
cagcccccaggcu

SEQ ID NO: 2527063 - RNA, 16 nt, Chlamydophila pneumoniae CWL029
cagccgcaucaugguc

SEQ ID NO: 2527064 - RNA, 20 nt, Chlamydophila pneumoniae CWL029
cagccggagcuucuaagauc

SEQ ID NO: 2527065 - RNA, 17 nt, Chlamydophila pneumoniae CWL029
cagccuggaaagcuucu

SEQ ID NO: 2527066 - RNA, 22 nt, Chlamydophila pneumoniae CWL029
cagccuggaaagcuucuggauu

SEQ ID NO: 2527067 - RNA, 22 nt, Chlamydophila pneumoniae CWL029
cagccuguaaagaaggaggucc

SEQ ID NO: 2527068 - RNA, 19 nt, Chlamydophila pneumoniae CWL029
cagccugucuauaaaauaa

SEQ ID NO: 2527069 - RNA, 13 nt, Chlamydophila pneumoniae CWL029
cagcgaggagaag

SEQ ID NO: 2527070 - RNA, 23 nt, Chlamydophila pneumoniae CWL029
cagcgaggaguuuuccaaaguca

SEQ ID NO: 2527071 - RNA, 18 nt, Chlamydophila pneumoniae CWL029
cagcgauauaagacucca

SEQ ID NO: 2527072 - RNA, 21 nt, Chlamydophila pneumoniae CWL029
cagcgcugugaggaaaauucc

SEQ ID NO: 2527073 - RNA, 19 nt, Chlamydophila pneumoniae CWL029
cagcgguugccuuucucuu

SEQ ID NO: 2527074 - RNA, 23 nt, Chlamydophila pneumoniae CWL029
cagcgugaauaucaucacuaaga

SEQ ID NO: 2527075 - RNA, 20 nt, Chlamydophila pneumoniae CWL029
cagcguugcuaagcauagcc

SEQ ID NO: 2527076 - RNA, 15 nt, Chlamydophila pneumoniae CWL029
cagcuaacgaaguga

SEQ ID NO: 2527077 - RNA, 13 nt, Chlamydophila pneumoniae CWL029
cagcuaaucaauc

SEQ ID NO: 2527078 - RNA, 19 nt, Chlamydophila pneumoniae CWL029
cagcuaaucaauccaagaa

SEQ ID NO: 2527079 - RNA, 19 nt, Chlamydophila pneumoniae CWL029
cagcuaaucauagccauca

SEQ ID NO: 2527080 - RNA, 21 nt, Chlamydophila pneumoniae CWL029
cagcuaaucauagccaucaua

SEQ ID NO: 2527081 - RNA, 19 nt, Chlamydophila pneumoniae CWL029
cagcuaauuuaaaugccuu

SEQ ID NO: 2527082 - RNA, 21 nt, Chlamydophila pneumoniae CWL029
cagcuaauuuaaaugccuuaa

SEQ ID NO: 2527083 - RNA, 14 nt, Chlamydophila pneumoniae CWL029
cagcucccaugugc

SEQ ID NO: 2527084 - RNA, 20 nt, Chlamydophila pneumoniae CWL029
cagcucccaugugcugaaga

SEQ ID NO: 2527085 - RNA, 13 nt, Chlamydophila pneumoniae CWL029
cagcuccuggaua

SEQ ID NO: 2527086 - RNA, 14 nt, Chlamydophila pneumoniae CWL029
cagcucgagaucuu

SEQ ID NO: 2527087 - RNA, 14 nt, Chlamydophila pneumoniae CWL029
cagcucggaaugcu

SEQ ID NO: 2527088 - RNA, 20 nt, Chlamydophila pneumoniae CWL029
cagcugagcuaucuucaagu

SEQ ID NO: 2527089 - RNA, 18 nt, Chlamydophila pneumoniae CWL029
cagcuggguaaguccaca

SEQ ID NO: 2527090 - RNA, 13 nt, Chlamydophila pneumoniae CWL029
cagcuguacagaa

SEQ ID NO: 2527091 - RNA, 19 nt, Chlamydophila pneumoniae CWL029
cagcugucaauccaacaaa

SEQ ID NO: 2527092 - RNA, 13 nt, Chlamydophila pneumoniae CWL029
cagcugugguggu

SEQ ID NO: 2527093 - RNA, 17 nt, Chlamydophila pneumoniae CWL029
cagcuucaggauuagua

SEQ ID NO: 2527094 - RNA, 14 nt, Chlamydophila pneumoniae CWL029
cagcuucaucagaa

SEQ ID NO: 2527095 - RNA, 13 nt, Chlamydophila pneumoniae CWL029
cagcuucccaagc

SEQ ID NO: 2527096 - RNA, 23 nt, Chlamydophila pneumoniae CWL029
cagcuucccaagcagaagacccu

SEQ ID NO: 2527097 - RNA, 18 nt, Chlamydophila pneumoniae CWL029
cagcuucgcaaucuuuga

SEQ ID NO: 2527098 - RNA, 22 nt, Chlamydophila pneumoniae CWL029
cagcuucuggagaaaaaauauc

SEQ ID NO: 2527099 - RNA, 11 nt, Chlamydophila pneumoniae CWL029
cagcuucuuga

SEQ ID NO: 2527100 - RNA, 14 nt, Chlamydophila pneumoniae CWL029
cagcuucuuuucca

SEQ ID NO: 2527101 - RNA, 15 nt, Chlamydophila pneumoniae CWL029
cagcuucuuuuccag

SEQ ID NO: 2527102 - RNA, 20 nt, Chlamydophila pneumoniae CWL029
cagcuuguuuuugcaaggca

SEQ ID NO: 2527103 - RNA, 19 nt, Chlamydophila pneumoniae CWL029
cagcuuugcuuauuucccc

SEQ ID NO: 2527104 - RNA, 17 nt, Chlamydophila pneumoniae CWL029
cagcuuuuucaauagca

SEQ ID NO: 2527105 - RNA, 20 nt, Chlamydophila pneumoniae CWL029
caggaaaacgcccucuagaa

SEQ ID NO: 2527106 - RNA, 18 nt, Chlamydophila pneumoniae CWL029
caggaaacguucuuucaa

SEQ ID NO: 2527107 - RNA, 18 nt, Chlamydophila pneumoniae CWL029
caggaaacuagauuucua

SEQ ID NO: 2527108 - RNA, 21 nt, Chlamydophila pneumoniae CWL029
caggaaauaauuuguuuagaa

SEQ ID NO: 2527109 - RNA, 23 nt, Chlamydophila pneumoniae CWL029
caggaaauaauuuguuuagaaaa

SEQ ID NO: 2527110 - RNA, 13 nt, Chlamydophila pneumoniae CWL029
caggaacaaaggu

SEQ ID NO: 2527111 - RNA, 17 nt, Chlamydophila pneumoniae CWL029
caggaacccuggaugaa

SEQ ID NO: 2527112 - RNA, 16 nt, Chlamydophila pneumoniae CWL029
caggaacuaaaaguuu

SEQ ID NO: 2527113 - RNA, 14 nt, Chlamydophila pneumoniae CWL029
caggaagaaaggau

SEQ ID NO: 2527114 - RNA, 17 nt, Chlamydophila pneumoniae CWL029
caggaaggaauagagaa

SEQ ID NO: 2527115 - RNA, 21 nt, Chlamydophila pneumoniae CWL029
caggaaguaagguuccaaaaa

SEQ ID NO: 2527116 - RNA, 13 nt, Chlamydophila pneumoniae CWL029
caggaaguccaug

SEQ ID NO: 2527117 - RNA, 23 nt, Chlamydophila pneumoniae CWL029
caggaaguccauguacagaaaau

SEQ ID NO: 2527118 - RNA, 19 nt, Chlamydophila pneumoniae CWL029
caggaaguccgauagcaau

SEQ ID NO: 2527119 - RNA, 19 nt, Chlamydophila pneumoniae CWL029
caggaauaaucaaccaaaa

SEQ ID NO: 2527120 - RNA, 18 nt, Chlamydophila pneumoniae CWL029
caggaauucucaucggca

SEQ ID NO: 2527121 - RNA, 17 nt, Chlamydophila pneumoniae CWL029
caggacguaaaaagaaa

SEQ ID NO: 2527122 - RNA, 23 nt, Chlamydophila pneumoniae CWL029
caggacuguuuguuuauuaucua

SEQ ID NO: 2527123 - RNA, 16 nt, Chlamydophila pneumoniae CWL029
caggagagagaaggcu

SEQ ID NO: 2527124 - RNA, 17 nt, Chlamydophila pneumoniae CWL029
caggaguuuuccuaaau

SEQ ID NO: 2527125 - RNA, 17 nt, Chlamydophila pneumoniae CWL029
caggauaccauaaggag

SEQ ID NO: 2527126 - RNA, 15 nt, Chlamydophila pneumoniae CWL029
caggauugauaaaua

SEQ ID NO: 2527127 - RNA, 13 nt, Chlamydophila pneumoniae CWL029
caggauuuuccau

SEQ ID NO: 2527128 - RNA, 15 nt, Chlamydophila pneumoniae CWL029
caggcaucacuaauc

SEQ ID NO: 2527129 - RNA, 20 nt, Chlamydophila pneumoniae CWL029
caggcaucacuaaucucagg

SEQ ID NO: 2527130 - RNA, 14 nt, Chlamydophila pneumoniae CWL029
caggccugaugucu

SEQ ID NO: 2527131 - RNA, 14 nt, Chlamydophila pneumoniae CWL029
caggcuacauaguu

SEQ ID NO: 2527132 - RNA, 21 nt, Chlamydophila pneumoniae CWL029
caggcuccaucacgaggagcu

SEQ ID NO: 2527133 - RNA, 14 nt, Chlamydophila pneumoniae CWL029
caggcugaaccaaa

SEQ ID NO: 2527134 - RNA, 23 nt, Chlamydophila pneumoniae CWL029
caggcugaaccaaaucuaucugc

SEQ ID NO: 2527135 - RNA, 13 nt, Chlamydophila pneumoniae CWL029
caggcuucaccau

SEQ ID NO: 2527136 - RNA, 17 nt, Chlamydophila pneumoniae CWL029
cagggaaagaacagcag

SEQ ID NO: 2527137 - RNA, 23 nt, Chlamydophila pneumoniae CWL029
cagggaaagaacagcagaaacgg

SEQ ID NO: 2527138 - RNA, 14 nt, Chlamydophila pneumoniae CWL029
cagggacagaaguc

SEQ ID NO: 2527139 - RNA, 12 nt, Chlamydophila pneumoniae CWL029
cagggauauuuu

SEQ ID NO: 2527140 - RNA, 24 nt, Chlamydophila pneumoniae CWL029
cagggauauuuugagcuacaagaa

SEQ ID NO: 2527141 - RNA, 14 nt, Chlamydophila pneumoniae CWL029
cagggaucuucauc

SEQ ID NO: 2527142 - RNA, 13 nt, Chlamydophila pneumoniae CWL029
caggggugagauc

SEQ ID NO: 2527143 - RNA, 22 nt, Chlamydophila pneumoniae CWL029
caggguuucucggauccuccaa

SEQ ID NO: 2527144 - RNA, 14 nt, Chlamydophila pneumoniae CWL029
cagguaaacaacaa

SEQ ID NO: 2527145 - RNA, 19 nt, Chlamydophila pneumoniae CWL029
cagguagagugucuuccuu

SEQ ID NO: 2527146 - RNA, 14 nt, Chlamydophila pneumoniae CWL029
cagguaguaggaca

SEQ ID NO: 2527147 - RNA, 13 nt, Chlamydophila pneumoniae CWL029
cagguagucccuu

SEQ ID NO: 2527148 - RNA, 18 nt, Chlamydophila pneumoniae CWL029
cagguccuucuggaguga

SEQ ID NO: 2527149 - RNA, 18 nt, Chlamydophila pneumoniae CWL029
caggucugcugaggagag

SEQ ID NO: 2527150 - RNA, 18 nt, Chlamydophila pneumoniae CWL029
cagguucugaaauugucu

SEQ ID NO: 2527151 - RNA, 21 nt, Chlamydophila pneumoniae CWL029
cagguucugaaauugucuuca

SEQ ID NO: 2527152 - RNA, 20 nt, Chlamydophila pneumoniae CWL029
cagguuguccuauagagaau

SEQ ID NO: 2527153 - RNA, 20 nt, Chlamydophila pneumoniae CWL029
caguaaaacacaaauagcaa

SEQ ID NO: 2527154 - RNA, 22 nt, Chlamydophila pneumoniae CWL029
caguaaaagacugaaaagaucg

SEQ ID NO: 2527155 - RNA, 19 nt, Chlamydophila pneumoniae CWL029
caguaaaaggucugcgucu

SEQ ID NO: 2527156 - RNA, 23 nt, Chlamydophila pneumoniae CWL029
caguaauuccaaaauaaaaggag

SEQ ID NO: 2527157 - RNA, 18 nt, Chlamydophila pneumoniae CWL029
caguacuaaauuaguaaa

SEQ ID NO: 2527158 - RNA, 16 nt, Chlamydophila pneumoniae CWL029
caguagaucuucugaa

SEQ ID NO: 2527159 - RNA, 15 nt, Chlamydophila pneumoniae CWL029
caguagccuucuucu

SEQ ID NO: 2527160 - RNA, 14 nt, Chlamydophila pneumoniae CWL029
caguaggagcagcg

SEQ ID NO: 2527161 - RNA, 16 nt, Chlamydophila pneumoniae CWL029
caguaguaaauaauaa

SEQ ID NO: 2527162 - RNA, 14 nt, Chlamydophila pneumoniae CWL029
caguaguguaucua

SEQ ID NO: 2527163 - RNA, 17 nt, Chlamydophila pneumoniae CWL029
caguauaagaugcugaa

SEQ ID NO: 2527164 - RNA, 16 nt, Chlamydophila pneumoniae CWL029
caguauaaucagaagu

SEQ ID NO: 2527165 - RNA, 15 nt, Chlamydophila pneumoniae CWL029
caguaucguaacuuc

SEQ ID NO: 2527166 - RNA, 21 nt, Chlamydophila pneumoniae CWL029
caguaucguaacuuccuuuuu

SEQ ID NO: 2527167 - RNA, 17 nt, Chlamydophila pneumoniae CWL029
caguauggcguuuuuuu

SEQ ID NO: 2527168 - RNA, 19 nt, Chlamydophila pneumoniae CWL029
caguauggcguuuuuuuug

SEQ ID NO: 2527169 - RNA, 18 nt, Chlamydophila pneumoniae CWL029
caguauucccuccgcagu

SEQ ID NO: 2527170 - RNA, 17 nt, Chlamydophila pneumoniae CWL029
cagucacaauauagccc

SEQ ID NO: 2527171 - RNA, 13 nt, Chlamydophila pneumoniae CWL029
caguccucucccu

SEQ ID NO: 2527172 - RNA, 14 nt, Chlamydophila pneumoniae CWL029
caguccucucccuu

SEQ ID NO: 2527173 - RNA, 15 nt, Chlamydophila pneumoniae CWL029
cagucguauucaggu

SEQ ID NO: 2527174 - RNA, 19 nt, Chlamydophila pneumoniae CWL029
cagucgugagaagcaucuu

SEQ ID NO: 2527175 - RNA, 18 nt, Chlamydophila pneumoniae CWL029
cagucuauagccucuucu

SEQ ID NO: 2527176 - RNA, 16 nt, Chlamydophila pneumoniae CWL029
cagucucgaguccagu

SEQ ID NO: 2527177 - RNA, 20 nt, Chlamydophila pneumoniae CWL029
cagucuggcuuaggaggagg

SEQ ID NO: 2527178 - RNA, 15 nt, Chlamydophila pneumoniae CWL029
cagucugugagaaau

SEQ ID NO: 2527179 - RNA, 19 nt, Chlamydophila pneumoniae CWL029
cagucugugagaaauaggu

SEQ ID NO: 2527180 - RNA, 17 nt, Chlamydophila pneumoniae CWL029
cagugaaauuuugcaac

SEQ ID NO: 2527181 - RNA, 19 nt, Chlamydophila pneumoniae CWL029
cagugaacucuucaagagc

SEQ ID NO: 2527182 - RNA, 15 nt, Chlamydophila pneumoniae CWL029
cagugaauccuucca

SEQ ID NO: 2527183 - RNA, 21 nt, Chlamydophila pneumoniae CWL029
cagugauuccugucauuccua

SEQ ID NO: 2527184 - RNA, 16 nt, Chlamydophila pneumoniae CWL029
cagugcugccaugaca

SEQ ID NO: 2527185 - RNA, 20 nt, Chlamydophila pneumoniae CWL029
caguggacggggagagccau

SEQ ID NO: 2527186 - RNA, 16 nt, Chlamydophila pneumoniae CWL029
caguguauaacguaga

SEQ ID NO: 2527187 - RNA, 18 nt, Chlamydophila pneumoniae CWL029
caguguauuguuugcuau

SEQ ID NO: 2527188 - RNA, 15 nt, Chlamydophila pneumoniae CWL029
cagugugcugauuuu

SEQ ID NO: 2527189 - RNA, 13 nt, Chlamydophila pneumoniae CWL029
caguuaaagagca

SEQ ID NO: 2527190 - RNA, 16 nt, Chlamydophila pneumoniae CWL029
caguucaucuagauga

SEQ ID NO: 2527191 - RNA, 21 nt, Chlamydophila pneumoniae CWL029
caguucauguugcucauccuu

SEQ ID NO: 2527192 - RNA, 15 nt, Chlamydophila pneumoniae CWL029
caguuccauagcuaa

SEQ ID NO: 2527193 - RNA, 17 nt, Chlamydophila pneumoniae CWL029
caguuccgauaaagaua

SEQ ID NO: 2527194 - RNA, 19 nt, Chlamydophila pneumoniae CWL029
caguucgugagagucagga

SEQ ID NO: 2527195 - RNA, 22 nt, Chlamydophila pneumoniae CWL029
caguucuucauuccaggauucu

SEQ ID NO: 2527196 - RNA, 21 nt, Chlamydophila pneumoniae CWL029
caguucuugaaacucuaucag

SEQ ID NO: 2527197 - RNA, 22 nt, Chlamydophila pneumoniae CWL029
caguucuuguuaaaguaaaaaa

SEQ ID NO: 2527198 - RNA, 15 nt, Chlamydophila pneumoniae CWL029
caguucuuucugcuu

SEQ ID NO: 2527199 - RNA, 16 nt, Chlamydophila pneumoniae CWL029
caguugaugagaaaaa

SEQ ID NO: 2527200 - RNA, 20 nt, Chlamydophila pneumoniae CWL029
caguugaugagaaaaagaau

SEQ ID NO: 2527201 - RNA, 23 nt, Chlamydophila pneumoniae CWL029
caguugaugagaaaaagaaucuc

SEQ ID NO: 2527202 - RNA, 15 nt, Chlamydophila pneumoniae CWL029
caguugcaauaccaa

SEQ ID NO: 2527203 - RNA, 13 nt, Chlamydophila pneumoniae CWL029
caguugcggagau

SEQ ID NO: 2527204 - RNA, 17 nt, Chlamydophila pneumoniae CWL029
caguuggcguuuucuag

SEQ ID NO: 2527205 - RNA, 21 nt, Chlamydophila pneumoniae CWL029
caguuuuaucggcaauuguua

SEQ ID NO: 2527206 - RNA, 22 nt, Chlamydophila pneumoniae CWL029
caguuuuaucggcaauuguuaa

SEQ ID NO: 2527207 - RNA, 18 nt, Chlamydophila pneumoniae CWL029
caguuuuuuucuaaauuu

SEQ ID NO: 2527208 - RNA, 16 nt, Chlamydophila pneumoniae CWL029
cauaaaaauucucaua

SEQ ID NO: 2527209 - RNA, 15 nt, Chlamydophila pneumoniae CWL029
cauaaacaauucaug

SEQ ID NO: 2527210 - RNA, 20 nt, Chlamydophila pneumoniae CWL029
cauaaacaucgcagcaggau

SEQ ID NO: 2527211 - RNA, 16 nt, Chlamydophila pneumoniae CWL029
cauaaagacccuucuu

SEQ ID NO: 2527212 - RNA, 23 nt, Chlamydophila pneumoniae CWL029
cauaaagaccgagaagcuucaau

SEQ ID NO: 2527213 - RNA, 22 nt, Chlamydophila pneumoniae CWL029
cauaaagaucgugaucaaagaa

SEQ ID NO: 2527214 - RNA, 22 nt, Chlamydophila pneumoniae CWL029
cauaaagccccacccacuccag

SEQ ID NO: 2527215 - RNA, 22 nt, Chlamydophila pneumoniae CWL029
cauaaaggcgucgccccaugaa

SEQ ID NO: 2527216 - RNA, 15 nt, Chlamydophila pneumoniae CWL029
cauaaaggcucuuuu

SEQ ID NO: 2527217 - RNA, 19 nt, Chlamydophila pneumoniae CWL029
cauaaauacgugcuugaau

SEQ ID NO: 2527218 - RNA, 21 nt, Chlamydophila pneumoniae CWL029
cauaaauacgugcuugaauau

SEQ ID NO: 2527219 - RNA, 13 nt, Chlamydophila pneumoniae CWL029
cauaacauugcuu

SEQ ID NO: 2527220 - RNA, 15 nt, Chlamydophila pneumoniae CWL029
cauaacauugcuugc

SEQ ID NO: 2527221 - RNA, 22 nt, Chlamydophila pneumoniae CWL029
cauaacauuuagauaaagaaag

SEQ ID NO: 2527222 - RNA, 20 nt, Chlamydophila pneumoniae CWL029
cauaacgacaugccuuggua

SEQ ID NO: 2527223 - RNA, 18 nt, Chlamydophila pneumoniae CWL029
cauaacgggguugucucu

SEQ ID NO: 2527224 - RNA, 14 nt, Chlamydophila pneumoniae CWL029
cauaacuugaagaa

SEQ ID NO: 2527225 - RNA, 15 nt, Chlamydophila pneumoniae CWL029
cauaacuugaagaag

SEQ ID NO: 2527226 - RNA, 22 nt, Chlamydophila pneumoniae CWL029
cauaacuugaagaaguacaagu

SEQ ID NO: 2527227 - RNA, 11 nt, Chlamydophila pneumoniae CWL029
cauaagaacuc

SEQ ID NO: 2527228 - RNA, 17 nt, Chlamydophila pneumoniae CWL029
cauaagaacucuauuug

SEQ ID NO: 2527229 - RNA, 14 nt, Chlamydophila pneumoniae CWL029
cauaagagaacuuu

SEQ ID NO: 2527230 - RNA, 19 nt, Chlamydophila pneumoniae CWL029
cauaagagacauuucuuga

SEQ ID NO: 2527231 - RNA, 24 nt, Chlamydophila pneumoniae CWL029
cauaagaguagacaagagagagcu

SEQ ID NO: 2527232 - RNA, 19 nt, Chlamydophila pneumoniae CWL029
cauaagaucaauauagaga

SEQ ID NO: 2527233 - RNA, 20 nt, Chlamydophila pneumoniae CWL029
cauaagaucaauauagagaa

SEQ ID NO: 2527234 - RNA, 20 nt, Chlamydophila pneumoniae CWL029
cauaagauugccauguacau

SEQ ID NO: 2527235 - RNA, 14 nt, Chlamydophila pneumoniae CWL029
cauaagcuuuucuu

SEQ ID NO: 2527236 - RNA, 15 nt, Chlamydophila pneumoniae CWL029
cauaaguuagccugg

SEQ ID NO: 2527237 - RNA, 13 nt, Chlamydophila pneumoniae CWL029
cauaauagucucu

SEQ ID NO: 2527238 - RNA, 17 nt, Chlamydophila pneumoniae CWL029
cauaauagucucuguaa

SEQ ID NO: 2527239 - RNA, 12 nt, Chlamydophila pneumoniae CWL029
cauaauccaaga

SEQ ID NO: 2527240 - RNA, 13 nt, Chlamydophila pneumoniae CWL029
cauaauccaagau

SEQ ID NO: 2527241 - RNA, 20 nt, Chlamydophila pneumoniae CWL029
cauaauccugaauggcucug

SEQ ID NO: 2527242 - RNA, 16 nt, Chlamydophila pneumoniae CWL029
cauaaucucaccagaa

SEQ ID NO: 2527243 - RNA, 20 nt, Chlamydophila pneumoniae CWL029
cauaaucucaccagaagcaa

SEQ ID NO: 2527244 - RNA, 12 nt, Chlamydophila pneumoniae CWL029
cauaaucuccaa

SEQ ID NO: 2527245 - RNA, 22 nt, Chlamydophila pneumoniae CWL029
cauaaucuccaaacauuuuuaa

SEQ ID NO: 2527246 - RNA, 21 nt, Chlamydophila pneumoniae CWL029
cauacaggcuccucugcuaag

SEQ ID NO: 2527247 - RNA, 23 nt, Chlamydophila pneumoniae CWL029
cauacaggcuccucugcuaagca

SEQ ID NO: 2527248 - RNA, 17 nt, Chlamydophila pneumoniae CWL029
cauacccuucuucuuca

SEQ ID NO: 2527249 - RNA, 16 nt, Chlamydophila pneumoniae CWL029
cauacgguaaggagga

SEQ ID NO: 2527250 - RNA, 14 nt, Chlamydophila pneumoniae CWL029
cauacgguauacca

SEQ ID NO: 2527251 - RNA, 16 nt, Chlamydophila pneumoniae CWL029
cauacuacucucauca

SEQ ID NO: 2527252 - RNA, 14 nt, Chlamydophila pneumoniae CWL029
cauacucgucaaau

SEQ ID NO: 2527253 - RNA, 23 nt, Chlamydophila pneumoniae CWL029
cauacucgucaaauucauuaaga

SEQ ID NO: 2527254 - RNA, 20 nt, Chlamydophila pneumoniae CWL029
cauacugauauacaguuggc

SEQ ID NO: 2527255 - RNA, 20 nt, Chlamydophila pneumoniae CWL029
cauagaauaaagauuuuagg

SEQ ID NO: 2527256 - RNA, 23 nt, Chlamydophila pneumoniae CWL029
cauagagagaaggaauuaaaaua

SEQ ID NO: 2527257 - RNA, 18 nt, Chlamydophila pneumoniae CWL029
cauagagagccuuuccua

SEQ ID NO: 2527258 - RNA, 15 nt, Chlamydophila pneumoniae CWL029
cauagagauaucauc

SEQ ID NO: 2527259 - RNA, 12 nt, Chlamydophila pneumoniae CWL029
cauagaggagau

SEQ ID NO: 2527260 - RNA, 16 nt, Chlamydophila pneumoniae CWL029
cauagaguaucuaaaa

SEQ ID NO: 2527261 - RNA, 18 nt, Chlamydophila pneumoniae CWL029
cauagagugugccagaau

SEQ ID NO: 2527262 - RNA, 15 nt, Chlamydophila pneumoniae CWL029
cauagauacaaacau

SEQ ID NO: 2527263 - RNA, 20 nt, Chlamydophila pneumoniae CWL029
cauagcaacuacagagggcu

SEQ ID NO: 2527264 - RNA, 16 nt, Chlamydophila pneumoniae CWL029
cauagccaucauagca

SEQ ID NO: 2527265 - RNA, 17 nt, Chlamydophila pneumoniae CWL029
cauagccaucauagcaa

SEQ ID NO: 2527266 - RNA, 18 nt, Chlamydophila pneumoniae CWL029
cauagccaucauagcaaa

SEQ ID NO: 2527267 - RNA, 19 nt, Chlamydophila pneumoniae CWL029
cauagccuuccuguuaagg

SEQ ID NO: 2527268 - RNA, 14 nt, Chlamydophila pneumoniae CWL029
cauagcgaaaguca

SEQ ID NO: 2527269 - RNA, 17 nt, Chlamydophila pneumoniae CWL029
cauagcguauuccccac

SEQ ID NO: 2527270 - RNA, 17 nt, Chlamydophila pneumoniae CWL029
cauaggauccaggaguu

SEQ ID NO: 2527271 - RNA, 18 nt, Chlamydophila pneumoniae CWL029
cauagggaugacccaaaa

SEQ ID NO: 2527272 - RNA, 19 nt, Chlamydophila pneumoniae CWL029
cauagggaugacccaaaaa

SEQ ID NO: 2527273 - RNA, 20 nt, Chlamydophila pneumoniae CWL029
cauagguaaaaccagcauaa

SEQ ID NO: 2527274 - RNA, 19 nt, Chlamydophila pneumoniae CWL029
cauagguaauacgagagga

SEQ ID NO: 2527275 - RNA, 15 nt, Chlamydophila pneumoniae CWL029
cauaguauggcauuc

SEQ ID NO: 2527276 - RNA, 20 nt, Chlamydophila pneumoniae CWL029
cauaguauggcauucuuuuu

SEQ ID NO: 2527277 - RNA, 18 nt, Chlamydophila pneumoniae CWL029
cauagucgucuuuuaaag

SEQ ID NO: 2527278 - RNA, 17 nt, Chlamydophila pneumoniae CWL029
cauagucguuuucucga

SEQ ID NO: 2527279 - RNA, 15 nt, Chlamydophila pneumoniae CWL029
cauaguggcucagug

SEQ ID NO: 2527280 - RNA, 14 nt, Chlamydophila pneumoniae CWL029
cauaguguuccaaa

SEQ ID NO: 2527281 - RNA, 20 nt, Chlamydophila pneumoniae CWL029
cauaguuaaauuuccaaaga

SEQ ID NO: 2527282 - RNA, 22 nt, Chlamydophila pneumoniae CWL029
cauaguuuuuauuuuuaaauaa

SEQ ID NO: 2527283 - RNA, 19 nt, Chlamydophila pneumoniae CWL029
cauaucaucgauaucuaag

SEQ ID NO: 2527284 - RNA, 17 nt, Chlamydophila pneumoniae CWL029
cauauccauggaauggc

SEQ ID NO: 2527285 - RNA, 15 nt, Chlamydophila pneumoniae CWL029
cauaucggcagcagc

SEQ ID NO: 2527286 - RNA, 19 nt, Chlamydophila pneumoniae CWL029
cauaucuccuuuaaauaaa

SEQ ID NO: 2527287 - RNA, 14 nt, Chlamydophila pneumoniae CWL029
cauaugcuccagaa

SEQ ID NO: 2527288 - RNA, 22 nt, Chlamydophila pneumoniae CWL029
cauauggauugucgaugaggga

SEQ ID NO: 2527289 - RNA, 17 nt, Chlamydophila pneumoniae CWL029
cauaugggacuucaagc

SEQ ID NO: 2527290 - RNA, 12 nt, Chlamydophila pneumoniae CWL029
cauauugcaaag

SEQ ID NO: 2527291 - RNA, 15 nt, Chlamydophila pneumoniae CWL029
cauauugcaaagcau

SEQ ID NO: 2527292 - RNA, 14 nt, Chlamydophila pneumoniae CWL029
cauauugccuucuu

SEQ ID NO: 2527293 - RNA, 18 nt, Chlamydophila pneumoniae CWL029
cauauuuacgaaaacauc

SEQ ID NO: 2527294 - RNA, 16 nt, Chlamydophila pneumoniae CWL029
cauauuuauuuaaacc

SEQ ID NO: 2527295 - RNA, 15 nt, Chlamydophila pneumoniae CWL029
cauauuuugucuuca

SEQ ID NO: 2527296 - RNA, 17 nt, Chlamydophila pneumoniae CWL029
cauauuuugucuucauc

SEQ ID NO: 2527297 - RNA, 20 nt, Chlamydophila pneumoniae CWL029
cauauuuuucuugaagguuc

SEQ ID NO: 2527298 - RNA, 12 nt, Chlamydophila pneumoniae CWL029
caucaaaaagau

SEQ ID NO: 2527299 - RNA, 14 nt, Chlamydophila pneumoniae CWL029
caucaaagaauuau

SEQ ID NO: 2527300 - RNA, 12 nt, Chlamydophila pneumoniae CWL029
caucaagagaua

SEQ ID NO: 2527301 - RNA, 15 nt, Chlamydophila pneumoniae CWL029
caucaaucacucuau

SEQ ID NO: 2527302 - RNA, 21 nt, Chlamydophila pneumoniae CWL029
caucaaucacucuaugaucua

SEQ ID NO: 2527303 - RNA, 23 nt, Chlamydophila pneumoniae CWL029
caucaaugauaucgccuuccuua

SEQ ID NO: 2527304 - RNA, 21 nt, Chlamydophila pneumoniae CWL029
caucaaugcgauuacuucacg

SEQ ID NO: 2527305 - RNA, 20 nt, Chlamydophila pneumoniae CWL029
caucaaugguuaaaacccau

SEQ ID NO: 2527306 - RNA, 19 nt, Chlamydophila pneumoniae CWL029
caucacaaacuaaaucaac

SEQ ID NO: 2527307 - RNA, 22 nt, Chlamydophila pneumoniae CWL029
caucaccuucggaucuucccau

SEQ ID NO: 2527308 - RNA, 23 nt, Chlamydophila pneumoniae CWL029
caucaccuucggaucuucccauu

SEQ ID NO: 2527309 - RNA, 18 nt, Chlamydophila pneumoniae CWL029
caucacgaaaaggagaau

SEQ ID NO: 2527310 - RNA, 23 nt, Chlamydophila pneumoniae CWL029
caucacuaagauacgaaguccca

SEQ ID NO: 2527311 - RNA, 14 nt, Chlamydophila pneumoniae CWL029
caucacuaaucuca

SEQ ID NO: 2527312 - RNA, 15 nt, Chlamydophila pneumoniae CWL029
caucacuuauauuuu

SEQ ID NO: 2527313 - RNA, 21 nt, Chlamydophila pneumoniae CWL029
caucagaaguggccuugccag

SEQ ID NO: 2527314 - RNA, 17 nt, Chlamydophila pneumoniae CWL029
caucagacugaagagca

SEQ ID NO: 2527315 - RNA, 18 nt, Chlamydophila pneumoniae CWL029
caucagagaacucuuaaa

SEQ ID NO: 2527316 - RNA, 16 nt, Chlamydophila pneumoniae CWL029
caucagaggccaccaa

SEQ ID NO: 2527317 - RNA, 19 nt, Chlamydophila pneumoniae CWL029
caucagcaaaacucccgac

SEQ ID NO: 2527318 - RNA, 13 nt, Chlamydophila pneumoniae CWL029
caucaggauucuc

SEQ ID NO: 2527319 - RNA, 16 nt, Chlamydophila pneumoniae CWL029
caucaggauucucucu

SEQ ID NO: 2527320 - RNA, 13 nt, Chlamydophila pneumoniae CWL029
caucaguaaaaga

SEQ ID NO: 2527321 - RNA, 19 nt, Chlamydophila pneumoniae CWL029
caucaguggauucgugcuu

SEQ ID NO: 2527322 - RNA, 13 nt, Chlamydophila pneumoniae CWL029
caucaguuccauu

SEQ ID NO: 2527323 - RNA, 21 nt, Chlamydophila pneumoniae CWL029
caucauaaagugcgagguaug

SEQ ID NO: 2527324 - RNA, 12 nt, Chlamydophila pneumoniae CWL029
caucaucaccag

SEQ ID NO: 2527325 - RNA, 14 nt, Chlamydophila pneumoniae CWL029
caucaucagaagcu

SEQ ID NO: 2527326 - RNA, 16 nt, Chlamydophila pneumoniae CWL029
cauccaaauagaguga

SEQ ID NO: 2527327 - RNA, 16 nt, Chlamydophila pneumoniae CWL029
cauccagacaagacac

SEQ ID NO: 2527328 - RNA, 18 nt, Chlamydophila pneumoniae CWL029
cauccauucuuaauauaa

SEQ ID NO: 2527329 - RNA, 22 nt, Chlamydophila pneumoniae CWL029
cauccauucuuaauauaaaaga

SEQ ID NO: 2527330 - RNA, 17 nt, Chlamydophila pneumoniae CWL029
caucccauucaauaauu

SEQ ID NO: 2527331 - RNA, 21 nt, Chlamydophila pneumoniae CWL029
caucccgaacgcuagggaaac

SEQ ID NO: 2527332 - RNA, 22 nt, Chlamydophila pneumoniae CWL029
caucccuagggaaagcaucuuu

SEQ ID NO: 2527333 - RNA, 12 nt, Chlamydophila pneumoniae CWL029
caucccuucuuc

SEQ ID NO: 2527334 - RNA, 17 nt, Chlamydophila pneumoniae CWL029
caucccuucuucuuuua

SEQ ID NO: 2527335 - RNA, 15 nt, Chlamydophila pneumoniae CWL029
cauccgaagacucaa

SEQ ID NO: 2527336 - RNA, 22 nt, Chlamydophila pneumoniae CWL029
cauccuguagagcaagauucuu

SEQ ID NO: 2527337 - RNA, 19 nt, Chlamydophila pneumoniae CWL029
cauccugucuauuucuuaa

SEQ ID NO: 2527338 - RNA, 18 nt, Chlamydophila pneumoniae CWL029
cauccuucuuuaccuaug

SEQ ID NO: 2527339 - RNA, 18 nt, Chlamydophila pneumoniae CWL029
cauccuuguagaacuucu

SEQ ID NO: 2527340 - RNA, 22 nt, Chlamydophila pneumoniae CWL029
cauccuuguagaacuucucaag

SEQ ID NO: 2527341 - RNA, 21 nt, Chlamydophila pneumoniae CWL029
caucgaaaccacagcaaagac

SEQ ID NO: 2527342 - RNA, 12 nt, Chlamydophila pneumoniae CWL029
caucgaagaacu

SEQ ID NO: 2527343 - RNA, 17 nt, Chlamydophila pneumoniae CWL029
caucgacaaguaccuuc

SEQ ID NO: 2527344 - RNA, 18 nt, Chlamydophila pneumoniae CWL029
caucgacaaguaccuucu

SEQ ID NO: 2527345 - RNA, 15 nt, Chlamydophila pneumoniae CWL029
caucgcaguuccaua

SEQ ID NO: 2527346 - RNA, 22 nt, Chlamydophila pneumoniae CWL029
caucgccgaccaucauaauuug

SEQ ID NO: 2527347 - RNA, 18 nt, Chlamydophila pneumoniae CWL029
caucggagaacuuccuga

SEQ ID NO: 2527348 - RNA, 21 nt, Chlamydophila pneumoniae CWL029
caucggcauaacuuuaucaua

SEQ ID NO: 2527349 - RNA, 22 nt, Chlamydophila pneumoniae CWL029
caucggcauuucuccacaugcc

SEQ ID NO: 2527350 - RNA, 23 nt, Chlamydophila pneumoniae CWL029
caucggcuucuccaacuuccaua

SEQ ID NO: 2527351 - RNA, 17 nt, Chlamydophila pneumoniae CWL029
caucgguuuccaagaca

SEQ ID NO: 2527352 - RNA, 14 nt, Chlamydophila pneumoniae CWL029
caucguuaauauaa

SEQ ID NO: 2527353 - RNA, 17 nt, Chlamydophila pneumoniae CWL029
caucuacgauguuuucu

SEQ ID NO: 2527354 - RNA, 19 nt, Chlamydophila pneumoniae CWL029
caucuacgauguuuucuua

SEQ ID NO: 2527355 - RNA, 21 nt, Chlamydophila pneumoniae CWL029
caucuacgauguuuucuuauc

SEQ ID NO: 2527356 - RNA, 13 nt, Chlamydophila pneumoniae CWL029
caucucacagaua

SEQ ID NO: 2527357 - RNA, 16 nt, Chlamydophila pneumoniae CWL029
caucucauaguuucua

SEQ ID NO: 2527358 - RNA, 15 nt, Chlamydophila pneumoniae CWL029
caucuccaagauaau

SEQ ID NO: 2527359 - RNA, 13 nt, Chlamydophila pneumoniae CWL029
caucuccugaagc

SEQ ID NO: 2527360 - RNA, 14 nt, Chlamydophila pneumoniae CWL029
caucuccugaagcc

SEQ ID NO: 2527361 - RNA, 22 nt, Chlamydophila pneumoniae CWL029
caucucguugggcucauaaccc

SEQ ID NO: 2527362 - RNA, 14 nt, Chlamydophila pneumoniae CWL029
caucucucuccaaa

SEQ ID NO: 2527363 - RNA, 13 nt, Chlamydophila pneumoniae CWL029
caucucucuuuaa

SEQ ID NO: 2527364 - RNA, 12 nt, Chlamydophila pneumoniae CWL029
caucucuggaau

SEQ ID NO: 2527365 - RNA, 18 nt, Chlamydophila pneumoniae CWL029
caucugauacuguuuuuu

SEQ ID NO: 2527366 - RNA, 18 nt, Chlamydophila pneumoniae CWL029
caucugcguuuaaggguu

SEQ ID NO: 2527367 - RNA, 17 nt, Chlamydophila pneumoniae CWL029
caucuucacuaaaugac

SEQ ID NO: 2527368 - RNA, 21 nt, Chlamydophila pneumoniae CWL029
caucuucucgaacaggagaga

SEQ ID NO: 2527369 - RNA, 17 nt, Chlamydophila pneumoniae CWL029
caucuucuuggcuuucc

SEQ ID NO: 2527370 - RNA, 16 nt, Chlamydophila pneumoniae CWL029
caucuucuuugccaau

SEQ ID NO: 2527371 - RNA, 12 nt, Chlamydophila pneumoniae CWL029
caucuuguucug

SEQ ID NO: 2527372 - RNA, 13 nt, Chlamydophila pneumoniae CWL029
caucuuucaucaa

SEQ ID NO: 2527373 - RNA, 16 nt, Chlamydophila pneumoniae CWL029
caucuuuucaaaagaa

SEQ ID NO: 2527374 - RNA, 16 nt, Chlamydophila pneumoniae CWL029
caugaaaaaagaauaa

SEQ ID NO: 2527375 - RNA, 21 nt, Chlamydophila pneumoniae CWL029
caugaaaagcuagucuucuua

SEQ ID NO: 2527376 - RNA, 14 nt, Chlamydophila pneumoniae CWL029
caugaaagauaaug

SEQ ID NO: 2527377 - RNA, 19 nt, Chlamydophila pneumoniae CWL029
caugaaauaguguuucuuu

SEQ ID NO: 2527378 - RNA, 21 nt, Chlamydophila pneumoniae CWL029
caugaaauaguguuucuuuau

SEQ ID NO: 2527379 - RNA, 16 nt, Chlamydophila pneumoniae CWL029
caugaacgugcaucuc

SEQ ID NO: 2527380 - RNA, 17 nt, Chlamydophila pneumoniae CWL029
caugaagcagaaacuuu

SEQ ID NO: 2527381 - RNA, 20 nt, Chlamydophila pneumoniae CWL029
caugaaguccuguauauucu

SEQ ID NO: 2527382 - RNA, 15 nt, Chlamydophila pneumoniae CWL029
caugaaucucuucug

SEQ ID NO: 2527383 - RNA, 19 nt, Chlamydophila pneumoniae CWL029
caugaaucucuucuguagg

SEQ ID NO: 2527384 - RNA, 18 nt, Chlamydophila pneumoniae CWL029
caugaaucugguuccuua

SEQ ID NO: 2527385 - RNA, 22 nt, Chlamydophila pneumoniae CWL029
caugaaucuuaugggagaagcu

SEQ ID NO: 2527386 - RNA, 15 nt, Chlamydophila pneumoniae CWL029
caugacauaggcaaa

SEQ ID NO: 2527387 - RNA, 20 nt, Chlamydophila pneumoniae CWL029
caugaccuuuagcugcugaa

SEQ ID NO: 2527388 - RNA, 15 nt, Chlamydophila pneumoniae CWL029
caugacgcuuuucca

SEQ ID NO: 2527389 - RNA, 19 nt, Chlamydophila pneumoniae CWL029
caugacgcuuuuccaaagc

SEQ ID NO: 2527390 - RNA, 21 nt, Chlamydophila pneumoniae CWL029
caugagagucgaaacacucau

SEQ ID NO: 2527391 - RNA, 21 nt, Chlamydophila pneumoniae CWL029
caugagccgauguugcagaau

SEQ ID NO: 2527392 - RNA, 23 nt, Chlamydophila pneumoniae CWL029
caugagggcaugccuaucuaucu

SEQ ID NO: 2527393 - RNA, 14 nt, Chlamydophila pneumoniae CWL029
caugaguuuuucag

SEQ ID NO: 2527394 - RNA, 20 nt, Chlamydophila pneumoniae CWL029
caugaguuuuucagauguac

SEQ ID NO: 2527395 - RNA, 21 nt, Chlamydophila pneumoniae CWL029
caugauaaaaauuuucaggaa

SEQ ID NO: 2527396 - RNA, 20 nt, Chlamydophila pneumoniae CWL029
caugauauuuuuauuuaaaa

SEQ ID NO: 2527397 - RNA, 15 nt, Chlamydophila pneumoniae CWL029
caugaucuuuaggaa

SEQ ID NO: 2527398 - RNA, 17 nt, Chlamydophila pneumoniae CWL029
caugcaauacuuuucuc

SEQ ID NO: 2527399 - RNA, 16 nt, Chlamydophila pneumoniae CWL029
caugcauagaauaaag

SEQ ID NO: 2527400 - RNA, 13 nt, Chlamydophila pneumoniae CWL029
caugcauagcuga

SEQ ID NO: 2527401 - RNA, 19 nt, Chlamydophila pneumoniae CWL029
caugccgcauuucuucaau

SEQ ID NO: 2527402 - RNA, 16 nt, Chlamydophila pneumoniae CWL029
caugccugaaaacaag

SEQ ID NO: 2527403 - RNA, 17 nt, Chlamydophila pneumoniae CWL029
caugcgaagggaggaga

SEQ ID NO: 2527404 - RNA, 18 nt, Chlamydophila pneumoniae CWL029
caugcgcagaauaaaaug

SEQ ID NO: 2527405 - RNA, 19 nt, Chlamydophila pneumoniae CWL029
caugcgcagaauaaaaugg

SEQ ID NO: 2527406 - RNA, 17 nt, Chlamydophila pneumoniae CWL029
caugcucaagaagauga

SEQ ID NO: 2527407 - RNA, 13 nt, Chlamydophila pneumoniae CWL029
caugcuugaggaa

SEQ ID NO: 2527408 - RNA, 16 nt, Chlamydophila pneumoniae CWL029
cauggacaauauagag

SEQ ID NO: 2527409 - RNA, 15 nt, Chlamydophila pneumoniae CWL029
cauggauauggaaug

SEQ ID NO: 2527410 - RNA, 20 nt, Chlamydophila pneumoniae CWL029
cauggauucacaucuuaaaa

SEQ ID NO: 2527411 - RNA, 17 nt, Chlamydophila pneumoniae CWL029
cauggcccgauacaaau

SEQ ID NO: 2527412 - RNA, 14 nt, Chlamydophila pneumoniae CWL029
cauggcgaggggcc

SEQ ID NO: 2527413 - RNA, 15 nt, Chlamydophila pneumoniae CWL029
cauggcguaaugcuc

SEQ ID NO: 2527414 - RNA, 19 nt, Chlamydophila pneumoniae CWL029
cauggcuggaaagccaagc

SEQ ID NO: 2527415 - RNA, 18 nt, Chlamydophila pneumoniae CWL029
cauguacaguuuguaaaa

SEQ ID NO: 2527416 - RNA, 20 nt, Chlamydophila pneumoniae CWL029
cauguaggaugugaaggauc

SEQ ID NO: 2527417 - RNA, 16 nt, Chlamydophila pneumoniae CWL029
cauguaguaaauuccu

SEQ ID NO: 2527418 - RNA, 17 nt, Chlamydophila pneumoniae CWL029
cauguaguaaauuccuc

SEQ ID NO: 2527419 - RNA, 19 nt, Chlamydophila pneumoniae CWL029
cauguauccgaaaucugac

SEQ ID NO: 2527420 - RNA, 20 nt, Chlamydophila pneumoniae CWL029
cauguauuguguucccucuu

SEQ ID NO: 2527421 - RNA, 14 nt, Chlamydophila pneumoniae CWL029
caugugcugaagac

SEQ ID NO: 2527422 - RNA, 15 nt, Chlamydophila pneumoniae CWL029
caugugcugaagacc

SEQ ID NO: 2527423 - RNA, 20 nt, Chlamydophila pneumoniae CWL029
cauguuaagcguauagaaua

SEQ ID NO: 2527424 - RNA, 14 nt, Chlamydophila pneumoniae CWL029
cauguugcaaagca

SEQ ID NO: 2527425 - RNA, 13 nt, Chlamydophila pneumoniae CWL029
cauguuucacuua

SEQ ID NO: 2527426 - RNA, 13 nt, Chlamydophila pneumoniae CWL029
cauuaagaacauc

SEQ ID NO: 2527427 - RNA, 20 nt, Chlamydophila pneumoniae CWL029
cauuaagcucaaaauuuccu

SEQ ID NO: 2527428 - RNA, 16 nt, Chlamydophila pneumoniae CWL029
cauuaauaauaucuaa

SEQ ID NO: 2527429 - RNA, 21 nt, Chlamydophila pneumoniae CWL029
cauuacacaacucuuucccua

SEQ ID NO: 2527430 - RNA, 20 nt, Chlamydophila pneumoniae CWL029
cauuaccguucccuaaagua

SEQ ID NO: 2527431 - RNA, 22 nt, Chlamydophila pneumoniae CWL029
cauuaccugcuaaacuuuuuuu

SEQ ID NO: 2527432 - RNA, 23 nt, Chlamydophila pneumoniae CWL029
cauuacggaggcauaaucuccaa

SEQ ID NO: 2527433 - RNA, 23 nt, Chlamydophila pneumoniae CWL029
cauuagaguuugguuuguuugau

SEQ ID NO: 2527434 - RNA, 21 nt, Chlamydophila pneumoniae CWL029
cauuagcaagagcucuugaga

SEQ ID NO: 2527435 - RNA, 19 nt, Chlamydophila pneumoniae CWL029
cauuagcaaucgaauagcu

SEQ ID NO: 2527436 - RNA, 19 nt, Chlamydophila pneumoniae CWL029
cauuagggcauucuguaau

SEQ ID NO: 2527437 - RNA, 15 nt, Chlamydophila pneumoniae CWL029
cauuauacuuuuuuu

SEQ ID NO: 2527438 - RNA, 15 nt, Chlamydophila pneumoniae CWL029
cauuaucacagcaau

SEQ ID NO: 2527439 - RNA, 15 nt, Chlamydophila pneumoniae CWL029
cauucaauaauuuca

SEQ ID NO: 2527440 - RNA, 13 nt, Chlamydophila pneumoniae CWL029
cauucacuaaaua

SEQ ID NO: 2527441 - RNA, 16 nt, Chlamydophila pneumoniae CWL029
cauuccaagaaaaauu

SEQ ID NO: 2527442 - RNA, 12 nt, Chlamydophila pneumoniae CWL029
cauuccaagauu

SEQ ID NO: 2527443 - RNA, 20 nt, Chlamydophila pneumoniae CWL029
cauuccaagauugaauucau

SEQ ID NO: 2527444 - RNA, 20 nt, Chlamydophila pneumoniae CWL029
cauuccaggacguaaaaaga

SEQ ID NO: 2527445 - RNA, 14 nt, Chlamydophila pneumoniae CWL029
cauuccaggauucu

SEQ ID NO: 2527446 - RNA, 15 nt, Chlamydophila pneumoniae CWL029
cauucccuaaagcug

SEQ ID NO: 2527447 - RNA, 18 nt, Chlamydophila pneumoniae CWL029
cauucccuaaagcugcca

SEQ ID NO: 2527448 - RNA, 19 nt, Chlamydophila pneumoniae CWL029
cauucccuaaagcugccag

SEQ ID NO: 2527449 - RNA, 12 nt, Chlamydophila pneumoniae CWL029
cauuccugcagu

SEQ ID NO: 2527450 - RNA, 18 nt, Chlamydophila pneumoniae CWL029
cauucguuaggugaccca

SEQ ID NO: 2527451 - RNA, 22 nt, Chlamydophila pneumoniae CWL029
cauucuaacgcuuuuucaaacu

SEQ ID NO: 2527452 - RNA, 13 nt, Chlamydophila pneumoniae CWL029
cauucuauucuau

SEQ ID NO: 2527453 - RNA, 15 nt, Chlamydophila pneumoniae CWL029
cauucucaauucugu

SEQ ID NO: 2527454 - RNA, 16 nt, Chlamydophila pneumoniae CWL029
cauucuuaauauaaaa

SEQ ID NO: 2527455 - RNA, 14 nt, Chlamydophila pneumoniae CWL029
cauucuuucgauau

SEQ ID NO: 2527456 - RNA, 15 nt, Chlamydophila pneumoniae CWL029
cauugaauccuucua

SEQ ID NO: 2527457 - RNA, 17 nt, Chlamydophila pneumoniae CWL029
cauugaccugcuuuuuu

SEQ ID NO: 2527458 - RNA, 22 nt, Chlamydophila pneumoniae CWL029
cauugacgcuuaaaaucagcac

SEQ ID NO: 2527459 - RNA, 15 nt, Chlamydophila pneumoniae CWL029
cauugagauccauag

SEQ ID NO: 2527460 - RNA, 16 nt, Chlamydophila pneumoniae CWL029
cauugcaaaaaugaaa

SEQ ID NO: 2527461 - RNA, 23 nt, Chlamydophila pneumoniae CWL029
cauugcaaauaagccaguacuaa

SEQ ID NO: 2527462 - RNA, 23 nt, Chlamydophila pneumoniae CWL029
cauugcuauugaaaaaucccugu

SEQ ID NO: 2527463 - RNA, 19 nt, Chlamydophila pneumoniae CWL029
cauuggcuccuaaggaaac

SEQ ID NO: 2527464 - RNA, 17 nt, Chlamydophila pneumoniae CWL029
cauugucucuuuuaaag

SEQ ID NO: 2527465 - RNA, 21 nt, Chlamydophila pneumoniae CWL029
cauuguuuggcaguucacuga

SEQ ID NO: 2527466 - RNA, 17 nt, Chlamydophila pneumoniae CWL029
cauuguuuguccuagga

SEQ ID NO: 2527467 - RNA, 23 nt, Chlamydophila pneumoniae CWL029
cauuguuuguccuaggagagcua

SEQ ID NO: 2527468 - RNA, 16 nt, Chlamydophila pneumoniae CWL029
cauuuaaacuaagaau

SEQ ID NO: 2527469 - RNA, 20 nt, Chlamydophila pneumoniae CWL029
cauuuaaagcugaaauucuu

SEQ ID NO: 2527470 - RNA, 15 nt, Chlamydophila pneumoniae CWL029
cauuuaaauggaugc

SEQ ID NO: 2527471 - RNA, 16 nt, Chlamydophila pneumoniae CWL029
cauuuagaaguaaucc

SEQ ID NO: 2527472 - RNA, 17 nt, Chlamydophila pneumoniae CWL029
cauuuagacaaucuacg

SEQ ID NO: 2527473 - RNA, 16 nt, Chlamydophila pneumoniae CWL029
cauuuagauaaagaaa

SEQ ID NO: 2527474 - RNA, 19 nt, Chlamydophila pneumoniae CWL029
cauuuaucugcguuucuuu

SEQ ID NO: 2527475 - RNA, 12 nt, Chlamydophila pneumoniae CWL029
cauuucaugaau

SEQ ID NO: 2527476 - RNA, 16 nt, Chlamydophila pneumoniae CWL029
cauuucauguaagaau

SEQ ID NO: 2527477 - RNA, 16 nt, Chlamydophila pneumoniae CWL029
cauuuccccaugaaaa

SEQ ID NO: 2527478 - RNA, 18 nt, Chlamydophila pneumoniae CWL029
cauuucuacacgccacaa

SEQ ID NO: 2527479 - RNA, 22 nt, Chlamydophila pneumoniae CWL029
cauuucuaucaguucauuuugg

SEQ ID NO: 2527480 - RNA, 18 nt, Chlamydophila pneumoniae CWL029
cauuucucaccacggaag

SEQ ID NO: 2527481 - RNA, 22 nt, Chlamydophila pneumoniae CWL029
cauuucuggagaaugccccuuc

SEQ ID NO: 2527482 - RNA, 15 nt, Chlamydophila pneumoniae CWL029
cauuugauucauaaa

SEQ ID NO: 2527483 - RNA, 17 nt, Chlamydophila pneumoniae CWL029
cauuugauucauaaaga

SEQ ID NO: 2527484 - RNA, 16 nt, Chlamydophila pneumoniae CWL029
cauuugccccuuccaa

SEQ ID NO: 2527485 - RNA, 13 nt, Chlamydophila pneumoniae CWL029
cauuugcuauuuu

SEQ ID NO: 2527486 - RNA, 16 nt, Chlamydophila pneumoniae CWL029
cauuugcuauuuuccc

SEQ ID NO: 2527487 - RNA, 14 nt, Chlamydophila pneumoniae CWL029
cauuugcuuuaaca

SEQ ID NO: 2527488 - RNA, 15 nt, Chlamydophila pneumoniae CWL029
cauuuguuuggaaau

SEQ ID NO: 2527489 - RNA, 14 nt, Chlamydophila pneumoniae CWL029
cauuuuaugaucuc

SEQ ID NO: 2527490 - RNA, 18 nt, Chlamydophila pneumoniae CWL029
cauuuucaggcugaacca

SEQ ID NO: 2527491 - RNA, 14 nt, Chlamydophila pneumoniae CWL029
cauuuucuaaagua

SEQ ID NO: 2527492 - RNA, 14 nt, Chlamydophila pneumoniae CWL029
cauuuuuaaggaaa

SEQ ID NO: 2527493 - RNA, 15 nt, Chlamydophila pneumoniae CWL029
cauuuuucaauaacc

SEQ ID NO: 2527494 - RNA, 14 nt, Chlamydophila pneumoniae CWL029
cauuuuuccuccuc

SEQ ID NO: 2527495 - RNA, 16 nt, Chlamydophila pneumoniae CWL029
cauuuuucuauaauaa

SEQ ID NO: 2527496 - RNA, 17 nt, Chlamydophila pneumoniae CWL029
cauuuuuggaaaaccau

SEQ ID NO: 2527497 - RNA, 21 nt, Chlamydophila pneumoniae CWL029
ccaaaaaagagcccaaaaaca

SEQ ID NO: 2527498 - RNA, 20 nt, Chlamydophila pneumoniae CWL029
ccaaaaaaugcccguccccu

SEQ ID NO: 2527499 - RNA, 22 nt, Chlamydophila pneumoniae CWL029
ccaaaaaaugcccguccccucu

SEQ ID NO: 2527500 - RNA, 22 nt, Chlamydophila pneumoniae CWL029
ccaaaauuaccguuuccuccuc

SEQ ID NO: 2527501 - RNA, 23 nt, Chlamydophila pneumoniae CWL029
ccaaaauuaccguuuccuccucu

SEQ ID NO: 2527502 - RNA, 11 nt, Chlamydophila pneumoniae CWL029
ccaaacaugga

SEQ ID NO: 2527503 - RNA, 21 nt, Chlamydophila pneumoniae CWL029
ccaaacauggacaauauagag

SEQ ID NO: 2527504 - RNA, 20 nt, Chlamydophila pneumoniae CWL029
ccaaacgaauuucuuguucc

SEQ ID NO: 2527505 - RNA, 21 nt, Chlamydophila pneumoniae CWL029
ccaaacgucaggcuccugacg

SEQ ID NO: 2527506 - RNA, 15 nt, Chlamydophila pneumoniae CWL029
ccaaagaacagcacu

SEQ ID NO: 2527507 - RNA, 21 nt, Chlamydophila pneumoniae CWL029
ccaaagaggggagcuauaaau

SEQ ID NO: 2527508 - RNA, 16 nt, Chlamydophila pneumoniae CWL029
ccaaagaucaucuuca

SEQ ID NO: 2527509 - RNA, 18 nt, Chlamydophila pneumoniae CWL029
ccaaagcagauccugcuu

SEQ ID NO: 2527510 - RNA, 23 nt, Chlamydophila pneumoniae CWL029
ccaaagcuauuucucuaucauca

SEQ ID NO: 2527511 - RNA, 14 nt, Chlamydophila pneumoniae CWL029
ccaaagcuucuuuc

SEQ ID NO: 2527512 - RNA, 19 nt, Chlamydophila pneumoniae CWL029
ccaaagucacucaaacccu

SEQ ID NO: 2527513 - RNA, 20 nt, Chlamydophila pneumoniae CWL029
ccaaagucacucaaacccuc

SEQ ID NO: 2527514 - RNA, 23 nt, Chlamydophila pneumoniae CWL029
ccaaagugacuuccuccaaaauu

SEQ ID NO: 2527515 - RNA, 17 nt, Chlamydophila pneumoniae CWL029
ccaaaguuuguagcauu

SEQ ID NO: 2527516 - RNA, 13 nt, Chlamydophila pneumoniae CWL029
ccaaauaaagcaa

SEQ ID NO: 2527517 - RNA, 16 nt, Chlamydophila pneumoniae CWL029
ccaaauacgaacugua

SEQ ID NO: 2527518 - RNA, 13 nt, Chlamydophila pneumoniae CWL029
ccaaauccuccgc

SEQ ID NO: 2527519 - RNA, 23 nt, Chlamydophila pneumoniae CWL029
ccaaaucucaaucgauaaucaaa

SEQ ID NO: 2527520 - RNA, 14 nt, Chlamydophila pneumoniae CWL029
ccaaauguucucuc

SEQ ID NO: 2527521 - RNA, 21 nt, Chlamydophila pneumoniae CWL029
ccaaauguucucuccagcugu

SEQ ID NO: 2527522 - RNA, 13 nt, Chlamydophila pneumoniae CWL029
ccaacaaagauga

SEQ ID NO: 2527523 - RNA, 23 nt, Chlamydophila pneumoniae CWL029
ccaacacgcacaaacuaacauag

SEQ ID NO: 2527524 - RNA, 20 nt, Chlamydophila pneumoniae CWL029
ccaacacuuuuaaagauaag

SEQ ID NO: 2527525 - RNA, 15 nt, Chlamydophila pneumoniae CWL029
ccaacaguguagccu

SEQ ID NO: 2527526 - RNA, 15 nt, Chlamydophila pneumoniae CWL029
ccaacaguucuuucu

SEQ ID NO: 2527527 - RNA, 16 nt, Chlamydophila pneumoniae CWL029
ccaacaguucuuucug

SEQ ID NO: 2527528 - RNA, 17 nt, Chlamydophila pneumoniae CWL029
ccaacggcauaggauug

SEQ ID NO: 2527529 - RNA, 21 nt, Chlamydophila pneumoniae CWL029
ccaacuaaaacagccuagcaa

SEQ ID NO: 2527530 - RNA, 13 nt, Chlamydophila pneumoniae CWL029
ccaacuccucuaa

SEQ ID NO: 2527531 - RNA, 20 nt, Chlamydophila pneumoniae CWL029
ccaacuuccuauaaaaaccu

SEQ ID NO: 2527532 - RNA, 16 nt, Chlamydophila pneumoniae CWL029
ccaagaaauauacugc

SEQ ID NO: 2527533 - RNA, 17 nt, Chlamydophila pneumoniae CWL029
ccaagaaaucucaguga

SEQ ID NO: 2527534 - RNA, 13 nt, Chlamydophila pneumoniae CWL029
ccaagacaaaaaa

SEQ ID NO: 2527535 - RNA, 16 nt, Chlamydophila pneumoniae CWL029
ccaagacaauggaaau

SEQ ID NO: 2527536 - RNA, 13 nt, Chlamydophila pneumoniae CWL029
ccaagacgcggaa

SEQ ID NO: 2527537 - RNA, 22 nt, Chlamydophila pneumoniae CWL029
ccaagagucuuugaugcuaaac

SEQ ID NO: 2527538 - RNA, 22 nt, Chlamydophila pneumoniae CWL029
ccaagcaggugugugguaaaaa

SEQ ID NO: 2527539 - RNA, 20 nt, Chlamydophila pneumoniae CWL029
ccaagcuuccaacuuuugaa

SEQ ID NO: 2527540 - RNA, 20 nt, Chlamydophila pneumoniae CWL029
ccaagcuuccgucugaaugu

SEQ ID NO: 2527541 - RNA, 22 nt, Chlamydophila pneumoniae CWL029
ccaaggggcguucuugaaaaaa

SEQ ID NO: 2527542 - RNA, 14 nt, Chlamydophila pneumoniae CWL029
ccaaguacaguauc

SEQ ID NO: 2527543 - RNA, 18 nt, Chlamydophila pneumoniae CWL029
ccaaguuguagugaauga

SEQ ID NO: 2527544 - RNA, 15 nt, Chlamydophila pneumoniae CWL029
ccaauaaauccaaaa

SEQ ID NO: 2527545 - RNA, 18 nt, Chlamydophila pneumoniae CWL029
ccaauaaauccaaaaaau

SEQ ID NO: 2527546 - RNA, 13 nt, Chlamydophila pneumoniae CWL029
ccaauacagcaua

SEQ ID NO: 2527547 - RNA, 14 nt, Chlamydophila pneumoniae CWL029
ccaauacuaaaacu

SEQ ID NO: 2527548 - RNA, 20 nt, Chlamydophila pneumoniae CWL029
ccaauauccagaaauacguc

SEQ ID NO: 2527549 - RNA, 17 nt, Chlamydophila pneumoniae CWL029
ccaauaugcucugccau

SEQ ID NO: 2527550 - RNA, 14 nt, Chlamydophila pneumoniae CWL029
ccaaucgauaacgu

SEQ ID NO: 2527551 - RNA, 19 nt, Chlamydophila pneumoniae CWL029
ccaaucgauaacguugccu

SEQ ID NO: 2527552 - RNA, 12 nt, Chlamydophila pneumoniae CWL029
ccaaucugcuga

SEQ ID NO: 2527553 - RNA, 17 nt, Chlamydophila pneumoniae CWL029
ccaaugacgggagcucu

SEQ ID NO: 2527554 - RNA, 16 nt, Chlamydophila pneumoniae CWL029
ccaaugagcucuauuu

SEQ ID NO: 2527555 - RNA, 18 nt, Chlamydophila pneumoniae CWL029
ccaaugagcucuauuucu

SEQ ID NO: 2527556 - RNA, 17 nt, Chlamydophila pneumoniae CWL029
ccaaugcuauuggaaca

SEQ ID NO: 2527557 - RNA, 22 nt, Chlamydophila pneumoniae CWL029
ccaaugggaauuugauuuuuca

SEQ ID NO: 2527558 - RNA, 19 nt, Chlamydophila pneumoniae CWL029
ccaauguggugauuucuuu

SEQ ID NO: 2527559 - RNA, 17 nt, Chlamydophila pneumoniae CWL029
ccaauuguaucuguauc

SEQ ID NO: 2527560 - RNA, 13 nt, Chlamydophila pneumoniae CWL029
ccaauuuuuuccc

SEQ ID NO: 2527561 - RNA, 15 nt, Chlamydophila pneumoniae CWL029
ccacaacauaacagg

SEQ ID NO: 2527562 - RNA, 23 nt, Chlamydophila pneumoniae CWL029
ccacaacuaaacgagcuguccag

SEQ ID NO: 2527563 - RNA, 13 nt, Chlamydophila pneumoniae CWL029
ccacaauuccuaa

SEQ ID NO: 2527564 - RNA, 19 nt, Chlamydophila pneumoniae CWL029
ccacaauuccuaaaacaag

SEQ ID NO: 2527565 - RNA, 17 nt, Chlamydophila pneumoniae CWL029
ccacacaggauuguuau

SEQ ID NO: 2527566 - RNA, 11 nt, Chlamydophila pneumoniae CWL029
ccacagagaau

SEQ ID NO: 2527567 - RNA, 23 nt, Chlamydophila pneumoniae CWL029
ccacagccaaguucguuggccca

SEQ ID NO: 2527568 - RNA, 13 nt, Chlamydophila pneumoniae CWL029
ccacagcuucuuc

SEQ ID NO: 2527569 - RNA, 14 nt, Chlamydophila pneumoniae CWL029
ccacaggaaugaaa

SEQ ID NO: 2527570 - RNA, 15 nt, Chlamydophila pneumoniae CWL029
ccacaugaaguccug

SEQ ID NO: 2527571 - RNA, 16 nt, Chlamydophila pneumoniae CWL029
ccaccaacaaugcgau

SEQ ID NO: 2527572 - RNA, 15 nt, Chlamydophila pneumoniae CWL029
ccaccaacaguccug

SEQ ID NO: 2527573 - RNA, 12 nt, Chlamydophila pneumoniae CWL029
ccaccaggagcu

SEQ ID NO: 2527574 - RNA, 16 nt, Chlamydophila pneumoniae CWL029
ccaccaggagcuccuc

SEQ ID NO: 2527575 - RNA, 18 nt, Chlamydophila pneumoniae CWL029
ccaccaggagcuccuccu

SEQ ID NO: 2527576 - RNA, 19 nt, Chlamydophila pneumoniae CWL029
ccaccaggagcuccuccuu

SEQ ID NO: 2527577 - RNA, 21 nt, Chlamydophila pneumoniae CWL029
ccaccagggguuucuaaauac

SEQ ID NO: 2527578 - RNA, 18 nt, Chlamydophila pneumoniae CWL029
ccacccuuggcagagccg

SEQ ID NO: 2527579 - RNA, 17 nt, Chlamydophila pneumoniae CWL029
ccaccuuccccaagcuc

SEQ ID NO: 2527580 - RNA, 13 nt, Chlamydophila pneumoniae CWL029
ccacgaaauguua

SEQ ID NO: 2527581 - RNA, 14 nt, Chlamydophila pneumoniae CWL029
ccacgaauucuuua

SEQ ID NO: 2527582 - RNA, 16 nt, Chlamydophila pneumoniae CWL029
ccacgaauucuuuaaa

SEQ ID NO: 2527583 - RNA, 22 nt, Chlamydophila pneumoniae CWL029
ccacgaccugcaaacuccccag

SEQ ID NO: 2527584 - RNA, 14 nt, Chlamydophila pneumoniae CWL029
ccacgagauucugc

SEQ ID NO: 2527585 - RNA, 23 nt, Chlamydophila pneumoniae CWL029
ccacgaguucgcggaucuucuuc

SEQ ID NO: 2527586 - RNA, 15 nt, Chlamydophila pneumoniae CWL029
ccacggauuuucucu

SEQ ID NO: 2527587 - RNA, 15 nt, Chlamydophila pneumoniae CWL029
ccacgggucaggagg

SEQ ID NO: 2527588 - RNA, 13 nt, Chlamydophila pneumoniae CWL029
ccacguccauuuc

SEQ ID NO: 2527589 - RNA, 22 nt, Chlamydophila pneumoniae CWL029
ccacuaaguuuaggcaggaagu

SEQ ID NO: 2527590 - RNA, 20 nt, Chlamydophila pneumoniae CWL029
ccacuacugagcuucuauuu

SEQ ID NO: 2527591 - RNA, 23 nt, Chlamydophila pneumoniae CWL029
ccacuccagaaaguauuccucuu

SEQ ID NO: 2527592 - RNA, 22 nt, Chlamydophila pneumoniae CWL029
ccacuuuuuucccuccaccaga

SEQ ID NO: 2527593 - RNA, 21 nt, Chlamydophila pneumoniae CWL029
ccagaaacgcagcuuuccuuu

SEQ ID NO: 2527594 - RNA, 12 nt, Chlamydophila pneumoniae CWL029
ccagaaaguauu

SEQ ID NO: 2527595 - RNA, 14 nt, Chlamydophila pneumoniae CWL029
ccagaaauuuuuac

SEQ ID NO: 2527596 - RNA, 16 nt, Chlamydophila pneumoniae CWL029
ccagaaauuuuuacaa

SEQ ID NO: 2527597 - RNA, 21 nt, Chlamydophila pneumoniae CWL029
ccagaaucuccauuuagaaug

SEQ ID NO: 2527598 - RNA, 16 nt, Chlamydophila pneumoniae CWL029
ccagacuuuccucucu

SEQ ID NO: 2527599 - RNA, 19 nt, Chlamydophila pneumoniae CWL029
ccagacuuuccucucuuua

SEQ ID NO: 2527600 - RNA, 17 nt, Chlamydophila pneumoniae CWL029
ccagagaauguucccaa

SEQ ID NO: 2527601 - RNA, 14 nt, Chlamydophila pneumoniae CWL029
ccagagauucuuca

SEQ ID NO: 2527602 - RNA, 22 nt, Chlamydophila pneumoniae CWL029
ccagagucgugccugguccaug

SEQ ID NO: 2527603 - RNA, 14 nt, Chlamydophila pneumoniae CWL029
ccagaugauuuuuu

SEQ ID NO: 2527604 - RNA, 16 nt, Chlamydophila pneumoniae CWL029
ccagaugauuuuuuga

SEQ ID NO: 2527605 - RNA, 15 nt, Chlamydophila pneumoniae CWL029
ccagaugcuaaagag

SEQ ID NO: 2527606 - RNA, 22 nt, Chlamydophila pneumoniae CWL029
ccagauuguucaaaaauagaua

SEQ ID NO: 2527607 - RNA, 23 nt, Chlamydophila pneumoniae CWL029
ccagcaccuuuaggaagcuguac

SEQ ID NO: 2527608 - RNA, 14 nt, Chlamydophila pneumoniae CWL029
ccagcaucuucucg

SEQ ID NO: 2527609 - RNA, 23 nt, Chlamydophila pneumoniae CWL029
ccagcauuaagauaaacagcaca

SEQ ID NO: 2527610 - RNA, 13 nt, Chlamydophila pneumoniae CWL029
ccagcauuuuugg

SEQ ID NO: 2527611 - RNA, 21 nt, Chlamydophila pneumoniae CWL029
ccagccacccccacuucuuuu

SEQ ID NO: 2527612 - RNA, 17 nt, Chlamydophila pneumoniae CWL029
ccagcucgagaucuuuu

SEQ ID NO: 2527613 - RNA, 18 nt, Chlamydophila pneumoniae CWL029
ccagcugauauccuugcu

SEQ ID NO: 2527614 - RNA, 22 nt, Chlamydophila pneumoniae CWL029
ccaggaaguccgauagcaauga

SEQ ID NO: 2527615 - RNA, 17 nt, Chlamydophila pneumoniae CWL029
ccaggaauagaaagaca

SEQ ID NO: 2527616 - RNA, 17 nt, Chlamydophila pneumoniae CWL029
ccaggacguaaaaagaa

SEQ ID NO: 2527617 - RNA, 14 nt, Chlamydophila pneumoniae CWL029
ccaggauggcuccu

SEQ ID NO: 2527618 - RNA, 16 nt, Chlamydophila pneumoniae CWL029
ccagggguuucuaaau

SEQ ID NO: 2527619 - RNA, 23 nt, Chlamydophila pneumoniae CWL029
ccaguagaucuucugaaaucaaa

SEQ ID NO: 2527620 - RNA, 15 nt, Chlamydophila pneumoniae CWL029
ccaguuacugucugc

SEQ ID NO: 2527621 - RNA, 19 nt, Chlamydophila pneumoniae CWL029
ccaguuguauccagcucaa

SEQ ID NO: 2527622 - RNA, 18 nt, Chlamydophila pneumoniae CWL029
ccaguuuuccauccacga

SEQ ID NO: 2527623 - RNA, 20 nt, Chlamydophila pneumoniae CWL029
ccauaaaaauguaauuuuuu

SEQ ID NO: 2527624 - RNA, 21 nt, Chlamydophila pneumoniae CWL029
ccauaaaaauguaauuuuuuc

SEQ ID NO: 2527625 - RNA, 22 nt, Chlamydophila pneumoniae CWL029
ccauaaaaauguaauuuuuuca

SEQ ID NO: 2527626 - RNA, 16 nt, Chlamydophila pneumoniae CWL029
ccauaaagaauucccc

SEQ ID NO: 2527627 - RNA, 12 nt, Chlamydophila pneumoniae CWL029
ccauaaauguau

SEQ ID NO: 2527628 - RNA, 19 nt, Chlamydophila pneumoniae CWL029
ccauaacagcacucacgcu

SEQ ID NO: 2527629 - RNA, 21 nt, Chlamydophila pneumoniae CWL029
ccauaaccgucacuguuuucc

SEQ ID NO: 2527630 - RNA, 22 nt, Chlamydophila pneumoniae CWL029
ccauaagaaugguuauuucuug

SEQ ID NO: 2527631 - RNA, 19 nt, Chlamydophila pneumoniae CWL029
ccauaagaucaauauagag

SEQ ID NO: 2527632 - RNA, 20 nt, Chlamydophila pneumoniae CWL029
ccauaagcuuuucuuccaaa

SEQ ID NO: 2527633 - RNA, 13 nt, Chlamydophila pneumoniae CWL029
ccauaauaaaggu

SEQ ID NO: 2527634 - RNA, 17 nt, Chlamydophila pneumoniae CWL029
ccauaauuagaacagca

SEQ ID NO: 2527635 - RNA, 20 nt, Chlamydophila pneumoniae CWL029
ccauacccaaauuucuucug

SEQ ID NO: 2527636 - RNA, 22 nt, Chlamydophila pneumoniae CWL029
ccauacgguaaggaggaaucuu

SEQ ID NO: 2527637 - RNA, 16 nt, Chlamydophila pneumoniae CWL029
ccauagaguaucuaaa

SEQ ID NO: 2527638 - RNA, 15 nt, Chlamydophila pneumoniae CWL029
ccauaggaucugcau

SEQ ID NO: 2527639 - RNA, 16 nt, Chlamydophila pneumoniae CWL029
ccauauccauggaaug

SEQ ID NO: 2527640 - RNA, 21 nt, Chlamydophila pneumoniae CWL029
ccauauuccuauaacaacauu

SEQ ID NO: 2527641 - RNA, 17 nt, Chlamydophila pneumoniae CWL029
ccauauuugaauaaagg

SEQ ID NO: 2527642 - RNA, 14 nt, Chlamydophila pneumoniae CWL029
ccaucaagguauug

SEQ ID NO: 2527643 - RNA, 17 nt, Chlamydophila pneumoniae CWL029
ccaucacauaaaucaac

SEQ ID NO: 2527644 - RNA, 14 nt, Chlamydophila pneumoniae CWL029
ccaucacuuccugu

SEQ ID NO: 2527645 - RNA, 15 nt, Chlamydophila pneumoniae CWL029
ccaucauaauuugac

SEQ ID NO: 2527646 - RNA, 13 nt, Chlamydophila pneumoniae CWL029
ccaucaucaccag

SEQ ID NO: 2527647 - RNA, 18 nt, Chlamydophila pneumoniae CWL029
ccaucaucgaagaacuua

SEQ ID NO: 2527648 - RNA, 17 nt, Chlamydophila pneumoniae CWL029
ccauccacgaccucgaa

SEQ ID NO: 2527649 - RNA, 17 nt, Chlamydophila pneumoniae CWL029
ccauccacgaccugcaa

SEQ ID NO: 2527650 - RNA, 14 nt, Chlamydophila pneumoniae CWL029
ccauccucagucuc

SEQ ID NO: 2527651 - RNA, 22 nt, Chlamydophila pneumoniae CWL029
ccauccugucuauuucuuaauu

SEQ ID NO: 2527652 - RNA, 14 nt, Chlamydophila pneumoniae CWL029
ccaucuaauccugu

SEQ ID NO: 2527653 - RNA, 20 nt, Chlamydophila pneumoniae CWL029
ccaucucuuucuauuucguc

SEQ ID NO: 2527654 - RNA, 17 nt, Chlamydophila pneumoniae CWL029
ccaugaguuuuucagau

SEQ ID NO: 2527655 - RNA, 22 nt, Chlamydophila pneumoniae CWL029
ccaugcagccugcgacuacaag

SEQ ID NO: 2527656 - RNA, 19 nt, Chlamydophila pneumoniae CWL029
ccaugcuaauaauuccuga

SEQ ID NO: 2527657 - RNA, 14 nt, Chlamydophila pneumoniae CWL029
ccaugcuuaucuau

SEQ ID NO: 2527658 - RNA, 16 nt, Chlamydophila pneumoniae CWL029
ccauggauauggaaug

SEQ ID NO: 2527659 - RNA, 17 nt, Chlamydophila pneumoniae CWL029
ccaugguuauagauacg

SEQ ID NO: 2527660 - RNA, 18 nt, Chlamydophila pneumoniae CWL029
ccauguacaugcaggcga

SEQ ID NO: 2527661 - RNA, 15 nt, Chlamydophila pneumoniae CWL029
ccaugucuaaagauu

SEQ ID NO: 2527662 - RNA, 19 nt, Chlamydophila pneumoniae CWL029
ccaugucuaaagauuggaa

SEQ ID NO: 2527663 - RNA, 16 nt, Chlamydophila pneumoniae CWL029
ccauguuucuuccuga

SEQ ID NO: 2527664 - RNA, 23 nt, Chlamydophila pneumoniae CWL029
ccauuaaauuguauggaauucaa

SEQ ID NO: 2527665 - RNA, 12 nt, Chlamydophila pneumoniae CWL029
ccauuaaggaau

SEQ ID NO: 2527666 - RNA, 18 nt, Chlamydophila pneumoniae CWL029
ccauuaauaucccaguuu

SEQ ID NO: 2527667 - RNA, 17 nt, Chlamydophila pneumoniae CWL029
ccauuagggcauucugu

SEQ ID NO: 2527668 - RNA, 14 nt, Chlamydophila pneumoniae CWL029
ccauuauacuuuuu

SEQ ID NO: 2527669 - RNA, 14 nt, Chlamydophila pneumoniae CWL029
ccauuccauaucca

SEQ ID NO: 2527670 - RNA, 14 nt, Chlamydophila pneumoniae CWL029
ccauucugaccaaa

SEQ ID NO: 2527671 - RNA, 14 nt, Chlamydophila pneumoniae CWL029
ccauucuuaucugc

SEQ ID NO: 2527672 - RNA, 15 nt, Chlamydophila pneumoniae CWL029
ccauuguuguugcau

SEQ ID NO: 2527673 - RNA, 14 nt, Chlamydophila pneumoniae CWL029
ccauuuagacaaga

SEQ ID NO: 2527674 - RNA, 16 nt, Chlamydophila pneumoniae CWL029
ccauuuagacaagaca

SEQ ID NO: 2527675 - RNA, 13 nt, Chlamydophila pneumoniae CWL029
ccauuucauguaa

SEQ ID NO: 2527676 - RNA, 19 nt, Chlamydophila pneumoniae CWL029
ccauuucauguaagaaugu

SEQ ID NO: 2527677 - RNA, 12 nt, Chlamydophila pneumoniae CWL029
ccauuuucuaag

SEQ ID NO: 2527678 - RNA, 13 nt, Chlamydophila pneumoniae CWL029
ccauuuucuaaga

SEQ ID NO: 2527679 - RNA, 22 nt, Chlamydophila pneumoniae CWL029
ccauuuuugaauaugauuucca

SEQ ID NO: 2527680 - RNA, 19 nt, Chlamydophila pneumoniae CWL029
cccaaacugaugccaagaa

SEQ ID NO: 2527681 - RNA, 17 nt, Chlamydophila pneumoniae CWL029
cccaaagaggggagcua

SEQ ID NO: 2527682 - RNA, 16 nt, Chlamydophila pneumoniae CWL029
cccaagcaagaagugu

SEQ ID NO: 2527683 - RNA, 13 nt, Chlamydophila pneumoniae CWL029
cccaagcucucuc

SEQ ID NO: 2527684 - RNA, 13 nt, Chlamydophila pneumoniae CWL029
cccaaggaaaaac

SEQ ID NO: 2527685 - RNA, 22 nt, Chlamydophila pneumoniae CWL029
cccaaguuguagugaaugagcu

SEQ ID NO: 2527686 - RNA, 16 nt, Chlamydophila pneumoniae CWL029
cccaaguuuguauuuu

SEQ ID NO: 2527687 - RNA, 15 nt, Chlamydophila pneumoniae CWL029
cccaauauccagaaa

SEQ ID NO: 2527688 - RNA, 23 nt, Chlamydophila pneumoniae CWL029
cccaauucuuaaaaagcuaaaca

SEQ ID NO: 2527689 - RNA, 18 nt, Chlamydophila pneumoniae CWL029
cccacggcaaguuguggc

SEQ ID NO: 2527690 - RNA, 20 nt, Chlamydophila pneumoniae CWL029
cccacggcaaguuguggcau

SEQ ID NO: 2527691 - RNA, 21 nt, Chlamydophila pneumoniae CWL029
cccacgggucaggagguggug

SEQ ID NO: 2527692 - RNA, 13 nt, Chlamydophila pneumoniae CWL029
cccacuccagaaa

SEQ ID NO: 2527693 - RNA, 12 nt, Chlamydophila pneumoniae CWL029
cccacuucuacc

SEQ ID NO: 2527694 - RNA, 13 nt, Chlamydophila pneumoniae CWL029
cccagauuuuuuu

SEQ ID NO: 2527695 - RNA, 17 nt, Chlamydophila pneumoniae CWL029
cccagauuuuuuugguu

SEQ ID NO: 2527696 - RNA, 11 nt, Chlamydophila pneumoniae CWL029
cccagccuuga

SEQ ID NO: 2527697 - RNA, 17 nt, Chlamydophila pneumoniae CWL029
cccaguuguauccagcu

SEQ ID NO: 2527698 - RNA, 19 nt, Chlamydophila pneumoniae CWL029
cccaguuuuccauccacga

SEQ ID NO: 2527699 - RNA, 23 nt, Chlamydophila pneumoniae CWL029
cccauacauagggaaaguucagu

SEQ ID NO: 2527700 - RNA, 13 nt, Chlamydophila pneumoniae CWL029
cccauagcaaugc

SEQ ID NO: 2527701 - RNA, 14 nt, Chlamydophila pneumoniae CWL029
cccaugucuucaua

SEQ ID NO: 2527702 - RNA, 22 nt, Chlamydophila pneumoniae CWL029
ccccaaacauggacaauauaga

SEQ ID NO: 2527703 - RNA, 22 nt, Chlamydophila pneumoniae CWL029
ccccaccaaagugacuuccucc

SEQ ID NO: 2527704 - RNA, 14 nt, Chlamydophila pneumoniae CWL029
ccccacgcuaaacu

SEQ ID NO: 2527705 - RNA, 19 nt, Chlamydophila pneumoniae CWL029
ccccacgcuaaacuaaaau

SEQ ID NO: 2527706 - RNA, 15 nt, Chlamydophila pneumoniae CWL029
ccccaucuaauccug

SEQ ID NO: 2527707 - RNA, 11 nt, Chlamydophila pneumoniae CWL029
ccccgcagcuu

SEQ ID NO: 2527708 - RNA, 14 nt, Chlamydophila pneumoniae CWL029
ccccuacagcagaa

SEQ ID NO: 2527709 - RNA, 19 nt, Chlamydophila pneumoniae CWL029
ccccucgaaucucaucugg

SEQ ID NO: 2527710 - RNA, 10 nt, Chlamydophila pneumoniae CWL029
ccccucucuc

SEQ ID NO: 2527711 - RNA, 17 nt, Chlamydophila pneumoniae CWL029
ccccuucuaauacuuua

SEQ ID NO: 2527712 - RNA, 22 nt, Chlamydophila pneumoniae CWL029
cccgaguccuaaaauuucuagg

SEQ ID NO: 2527713 - RNA, 12 nt, Chlamydophila pneumoniae CWL029
cccgcagcuucu

SEQ ID NO: 2527714 - RNA, 13 nt, Chlamydophila pneumoniae CWL029
cccgugacugcgu

SEQ ID NO: 2527715 - RNA, 13 nt, Chlamydophila pneumoniae CWL029
cccgugagcaugc

SEQ ID NO: 2527716 - RNA, 12 nt, Chlamydophila pneumoniae CWL029
cccuaagauucg

SEQ ID NO: 2527717 - RNA, 20 nt, Chlamydophila pneumoniae CWL029
cccuaagguagaguccacag

SEQ ID NO: 2527718 - RNA, 17 nt, Chlamydophila pneumoniae CWL029
cccuagagguauuuccu

SEQ ID NO: 2527719 - RNA, 22 nt, Chlamydophila pneumoniae CWL029
cccuauagaacaugaggcacau

SEQ ID NO: 2527720 - RNA, 19 nt, Chlamydophila pneumoniae CWL029
cccucacaauauaaaugcu

SEQ ID NO: 2527721 - RNA, 15 nt, Chlamydophila pneumoniae CWL029
cccucagaaaggaga

SEQ ID NO: 2527722 - RNA, 14 nt, Chlamydophila pneumoniae CWL029
cccucauaagauuu

SEQ ID NO: 2527723 - RNA, 21 nt, Chlamydophila pneumoniae CWL029
cccucauaagauuuccccaag

SEQ ID NO: 2527724 - RNA, 22 nt, Chlamydophila pneumoniae CWL029
cccucccccaccaaagugacuu

SEQ ID NO: 2527725 - RNA, 13 nt, Chlamydophila pneumoniae CWL029
cccucgaaccacu

SEQ ID NO: 2527726 - RNA, 14 nt, Chlamydophila pneumoniae CWL029
cccucgccaaacca

SEQ ID NO: 2527727 - RNA, 22 nt, Chlamydophila pneumoniae CWL029
cccucuaaugacagcugagaaa

SEQ ID NO: 2527728 - RNA, 12 nt, Chlamydophila pneumoniae CWL029
cccucuucaucc

SEQ ID NO: 2527729 - RNA, 23 nt, Chlamydophila pneumoniae CWL029
cccucuucauccgaagacucaaa

SEQ ID NO: 2527730 - RNA, 12 nt, Chlamydophila pneumoniae CWL029
cccucuucuucc

SEQ ID NO: 2527731 - RNA, 15 nt, Chlamydophila pneumoniae CWL029
cccugagccugugau

SEQ ID NO: 2527732 - RNA, 21 nt, Chlamydophila pneumoniae CWL029
cccugauuccauccugucuau

SEQ ID NO: 2527733 - RNA, 18 nt, Chlamydophila pneumoniae CWL029
cccugcaccaauugcagu

SEQ ID NO: 2527734 - RNA, 16 nt, Chlamydophila pneumoniae CWL029
cccugcaucucugcau

SEQ ID NO: 2527735 - RNA, 23 nt, Chlamydophila pneumoniae CWL029
cccuggauagcauacgacaguaa

SEQ ID NO: 2527736 - RNA, 14 nt, Chlamydophila pneumoniae CWL029
cccuguauuaaaga

SEQ ID NO: 2527737 - RNA, 16 nt, Chlamydophila pneumoniae CWL029
cccuugggauuccuua

SEQ ID NO: 2527738 - RNA, 23 nt, Chlamydophila pneumoniae CWL029
cccuuuauacuguuuuucuucca

SEQ ID NO: 2527739 - RNA, 20 nt, Chlamydophila pneumoniae CWL029
cccuuugucuaugauugcua

SEQ ID NO: 2527740 - RNA, 15 nt, Chlamydophila pneumoniae CWL029
ccgaaaguaucuuca

SEQ ID NO: 2527741 - RNA, 22 nt, Chlamydophila pneumoniae CWL029
ccgaagacaaugucgucucaga

SEQ ID NO: 2527742 - RNA, 15 nt, Chlamydophila pneumoniae CWL029
ccgaagacuaccaau

SEQ ID NO: 2527743 - RNA, 21 nt, Chlamydophila pneumoniae CWL029
ccgaagccuucauuccaugag

SEQ ID NO: 2527744 - RNA, 15 nt, Chlamydophila pneumoniae CWL029
ccgaaucucuccagc

SEQ ID NO: 2527745 - RNA, 18 nt, Chlamydophila pneumoniae CWL029
ccgaaucuuucaaaagaa

SEQ ID NO: 2527746 - RNA, 22 nt, Chlamydophila pneumoniae CWL029
ccgacaagcuucguccugacac

SEQ ID NO: 2527747 - RNA, 17 nt, Chlamydophila pneumoniae CWL029
ccgacauucacccucau

SEQ ID NO: 2527748 - RNA, 15 nt, Chlamydophila pneumoniae CWL029
ccgagcuuuuugcuu

SEQ ID NO: 2527749 - RNA, 19 nt, Chlamydophila pneumoniae CWL029
ccgaggagggaaacaccgu

SEQ ID NO: 2527750 - RNA, 16 nt, Chlamydophila pneumoniae CWL029
ccgaucauuuuugcua

SEQ ID NO: 2527751 - RNA, 12 nt, Chlamydophila pneumoniae CWL029
ccgcaaaccauc

SEQ ID NO: 2527752 - RNA, 18 nt, Chlamydophila pneumoniae CWL029
ccgcaaauacagacagau

SEQ ID NO: 2527753 - RNA, 16 nt, Chlamydophila pneumoniae CWL029
ccgcagcaaaaauaug

SEQ ID NO: 2527754 - RNA, 13 nt, Chlamydophila pneumoniae CWL029
ccgcauauugauc

SEQ ID NO: 2527755 - RNA, 20 nt, Chlamydophila pneumoniae CWL029
ccgccuugacggguugugaa

SEQ ID NO: 2527756 - RNA, 16 nt, Chlamydophila pneumoniae CWL029
ccgccuuuauauaaag

SEQ ID NO: 2527757 - RNA, 23 nt, Chlamydophila pneumoniae CWL029
ccgcucuaagcugugcauuuucu

SEQ ID NO: 2527758 - RNA, 21 nt, Chlamydophila pneumoniae CWL029
ccgcuguauuuucagcacuga

SEQ ID NO: 2527759 - RNA, 19 nt, Chlamydophila pneumoniae CWL029
ccggagcuucuaagaucuu

SEQ ID NO: 2527760 - RNA, 17 nt, Chlamydophila pneumoniae CWL029
ccggcgguggaaaagga

SEQ ID NO: 2527761 - RNA, 17 nt, Chlamydophila pneumoniae CWL029
ccggcuuguaggaucug

SEQ ID NO: 2527762 - RNA, 14 nt, Chlamydophila pneumoniae CWL029
ccgggaaacaucag

SEQ ID NO: 2527763 - RNA, 14 nt, Chlamydophila pneumoniae CWL029
ccguaaaagaacgu

SEQ ID NO: 2527764 - RNA, 18 nt, Chlamydophila pneumoniae CWL029
ccguaaagaaaagcaauc

SEQ ID NO: 2527765 - RNA, 21 nt, Chlamydophila pneumoniae CWL029
ccguaggguagccauccacga

SEQ ID NO: 2527766 - RNA, 14 nt, Chlamydophila pneumoniae CWL029
ccguauucccaggu

SEQ ID NO: 2527767 - RNA, 12 nt, Chlamydophila pneumoniae CWL029
ccguccucccca

SEQ ID NO: 2527768 - RNA, 14 nt, Chlamydophila pneumoniae CWL029
ccgugaacaaaaac

SEQ ID NO: 2527769 - RNA, 15 nt, Chlamydophila pneumoniae CWL029
ccgugacuccagaag

SEQ ID NO: 2527770 - RNA, 17 nt, Chlamydophila pneumoniae CWL029
ccgugacuccagaaggu

SEQ ID NO: 2527771 - RNA, 17 nt, Chlamydophila pneumoniae CWL029
ccgugagauacuuuaaa

SEQ ID NO: 2527772 - RNA, 13 nt, Chlamydophila pneumoniae CWL029
ccguucgagaggu

SEQ ID NO: 2527773 - RNA, 13 nt, Chlamydophila pneumoniae CWL029
ccguuugucccuu

SEQ ID NO: 2527774 - RNA, 20 nt, Chlamydophila pneumoniae CWL029
ccuaaaaaggucagcccugc

SEQ ID NO: 2527775 - RNA, 21 nt, Chlamydophila pneumoniae CWL029
ccuaaaccaucacuuccuguu

SEQ ID NO: 2527776 - RNA, 11 nt, Chlamydophila pneumoniae CWL029
ccuaaagcauc

SEQ ID NO: 2527777 - RNA, 23 nt, Chlamydophila pneumoniae CWL029
ccuaaaguuugagcuaagcugaa

SEQ ID NO: 2527778 - RNA, 19 nt, Chlamydophila pneumoniae CWL029
ccuaaaucugcuuuuaucu

SEQ ID NO: 2527779 - RNA, 20 nt, Chlamydophila pneumoniae CWL029
ccuaaaucugcuuuuaucuc

SEQ ID NO: 2527780 - RNA, 21 nt, Chlamydophila pneumoniae CWL029
ccuaaaucugcuuuuaucuca

SEQ ID NO: 2527781 - RNA, 16 nt, Chlamydophila pneumoniae CWL029
ccuaaauuaaauaucu

SEQ ID NO: 2527782 - RNA, 16 nt, Chlamydophila pneumoniae CWL029
ccuaaauucauaacac

SEQ ID NO: 2527783 - RNA, 15 nt, Chlamydophila pneumoniae CWL029
ccuaacggcuugccu

SEQ ID NO: 2527784 - RNA, 18 nt, Chlamydophila pneumoniae CWL029
ccuaagagauuuuccaua

SEQ ID NO: 2527785 - RNA, 17 nt, Chlamydophila pneumoniae CWL029
ccuaagcucauaagaaa

SEQ ID NO: 2527786 - RNA, 15 nt, Chlamydophila pneumoniae CWL029
ccuaagggcucuccu

SEQ ID NO: 2527787 - RNA, 16 nt, Chlamydophila pneumoniae CWL029
ccuaagggcucuccua

SEQ ID NO: 2527788 - RNA, 20 nt, Chlamydophila pneumoniae CWL029
ccuaagguuuccaugagaau

SEQ ID NO: 2527789 - RNA, 17 nt, Chlamydophila pneumoniae CWL029
ccuaagucguuaacauc

SEQ ID NO: 2527790 - RNA, 16 nt, Chlamydophila pneumoniae CWL029
ccuaagugauaaggaa

SEQ ID NO: 2527791 - RNA, 24 nt, Chlamydophila pneumoniae CWL029
ccuaauuccuucaaagcuuguucc

SEQ ID NO: 2527792 - RNA, 19 nt, Chlamydophila pneumoniae CWL029
ccuaauucucgagcagcug

SEQ ID NO: 2527793 - RNA, 19 nt, Chlamydophila pneumoniae CWL029
ccuacaaucgccuuacaau

SEQ ID NO: 2527794 - RNA, 23 nt, Chlamydophila pneumoniae CWL029
ccuacagaucaggauucuaaaaa

SEQ ID NO: 2527795 - RNA, 18 nt, Chlamydophila pneumoniae CWL029
ccuaccucugggaagacu

SEQ ID NO: 2527796 - RNA, 15 nt, Chlamydophila pneumoniae CWL029
ccuacguuuucucua

SEQ ID NO: 2527797 - RNA, 13 nt, Chlamydophila pneumoniae CWL029
ccuacuucugcag

SEQ ID NO: 2527798 - RNA, 14 nt, Chlamydophila pneumoniae CWL029
ccuagaauaggaau

SEQ ID NO: 2527799 - RNA, 21 nt, Chlamydophila pneumoniae CWL029
ccuagagaguucuuguaauaa

SEQ ID NO: 2527800 - RNA, 17 nt, Chlamydophila pneumoniae CWL029
ccuagauagcaaaucaa

SEQ ID NO: 2527801 - RNA, 11 nt, Chlamydophila pneumoniae CWL029
ccuaggaggau

SEQ ID NO: 2527802 - RNA, 14 nt, Chlamydophila pneumoniae CWL029
ccuagguucuuuuc

SEQ ID NO: 2527803 - RNA, 21 nt, Chlamydophila pneumoniae CWL029
ccuaguucauuagcuaaauca

SEQ ID NO: 2527804 - RNA, 18 nt, Chlamydophila pneumoniae CWL029
ccuauaaaaaccuuaucg

SEQ ID NO: 2527805 - RNA, 21 nt, Chlamydophila pneumoniae CWL029
ccuauaccaucuuuaaaaggc

SEQ ID NO: 2527806 - RNA, 16 nt, Chlamydophila pneumoniae CWL029
ccuauaguauaauagu

SEQ ID NO: 2527807 - RNA, 21 nt, Chlamydophila pneumoniae CWL029
ccuauaguauaauagugagcu

SEQ ID NO: 2527808 - RNA, 21 nt, Chlamydophila pneumoniae CWL029
ccuauauuuuuuacauaacac

SEQ ID NO: 2527809 - RNA, 13 nt, Chlamydophila pneumoniae CWL029
ccuaucaaagcaa

SEQ ID NO: 2527810 - RNA, 16 nt, Chlamydophila pneumoniae CWL029
ccuaucaaagcaaaag

SEQ ID NO: 2527811 - RNA, 18 nt, Chlamydophila pneumoniae CWL029
ccuaucaaagcaaaaguc

SEQ ID NO: 2527812 - RNA, 20 nt, Chlamydophila pneumoniae CWL029
ccuaugacggauccuagaau

SEQ ID NO: 2527813 - RNA, 17 nt, Chlamydophila pneumoniae CWL029
ccuauugguguaucucu

SEQ ID NO: 2527814 - RNA, 10 nt, Chlamydophila pneumoniae CWL029
ccuauuuaag

SEQ ID NO: 2527815 - RNA, 19 nt, Chlamydophila pneumoniae CWL029
ccucaaagaguuuuuuaga

SEQ ID NO: 2527816 - RNA, 16 nt, Chlamydophila pneumoniae CWL029
ccucaagauaaauccc

SEQ ID NO: 2527817 - RNA, 18 nt, Chlamydophila pneumoniae CWL029
ccucaagauaaaucccac

SEQ ID NO: 2527818 - RNA, 17 nt, Chlamydophila pneumoniae CWL029
ccucacauguuucacuu

SEQ ID NO: 2527819 - RNA, 19 nt, Chlamydophila pneumoniae CWL029
ccucacuaacggcaguaug

SEQ ID NO: 2527820 - RNA, 21 nt, Chlamydophila pneumoniae CWL029
ccucagaauccauuuugccca

SEQ ID NO: 2527821 - RNA, 20 nt, Chlamydophila pneumoniae CWL029
ccucaucagaggccaccaaa

SEQ ID NO: 2527822 - RNA, 23 nt, Chlamydophila pneumoniae CWL029
ccucaucagaggccaccaaaaau

SEQ ID NO: 2527823 - RNA, 13 nt, Chlamydophila pneumoniae CWL029
ccucaucaucaga

SEQ ID NO: 2527824 - RNA, 17 nt, Chlamydophila pneumoniae CWL029
ccucauccucaucauca

SEQ ID NO: 2527825 - RNA, 16 nt, Chlamydophila pneumoniae CWL029
ccucauucaaggcgcc

SEQ ID NO: 2527826 - RNA, 22 nt, Chlamydophila pneumoniae CWL029
ccuccaaaagaccaaaaauaaa

SEQ ID NO: 2527827 - RNA, 15 nt, Chlamydophila pneumoniae CWL029
ccuccaccagaagca

SEQ ID NO: 2527828 - RNA, 17 nt, Chlamydophila pneumoniae CWL029
ccuccauaaugcugaga

SEQ ID NO: 2527829 - RNA, 12 nt, Chlamydophila pneumoniae CWL029
ccuccauuuaga

SEQ ID NO: 2527830 - RNA, 21 nt, Chlamydophila pneumoniae CWL029
ccuccgaggagggaaacaccg

SEQ ID NO: 2527831 - RNA, 21 nt, Chlamydophila pneumoniae CWL029
ccuccgcccccuugcacccca

SEQ ID NO: 2527832 - RNA, 18 nt, Chlamydophila pneumoniae CWL029
ccuccucuucuauucuga

SEQ ID NO: 2527833 - RNA, 20 nt, Chlamydophila pneumoniae CWL029
ccuccucuucuauucugaua

SEQ ID NO: 2527834 - RNA, 12 nt, Chlamydophila pneumoniae CWL029
ccuccucuucuu

SEQ ID NO: 2527835 - RNA, 22 nt, Chlamydophila pneumoniae CWL029
ccuccugcagggggcauucccu

SEQ ID NO: 2527836 - RNA, 17 nt, Chlamydophila pneumoniae CWL029
ccuccuucugcaugaau

SEQ ID NO: 2527837 - RNA, 14 nt, Chlamydophila pneumoniae CWL029
ccucgacuuccucc

SEQ ID NO: 2527838 - RNA, 21 nt, Chlamydophila pneumoniae CWL029
ccucgaguauggcaaauaaaa

SEQ ID NO: 2527839 - RNA, 17 nt, Chlamydophila pneumoniae CWL029
ccucgauacuguugauc

SEQ ID NO: 2527840 - RNA, 13 nt, Chlamydophila pneumoniae CWL029
ccucgccaaacca

SEQ ID NO: 2527841 - RNA, 16 nt, Chlamydophila pneumoniae CWL029
ccucgccgcugcccua

SEQ ID NO: 2527842 - RNA, 21 nt, Chlamydophila pneumoniae CWL029
ccucgguuauuuuuccagaaa

SEQ ID NO: 2527843 - RNA, 16 nt, Chlamydophila pneumoniae CWL029
ccucgucaccugagcu

SEQ ID NO: 2527844 - RNA, 22 nt, Chlamydophila pneumoniae CWL029
ccucuaaacauaaagacccuuc

SEQ ID NO: 2527845 - RNA, 22 nt, Chlamydophila pneumoniae CWL029
ccucuaaggacaaaucucccaa

SEQ ID NO: 2527846 - RNA, 20 nt, Chlamydophila pneumoniae CWL029
ccucuacgcuauucuuaagc

SEQ ID NO: 2527847 - RNA, 15 nt, Chlamydophila pneumoniae CWL029
ccucuacgcucuuaa

SEQ ID NO: 2527848 - RNA, 15 nt, Chlamydophila pneumoniae CWL029
ccucuagaagacaca

SEQ ID NO: 2527849 - RNA, 18 nt, Chlamydophila pneumoniae CWL029
ccucucacauuugcagac

SEQ ID NO: 2527850 - RNA, 19 nt, Chlamydophila pneumoniae CWL029
ccucucaucaaagcaaaga

SEQ ID NO: 2527851 - RNA, 22 nt, Chlamydophila pneumoniae CWL029
ccucucaugaaauuuucuaaga

SEQ ID NO: 2527852 - RNA, 23 nt, Chlamydophila pneumoniae CWL029
ccucucaugaaauuuucuaagag

SEQ ID NO: 2527853 - RNA, 14 nt, Chlamydophila pneumoniae CWL029
ccucucccuuggga

SEQ ID NO: 2527854 - RNA, 19 nt, Chlamydophila pneumoniae CWL029
ccucugauuauuucuaaaa

SEQ ID NO: 2527855 - RNA, 20 nt, Chlamydophila pneumoniae CWL029
ccucugcauauaaagacucu

SEQ ID NO: 2527856 - RNA, 20 nt, Chlamydophila pneumoniae CWL029
ccucugggaagacucucauc

SEQ ID NO: 2527857 - RNA, 14 nt, Chlamydophila pneumoniae CWL029
ccucuucaauuucu

SEQ ID NO: 2527858 - RNA, 19 nt, Chlamydophila pneumoniae CWL029
ccucuucaauuucuucauc

SEQ ID NO: 2527859 - RNA, 20 nt, Chlamydophila pneumoniae CWL029
ccucuugaggaccuuccuua

SEQ ID NO: 2527860 - RNA, 14 nt, Chlamydophila pneumoniae CWL029
ccucuugcuuuucc

SEQ ID NO: 2527861 - RNA, 13 nt, Chlamydophila pneumoniae CWL029
ccugaaaaaacag

SEQ ID NO: 2527862 - RNA, 16 nt, Chlamydophila pneumoniae CWL029
ccugaacaucuccagc

SEQ ID NO: 2527863 - RNA, 13 nt, Chlamydophila pneumoniae CWL029
ccugaagcagcuu

SEQ ID NO: 2527864 - RNA, 17 nt, Chlamydophila pneumoniae CWL029
ccugacucuuauugcag

SEQ ID NO: 2527865 - RNA, 20 nt, Chlamydophila pneumoniae CWL029
ccugacucuuuuaagacaau

SEQ ID NO: 2527866 - RNA, 21 nt, Chlamydophila pneumoniae CWL029
ccugacucuuuuaagacaaua

SEQ ID NO: 2527867 - RNA, 20 nt, Chlamydophila pneumoniae CWL029
ccugagaaaaguugccuaaa

SEQ ID NO: 2527868 - RNA, 12 nt, Chlamydophila pneumoniae CWL029
ccugagaguguu

SEQ ID NO: 2527869 - RNA, 21 nt, Chlamydophila pneumoniae CWL029
ccugaggcuauagaauacaca

SEQ ID NO: 2527870 - RNA, 23 nt, Chlamydophila pneumoniae CWL029
ccugaguacuuugugauuacagc

SEQ ID NO: 2527871 - RNA, 15 nt, Chlamydophila pneumoniae CWL029
ccugaguauccgaau

SEQ ID NO: 2527872 - RNA, 22 nt, Chlamydophila pneumoniae CWL029
ccugaguauuuugcaaaugaaa

SEQ ID NO: 2527873 - RNA, 17 nt, Chlamydophila pneumoniae CWL029
ccugauacgcagcuaga

SEQ ID NO: 2527874 - RNA, 14 nt, Chlamydophila pneumoniae CWL029
ccugaucuucuuga

SEQ ID NO: 2527875 - RNA, 23 nt, Chlamydophila pneumoniae CWL029
ccugcaaaaaaccagccaauaac

SEQ ID NO: 2527876 - RNA, 13 nt, Chlamydophila pneumoniae CWL029
ccugcauggcuuu

SEQ ID NO: 2527877 - RNA, 15 nt, Chlamydophila pneumoniae CWL029
ccugcauucauaaaa

SEQ ID NO: 2527878 - RNA, 19 nt, Chlamydophila pneumoniae CWL029
ccugcccauuuuuggaaaa

SEQ ID NO: 2527879 - RNA, 16 nt, Chlamydophila pneumoniae CWL029
ccugccucacagcuaa

SEQ ID NO: 2527880 - RNA, 16 nt, Chlamydophila pneumoniae CWL029
ccugcuaaacuuuuuu

SEQ ID NO: 2527881 - RNA, 12 nt, Chlamydophila pneumoniae CWL029
ccugcugcuuca

SEQ ID NO: 2527882 - RNA, 21 nt, Chlamydophila pneumoniae CWL029
ccugcuucuauagagacacga

SEQ ID NO: 2527883 - RNA, 17 nt, Chlamydophila pneumoniae CWL029
ccuggaaagcuucugga

SEQ ID NO: 2527884 - RNA, 23 nt, Chlamydophila pneumoniae CWL029
ccuggaaaugaauauaauuccaa

SEQ ID NO: 2527885 - RNA, 20 nt, Chlamydophila pneumoniae CWL029
ccuggaacaguauaaucaga

SEQ ID NO: 2527886 - RNA, 21 nt, Chlamydophila pneumoniae CWL029
ccuggaggcgguggcaugcca

SEQ ID NO: 2527887 - RNA, 14 nt, Chlamydophila pneumoniae CWL029
ccuggauuuaggau

SEQ ID NO: 2527888 - RNA, 23 nt, Chlamydophila pneumoniae CWL029
ccugggcucacucuaagcgaaac

SEQ ID NO: 2527889 - RNA, 21 nt, Chlamydophila pneumoniae CWL029
ccugggggacuucaaaugaaa

SEQ ID NO: 2527890 - RNA, 13 nt, Chlamydophila pneumoniae CWL029
ccuguaacacccu

SEQ ID NO: 2527891 - RNA, 15 nt, Chlamydophila pneumoniae CWL029
ccuguaacacccucc

SEQ ID NO: 2527892 - RNA, 20 nt, Chlamydophila pneumoniae CWL029
ccuguaauugauguuccuug

SEQ ID NO: 2527893 - RNA, 22 nt, Chlamydophila pneumoniae CWL029
ccuguaccacauacucuucauc

SEQ ID NO: 2527894 - RNA, 17 nt, Chlamydophila pneumoniae CWL029
ccuguacgguaaaucca

SEQ ID NO: 2527895 - RNA, 19 nt, Chlamydophila pneumoniae CWL029
ccuguaguaaaauaagaaa

SEQ ID NO: 2527896 - RNA, 22 nt, Chlamydophila pneumoniae CWL029
ccuguaguuucuaaaacagaaa

SEQ ID NO: 2527897 - RNA, 16 nt, Chlamydophila pneumoniae CWL029
ccuguauuaaagaauc

SEQ ID NO: 2527898 - RNA, 21 nt, Chlamydophila pneumoniae CWL029
ccuguauuaaagaaucuaacu

SEQ ID NO: 2527899 - RNA, 19 nt, Chlamydophila pneumoniae CWL029
ccugucacaauaccaucuc

SEQ ID NO: 2527900 - RNA, 21 nt, Chlamydophila pneumoniae CWL029
ccuguccaacuaaaacagccu

SEQ ID NO: 2527901 - RNA, 19 nt, Chlamydophila pneumoniae CWL029
ccugugauaguagaacugc

SEQ ID NO: 2527902 - RNA, 13 nt, Chlamydophila pneumoniae CWL029
ccugugauuuccu

SEQ ID NO: 2527903 - RNA, 17 nt, Chlamydophila pneumoniae CWL029
ccugugauuuccugacu

SEQ ID NO: 2527904 - RNA, 21 nt, Chlamydophila pneumoniae CWL029
ccugugugguuggauccaucg

SEQ ID NO: 2527905 - RNA, 16 nt, Chlamydophila pneumoniae CWL029
ccuguguguuuuuucc

SEQ ID NO: 2527906 - RNA, 21 nt, Chlamydophila pneumoniae CWL029
ccuguugucacuaagauaucu

SEQ ID NO: 2527907 - RNA, 22 nt, Chlamydophila pneumoniae CWL029
ccuguuuucuuuucugaagauu

SEQ ID NO: 2527908 - RNA, 17 nt, Chlamydophila pneumoniae CWL029
ccuuaaccuccucaaga

SEQ ID NO: 2527909 - RNA, 17 nt, Chlamydophila pneumoniae CWL029
ccuuacaagcuuccuug

SEQ ID NO: 2527910 - RNA, 20 nt, Chlamydophila pneumoniae CWL029
ccuuacggccccuggaauuu

SEQ ID NO: 2527911 - RNA, 22 nt, Chlamydophila pneumoniae CWL029
ccuuagcagcacccauaaggga

SEQ ID NO: 2527912 - RNA, 18 nt, Chlamydophila pneumoniae CWL029
ccuuaggcuuaauaaaca

SEQ ID NO: 2527913 - RNA, 15 nt, Chlamydophila pneumoniae CWL029
ccuuaguuuuuucua

SEQ ID NO: 2527914 - RNA, 22 nt, Chlamydophila pneumoniae CWL029
ccuuaucgccaacggcauagga

SEQ ID NO: 2527915 - RNA, 17 nt, Chlamydophila pneumoniae CWL029
ccuuauugguaacacga

SEQ ID NO: 2527916 - RNA, 12 nt, Chlamydophila pneumoniae CWL029
ccuucaacacac

SEQ ID NO: 2527917 - RNA, 20 nt, Chlamydophila pneumoniae CWL029
ccuucaacacaccauuuuug

SEQ ID NO: 2527918 - RNA, 16 nt, Chlamydophila pneumoniae CWL029
ccuucaagucgagaaa

SEQ ID NO: 2527919 - RNA, 19 nt, Chlamydophila pneumoniae CWL029
ccuucacaagaaaacaaag

SEQ ID NO: 2527920 - RNA, 18 nt, Chlamydophila pneumoniae CWL029
ccuucagaauucucaagu

SEQ ID NO: 2527921 - RNA, 22 nt, Chlamydophila pneumoniae CWL029
ccuucauacguuuuuuuccuuu

SEQ ID NO: 2527922 - RNA, 14 nt, Chlamydophila pneumoniae CWL029
ccuuccaagugcuc

SEQ ID NO: 2527923 - RNA, 12 nt, Chlamydophila pneumoniae CWL029
ccuuccaauacu

SEQ ID NO: 2527924 - RNA, 14 nt, Chlamydophila pneumoniae CWL029
ccuucgauuccagg

SEQ ID NO: 2527925 - RNA, 16 nt, Chlamydophila pneumoniae CWL029
ccuucggaucuuccca

SEQ ID NO: 2527926 - RNA, 14 nt, Chlamydophila pneumoniae CWL029
ccuucuaauuucag

SEQ ID NO: 2527927 - RNA, 14 nt, Chlamydophila pneumoniae CWL029
ccuucucagaaaga

SEQ ID NO: 2527928 - RNA, 15 nt, Chlamydophila pneumoniae CWL029
ccuucucauugcggc

SEQ ID NO: 2527929 - RNA, 11 nt, Chlamydophila pneumoniae CWL029
ccuucucccuc

SEQ ID NO: 2527930 - RNA, 16 nt, Chlamydophila pneumoniae CWL029
ccuucucgucauucug

SEQ ID NO: 2527931 - RNA, 16 nt, Chlamydophila pneumoniae CWL029
ccuucuguuuucacau

SEQ ID NO: 2527932 - RNA, 15 nt, Chlamydophila pneumoniae CWL029
ccuucuuaguaaaga

SEQ ID NO: 2527933 - RNA, 23 nt, Chlamydophila pneumoniae CWL029
ccuucuucuuguucuucuugauu

SEQ ID NO: 2527934 - RNA, 11 nt, Chlamydophila pneumoniae CWL029
ccuucuugcaa

SEQ ID NO: 2527935 - RNA, 21 nt, Chlamydophila pneumoniae CWL029
ccuucuugcaaagauaaccau

SEQ ID NO: 2527936 - RNA, 13 nt, Chlamydophila pneumoniae CWL029
ccuucuuuaccua

SEQ ID NO: 2527937 - RNA, 15 nt, Chlamydophila pneumoniae CWL029
ccuucuuucaauagc

SEQ ID NO: 2527938 - RNA, 18 nt, Chlamydophila pneumoniae CWL029
ccuucuuucaauagcuuc

SEQ ID NO: 2527939 - RNA, 20 nt, Chlamydophila pneumoniae CWL029
ccuucuuucaauagcuucca

SEQ ID NO: 2527940 - RNA, 21 nt, Chlamydophila pneumoniae CWL029
ccuucuuucaauagcuuccaa

SEQ ID NO: 2527941 - RNA, 14 nt, Chlamydophila pneumoniae CWL029
ccuugaaaaucaag

SEQ ID NO: 2527942 - RNA, 15 nt, Chlamydophila pneumoniae CWL029
ccuugacuaaaucca

SEQ ID NO: 2527943 - RNA, 13 nt, Chlamydophila pneumoniae CWL029
ccuugcagcccug

SEQ ID NO: 2527944 - RNA, 13 nt, Chlamydophila pneumoniae CWL029
ccuuggaaaucag

SEQ ID NO: 2527945 - RNA, 23 nt, Chlamydophila pneumoniae CWL029
ccuugggauuccuuaaugguagc

SEQ ID NO: 2527946 - RNA, 14 nt, Chlamydophila pneumoniae CWL029
ccuugguaucccaa

SEQ ID NO: 2527947 - RNA, 15 nt, Chlamydophila pneumoniae CWL029
ccuuguauaagagca

SEQ ID NO: 2527948 - RNA, 15 nt, Chlamydophila pneumoniae CWL029
ccuugugagaggguc

SEQ ID NO: 2527949 - RNA, 16 nt, Chlamydophila pneumoniae CWL029
ccuugugucuuaaagc

SEQ ID NO: 2527950 - RNA, 12 nt, Chlamydophila pneumoniae CWL029
ccuuguuuuccu

SEQ ID NO: 2527951 - RNA, 13 nt, Chlamydophila pneumoniae CWL029
ccuuguuuuccug

SEQ ID NO: 2527952 - RNA, 16 nt, Chlamydophila pneumoniae CWL029
ccuuuaaauaaaaucg

SEQ ID NO: 2527953 - RNA, 15 nt, Chlamydophila pneumoniae CWL029
ccuuuagcugcugaa

SEQ ID NO: 2527954 - RNA, 16 nt, Chlamydophila pneumoniae CWL029
ccuuuaggaagcugua

SEQ ID NO: 2527955 - RNA, 22 nt, Chlamydophila pneumoniae CWL029
ccuuuauacuguuuuucuucca

SEQ ID NO: 2527956 - RNA, 20 nt, Chlamydophila pneumoniae CWL029
ccuuucacaaagaauucaga

SEQ ID NO: 2527957 - RNA, 19 nt, Chlamydophila pneumoniae CWL029
ccuuucuccagcauuuuug

SEQ ID NO: 2527958 - RNA, 23 nt, Chlamydophila pneumoniae CWL029
ccuuucucuuccgauuaacuuua

SEQ ID NO: 2527959 - RNA, 17 nt, Chlamydophila pneumoniae CWL029
ccuuucuuuugcuuuuc

SEQ ID NO: 2527960 - RNA, 18 nt, Chlamydophila pneumoniae CWL029
ccuuucuuuugcuuuucc

SEQ ID NO: 2527961 - RNA, 21 nt, Chlamydophila pneumoniae CWL029
ccuuugcaaaccaaucuugag

SEQ ID NO: 2527962 - RNA, 18 nt, Chlamydophila pneumoniae CWL029
ccuuuucagauuuuuuaa

SEQ ID NO: 2527963 - RNA, 13 nt, Chlamydophila pneumoniae CWL029
ccuuuucuccuuc

SEQ ID NO: 2527964 - RNA, 19 nt, Chlamydophila pneumoniae CWL029
ccuuuuucauugaugcuua

SEQ ID NO: 2527965 - RNA, 19 nt, Chlamydophila pneumoniae CWL029
cgaaaaacgguaaauaucu

SEQ ID NO: 2527966 - RNA, 15 nt, Chlamydophila pneumoniae CWL029
cgaaaaauaccucag

SEQ ID NO: 2527967 - RNA, 13 nt, Chlamydophila pneumoniae CWL029
cgaaaaucuacac

SEQ ID NO: 2527968 - RNA, 18 nt, Chlamydophila pneumoniae CWL029
cgaaagcuacagcuaacg

SEQ ID NO: 2527969 - RNA, 13 nt, Chlamydophila pneumoniae CWL029
cgaaauccuaaaa

SEQ ID NO: 2527970 - RNA, 15 nt, Chlamydophila pneumoniae CWL029
cgaaauccuaaaaag

SEQ ID NO: 2527971 - RNA, 21 nt, Chlamydophila pneumoniae CWL029
cgaaauccuaaaaaggguucc

SEQ ID NO: 2527972 - RNA, 16 nt, Chlamydophila pneumoniae CWL029
cgaaaugucgcuacca

SEQ ID NO: 2527973 - RNA, 19 nt, Chlamydophila pneumoniae CWL029
cgaacacgucgaacaugac

SEQ ID NO: 2527974 - RNA, 13 nt, Chlamydophila pneumoniae CWL029
cgaacaguuccua

SEQ ID NO: 2527975 - RNA, 18 nt, Chlamydophila pneumoniae CWL029
cgaacaguuccuauuuuu

SEQ ID NO: 2527976 - RNA, 14 nt, Chlamydophila pneumoniae CWL029
cgaacaugccugaa

SEQ ID NO: 2527977 - RNA, 23 nt, Chlamydophila pneumoniae CWL029
cgaacgguugaggguucaauucc

SEQ ID NO: 2527978 - RNA, 21 nt, Chlamydophila pneumoniae CWL029
cgaacuauagcaauccauagu

SEQ ID NO: 2527979 - RNA, 17 nt, Chlamydophila pneumoniae CWL029
cgaagacucaaagaacu

SEQ ID NO: 2527980 - RNA, 22 nt, Chlamydophila pneumoniae CWL029
cgaagacuuguucuucauuauu

SEQ ID NO: 2527981 - RNA, 19 nt, Chlamydophila pneumoniae CWL029
cgaagauucaaagaagucg

SEQ ID NO: 2527982 - RNA, 19 nt, Chlamydophila pneumoniae CWL029
cgaagcggagcaucuuuuc

SEQ ID NO: 2527983 - RNA, 21 nt, Chlamydophila pneumoniae CWL029
cgaaguugauuguagagacau

SEQ ID NO: 2527984 - RNA, 11 nt, Chlamydophila pneumoniae CWL029
cgaauaacuac

SEQ ID NO: 2527985 - RNA, 21 nt, Chlamydophila pneumoniae CWL029
cgaauaaguuuugauuuugca

SEQ ID NO: 2527986 - RNA, 17 nt, Chlamydophila pneumoniae CWL029
cgaauagcucuggagau

SEQ ID NO: 2527987 - RNA, 22 nt, Chlamydophila pneumoniae CWL029
cgaauaggcauuacacaacucu

SEQ ID NO: 2527988 - RNA, 21 nt, Chlamydophila pneumoniae CWL029
cgaaucccuguguguuuuuuc

SEQ ID NO: 2527989 - RNA, 21 nt, Chlamydophila pneumoniae CWL029
cgaauccuagagaaccuccua

SEQ ID NO: 2527990 - RNA, 16 nt, Chlamydophila pneumoniae CWL029
cgaauccugaggaugc

SEQ ID NO: 2527991 - RNA, 13 nt, Chlamydophila pneumoniae CWL029
cgaaucuaaaaac

SEQ ID NO: 2527992 - RNA, 22 nt, Chlamydophila pneumoniae CWL029
cgaaucuaaaaacuucccaucu

SEQ ID NO: 2527993 - RNA, 12 nt, Chlamydophila pneumoniae CWL029
cgaaucucucca

SEQ ID NO: 2527994 - RNA, 13 nt, Chlamydophila pneumoniae CWL029
cgaaucucuccag

SEQ ID NO: 2527995 - RNA, 16 nt, Chlamydophila pneumoniae CWL029
cgaaucuuuauuucug

SEQ ID NO: 2527996 - RNA, 20 nt, Chlamydophila pneumoniae CWL029
cgaaugcugcacaguucaca

SEQ ID NO: 2527997 - RNA, 18 nt, Chlamydophila pneumoniae CWL029
cgaaugucguuaaaaacu

SEQ ID NO: 2527998 - RNA, 20 nt, Chlamydophila pneumoniae CWL029
cgaaugucguuaaaaacuau

SEQ ID NO: 2527999 - RNA, 13 nt, Chlamydophila pneumoniae CWL029
cgaauucucagaa

SEQ ID NO: 2528000 - RNA, 14 nt, Chlamydophila pneumoniae CWL029
cgaauuucuuguuc

SEQ ID NO: 2528001 - RNA, 14 nt, Chlamydophila pneumoniae CWL029
cgacaaaaaugccu

SEQ ID NO: 2528002 - RNA, 22 nt, Chlamydophila pneumoniae CWL029
cgacaagacaaugacuguagga

SEQ ID NO: 2528003 - RNA, 13 nt, Chlamydophila pneumoniae CWL029
cgacaaggaagcc

SEQ ID NO: 2528004 - RNA, 13 nt, Chlamydophila pneumoniae CWL029
cgacacgaauuuc

SEQ ID NO: 2528005 - RNA, 21 nt, Chlamydophila pneumoniae CWL029
cgacacuauguguuuccuuuu

SEQ ID NO: 2528006 - RNA, 22 nt, Chlamydophila pneumoniae CWL029
cgacacuauguguuuccuuuuc

SEQ ID NO: 2528007 - RNA, 15 nt, Chlamydophila pneumoniae CWL029
cgacaugagaaaucu

SEQ ID NO: 2528008 - RNA, 20 nt, Chlamydophila pneumoniae CWL029
cgacaugcaggccaacucuc

SEQ ID NO: 2528009 - RNA, 16 nt, Chlamydophila pneumoniae CWL029
cgacaugcuuuccuuc

SEQ ID NO: 2528010 - RNA, 15 nt, Chlamydophila pneumoniae CWL029
cgaccaacuccucaa

SEQ ID NO: 2528011 - RNA, 17 nt, Chlamydophila pneumoniae CWL029
cgaccuaggagaaauca

SEQ ID NO: 2528012 - RNA, 22 nt, Chlamydophila pneumoniae CWL029
cgaccuaggagaaaucacacuu

SEQ ID NO: 2528013 - RNA, 17 nt, Chlamydophila pneumoniae CWL029
cgaccucgaauuccucc

SEQ ID NO: 2528014 - RNA, 20 nt, Chlamydophila pneumoniae CWL029
cgaccucgaauuccucccag

SEQ ID NO: 2528015 - RNA, 22 nt, Chlamydophila pneumoniae CWL029
cgaccugagguaucaauaauga

SEQ ID NO: 2528016 - RNA, 15 nt, Chlamydophila pneumoniae CWL029
cgacgagaaggaaga

SEQ ID NO: 2528017 - RNA, 18 nt, Chlamydophila pneumoniae CWL029
cgacguuugaucuucucu

SEQ ID NO: 2528018 - RNA, 21 nt, Chlamydophila pneumoniae CWL029
cgacguuuugcuguggaauuu

SEQ ID NO: 2528019 - RNA, 16 nt, Chlamydophila pneumoniae CWL029
cgacuacaucuuguuc

SEQ ID NO: 2528020 - RNA, 16 nt, Chlamydophila pneumoniae CWL029
cgacucugccaugucu

SEQ ID NO: 2528021 - RNA, 22 nt, Chlamydophila pneumoniae CWL029
cgacuguacaaaugcaucucua

SEQ ID NO: 2528022 - RNA, 18 nt, Chlamydophila pneumoniae CWL029
cgacuucaccuugaaguu

SEQ ID NO: 2528023 - RNA, 23 nt, Chlamydophila pneumoniae CWL029
cgacuuccuccaauaaucacugu

SEQ ID NO: 2528024 - RNA, 19 nt, Chlamydophila pneumoniae CWL029
cgacuugccaaucuuccuu

SEQ ID NO: 2528025 - RNA, 14 nt, Chlamydophila pneumoniae CWL029
cgagaacguagcag

SEQ ID NO: 2528026 - RNA, 16 nt, Chlamydophila pneumoniae CWL029
cgagaagcuucaauga

SEQ ID NO: 2528027 - RNA, 17 nt, Chlamydophila pneumoniae CWL029
cgagacaguuuuggauu

SEQ ID NO: 2528028 - RNA, 17 nt, Chlamydophila pneumoniae CWL029
cgagacuauuuuggaaa

SEQ ID NO: 2528029 - RNA, 16 nt, Chlamydophila pneumoniae CWL029
cgagacugcaaaggaa

SEQ ID NO: 2528030 - RNA, 17 nt, Chlamydophila pneumoniae CWL029
cgagacugcaaaggaag

SEQ ID NO: 2528031 - RNA, 22 nt, Chlamydophila pneumoniae CWL029
cgagaggaaaucccgagauaug

SEQ ID NO: 2528032 - RNA, 19 nt, Chlamydophila pneumoniae CWL029
cgagaguugccaggaaacg

SEQ ID NO: 2528033 - RNA, 15 nt, Chlamydophila pneumoniae CWL029
cgagauaucgauagu

SEQ ID NO: 2528034 - RNA, 15 nt, Chlamydophila pneumoniae CWL029
cgagauaugaagaga

SEQ ID NO: 2528035 - RNA, 16 nt, Chlamydophila pneumoniae CWL029
cgagaucauuagcauc

SEQ ID NO: 2528036 - RNA, 18 nt, Chlamydophila pneumoniae CWL029
cgagauccuccuggaaga

SEQ ID NO: 2528037 - RNA, 16 nt, Chlamydophila pneumoniae CWL029
cgagaugaacauaauu

SEQ ID NO: 2528038 - RNA, 16 nt, Chlamydophila pneumoniae CWL029
cgagcagaaacuccaa

SEQ ID NO: 2528039 - RNA, 22 nt, Chlamydophila pneumoniae CWL029
cgagcaucucaagaguaggcaa

SEQ ID NO: 2528040 - RNA, 17 nt, Chlamydophila pneumoniae CWL029
cgagcauuuccaaaccc

SEQ ID NO: 2528041 - RNA, 14 nt, Chlamydophila pneumoniae CWL029
cgagcucacaaccc

SEQ ID NO: 2528042 - RNA, 20 nt, Chlamydophila pneumoniae CWL029
cgagcuuuuugcuuuucccu

SEQ ID NO: 2528043 - RNA, 14 nt, Chlamydophila pneumoniae CWL029
cgaggaaaaaggag

SEQ ID NO: 2528044 - RNA, 19 nt, Chlamydophila pneumoniae CWL029
cgaggaaaaaggaggaugu

SEQ ID NO: 2528045 - RNA, 17 nt, Chlamydophila pneumoniae CWL029
cgaggagcuuuuaccuu

SEQ ID NO: 2528046 - RNA, 18 nt, Chlamydophila pneumoniae CWL029
cgaggucuuuucuuuuua

SEQ ID NO: 2528047 - RNA, 19 nt, Chlamydophila pneumoniae CWL029
cgaggucuuuucuuuuuag

SEQ ID NO: 2528048 - RNA, 19 nt, Chlamydophila pneumoniae CWL029
cgaguaccucaucucugga

SEQ ID NO: 2528049 - RNA, 15 nt, Chlamydophila pneumoniae CWL029
cgagucccuucuuuc

SEQ ID NO: 2528050 - RNA, 15 nt, Chlamydophila pneumoniae CWL029
cgagugccuucuuca

SEQ ID NO: 2528051 - RNA, 19 nt, Chlamydophila pneumoniae CWL029
cgaguucgcggaucuucuu

SEQ ID NO: 2528052 - RNA, 13 nt, Chlamydophila pneumoniae CWL029
cgauaaaaacucc

SEQ ID NO: 2528053 - RNA, 15 nt, Chlamydophila pneumoniae CWL029
cgauaacacuucuuu

SEQ ID NO: 2528054 - RNA, 16 nt, Chlamydophila pneumoniae CWL029
cgauaacgauuucuug

SEQ ID NO: 2528055 - RNA, 21 nt, Chlamydophila pneumoniae CWL029
cgauaacguugccuguuuuau

SEQ ID NO: 2528056 - RNA, 17 nt, Chlamydophila pneumoniae CWL029
cgauaccgcuguuuuau

SEQ ID NO: 2528057 - RNA, 13 nt, Chlamydophila pneumoniae CWL029
cgauacgaaggau

SEQ ID NO: 2528058 - RNA, 20 nt, Chlamydophila pneumoniae CWL029
cgauacgaaggaucauauuu

SEQ ID NO: 2528059 - RNA, 19 nt, Chlamydophila pneumoniae CWL029
cgauagagauucuuucucg

SEQ ID NO: 2528060 - RNA, 19 nt, Chlamydophila pneumoniae CWL029
cgauaugggcuuugcuaac

SEQ ID NO: 2528061 - RNA, 20 nt, Chlamydophila pneumoniae CWL029
cgauauuuagagagaaacau

SEQ ID NO: 2528062 - RNA, 22 nt, Chlamydophila pneumoniae CWL029
cgaucaaauuccuucucagaaa

SEQ ID NO: 2528063 - RNA, 18 nt, Chlamydophila pneumoniae CWL029
cgaucgcaaucagcaaca

SEQ ID NO: 2528064 - RNA, 17 nt, Chlamydophila pneumoniae CWL029
cgaugacagggaaagaa

SEQ ID NO: 2528065 - RNA, 18 nt, Chlamydophila pneumoniae CWL029
cgaugacagggaaagaac

SEQ ID NO: 2528066 - RNA, 15 nt, Chlamydophila pneumoniae CWL029
cgaugacuuggcugg

SEQ ID NO: 2528067 - RNA, 23 nt, Chlamydophila pneumoniae CWL029
cgaugcuauuuuuccauggcuau

SEQ ID NO: 2528068 - RNA, 21 nt, Chlamydophila pneumoniae CWL029
cgauggcaguuuuaaugagag

SEQ ID NO: 2528069 - RNA, 14 nt, Chlamydophila pneumoniae CWL029
cgauguuccuuuuu

SEQ ID NO: 2528070 - RNA, 20 nt, Chlamydophila pneumoniae CWL029
cgauguuuaugaaaaucugc

SEQ ID NO: 2528071 - RNA, 24 nt, Chlamydophila pneumoniae CWL029
cgauuauuucuuguugcaauagca

SEQ ID NO: 2528072 - RNA, 14 nt, Chlamydophila pneumoniae CWL029
cgauuccugaggcu

SEQ ID NO: 2528073 - RNA, 15 nt, Chlamydophila pneumoniae CWL029
cgauuccugaggcua

SEQ ID NO: 2528074 - RNA, 22 nt, Chlamydophila pneumoniae CWL029
cgauuguaaaaguagcauccug

SEQ ID NO: 2528075 - RNA, 16 nt, Chlamydophila pneumoniae CWL029
cgauuguaauuucuag

SEQ ID NO: 2528076 - RNA, 20 nt, Chlamydophila pneumoniae CWL029
cgauuuagccguagauagua

SEQ ID NO: 2528077 - RNA, 13 nt, Chlamydophila pneumoniae CWL029
cgauuucccagaa

SEQ ID NO: 2528078 - RNA, 16 nt, Chlamydophila pneumoniae CWL029
cgcaaaucuuacauaa

SEQ ID NO: 2528079 - RNA, 22 nt, Chlamydophila pneumoniae CWL029
cgcaacuuaagauacuucucca

SEQ ID NO: 2528080 - RNA, 24 nt, Chlamydophila pneumoniae CWL029
cgcaagcacuuguuuuuucuucug

SEQ ID NO: 2528081 - RNA, 20 nt, Chlamydophila pneumoniae CWL029
cgcaaguaaagaaauucugg

SEQ ID NO: 2528082 - RNA, 21 nt, Chlamydophila pneumoniae CWL029
cgcacaccagcucgagaucuu

SEQ ID NO: 2528083 - RNA, 15 nt, Chlamydophila pneumoniae CWL029
cgcaccauuccuuag

SEQ ID NO: 2528084 - RNA, 20 nt, Chlamydophila pneumoniae CWL029
cgcagaaacacugaacgcca

SEQ ID NO: 2528085 - RNA, 21 nt, Chlamydophila pneumoniae CWL029
cgcaguggacggggagagcca

SEQ ID NO: 2528086 - RNA, 18 nt, Chlamydophila pneumoniae CWL029
cgcauaagagacauuucu

SEQ ID NO: 2528087 - RNA, 16 nt, Chlamydophila pneumoniae CWL029
cgcauaugcuccagaa

SEQ ID NO: 2528088 - RNA, 20 nt, Chlamydophila pneumoniae CWL029
cgcaucaaaaaauacauagg

SEQ ID NO: 2528089 - RNA, 16 nt, Chlamydophila pneumoniae CWL029
cgcaucauggucccua

SEQ ID NO: 2528090 - RNA, 14 nt, Chlamydophila pneumoniae CWL029
cgcaucuagaagca

SEQ ID NO: 2528091 - RNA, 16 nt, Chlamydophila pneumoniae CWL029
cgcaucuuaagagaaa

SEQ ID NO: 2528092 - RNA, 21 nt, Chlamydophila pneumoniae CWL029
cgcaugccucuuggugcuuug

SEQ ID NO: 2528093 - RNA, 15 nt, Chlamydophila pneumoniae CWL029
cgcauuacaaauggc

SEQ ID NO: 2528094 - RNA, 15 nt, Chlamydophila pneumoniae CWL029
cgccaaaccaugagg

SEQ ID NO: 2528095 - RNA, 17 nt, Chlamydophila pneumoniae CWL029
cgccaaacgaauuucuu

SEQ ID NO: 2528096 - RNA, 14 nt, Chlamydophila pneumoniae CWL029
cgccagcaaagauu

SEQ ID NO: 2528097 - RNA, 15 nt, Chlamydophila pneumoniae CWL029
cgcccgagcuuccau

SEQ ID NO: 2528098 - RNA, 20 nt, Chlamydophila pneumoniae CWL029
cgcccuucaggacaugccuu

SEQ ID NO: 2528099 - RNA, 12 nt, Chlamydophila pneumoniae CWL029
cgccuacaaguu

SEQ ID NO: 2528100 - RNA, 21 nt, Chlamydophila pneumoniae CWL029
cgccuauagauuccccaaacu

SEQ ID NO: 2528101 - RNA, 14 nt, Chlamydophila pneumoniae CWL029
cgccuucuaauuuc

SEQ ID NO: 2528102 - RNA, 19 nt, Chlamydophila pneumoniae CWL029
cgccuuggguuugucucca

SEQ ID NO: 2528103 - RNA, 12 nt, Chlamydophila pneumoniae CWL029
cgcgaccuguga

SEQ ID NO: 2528104 - RNA, 23 nt, Chlamydophila pneumoniae CWL029
cgcgagugugacugcagagaaau

SEQ ID NO: 2528105 - RNA, 17 nt, Chlamydophila pneumoniae CWL029
cgcgggauggacugaug

SEQ ID NO: 2528106 - RNA, 12 nt, Chlamydophila pneumoniae CWL029
cgcguauuuucg

SEQ ID NO: 2528107 - RNA, 22 nt, Chlamydophila pneumoniae CWL029
cgcguuccuguaguuugcagag

SEQ ID NO: 2528108 - RNA, 19 nt, Chlamydophila pneumoniae CWL029
cgcguuggugaugauuuga

SEQ ID NO: 2528109 - RNA, 14 nt, Chlamydophila pneumoniae CWL029
cgcuaaacaaucuu

SEQ ID NO: 2528110 - RNA, 17 nt, Chlamydophila pneumoniae CWL029
cgcuaccauaucuugag

SEQ ID NO: 2528111 - RNA, 17 nt, Chlamydophila pneumoniae CWL029
cgcuagaggaucuucaa

SEQ ID NO: 2528112 - RNA, 21 nt, Chlamydophila pneumoniae CWL029
cgcuagaggaucuucaaggua

SEQ ID NO: 2528113 - RNA, 17 nt, Chlamydophila pneumoniae CWL029
cgcuauagccuuguaaa

SEQ ID NO: 2528114 - RNA, 16 nt, Chlamydophila pneumoniae CWL029
cgcucguagguaugag

SEQ ID NO: 2528115 - RNA, 19 nt, Chlamydophila pneumoniae CWL029
cgcucuaaacucucuuccu

SEQ ID NO: 2528116 - RNA, 16 nt, Chlamydophila pneumoniae CWL029
cgcucuaagcugugca

SEQ ID NO: 2528117 - RNA, 20 nt, Chlamydophila pneumoniae CWL029
cgcucuaagcugugcauuuu

SEQ ID NO: 2528118 - RNA, 14 nt, Chlamydophila pneumoniae CWL029
cgcucucuccauga

SEQ ID NO: 2528119 - RNA, 14 nt, Chlamydophila pneumoniae CWL029
cgcucucuuuaaaa

SEQ ID NO: 2528120 - RNA, 13 nt, Chlamydophila pneumoniae CWL029
cgcucuuaacgag

SEQ ID NO: 2528121 - RNA, 23 nt, Chlamydophila pneumoniae CWL029
cgcugcuucucuacuaaaaucuc

SEQ ID NO: 2528122 - RNA, 21 nt, Chlamydophila pneumoniae CWL029
cgcuguugaaaugcaguucuu

SEQ ID NO: 2528123 - RNA, 14 nt, Chlamydophila pneumoniae CWL029
cgcuuaaaaucagc

SEQ ID NO: 2528124 - RNA, 21 nt, Chlamydophila pneumoniae CWL029
cgcuuagagaauuggaagcuu

SEQ ID NO: 2528125 - RNA, 12 nt, Chlamydophila pneumoniae CWL029
cgcuucuuuuug

SEQ ID NO: 2528126 - RNA, 13 nt, Chlamydophila pneumoniae CWL029
cgcuugcaucuua

SEQ ID NO: 2528127 - RNA, 22 nt, Chlamydophila pneumoniae CWL029
cgcuuucuuuuauuaagggaag

SEQ ID NO: 2528128 - RNA, 11 nt, Chlamydophila pneumoniae CWL029
cgcuuuugcua

SEQ ID NO: 2528129 - RNA, 14 nt, Chlamydophila pneumoniae CWL029
cgcuuuuuuaaagu

SEQ ID NO: 2528130 - RNA, 23 nt, Chlamydophila pneumoniae CWL029
cggaaaauacagccagcagaagg

SEQ ID NO: 2528131 - RNA, 17 nt, Chlamydophila pneumoniae CWL029
cggaaaaucacacuuuc

SEQ ID NO: 2528132 - RNA, 16 nt, Chlamydophila pneumoniae CWL029
cggaaauugaauaucg

SEQ ID NO: 2528133 - RNA, 13 nt, Chlamydophila pneumoniae CWL029
cggaacuaaagag

SEQ ID NO: 2528134 - RNA, 15 nt, Chlamydophila pneumoniae CWL029
cggaacucauuaaga

SEQ ID NO: 2528135 - RNA, 23 nt, Chlamydophila pneumoniae CWL029
cggaacucucuucccccagaccu

SEQ ID NO: 2528136 - RNA, 12 nt, Chlamydophila pneumoniae CWL029
cggaagauaaau

SEQ ID NO: 2528137 - RNA, 14 nt, Chlamydophila pneumoniae CWL029
cggacaacaacagc

SEQ ID NO: 2528138 - RNA, 19 nt, Chlamydophila pneumoniae CWL029
cggacaaugcuaucuccag

SEQ ID NO: 2528139 - RNA, 22 nt, Chlamydophila pneumoniae CWL029
cggacauaccuacuaaacccug

SEQ ID NO: 2528140 - RNA, 22 nt, Chlamydophila pneumoniae CWL029
cggacuucacaaagaaccauag

SEQ ID NO: 2528141 - RNA, 17 nt, Chlamydophila pneumoniae CWL029
cggagaacuuccugauu

SEQ ID NO: 2528142 - RNA, 12 nt, Chlamydophila pneumoniae CWL029
cggagaccaaaa

SEQ ID NO: 2528143 - RNA, 22 nt, Chlamydophila pneumoniae CWL029
cggagcaucuuuucaaaagaaa

SEQ ID NO: 2528144 - RNA, 21 nt, Chlamydophila pneumoniae CWL029
cggaguccuucuugcaaagau

SEQ ID NO: 2528145 - RNA, 23 nt, Chlamydophila pneumoniae CWL029
cggaguccuucuugcaaagauaa

SEQ ID NO: 2528146 - RNA, 19 nt, Chlamydophila pneumoniae CWL029
cggaucgucgccuuuuccu

SEQ ID NO: 2528147 - RNA, 20 nt, Chlamydophila pneumoniae CWL029
cggaucuuaggauucuuauc

SEQ ID NO: 2528148 - RNA, 19 nt, Chlamydophila pneumoniae CWL029
cggaucuuuucuuucuaag

SEQ ID NO: 2528149 - RNA, 22 nt, Chlamydophila pneumoniae CWL029
cggaugugccgugacuccagaa

SEQ ID NO: 2528150 - RNA, 20 nt, Chlamydophila pneumoniae CWL029
cggauuuuacucccugaagu

SEQ ID NO: 2528151 - RNA, 13 nt, Chlamydophila pneumoniae CWL029
cggauuuucucua

SEQ ID NO: 2528152 - RNA, 19 nt, Chlamydophila pneumoniae CWL029
cggcaacuacuguagaguu

SEQ ID NO: 2528153 - RNA, 20 nt, Chlamydophila pneumoniae CWL029
cggcacuuacuucaagaaaa

SEQ ID NO: 2528154 - RNA, 14 nt, Chlamydophila pneumoniae CWL029
cggccaucauuaag

SEQ ID NO: 2528155 - RNA, 18 nt, Chlamydophila pneumoniae CWL029
cggccaucauuaaguacu

SEQ ID NO: 2528156 - RNA, 19 nt, Chlamydophila pneumoniae CWL029
cggcggagaauaucaucuu

SEQ ID NO: 2528157 - RNA, 13 nt, Chlamydophila pneumoniae CWL029
cggcuuuagaaaa

SEQ ID NO: 2528158 - RNA, 12 nt, Chlamydophila pneumoniae CWL029
cggcuuuuccag

SEQ ID NO: 2528159 - RNA, 15 nt, Chlamydophila pneumoniae CWL029
cgggagcucuuucuu

SEQ ID NO: 2528160 - RNA, 19 nt, Chlamydophila pneumoniae CWL029
cgggaucguagcaggcauc

SEQ ID NO: 2528161 - RNA, 15 nt, Chlamydophila pneumoniae CWL029
cgggaucuaaaagca

SEQ ID NO: 2528162 - RNA, 19 nt, Chlamydophila pneumoniae CWL029
cggggucggagauuguuuc

SEQ ID NO: 2528163 - RNA, 17 nt, Chlamydophila pneumoniae CWL029
cggguguggcaaaggac

SEQ ID NO: 2528164 - RNA, 23 nt, Chlamydophila pneumoniae CWL029
cggguucauuuccaaauucuugc

SEQ ID NO: 2528165 - RNA, 16 nt, Chlamydophila pneumoniae CWL029
cgguaaccugugaaaa

SEQ ID NO: 2528166 - RNA, 20 nt, Chlamydophila pneumoniae CWL029
cgguaaggaggaaucuugau

SEQ ID NO: 2528167 - RNA, 16 nt, Chlamydophila pneumoniae CWL029
cgguaaugccagcagc

SEQ ID NO: 2528168 - RNA, 15 nt, Chlamydophila pneumoniae CWL029
cggucacuucaauua

SEQ ID NO: 2528169 - RNA, 21 nt, Chlamydophila pneumoniae CWL029
cggucgucuuagaauccucua

SEQ ID NO: 2528170 - RNA, 12 nt, Chlamydophila pneumoniae CWL029
cggucucuucuc

SEQ ID NO: 2528171 - RNA, 11 nt, Chlamydophila pneumoniae CWL029
cggucuuucuu

SEQ ID NO: 2528172 - RNA, 16 nt, Chlamydophila pneumoniae CWL029
cgguuucuuuuuuuug

SEQ ID NO: 2528173 - RNA, 15 nt, Chlamydophila pneumoniae CWL029
cguaaagaaaagcaa

SEQ ID NO: 2528174 - RNA, 20 nt, Chlamydophila pneumoniae CWL029
cguaacaauucgauguuaag

SEQ ID NO: 2528175 - RNA, 13 nt, Chlamydophila pneumoniae CWL029
cguaacugaggca

SEQ ID NO: 2528176 - RNA, 16 nt, Chlamydophila pneumoniae CWL029
cguaagagaauuauua

SEQ ID NO: 2528177 - RNA, 17 nt, Chlamydophila pneumoniae CWL029
cguaagcugcaaucuca

SEQ ID NO: 2528178 - RNA, 23 nt, Chlamydophila pneumoniae CWL029
cguaauacggacuucacaaagaa

SEQ ID NO: 2528179 - RNA, 17 nt, Chlamydophila pneumoniae CWL029
cguaauccuucuuucug

SEQ ID NO: 2528180 - RNA, 15 nt, Chlamydophila pneumoniae CWL029
cguaaucuuuuuuaa

SEQ ID NO: 2528181 - RNA, 15 nt, Chlamydophila pneumoniae CWL029
cguaaugcagauagc

SEQ ID NO: 2528182 - RNA, 14 nt, Chlamydophila pneumoniae CWL029
cguacaggacuguu

SEQ ID NO: 2528183 - RNA, 21 nt, Chlamydophila pneumoniae CWL029
cguacgagaucagauguaaag

SEQ ID NO: 2528184 - RNA, 18 nt, Chlamydophila pneumoniae CWL029
cguacgcaaguaaagaaa

SEQ ID NO: 2528185 - RNA, 20 nt, Chlamydophila pneumoniae CWL029
cguacgcaaguaaagaaauu

SEQ ID NO: 2528186 - RNA, 14 nt, Chlamydophila pneumoniae CWL029
cguacuucacuucu

SEQ ID NO: 2528187 - RNA, 23 nt, Chlamydophila pneumoniae CWL029
cguacuuuacacuauaagacauu

SEQ ID NO: 2528188 - RNA, 17 nt, Chlamydophila pneumoniae CWL029
cguagacgcucuaaacu

SEQ ID NO: 2528189 - RNA, 14 nt, Chlamydophila pneumoniae CWL029
cguagcagaggcag

SEQ ID NO: 2528190 - RNA, 18 nt, Chlamydophila pneumoniae CWL029
cguagcaggcaucacuaa

SEQ ID NO: 2528191 - RNA, 18 nt, Chlamydophila pneumoniae CWL029
cguagcuugcgagcuucu

SEQ ID NO: 2528192 - RNA, 21 nt, Chlamydophila pneumoniae CWL029
cguagcuugcgagcuucuuga

SEQ ID NO: 2528193 - RNA, 19 nt, Chlamydophila pneumoniae CWL029
cguaggcauacaguagaaa

SEQ ID NO: 2528194 - RNA, 19 nt, Chlamydophila pneumoniae CWL029
cguaggguagaaaaguuug

SEQ ID NO: 2528195 - RNA, 18 nt, Chlamydophila pneumoniae CWL029
cguaggugccugaagaug

SEQ ID NO: 2528196 - RNA, 15 nt, Chlamydophila pneumoniae CWL029
cguagguguuaaguu

SEQ ID NO: 2528197 - RNA, 16 nt, Chlamydophila pneumoniae CWL029
cguauaaggauguugu

SEQ ID NO: 2528198 - RNA, 21 nt, Chlamydophila pneumoniae CWL029
cguauacgucccacaaaauuu

SEQ ID NO: 2528199 - RNA, 14 nt, Chlamydophila pneumoniae CWL029
cguauagauuuucc

SEQ ID NO: 2528200 - RNA, 15 nt, Chlamydophila pneumoniae CWL029
cguauagauuuuccg

SEQ ID NO: 2528201 - RNA, 21 nt, Chlamydophila pneumoniae CWL029
cguauccuugauuuuaaaaug

SEQ ID NO: 2528202 - RNA, 13 nt, Chlamydophila pneumoniae CWL029
cguauucccaggu

SEQ ID NO: 2528203 - RNA, 21 nt, Chlamydophila pneumoniae CWL029
cguauuucacaagcauaaacu

SEQ ID NO: 2528204 - RNA, 16 nt, Chlamydophila pneumoniae CWL029
cgucaaagguuuuaaa

SEQ ID NO: 2528205 - RNA, 15 nt, Chlamydophila pneumoniae CWL029
cgucaaauucauuaa

SEQ ID NO: 2528206 - RNA, 18 nt, Chlamydophila pneumoniae CWL029
cgucaaauucauuaagaa

SEQ ID NO: 2528207 - RNA, 19 nt, Chlamydophila pneumoniae CWL029
cgucaaauucauuaagaac

SEQ ID NO: 2528208 - RNA, 18 nt, Chlamydophila pneumoniae CWL029
cgucaauaagcuugccag

SEQ ID NO: 2528209 - RNA, 17 nt, Chlamydophila pneumoniae CWL029
cgucacauuuguuguca

SEQ ID NO: 2528210 - RNA, 24 nt, Chlamydophila pneumoniae CWL029
cgucaggaacccuggaugaacauc

SEQ ID NO: 2528211 - RNA, 16 nt, Chlamydophila pneumoniae CWL029
cgucaguaaaacacaa

SEQ ID NO: 2528212 - RNA, 22 nt, Chlamydophila pneumoniae CWL029
cgucaguaaaacacaaauagca

SEQ ID NO: 2528213 - RNA, 20 nt, Chlamydophila pneumoniae CWL029
cgucaugagccgauguugca

SEQ ID NO: 2528214 - RNA, 13 nt, Chlamydophila pneumoniae CWL029
cgucaugcauaga

SEQ ID NO: 2528215 - RNA, 19 nt, Chlamydophila pneumoniae CWL029
cguccagccugcaccagac

SEQ ID NO: 2528216 - RNA, 20 nt, Chlamydophila pneumoniae CWL029
cguccaguucuucauuccag

SEQ ID NO: 2528217 - RNA, 22 nt, Chlamydophila pneumoniae CWL029
cgucccccccggguuguccaga

SEQ ID NO: 2528218 - RNA, 16 nt, Chlamydophila pneumoniae CWL029
cgucgccccaugaauc

SEQ ID NO: 2528219 - RNA, 18 nt, Chlamydophila pneumoniae CWL029
cgucuaagaaucguucuu

SEQ ID NO: 2528220 - RNA, 14 nt, Chlamydophila pneumoniae CWL029
cgucuccaacaguc

SEQ ID NO: 2528221 - RNA, 17 nt, Chlamydophila pneumoniae CWL029
cgucuuagaauccucua

SEQ ID NO: 2528222 - RNA, 15 nt, Chlamydophila pneumoniae CWL029
cgucuucucugcauc

SEQ ID NO: 2528223 - RNA, 14 nt, Chlamydophila pneumoniae CWL029
cgucuuucaccaac

SEQ ID NO: 2528224 - RNA, 16 nt, Chlamydophila pneumoniae CWL029
cgucuuugcuuucuag

SEQ ID NO: 2528225 - RNA, 13 nt, Chlamydophila pneumoniae CWL029
cgugaacaaaaac

SEQ ID NO: 2528226 - RNA, 15 nt, Chlamydophila pneumoniae CWL029
cgugaacaaaaacug

SEQ ID NO: 2528227 - RNA, 12 nt, Chlamydophila pneumoniae CWL029
cgugaacaaaau

SEQ ID NO: 2528228 - RNA, 14 nt, Chlamydophila pneumoniae CWL029
cgugaacaaaaucg

SEQ ID NO: 2528229 - RNA, 20 nt, Chlamydophila pneumoniae CWL029
cgugacucuuaucuggagau

SEQ ID NO: 2528230 - RNA, 22 nt, Chlamydophila pneumoniae CWL029
cgugagagucaggaagaugcug

SEQ ID NO: 2528231 - RNA, 20 nt, Chlamydophila pneumoniae CWL029
cgugauugcugucagaacaa

SEQ ID NO: 2528232 - RNA, 15 nt, Chlamydophila pneumoniae CWL029
cgugcaaguucacac

SEQ ID NO: 2528233 - RNA, 12 nt, Chlamydophila pneumoniae CWL029
cgugcauaauga

SEQ ID NO: 2528234 - RNA, 21 nt, Chlamydophila pneumoniae CWL029
cgugcucccauuucuggagaa

SEQ ID NO: 2528235 - RNA, 16 nt, Chlamydophila pneumoniae CWL029
cgugcucucuucuucu

SEQ ID NO: 2528236 - RNA, 14 nt, Chlamydophila pneumoniae CWL029
cgugcucugcaauc

SEQ ID NO: 2528237 - RNA, 13 nt, Chlamydophila pneumoniae CWL029
cguggagcaucau

SEQ ID NO: 2528238 - RNA, 19 nt, Chlamydophila pneumoniae CWL029
cguggagugcucuacccca

SEQ ID NO: 2528239 - RNA, 18 nt, Chlamydophila pneumoniae CWL029
cguggcuuccauaacgag

SEQ ID NO: 2528240 - RNA, 16 nt, Chlamydophila pneumoniae CWL029
cguggcuuuuguauua

SEQ ID NO: 2528241 - RNA, 21 nt, Chlamydophila pneumoniae CWL029
cguguacagaccguccucccc

SEQ ID NO: 2528242 - RNA, 19 nt, Chlamydophila pneumoniae CWL029
cguguggguaaugccaaua

SEQ ID NO: 2528243 - RNA, 14 nt, Chlamydophila pneumoniae CWL029
cguuaaaaacuauc

SEQ ID NO: 2528244 - RNA, 15 nt, Chlamydophila pneumoniae CWL029
cguuaauaagaaccu

SEQ ID NO: 2528245 - RNA, 19 nt, Chlamydophila pneumoniae CWL029
cguuaauaagaaccucuaa

SEQ ID NO: 2528246 - RNA, 12 nt, Chlamydophila pneumoniae CWL029
cguuauauuuuu

SEQ ID NO: 2528247 - RNA, 22 nt, Chlamydophila pneumoniae CWL029
cguucaacuuuguuaauagaag

SEQ ID NO: 2528248 - RNA, 19 nt, Chlamydophila pneumoniae CWL029
cguuccagccugugagcuc

SEQ ID NO: 2528249 - RNA, 22 nt, Chlamydophila pneumoniae CWL029
cguuccuuucucagucacaaua

SEQ ID NO: 2528250 - RNA, 19 nt, Chlamydophila pneumoniae CWL029
cguugauuggaugauagcu

SEQ ID NO: 2528251 - RNA, 17 nt, Chlamydophila pneumoniae CWL029
cguugguucaaauccag

SEQ ID NO: 2528252 - RNA, 18 nt, Chlamydophila pneumoniae CWL029
cguuuaauuccuuggauu

SEQ ID NO: 2528253 - RNA, 12 nt, Chlamydophila pneumoniae CWL029
cguuuccuccuc

SEQ ID NO: 2528254 - RNA, 22 nt, Chlamydophila pneumoniae CWL029
cguuuguuuugcuuuuugaaug

SEQ ID NO: 2528255 - RNA, 16 nt, Chlamydophila pneumoniae CWL029
cguuuucuagaaaaga

SEQ ID NO: 2528256 - RNA, 12 nt, Chlamydophila pneumoniae CWL029
cguuuuucccua

SEQ ID NO: 2528257 - RNA, 23 nt, Chlamydophila pneumoniae CWL029
cuaaaaaggucagcccugccuca

SEQ ID NO: 2528258 - RNA, 13 nt, Chlamydophila pneumoniae CWL029
cuaaaaccuagac

SEQ ID NO: 2528259 - RNA, 14 nt, Chlamydophila pneumoniae CWL029
cuaaaacuucuugu

SEQ ID NO: 2528260 - RNA, 23 nt, Chlamydophila pneumoniae CWL029
cuaaaauaugcucgugcgacugc

SEQ ID NO: 2528261 - RNA, 21 nt, Chlamydophila pneumoniae CWL029
cuaaaaucuuucaauguaauu

SEQ ID NO: 2528262 - RNA, 20 nt, Chlamydophila pneumoniae CWL029
cuaaaaugcuuguauaaaug

SEQ ID NO: 2528263 - RNA, 13 nt, Chlamydophila pneumoniae CWL029
cuaaacaauuuca

SEQ ID NO: 2528264 - RNA, 19 nt, Chlamydophila pneumoniae CWL029
cuaaacccuguccaacuaa

SEQ ID NO: 2528265 - RNA, 17 nt, Chlamydophila pneumoniae CWL029
cuaaaccuaaaauggug

SEQ ID NO: 2528266 - RNA, 15 nt, Chlamydophila pneumoniae CWL029
cuaaaccuucaauga

SEQ ID NO: 2528267 - RNA, 23 nt, Chlamydophila pneumoniae CWL029
cuaaaccuucaaugauuucuuua

SEQ ID NO: 2528268 - RNA, 17 nt, Chlamydophila pneumoniae CWL029
cuaaacgacguuuaauu

SEQ ID NO: 2528269 - RNA, 22 nt, Chlamydophila pneumoniae CWL029
cuaaacgacguuuaauuccuug

SEQ ID NO: 2528270 - RNA, 17 nt, Chlamydophila pneumoniae CWL029
cuaaacgauuguaauuu

SEQ ID NO: 2528271 - RNA, 12 nt, Chlamydophila pneumoniae CWL029
cuaaacucucuu

SEQ ID NO: 2528272 - RNA, 14 nt, Chlamydophila pneumoniae CWL029
cuaaacucucuucc

SEQ ID NO: 2528273 - RNA, 16 nt, Chlamydophila pneumoniae CWL029
cuaaacucucuuccuu

SEQ ID NO: 2528274 - RNA, 17 nt, Chlamydophila pneumoniae CWL029
cuaaacucucuuccuuc

SEQ ID NO: 2528275 - RNA, 21 nt, Chlamydophila pneumoniae CWL029
cuaaacucucuuccuucuccu

SEQ ID NO: 2528276 - RNA, 21 nt, Chlamydophila pneumoniae CWL029
cuaaacugggaagaccacgaa

SEQ ID NO: 2528277 - RNA, 23 nt, Chlamydophila pneumoniae CWL029
cuaaagaaagagucucacucuuu

SEQ ID NO: 2528278 - RNA, 16 nt, Chlamydophila pneumoniae CWL029
cuaaagaagauucaag

SEQ ID NO: 2528279 - RNA, 20 nt, Chlamydophila pneumoniae CWL029
cuaaagaauuuguaacucuu

SEQ ID NO: 2528280 - RNA, 23 nt, Chlamydophila pneumoniae CWL029
cuaaagacgaagggaguuucccg

SEQ ID NO: 2528281 - RNA, 18 nt, Chlamydophila pneumoniae CWL029
cuaaagagaucacaggga

SEQ ID NO: 2528282 - RNA, 21 nt, Chlamydophila pneumoniae CWL029
cuaaagauacuuaucuuuaaa

SEQ ID NO: 2528283 - RNA, 15 nt, Chlamydophila pneumoniae CWL029
cuaaagcagaauccc

SEQ ID NO: 2528284 - RNA, 17 nt, Chlamydophila pneumoniae CWL029
cuaaaggaaucucggga

SEQ ID NO: 2528285 - RNA, 15 nt, Chlamydophila pneumoniae CWL029
cuaaaguaacgauaa

SEQ ID NO: 2528286 - RNA, 18 nt, Chlamydophila pneumoniae CWL029
cuaaaguaacgauaagaa

SEQ ID NO: 2528287 - RNA, 18 nt, Chlamydophila pneumoniae CWL029
cuaaaguaggaauuuuca

SEQ ID NO: 2528288 - RNA, 13 nt, Chlamydophila pneumoniae CWL029
cuaaauaaaccac

SEQ ID NO: 2528289 - RNA, 14 nt, Chlamydophila pneumoniae CWL029
cuaaauagaaaaca

SEQ ID NO: 2528290 - RNA, 16 nt, Chlamydophila pneumoniae CWL029
cuaaauagaaaacaua

SEQ ID NO: 2528291 - RNA, 21 nt, Chlamydophila pneumoniae CWL029
cuaaauagaaaacauagagau

SEQ ID NO: 2528292 - RNA, 18 nt, Chlamydophila pneumoniae CWL029
cuaaauagagcggaacua

SEQ ID NO: 2528293 - RNA, 21 nt, Chlamydophila pneumoniae CWL029
cuaaauauaucgcguguaaaa

SEQ ID NO: 2528294 - RNA, 16 nt, Chlamydophila pneumoniae CWL029
cuaaaucuauacccag

SEQ ID NO: 2528295 - RNA, 12 nt, Chlamydophila pneumoniae CWL029
cuaaaucugcuu

SEQ ID NO: 2528296 - RNA, 14 nt, Chlamydophila pneumoniae CWL029
cuaaauuaaauauc

SEQ ID NO: 2528297 - RNA, 13 nt, Chlamydophila pneumoniae CWL029
cuaacaacuucug

SEQ ID NO: 2528298 - RNA, 20 nt, Chlamydophila pneumoniae CWL029
cuaacaacuucugacaauaa

SEQ ID NO: 2528299 - RNA, 18 nt, Chlamydophila pneumoniae CWL029
cuaacaagauaaccugag

SEQ ID NO: 2528300 - RNA, 13 nt, Chlamydophila pneumoniae CWL029
cuaacacaguccc

SEQ ID NO: 2528301 - RNA, 23 nt, Chlamydophila pneumoniae CWL029
cuaacgaagugaggagaauagca

SEQ ID NO: 2528302 - RNA, 20 nt, Chlamydophila pneumoniae CWL029
cuaacgaugcaggccaggag

SEQ ID NO: 2528303 - RNA, 15 nt, Chlamydophila pneumoniae CWL029
cuaacgcaacaucca

SEQ ID NO: 2528304 - RNA, 16 nt, Chlamydophila pneumoniae CWL029
cuaacuuagagcgaau

SEQ ID NO: 2528305 - RNA, 20 nt, Chlamydophila pneumoniae CWL029
cuaagaaaggcacuccaaaa

SEQ ID NO: 2528306 - RNA, 17 nt, Chlamydophila pneumoniae CWL029
cuaagaagcucacucuu

SEQ ID NO: 2528307 - RNA, 21 nt, Chlamydophila pneumoniae CWL029
cuaagaagcucacucuuuaaa

SEQ ID NO: 2528308 - RNA, 14 nt, Chlamydophila pneumoniae CWL029
cuaagaaugagaac

SEQ ID NO: 2528309 - RNA, 13 nt, Chlamydophila pneumoniae CWL029
cuaagacuagauc

SEQ ID NO: 2528310 - RNA, 19 nt, Chlamydophila pneumoniae CWL029
cuaagagcaucuuugggaa

SEQ ID NO: 2528311 - RNA, 18 nt, Chlamydophila pneumoniae CWL029
cuaagagcgucuucuuuu

SEQ ID NO: 2528312 - RNA, 21 nt, Chlamydophila pneumoniae CWL029
cuaagaguuccaagacaauaa

SEQ ID NO: 2528313 - RNA, 17 nt, Chlamydophila pneumoniae CWL029
cuaagauccugagacca

SEQ ID NO: 2528314 - RNA, 23 nt, Chlamydophila pneumoniae CWL029
cuaagaucuuuagaauaagagcu

SEQ ID NO: 2528315 - RNA, 15 nt, Chlamydophila pneumoniae CWL029
cuaagaucuuuugua

SEQ ID NO: 2528316 - RNA, 17 nt, Chlamydophila pneumoniae CWL029
cuaagauuccuaacuuc

SEQ ID NO: 2528317 - RNA, 14 nt, Chlamydophila pneumoniae CWL029
cuaagcaaaaacuu

SEQ ID NO: 2528318 - RNA, 13 nt, Chlamydophila pneumoniae CWL029
cuaagcaauauuu

SEQ ID NO: 2528319 - RNA, 15 nt, Chlamydophila pneumoniae CWL029
cuaagcaauauuucu

SEQ ID NO: 2528320 - RNA, 16 nt, Chlamydophila pneumoniae CWL029
cuaagcacaagaaucc

SEQ ID NO: 2528321 - RNA, 17 nt, Chlamydophila pneumoniae CWL029
cuaagcagccucuucuc

SEQ ID NO: 2528322 - RNA, 21 nt, Chlamydophila pneumoniae CWL029
cuaagcagccucuucucuacc

SEQ ID NO: 2528323 - RNA, 13 nt, Chlamydophila pneumoniae CWL029
cuaagcauagccc

SEQ ID NO: 2528324 - RNA, 16 nt, Chlamydophila pneumoniae CWL029
cuaagcauucgacucu

SEQ ID NO: 2528325 - RNA, 12 nt, Chlamydophila pneumoniae CWL029
cuaagccaaaua

SEQ ID NO: 2528326 - RNA, 16 nt, Chlamydophila pneumoniae CWL029
cuaagccaaauaccaa

SEQ ID NO: 2528327 - RNA, 16 nt, Chlamydophila pneumoniae CWL029
cuaagcgcucuucaau

SEQ ID NO: 2528328 - RNA, 20 nt, Chlamydophila pneumoniae CWL029
cuaagcugaaagaacacucc

SEQ ID NO: 2528329 - RNA, 15 nt, Chlamydophila pneumoniae CWL029
cuaagcuuauuucug

SEQ ID NO: 2528330 - RNA, 19 nt, Chlamydophila pneumoniae CWL029
cuaaggacaaaucucccaa

SEQ ID NO: 2528331 - RNA, 20 nt, Chlamydophila pneumoniae CWL029
cuaaggugcuauuuuaaacu

SEQ ID NO: 2528332 - RNA, 18 nt, Chlamydophila pneumoniae CWL029
cuaagguuuccaugagaa

SEQ ID NO: 2528333 - RNA, 13 nt, Chlamydophila pneumoniae CWL029
cuaaguaacaguc

SEQ ID NO: 2528334 - RNA, 21 nt, Chlamydophila pneumoniae CWL029
cuaaguaacaguccucucccu

SEQ ID NO: 2528335 - RNA, 23 nt, Chlamydophila pneumoniae CWL029
cuaaguaacaguccucucccuua

SEQ ID NO: 2528336 - RNA, 20 nt, Chlamydophila pneumoniae CWL029
cuaaguccaacaucagcugu

SEQ ID NO: 2528337 - RNA, 20 nt, Chlamydophila pneumoniae CWL029
cuaagucuccauaauucugc

SEQ ID NO: 2528338 - RNA, 17 nt, Chlamydophila pneumoniae CWL029
cuaagugauaaggaaga

SEQ ID NO: 2528339 - RNA, 18 nt, Chlamydophila pneumoniae CWL029
cuaaguuuaggcaggaag

SEQ ID NO: 2528340 - RNA, 17 nt, Chlamydophila pneumoniae CWL029
cuaaguuuguagcagca

SEQ ID NO: 2528341 - RNA, 16 nt, Chlamydophila pneumoniae CWL029
cuaauaagauccaaaa

SEQ ID NO: 2528342 - RNA, 17 nt, Chlamydophila pneumoniae CWL029
cuaauaagauccaaaaa

SEQ ID NO: 2528343 - RNA, 15 nt, Chlamydophila pneumoniae CWL029
cuaauacuuuaggag

SEQ ID NO: 2528344 - RNA, 20 nt, Chlamydophila pneumoniae CWL029
cuaauaggggaccuaucggg

SEQ ID NO: 2528345 - RNA, 17 nt, Chlamydophila pneumoniae CWL029
cuaaucaauccaagaau

SEQ ID NO: 2528346 - RNA, 16 nt, Chlamydophila pneumoniae CWL029
cuaaucauagccauca

SEQ ID NO: 2528347 - RNA, 15 nt, Chlamydophila pneumoniae CWL029
cuaaucauuagaguu

SEQ ID NO: 2528348 - RNA, 14 nt, Chlamydophila pneumoniae CWL029
cuaauccagcaaca

SEQ ID NO: 2528349 - RNA, 15 nt, Chlamydophila pneumoniae CWL029
cuaaucucaggcauu

SEQ ID NO: 2528350 - RNA, 17 nt, Chlamydophila pneumoniae CWL029
cuaaucucaggcauucu

SEQ ID NO: 2528351 - RNA, 20 nt, Chlamydophila pneumoniae CWL029
cuaauguugaguagagaagg

SEQ ID NO: 2528352 - RNA, 16 nt, Chlamydophila pneumoniae CWL029
cuaauuccuucaaagc

SEQ ID NO: 2528353 - RNA, 17 nt, Chlamydophila pneumoniae CWL029
cuaauucucgagcagcu

SEQ ID NO: 2528354 - RNA, 15 nt, Chlamydophila pneumoniae CWL029
cuaauuuaaaugccu

SEQ ID NO: 2528355 - RNA, 12 nt, Chlamydophila pneumoniae CWL029
cuaauuuccuuc

SEQ ID NO: 2528356 - RNA, 22 nt, Chlamydophila pneumoniae CWL029
cuaauuuuaaauuuuguuuuuc

SEQ ID NO: 2528357 - RNA, 22 nt, Chlamydophila pneumoniae CWL029
cuacaaaauccacauccuugua

SEQ ID NO: 2528358 - RNA, 20 nt, Chlamydophila pneumoniae CWL029
cuacaaaauuauuaaacucg

SEQ ID NO: 2528359 - RNA, 22 nt, Chlamydophila pneumoniae CWL029
cuacaaacagguaauacccuca

SEQ ID NO: 2528360 - RNA, 16 nt, Chlamydophila pneumoniae CWL029
cuacaaauuaccuuga

SEQ ID NO: 2528361 - RNA, 11 nt, Chlamydophila pneumoniae CWL029
cuacaacaguu

SEQ ID NO: 2528362 - RNA, 18 nt, Chlamydophila pneumoniae CWL029
cuacaaggucuuuuccug

SEQ ID NO: 2528363 - RNA, 13 nt, Chlamydophila pneumoniae CWL029
cuacaaguugaga

SEQ ID NO: 2528364 - RNA, 19 nt, Chlamydophila pneumoniae CWL029
cuacaaucgccuuacaauu

SEQ ID NO: 2528365 - RNA, 20 nt, Chlamydophila pneumoniae CWL029
cuacacacaugacaaauaaa

SEQ ID NO: 2528366 - RNA, 23 nt, Chlamydophila pneumoniae CWL029
cuacacagacuugaggaaucuga

SEQ ID NO: 2528367 - RNA, 22 nt, Chlamydophila pneumoniae CWL029
cuacacaguagccuucuucucg

SEQ ID NO: 2528368 - RNA, 14 nt, Chlamydophila pneumoniae CWL029
cuacaccauagaac

SEQ ID NO: 2528369 - RNA, 20 nt, Chlamydophila pneumoniae CWL029
cuacacccaggaaacuagau

SEQ ID NO: 2528370 - RNA, 19 nt, Chlamydophila pneumoniae CWL029
cuacacgcuauagcaacag

SEQ ID NO: 2528371 - RNA, 22 nt, Chlamydophila pneumoniae CWL029
cuacacugguagcuaaauuuag

SEQ ID NO: 2528372 - RNA, 23 nt, Chlamydophila pneumoniae CWL029
cuacagaaagagcuaaagaaacu

SEQ ID NO: 2528373 - RNA, 15 nt, Chlamydophila pneumoniae CWL029
cuacagaggaaucua

SEQ ID NO: 2528374 - RNA, 18 nt, Chlamydophila pneumoniae CWL029
cuacagagggaauuucau

SEQ ID NO: 2528375 - RNA, 17 nt, Chlamydophila pneumoniae CWL029
cuacagagggcuucauu

SEQ ID NO: 2528376 - RNA, 20 nt, Chlamydophila pneumoniae CWL029
cuacagagggcuucauuccu

SEQ ID NO: 2528377 - RNA, 12 nt, Chlamydophila pneumoniae CWL029
cuacagcagaaa

SEQ ID NO: 2528378 - RNA, 13 nt, Chlamydophila pneumoniae CWL029
cuacagcuucauu

SEQ ID NO: 2528379 - RNA, 19 nt, Chlamydophila pneumoniae CWL029
cuacagcuucuuuuccagc

SEQ ID NO: 2528380 - RNA, 14 nt, Chlamydophila pneumoniae CWL029
cuacaggagaagcg

SEQ ID NO: 2528381 - RNA, 16 nt, Chlamydophila pneumoniae CWL029
cuacauaaaaugagcu

SEQ ID NO: 2528382 - RNA, 19 nt, Chlamydophila pneumoniae CWL029
cuacauaguuguucggaca

SEQ ID NO: 2528383 - RNA, 19 nt, Chlamydophila pneumoniae CWL029
cuacauaguuuuuauuuuu

SEQ ID NO: 2528384 - RNA, 21 nt, Chlamydophila pneumoniae CWL029
cuacauaguuuuuauuuuuaa

SEQ ID NO: 2528385 - RNA, 20 nt, Chlamydophila pneumoniae CWL029
cuacauauucguguaaaucu

SEQ ID NO: 2528386 - RNA, 14 nt, Chlamydophila pneumoniae CWL029
cuacaucugugauu

SEQ ID NO: 2528387 - RNA, 15 nt, Chlamydophila pneumoniae CWL029
cuacaucuuguucug

SEQ ID NO: 2528388 - RNA, 13 nt, Chlamydophila pneumoniae CWL029
cuacaugaggaua

SEQ ID NO: 2528389 - RNA, 14 nt, Chlamydophila pneumoniae CWL029
cuacaugcucaaga

SEQ ID NO: 2528390 - RNA, 22 nt, Chlamydophila pneumoniae CWL029
cuaccaaagucgauacccaaag

SEQ ID NO: 2528391 - RNA, 13 nt, Chlamydophila pneumoniae CWL029
cuaccaauucucu

SEQ ID NO: 2528392 - RNA, 21 nt, Chlamydophila pneumoniae CWL029
cuaccaggcugcgcuacaccc

SEQ ID NO: 2528393 - RNA, 14 nt, Chlamydophila pneumoniae CWL029
cuaccauaucuuga

SEQ ID NO: 2528394 - RNA, 14 nt, Chlamydophila pneumoniae CWL029
cuaccaucaugaau

SEQ ID NO: 2528395 - RNA, 19 nt, Chlamydophila pneumoniae CWL029
cuaccauuaaggaauccca

SEQ ID NO: 2528396 - RNA, 18 nt, Chlamydophila pneumoniae CWL029
cuaccccacgcuaaacua

SEQ ID NO: 2528397 - RNA, 20 nt, Chlamydophila pneumoniae CWL029
cuaccccacgcuaaacuaaa

SEQ ID NO: 2528398 - RNA, 19 nt, Chlamydophila pneumoniae CWL029
cuacccccagcuucuucaa

SEQ ID NO: 2528399 - RNA, 18 nt, Chlamydophila pneumoniae CWL029
cuacccucaucauccuca

SEQ ID NO: 2528400 - RNA, 20 nt, Chlamydophila pneumoniae CWL029
cuaccguucgguuauuugcu

SEQ ID NO: 2528401 - RNA, 19 nt, Chlamydophila pneumoniae CWL029
cuaccuacguagcauuaaa

SEQ ID NO: 2528402 - RNA, 21 nt, Chlamydophila pneumoniae CWL029
cuaccuauuuaagggaaaugu

SEQ ID NO: 2528403 - RNA, 24 nt, Chlamydophila pneumoniae CWL029
cuaccucugggaagacucucauca

SEQ ID NO: 2528404 - RNA, 19 nt, Chlamydophila pneumoniae CWL029
cuaccuguagcuacagauu

SEQ ID NO: 2528405 - RNA, 15 nt, Chlamydophila pneumoniae CWL029
cuacgaauccaaaaa

SEQ ID NO: 2528406 - RNA, 21 nt, Chlamydophila pneumoniae CWL029
cuacgacuacaucuuguucug

SEQ ID NO: 2528407 - RNA, 19 nt, Chlamydophila pneumoniae CWL029
ugauaaaagguauuucucu

SEQ ID NO: 2528408 - RNA, 20 nt, Chlamydophila pneumoniae CWL029
ugauaaagggaauuuucuca

SEQ ID NO: 2528409 - RNA, 13 nt, Chlamydophila pneumoniae CWL029
ugauaaggaagaa

SEQ ID NO: 2528410 - RNA, 18 nt, Chlamydophila pneumoniae CWL029
ugauaaugcaggggcuuu

SEQ ID NO: 2528411 - RNA, 19 nt, Chlamydophila pneumoniae CWL029
ugauaccaagaugaagaaa

SEQ ID NO: 2528412 - RNA, 19 nt, Chlamydophila pneumoniae CWL029
ugauaccaccuaaaaugca

SEQ ID NO: 2528413 - RNA, 17 nt, Chlamydophila pneumoniae CWL029
ugauacgugcagugaau

SEQ ID NO: 2528414 - RNA, 15 nt, Chlamydophila pneumoniae CWL029
ugauacuguuuuuua

SEQ ID NO: 2528415 - RNA, 22 nt, Chlamydophila pneumoniae CWL029
ugauacuuguaccguaaagaaa

SEQ ID NO: 2528416 - RNA, 12 nt, Chlamydophila pneumoniae CWL029
ugauacuuuaga

SEQ ID NO: 2528417 - RNA, 13 nt, Chlamydophila pneumoniae CWL029
ugauauccaccuu

SEQ ID NO: 2528418 - RNA, 17 nt, Chlamydophila pneumoniae CWL029
ugauauuugucuaguga

SEQ ID NO: 2528419 - RNA, 12 nt, Chlamydophila pneumoniae CWL029
ugauauuuucuu

SEQ ID NO: 2528420 - RNA, 19 nt, Chlamydophila pneumoniae CWL029
ugaucaaaauuauccagaa

SEQ ID NO: 2528421 - RNA, 12 nt, Chlamydophila pneumoniae CWL029
ugaucaaagaac

SEQ ID NO: 2528422 - RNA, 20 nt, Chlamydophila pneumoniae CWL029
ugaucacguggacagcggcc

SEQ ID NO: 2528423 - RNA, 13 nt, Chlamydophila pneumoniae CWL029
ugaucaggagucu

SEQ ID NO: 2528424 - RNA, 13 nt, Chlamydophila pneumoniae CWL029
ugauccagcucca

SEQ ID NO: 2528425 - RNA, 15 nt, Chlamydophila pneumoniae CWL029
ugauccgaaaacucu

SEQ ID NO: 2528426 - RNA, 20 nt, Chlamydophila pneumoniae CWL029
ugauccgaaaacucuuagag

SEQ ID NO: 2528427 - RNA, 19 nt, Chlamydophila pneumoniae CWL029
ugauccucggcaucuuugg

SEQ ID NO: 2528428 - RNA, 17 nt, Chlamydophila pneumoniae CWL029
ugauccuugcaaaacag

SEQ ID NO: 2528429 - RNA, 16 nt, Chlamydophila pneumoniae CWL029
ugaucucacgaacucu

SEQ ID NO: 2528430 - RNA, 16 nt, Chlamydophila pneumoniae CWL029
ugaucucuucaugaaa

SEQ ID NO: 2528431 - RNA, 13 nt, Chlamydophila pneumoniae CWL029
ugaucugaaguug

SEQ ID NO: 2528432 - RNA, 22 nt, Chlamydophila pneumoniae CWL029
ugaucuuuccucucaugaaauu

SEQ ID NO: 2528433 - RNA, 18 nt, Chlamydophila pneumoniae CWL029
ugaugaccucuauaccua

SEQ ID NO: 2528434 - RNA, 12 nt, Chlamydophila pneumoniae CWL029
ugaugagaaaaa

SEQ ID NO: 2528435 - RNA, 15 nt, Chlamydophila pneumoniae CWL029
ugaugccuuuuucuu

SEQ ID NO: 2528436 - RNA, 20 nt, Chlamydophila pneumoniae CWL029
ugauguauaaaguuuguaaa

SEQ ID NO: 2528437 - RNA, 20 nt, Chlamydophila pneumoniae CWL029
ugauguuugacuuuauguua

SEQ ID NO: 2528438 - RNA, 16 nt, Chlamydophila pneumoniae CWL029
ugauuaagaucuucgu

SEQ ID NO: 2528439 - RNA, 18 nt, Chlamydophila pneumoniae CWL029
ugauuagagccccaaccc

SEQ ID NO: 2528440 - RNA, 18 nt, Chlamydophila pneumoniae CWL029
ugauuaguuuguuuuaau

SEQ ID NO: 2528441 - RNA, 16 nt, Chlamydophila pneumoniae CWL029
ugauuauuuaagacca

SEQ ID NO: 2528442 - RNA, 17 nt, Chlamydophila pneumoniae CWL029
ugauucauaaagaggaa

SEQ ID NO: 2528443 - RNA, 21 nt, Chlamydophila pneumoniae CWL029
ugauucccggaggcaaagauc

SEQ ID NO: 2528444 - RNA, 14 nt, Chlamydophila pneumoniae CWL029
ugauuccuuaaguc

SEQ ID NO: 2528445 - RNA, 21 nt, Chlamydophila pneumoniae CWL029
ugauuccuuggcguacucuau

SEQ ID NO: 2528446 - RNA, 15 nt, Chlamydophila pneumoniae CWL029
ugauucuccgucccc

SEQ ID NO: 2528447 - RNA, 15 nt, Chlamydophila pneumoniae CWL029
ugauugaaaccguaa

SEQ ID NO: 2528448 - RNA, 16 nt, Chlamydophila pneumoniae CWL029
ugauugaaguucagac

SEQ ID NO: 2528449 - RNA, 22 nt, Chlamydophila pneumoniae CWL029
ugauugaaguucagacgugcuc

SEQ ID NO: 2528450 - RNA, 20 nt, Chlamydophila pneumoniae CWL029
ugauuggaugauagcuauga

SEQ ID NO: 2528451 - RNA, 12 nt, Chlamydophila pneumoniae CWL029
ugauuguagaga

SEQ ID NO: 2528452 - RNA, 15 nt, Chlamydophila pneumoniae CWL029
ugauuguauagcuua

SEQ ID NO: 2528453 - RNA, 19 nt, Chlamydophila pneumoniae CWL029
ugauuuccugacuauaaaa

SEQ ID NO: 2528454 - RNA, 19 nt, Chlamydophila pneumoniae CWL029
ugauuucgacgcauaguau

SEQ ID NO: 2528455 - RNA, 17 nt, Chlamydophila pneumoniae CWL029
ugauuucgugaacaaaa

SEQ ID NO: 2528456 - RNA, 16 nt, Chlamydophila pneumoniae CWL029
ugauuucucuaagcag

SEQ ID NO: 2528457 - RNA, 15 nt, Chlamydophila pneumoniae CWL029
ugauuucuuuauucc

SEQ ID NO: 2528458 - RNA, 23 nt, Chlamydophila pneumoniae CWL029
ugauuuggccaacaguguagccu

SEQ ID NO: 2528459 - RNA, 13 nt, Chlamydophila pneumoniae CWL029
ugauuugggauga

SEQ ID NO: 2528460 - RNA, 22 nt, Chlamydophila pneumoniae CWL029
ugauuuguuuagcauagagcuc

SEQ ID NO: 2528461 - RNA, 19 nt, Chlamydophila pneumoniae CWL029
ugauuuuucaaucaauaaa

SEQ ID NO: 2528462 - RNA, 18 nt, Chlamydophila pneumoniae CWL029
ugauuuuugcuaagagcu

SEQ ID NO: 2528463 - RNA, 19 nt, Chlamydophila pneumoniae CWL029
ugauuuuugcuaagagcuc

SEQ ID NO: 2528464 - RNA, 22 nt, Chlamydophila pneumoniae CWL029
ugauuuuuuaugacaaacucua

SEQ ID NO: 2528465 - RNA, 14 nt, Chlamydophila pneumoniae CWL029
ugcaaaaaaccagc

SEQ ID NO: 2528466 - RNA, 23 nt, Chlamydophila pneumoniae CWL029
ugcaaaaaaccagccaauaacau

SEQ ID NO: 2528467 - RNA, 18 nt, Chlamydophila pneumoniae CWL029
ugcaaaaaguuucaaucu

SEQ ID NO: 2528468 - RNA, 17 nt, Chlamydophila pneumoniae CWL029
ugcaaaaaugaaagaaa

SEQ ID NO: 2528469 - RNA, 12 nt, Chlamydophila pneumoniae CWL029
ugcaaaauuuaa

SEQ ID NO: 2528470 - RNA, 18 nt, Chlamydophila pneumoniae CWL029
ugcaaacacaauuguaaa

SEQ ID NO: 2528471 - RNA, 17 nt, Chlamydophila pneumoniae CWL029
ugcaaacugaucugaaa

SEQ ID NO: 2528472 - RNA, 16 nt, Chlamydophila pneumoniae CWL029
ugcaaagcaucuugua

SEQ ID NO: 2528473 - RNA, 14 nt, Chlamydophila pneumoniae CWL029
ugcaaagcccauac

SEQ ID NO: 2528474 - RNA, 19 nt, Chlamydophila pneumoniae CWL029
ugcaaagcccccuccccca

SEQ ID NO: 2528475 - RNA, 19 nt, Chlamydophila pneumoniae CWL029
ugcaaauaagccaguacua

SEQ ID NO: 2528476 - RNA, 16 nt, Chlamydophila pneumoniae CWL029
ugcaaaugaaaagaga

SEQ ID NO: 2528477 - RNA, 22 nt, Chlamydophila pneumoniae CWL029
ugcaaaugaagggaugggaucg

SEQ ID NO: 2528478 - RNA, 19 nt, Chlamydophila pneumoniae CWL029
ugcaaccacacaggauugu

SEQ ID NO: 2528479 - RNA, 19 nt, Chlamydophila pneumoniae CWL029
ugcaacggagaaauuugug

SEQ ID NO: 2528480 - RNA, 14 nt, Chlamydophila pneumoniae CWL029
ugcaagcaacucuu

SEQ ID NO: 2528481 - RNA, 22 nt, Chlamydophila pneumoniae CWL029
ugcaagcagauagagcuucuuu

SEQ ID NO: 2528482 - RNA, 19 nt, Chlamydophila pneumoniae CWL029
ugcaagcauuguuuguccu

SEQ ID NO: 2528483 - RNA, 13 nt, Chlamydophila pneumoniae CWL029
ugcaaggagcuuu

SEQ ID NO: 2528484 - RNA, 13 nt, Chlamydophila pneumoniae CWL029
ugcaaggcaagau

SEQ ID NO: 2528485 - RNA, 21 nt, Chlamydophila pneumoniae CWL029
ugcaaggcaagaugugcucga

SEQ ID NO: 2528486 - RNA, 14 nt, Chlamydophila pneumoniae CWL029
ugcaaggcaaugau

SEQ ID NO: 2528487 - RNA, 17 nt, Chlamydophila pneumoniae CWL029
ugcaaggccuaaucuug

SEQ ID NO: 2528488 - RNA, 22 nt, Chlamydophila pneumoniae CWL029
ugcaagguucugcgaaacaacu

SEQ ID NO: 2528489 - RNA, 16 nt, Chlamydophila pneumoniae CWL029
ugcaauagcaauggcu

SEQ ID NO: 2528490 - RNA, 17 nt, Chlamydophila pneumoniae CWL029
ugcaaugguugucuuua

SEQ ID NO: 2528491 - RNA, 17 nt, Chlamydophila pneumoniae CWL029
ugcaauuccauagguua

SEQ ID NO: 2528492 - RNA, 16 nt, Chlamydophila pneumoniae CWL029
ugcacaaucgcaucaa

SEQ ID NO: 2528493 - RNA, 15 nt, Chlamydophila pneumoniae CWL029
ugcacacauccugga

SEQ ID NO: 2528494 - RNA, 24 nt, Chlamydophila pneumoniae CWL029
ugcacccaaucgguaugauagaac

SEQ ID NO: 2528495 - RNA, 22 nt, Chlamydophila pneumoniae CWL029
ugcacgaucgcgauaagaagcu

SEQ ID NO: 2528496 - RNA, 17 nt, Chlamydophila pneumoniae CWL029
ugcacucuuucagaaag

SEQ ID NO: 2528497 - RNA, 23 nt, Chlamydophila pneumoniae CWL029
ugcacuugcgguuuuggauagaa

SEQ ID NO: 2528498 - RNA, 18 nt, Chlamydophila pneumoniae CWL029
ugcacuuucuuuuuuaau

SEQ ID NO: 2528499 - RNA, 15 nt, Chlamydophila pneumoniae CWL029
ugcacuuugaauaau

SEQ ID NO: 2528500 - RNA, 16 nt, Chlamydophila pneumoniae CWL029
ugcacuuugaauaaug

SEQ ID NO: 2528501 - RNA, 15 nt, Chlamydophila pneumoniae CWL029
ugcagaaucuaugag

SEQ ID NO: 2528502 - RNA, 20 nt, Chlamydophila pneumoniae CWL029
ugcagaguuuuaaacugcua

SEQ ID NO: 2528503 - RNA, 21 nt, Chlamydophila pneumoniae CWL029
ugcagauacuaaacuccauug

SEQ ID NO: 2528504 - RNA, 20 nt, Chlamydophila pneumoniae CWL029
ugcucaggagauacaagcaa

SEQ ID NO: 2528505 - RNA, 22 nt, Chlamydophila pneumoniae CWL029
ugcucaggagauacaagcaauu

SEQ ID NO: 2528506 - RNA, 14 nt, Chlamydophila pneumoniae CWL029
ugcuccuccaaaag

SEQ ID NO: 2528507 - RNA, 15 nt, Chlamydophila pneumoniae CWL029
ugcuccucuucuucc

SEQ ID NO: 2528508 - RNA, 14 nt, Chlamydophila pneumoniae CWL029
ugcuccugaagcug

SEQ ID NO: 2528509 - RNA, 16 nt, Chlamydophila pneumoniae CWL029
ugcuccugaagcugag

SEQ ID NO: 2528510 - RNA, 15 nt, Chlamydophila pneumoniae CWL029
ugcucggacagaaag

SEQ ID NO: 2528511 - RNA, 16 nt, Chlamydophila pneumoniae CWL029
ugcucgugcgacugcu

SEQ ID NO: 2528512 - RNA, 17 nt, Chlamydophila pneumoniae CWL029
ugcucuaaguugauacu

SEQ ID NO: 2528513 - RNA, 16 nt, Chlamydophila pneumoniae CWL029
ugcucuaccaacugag

SEQ ID NO: 2528514 - RNA, 22 nt, Chlamydophila pneumoniae CWL029
ugcucuagaaaacgcucuccua

SEQ ID NO: 2528515 - RNA, 16 nt, Chlamydophila pneumoniae CWL029
ugcucuagucuuucaa

SEQ ID NO: 2528516 - RNA, 19 nt, Chlamydophila pneumoniae CWL029
ugcucuccugcaaaaaguu

SEQ ID NO: 2528517 - RNA, 14 nt, Chlamydophila pneumoniae CWL029
ugcucugacaagug

SEQ ID NO: 2528518 - RNA, 15 nt, Chlamydophila pneumoniae CWL029
ugcucugacaagugu

SEQ ID NO: 2528519 - RNA, 14 nt, Chlamydophila pneumoniae CWL029
ugcucuuucauuuc

SEQ ID NO: 2528520 - RNA, 14 nt, Chlamydophila pneumoniae CWL029
ugcucuuuugcaag

SEQ ID NO: 2528521 - RNA, 17 nt, Chlamydophila pneumoniae CWL029
ugcugaagauuuuuucu

SEQ ID NO: 2528522 - RNA, 21 nt, Chlamydophila pneumoniae CWL029
ugcugaagauuuuuucuuggu

SEQ ID NO: 2528523 - RNA, 13 nt, Chlamydophila pneumoniae CWL029
ugcugaauuccuc

SEQ ID NO: 2528524 - RNA, 15 nt, Chlamydophila pneumoniae CWL029
ugcugauuucuuuuu

SEQ ID NO: 2528525 - RNA, 18 nt, Chlamydophila pneumoniae CWL029
ugcugauuucuuuuucag

SEQ ID NO: 2528526 - RNA, 10 nt, Chlamydophila pneumoniae CWL029
ugcugcccaa

SEQ ID NO: 2528527 - RNA, 17 nt, Chlamydophila pneumoniae CWL029
ugcugcuaaacagggaa

SEQ ID NO: 2528528 - RNA, 12 nt, Chlamydophila pneumoniae CWL029
ugcugcucucca

SEQ ID NO: 2528529 - RNA, 18 nt, Chlamydophila pneumoniae CWL029
ugcugcucuccaaaggga

SEQ ID NO: 2528530 - RNA, 14 nt, Chlamydophila pneumoniae CWL029
ugcugcuucagaaa

SEQ ID NO: 2528531 - RNA, 21 nt, Chlamydophila pneumoniae CWL029
ugcugcuuccccuaauagggg

SEQ ID NO: 2528532 - RNA, 16 nt, Chlamydophila pneumoniae CWL029
ugcuggaguagcucaa

SEQ ID NO: 2528533 - RNA, 20 nt, Chlamydophila pneumoniae CWL029
ugcuguagauuguuagugag

SEQ ID NO: 2528534 - RNA, 14 nt, Chlamydophila pneumoniae CWL029
ugcugucagaacaa

SEQ ID NO: 2528535 - RNA, 15 nt, Chlamydophila pneumoniae CWL029
ugcugucagaacaag

SEQ ID NO: 2528536 - RNA, 13 nt, Chlamydophila pneumoniae CWL029
ugcuguuguaaua

SEQ ID NO: 2528537 - RNA, 16 nt, Chlamydophila pneumoniae CWL029
ugcuguuucuauuagc

SEQ ID NO: 2528538 - RNA, 13 nt, Chlamydophila pneumoniae CWL029
ugcuguuucuucu

SEQ ID NO: 2528539 - RNA, 15 nt, Chlamydophila pneumoniae CWL029
ugcuuagcaaaggca

SEQ ID NO: 2528540 - RNA, 12 nt, Chlamydophila pneumoniae CWL029
ugcuuauuuccc

SEQ ID NO: 2528541 - RNA, 18 nt, Chlamydophila pneumoniae CWL029
ugcuucgggaucuaaaag

SEQ ID NO: 2528542 - RNA, 12 nt, Chlamydophila pneumoniae CWL029
ugcuucuccaaa

SEQ ID NO: 2528543 - RNA, 23 nt, Chlamydophila pneumoniae CWL029
ugcuucuccaaauaaagcaacug

SEQ ID NO: 2528544 - RNA, 18 nt, Chlamydophila pneumoniae CWL029
ugcuucuguaaagauucu

SEQ ID NO: 2528545 - RNA, 17 nt, Chlamydophila pneumoniae CWL029
ugcuuggcaauagcuuu

SEQ ID NO: 2528546 - RNA, 22 nt, Chlamydophila pneumoniae CWL029
ugcuuguauaaaugcuguagau

SEQ ID NO: 2528547 - RNA, 15 nt, Chlamydophila pneumoniae CWL029
ugcuugucuacagag

SEQ ID NO: 2528548 - RNA, 20 nt, Chlamydophila pneumoniae CWL029
ugcuuguugguuaaaauaga

SEQ ID NO: 2528549 - RNA, 20 nt, Chlamydophila pneumoniae CWL029
ugcuuuauggcucaacuuaa

SEQ ID NO: 2528550 - RNA, 23 nt, Chlamydophila pneumoniae CWL029
ugcuuucaggaguucuugauucu

SEQ ID NO: 2528551 - RNA, 22 nt, Chlamydophila pneumoniae CWL029
ugcuuucuguacaacaaaauuu

SEQ ID NO: 2528552 - RNA, 19 nt, Chlamydophila pneumoniae CWL029
ugcuuugugaguucuuccu

SEQ ID NO: 2528553 - RNA, 22 nt, Chlamydophila pneumoniae CWL029
ugcuuugugaguucuuccuucu

SEQ ID NO: 2528554 - RNA, 23 nt, Chlamydophila pneumoniae CWL029
ugcuuuuagaucccgaagcaauc

SEQ ID NO: 2528555 - RNA, 12 nt, Chlamydophila pneumoniae CWL029
ugcuuuucaaau

SEQ ID NO: 2528556 - RNA, 13 nt, Chlamydophila pneumoniae CWL029
ugcuuuucauuuu

SEQ ID NO: 2528557 - RNA, 10 nt, Chlamydophila pneumoniae CWL029
ugcuuuuccc

SEQ ID NO: 2528558 - RNA, 13 nt, Chlamydophila pneumoniae CWL029
ugcuuuucucuuc

SEQ ID NO: 2528559 - RNA, 15 nt, Chlamydophila pneumoniae CWL029
ugcuuuucucuucaa

SEQ ID NO: 2528560 - RNA, 19 nt, Chlamydophila pneumoniae CWL029
ugcuuuuguuguuuuugcu

SEQ ID NO: 2528561 - RNA, 15 nt, Chlamydophila pneumoniae CWL029
ugcuuuuugaaugau

SEQ ID NO: 2528562 - RNA, 14 nt, Chlamydophila pneumoniae CWL029
uggaaacuuuucca

SEQ ID NO: 2528563 - RNA, 18 nt, Chlamydophila pneumoniae CWL029
uggaaacuuuuccaaauu

SEQ ID NO: 2528564 - RNA, 15 nt, Chlamydophila pneumoniae CWL029
uggaaauagagaaac

SEQ ID NO: 2528565 - RNA, 20 nt, Chlamydophila pneumoniae CWL029
uggaaauagagaaacuuuug

SEQ ID NO: 2528566 - RNA, 15 nt, Chlamydophila pneumoniae CWL029
uggaaauugugaaaa

SEQ ID NO: 2528567 - RNA, 18 nt, Chlamydophila pneumoniae CWL029
uggaaauugugaaaaaaa

SEQ ID NO: 2528568 - RNA, 15 nt, Chlamydophila pneumoniae CWL029
uggaagagagcaaga

SEQ ID NO: 2528569 - RNA, 18 nt, Chlamydophila pneumoniae CWL029
uggaagauaaacauacau

SEQ ID NO: 2528570 - RNA, 16 nt, Chlamydophila pneumoniae CWL029
uggaagauugaaggca

SEQ ID NO: 2528571 - RNA, 19 nt, Chlamydophila pneumoniae CWL029
uggaauauagguuuagauu

SEQ ID NO: 2528572 - RNA, 14 nt, Chlamydophila pneumoniae CWL029
uggaaugacuaaau

SEQ ID NO: 2528573 - RNA, 18 nt, Chlamydophila pneumoniae CWL029
uggaaugacuaaaugcga

SEQ ID NO: 2528574 - RNA, 19 nt, Chlamydophila pneumoniae CWL029
uggaaugccaaauccuccg

SEQ ID NO: 2528575 - RNA, 23 nt, Chlamydophila pneumoniae CWL029
uggaauggcuuuuguuuuguauu

SEQ ID NO: 2528576 - RNA, 16 nt, Chlamydophila pneumoniae CWL029
uggaauucaaacuccu

SEQ ID NO: 2528577 - RNA, 19 nt, Chlamydophila pneumoniae CWL029
uggaauucaaacuccuuuu

SEQ ID NO: 2528578 - RNA, 22 nt, Chlamydophila pneumoniae CWL029
uggaauucaaacuccuuuuaaa

SEQ ID NO: 2528579 - RNA, 23 nt, Chlamydophila pneumoniae CWL029
uggaauucaaacuccuuuuaaaa

SEQ ID NO: 2528580 - RNA, 13 nt, Chlamydophila pneumoniae CWL029
uggaauugcauua

SEQ ID NO: 2528581 - RNA, 13 nt, Chlamydophila pneumoniae CWL029
uggaauuuuccug

SEQ ID NO: 2528582 - RNA, 15 nt, Chlamydophila pneumoniae CWL029
uggacaauauagaga

SEQ ID NO: 2528583 - RNA, 16 nt, Chlamydophila pneumoniae CWL029
uggaccagaugcuaaa

SEQ ID NO: 2528584 - RNA, 19 nt, Chlamydophila pneumoniae CWL029
uggaccagaugcuaaagag

SEQ ID NO: 2528585 - RNA, 17 nt, Chlamydophila pneumoniae CWL029
uggacguacuaagauac

SEQ ID NO: 2528586 - RNA, 18 nt, Chlamydophila pneumoniae CWL029
uggacgugguaagguuau

SEQ ID NO: 2528587 - RNA, 14 nt, Chlamydophila pneumoniae CWL029
uggacuccaagaau

SEQ ID NO: 2528588 - RNA, 20 nt, Chlamydophila pneumoniae CWL029
uggacucuagggucaagaac

SEQ ID NO: 2528589 - RNA, 16 nt, Chlamydophila pneumoniae CWL029
uggagaagagguaaua

SEQ ID NO: 2528590 - RNA, 15 nt, Chlamydophila pneumoniae CWL029
uggagagcgaaauag

SEQ ID NO: 2528591 - RNA, 17 nt, Chlamydophila pneumoniae CWL029
uggagagggaaggaaua

SEQ ID NO: 2528592 - RNA, 17 nt, Chlamydophila pneumoniae CWL029
uggagcaucauuccagc

SEQ ID NO: 2528593 - RNA, 15 nt, Chlamydophila pneumoniae CWL029
uggaggauaaaugag

SEQ ID NO: 2528594 - RNA, 15 nt, Chlamydophila pneumoniae CWL029
uggaggccaaagaac

SEQ ID NO: 2528595 - RNA, 19 nt, Chlamydophila pneumoniae CWL029
uggaggccaaagaacagca

SEQ ID NO: 2528596 - RNA, 21 nt, Chlamydophila pneumoniae CWL029
uggaggccaaagaacagcacu

SEQ ID NO: 2528597 - RNA, 21 nt, Chlamydophila pneumoniae CWL029
uggaggcgguggcaugccaua

SEQ ID NO: 2528598 - RNA, 22 nt, Chlamydophila pneumoniae CWL029
uggaguaucuagcuuugucucu

SEQ ID NO: 2528599 - RNA, 19 nt, Chlamydophila pneumoniae CWL029
uggauaacacgaguuucga

SEQ ID NO: 2528600 - RNA, 21 nt, Chlamydophila pneumoniae CWL029
uggauaacacgaguuucgaua

SEQ ID NO: 2528601 - RNA, 16 nt, Chlamydophila pneumoniae CWL029
uggauacguuuuuccc

SEQ ID NO: 2528602 - RNA, 22 nt, Chlamydophila pneumoniae CWL029
uguacaagcuucaucaaaacau

SEQ ID NO: 2528603 - RNA, 16 nt, Chlamydophila pneumoniae CWL029
uguacaauuugcuccu

SEQ ID NO: 2528604 - RNA, 13 nt, Chlamydophila pneumoniae CWL029
uguacacagagau

SEQ ID NO: 2528605 - RNA, 16 nt, Chlamydophila pneumoniae CWL029
uguacacagagaugcu

SEQ ID NO: 2528606 - RNA, 14 nt, Chlamydophila pneumoniae CWL029
uguacacuuucaag

SEQ ID NO: 2528607 - RNA, 19 nt, Chlamydophila pneumoniae CWL029
uguacagaaaauaagaagc

SEQ ID NO: 2528608 - RNA, 13 nt, Chlamydophila pneumoniae CWL029
uguacagaacaau

SEQ ID NO: 2528609 - RNA, 20 nt, Chlamydophila pneumoniae CWL029
uguacaguuuguaaaaagcc

SEQ ID NO: 2528610 - RNA, 23 nt, Chlamydophila pneumoniae CWL029
uguacaguuuguaaaaagccuau

SEQ ID NO: 2528611 - RNA, 21 nt, Chlamydophila pneumoniae CWL029
uguacuagauaguucacaagu

SEQ ID NO: 2528612 - RNA, 17 nt, Chlamydophila pneumoniae CWL029
uguacuugauauuguuc

SEQ ID NO: 2528613 - RNA, 21 nt, Chlamydophila pneumoniae CWL029
uguagacaauaccagauaaag

SEQ ID NO: 2528614 - RNA, 19 nt, Chlamydophila pneumoniae CWL029
uguagaggucacuauagau

SEQ ID NO: 2528615 - RNA, 12 nt, Chlamydophila pneumoniae CWL029
uguagauuuucc

SEQ ID NO: 2528616 - RNA, 14 nt, Chlamydophila pneumoniae CWL029
uguagcagagccuc

SEQ ID NO: 2528617 - RNA, 19 nt, Chlamydophila pneumoniae CWL029
uguagcauuucuuucucuu

SEQ ID NO: 2528618 - RNA, 21 nt, Chlamydophila pneumoniae CWL029
uguaggaacaugccaaauauc

SEQ ID NO: 2528619 - RNA, 15 nt, Chlamydophila pneumoniae CWL029
uguagggaugaucac

SEQ ID NO: 2528620 - RNA, 14 nt, Chlamydophila pneumoniae CWL029
uguagguuuuucca

SEQ ID NO: 2528621 - RNA, 14 nt, Chlamydophila pneumoniae CWL029
uguaguaaauuccu

SEQ ID NO: 2528622 - RNA, 16 nt, Chlamydophila pneumoniae CWL029
uguaguaaauuccucu

SEQ ID NO: 2528623 - RNA, 15 nt, Chlamydophila pneumoniae CWL029
uguaguaagauuuuc

SEQ ID NO: 2528624 - RNA, 19 nt, Chlamydophila pneumoniae CWL029
uguagucaugauuuuucaa

SEQ ID NO: 2528625 - RNA, 13 nt, Chlamydophila pneumoniae CWL029
uguaguucuugcc

SEQ ID NO: 2528626 - RNA, 23 nt, Chlamydophila pneumoniae CWL029
uguaguucuuugaauuuccaaag

SEQ ID NO: 2528627 - RNA, 20 nt, Chlamydophila pneumoniae CWL029
uguaguuucuaaaacagaaa

SEQ ID NO: 2528628 - RNA, 20 nt, Chlamydophila pneumoniae CWL029
uguaguuugggaugacuggc

SEQ ID NO: 2528629 - RNA, 16 nt, Chlamydophila pneumoniae CWL029
uguaguuuguucacuu

SEQ ID NO: 2528630 - RNA, 13 nt, Chlamydophila pneumoniae CWL029
uguauaaacucca

SEQ ID NO: 2528631 - RNA, 22 nt, Chlamydophila pneumoniae CWL029
uguauaaacuccacgaauucuu

SEQ ID NO: 2528632 - RNA, 23 nt, Chlamydophila pneumoniae CWL029
uguauaacaucuaaaaaugcacu

SEQ ID NO: 2528633 - RNA, 15 nt, Chlamydophila pneumoniae CWL029
uguauacauaucucc

SEQ ID NO: 2528634 - RNA, 19 nt, Chlamydophila pneumoniae CWL029
uguauagcuuacuuagaac

SEQ ID NO: 2528635 - RNA, 14 nt, Chlamydophila pneumoniae CWL029
uguauauucugaaa

SEQ ID NO: 2528636 - RNA, 19 nt, Chlamydophila pneumoniae CWL029
uguauauucugaaauuucu

SEQ ID NO: 2528637 - RNA, 15 nt, Chlamydophila pneumoniae CWL029
uguauccagcucaag

SEQ ID NO: 2528638 - RNA, 18 nt, Chlamydophila pneumoniae CWL029
uguauccagcucaaggca

SEQ ID NO: 2528639 - RNA, 22 nt, Chlamydophila pneumoniae CWL029
uguaucgauaacgauuucuuga

SEQ ID NO: 2528640 - RNA, 17 nt, Chlamydophila pneumoniae CWL029
uguaucuagggacuucu

SEQ ID NO: 2528641 - RNA, 19 nt, Chlamydophila pneumoniae CWL029
uguaucucuuaaaauauua

SEQ ID NO: 2528642 - RNA, 16 nt, Chlamydophila pneumoniae CWL029
uguauggaauucaaac

SEQ ID NO: 2528643 - RNA, 13 nt, Chlamydophila pneumoniae CWL029
uguauuaaagaau

SEQ ID NO: 2528644 - RNA, 16 nt, Chlamydophila pneumoniae CWL029
uguauuaaagaaucua

SEQ ID NO: 2528645 - RNA, 16 nt, Chlamydophila pneumoniae CWL029
uguauucugaagcugc

SEQ ID NO: 2528646 - RNA, 15 nt, Chlamydophila pneumoniae CWL029
uguauuguacuuuuu

SEQ ID NO: 2528647 - RNA, 12 nt, Chlamydophila pneumoniae CWL029
uguauuuaaauu

SEQ ID NO: 2528648 - RNA, 20 nt, Chlamydophila pneumoniae CWL029
ugucaaguaagucuucgaaa

SEQ ID NO: 2528649 - RNA, 18 nt, Chlamydophila pneumoniae CWL029
ugucaccacgaacuucag

SEQ ID NO: 2528650 - RNA, 14 nt, Chlamydophila pneumoniae CWL029
ugucacggaagaac

SEQ ID NO: 2528651 - RNA, 20 nt, Chlamydophila pneumoniae CWL029
ugucacuaagauaucuccag

SEQ ID NO: 2528652 - RNA, 21 nt, Chlamydophila pneumoniae CWL029
ugucacucuagaaaauauucc

SEQ ID NO: 2528653 - RNA, 15 nt, Chlamydophila pneumoniae CWL029
ugucaucacaucagu

SEQ ID NO: 2528654 - RNA, 18 nt, Chlamydophila pneumoniae CWL029
ugucaucggcuucuccaa

SEQ ID NO: 2528655 - RNA, 23 nt, Chlamydophila pneumoniae CWL029
uguccaugcacgagauucuugag

SEQ ID NO: 2528656 - RNA, 13 nt, Chlamydophila pneumoniae CWL029
uguccguauuuuu

SEQ ID NO: 2528657 - RNA, 17 nt, Chlamydophila pneumoniae CWL029
uguccgugagcaacaag

SEQ ID NO: 2528658 - RNA, 17 nt, Chlamydophila pneumoniae CWL029
uguccuguuaagaugug

SEQ ID NO: 2528659 - RNA, 12 nt, Chlamydophila pneumoniae CWL029
ugucgcaaaugc

SEQ ID NO: 2528660 - RNA, 13 nt, Chlamydophila pneumoniae CWL029
ugucgcaaaugca

SEQ ID NO: 2528661 - RNA, 15 nt, Chlamydophila pneumoniae CWL029
ugucguaauaacccc

SEQ ID NO: 2528662 - RNA, 17 nt, Chlamydophila pneumoniae CWL029
ugucguaauugcugaaa

SEQ ID NO: 2528663 - RNA, 14 nt, Chlamydophila pneumoniae CWL029
ugucuaaagauugg

SEQ ID NO: 2528664 - RNA, 17 nt, Chlamydophila pneumoniae CWL029
ugucuaagauauagaga

SEQ ID NO: 2528665 - RNA, 18 nt, Chlamydophila pneumoniae CWL029
ugucuaggagcuucgccu

SEQ ID NO: 2528666 - RNA, 20 nt, Chlamydophila pneumoniae CWL029
ugucuagugaagcugcuucu

SEQ ID NO: 2528667 - RNA, 23 nt, Chlamydophila pneumoniae CWL029
ugucuauuucuuaauuuccuucu

SEQ ID NO: 2528668 - RNA, 23 nt, Chlamydophila pneumoniae CWL029
ugucucagcauuuuauccacugc

SEQ ID NO: 2528669 - RNA, 14 nt, Chlamydophila pneumoniae CWL029
ugucuccaaagaua

SEQ ID NO: 2528670 - RNA, 15 nt, Chlamydophila pneumoniae CWL029
ugucuccauacagcg

SEQ ID NO: 2528671 - RNA, 19 nt, Chlamydophila pneumoniae CWL029
ugucucugaagaccccucu

SEQ ID NO: 2528672 - RNA, 17 nt, Chlamydophila pneumoniae CWL029
ugucugcaaagagcaaa

SEQ ID NO: 2528673 - RNA, 22 nt, Chlamydophila pneumoniae CWL029
ugucuuccacgaaggaaucuga

SEQ ID NO: 2528674 - RNA, 22 nt, Chlamydophila pneumoniae CWL029
ugucuugaagagauugauuucu

SEQ ID NO: 2528675 - RNA, 23 nt, Chlamydophila pneumoniae CWL029
ugucuugcuuugugaguucuucc

SEQ ID NO: 2528676 - RNA, 12 nt, Chlamydophila pneumoniae CWL029
ugucuuuuuaag

SEQ ID NO: 2528677 - RNA, 15 nt, Chlamydophila pneumoniae CWL029
ugugaguucuuccuu

SEQ ID NO: 2528678 - RNA, 19 nt, Chlamydophila pneumoniae CWL029
ugugauccuugcaaaacag

SEQ ID NO: 2528679 - RNA, 15 nt, Chlamydophila pneumoniae CWL029
ugugauguucugcug

SEQ ID NO: 2528680 - RNA, 16 nt, Chlamydophila pneumoniae CWL029
ugugauguucugcugc

SEQ ID NO: 2528681 - RNA, 21 nt, Chlamydophila pneumoniae CWL029
ugugcacccaaucgguaugau

SEQ ID NO: 2528682 - RNA, 22 nt, Chlamydophila pneumoniae CWL029
ugugcacccaaucgguaugaua

SEQ ID NO: 2528683 - RNA, 20 nt, Chlamydophila pneumoniae CWL029
ugugcagaagguuccacaga

SEQ ID NO: 2528684 - RNA, 12 nt, Chlamydophila pneumoniae CWL029
ugugcaucaguc

SEQ ID NO: 2528685 - RNA, 23 nt, Chlamydophila pneumoniae CWL029
ugugcauuuucuucuugcaaucu

SEQ ID NO: 2528686 - RNA, 18 nt, Chlamydophila pneumoniae CWL029
ugugcugaagaccaugaa

SEQ ID NO: 2528687 - RNA, 13 nt, Chlamydophila pneumoniae CWL029
ugugcuuuucucu

SEQ ID NO: 2528688 - RNA, 15 nt, Chlamydophila pneumoniae CWL029
ugugcuuuugguucu

SEQ ID NO: 2528689 - RNA, 17 nt, Chlamydophila pneumoniae CWL029
ugugggauggucaggaa

SEQ ID NO: 2528690 - RNA, 14 nt, Chlamydophila pneumoniae CWL029
uguggucuuccgua

SEQ ID NO: 2528691 - RNA, 19 nt, Chlamydophila pneumoniae CWL029
uguggugaggagcuauuaa

SEQ ID NO: 2528692 - RNA, 20 nt, Chlamydophila pneumoniae CWL029
uguguauuuaagaaaugcaa

SEQ ID NO: 2528693 - RNA, 14 nt, Chlamydophila pneumoniae CWL029
uguguauuugcaga

SEQ ID NO: 2528694 - RNA, 18 nt, Chlamydophila pneumoniae CWL029
ugugugacgacaaaucac

SEQ ID NO: 2528695 - RNA, 21 nt, Chlamydophila pneumoniae CWL029
ugugugacgacaaaucacgac

SEQ ID NO: 2528696 - RNA, 23 nt, Chlamydophila pneumoniae CWL029
uguuaaguucauaaccugggcaa

SEQ ID NO: 2528697 - RNA, 22 nt, Chlamydophila pneumoniae CWL029
uguuaauaagcauauuuaaaua

SEQ ID NO: 2528698 - RNA, 20 nt, Chlamydophila pneumoniae CWL029
uguuaauagaagaucauuaa

SEQ ID NO: 2528699 - RNA, 15 nt, Chlamydophila pneumoniae CWL029
uuaagauagacucuc

SEQ ID NO: 2528700 - RNA, 18 nt, Chlamydophila pneumoniae CWL029
uuaagauagacucucacu

SEQ ID NO: 2528701 - RNA, 13 nt, Chlamydophila pneumoniae CWL029
uuaagcuaauaag

SEQ ID NO: 2528702 - RNA, 13 nt, Chlamydophila pneumoniae CWL029
uuaagguugcuuu

SEQ ID NO: 2528703 - RNA, 17 nt, Chlamydophila pneumoniae CWL029
uuaagguugcuuuucua

SEQ ID NO: 2528704 - RNA, 17 nt, Chlamydophila pneumoniae CWL029
uuaagugcuuuuagauc

SEQ ID NO: 2528705 - RNA, 18 nt, Chlamydophila pneumoniae CWL029
uuaaguugaccuuuuuca

SEQ ID NO: 2528706 - RNA, 13 nt, Chlamydophila pneumoniae CWL029
uuaauaaaauuua

SEQ ID NO: 2528707 - RNA, 22 nt, Chlamydophila pneumoniae CWL029
uuaauaagcauauuuaaauaua

SEQ ID NO: 2528708 - RNA, 23 nt, Chlamydophila pneumoniae CWL029
uuaauaagcauauuuaaauauaa

SEQ ID NO: 2528709 - RNA, 18 nt, Chlamydophila pneumoniae CWL029
uuaauacaaaaaauaaaa

SEQ ID NO: 2528710 - RNA, 15 nt, Chlamydophila pneumoniae CWL029
uuaauacuuugccaa

SEQ ID NO: 2528711 - RNA, 14 nt, Chlamydophila pneumoniae CWL029
uuaauauaaaagaa

SEQ ID NO: 2528712 - RNA, 16 nt, Chlamydophila pneumoniae CWL029
uuaauauaaaagaaga

SEQ ID NO: 2528713 - RNA, 14 nt, Chlamydophila pneumoniae CWL029
uuaaucaagccuaa

SEQ ID NO: 2528714 - RNA, 12 nt, Chlamydophila pneumoniae CWL029
uuaaucaauccu

SEQ ID NO: 2528715 - RNA, 22 nt, Chlamydophila pneumoniae CWL029
uuaauccuugagggcuauccac

SEQ ID NO: 2528716 - RNA, 16 nt, Chlamydophila pneumoniae CWL029
uuaauccuuucacaaa

SEQ ID NO: 2528717 - RNA, 17 nt, Chlamydophila pneumoniae CWL029
uuaaugguagcuuaaga

SEQ ID NO: 2528718 - RNA, 13 nt, Chlamydophila pneumoniae CWL029
uuaauguuuggcc

SEQ ID NO: 2528719 - RNA, 12 nt, Chlamydophila pneumoniae CWL029
uuaauucucuga

SEQ ID NO: 2528720 - RNA, 18 nt, Chlamydophila pneumoniae CWL029
uuaauuuuugcuaaacaa

SEQ ID NO: 2528721 - RNA, 22 nt, Chlamydophila pneumoniae CWL029
uuaauuuuugcuaaacaaugca

SEQ ID NO: 2528722 - RNA, 15 nt, Chlamydophila pneumoniae CWL029
uuacaaauaaaauga

SEQ ID NO: 2528723 - RNA, 17 nt, Chlamydophila pneumoniae CWL029
uuacaaauaaaaugauu

SEQ ID NO: 2528724 - RNA, 15 nt, Chlamydophila pneumoniae CWL029
uuacaagcuuccuug

SEQ ID NO: 2528725 - RNA, 14 nt, Chlamydophila pneumoniae CWL029
uuacaauugaaaau

SEQ ID NO: 2528726 - RNA, 18 nt, Chlamydophila pneumoniae CWL029
uuacaauuuaaaucugca

SEQ ID NO: 2528727 - RNA, 13 nt, Chlamydophila pneumoniae CWL029
uuacagaaaggcu

SEQ ID NO: 2528728 - RNA, 14 nt, Chlamydophila pneumoniae CWL029
uuacagaucugcau

SEQ ID NO: 2528729 - RNA, 18 nt, Chlamydophila pneumoniae CWL029
uuacagcaucuauagaau

SEQ ID NO: 2528730 - RNA, 13 nt, Chlamydophila pneumoniae CWL029
uuacaggaaacuc

SEQ ID NO: 2528731 - RNA, 16 nt, Chlamydophila pneumoniae CWL029
uuacaggaaacucuau

SEQ ID NO: 2528732 - RNA, 13 nt, Chlamydophila pneumoniae CWL029
uuacaucaaugau

SEQ ID NO: 2528733 - RNA, 15 nt, Chlamydophila pneumoniae CWL029
uuacauguaaacaaa

SEQ ID NO: 2528734 - RNA, 16 nt, Chlamydophila pneumoniae CWL029
uuacauguaaacaaaa

SEQ ID NO: 2528735 - RNA, 14 nt, Chlamydophila pneumoniae CWL029
uuaccaaaaacugg

SEQ ID NO: 2528736 - RNA, 16 nt, Chlamydophila pneumoniae CWL029
uuaccguuuccuccuc

SEQ ID NO: 2528737 - RNA, 23 nt, Chlamydophila pneumoniae CWL029
uuaccucauggagguucucaaug

SEQ ID NO: 2528738 - RNA, 14 nt, Chlamydophila pneumoniae CWL029
uuacgaugagguug

SEQ ID NO: 2528739 - RNA, 12 nt, Chlamydophila pneumoniae CWL029
uuacgcucucca

SEQ ID NO: 2528740 - RNA, 23 nt, Chlamydophila pneumoniae CWL029
uuacuaaagaaagagucucacuc

SEQ ID NO: 2528741 - RNA, 19 nt, Chlamydophila pneumoniae CWL029
uuacuaaaggugaaaguac

SEQ ID NO: 2528742 - RNA, 21 nt, Chlamydophila pneumoniae CWL029
uuacuaacucuguaauauuca

SEQ ID NO: 2528743 - RNA, 16 nt, Chlamydophila pneumoniae CWL029
uuacuaggaaggaaau

SEQ ID NO: 2528744 - RNA, 20 nt, Chlamydophila pneumoniae CWL029
uuacuaggaaggaaaucaca

SEQ ID NO: 2528745 - RNA, 21 nt, Chlamydophila pneumoniae CWL029
uuacuaggaaggaaaucacag

SEQ ID NO: 2528746 - RNA, 16 nt, Chlamydophila pneumoniae CWL029
uuacugaggaaaucgc

SEQ ID NO: 2528747 - RNA, 17 nt, Chlamydophila pneumoniae CWL029
uuacugucugcaaagag

SEQ ID NO: 2528748 - RNA, 18 nt, Chlamydophila pneumoniae CWL029
uuacugugguauacaucc

SEQ ID NO: 2528749 - RNA, 16 nt, Chlamydophila pneumoniae CWL029
uuacuucacguugcaa

SEQ ID NO: 2528750 - RNA, 18 nt, Chlamydophila pneumoniae CWL029
uuacuuuaaucaagccua

SEQ ID NO: 2528751 - RNA, 22 nt, Chlamydophila pneumoniae CWL029
uuacuuuaaucaagccuaaauc

SEQ ID NO: 2528752 - RNA, 14 nt, Chlamydophila pneumoniae CWL029
uuacuuucugauug

SEQ ID NO: 2528753 - RNA, 20 nt, Chlamydophila pneumoniae CWL029
uuacuuucuuuuagcuacuu

SEQ ID NO: 2528754 - RNA, 18 nt, Chlamydophila pneumoniae CWL029
uuagaaaccaugaugcaa

SEQ ID NO: 2528755 - RNA, 19 nt, Chlamydophila pneumoniae CWL029
uuagaaauguuuuuaaacc

SEQ ID NO: 2528756 - RNA, 13 nt, Chlamydophila pneumoniae CWL029
uuagaacuucaau

SEQ ID NO: 2528757 - RNA, 16 nt, Chlamydophila pneumoniae CWL029
uuagaaucuuuucuag

SEQ ID NO: 2528758 - RNA, 21 nt, Chlamydophila pneumoniae CWL029
uuagaaucuuuucuagaaaac

SEQ ID NO: 2528759 - RNA, 18 nt, Chlamydophila pneumoniae CWL029
uuagacgaggagaagucg

SEQ ID NO: 2528760 - RNA, 18 nt, Chlamydophila pneumoniae CWL029
uuagacgugcucucuucu

SEQ ID NO: 2528761 - RNA, 15 nt, Chlamydophila pneumoniae CWL029
uuagagaaaucugca

SEQ ID NO: 2528762 - RNA, 16 nt, Chlamydophila pneumoniae CWL029
uuagagagaaacaucg

SEQ ID NO: 2528763 - RNA, 18 nt, Chlamydophila pneumoniae CWL029
uuagagucgauaaaaacu

SEQ ID NO: 2528764 - RNA, 13 nt, Chlamydophila pneumoniae CWL029
uuagagucugcag

SEQ ID NO: 2528765 - RNA, 13 nt, Chlamydophila pneumoniae CWL029
uuagagugacuca

SEQ ID NO: 2528766 - RNA, 20 nt, Chlamydophila pneumoniae CWL029
uuagauacgcuuacaaauaa

SEQ ID NO: 2528767 - RNA, 12 nt, Chlamydophila pneumoniae CWL029
uuagauuuccuc

SEQ ID NO: 2528768 - RNA, 14 nt, Chlamydophila pneumoniae CWL029
uuagcaagagcucu

SEQ ID NO: 2528769 - RNA, 14 nt, Chlamydophila pneumoniae CWL029
uuagcauagagcuc

SEQ ID NO: 2528770 - RNA, 23 nt, Chlamydophila pneumoniae CWL029
uuagcauagagcucuaaaaaaga

SEQ ID NO: 2528771 - RNA, 17 nt, Chlamydophila pneumoniae CWL029
uuagcaucaucuccuga

SEQ ID NO: 2528772 - RNA, 13 nt, Chlamydophila pneumoniae CWL029
uuagcauuucucu

SEQ ID NO: 2528773 - RNA, 16 nt, Chlamydophila pneumoniae CWL029
uuagccaaaauuuccu

SEQ ID NO: 2528774 - RNA, 20 nt, Chlamydophila pneumoniae CWL029
uuaggaggaguauagcauga

SEQ ID NO: 2528775 - RNA, 19 nt, Chlamydophila pneumoniae CWL029
uuaggauuucgagauauug

SEQ ID NO: 2528776 - RNA, 20 nt, Chlamydophila pneumoniae CWL029
uuagggaugguuuccucuau

SEQ ID NO: 2528777 - RNA, 23 nt, Chlamydophila pneumoniae CWL029
uuagguagauagaaauucuguag

SEQ ID NO: 2528778 - RNA, 12 nt, Chlamydophila pneumoniae CWL029
uuaggucuuaaa

SEQ ID NO: 2528779 - RNA, 12 nt, Chlamydophila pneumoniae CWL029
uuaguaaagaau

SEQ ID NO: 2528780 - RNA, 19 nt, Chlamydophila pneumoniae CWL029
uuaguauacuaagacuguc

SEQ ID NO: 2528781 - RNA, 18 nt, Chlamydophila pneumoniae CWL029
uuaguuuaccugaaaaaa

SEQ ID NO: 2528782 - RNA, 19 nt, Chlamydophila pneumoniae CWL029
uuaguuuaccugaaaaaac

SEQ ID NO: 2528783 - RNA, 19 nt, Chlamydophila pneumoniae CWL029
uuaguuuuucuagcuuccu

SEQ ID NO: 2528784 - RNA, 22 nt, Chlamydophila pneumoniae CWL029
uuauaaacuucaaugaagaaaa

SEQ ID NO: 2528785 - RNA, 13 nt, Chlamydophila pneumoniae CWL029
uuauaaacuucua

SEQ ID NO: 2528786 - RNA, 18 nt, Chlamydophila pneumoniae CWL029
uuauaaacuucuagacaa

SEQ ID NO: 2528787 - RNA, 19 nt, Chlamydophila pneumoniae CWL029
uuauaaacuucuagacaac

SEQ ID NO: 2528788 - RNA, 22 nt, Chlamydophila pneumoniae CWL029
uuauaaacuucuagacaacaaa

SEQ ID NO: 2528789 - RNA, 18 nt, Chlamydophila pneumoniae CWL029
uuauaacaucaagaauuu

SEQ ID NO: 2528790 - RNA, 23 nt, Chlamydophila pneumoniae CWL029
uuauacccacaaagaucacugag

SEQ ID NO: 2528791 - RNA, 13 nt, Chlamydophila pneumoniae CWL029
uuauauaaaacuu

SEQ ID NO: 2528792 - RNA, 15 nt, Chlamydophila pneumoniae CWL029
uuauauaaaacuuau

SEQ ID NO: 2528793 - RNA, 14 nt, Chlamydophila pneumoniae CWL029
uuauauaaagaucu

SEQ ID NO: 2528794 - RNA, 17 nt, Chlamydophila pneumoniae CWL029
uuauauaccacuacuga

SEQ ID NO: 2528795 - RNA, 20 nt, Chlamydophila pneumoniae CWL029
uuauauagacaaugcaaccu

SEQ ID NO: 2528796 - RNA, 20 nt, Chlamydophila pneumoniae CWL029
uuaucaggaacuaaaaguuu

SEQ ID NO: 2528797 - RNA, 21 nt, Chlamydophila pneumoniae CWL029
uucauaacacccugacaggua

SEQ ID NO: 2528798 - RNA, 17 nt, Chlamydophila pneumoniae CWL029
uucauaaccaaguaaau

SEQ ID NO: 2528799 - RNA, 20 nt, Chlamydophila pneumoniae CWL029
uucauaaccaaguaaaucag

SEQ ID NO: 2528800 - RNA, 13 nt, Chlamydophila pneumoniae CWL029
uucauaagauugc

SEQ ID NO: 2528801 - RNA, 16 nt, Chlamydophila pneumoniae CWL029
uucauauaaaguuucc

SEQ ID NO: 2528802 - RNA, 14 nt, Chlamydophila pneumoniae CWL029
uucaucaaaacaua

SEQ ID NO: 2528803 - RNA, 21 nt, Chlamydophila pneumoniae CWL029
uucaucacaaaauucaugcaa

SEQ ID NO: 2528804 - RNA, 20 nt, Chlamydophila pneumoniae CWL029
uucaucgauaggaugacacu

SEQ ID NO: 2528805 - RNA, 20 nt, Chlamydophila pneumoniae CWL029
uucaucuaggggagcuauua

SEQ ID NO: 2528806 - RNA, 15 nt, Chlamydophila pneumoniae CWL029
uucaucugucauuaa

SEQ ID NO: 2528807 - RNA, 20 nt, Chlamydophila pneumoniae CWL029
uucaucugucauuaaaaauu

SEQ ID NO: 2528808 - RNA, 12 nt, Chlamydophila pneumoniae CWL029
uucaucuucuuu

SEQ ID NO: 2528809 - RNA, 16 nt, Chlamydophila pneumoniae CWL029
uucaugaaaaaagaau

SEQ ID NO: 2528810 - RNA, 22 nt, Chlamydophila pneumoniae CWL029
uucaugaaaaaagaauaaaaau

SEQ ID NO: 2528811 - RNA, 12 nt, Chlamydophila pneumoniae CWL029
uucaugcaaaac

SEQ ID NO: 2528812 - RNA, 13 nt, Chlamydophila pneumoniae CWL029
uucauucacagca

SEQ ID NO: 2528813 - RNA, 15 nt, Chlamydophila pneumoniae CWL029
uucauucacagcagu

SEQ ID NO: 2528814 - RNA, 15 nt, Chlamydophila pneumoniae CWL029
uucauucuuucgaua

SEQ ID NO: 2528815 - RNA, 13 nt, Chlamydophila pneumoniae CWL029
uucauugcaaaaa

SEQ ID NO: 2528816 - RNA, 21 nt, Chlamydophila pneumoniae CWL029
uucauuguagaggucacuaua

SEQ ID NO: 2528817 - RNA, 18 nt, Chlamydophila pneumoniae CWL029
uuccaaaauaaaaggagc

SEQ ID NO: 2528818 - RNA, 13 nt, Chlamydophila pneumoniae CWL029
uuccaaagacuga

SEQ ID NO: 2528819 - RNA, 14 nt, Chlamydophila pneumoniae CWL029
uuccaagaaaaauu

SEQ ID NO: 2528820 - RNA, 17 nt, Chlamydophila pneumoniae CWL029
uuccaagugaucagaaa

SEQ ID NO: 2528821 - RNA, 14 nt, Chlamydophila pneumoniae CWL029
uuccaauaauuuuc

SEQ ID NO: 2528822 - RNA, 17 nt, Chlamydophila pneumoniae CWL029
uuccaauacuaaaacua

SEQ ID NO: 2528823 - RNA, 17 nt, Chlamydophila pneumoniae CWL029
uuccaauagagucucuu

SEQ ID NO: 2528824 - RNA, 19 nt, Chlamydophila pneumoniae CWL029
uuccaauagagucucuuga

SEQ ID NO: 2528825 - RNA, 20 nt, Chlamydophila pneumoniae CWL029
uuccaauccauucugagaaa

SEQ ID NO: 2528826 - RNA, 23 nt, Chlamydophila pneumoniae CWL029
uuccaauccauucugagaaagaa

SEQ ID NO: 2528827 - RNA, 16 nt, Chlamydophila pneumoniae CWL029
uuccaauuguaaauca

SEQ ID NO: 2528828 - RNA, 18 nt, Chlamydophila pneumoniae CWL029
uuccacagagaccuucuc

SEQ ID NO: 2528829 - RNA, 13 nt, Chlamydophila pneumoniae CWL029
uuccagaaaucug

SEQ ID NO: 2528830 - RNA, 15 nt, Chlamydophila pneumoniae CWL029
uuccaggcucuagga

SEQ ID NO: 2528831 - RNA, 21 nt, Chlamydophila pneumoniae CWL029
uuccauaauuuuagcuucuuu

SEQ ID NO: 2528832 - RNA, 23 nt, Chlamydophila pneumoniae CWL029
uuccauagccaaggagcuauaga

SEQ ID NO: 2528833 - RNA, 18 nt, Chlamydophila pneumoniae CWL029
uuccauaggaucugcaug

SEQ ID NO: 2528834 - RNA, 19 nt, Chlamydophila pneumoniae CWL029
uuccauagguuagaaauga

SEQ ID NO: 2528835 - RNA, 20 nt, Chlamydophila pneumoniae CWL029
uuccaucgccgaccaucaua

SEQ ID NO: 2528836 - RNA, 23 nt, Chlamydophila pneumoniae CWL029
uuccauggcuauuuuuaaaauga

SEQ ID NO: 2528837 - RNA, 13 nt, Chlamydophila pneumoniae CWL029
uuccauguagaag

SEQ ID NO: 2528838 - RNA, 21 nt, Chlamydophila pneumoniae CWL029
uuccauuagggcauucuguaa

SEQ ID NO: 2528839 - RNA, 15 nt, Chlamydophila pneumoniae CWL029
uuccauuuucaggcu

SEQ ID NO: 2528840 - RNA, 12 nt, Chlamydophila pneumoniae CWL029
uuccauuuuucc

SEQ ID NO: 2528841 - RNA, 16 nt, Chlamydophila pneumoniae CWL029
uuccauuuuuccuccu

SEQ ID NO: 2528842 - RNA, 17 nt, Chlamydophila pneumoniae CWL029
uucccacuaagaaugag

SEQ ID NO: 2528843 - RNA, 18 nt, Chlamydophila pneumoniae CWL029
uucccaucuuguucuaaa

SEQ ID NO: 2528844 - RNA, 22 nt, Chlamydophila pneumoniae CWL029
uucccaucuuguucuaaaauga

SEQ ID NO: 2528845 - RNA, 17 nt, Chlamydophila pneumoniae CWL029
uuccccaaacuuagcuc

SEQ ID NO: 2528846 - RNA, 17 nt, Chlamydophila pneumoniae CWL029
uuccccaugaaaauaca

SEQ ID NO: 2528847 - RNA, 20 nt, Chlamydophila pneumoniae CWL029
uucccccgcguaauagcagu

SEQ ID NO: 2528848 - RNA, 13 nt, Chlamydophila pneumoniae CWL029
uuccccugaaaau

SEQ ID NO: 2528849 - RNA, 23 nt, Chlamydophila pneumoniae CWL029
uucccgaaggggaagaggaaugc

SEQ ID NO: 2528850 - RNA, 14 nt, Chlamydophila pneumoniae CWL029
uucccgauagcaua

SEQ ID NO: 2528851 - RNA, 15 nt, Chlamydophila pneumoniae CWL029
uucccuaacaggaaa

SEQ ID NO: 2528852 - RNA, 21 nt, Chlamydophila pneumoniae CWL029
uucccuaagguagaguccaca

SEQ ID NO: 2528853 - RNA, 18 nt, Chlamydophila pneumoniae CWL029
uucccucaugaagaauua

SEQ ID NO: 2528854 - RNA, 16 nt, Chlamydophila pneumoniae CWL029
uucccuccuuccuuaa

SEQ ID NO: 2528855 - RNA, 17 nt, Chlamydophila pneumoniae CWL029
uucccugacacagagcu

SEQ ID NO: 2528856 - RNA, 18 nt, Chlamydophila pneumoniae CWL029
uucccuguccgcaauagu

SEQ ID NO: 2528857 - RNA, 23 nt, Chlamydophila pneumoniae CWL029
uucccuuuaaaaguacgaccaac

SEQ ID NO: 2528858 - RNA, 17 nt, Chlamydophila pneumoniae CWL029
uuccggguucauuucca

SEQ ID NO: 2528859 - RNA, 16 nt, Chlamydophila pneumoniae CWL029
uuccuaaaacaagaag

SEQ ID NO: 2528860 - RNA, 22 nt, Chlamydophila pneumoniae CWL029
uuccuaaacgacguuuaauucc

SEQ ID NO: 2528861 - RNA, 15 nt, Chlamydophila pneumoniae CWL029
uuccuaacuaucucu

SEQ ID NO: 2528862 - RNA, 21 nt, Chlamydophila pneumoniae CWL029
uuccuaacuaucucuguuuuu

SEQ ID NO: 2528863 - RNA, 13 nt, Chlamydophila pneumoniae CWL029
uuccuaacuucug

SEQ ID NO: 2528864 - RNA, 16 nt, Chlamydophila pneumoniae CWL029
uuccuaacuucugaag

SEQ ID NO: 2528865 - RNA, 15 nt, Chlamydophila pneumoniae CWL029
uuccuaaguuagaga

SEQ ID NO: 2528866 - RNA, 20 nt, Chlamydophila pneumoniae CWL029
uuccuacaucugugauuaau

SEQ ID NO: 2528867 - RNA, 12 nt, Chlamydophila pneumoniae CWL029
uuccuaccuaua

SEQ ID NO: 2528868 - RNA, 16 nt, Chlamydophila pneumoniae CWL029
uuccuacgacaugccu

SEQ ID NO: 2528869 - RNA, 18 nt, Chlamydophila pneumoniae CWL029
uuccuacgacaugccuaa

SEQ ID NO: 2528870 - RNA, 21 nt, Chlamydophila pneumoniae CWL029
uuccuacgacaugccuaaaua

SEQ ID NO: 2528871 - RNA, 16 nt, Chlamydophila pneumoniae CWL029
uuccuacuucugcagg

SEQ ID NO: 2528872 - RNA, 22 nt, Chlamydophila pneumoniae CWL029
uuccuauaugaaugauuuccau

SEQ ID NO: 2528873 - RNA, 18 nt, Chlamydophila pneumoniae CWL029
uuccuccuuucgucccuc

SEQ ID NO: 2528874 - RNA, 17 nt, Chlamydophila pneumoniae CWL029
uuccucgagcuaccaga

SEQ ID NO: 2528875 - RNA, 20 nt, Chlamydophila pneumoniae CWL029
uuccucuaucagggagcgga

SEQ ID NO: 2528876 - RNA, 17 nt, Chlamydophila pneumoniae CWL029
uuccucucaugaaauuu

SEQ ID NO: 2528877 - RNA, 19 nt, Chlamydophila pneumoniae CWL029
uuccucuucaauuucuuca

SEQ ID NO: 2528878 - RNA, 24 nt, Chlamydophila pneumoniae CWL029
uuccucuucaauuucuucaucaau

SEQ ID NO: 2528879 - RNA, 18 nt, Chlamydophila pneumoniae CWL029
uuccugaagcagcuucug

SEQ ID NO: 2528880 - RNA, 17 nt, Chlamydophila pneumoniae CWL029
uuccugaggcuauagaa

SEQ ID NO: 2528881 - RNA, 14 nt, Chlamydophila pneumoniae CWL029
uuccuggucuccag

SEQ ID NO: 2528882 - RNA, 23 nt, Chlamydophila pneumoniae CWL029
uuccuguuguacuaucacagcca

SEQ ID NO: 2528883 - RNA, 15 nt, Chlamydophila pneumoniae CWL029
uuccuuaagucgucc

SEQ ID NO: 2528884 - RNA, 22 nt, Chlamydophila pneumoniae CWL029
uuccuuacaagcuuccuugguc

SEQ ID NO: 2528885 - RNA, 23 nt, Chlamydophila pneumoniae CWL029
uuccuuaucaggaaaugaagucc

SEQ ID NO: 2528886 - RNA, 16 nt, Chlamydophila pneumoniae CWL029
uuccuucgaagcggag

SEQ ID NO: 2528887 - RNA, 17 nt, Chlamydophila pneumoniae CWL029
uuccuugggaggaggag

SEQ ID NO: 2528888 - RNA, 15 nt, Chlamydophila pneumoniae CWL029
uuccuuggucuuauu

SEQ ID NO: 2528889 - RNA, 18 nt, Chlamydophila pneumoniae CWL029
uuccuuucucagucacaa

SEQ ID NO: 2528890 - RNA, 14 nt, Chlamydophila pneumoniae CWL029
uuccuuuugauaaa

SEQ ID NO: 2528891 - RNA, 17 nt, Chlamydophila pneumoniae CWL029
uuccuuuuucugcuucu

SEQ ID NO: 2528892 - RNA, 22 nt, Chlamydophila pneumoniae CWL029
uuccuuuuucugcuucuccaaa

SEQ ID NO: 2528893 - RNA, 16 nt, Chlamydophila pneumoniae CWL029
uuccuuuuugcauagc

SEQ ID NO: 2528894 - RNA, 16 nt, Chlamydophila pneumoniae CWL029
uucucgaagcuugcug

SEQ ID NO: 2528895 - RNA, 15 nt, Chlamydophila pneumoniae CWL029
uucucgggucuugga

SEQ ID NO: 2528896 - RNA, 13 nt, Chlamydophila pneumoniae CWL029
uucucgguuuaag

SEQ ID NO: 2528897 - RNA, 19 nt, Chlamydophila pneumoniae CWL029
uucucuaggaacucuuuaa

SEQ ID NO: 2528898 - RNA, 21 nt, Chlamydophila pneumoniae CWL029
uucucuaugacuucuuguccu

SEQ ID NO: 2528899 - RNA, 18 nt, Chlamydophila pneumoniae CWL029
uucucuguugggagcuuc

SEQ ID NO: 2528900 - RNA, 23 nt, Chlamydophila pneumoniae CWL029
uucucuuucgaugcuauuuuucc

SEQ ID NO: 2528901 - RNA, 15 nt, Chlamydophila pneumoniae CWL029
uucugaaauugucuu

SEQ ID NO: 2528902 - RNA, 20 nt, Chlamydophila pneumoniae CWL029
uucugaaauuucugaaacaa

SEQ ID NO: 2528903 - RNA, 14 nt, Chlamydophila pneumoniae CWL029
uucugaagauuuuu

SEQ ID NO: 2528904 - RNA, 14 nt, Chlamydophila pneumoniae CWL029
uucugacaauaaca

SEQ ID NO: 2528905 - RNA, 15 nt, Chlamydophila pneumoniae CWL029
uucugauacaucauc

SEQ ID NO: 2528906 - RNA, 22 nt, Chlamydophila pneumoniae CWL029
uucugaugacguuaauaaagag

SEQ ID NO: 2528907 - RNA, 21 nt, Chlamydophila pneumoniae CWL029
uucugauugagaauaaaacuu

SEQ ID NO: 2528908 - RNA, 20 nt, Chlamydophila pneumoniae CWL029
uucugcaaucagugcugcca

SEQ ID NO: 2528909 - RNA, 16 nt, Chlamydophila pneumoniae CWL029
uucugcagcgugaaua

SEQ ID NO: 2528910 - RNA, 21 nt, Chlamydophila pneumoniae CWL029
uucugcaggauuuguagcucc

SEQ ID NO: 2528911 - RNA, 22 nt, Chlamydophila pneumoniae CWL029
uucugcuucuccaaauaaagca

SEQ ID NO: 2528912 - RNA, 14 nt, Chlamydophila pneumoniae CWL029
uucuggagaaaaaa

SEQ ID NO: 2528913 - RNA, 22 nt, Chlamydophila pneumoniae CWL029
uucuggauacguuuuucccuuu

SEQ ID NO: 2528914 - RNA, 15 nt, Chlamydophila pneumoniae CWL029
uucuguaaagauucu

SEQ ID NO: 2528915 - RNA, 21 nt, Chlamydophila pneumoniae CWL029
uucuguaauuuuuuucaaagg

SEQ ID NO: 2528916 - RNA, 22 nt, Chlamydophila pneumoniae CWL029
uucuguagugagauacggagga

SEQ ID NO: 2528917 - RNA, 18 nt, Chlamydophila pneumoniae CWL029
uucuuaauauaaaagaag

SEQ ID NO: 2528918 - RNA, 13 nt, Chlamydophila pneumoniae CWL029
uucuuaauuuccu

SEQ ID NO: 2528919 - RNA, 16 nt, Chlamydophila pneumoniae CWL029
uucuuaauuuccuucu

SEQ ID NO: 2528920 - RNA, 14 nt, Chlamydophila pneumoniae CWL029
uucuuagaagagaa

SEQ ID NO: 2528921 - RNA, 16 nt, Chlamydophila pneumoniae CWL029
uucuuagaagagaaag

SEQ ID NO: 2528922 - RNA, 14 nt, Chlamydophila pneumoniae CWL029
uucuuaguaaagaa

SEQ ID NO: 2528923 - RNA, 20 nt, Chlamydophila pneumoniae CWL029
uucuuaucaaaauaaaaaaa

SEQ ID NO: 2528924 - RNA, 18 nt, Chlamydophila pneumoniae CWL029
uucuuaucacaaauuguc

SEQ ID NO: 2528925 - RNA, 22 nt, Chlamydophila pneumoniae CWL029
uucuuauccuugaaauugcucu

SEQ ID NO: 2528926 - RNA, 11 nt, Chlamydophila pneumoniae CWL029
uucuuaucugc

SEQ ID NO: 2528927 - RNA, 15 nt, Chlamydophila pneumoniae CWL029
uucuuaucuucuaaa

SEQ ID NO: 2528928 - RNA, 17 nt, Chlamydophila pneumoniae CWL029
uucuucaaagcuacuaa

SEQ ID NO: 2528929 - RNA, 12 nt, Chlamydophila pneumoniae CWL029
uucuucaauauc

SEQ ID NO: 2528930 - RNA, 13 nt, Chlamydophila pneumoniae CWL029
uucuucacaaucu

SEQ ID NO: 2528931 - RNA, 20 nt, Chlamydophila pneumoniae CWL029
uucuucacaaucuaaauaag

SEQ ID NO: 2528932 - RNA, 18 nt, Chlamydophila pneumoniae CWL029
uucuucagcacuuuuauu

SEQ ID NO: 2528933 - RNA, 14 nt, Chlamydophila pneumoniae CWL029
uucuucaucaauac

SEQ ID NO: 2528934 - RNA, 18 nt, Chlamydophila pneumoniae CWL029
uucuucaucuucuaaauc

SEQ ID NO: 2528935 - RNA, 23 nt, Chlamydophila pneumoniae CWL029
uucuucauuauuaaacgaauacu

SEQ ID NO: 2528936 - RNA, 23 nt, Chlamydophila pneumoniae CWL029
uucuuccaaagacugagcuucua

SEQ ID NO: 2528937 - RNA, 18 nt, Chlamydophila pneumoniae CWL029
uucuuccaaagcuucuuu

SEQ ID NO: 2528938 - RNA, 14 nt, Chlamydophila pneumoniae CWL029
uucuucccagguaa

SEQ ID NO: 2528939 - RNA, 12 nt, Chlamydophila pneumoniae CWL029
uucuuccuucuu

SEQ ID NO: 2528940 - RNA, 13 nt, Chlamydophila pneumoniae CWL029
uucuucgagagca

SEQ ID NO: 2528941 - RNA, 11 nt, Chlamydophila pneumoniae CWL029
uucuucuaaag

SEQ ID NO: 2528942 - RNA, 22 nt, Chlamydophila pneumoniae CWL029
uucuucuagcucauuaucaaga

SEQ ID NO: 2528943 - RNA, 17 nt, Chlamydophila pneumoniae CWL029
uucuucuauagaaucca

SEQ ID NO: 2528944 - RNA, 15 nt, Chlamydophila pneumoniae CWL029
uucuucucuaagaaa

SEQ ID NO: 2528945 - RNA, 14 nt, Chlamydophila pneumoniae CWL029
uucuucucuaggaa

SEQ ID NO: 2528946 - RNA, 22 nt, Chlamydophila pneumoniae CWL029
uucuucuggauacguuuuuccc

SEQ ID NO: 2528947 - RNA, 15 nt, Chlamydophila pneumoniae CWL029
uucuucuucagagcu

SEQ ID NO: 2528948 - RNA, 12 nt, Chlamydophila pneumoniae CWL029
uucuucuucuaa

SEQ ID NO: 2528949 - RNA, 21 nt, Chlamydophila pneumoniae CWL029
uucuucuuuccauagaucccu

SEQ ID NO: 2528950 - RNA, 14 nt, Chlamydophila pneumoniae CWL029
uucuugaagaucuc

SEQ ID NO: 2528951 - RNA, 14 nt, Chlamydophila pneumoniae CWL029
uucuugacggcagg

SEQ ID NO: 2528952 - RNA, 19 nt, Chlamydophila pneumoniae CWL029
uucuugacuuguuucuccu

SEQ ID NO: 2528953 - RNA, 22 nt, Chlamydophila pneumoniae CWL029
uucuugacuuguuucuccuauu

SEQ ID NO: 2528954 - RNA, 21 nt, Chlamydophila pneumoniae CWL029
uucuugguguauaguauuuuu

SEQ ID NO: 2528955 - RNA, 18 nt, Chlamydophila pneumoniae CWL029
uucuuguaauaaaagaac

SEQ ID NO: 2528956 - RNA, 20 nt, Chlamydophila pneumoniae CWL029
uucuuguaauaaaagaacau

SEQ ID NO: 2528957 - RNA, 14 nt, Chlamydophila pneumoniae CWL029
uucuuguagcuccc

SEQ ID NO: 2528958 - RNA, 20 nt, Chlamydophila pneumoniae CWL029
uucuuuauaaauacaggaga

SEQ ID NO: 2528959 - RNA, 19 nt, Chlamydophila pneumoniae CWL029
uucuuuauccccagaucuc

SEQ ID NO: 2528960 - RNA, 19 nt, Chlamydophila pneumoniae CWL029
uucuuuaucuagcucuuca

SEQ ID NO: 2528961 - RNA, 18 nt, Chlamydophila pneumoniae CWL029
uucuuucggugucucuag

SEQ ID NO: 2528962 - RNA, 17 nt, Chlamydophila pneumoniae CWL029
uucuuucuaggccggga

SEQ ID NO: 2528963 - RNA, 14 nt, Chlamydophila pneumoniae CWL029
uucuuucugcucuu

SEQ ID NO: 2528964 - RNA, 12 nt, Chlamydophila pneumoniae CWL029
uucuuucugcuu

SEQ ID NO: 2528965 - RNA, 12 nt, Chlamydophila pneumoniae CWL029
uucuuucuugcu

SEQ ID NO: 2528966 - RNA, 22 nt, Chlamydophila pneumoniae CWL029
uucuuugaagaacaaaaaauca

SEQ ID NO: 2528967 - RNA, 20 nt, Chlamydophila pneumoniae CWL029
uucuuugccguauagauuuu

SEQ ID NO: 2528968 - RNA, 21 nt, Chlamydophila pneumoniae CWL029
uucuuuuagcuacuucuucuu

SEQ ID NO: 2528969 - RNA, 11 nt, Chlamydophila pneumoniae CWL029
uucuuuuccug

SEQ ID NO: 2528970 - RNA, 12 nt, Chlamydophila pneumoniae CWL029
uucuuuucuaua

SEQ ID NO: 2528971 - RNA, 15 nt, Chlamydophila pneumoniae CWL029
uucuuuucugaagau

SEQ ID NO: 2528972 - RNA, 21 nt, Chlamydophila pneumoniae CWL029
uugaaaagaaagaauaucuuu

SEQ ID NO: 2528973 - RNA, 20 nt, Chlamydophila pneumoniae CWL029
uugaaacuuuuuuucuucuc

SEQ ID NO: 2528974 - RNA, 13 nt, Chlamydophila pneumoniae CWL029
uugaaaucuaccg

SEQ ID NO: 2528975 - RNA, 13 nt, Chlamydophila pneumoniae CWL029
uugaaauugcucu

SEQ ID NO: 2528976 - RNA, 14 nt, Chlamydophila pneumoniae CWL029
uugaacaugaggau

SEQ ID NO: 2528977 - RNA, 19 nt, Chlamydophila pneumoniae CWL029
uugaacguagcuacaaaau

SEQ ID NO: 2528978 - RNA, 15 nt, Chlamydophila pneumoniae CWL029
uugaagaacaaaaaa

SEQ ID NO: 2528979 - RNA, 16 nt, Chlamydophila pneumoniae CWL029
uugaagaacaaaaaau

SEQ ID NO: 2528980 - RNA, 18 nt, Chlamydophila pneumoniae CWL029
uugaagaaguacaaguga

SEQ ID NO: 2528981 - RNA, 16 nt, Chlamydophila pneumoniae CWL029
uugaagagcuugcugu

SEQ ID NO: 2528982 - RNA, 21 nt, Chlamydophila pneumoniae CWL029
uugaagaucuccgaagacuac

SEQ ID NO: 2528983 - RNA, 18 nt, Chlamydophila pneumoniae CWL029
uugaagcuccucacaucu

SEQ ID NO: 2528984 - RNA, 14 nt, Chlamydophila pneumoniae CWL029
uugaaguucucaaa

SEQ ID NO: 2528985 - RNA, 21 nt, Chlamydophila pneumoniae CWL029
uugaaguuuugcucucuagau

SEQ ID NO: 2528986 - RNA, 16 nt, Chlamydophila pneumoniae CWL029
uugaauaaugcauccc

SEQ ID NO: 2528987 - RNA, 24 nt, Chlamydophila pneumoniae CWL029
uugaaucauagagauaucaucaaa

SEQ ID NO: 2528988 - RNA, 16 nt, Chlamydophila pneumoniae CWL029
uugaaucccaucaaag

SEQ ID NO: 2528989 - RNA, 17 nt, Chlamydophila pneumoniae CWL029
uugaaucuauagucugu

SEQ ID NO: 2528990 - RNA, 19 nt, Chlamydophila pneumoniae CWL029
uugaauuaaaaguuccaaa

SEQ ID NO: 2528991 - RNA, 17 nt, Chlamydophila pneumoniae CWL029
uugaauuaauaaaagag

SEQ ID NO: 2528992 - RNA, 14 nt, Chlamydophila pneumoniae CWL029
uuggaaaaccauga

SEQ ID NO: 2528993 - RNA, 14 nt, Chlamydophila pneumoniae CWL029
uuggaaaucagaau

SEQ ID NO: 2528994 - RNA, 15 nt, Chlamydophila pneumoniae CWL029
uuggaaaucagaauc

SEQ ID NO: 2528995 - RNA, 18 nt, Chlamydophila pneumoniae CWL029
uuggacaacgcuucuuuu

SEQ ID NO: 2528996 - RNA, 23 nt, Chlamydophila pneumoniae CWL029
uuggacucuagggucaagaacag

SEQ ID NO: 2528997 - RNA, 22 nt, Chlamydophila pneumoniae CWL029
uuggaggaacaauacucucugc

SEQ ID NO: 2528998 - RNA, 15 nt, Chlamydophila pneumoniae CWL029
uuggauaggauagga

SEQ ID NO: 2528999 - RNA, 14 nt, Chlamydophila pneumoniae CWL029
uuggcaauagcuuu

SEQ ID NO: 2529000 - RNA, 22 nt, Chlamydophila pneumoniae CWL029
uuggcagagcauucgauuugua

SEQ ID NO: 2529001 - RNA, 16 nt, Chlamydophila pneumoniae CWL029
uuggcaguucacugag

SEQ ID NO: 2529002 - RNA, 19 nt, Chlamydophila pneumoniae CWL029
uuggcuauggaaagagucc

SEQ ID NO: 2529003 - RNA, 15 nt, Chlamydophila pneumoniae CWL029
uugggaaaagaaaag

SEQ ID NO: 2529004 - RNA, 13 nt, Chlamydophila pneumoniae CWL029
uugggaggaggag

SEQ ID NO: 2529005 - RNA, 16 nt, Chlamydophila pneumoniae CWL029
uugggauaaaaaguuu

SEQ ID NO: 2529006 - RNA, 17 nt, Chlamydophila pneumoniae CWL029
uugggcaucucucuuua

SEQ ID NO: 2529007 - RNA, 21 nt, Chlamydophila pneumoniae CWL029
uugguagagcaacacauucgu

SEQ ID NO: 2529008 - RNA, 14 nt, Chlamydophila pneumoniae CWL029
uuggugcuuugccu

SEQ ID NO: 2529009 - RNA, 23 nt, Chlamydophila pneumoniae CWL029
uugguucuuggaguuaggaaaau

SEQ ID NO: 2529010 - RNA, 18 nt, Chlamydophila pneumoniae CWL029
uugguugcagucguauuc

SEQ ID NO: 2529011 - RNA, 16 nt, Chlamydophila pneumoniae CWL029
uugguuuucuccuucu

SEQ ID NO: 2529012 - RNA, 14 nt, Chlamydophila pneumoniae CWL029
uuguaaauacaaaa

SEQ ID NO: 2529013 - RNA, 23 nt, Chlamydophila pneumoniae CWL029
uuguaacgcugcuaauguugucu

SEQ ID NO: 2529014 - RNA, 19 nt, Chlamydophila pneumoniae CWL029
uuguaagacuaaaaaagag

SEQ ID NO: 2529015 - RNA, 21 nt, Chlamydophila pneumoniae CWL029
uuguaagcagugugcugauuu

SEQ ID NO: 2529016 - RNA, 14 nt, Chlamydophila pneumoniae CWL029
uuguaauuuccuua

SEQ ID NO: 2529017 - RNA, 13 nt, Chlamydophila pneumoniae CWL029
uuguagaacuucu

SEQ ID NO: 2529018 - RNA, 22 nt, Chlamydophila pneumoniae CWL029
uuguagagagaaucgagaacag

SEQ ID NO: 2529019 - RNA, 23 nt, Chlamydophila pneumoniae CWL029
uuguaggaacaugccaaauaucu

SEQ ID NO: 2529020 - RNA, 23 nt, Chlamydophila pneumoniae CWL029
uuguaguaaggagagacuguguu

SEQ ID NO: 2529021 - RNA, 19 nt, Chlamydophila pneumoniae CWL029
uuguauaagagcaagguaa

SEQ ID NO: 2529022 - RNA, 19 nt, Chlamydophila pneumoniae CWL029
uuguauggcagccuggaaa

SEQ ID NO: 2529023 - RNA, 12 nt, Chlamydophila pneumoniae CWL029
uuguauucagug

SEQ ID NO: 2529024 - RNA, 17 nt, Chlamydophila pneumoniae CWL029
uugucaacaaaagcuau

SEQ ID NO: 2529025 - RNA, 23 nt, Chlamydophila pneumoniae CWL029
uugucagcuuugcuuauuucccc

SEQ ID NO: 2529026 - RNA, 14 nt, Chlamydophila pneumoniae CWL029
uugucccaaucaag

SEQ ID NO: 2529027 - RNA, 12 nt, Chlamydophila pneumoniae CWL029
uugucccuuuca

SEQ ID NO: 2529028 - RNA, 18 nt, Chlamydophila pneumoniae CWL029
uuguccuaggagagcuag

SEQ ID NO: 2529029 - RNA, 21 nt, Chlamydophila pneumoniae CWL029
uuguccuuugcuaagaacuag

SEQ ID NO: 2529030 - RNA, 19 nt, Chlamydophila pneumoniae CWL029
uugucuacagaggaaucua

SEQ ID NO: 2529031 - RNA, 19 nt, Chlamydophila pneumoniae CWL029
uugucucaauugaaucaga

SEQ ID NO: 2529032 - RNA, 20 nt, Chlamydophila pneumoniae CWL029
uugucucgaaacucuuugag

SEQ ID NO: 2529033 - RNA, 22 nt, Chlamydophila pneumoniae CWL029
uugucugaggacaguauucccu

SEQ ID NO: 2529034 - RNA, 15 nt, Chlamydophila pneumoniae CWL029
uugucuuugauuuuc

SEQ ID NO: 2529035 - RNA, 13 nt, Chlamydophila pneumoniae CWL029
uugugagcugcug

SEQ ID NO: 2529036 - RNA, 15 nt, Chlamydophila pneumoniae CWL029
uugugaguucuuccu

SEQ ID NO: 2529037 - RNA, 15 nt, Chlamydophila pneumoniae CWL029
uugugcgucaucaac

SEQ ID NO: 2529038 - RNA, 19 nt, Chlamydophila pneumoniae CWL029
uugugcuaaagcaggagca

SEQ ID NO: 2529039 - RNA, 19 nt, Chlamydophila pneumoniae CWL029
uugugcuagguaguguggu

SEQ ID NO: 2529040 - RNA, 12 nt, Chlamydophila pneumoniae CWL029
uuguggaaguaa

SEQ ID NO: 2529041 - RNA, 16 nt, Chlamydophila pneumoniae CWL029
uuguggcuuuucuaaa

SEQ ID NO: 2529042 - RNA, 22 nt, Chlamydophila pneumoniae CWL029
uuguggcuuuucuaaagcguuu

SEQ ID NO: 2529043 - RNA, 22 nt, Chlamydophila pneumoniae CWL029
uuguguaagacugaaauugaau

SEQ ID NO: 2529044 - RNA, 22 nt, Chlamydophila pneumoniae CWL029
uuguguuuuuggcauaaagacc

SEQ ID NO: 2529045 - RNA, 21 nt, Chlamydophila pneumoniae CWL029
uuguuaaaguaaaaaauacag

SEQ ID NO: 2529046 - RNA, 16 nt, Chlamydophila pneumoniae CWL029
uuguuaaauucccaaa

SEQ ID NO: 2529047 - RNA, 21 nt, Chlamydophila pneumoniae CWL029
uuguuagugagaucaaaaaua

SEQ ID NO: 2529048 - RNA, 13 nt, Chlamydophila pneumoniae CWL029
uuguuaucaggaa

SEQ ID NO: 2529049 - RNA, 20 nt, Chlamydophila pneumoniae CWL029
uuguucagcuagagcacaua

SEQ ID NO: 2529050 - RNA, 22 nt, Chlamydophila pneumoniae CWL029
uuguucuuccaacuucuguauc

SEQ ID NO: 2529051 - RNA, 22 nt, Chlamydophila pneumoniae CWL029
uuguuggcauagcgagaacacc

SEQ ID NO: 2529052 - RNA, 19 nt, Chlamydophila pneumoniae CWL029
uuguugucagcuuugcuua

SEQ ID NO: 2529053 - RNA, 15 nt, Chlamydophila pneumoniae CWL029
uuguuuagaaaaaga

SEQ ID NO: 2529054 - RNA, 13 nt, Chlamydophila pneumoniae CWL029
uuguuucuagaaa

SEQ ID NO: 2529055 - RNA, 16 nt, Chlamydophila pneumoniae CWL029
uuguuugcuauacaga

SEQ ID NO: 2529056 - RNA, 14 nt, Chlamydophila pneumoniae CWL029
uuguuuuaauugua

SEQ ID NO: 2529057 - RNA, 19 nt, Chlamydophila pneumoniae CWL029
uuguuuugcuuuuugaaug

SEQ ID NO: 2529058 - RNA, 16 nt, Chlamydophila pneumoniae CWL029
uuuaaaaaauucuaau

SEQ ID NO: 2529059 - RNA, 21 nt, Chlamydophila pneumoniae CWL029
uuuaaaaacucuuucauaaga

SEQ ID NO: 2529060 - RNA, 16 nt, Chlamydophila pneumoniae CWL029
uuuaaaaauagaaaua

SEQ ID NO: 2529061 - RNA, 21 nt, Chlamydophila pneumoniae CWL029
uuuaaaaauaggagaagcccc

SEQ ID NO: 2529062 - RNA, 12 nt, Chlamydophila pneumoniae CWL029
uuuaaaaauaua

SEQ ID NO: 2529063 - RNA, 22 nt, Chlamydophila pneumoniae CWL029
uuuaaaacuccacgccaaagua

SEQ ID NO: 2529064 - RNA, 21 nt, Chlamydophila pneumoniae CWL029
uuuaaaaguacgaccaacucc

SEQ ID NO: 2529065 - RNA, 12 nt, Chlamydophila pneumoniae CWL029
uuuaaagccucc

SEQ ID NO: 2529066 - RNA, 17 nt, Chlamydophila pneumoniae CWL029
uuuaaaguguguaaaug

SEQ ID NO: 2529067 - RNA, 20 nt, Chlamydophila pneumoniae CWL029
uuuaaaguguguaaauguuu

SEQ ID NO: 2529068 - RNA, 21 nt, Chlamydophila pneumoniae CWL029
uuuaaauaaaaccacuucucu

SEQ ID NO: 2529069 - RNA, 14 nt, Chlamydophila pneumoniae CWL029
uuuaaauagcaucc

SEQ ID NO: 2529070 - RNA, 14 nt, Chlamydophila pneumoniae CWL029
uuuaaaugccuuaa

SEQ ID NO: 2529071 - RNA, 22 nt, Chlamydophila pneumoniae CWL029
uuuaaauucgccaaacgaauuu

SEQ ID NO: 2529072 - RNA, 19 nt, Chlamydophila pneumoniae CWL029
uuuaaauuuuguuuuucca

SEQ ID NO: 2529073 - RNA, 21 nt, Chlamydophila pneumoniae CWL029
uuuaaccgagcuuuuugcuuu

SEQ ID NO: 2529074 - RNA, 17 nt, Chlamydophila pneumoniae CWL029
uuuaaccucuuuucuua

SEQ ID NO: 2529075 - RNA, 16 nt, Chlamydophila pneumoniae CWL029
uuuaacucuagaucuu

SEQ ID NO: 2529076 - RNA, 21 nt, Chlamydophila pneumoniae CWL029
uuuaacucuagaucuucaauc

SEQ ID NO: 2529077 - RNA, 18 nt, Chlamydophila pneumoniae CWL029
uuuaagacaauauaagca

SEQ ID NO: 2529078 - RNA, 12 nt, Chlamydophila pneumoniae CWL029
uuuaagauuuuu

SEQ ID NO: 2529079 - RNA, 20 nt, Chlamydophila pneumoniae CWL029
uuuaagguucucugaacuug

SEQ ID NO: 2529080 - RNA, 18 nt, Chlamydophila pneumoniae CWL029
uuuaagguugcuuuucua

SEQ ID NO: 2529081 - RNA, 20 nt, Chlamydophila pneumoniae CWL029
uuuaagucacuaaagauacu

SEQ ID NO: 2529082 - RNA, 13 nt, Chlamydophila pneumoniae CWL029
uuuaauaaaauuu

SEQ ID NO: 2529083 - RNA, 18 nt, Chlamydophila pneumoniae CWL029
uuuaauaaaauuuaaaaa

SEQ ID NO: 2529084 - RNA, 20 nt, Chlamydophila pneumoniae CWL029
uuuaaucaagccuaaaucua

SEQ ID NO: 2529085 - RNA, 15 nt, Chlamydophila pneumoniae CWL029
uuuaauccaguuuuu

SEQ ID NO: 2529086 - RNA, 15 nt, Chlamydophila pneumoniae CWL029
uuuaaugaucacgug

SEQ ID NO: 2529087 - RNA, 22 nt, Chlamydophila pneumoniae CWL029
uuuaauguuuggccaacagcua

SEQ ID NO: 2529088 - RNA, 15 nt, Chlamydophila pneumoniae CWL029
uuuaauucaaaaaga

SEQ ID NO: 2529089 - RNA, 20 nt, Chlamydophila pneumoniae CWL029
uuucuaagauuccuaacuuc

SEQ ID NO: 2529090 - RNA, 14 nt, Chlamydophila pneumoniae CWL029
uuucuaauguaggg

SEQ ID NO: 2529091 - RNA, 20 nt, Chlamydophila pneumoniae CWL029
uuucuacugaaaccuucucu

SEQ ID NO: 2529092 - RNA, 19 nt, Chlamydophila pneumoniae CWL029
uuucuacuucaggaaauaa

SEQ ID NO: 2529093 - RNA, 22 nt, Chlamydophila pneumoniae CWL029
uuucuagaaugaugcaagcaga

SEQ ID NO: 2529094 - RNA, 22 nt, Chlamydophila pneumoniae CWL029
uuucuagcugcucuuuuagaau

SEQ ID NO: 2529095 - RNA, 22 nt, Chlamydophila pneumoniae CWL029
uuucuaggacagcacauagagu

SEQ ID NO: 2529096 - RNA, 23 nt, Chlamydophila pneumoniae CWL029
uuucuaguucguucaucugucau

SEQ ID NO: 2529097 - RNA, 17 nt, Chlamydophila pneumoniae CWL029
uuucucaauaguguaac

SEQ ID NO: 2529098 - RNA, 15 nt, Chlamydophila pneumoniae CWL029
uuucucauagcuucc

SEQ ID NO: 2529099 - RNA, 16 nt, Chlamydophila pneumoniae CWL029
uuucucauagguaaua

SEQ ID NO: 2529100 - RNA, 15 nt, Chlamydophila pneumoniae CWL029
uuucucuaaaauaug

SEQ ID NO: 2529101 - RNA, 21 nt, Chlamydophila pneumoniae CWL029
uuucucuaagcagccucuucu

SEQ ID NO: 2529102 - RNA, 13 nt, Chlamydophila pneumoniae CWL029
uuucucuccacag

SEQ ID NO: 2529103 - RNA, 22 nt, Chlamydophila pneumoniae CWL029
uuucucuuucgaugcuauuuuu

SEQ ID NO: 2529104 - RNA, 18 nt, Chlamydophila pneumoniae CWL029
uuucugaaucuuuuguuu

SEQ ID NO: 2529105 - RNA, 23 nt, Chlamydophila pneumoniae CWL029
uuucugauugagaauaaaacuuu

SEQ ID NO: 2529106 - RNA, 13 nt, Chlamydophila pneumoniae CWL029
uuucugcucuucu

SEQ ID NO: 2529107 - RNA, 20 nt, Chlamydophila pneumoniae CWL029
uuucuguacaacaaaauuug

SEQ ID NO: 2529108 - RNA, 22 nt, Chlamydophila pneumoniae CWL029
uuucuguacaacaaaauuugca

SEQ ID NO: 2529109 - RNA, 16 nt, Chlamydophila pneumoniae CWL029
uuucuguucugcuucu

SEQ ID NO: 2529110 - RNA, 17 nt, Chlamydophila pneumoniae CWL029
uuucuguugcacuuucc

SEQ ID NO: 2529111 - RNA, 15 nt, Chlamydophila pneumoniae CWL029
uuucuuauaaaaaag

SEQ ID NO: 2529112 - RNA, 24 nt, Chlamydophila pneumoniae CWL029
uuucuuccacacaacucguuucag

SEQ ID NO: 2529113 - RNA, 18 nt, Chlamydophila pneumoniae CWL029
uuucuucucuaagaaauu

SEQ ID NO: 2529114 - RNA, 20 nt, Chlamydophila pneumoniae CWL029
uuucuucucuaggaagauuu

SEQ ID NO: 2529115 - RNA, 12 nt, Chlamydophila pneumoniae CWL029
uuucuucuguuu

SEQ ID NO: 2529116 - RNA, 14 nt, Chlamydophila pneumoniae CWL029
uuucuucuucuaaa

SEQ ID NO: 2529117 - RNA, 11 nt, Chlamydophila pneumoniae CWL029
uuucuucuuuc

SEQ ID NO: 2529118 - RNA, 14 nt, Chlamydophila pneumoniae CWL029
uuucuugaaaaauc

SEQ ID NO: 2529119 - RNA, 17 nt, Chlamydophila pneumoniae CWL029
uuucuugauauuugucu

SEQ ID NO: 2529120 - RNA, 15 nt, Chlamydophila pneumoniae CWL029
uuucuugcaaggagc

SEQ ID NO: 2529121 - RNA, 12 nt, Chlamydophila pneumoniae CWL029
uuucuuguugca

SEQ ID NO: 2529122 - RNA, 22 nt, Chlamydophila pneumoniae CWL029
uuucuuuaaagaauagcaugaa

SEQ ID NO: 2529123 - RNA, 14 nt, Chlamydophila pneumoniae CWL029
uuucuuuauucccu

SEQ ID NO: 2529124 - RNA, 15 nt, Chlamydophila pneumoniae CWL029
uuucuuuauucccuu

SEQ ID NO: 2529125 - RNA, 14 nt, Chlamydophila pneumoniae CWL029
uuucuuuccaucau

SEQ ID NO: 2529126 - RNA, 19 nt, Chlamydophila pneumoniae CWL029
uuucuuuucugaagauuuu

SEQ ID NO: 2529127 - RNA, 13 nt, Chlamydophila pneumoniae CWL029
uuucuuuugcaaa

SEQ ID NO: 2529128 - RNA, 14 nt, Chlamydophila pneumoniae CWL029
uuucuuuuucagcu

SEQ ID NO: 2529129 - RNA, 14 nt, Chlamydophila pneumoniae CWL029
uuugaaaagaaaga

SEQ ID NO: 2529130 - RNA, 23 nt, Chlamydophila pneumoniae CWL029
uuugaaauaauuuucagucuucc

SEQ ID NO: 2529131 - RNA, 21 nt, Chlamydophila pneumoniae CWL029
uuugaauauauugugcauuac

SEQ ID NO: 2529132 - RNA, 23 nt, Chlamydophila pneumoniae CWL029
uuugaauuuccaaaggaaaauaa

SEQ ID NO: 2529133 - RNA, 14 nt, Chlamydophila pneumoniae CWL029
uuugacaaauuuau

SEQ ID NO: 2529134 - RNA, 18 nt, Chlamydophila pneumoniae CWL029
uuugacacccuuuaccuu

SEQ ID NO: 2529135 - RNA, 23 nt, Chlamydophila pneumoniae CWL029
uuugaccagaugauuuuuugaau

SEQ ID NO: 2529136 - RNA, 15 nt, Chlamydophila pneumoniae CWL029
uuugacuugucccaa

SEQ ID NO: 2529137 - RNA, 23 nt, Chlamydophila pneumoniae CWL029
uuugagcaguaauguuaacgaau

SEQ ID NO: 2529138 - RNA, 14 nt, Chlamydophila pneumoniae CWL029
uuugaggauuucuu

SEQ ID NO: 2529139 - RNA, 18 nt, Chlamydophila pneumoniae CWL029
uuugaucuugcucaggag

SEQ ID NO: 2529140 - RNA, 18 nt, Chlamydophila pneumoniae CWL029
uuugaugcuucuuucaaa

SEQ ID NO: 2529141 - RNA, 21 nt, Chlamydophila pneumoniae CWL029
uuugauuauucccaagaacuu

SEQ ID NO: 2529142 - RNA, 13 nt, Chlamydophila pneumoniae CWL029
uuugauucauaaa

SEQ ID NO: 2529143 - RNA, 16 nt, Chlamydophila pneumoniae CWL029
uuugauucauaaagag

SEQ ID NO: 2529144 - RNA, 13 nt, Chlamydophila pneumoniae CWL029
uuugcaaaucuuc

SEQ ID NO: 2529145 - RNA, 13 nt, Chlamydophila pneumoniae CWL029
uuugcaaaugaaa

SEQ ID NO: 2529146 - RNA, 18 nt, Chlamydophila pneumoniae CWL029
uuugcaaaugaaaagaga

SEQ ID NO: 2529147 - RNA, 14 nt, Chlamydophila pneumoniae CWL029
uuugccauuucuau

SEQ ID NO: 2529148 - RNA, 15 nt, Chlamydophila pneumoniae CWL029
uuugccauuucuauc

SEQ ID NO: 2529149 - RNA, 13 nt, Chlamydophila pneumoniae CWL029
uuugccugaaauc

SEQ ID NO: 2529150 - RNA, 14 nt, Chlamydophila pneumoniae CWL029
uuugcgauuucagc

SEQ ID NO: 2529151 - RNA, 17 nt, Chlamydophila pneumoniae CWL029
uuugcuacagcuucuuu

SEQ ID NO: 2529152 - RNA, 21 nt, Chlamydophila pneumoniae CWL029
uuugcuacagcuucuuuucca

SEQ ID NO: 2529153 - RNA, 17 nt, Chlamydophila pneumoniae CWL029
uuugcuagaucuggaga

SEQ ID NO: 2529154 - RNA, 14 nt, Chlamydophila pneumoniae CWL029
uuugcuccuccaaa

SEQ ID NO: 2529155 - RNA, 15 nt, Chlamydophila pneumoniae CWL029
uuugcucucuagauu

SEQ ID NO: 2529156 - RNA, 12 nt, Chlamydophila pneumoniae CWL029
uuugcugaagau

SEQ ID NO: 2529157 - RNA, 16 nt, Chlamydophila pneumoniae CWL029
uuugcugcgaaugucg

SEQ ID NO: 2529158 - RNA, 17 nt, Chlamydophila pneumoniae CWL029
uuugcuggagacaacua

SEQ ID NO: 2529159 - RNA, 18 nt, Chlamydophila pneumoniae CWL029
uuuggaaagcucuuucau

SEQ ID NO: 2529160 - RNA, 14 nt, Chlamydophila pneumoniae CWL029
uuuggagaagcuca

SEQ ID NO: 2529161 - RNA, 22 nt, Chlamydophila pneumoniae CWL029
uuuggauagaagcaugaagcag

SEQ ID NO: 2529162 - RNA, 17 nt, Chlamydophila pneumoniae CWL029
uuugggauaaaaaguuu

SEQ ID NO: 2529163 - RNA, 19 nt, Chlamydophila pneumoniae CWL029
uuugguaucugauugcuaa

SEQ ID NO: 2529164 - RNA, 20 nt, Chlamydophila pneumoniae CWL029
uuuguaaaugucgguuuguu

SEQ ID NO: 2529165 - RNA, 17 nt, Chlamydophila pneumoniae CWL029
uuuguaaucguuucaua

SEQ ID NO: 2529166 - RNA, 13 nt, Chlamydophila pneumoniae CWL029
uuuguagauuagg

SEQ ID NO: 2529167 - RNA, 14 nt, Chlamydophila pneumoniae CWL029
uuuguaguguugaa

SEQ ID NO: 2529168 - RNA, 16 nt, Chlamydophila pneumoniae CWL029
uuugucaucacaucag

SEQ ID NO: 2529169 - RNA, 15 nt, Chlamydophila pneumoniae CWL029
uuuguccuuugcuaa

SEQ ID NO: 2529170 - RNA, 18 nt, Chlamydophila pneumoniae CWL029
uuugucguaauugcugaa

SEQ ID NO: 2529171 - RNA, 18 nt, Chlamydophila pneumoniae CWL029
uuugugaagauaagacca

SEQ ID NO: 2529172 - RNA, 22 nt, Chlamydophila pneumoniae CWL029
uuugugauauucuuggaauaua

SEQ ID NO: 2529173 - RNA, 22 nt, Chlamydophila pneumoniae CWL029
uuugugccccuccgauugcuaa

SEQ ID NO: 2529174 - RNA, 17 nt, Chlamydophila pneumoniae CWL029
uuuguggggauuuucag

SEQ ID NO: 2529175 - RNA, 19 nt, Chlamydophila pneumoniae CWL029
uuuguuaaacccaauucuu

SEQ ID NO: 2529176 - RNA, 18 nt, Chlamydophila pneumoniae CWL029
uuuguuaauagaagauca

SEQ ID NO: 2529177 - RNA, 21 nt, Chlamydophila pneumoniae CWL029
uuuguuucuucugugcaucag

SEQ ID NO: 2529178 - RNA, 16 nt, Chlamydophila pneumoniae CWL029
uuuguuuuuccauuuu

SEQ ID NO: 2529179 - RNA, 16 nt, Chlamydophila pneumoniae CWL029
uuuuaaagcaaaaauu

SEQ ID NO: 2529180 - RNA, 13 nt, Chlamydophila pneumoniae CWL029
uuuuaaauacaga

SEQ ID NO: 2529181 - RNA, 13 nt, Chlamydophila pneumoniae CWL029
uuuuaaccucuuu

SEQ ID NO: 2529182 - RNA, 18 nt, Chlamydophila pneumoniae CWL029
uuuuaagugcuuuuagau

SEQ ID NO: 2529183 - RNA, 17 nt, Chlamydophila pneumoniae CWL029
uuuuaauucaaaaagag

SEQ ID NO: 2529184 - RNA, 22 nt, Chlamydophila pneumoniae CWL029
uuuuaccaauaaggauagcauu

SEQ ID NO: 2529185 - RNA, 15 nt, Chlamydophila pneumoniae CWL029
uuuuaccauugagau

SEQ ID NO: 2529186 - RNA, 14 nt, Chlamydophila pneumoniae CWL029
uuuuacgaauuuca

SEQ ID NO: 2529187 - RNA, 11 nt, Chlamydophila pneumoniae CWL029
uuuuuucuaua

SEQ ID NO: 2529188 - RNA, 11 nt, Chlamydophila pneumoniae CWL029
uuuuuucuauu

SEQ ID NO: 2529189 - RNA, 12 nt, Chlamydophila pneumoniae CWL029
caaauugagaaa

SEQ ID NO: 2529190 - RNA, 14 nt, Chlamydophila pneumoniae CWL029
caaauugagaaaua

SEQ ID NO: 2529191 - RNA, 17 nt, Chlamydophila pneumoniae CWL029
caaauugagaaauauaa

SEQ ID NO: 2529192 - RNA, 19 nt, Chlamydophila pneumoniae CWL029
caaauugagaaauauaacu

SEQ ID NO: 2529193 - RNA, 19 nt, Chlamydophila pneumoniae CWL029
caaauuuaucggcuaaaga

SEQ ID NO: 2529194 - RNA, 18 nt, Chlamydophila pneumoniae CWL029
caaauuuccauaggaucu

SEQ ID NO: 2529195 - RNA, 17 nt, Chlamydophila pneumoniae CWL029
caaauuucuucuggaua

SEQ ID NO: 2529196 - RNA, 17 nt, Chlamydophila pneumoniae CWL029
caacaaaagcuauauag

SEQ ID NO: 2529197 - RNA, 21 nt, Chlamydophila pneumoniae CWL029
caacaaaggcuccaaacgcaa

SEQ ID NO: 2529198 - RNA, 17 nt, Chlamydophila pneumoniae CWL029
caacaacgcucccuaug

SEQ ID NO: 2529199 - RNA, 21 nt, Chlamydophila pneumoniae CWL029
caacaagcugcugagcagcaa

SEQ ID NO: 2529200 - RNA, 15 nt, Chlamydophila pneumoniae CWL029
caacaagggaaagaa

SEQ ID NO: 2529201 - RNA, 17 nt, Chlamydophila pneumoniae CWL029
caacaaucuuucuucua

SEQ ID NO: 2529202 - RNA, 17 nt, Chlamydophila pneumoniae CWL029
caacacccggcuuuucc

SEQ ID NO: 2529203 - RNA, 13 nt, Chlamydophila pneumoniae CWL029
caacaccucccac

SEQ ID NO: 2529204 - RNA, 13 nt, Chlamydophila pneumoniae CWL029
caacacgcacaaa

SEQ ID NO: 2529205 - RNA, 16 nt, Chlamydophila pneumoniae CWL029
caacacgcacaaacua

SEQ ID NO: 2529206 - RNA, 21 nt, Chlamydophila pneumoniae CWL029
caacacgcacaaacuaacaua

SEQ ID NO: 2529207 - RNA, 24 nt, Chlamydophila pneumoniae CWL029
caacacgucacuggggcauaagaa

SEQ ID NO: 2529208 - RNA, 14 nt, Chlamydophila pneumoniae CWL029
caacagaaauguug

SEQ ID NO: 2529209 - RNA, 18 nt, Chlamydophila pneumoniae CWL029
caacagguaagacgagca

SEQ ID NO: 2529210 - RNA, 12 nt, Chlamydophila pneumoniae CWL029
caacauaaagaa

SEQ ID NO: 2529211 - RNA, 19 nt, Chlamydophila pneumoniae CWL029
caacauaacaugagaaaua

SEQ ID NO: 2529212 - RNA, 20 nt, Chlamydophila pneumoniae CWL029
caacauaacaugagaaauac

SEQ ID NO: 2529213 - RNA, 12 nt, Chlamydophila pneumoniae CWL029
caacauccauuc

SEQ ID NO: 2529214 - RNA, 18 nt, Chlamydophila pneumoniae CWL029
caacaugcgcguauaagg

SEQ ID NO: 2529215 - RNA, 12 nt, Chlamydophila pneumoniae CWL029
caacauucguua

SEQ ID NO: 2529216 - RNA, 16 nt, Chlamydophila pneumoniae CWL029
caaccaguugagucaa

SEQ ID NO: 2529217 - RNA, 15 nt, Chlamydophila pneumoniae CWL029
caacccgaauuccuc

SEQ ID NO: 2529218 - RNA, 18 nt, Chlamydophila pneumoniae CWL029
caacccgaauuccucucc

SEQ ID NO: 2529219 - RNA, 19 nt, Chlamydophila pneumoniae CWL029
caacccuauuuaaggacgu

SEQ ID NO: 2529220 - RNA, 15 nt, Chlamydophila pneumoniae CWL029
caaccgccuuuauau

SEQ ID NO: 2529221 - RNA, 20 nt, Chlamydophila pneumoniae CWL029
caaccgccuuuauauaaagg

SEQ ID NO: 2529222 - RNA, 23 nt, Chlamydophila pneumoniae CWL029
caaccuagaaucacauaaaauaa

SEQ ID NO: 2529223 - RNA, 13 nt, Chlamydophila pneumoniae CWL029
caaccucugcaug

SEQ ID NO: 2529224 - RNA, 19 nt, Chlamydophila pneumoniae CWL029
caacgaucgucaguaaaac

SEQ ID NO: 2529225 - RNA, 13 nt, Chlamydophila pneumoniae CWL029
caacgcuucuuuu

SEQ ID NO: 2529226 - RNA, 19 nt, Chlamydophila pneumoniae CWL029
caacgcuucuuuuuggaua

SEQ ID NO: 2529227 - RNA, 13 nt, Chlamydophila pneumoniae CWL029
caacggacauuuu

SEQ ID NO: 2529228 - RNA, 20 nt, Chlamydophila pneumoniae CWL029
caacuaaaccuucaaugauu

SEQ ID NO: 2529229 - RNA, 15 nt, Chlamydophila pneumoniae CWL029
caagguaacauccau

SEQ ID NO: 2529230 - RNA, 21 nt, Chlamydophila pneumoniae CWL029
caagguaacauccauagagaa

SEQ ID NO: 2529231 - RNA, 22 nt, Chlamydophila pneumoniae CWL029
caagguaacauccauagagaac

SEQ ID NO: 2529232 - RNA, 23 nt, Chlamydophila pneumoniae CWL029
caaggucacagcauuuucucuga

SEQ ID NO: 2529233 - RNA, 20 nt, Chlamydophila pneumoniae CWL029
caagguguugauuucgugaa

SEQ ID NO: 2529234 - RNA, 12 nt, Chlamydophila pneumoniae CWL029
caaguaaagaaa

SEQ ID NO: 2529235 - RNA, 18 nt, Chlamydophila pneumoniae CWL029
caaguaaucaugauaaaa

SEQ ID NO: 2529236 - RNA, 19 nt, Chlamydophila pneumoniae CWL029
caaguaaucaugauaaaaa

SEQ ID NO: 2529237 - RNA, 18 nt, Chlamydophila pneumoniae CWL029
caaguaccuucucgucau

SEQ ID NO: 2529238 - RNA, 17 nt, Chlamydophila pneumoniae CWL029
caaguaugguccauaau

SEQ ID NO: 2529239 - RNA, 16 nt, Chlamydophila pneumoniae CWL029
caaguccgugagagga

SEQ ID NO: 2529240 - RNA, 18 nt, Chlamydophila pneumoniae CWL029
caagugcucaguaaauau

SEQ ID NO: 2529241 - RNA, 21 nt, Chlamydophila pneumoniae CWL029
caagugugcggucucauguaa

SEQ ID NO: 2529242 - RNA, 15 nt, Chlamydophila pneumoniae CWL029
caaguguguauugua

SEQ ID NO: 2529243 - RNA, 21 nt, Chlamydophila pneumoniae CWL029
caaguguucgaguucuuuagc

SEQ ID NO: 2529244 - RNA, 20 nt, Chlamydophila pneumoniae CWL029
caaguucaucaaauaaggcu

SEQ ID NO: 2529245 - RNA, 19 nt, Chlamydophila pneumoniae CWL029
caaguucuaccuauauuuc

SEQ ID NO: 2529246 - RNA, 14 nt, Chlamydophila pneumoniae CWL029
caaguugagagaga

SEQ ID NO: 2529247 - RNA, 21 nt, Chlamydophila pneumoniae CWL029
caaguuguugauaauuacaga

SEQ ID NO: 2529248 - RNA, 16 nt, Chlamydophila pneumoniae CWL029
caaguuuuuucaaucc

SEQ ID NO: 2529249 - RNA, 13 nt, Chlamydophila pneumoniae CWL029
caauaaaaaagag

SEQ ID NO: 2529250 - RNA, 22 nt, Chlamydophila pneumoniae CWL029
caauaaaaggguagcgaaugaa

SEQ ID NO: 2529251 - RNA, 23 nt, Chlamydophila pneumoniae CWL029
caauaaaaggguagcgaaugaaa

SEQ ID NO: 2529252 - RNA, 14 nt, Chlamydophila pneumoniae CWL029
caauaaaaugucca

SEQ ID NO: 2529253 - RNA, 19 nt, Chlamydophila pneumoniae CWL029
caauaaacaacgaucguca

SEQ ID NO: 2529254 - RNA, 22 nt, Chlamydophila pneumoniae CWL029
caauaaacgagacugcaaagga

SEQ ID NO: 2529255 - RNA, 18 nt, Chlamydophila pneumoniae CWL029
caauaaaucuauuccccu

SEQ ID NO: 2529256 - RNA, 22 nt, Chlamydophila pneumoniae CWL029
caauaacaaacgccgcucuuga

SEQ ID NO: 2529257 - RNA, 22 nt, Chlamydophila pneumoniae CWL029
caauaacaugcgcagaauaaaa

SEQ ID NO: 2529258 - RNA, 18 nt, Chlamydophila pneumoniae CWL029
caauaaccagaagacucc

SEQ ID NO: 2529259 - RNA, 22 nt, Chlamydophila pneumoniae CWL029
caauaaccaggggcuuuccuuc

SEQ ID NO: 2529260 - RNA, 13 nt, Chlamydophila pneumoniae CWL029
caauaagaaaauc

SEQ ID NO: 2529261 - RNA, 20 nt, Chlamydophila pneumoniae CWL029
caauaagcuugccagcagaa

SEQ ID NO: 2529262 - RNA, 21 nt, Chlamydophila pneumoniae CWL029
caauaagcuugccagcagaag

SEQ ID NO: 2529263 - RNA, 24 nt, Chlamydophila pneumoniae CWL029
caauaauaucgguuccuauaugaa

SEQ ID NO: 2529264 - RNA, 15 nt, Chlamydophila pneumoniae CWL029
caauaauuucaaaga

SEQ ID NO: 2529265 - RNA, 17 nt, Chlamydophila pneumoniae CWL029
caauacagauguaaaug

SEQ ID NO: 2529266 - RNA, 23 nt, Chlamydophila pneumoniae CWL029
caauacagauguaaaugcuccuu

SEQ ID NO: 2529267 - RNA, 14 nt, Chlamydophila pneumoniae CWL029
caauaccagauaaa

SEQ ID NO: 2529268 - RNA, 15 nt, Chlamydophila pneumoniae CWL029
caauaccagauaaag

SEQ ID NO: 2529269 - RNA, 23 nt, Chlamydophila pneumoniae CWL029
caauaccagauaaagcaaagaua

SEQ ID NO: 2529270 - RNA, 16 nt, Chlamydophila pneumoniae CWL029
caauacccuaucuauu

SEQ ID NO: 2529271 - RNA, 22 nt, Chlamydophila pneumoniae CWL029
caauaccuguacgguaaaucca

SEQ ID NO: 2529272 - RNA, 14 nt, Chlamydophila pneumoniae CWL029
caauacgaucuuuu

SEQ ID NO: 2529273 - RNA, 20 nt, Chlamydophila pneumoniae CWL029
caauacgccgggccacuuca

SEQ ID NO: 2529274 - RNA, 18 nt, Chlamydophila pneumoniae CWL029
caauacgcuagcucuuaa

SEQ ID NO: 2529275 - RNA, 19 nt, Chlamydophila pneumoniae CWL029
caauacucuguuuguaguc

SEQ ID NO: 2529276 - RNA, 23 nt, Chlamydophila pneumoniae CWL029
caauacuggagagguaaccagag

SEQ ID NO: 2529277 - RNA, 23 nt, Chlamydophila pneumoniae CWL029
caauacuucaggacgcacauuua

SEQ ID NO: 2529278 - RNA, 18 nt, Chlamydophila pneumoniae CWL029
caauagaagcuuguugag

SEQ ID NO: 2529279 - RNA, 19 nt, Chlamydophila pneumoniae CWL029
caauagcaaagauuucugc

SEQ ID NO: 2529280 - RNA, 19 nt, Chlamydophila pneumoniae CWL029
caauagcaauggcuuuuuu

SEQ ID NO: 2529281 - RNA, 16 nt, Chlamydophila pneumoniae CWL029
caauagccaaagacuc

SEQ ID NO: 2529282 - RNA, 18 nt, Chlamydophila pneumoniae CWL029
caauaggaauuagagaaa

SEQ ID NO: 2529283 - RNA, 21 nt, Chlamydophila pneumoniae CWL029
caauaggccagaauguacaua

SEQ ID NO: 2529284 - RNA, 15 nt, Chlamydophila pneumoniae CWL029
caauaguaaagcauu

SEQ ID NO: 2529285 - RNA, 19 nt, Chlamydophila pneumoniae CWL029
caauaguguaacauugacc

SEQ ID NO: 2529286 - RNA, 20 nt, Chlamydophila pneumoniae CWL029
caauauaaaugcuauuuucc

SEQ ID NO: 2529287 - RNA, 21 nt, Chlamydophila pneumoniae CWL029
caauauaaaugcuauuuuccu

SEQ ID NO: 2529288 - RNA, 20 nt, Chlamydophila pneumoniae CWL029
caauauagaagcugcugcua

SEQ ID NO: 2529289 - RNA, 21 nt, Chlamydophila pneumoniae CWL029
caauauagaagcugcugcuac

SEQ ID NO: 2529290 - RNA, 13 nt, Chlamydophila pneumoniae CWL029
caauauagagaac

SEQ ID NO: 2529291 - RNA, 21 nt, Chlamydophila pneumoniae CWL029
caauauagagaacuccauuca

SEQ ID NO: 2529292 - RNA, 22 nt, Chlamydophila pneumoniae CWL029
caauauagagaacuccauucag

SEQ ID NO: 2529293 - RNA, 16 nt, Chlamydophila pneumoniae CWL029
caauaucuugaauucu

SEQ ID NO: 2529294 - RNA, 22 nt, Chlamydophila pneumoniae CWL029
caauauuaaaccguaggauucu

SEQ ID NO: 2529295 - RNA, 18 nt, Chlamydophila pneumoniae CWL029
caaucaacauucuucugu

SEQ ID NO: 2529296 - RNA, 23 nt, Chlamydophila pneumoniae CWL029
caaucaccguacuucccucauga

SEQ ID NO: 2529297 - RNA, 13 nt, Chlamydophila pneumoniae CWL029
caaucagugcugc

SEQ ID NO: 2529298 - RNA, 16 nt, Chlamydophila pneumoniae CWL029
caauccacgcuccucu

SEQ ID NO: 2529299 - RNA, 17 nt, Chlamydophila pneumoniae CWL029
caauccggcauaaaaaa

SEQ ID NO: 2529300 - RNA, 15 nt, Chlamydophila pneumoniae CWL029
caaucgcaucaaaaa

SEQ ID NO: 2529301 - RNA, 21 nt, Chlamydophila pneumoniae CWL029
caaucuaaaaucacacuaaau

SEQ ID NO: 2529302 - RNA, 14 nt, Chlamydophila pneumoniae CWL029
caaucuaaauaaga

SEQ ID NO: 2529303 - RNA, 22 nt, Chlamydophila pneumoniae CWL029
caaucucaaaaucaaauagauu

SEQ ID NO: 2529304 - RNA, 15 nt, Chlamydophila pneumoniae CWL029
caaucucuagggaua

SEQ ID NO: 2529305 - RNA, 17 nt, Chlamydophila pneumoniae CWL029
caaucucuuucacaaag

SEQ ID NO: 2529306 - RNA, 13 nt, Chlamydophila pneumoniae CWL029
caaucugcugaag

SEQ ID NO: 2529307 - RNA, 16 nt, Chlamydophila pneumoniae CWL029
caaucugcugaaggga

SEQ ID NO: 2529308 - RNA, 18 nt, Chlamydophila pneumoniae CWL029
caaucugguuaagcacca

SEQ ID NO: 2529309 - RNA, 19 nt, Chlamydophila pneumoniae CWL029
caaucuugagcauccaaaa

SEQ ID NO: 2529310 - RNA, 23 nt, Chlamydophila pneumoniae CWL029
caaucuuugaucgcuugugcaug

SEQ ID NO: 2529311 - RNA, 15 nt, Chlamydophila pneumoniae CWL029
caaugaaggccaaga

SEQ ID NO: 2529312 - RNA, 18 nt, Chlamydophila pneumoniae CWL029
caaugagcaucugaguca

SEQ ID NO: 2529313 - RNA, 16 nt, Chlamydophila pneumoniae CWL029
caaugagcucuauuuc

SEQ ID NO: 2529314 - RNA, 14 nt, Chlamydophila pneumoniae CWL029
caaugauaauuuca

SEQ ID NO: 2529315 - RNA, 20 nt, Chlamydophila pneumoniae CWL029
caaugauaauuucauuauag

SEQ ID NO: 2529316 - RNA, 16 nt, Chlamydophila pneumoniae CWL029
caaugauauaaaagcu

SEQ ID NO: 2529317 - RNA, 14 nt, Chlamydophila pneumoniae CWL029
caaugauuucucua

SEQ ID NO: 2529318 - RNA, 22 nt, Chlamydophila pneumoniae CWL029
caaugauuucuuuagcuuuauu

SEQ ID NO: 2529319 - RNA, 19 nt, Chlamydophila pneumoniae CWL029
caaugcaaccuguaaagac

SEQ ID NO: 2529320 - RNA, 15 nt, Chlamydophila pneumoniae CWL029
caaugcaugaaucuc

SEQ ID NO: 2529321 - RNA, 11 nt, Chlamydophila pneumoniae CWL029
caaugcauuug

SEQ ID NO: 2529322 - RNA, 16 nt, Chlamydophila pneumoniae CWL029
caaugcgauaaccacu

SEQ ID NO: 2529323 - RNA, 12 nt, Chlamydophila pneumoniae CWL029
caaugcgauacg

SEQ ID NO: 2529324 - RNA, 15 nt, Chlamydophila pneumoniae CWL029
caauggaaauagaga

SEQ ID NO: 2529325 - RNA, 15 nt, Chlamydophila pneumoniae CWL029
caauggcgauaaaug

SEQ ID NO: 2529326 - RNA, 20 nt, Chlamydophila pneumoniae CWL029
caacuaaacgagcuguccag

SEQ ID NO: 2529327 - RNA, 12 nt, Chlamydophila pneumoniae CWL029
caacuaaacucu

SEQ ID NO: 2529328 - RNA, 16 nt, Chlamydophila pneumoniae CWL029
caacuaaacucuccaa

SEQ ID NO: 2529329 - RNA, 13 nt, Chlamydophila pneumoniae CWL029
caacuaaagcaua

SEQ ID NO: 2529330 - RNA, 23 nt, Chlamydophila pneumoniae CWL029
caacuacauaauaagcaggaaaa

SEQ ID NO: 2529331 - RNA, 17 nt, Chlamydophila pneumoniae CWL029
caacuacuguagaguuu

SEQ ID NO: 2529332 - RNA, 13 nt, Chlamydophila pneumoniae CWL029
caacuccucaaaa

SEQ ID NO: 2529333 - RNA, 15 nt, Chlamydophila pneumoniae CWL029
caacucguuucagca

SEQ ID NO: 2529334 - RNA, 20 nt, Chlamydophila pneumoniae CWL029
caacucuacaagugucugag

SEQ ID NO: 2529335 - RNA, 15 nt, Chlamydophila pneumoniae CWL029
caacucuccauccuc

SEQ ID NO: 2529336 - RNA, 21 nt, Chlamydophila pneumoniae CWL029
caacucucccauguaguaaau

SEQ ID NO: 2529337 - RNA, 15 nt, Chlamydophila pneumoniae CWL029
caacucuucagcagg

SEQ ID NO: 2529338 - RNA, 13 nt, Chlamydophila pneumoniae CWL029
caacucuuuaauu

SEQ ID NO: 2529339 - RNA, 21 nt, Chlamydophila pneumoniae CWL029
caacugaaaaaccauaagaau

SEQ ID NO: 2529340 - RNA, 19 nt, Chlamydophila pneumoniae CWL029
caacugauguuuuauagau

SEQ ID NO: 2529341 - RNA, 13 nt, Chlamydophila pneumoniae CWL029
caacuuccauaug

SEQ ID NO: 2529342 - RNA, 14 nt, Chlamydophila pneumoniae CWL029
caacuucuccaacu

SEQ ID NO: 2529343 - RNA, 14 nt, Chlamydophila pneumoniae CWL029
caacuucuucguua

SEQ ID NO: 2529344 - RNA, 19 nt, Chlamydophila pneumoniae CWL029
caacuuuguuaauagaaga

SEQ ID NO: 2529345 - RNA, 23 nt, Chlamydophila pneumoniae CWL029
caacuuuguuaauagaagaucau

SEQ ID NO: 2529346 - RNA, 21 nt, Chlamydophila pneumoniae CWL029
caacuuuuuuacuaucuccua

SEQ ID NO: 2529347 - RNA, 23 nt, Chlamydophila pneumoniae CWL029
caagaaaaauucuucgagagcau

SEQ ID NO: 2529348 - RNA, 16 nt, Chlamydophila pneumoniae CWL029
caagaaaacaaaguca

SEQ ID NO: 2529349 - RNA, 18 nt, Chlamydophila pneumoniae CWL029
caagaaauauacugccag

SEQ ID NO: 2529350 - RNA, 18 nt, Chlamydophila pneumoniae CWL029
caagaacaguuugcucug

SEQ ID NO: 2529351 - RNA, 14 nt, Chlamydophila pneumoniae CWL029
caagaacauaaccu

SEQ ID NO: 2529352 - RNA, 22 nt, Chlamydophila pneumoniae CWL029
caagaacauaaccucggucucg

SEQ ID NO: 2529353 - RNA, 17 nt, Chlamydophila pneumoniae CWL029
caagaaccuguuuuucu

SEQ ID NO: 2529354 - RNA, 14 nt, Chlamydophila pneumoniae CWL029
caagaacugaagag

SEQ ID NO: 2529355 - RNA, 18 nt, Chlamydophila pneumoniae CWL029
caagaacuugagcacaaa

SEQ ID NO: 2529356 - RNA, 17 nt, Chlamydophila pneumoniae CWL029
caagaagagaaaagaua

SEQ ID NO: 2529357 - RNA, 16 nt, Chlamydophila pneumoniae CWL029
caagaagaucaaagau

SEQ ID NO: 2529358 - RNA, 21 nt, Chlamydophila pneumoniae CWL029
caagaauagcaggaaggaaua

SEQ ID NO: 2529359 - RNA, 18 nt, Chlamydophila pneumoniae CWL029
caagaaucacugcgugau

SEQ ID NO: 2529360 - RNA, 19 nt, Chlamydophila pneumoniae CWL029
caagaauccgaucauaauu

SEQ ID NO: 2529361 - RNA, 17 nt, Chlamydophila pneumoniae CWL029
caagaauuucuucuuuc

SEQ ID NO: 2529362 - RNA, 24 nt, Chlamydophila pneumoniae CWL029
caagaauuucuucuuuccauagau

SEQ ID NO: 2529363 - RNA, 20 nt, Chlamydophila pneumoniae CWL029
caagacaaaaaagggaucuc

SEQ ID NO: 2529364 - RNA, 13 nt, Chlamydophila pneumoniae CWL029
caagacaaaguug

SEQ ID NO: 2529365 - RNA, 16 nt, Chlamydophila pneumoniae CWL029
caagacaauaaaaaag

SEQ ID NO: 2529366 - RNA, 16 nt, Chlamydophila pneumoniae CWL029
caagacgaaagcacau

SEQ ID NO: 2529367 - RNA, 21 nt, Chlamydophila pneumoniae CWL029
caagacgaaagcacauaagau

SEQ ID NO: 2529368 - RNA, 12 nt, Chlamydophila pneumoniae CWL029
caagacgacacu

SEQ ID NO: 2529369 - RNA, 14 nt, Chlamydophila pneumoniae CWL029
caagacgagaacau

SEQ ID NO: 2529370 - RNA, 17 nt, Chlamydophila pneumoniae CWL029
caagacuacgacagaag

SEQ ID NO: 2529371 - RNA, 18 nt, Chlamydophila pneumoniae CWL029
caagacuacgacagaagu

SEQ ID NO: 2529372 - RNA, 12 nt, Chlamydophila pneumoniae CWL029
caagagacaaga

SEQ ID NO: 2529373 - RNA, 16 nt, Chlamydophila pneumoniae CWL029
caagagacaagaaaau

SEQ ID NO: 2529374 - RNA, 18 nt, Chlamydophila pneumoniae CWL029
caagagacaagaaaauau

SEQ ID NO: 2529375 - RNA, 21 nt, Chlamydophila pneumoniae CWL029
caagagacaagaaaauaucac

SEQ ID NO: 2529376 - RNA, 20 nt, Chlamydophila pneumoniae CWL029
caagagcaucacaaacuaaa

SEQ ID NO: 2529377 - RNA, 15 nt, Chlamydophila pneumoniae CWL029
caagagcccuugugc

SEQ ID NO: 2529378 - RNA, 23 nt, Chlamydophila pneumoniae CWL029
caagagcuccgcuagaggaucuu

SEQ ID NO: 2529379 - RNA, 23 nt, Chlamydophila pneumoniae CWL029
caagagcucguaauccuucuuuc

SEQ ID NO: 2529380 - RNA, 17 nt, Chlamydophila pneumoniae CWL029
caagagcucuugagaaa

SEQ ID NO: 2529381 - RNA, 16 nt, Chlamydophila pneumoniae CWL029
caagagcuugucuucc

SEQ ID NO: 2529382 - RNA, 16 nt, Chlamydophila pneumoniae CWL029
caagaguucucuuuga

SEQ ID NO: 2529383 - RNA, 22 nt, Chlamydophila pneumoniae CWL029
caagaguuucgaauucaaugag

SEQ ID NO: 2529384 - RNA, 17 nt, Chlamydophila pneumoniae CWL029
caagauacuacuuacaa

SEQ ID NO: 2529385 - RNA, 22 nt, Chlamydophila pneumoniae CWL029
caagauagugguagcaaucugu

SEQ ID NO: 2529386 - RNA, 14 nt, Chlamydophila pneumoniae CWL029
caagaucaaacgaa

SEQ ID NO: 2529387 - RNA, 16 nt, Chlamydophila pneumoniae CWL029
caagauggcaacaacu

SEQ ID NO: 2529388 - RNA, 15 nt, Chlamydophila pneumoniae CWL029
caagaugucuccaaa

SEQ ID NO: 2529389 - RNA, 14 nt, Chlamydophila pneumoniae CWL029
caagauuaucuuua

SEQ ID NO: 2529390 - RNA, 15 nt, Chlamydophila pneumoniae CWL029
caagauucucacucu

SEQ ID NO: 2529391 - RNA, 23 nt, Chlamydophila pneumoniae CWL029
caagauucucacucuaugagaac

SEQ ID NO: 2529392 - RNA, 22 nt, Chlamydophila pneumoniae CWL029
caagauucucagcuucaucaga

SEQ ID NO: 2529393 - RNA, 15 nt, Chlamydophila pneumoniae CWL029
caagcaaggaaaaaa

SEQ ID NO: 2529394 - RNA, 17 nt, Chlamydophila pneumoniae CWL029
caagcacuuucgcaaaa

SEQ ID NO: 2529395 - RNA, 22 nt, Chlamydophila pneumoniae CWL029
caagcaggugugugguaaaaau

SEQ ID NO: 2529396 - RNA, 23 nt, Chlamydophila pneumoniae CWL029
caagcaggugugugguaaaaaua

SEQ ID NO: 2529397 - RNA, 16 nt, Chlamydophila pneumoniae CWL029
caagcaguaacugcaa

SEQ ID NO: 2529398 - RNA, 23 nt, Chlamydophila pneumoniae CWL029
caagcaguaacugcaaagagaau

SEQ ID NO: 2529399 - RNA, 23 nt, Chlamydophila pneumoniae CWL029
caagcauaguacgauccaucuca

SEQ ID NO: 2529400 - RNA, 14 nt, Chlamydophila pneumoniae CWL029
caagcauccuagaa

SEQ ID NO: 2529401 - RNA, 18 nt, Chlamydophila pneumoniae CWL029
caagcauuguuuguccua

SEQ ID NO: 2529402 - RNA, 14 nt, Chlamydophila pneumoniae CWL029
caagcucaagagca

SEQ ID NO: 2529403 - RNA, 19 nt, Chlamydophila pneumoniae CWL029
caagcucaagagcaugcuu

SEQ ID NO: 2529404 - RNA, 22 nt, Chlamydophila pneumoniae CWL029
caagcucuggauugaaagagcu

SEQ ID NO: 2529405 - RNA, 14 nt, Chlamydophila pneumoniae CWL029
caagcuucaucaaa

SEQ ID NO: 2529406 - RNA, 12 nt, Chlamydophila pneumoniae CWL029
caaggaaaaaaa

SEQ ID NO: 2529407 - RNA, 15 nt, Chlamydophila pneumoniae CWL029
caaggaaaaaaaauc

SEQ ID NO: 2529408 - RNA, 16 nt, Chlamydophila pneumoniae CWL029
caaggaaaaaaaaucu

SEQ ID NO: 2529409 - RNA, 14 nt, Chlamydophila pneumoniae CWL029
caaggaaaaacaaa

SEQ ID NO: 2529410 - RNA, 15 nt, Chlamydophila pneumoniae CWL029
caaggaacauuugag

SEQ ID NO: 2529411 - RNA, 16 nt, Chlamydophila pneumoniae CWL029
caaggaacauuugagc

SEQ ID NO: 2529412 - RNA, 23 nt, Chlamydophila pneumoniae CWL029
caaggaagccugcggcaaguauc

SEQ ID NO: 2529413 - RNA, 18 nt, Chlamydophila pneumoniae CWL029
caaggagcuuuucguaua

SEQ ID NO: 2529414 - RNA, 19 nt, Chlamydophila pneumoniae CWL029
caaggauuaugaauccuug

SEQ ID NO: 2529415 - RNA, 21 nt, Chlamydophila pneumoniae CWL029
caaggcaaaaaguugaggaaa

SEQ ID NO: 2529416 - RNA, 17 nt, Chlamydophila pneumoniae CWL029
caaggccuaaucuugua

SEQ ID NO: 2529417 - RNA, 23 nt, Chlamydophila pneumoniae CWL029
caaggcgaguguagauuauugau

SEQ ID NO: 2529418 - RNA, 17 nt, Chlamydophila pneumoniae CWL029
caaggcgccuaacaacu

SEQ ID NO: 2529419 - RNA, 19 nt, Chlamydophila pneumoniae CWL029
caaggcugcugauccaaaa

SEQ ID NO: 2529420 - RNA, 15 nt, Chlamydophila pneumoniae CWL029
caagggaaagaaacu

SEQ ID NO: 2529421 - RNA, 15 nt, Chlamydophila pneumoniae CWL029
caagggaagagaaaa

SEQ ID NO: 2529422 - RNA, 18 nt, Chlamydophila pneumoniae CWL029
caagggagaggucugcuc

SEQ ID NO: 2529423 - RNA, 20 nt, Chlamydophila pneumoniae CWL029
caaggggcguucuugaaaaa

SEQ ID NO: 2529424 - RNA, 15 nt, Chlamydophila pneumoniae CWL029
cacuguuuugcuucu

SEQ ID NO: 2529425 - RNA, 19 nt, Chlamydophila pneumoniae CWL029
cacuuaaaaaacuuccuaa

SEQ ID NO: 2529426 - RNA, 16 nt, Chlamydophila pneumoniae CWL029
cacuuaacccuauggu

SEQ ID NO: 2529427 - RNA, 17 nt, Chlamydophila pneumoniae CWL029
cacuuacuucaagaaaa

SEQ ID NO: 2529428 - RNA, 16 nt, Chlamydophila pneumoniae CWL029
cacuuaggguucucaa

SEQ ID NO: 2529429 - RNA, 21 nt, Chlamydophila pneumoniae CWL029
cacuuaguccgguuucuucua

SEQ ID NO: 2529430 - RNA, 14 nt, Chlamydophila pneumoniae CWL029
cacuucagcacgaa

SEQ ID NO: 2529431 - RNA, 18 nt, Chlamydophila pneumoniae CWL029
cacuucucuguaucgaua

SEQ ID NO: 2529432 - RNA, 17 nt, Chlamydophila pneumoniae CWL029
cacuucuuuaggagcau

SEQ ID NO: 2529433 - RNA, 18 nt, Chlamydophila pneumoniae CWL029
cacuucuuuuucuucaau

SEQ ID NO: 2529434 - RNA, 19 nt, Chlamydophila pneumoniae CWL029
cacuuguuuuuucuucugu

SEQ ID NO: 2529435 - RNA, 17 nt, Chlamydophila pneumoniae CWL029
cacuuucuuuuuuaauc

SEQ ID NO: 2529436 - RNA, 13 nt, Chlamydophila pneumoniae CWL029
cacuuugaauaau

SEQ ID NO: 2529437 - RNA, 15 nt, Chlamydophila pneumoniae CWL029
cacuuuguuuuucaa

SEQ ID NO: 2529438 - RNA, 21 nt, Chlamydophila pneumoniae CWL029
cacuuuuuucccuccaccaga

SEQ ID NO: 2529439 - RNA, 14 nt, Chlamydophila pneumoniae CWL029
cagaaaaagaacau

SEQ ID NO: 2529440 - RNA, 19 nt, Chlamydophila pneumoniae CWL029
cagaaaauguaaaaaauua

SEQ ID NO: 2529441 - RNA, 18 nt, Chlamydophila pneumoniae CWL029
cagaaacacugaacgcca

SEQ ID NO: 2529442 - RNA, 16 nt, Chlamydophila pneumoniae CWL029
cagaaacuccaaaaua

SEQ ID NO: 2529443 - RNA, 19 nt, Chlamydophila pneumoniae CWL029
cagagaugcuucuaaacaa

SEQ ID NO: 2529444 - RNA, 15 nt, Chlamydophila pneumoniae CWL029
cagagauguggcaga

SEQ ID NO: 2529445 - RNA, 17 nt, Chlamydophila pneumoniae CWL029
cagagauugccaggaga

SEQ ID NO: 2529446 - RNA, 18 nt, Chlamydophila pneumoniae CWL029
cagagauugccaggagag

SEQ ID NO: 2529447 - RNA, 16 nt, Chlamydophila pneumoniae CWL029
cagagcauaggguuuc

SEQ ID NO: 2529448 - RNA, 15 nt, Chlamydophila pneumoniae CWL029
cagagcauucgauuu

SEQ ID NO: 2529449 - RNA, 16 nt, Chlamydophila pneumoniae CWL029
cagagccucacuaacg

SEQ ID NO: 2529450 - RNA, 13 nt, Chlamydophila pneumoniae CWL029
cagagcgccucca

SEQ ID NO: 2529451 - RNA, 16 nt, Chlamydophila pneumoniae CWL029
cagagcgccuccaccu

SEQ ID NO: 2529452 - RNA, 18 nt, Chlamydophila pneumoniae CWL029
cagagcuucuaaaaacuc

SEQ ID NO: 2529453 - RNA, 19 nt, Chlamydophila pneumoniae CWL029
cagagcuucuaaaaacucu

SEQ ID NO: 2529454 - RNA, 15 nt, Chlamydophila pneumoniae CWL029
cagaggaaucuaaga

SEQ ID NO: 2529455 - RNA, 11 nt, Chlamydophila pneumoniae CWL029
cagaggagccu

SEQ ID NO: 2529456 - RNA, 14 nt, Chlamydophila pneumoniae CWL029
cagaggagccucca

SEQ ID NO: 2529457 - RNA, 18 nt, Chlamydophila pneumoniae CWL029
cagaggagccuccauaau

SEQ ID NO: 2529458 - RNA, 20 nt, Chlamydophila pneumoniae CWL029
cagaggucgauuugaacaug

SEQ ID NO: 2529459 - RNA, 15 nt, Chlamydophila pneumoniae CWL029
cagaguccuucuuuu

SEQ ID NO: 2529460 - RNA, 18 nt, Chlamydophila pneumoniae CWL029
cagaguccuucuuuuccg

SEQ ID NO: 2529461 - RNA, 22 nt, Chlamydophila pneumoniae CWL029
cagagucuauaucuacagcuau

SEQ ID NO: 2529462 - RNA, 13 nt, Chlamydophila pneumoniae CWL029
cagagucugggau

SEQ ID NO: 2529463 - RNA, 17 nt, Chlamydophila pneumoniae CWL029
cagaguggucauugccu

SEQ ID NO: 2529464 - RNA, 15 nt, Chlamydophila pneumoniae CWL029
cagaguuuaaagcuu

SEQ ID NO: 2529465 - RNA, 17 nt, Chlamydophila pneumoniae CWL029
cagaguuuuaaacugcu

SEQ ID NO: 2529466 - RNA, 14 nt, Chlamydophila pneumoniae CWL029
cagauaaaaagaag

SEQ ID NO: 2529467 - RNA, 21 nt, Chlamydophila pneumoniae CWL029
cagauaaaaagaaguaaucgu

SEQ ID NO: 2529468 - RNA, 22 nt, Chlamydophila pneumoniae CWL029
cagauaaagcaaagauaaagaa

SEQ ID NO: 2529469 - RNA, 18 nt, Chlamydophila pneumoniae CWL029
cagauaccaucaccuucg

SEQ ID NO: 2529470 - RNA, 20 nt, Chlamydophila pneumoniae CWL029
cagauacuaaacuccauugu

SEQ ID NO: 2529471 - RNA, 16 nt, Chlamydophila pneumoniae CWL029
cagauacuucuuccac

SEQ ID NO: 2529472 - RNA, 15 nt, Chlamydophila pneumoniae CWL029
cagauagcuuacaga

SEQ ID NO: 2529473 - RNA, 19 nt, Chlamydophila pneumoniae CWL029
cagauaucaaagcauugca

SEQ ID NO: 2529474 - RNA, 19 nt, Chlamydophila pneumoniae CWL029
cagaucaaugccuugcguu

SEQ ID NO: 2529475 - RNA, 20 nt, Chlamydophila pneumoniae CWL029
cagaucauaucggcagcagc

SEQ ID NO: 2529476 - RNA, 16 nt, Chlamydophila pneumoniae CWL029
cagauccugcuucuau

SEQ ID NO: 2529477 - RNA, 22 nt, Chlamydophila pneumoniae CWL029
cagaucguaaucuguauaugcu

SEQ ID NO: 2529478 - RNA, 13 nt, Chlamydophila pneumoniae CWL029
cagaucucuuuag

SEQ ID NO: 2529479 - RNA, 16 nt, Chlamydophila pneumoniae CWL029
cagaucugcauaauuu

SEQ ID NO: 2529480 - RNA, 20 nt, Chlamydophila pneumoniae CWL029
cagaucugcauaauuuuucu

SEQ ID NO: 2529481 - RNA, 17 nt, Chlamydophila pneumoniae CWL029
cagaucuuuuaugcgag

SEQ ID NO: 2529482 - RNA, 14 nt, Chlamydophila pneumoniae CWL029
cagaugcuucaagg

SEQ ID NO: 2529483 - RNA, 19 nt, Chlamydophila pneumoniae CWL029
cagaugcuucaaggcaucu

SEQ ID NO: 2529484 - RNA, 16 nt, Chlamydophila pneumoniae CWL029
cagauggucagucucg

SEQ ID NO: 2529485 - RNA, 15 nt, Chlamydophila pneumoniae CWL029
cagauguaaaugcuc

SEQ ID NO: 2529486 - RNA, 17 nt, Chlamydophila pneumoniae CWL029
cagauguaaucuugauc

SEQ ID NO: 2529487 - RNA, 16 nt, Chlamydophila pneumoniae CWL029
cagauguuuucguaaa

SEQ ID NO: 2529488 - RNA, 22 nt, Chlamydophila pneumoniae CWL029
cagauguuuucguaaauaugaa

SEQ ID NO: 2529489 - RNA, 20 nt, Chlamydophila pneumoniae CWL029
cagauuagaaaagauaaaac

SEQ ID NO: 2529490 - RNA, 23 nt, Chlamydophila pneumoniae CWL029
cagauuagaaaagauaaaacauu

SEQ ID NO: 2529491 - RNA, 18 nt, Chlamydophila pneumoniae CWL029
cagauuagaguuagaugu

SEQ ID NO: 2529492 - RNA, 16 nt, Chlamydophila pneumoniae CWL029
cagauucugaagagag

SEQ ID NO: 2529493 - RNA, 17 nt, Chlamydophila pneumoniae CWL029
cagcaaagaaguuauaa

SEQ ID NO: 2529494 - RNA, 18 nt, Chlamydophila pneumoniae CWL029
cagcaaagacauccaagc

SEQ ID NO: 2529495 - RNA, 23 nt, Chlamydophila pneumoniae CWL029
cagcaaagcgaccugcaaaugaa

SEQ ID NO: 2529496 - RNA, 15 nt, Chlamydophila pneumoniae CWL029
cagcaacaaccaaaa

SEQ ID NO: 2529497 - RNA, 17 nt, Chlamydophila pneumoniae CWL029
cagcaaccuuuccuaaa

SEQ ID NO: 2529498 - RNA, 23 nt, Chlamydophila pneumoniae CWL029
cagcaagaacauaaccucggucu

SEQ ID NO: 2529499 - RNA, 19 nt, Chlamydophila pneumoniae CWL029
cagcaaucacaucaguucc

SEQ ID NO: 2529500 - RNA, 20 nt, Chlamydophila pneumoniae CWL029
cagcaaucacaucaguucca

SEQ ID NO: 2529501 - RNA, 23 nt, Chlamydophila pneumoniae CWL029
cagcacaagaaccuguuuuucua

SEQ ID NO: 2529502 - RNA, 17 nt, Chlamydophila pneumoniae CWL029
cagcacaggcauggucu

SEQ ID NO: 2529503 - RNA, 20 nt, Chlamydophila pneumoniae CWL029
cagcaccuuuaggaagcugu

SEQ ID NO: 2529504 - RNA, 21 nt, Chlamydophila pneumoniae CWL029
cagcaccuuuaggaagcugua

SEQ ID NO: 2529505 - RNA, 18 nt, Chlamydophila pneumoniae CWL029
cagcacgaauaaagcccu

SEQ ID NO: 2529506 - RNA, 14 nt, Chlamydophila pneumoniae CWL029
cagcacucuuuuuc

SEQ ID NO: 2529507 - RNA, 15 nt, Chlamydophila pneumoniae CWL029
cagcagaaucauaau

SEQ ID NO: 2529508 - RNA, 14 nt, Chlamydophila pneumoniae CWL029
cagcagaugaaacu

SEQ ID NO: 2529509 - RNA, 14 nt, Chlamydophila pneumoniae CWL029
cagcagcauuuucu

SEQ ID NO: 2529510 - RNA, 16 nt, Chlamydophila pneumoniae CWL029
cagcagcguccccccc

SEQ ID NO: 2529511 - RNA, 22 nt, Chlamydophila pneumoniae CWL029
cagcagcugucaauccaacaaa

SEQ ID NO: 2529512 - RNA, 15 nt, Chlamydophila pneumoniae CWL029
cagcauaaaaauucu

SEQ ID NO: 2529513 - RNA, 18 nt, Chlamydophila pneumoniae CWL029
cagcauaaaaauucucau

SEQ ID NO: 2529514 - RNA, 18 nt, Chlamydophila pneumoniae CWL029
cagcaucaggauucucuc

SEQ ID NO: 2529515 - RNA, 20 nt, Chlamydophila pneumoniae CWL029
cagcauuaagauaaacagca

SEQ ID NO: 2529516 - RNA, 22 nt, Chlamydophila pneumoniae CWL029
cagcauuaagauaaacagcaca

SEQ ID NO: 2529517 - RNA, 16 nt, Chlamydophila pneumoniae CWL029
cagcauucacuaaaua

SEQ ID NO: 2529518 - RNA, 16 nt, Chlamydophila pneumoniae CWL029
cagcauuuucuaaagu

SEQ ID NO: 2529519 - RNA, 14 nt, Chlamydophila pneumoniae CWL029
cagcauuuucucug

SEQ ID NO: 2529520 - RNA, 21 nt, Chlamydophila pneumoniae CWL029
cagcauuuucucugagcagcu

SEQ ID NO: 2529521 - RNA, 13 nt, Chlamydophila pneumoniae CWL029
cagccagcagaag

SEQ ID NO: 2529522 - RNA, 12 nt, Chlamydophila pneumoniae CWL029
cagcccugccuc

SEQ ID NO: 2529523 - RNA, 13 nt, Chlamydophila pneumoniae CWL029
cagccggagcuuc

SEQ ID NO: 2529524 - RNA, 15 nt, Chlamydophila pneumoniae CWL029
cagccucuucucuac

SEQ ID NO: 2529525 - RNA, 15 nt, Chlamydophila pneumoniae CWL029
cagccugcaccagac

SEQ ID NO: 2529526 - RNA, 13 nt, Chlamydophila pneumoniae CWL029
cagccugucuaua

SEQ ID NO: 2529527 - RNA, 22 nt, Chlamydophila pneumoniae CWL029
cagccugugagcucucgacgaa

SEQ ID NO: 2529528 - RNA, 20 nt, Chlamydophila pneumoniae CWL029
cagccuugauugaacagucu

SEQ ID NO: 2529529 - RNA, 21 nt, Chlamydophila pneumoniae CWL029
cagccuuggcucuagaaauau

SEQ ID NO: 2529530 - RNA, 24 nt, Chlamydophila pneumoniae CWL029
cagcgacaacacgcccacggaaag

SEQ ID NO: 2529531 - RNA, 17 nt, Chlamydophila pneumoniae CWL029
cagcgaggaguuuucca

SEQ ID NO: 2529532 - RNA, 16 nt, Chlamydophila pneumoniae CWL029
cagcgcugugaggaaa

SEQ ID NO: 2529533 - RNA, 12 nt, Chlamydophila pneumoniae CWL029
cagcggcacccu

SEQ ID NO: 2529534 - RNA, 18 nt, Chlamydophila pneumoniae CWL029
cagcguagguuugcugcu

SEQ ID NO: 2529535 - RNA, 13 nt, Chlamydophila pneumoniae CWL029
cagcguauaggaa

SEQ ID NO: 2529536 - RNA, 22 nt, Chlamydophila pneumoniae CWL029
cagcgugaauaucaucacuaag

SEQ ID NO: 2529537 - RNA, 16 nt, Chlamydophila pneumoniae CWL029
cagcguugcuaagcau

SEQ ID NO: 2529538 - RNA, 14 nt, Chlamydophila pneumoniae CWL029
cagcguuucuaggg

SEQ ID NO: 2529539 - RNA, 20 nt, Chlamydophila pneumoniae CWL029
cagcuaaucaauccaagaau

SEQ ID NO: 2529540 - RNA, 15 nt, Chlamydophila pneumoniae CWL029
cauuccagcaucuuc

SEQ ID NO: 2529541 - RNA, 17 nt, Chlamydophila pneumoniae CWL029
cauuccagcaucuucuc

SEQ ID NO: 2529542 - RNA, 14 nt, Chlamydophila pneumoniae CWL029
cauuccgagcugca

SEQ ID NO: 2529543 - RNA, 17 nt, Chlamydophila pneumoniae CWL029
cauuccgagcugcaaac

SEQ ID NO: 2529544 - RNA, 15 nt, Chlamydophila pneumoniae CWL029
cauucucacagcaug

SEQ ID NO: 2529545 - RNA, 23 nt, Chlamydophila pneumoniae CWL029
cauucuccgccagaguuuaaagc

SEQ ID NO: 2529546 - RNA, 17 nt, Chlamydophila pneumoniae CWL029
cauucuugaagaucucc

SEQ ID NO: 2529547 - RNA, 22 nt, Chlamydophila pneumoniae CWL029
cauugaagagcuugcuguacga

SEQ ID NO: 2529548 - RNA, 18 nt, Chlamydophila pneumoniae CWL029
cauugaauccuucuauag

SEQ ID NO: 2529549 - RNA, 18 nt, Chlamydophila pneumoniae CWL029
cauugacuugggauucuu

SEQ ID NO: 2529550 - RNA, 14 nt, Chlamydophila pneumoniae CWL029
cauugaucagaauc

SEQ ID NO: 2529551 - RNA, 17 nt, Chlamydophila pneumoniae CWL029
cauugaugcuuaagagu

SEQ ID NO: 2529552 - RNA, 18 nt, Chlamydophila pneumoniae CWL029
cauugccauaauaaaggu

SEQ ID NO: 2529553 - RNA, 14 nt, Chlamydophila pneumoniae CWL029
cauugccuugcugc

SEQ ID NO: 2529554 - RNA, 16 nt, Chlamydophila pneumoniae CWL029
cauugcuauugaaaaa

SEQ ID NO: 2529555 - RNA, 15 nt, Chlamydophila pneumoniae CWL029
cauuggcuccuaagg

SEQ ID NO: 2529556 - RNA, 20 nt, Chlamydophila pneumoniae CWL029
cauuguggaacgcauaagag

SEQ ID NO: 2529557 - RNA, 13 nt, Chlamydophila pneumoniae CWL029
cauuguuuaaguc

SEQ ID NO: 2529558 - RNA, 23 nt, Chlamydophila pneumoniae CWL029
cauuguuuaaguccuucuuccca

SEQ ID NO: 2529559 - RNA, 22 nt, Chlamydophila pneumoniae CWL029
cauuguuuguccuaggagagcu

SEQ ID NO: 2529560 - RNA, 18 nt, Chlamydophila pneumoniae CWL029
cauuuaaacuaagaauac

SEQ ID NO: 2529561 - RNA, 14 nt, Chlamydophila pneumoniae CWL029
cauuuaaagcugaa

SEQ ID NO: 2529562 - RNA, 16 nt, Chlamydophila pneumoniae CWL029
cauuuagacaagacac

SEQ ID NO: 2529563 - RNA, 18 nt, Chlamydophila pneumoniae CWL029
cauuucgauaacacuucu

SEQ ID NO: 2529564 - RNA, 23 nt, Chlamydophila pneumoniae CWL029
cauuucgauaacacuucuuucuu

SEQ ID NO: 2529565 - RNA, 13 nt, Chlamydophila pneumoniae CWL029
cauuucguuuuuu

SEQ ID NO: 2529566 - RNA, 21 nt, Chlamydophila pneumoniae CWL029
cauuucguuuuuucuuaucug

SEQ ID NO: 2529567 - RNA, 22 nt, Chlamydophila pneumoniae CWL029
cauuucuucuuagaaacacagu

SEQ ID NO: 2529568 - RNA, 14 nt, Chlamydophila pneumoniae CWL029
cauuugcuauuuuc

SEQ ID NO: 2529569 - RNA, 17 nt, Chlamydophila pneumoniae CWL029
cauuuuauccacugcgc

SEQ ID NO: 2529570 - RNA, 20 nt, Chlamydophila pneumoniae CWL029
cauuuuaugaucucuucaug

SEQ ID NO: 2529571 - RNA, 20 nt, Chlamydophila pneumoniae CWL029
cauuuucaggcugaaccaaa

SEQ ID NO: 2529572 - RNA, 21 nt, Chlamydophila pneumoniae CWL029
cauuuucuucuugcaaucuuu

SEQ ID NO: 2529573 - RNA, 15 nt, Chlamydophila pneumoniae CWL029
cauuuucuuuuaaga

SEQ ID NO: 2529574 - RNA, 13 nt, Chlamydophila pneumoniae CWL029
cauuuugguaucu

SEQ ID NO: 2529575 - RNA, 14 nt, Chlamydophila pneumoniae CWL029
cauuuugguaucug

SEQ ID NO: 2529576 - RNA, 12 nt, Chlamydophila pneumoniae CWL029
cauuuuuaggau

SEQ ID NO: 2529577 - RNA, 13 nt, Chlamydophila pneumoniae CWL029
cauuuuuccuccu

SEQ ID NO: 2529578 - RNA, 15 nt, Chlamydophila pneumoniae CWL029
ccaaaaauucccaua

SEQ ID NO: 2529579 - RNA, 20 nt, Chlamydophila pneumoniae CWL029
ccaaaagaauuaagaagaag

SEQ ID NO: 2529580 - RNA, 23 nt, Chlamydophila pneumoniae CWL029
ccaaaagaauuaagaagaagcug

SEQ ID NO: 2529581 - RNA, 23 nt, Chlamydophila pneumoniae CWL029
ccaaaagaauuccuaaaacgagc

SEQ ID NO: 2529582 - RNA, 13 nt, Chlamydophila pneumoniae CWL029
ccaaaagaccaaa

SEQ ID NO: 2529583 - RNA, 17 nt, Chlamydophila pneumoniae CWL029
ccaaaaggcacaacaau

SEQ ID NO: 2529584 - RNA, 15 nt, Chlamydophila pneumoniae CWL029
ccaaaauaaaaggag

SEQ ID NO: 2529585 - RNA, 16 nt, Chlamydophila pneumoniae CWL029
ccaaaauaaaaggagc

SEQ ID NO: 2529586 - RNA, 12 nt, Chlamydophila pneumoniae CWL029
ccaaaauaaucu

SEQ ID NO: 2529587 - RNA, 16 nt, Chlamydophila pneumoniae CWL029
ccaaaaugucuuuuuc

SEQ ID NO: 2529588 - RNA, 16 nt, Chlamydophila pneumoniae CWL029
ccaaaccaugaggcug

SEQ ID NO: 2529589 - RNA, 22 nt, Chlamydophila pneumoniae CWL029
ccaaacccugggcucacucuaa

SEQ ID NO: 2529590 - RNA, 19 nt, Chlamydophila pneumoniae CWL029
ccaaaccucuuagcuauca

SEQ ID NO: 2529591 - RNA, 20 nt, Chlamydophila pneumoniae CWL029
ccaaacggcugauucuccca

SEQ ID NO: 2529592 - RNA, 19 nt, Chlamydophila pneumoniae CWL029
ccaaacuuggucauuauag

SEQ ID NO: 2529593 - RNA, 11 nt, Chlamydophila pneumoniae CWL029
ccaaagaacag

SEQ ID NO: 2529594 - RNA, 14 nt, Chlamydophila pneumoniae CWL029
ccaaagaacagcac

SEQ ID NO: 2529595 - RNA, 21 nt, Chlamydophila pneumoniae CWL029
ccaaagaacagcacucucugc

SEQ ID NO: 2529596 - RNA, 17 nt, Chlamydophila pneumoniae CWL029
ccaaagcagauccugcu

SEQ ID NO: 2529597 - RNA, 19 nt, Chlamydophila pneumoniae CWL029
ccaaagcaguguauaacgu

SEQ ID NO: 2529598 - RNA, 16 nt, Chlamydophila pneumoniae CWL029
ccaaagcauauacugu

SEQ ID NO: 2529599 - RNA, 17 nt, Chlamydophila pneumoniae CWL029
ccaaagcuauuucucua

SEQ ID NO: 2529600 - RNA, 20 nt, Chlamydophila pneumoniae CWL029
ccaaagcuauuucucuauca

SEQ ID NO: 2529601 - RNA, 15 nt, Chlamydophila pneumoniae CWL029
ccaaaggaaaauaau

SEQ ID NO: 2529602 - RNA, 18 nt, Chlamydophila pneumoniae CWL029
ccaaagucacucaaaccc

SEQ ID NO: 2529603 - RNA, 21 nt, Chlamydophila pneumoniae CWL029
ccaaagucacucaaacccucu

SEQ ID NO: 2529604 - RNA, 17 nt, Chlamydophila pneumoniae CWL029
ccaaagugacuuccucc

SEQ ID NO: 2529605 - RNA, 14 nt, Chlamydophila pneumoniae CWL029
ccaaaguuuguagc

SEQ ID NO: 2529606 - RNA, 12 nt, Chlamydophila pneumoniae CWL029
ccaaauccuccg

SEQ ID NO: 2529607 - RNA, 15 nt, Chlamydophila pneumoniae CWL029
ccaaauccuccgccu

SEQ ID NO: 2529608 - RNA, 16 nt, Chlamydophila pneumoniae CWL029
ccaaauguucucucca

SEQ ID NO: 2529609 - RNA, 16 nt, Chlamydophila pneumoniae CWL029
ccaaauuccuucauac

SEQ ID NO: 2529610 - RNA, 17 nt, Chlamydophila pneumoniae CWL029
ccaacaagggaaagaaa

SEQ ID NO: 2529611 - RNA, 19 nt, Chlamydophila pneumoniae CWL029
ccaacaucagcuguugcgu

SEQ ID NO: 2529612 - RNA, 13 nt, Chlamydophila pneumoniae CWL029
ccaacccuauuua

SEQ ID NO: 2529613 - RNA, 14 nt, Chlamydophila pneumoniae CWL029
ccaacuaaaacagc

SEQ ID NO: 2529614 - RNA, 11 nt, Chlamydophila pneumoniae CWL029
ccaacuagaau

SEQ ID NO: 2529615 - RNA, 22 nt, Chlamydophila pneumoniae CWL029
ccaacucccgcuagaucaaaac

SEQ ID NO: 2529616 - RNA, 13 nt, Chlamydophila pneumoniae CWL029
ccaacuccucaaa

SEQ ID NO: 2529617 - RNA, 12 nt, Chlamydophila pneumoniae CWL029
ccaacugagcua

SEQ ID NO: 2529618 - RNA, 15 nt, Chlamydophila pneumoniae CWL029
ccaacugagcuauuu

SEQ ID NO: 2529619 - RNA, 14 nt, Chlamydophila pneumoniae CWL029
ccaacuuccuauaa

SEQ ID NO: 2529620 - RNA, 18 nt, Chlamydophila pneumoniae CWL029
ccaacuuuugaagauccu

SEQ ID NO: 2529621 - RNA, 22 nt, Chlamydophila pneumoniae CWL029
ccaacuuuugaagauccugagu

SEQ ID NO: 2529622 - RNA, 21 nt, Chlamydophila pneumoniae CWL029
ccaagaaugaaucgaagaaca

SEQ ID NO: 2529623 - RNA, 22 nt, Chlamydophila pneumoniae CWL029
ccaagacaauggaaauagagaa

SEQ ID NO: 2529624 - RNA, 21 nt, Chlamydophila pneumoniae CWL029
ccaagacgcggaacucucuuc

SEQ ID NO: 2529625 - RNA, 14 nt, Chlamydophila pneumoniae CWL029
ccaagcaagaagug

SEQ ID NO: 2529626 - RNA, 15 nt, Chlamydophila pneumoniae CWL029
ccaaggaaaaacaaa

SEQ ID NO: 2529627 - RNA, 17 nt, Chlamydophila pneumoniae CWL029
ccaaggaaauuauggag

SEQ ID NO: 2529628 - RNA, 19 nt, Chlamydophila pneumoniae CWL029
ccaagggagaggucugcuc

SEQ ID NO: 2529629 - RNA, 22 nt, Chlamydophila pneumoniae CWL029
ccaagggagggacgacaaggag

SEQ ID NO: 2529630 - RNA, 19 nt, Chlamydophila pneumoniae CWL029
ccaagucagccaagacaaa

SEQ ID NO: 2529631 - RNA, 22 nt, Chlamydophila pneumoniae CWL029
ccaaguguugccagcccauguc

SEQ ID NO: 2529632 - RNA, 20 nt, Chlamydophila pneumoniae CWL029
ccaauaaccgaaacuucuca

SEQ ID NO: 2529633 - RNA, 22 nt, Chlamydophila pneumoniae CWL029
ccaauaaccgaaacuucucaga

SEQ ID NO: 2529634 - RNA, 18 nt, Chlamydophila pneumoniae CWL029
ccaauacagcauaaaaau

SEQ ID NO: 2529635 - RNA, 15 nt, Chlamydophila pneumoniae CWL029
ccaauauagaagcug

SEQ ID NO: 2529636 - RNA, 20 nt, Chlamydophila pneumoniae CWL029
ccaauauagaagcugcugcu

SEQ ID NO: 2529637 - RNA, 21 nt, Chlamydophila pneumoniae CWL029
ccaauaugcucugccauuucu

SEQ ID NO: 2529638 - RNA, 22 nt, Chlamydophila pneumoniae CWL029
ccaauccauucugagaaagaag

SEQ ID NO: 2529639 - RNA, 20 nt, Chlamydophila pneumoniae CWL029
ccaaucugagcacauuuuuc

SEQ ID NO: 2529640 - RNA, 13 nt, Chlamydophila pneumoniae CWL029
ccaaucuuccuua

SEQ ID NO: 2529641 - RNA, 12 nt, Chlamydophila pneumoniae CWL029
ccaaucuuucau

SEQ ID NO: 2529642 - RNA, 21 nt, Chlamydophila pneumoniae CWL029
ccaaugcaugaaucucuucug

SEQ ID NO: 2529643 - RNA, 23 nt, Chlamydophila pneumoniae CWL029
ccaaugggaauuugauuuuucaa

SEQ ID NO: 2529644 - RNA, 20 nt, Chlamydophila pneumoniae CWL029
ccaauugcagucacuacugu

SEQ ID NO: 2529645 - RNA, 23 nt, Chlamydophila pneumoniae CWL029
ccaauuguaucuguauccuuccu

SEQ ID NO: 2529646 - RNA, 17 nt, Chlamydophila pneumoniae CWL029
ccacaaaccucuaaaaa

SEQ ID NO: 2529647 - RNA, 14 nt, Chlamydophila pneumoniae CWL029
ccacaagcuuuucg

SEQ ID NO: 2529648 - RNA, 23 nt, Chlamydophila pneumoniae CWL029
ccacaaguuauccuuaucuugcu

SEQ ID NO: 2529649 - RNA, 14 nt, Chlamydophila pneumoniae CWL029
ccacaauuccuaaa

SEQ ID NO: 2529650 - RNA, 15 nt, Chlamydophila pneumoniae CWL029
ccacacaacucguuu

SEQ ID NO: 2529651 - RNA, 16 nt, Chlamydophila pneumoniae CWL029
ccacagacugcaggaa

SEQ ID NO: 2529652 - RNA, 17 nt, Chlamydophila pneumoniae CWL029
ccacagacugcaggaaa

SEQ ID NO: 2529653 - RNA, 21 nt, Chlamydophila pneumoniae CWL029
ccacagagaccuucucuucag

SEQ ID NO: 2529654 - RNA, 21 nt, Chlamydophila pneumoniae CWL029
ccacagcccucuacgcucuua

SEQ ID NO: 2529655 - RNA, 22 nt, Chlamydophila pneumoniae CWL029
ccacaucaaagcaauuucuccu

SEQ ID NO: 2529656 - RNA, 23 nt, Chlamydophila pneumoniae CWL029
ccacaucuugagcuucaaaaagc

SEQ ID NO: 2529657 - RNA, 16 nt, Chlamydophila pneumoniae CWL029
ccacaugcccaaacau

SEQ ID NO: 2529658 - RNA, 20 nt, Chlamydophila pneumoniae CWL029
ccacauugcgggcucaaaga

SEQ ID NO: 2529659 - RNA, 19 nt, Chlamydophila pneumoniae CWL029
ccaccaaagugacuuccuc

SEQ ID NO: 2529660 - RNA, 22 nt, Chlamydophila pneumoniae CWL029
ccaccaaagugacuuccuccaa

SEQ ID NO: 2529661 - RNA, 21 nt, Chlamydophila pneumoniae CWL029
ccaccuuggcuucuaucuuua

SEQ ID NO: 2529662 - RNA, 22 nt, Chlamydophila pneumoniae CWL029
ccacgaguucgcggaucuucuu

SEQ ID NO: 2529663 - RNA, 16 nt, Chlamydophila pneumoniae CWL029
ccacggauuuucucua

SEQ ID NO: 2529664 - RNA, 20 nt, Chlamydophila pneumoniae CWL029
ccacggauuuucucuacaca

SEQ ID NO: 2529665 - RNA, 21 nt, Chlamydophila pneumoniae CWL029
ccacgggucaggagguggugg

SEQ ID NO: 2529666 - RNA, 13 nt, Chlamydophila pneumoniae CWL029
ccacuacugagcu

SEQ ID NO: 2529667 - RNA, 18 nt, Chlamydophila pneumoniae CWL029
ccacucaaaagaagaguu

SEQ ID NO: 2529668 - RNA, 22 nt, Chlamydophila pneumoniae CWL029
ccacuccagaaaguauuccucu

SEQ ID NO: 2529669 - RNA, 15 nt, Chlamydophila pneumoniae CWL029
ccacugaccugauac

SEQ ID NO: 2529670 - RNA, 12 nt, Chlamydophila pneumoniae CWL029
ccacugcuuuag

SEQ ID NO: 2529671 - RNA, 15 nt, Chlamydophila pneumoniae CWL029
ccacuggacuucguu

SEQ ID NO: 2529672 - RNA, 15 nt, Chlamydophila pneumoniae CWL029
ccacuugcauggauc

SEQ ID NO: 2529673 - RNA, 22 nt, Chlamydophila pneumoniae CWL029
ccacuuuuaauuucuuacaaga

SEQ ID NO: 2529674 - RNA, 16 nt, Chlamydophila pneumoniae CWL029
ccacuuuuuucccucc

SEQ ID NO: 2529675 - RNA, 23 nt, Chlamydophila pneumoniae CWL029
ccagaaagauucugcccaaagcu

SEQ ID NO: 2529676 - RNA, 14 nt, Chlamydophila pneumoniae CWL029
ccagaaauuacugu

SEQ ID NO: 2529677 - RNA, 21 nt, Chlamydophila pneumoniae CWL029
ccagaacaccaucacauccug

SEQ ID NO: 2529678 - RNA, 22 nt, Chlamydophila pneumoniae CWL029
ccagaagcaacuaaacucucca

SEQ ID NO: 2529679 - RNA, 16 nt, Chlamydophila pneumoniae CWL029
ccagaagcaugaauga

SEQ ID NO: 2529680 - RNA, 20 nt, Chlamydophila pneumoniae CWL029
ccagaagguguggguacagg

SEQ ID NO: 2529681 - RNA, 22 nt, Chlamydophila pneumoniae CWL029
ccagaagucgcaguaaugccaa

SEQ ID NO: 2529682 - RNA, 19 nt, Chlamydophila pneumoniae CWL029
ccagaauauagacuuguau

SEQ ID NO: 2529683 - RNA, 18 nt, Chlamydophila pneumoniae CWL029
ccagagacaaagccacag

SEQ ID NO: 2529684 - RNA, 14 nt, Chlamydophila pneumoniae CWL029
ccagagagcuuuua

SEQ ID NO: 2529685 - RNA, 23 nt, Chlamydophila pneumoniae CWL029
ccagagagcuuuuagguagagaa

SEQ ID NO: 2529686 - RNA, 18 nt, Chlamydophila pneumoniae CWL029
ccagauaaagcaaagaua

SEQ ID NO: 2529687 - RNA, 18 nt, Chlamydophila pneumoniae CWL029
ccagaugauuuuuugaau

SEQ ID NO: 2529688 - RNA, 13 nt, Chlamydophila pneumoniae CWL029
ccagaugccuuga

SEQ ID NO: 2529689 - RNA, 18 nt, Chlamydophila pneumoniae CWL029
ccagauucugaagagaga

SEQ ID NO: 2529690 - RNA, 19 nt, Chlamydophila pneumoniae CWL029
ccagauuguucaaaaauag

SEQ ID NO: 2529691 - RNA, 22 nt, Chlamydophila pneumoniae CWL029
ccagauuuuuuugguugcuucu

SEQ ID NO: 2529692 - RNA, 20 nt, Chlamydophila pneumoniae CWL029
ccagcaccuuuaggaagcug

SEQ ID NO: 2529693 - RNA, 12 nt, Chlamydophila pneumoniae CWL029
cuggcuuaggag

SEQ ID NO: 2529694 - RNA, 15 nt, Chlamydophila pneumoniae CWL029
cugggaaaucuaaac

SEQ ID NO: 2529695 - RNA, 23 nt, Chlamydophila pneumoniae CWL029
cugggaagaccacgaaauguuaa

SEQ ID NO: 2529696 - RNA, 12 nt, Chlamydophila pneumoniae CWL029
cugggaagacuc

SEQ ID NO: 2529697 - RNA, 14 nt, Chlamydophila pneumoniae CWL029
cugggaauucuuuu

SEQ ID NO: 2529698 - RNA, 21 nt, Chlamydophila pneumoniae CWL029
cugggaauuguucuugaaguu

SEQ ID NO: 2529699 - RNA, 19 nt, Chlamydophila pneumoniae CWL029
cugggauguucaaagccau

SEQ ID NO: 2529700 - RNA, 23 nt, Chlamydophila pneumoniae CWL029
cugggcauaguggcucaguguau

SEQ ID NO: 2529701 - RNA, 15 nt, Chlamydophila pneumoniae CWL029
cugggcgucuucuuc

SEQ ID NO: 2529702 - RNA, 16 nt, Chlamydophila pneumoniae CWL029
cuggggcuuccagaaa

SEQ ID NO: 2529703 - RNA, 22 nt, Chlamydophila pneumoniae CWL029
cugggggacuucaaaugaaauu

SEQ ID NO: 2529704 - RNA, 23 nt, Chlamydophila pneumoniae CWL029
cugggugcgucguaaucuuuuuu

SEQ ID NO: 2529705 - RNA, 16 nt, Chlamydophila pneumoniae CWL029
cuggucucaugaccuu

SEQ ID NO: 2529706 - RNA, 18 nt, Chlamydophila pneumoniae CWL029
cuggucuguauuuucuuc

SEQ ID NO: 2529707 - RNA, 16 nt, Chlamydophila pneumoniae CWL029
cugguuccuuaaagag

SEQ ID NO: 2529708 - RNA, 18 nt, Chlamydophila pneumoniae CWL029
cugguuuuucuccugacu

SEQ ID NO: 2529709 - RNA, 16 nt, Chlamydophila pneumoniae CWL029
cuguaaauuucauuug

SEQ ID NO: 2529710 - RNA, 20 nt, Chlamydophila pneumoniae CWL029
cuguaacacccucccucaua

SEQ ID NO: 2529711 - RNA, 21 nt, Chlamydophila pneumoniae CWL029
cuguaacacccucccucauaa

SEQ ID NO: 2529712 - RNA, 19 nt, Chlamydophila pneumoniae CWL029
cuguaaccaacaucaaaga

SEQ ID NO: 2529713 - RNA, 18 nt, Chlamydophila pneumoniae CWL029
cuguaacuugcauuuuuu

SEQ ID NO: 2529714 - RNA, 12 nt, Chlamydophila pneumoniae CWL029
cuguaagaaaau

SEQ ID NO: 2529715 - RNA, 17 nt, Chlamydophila pneumoniae CWL029
cuguaagaauccuugcu

SEQ ID NO: 2529716 - RNA, 21 nt, Chlamydophila pneumoniae CWL029
cuguaauuuuuuucaaaggag

SEQ ID NO: 2529717 - RNA, 13 nt, Chlamydophila pneumoniae CWL029
cuguacagaacaa

SEQ ID NO: 2529718 - RNA, 21 nt, Chlamydophila pneumoniae CWL029
cuguaccacauacucuucauc

SEQ ID NO: 2529719 - RNA, 13 nt, Chlamydophila pneumoniae CWL029
cuguacgguaaau

SEQ ID NO: 2529720 - RNA, 17 nt, Chlamydophila pneumoniae CWL029
cuguagaaacauuuaag

SEQ ID NO: 2529721 - RNA, 22 nt, Chlamydophila pneumoniae CWL029
cuguagaaacauuuaagucauu

SEQ ID NO: 2529722 - RNA, 20 nt, Chlamydophila pneumoniae CWL029
cuguagauuuucccuaagag

SEQ ID NO: 2529723 - RNA, 22 nt, Chlamydophila pneumoniae CWL029
cuguagccccggucgucuuaga

SEQ ID NO: 2529724 - RNA, 14 nt, Chlamydophila pneumoniae CWL029
cuguagccuuugau

SEQ ID NO: 2529725 - RNA, 20 nt, Chlamydophila pneumoniae CWL029
cuguagggaaagacucaucu

SEQ ID NO: 2529726 - RNA, 21 nt, Chlamydophila pneumoniae CWL029
cuguagguuuuuccaacuuca

SEQ ID NO: 2529727 - RNA, 18 nt, Chlamydophila pneumoniae CWL029
cuguaguaaaauaagaaa

SEQ ID NO: 2529728 - RNA, 16 nt, Chlamydophila pneumoniae CWL029
cuguagugauacuuua

SEQ ID NO: 2529729 - RNA, 20 nt, Chlamydophila pneumoniae CWL029
cuguaguuagcauugcuugc

SEQ ID NO: 2529730 - RNA, 17 nt, Chlamydophila pneumoniae CWL029
cuguauagaaacuguua

SEQ ID NO: 2529731 - RNA, 18 nt, Chlamydophila pneumoniae CWL029
cuguauagaaacuguuaa

SEQ ID NO: 2529732 - RNA, 16 nt, Chlamydophila pneumoniae CWL029
cuguaucgacuguaca

SEQ ID NO: 2529733 - RNA, 18 nt, Chlamydophila pneumoniae CWL029
cuguaucgauaguuuuug

SEQ ID NO: 2529734 - RNA, 22 nt, Chlamydophila pneumoniae CWL029
cuguauuaaagaaucuaacucu

SEQ ID NO: 2529735 - RNA, 23 nt, Chlamydophila pneumoniae CWL029
cuguauuuuauagcguugauucc

SEQ ID NO: 2529736 - RNA, 15 nt, Chlamydophila pneumoniae CWL029
cuguauuuucagcac

SEQ ID NO: 2529737 - RNA, 19 nt, Chlamydophila pneumoniae CWL029
cugucaauccaacaaagau

SEQ ID NO: 2529738 - RNA, 16 nt, Chlamydophila pneumoniae CWL029
cugucacuaucuucua

SEQ ID NO: 2529739 - RNA, 12 nt, Chlamydophila pneumoniae CWL029
cugucagaacaa

SEQ ID NO: 2529740 - RNA, 15 nt, Chlamydophila pneumoniae CWL029
cuguccuccgagaaa

SEQ ID NO: 2529741 - RNA, 19 nt, Chlamydophila pneumoniae CWL029
cugucguccuaauuuuccu

SEQ ID NO: 2529742 - RNA, 18 nt, Chlamydophila pneumoniae CWL029
cugucuagaacacucaga

SEQ ID NO: 2529743 - RNA, 23 nt, Chlamydophila pneumoniae CWL029
cugucuauaagauagcucuugcg

SEQ ID NO: 2529744 - RNA, 17 nt, Chlamydophila pneumoniae CWL029
cugucuuaucuaaagaa

SEQ ID NO: 2529745 - RNA, 16 nt, Chlamydophila pneumoniae CWL029
cugugaaaauuuucuu

SEQ ID NO: 2529746 - RNA, 23 nt, Chlamydophila pneumoniae CWL029
cugugagcucucgacgaacaugc

SEQ ID NO: 2529747 - RNA, 21 nt, Chlamydophila pneumoniae CWL029
cugugauagguagcagcccgc

SEQ ID NO: 2529748 - RNA, 13 nt, Chlamydophila pneumoniae CWL029
cugugauaguaga

SEQ ID NO: 2529749 - RNA, 22 nt, Chlamydophila pneumoniae CWL029
cugugauuuccugacuauaaaa

SEQ ID NO: 2529750 - RNA, 15 nt, Chlamydophila pneumoniae CWL029
cugugcaucagucag

SEQ ID NO: 2529751 - RNA, 23 nt, Chlamydophila pneumoniae CWL029
cugugcaucagucagacucacau

SEQ ID NO: 2529752 - RNA, 18 nt, Chlamydophila pneumoniae CWL029
cugugcauuuucuucuug

SEQ ID NO: 2529753 - RNA, 20 nt, Chlamydophila pneumoniae CWL029
cugugcauuuucuucuugca

SEQ ID NO: 2529754 - RNA, 14 nt, Chlamydophila pneumoniae CWL029
cuguggaauuuucc

SEQ ID NO: 2529755 - RNA, 14 nt, Chlamydophila pneumoniae CWL029
cuguggcaauagcg

SEQ ID NO: 2529756 - RNA, 19 nt, Chlamydophila pneumoniae CWL029
cuguggcauacucuuugca

SEQ ID NO: 2529757 - RNA, 22 nt, Chlamydophila pneumoniae CWL029
cuguggcauacucuuugcagug

SEQ ID NO: 2529758 - RNA, 23 nt, Chlamydophila pneumoniae CWL029
cuguggcguaagcaauaucuaua

SEQ ID NO: 2529759 - RNA, 14 nt, Chlamydophila pneumoniae CWL029
cugugguauacauc

SEQ ID NO: 2529760 - RNA, 14 nt, Chlamydophila pneumoniae CWL029
cugugguuccugga

SEQ ID NO: 2529761 - RNA, 15 nt, Chlamydophila pneumoniae CWL029
cugugguuuuuauuc

SEQ ID NO: 2529762 - RNA, 13 nt, Chlamydophila pneumoniae CWL029
cuguguaugaauc

SEQ ID NO: 2529763 - RNA, 16 nt, Chlamydophila pneumoniae CWL029
cuguguuuuauccacc

SEQ ID NO: 2529764 - RNA, 15 nt, Chlamydophila pneumoniae CWL029
cuguguuuucuaguc

SEQ ID NO: 2529765 - RNA, 13 nt, Chlamydophila pneumoniae CWL029
cuguguuuuuagg

SEQ ID NO: 2529766 - RNA, 14 nt, Chlamydophila pneumoniae CWL029
cuguuaacaagauu

SEQ ID NO: 2529767 - RNA, 17 nt, Chlamydophila pneumoniae CWL029
cuguucauaauccaaga

SEQ ID NO: 2529768 - RNA, 16 nt, Chlamydophila pneumoniae CWL029
cuguuccaagagucuu

SEQ ID NO: 2529769 - RNA, 17 nt, Chlamydophila pneumoniae CWL029
cuguucccacuaagaau

SEQ ID NO: 2529770 - RNA, 16 nt, Chlamydophila pneumoniae CWL029
cuguucuagcaaaucu

SEQ ID NO: 2529771 - RNA, 16 nt, Chlamydophila pneumoniae CWL029
cuguucuucuucaguc

SEQ ID NO: 2529772 - RNA, 17 nt, Chlamydophila pneumoniae CWL029
cuguugcauuagauacg

SEQ ID NO: 2529773 - RNA, 19 nt, Chlamydophila pneumoniae CWL029
cuguugggagcuuccucca

SEQ ID NO: 2529774 - RNA, 20 nt, Chlamydophila pneumoniae CWL029
cuguugggagcuuccuccaa

SEQ ID NO: 2529775 - RNA, 17 nt, Chlamydophila pneumoniae CWL029
cuguuggucucuauuua

SEQ ID NO: 2529776 - RNA, 18 nt, Chlamydophila pneumoniae CWL029
cuguuguaauaaaagaaa

SEQ ID NO: 2529777 - RNA, 19 nt, Chlamydophila pneumoniae CWL029
cuguuuauggauuaucuua

SEQ ID NO: 2529778 - RNA, 18 nt, Chlamydophila pneumoniae CWL029
cuguuuucacauggccaa

SEQ ID NO: 2529779 - RNA, 14 nt, Chlamydophila pneumoniae CWL029
cuguuuuggaaaga

SEQ ID NO: 2529780 - RNA, 17 nt, Chlamydophila pneumoniae CWL029
cuguuuuucguaagcug

SEQ ID NO: 2529781 - RNA, 22 nt, Chlamydophila pneumoniae CWL029
cuguuuuuugaaaacuucaaaa

SEQ ID NO: 2529782 - RNA, 16 nt, Chlamydophila pneumoniae CWL029
cuuaaaaaacuuccua

SEQ ID NO: 2529783 - RNA, 17 nt, Chlamydophila pneumoniae CWL029
cuuaaaaaacuuccuaa

SEQ ID NO: 2529784 - RNA, 14 nt, Chlamydophila pneumoniae CWL029
cuuaaaauuccuga

SEQ ID NO: 2529785 - RNA, 15 nt, Chlamydophila pneumoniae CWL029
cuuaaaauucuguaa

SEQ ID NO: 2529786 - RNA, 16 nt, Chlamydophila pneumoniae CWL029
cuuaaagcuugagaaa

SEQ ID NO: 2529787 - RNA, 23 nt, Chlamydophila pneumoniae CWL029
cuuaaagcuugagaaaagguaac

SEQ ID NO: 2529788 - RNA, 23 nt, Chlamydophila pneumoniae CWL029
cuuaaagguaaaacuacaggaaa

SEQ ID NO: 2529789 - RNA, 23 nt, Chlamydophila pneumoniae CWL029
cuuaaagguaaagcuucuuucuc

SEQ ID NO: 2529790 - RNA, 12 nt, Chlamydophila pneumoniae CWL029
cuuaaauccuaa

SEQ ID NO: 2529791 - RNA, 17 nt, Chlamydophila pneumoniae CWL029
caaugucgucucagaaa

SEQ ID NO: 2529792 - RNA, 20 nt, Chlamydophila pneumoniae CWL029
caauguuaaucuaauuuuag

SEQ ID NO: 2529793 - RNA, 16 nt, Chlamydophila pneumoniae CWL029
caauuaaaaaauuauc

SEQ ID NO: 2529794 - RNA, 18 nt, Chlamydophila pneumoniae CWL029
caauuagagauucauaaa

SEQ ID NO: 2529795 - RNA, 21 nt, Chlamydophila pneumoniae CWL029
caauuaugcccaaggaaaaac

SEQ ID NO: 2529796 - RNA, 23 nt, Chlamydophila pneumoniae CWL029
caauuaugcccaaggaaaaacaa

SEQ ID NO: 2529797 - RNA, 20 nt, Chlamydophila pneumoniae CWL029
caauuccauagguuagaaau

SEQ ID NO: 2529798 - RNA, 22 nt, Chlamydophila pneumoniae CWL029
caauuccguacgcuauaaauaa

SEQ ID NO: 2529799 - RNA, 17 nt, Chlamydophila pneumoniae CWL029
caauuccuaaaacaaga

SEQ ID NO: 2529800 - RNA, 18 nt, Chlamydophila pneumoniae CWL029
caauuccuaaaacaagaa

SEQ ID NO: 2529801 - RNA, 20 nt, Chlamydophila pneumoniae CWL029
caauuccuaaaacaagaaga

SEQ ID NO: 2529802 - RNA, 21 nt, Chlamydophila pneumoniae CWL029
caauuccuuucuccagcauuu

SEQ ID NO: 2529803 - RNA, 17 nt, Chlamydophila pneumoniae CWL029
caauucgagauauggaa

SEQ ID NO: 2529804 - RNA, 17 nt, Chlamydophila pneumoniae CWL029
caauucgcucagaaaau

SEQ ID NO: 2529805 - RNA, 15 nt, Chlamydophila pneumoniae CWL029
caauucucucucugc

SEQ ID NO: 2529806 - RNA, 18 nt, Chlamydophila pneumoniae CWL029
caauucuguaucgauagu

SEQ ID NO: 2529807 - RNA, 21 nt, Chlamydophila pneumoniae CWL029
caauucuuaaaaagcuaaaca

SEQ ID NO: 2529808 - RNA, 13 nt, Chlamydophila pneumoniae CWL029
caauugaaaauuc

SEQ ID NO: 2529809 - RNA, 15 nt, Chlamydophila pneumoniae CWL029
caauugaaucagauu

SEQ ID NO: 2529810 - RNA, 20 nt, Chlamydophila pneumoniae CWL029
caauugcucguauuagaguu

SEQ ID NO: 2529811 - RNA, 20 nt, Chlamydophila pneumoniae CWL029
caauugguggagcucauuua

SEQ ID NO: 2529812 - RNA, 15 nt, Chlamydophila pneumoniae CWL029
caauuguaaauacaa

SEQ ID NO: 2529813 - RNA, 13 nt, Chlamydophila pneumoniae CWL029
caauuugcguugc

SEQ ID NO: 2529814 - RNA, 23 nt, Chlamydophila pneumoniae CWL029
caauuuguauauccacgaucuag

SEQ ID NO: 2529815 - RNA, 14 nt, Chlamydophila pneumoniae CWL029
caauuuuaaaaucu

SEQ ID NO: 2529816 - RNA, 18 nt, Chlamydophila pneumoniae CWL029
caauuuuaccacuuccag

SEQ ID NO: 2529817 - RNA, 23 nt, Chlamydophila pneumoniae CWL029
caauuuucuucagcacuuuuauu

SEQ ID NO: 2529818 - RNA, 17 nt, Chlamydophila pneumoniae CWL029
caauuuuuauaauauuu

SEQ ID NO: 2529819 - RNA, 18 nt, Chlamydophila pneumoniae CWL029
caauuuuuauaauauuuu

SEQ ID NO: 2529820 - RNA, 17 nt, Chlamydophila pneumoniae CWL029
caauuuuuguagacaau

SEQ ID NO: 2529821 - RNA, 21 nt, Chlamydophila pneumoniae CWL029
cacaaaaagcuuuuuucucuu

SEQ ID NO: 2529822 - RNA, 12 nt, Chlamydophila pneumoniae CWL029
cacaaaauaaaa

SEQ ID NO: 2529823 - RNA, 12 nt, Chlamydophila pneumoniae CWL029
cacaaaauuugu

SEQ ID NO: 2529824 - RNA, 19 nt, Chlamydophila pneumoniae CWL029
cacaaacaacagaaauguu

SEQ ID NO: 2529825 - RNA, 17 nt, Chlamydophila pneumoniae CWL029
cacaaaccucuaaaaac

SEQ ID NO: 2529826 - RNA, 19 nt, Chlamydophila pneumoniae CWL029
cacaaagaauucagagaaa

SEQ ID NO: 2529827 - RNA, 14 nt, Chlamydophila pneumoniae CWL029
cacaaauucaccaa

SEQ ID NO: 2529828 - RNA, 14 nt, Chlamydophila pneumoniae CWL029
cacaacucuuuaau

SEQ ID NO: 2529829 - RNA, 15 nt, Chlamydophila pneumoniae CWL029
cacaacucuuuaauu

SEQ ID NO: 2529830 - RNA, 21 nt, Chlamydophila pneumoniae CWL029
cacaagggauucuuguuggau

SEQ ID NO: 2529831 - RNA, 20 nt, Chlamydophila pneumoniae CWL029
cacaauaccaucucuuucua

SEQ ID NO: 2529832 - RNA, 13 nt, Chlamydophila pneumoniae CWL029
cacaaucgcauca

SEQ ID NO: 2529833 - RNA, 22 nt, Chlamydophila pneumoniae CWL029
cacaaucgugauugcugucaga

SEQ ID NO: 2529834 - RNA, 16 nt, Chlamydophila pneumoniae CWL029
cacaaucuaaauaaga

SEQ ID NO: 2529835 - RNA, 17 nt, Chlamydophila pneumoniae CWL029
cacaauuguaaauacaa

SEQ ID NO: 2529836 - RNA, 18 nt, Chlamydophila pneumoniae CWL029
cacaauuguaaauacaaa

SEQ ID NO: 2529837 - RNA, 19 nt, Chlamydophila pneumoniae CWL029
cacacgaucuucggaauac

SEQ ID NO: 2529838 - RNA, 22 nt, Chlamydophila pneumoniae CWL029
cacacugcuuacaauugaaaau

SEQ ID NO: 2529839 - RNA, 19 nt, Chlamydophila pneumoniae CWL029
cacacuuaaagguaaaacu

SEQ ID NO: 2529840 - RNA, 13 nt, Chlamydophila pneumoniae CWL029
cacacuuucuuua

SEQ ID NO: 2529841 - RNA, 14 nt, Chlamydophila pneumoniae CWL029
cacacuuucuuuaa

SEQ ID NO: 2529842 - RNA, 16 nt, Chlamydophila pneumoniae CWL029
cacagaaugauaagaa

SEQ ID NO: 2529843 - RNA, 20 nt, Chlamydophila pneumoniae CWL029
cacagaaugauaagaaagcu

SEQ ID NO: 2529844 - RNA, 15 nt, Chlamydophila pneumoniae CWL029
cacagacuugaggaa

SEQ ID NO: 2529845 - RNA, 10 nt, Chlamydophila pneumoniae CWL029
cacagagaac

SEQ ID NO: 2529846 - RNA, 23 nt, Chlamydophila pneumoniae CWL029
cacagagcuucuaaaaacucuuc

SEQ ID NO: 2529847 - RNA, 15 nt, Chlamydophila pneumoniae CWL029
cacagauaggaacca

SEQ ID NO: 2529848 - RNA, 23 nt, Chlamydophila pneumoniae CWL029
cacagaucguaaucuguauaugc

SEQ ID NO: 2529849 - RNA, 13 nt, Chlamydophila pneumoniae CWL029
cacagcauuuucu

SEQ ID NO: 2529850 - RNA, 17 nt, Chlamydophila pneumoniae CWL029
cacagcuaaucaaucca

SEQ ID NO: 2529851 - RNA, 18 nt, Chlamydophila pneumoniae CWL029
cacagcuaaucaauccaa

SEQ ID NO: 2529852 - RNA, 17 nt, Chlamydophila pneumoniae CWL029
cacagcuaugauugaaa

SEQ ID NO: 2529853 - RNA, 14 nt, Chlamydophila pneumoniae CWL029
cacagcuguacaga

SEQ ID NO: 2529854 - RNA, 18 nt, Chlamydophila pneumoniae CWL029
cacaggaaugaaaccuuc

SEQ ID NO: 2529855 - RNA, 21 nt, Chlamydophila pneumoniae CWL029
cacaggaaugaaaccuucaga

SEQ ID NO: 2529856 - RNA, 17 nt, Chlamydophila pneumoniae CWL029
cacaggcauggucuccc

SEQ ID NO: 2529857 - RNA, 20 nt, Chlamydophila pneumoniae CWL029
cacaggggaacgcucucuag

SEQ ID NO: 2529858 - RNA, 20 nt, Chlamydophila pneumoniae CWL029
cacaguauuccaucacaguu

SEQ ID NO: 2529859 - RNA, 15 nt, Chlamydophila pneumoniae CWL029
cacagugacacgcuu

SEQ ID NO: 2529860 - RNA, 15 nt, Chlamydophila pneumoniae CWL029
cacagugauuuagaa

SEQ ID NO: 2529861 - RNA, 23 nt, Chlamydophila pneumoniae CWL029
cacauacucuucauccugaucuu

SEQ ID NO: 2529862 - RNA, 14 nt, Chlamydophila pneumoniae CWL029
cacauagaaacagu

SEQ ID NO: 2529863 - RNA, 17 nt, Chlamydophila pneumoniae CWL029
cacaucauuaucauaaa

SEQ ID NO: 2529864 - RNA, 22 nt, Chlamydophila pneumoniae CWL029
cacauccuuguagaacuucuca

SEQ ID NO: 2529865 - RNA, 16 nt, Chlamydophila pneumoniae CWL029
cacaucuuuagaauca

SEQ ID NO: 2529866 - RNA, 14 nt, Chlamydophila pneumoniae CWL029
cacaucuuucucua

SEQ ID NO: 2529867 - RNA, 19 nt, Chlamydophila pneumoniae CWL029
cacaucuuucucuaaaaua

SEQ ID NO: 2529868 - RNA, 23 nt, Chlamydophila pneumoniae CWL029
cacaucuuucucuaaaauaugcu

SEQ ID NO: 2529869 - RNA, 15 nt, Chlamydophila pneumoniae CWL029
cacaugacaaauaaa

SEQ ID NO: 2529870 - RNA, 16 nt, Chlamydophila pneumoniae CWL029
cacaugcccaaacauc

SEQ ID NO: 2529871 - RNA, 17 nt, Chlamydophila pneumoniae CWL029
cacauuaagcaaucccc

SEQ ID NO: 2529872 - RNA, 17 nt, Chlamydophila pneumoniae CWL029
cacauucaagauucccu

SEQ ID NO: 2529873 - RNA, 17 nt, Chlamydophila pneumoniae CWL029
cacauuccaagaaaaau

SEQ ID NO: 2529874 - RNA, 18 nt, Chlamydophila pneumoniae CWL029
cacauugcgggcucaaag

SEQ ID NO: 2529875 - RNA, 17 nt, Chlamydophila pneumoniae CWL029
cacauuguuuaaguccu

SEQ ID NO: 2529876 - RNA, 23 nt, Chlamydophila pneumoniae CWL029
cacauuguuuaaguccuucuucc

SEQ ID NO: 2529877 - RNA, 19 nt, Chlamydophila pneumoniae CWL029
cacauuuagaaguaauccu

SEQ ID NO: 2529878 - RNA, 23 nt, Chlamydophila pneumoniae CWL029
cacauuuugguaucugauugcua

SEQ ID NO: 2529879 - RNA, 12 nt, Chlamydophila pneumoniae CWL029
caccaaaagaau

SEQ ID NO: 2529880 - RNA, 15 nt, Chlamydophila pneumoniae CWL029
caccaaaagaauacu

SEQ ID NO: 2529881 - RNA, 15 nt, Chlamydophila pneumoniae CWL029
caccaacaacaauaa

SEQ ID NO: 2529882 - RNA, 13 nt, Chlamydophila pneumoniae CWL029
caccaagggaugc

SEQ ID NO: 2529883 - RNA, 19 nt, Chlamydophila pneumoniae CWL029
caccaaugauaauuucauu

SEQ ID NO: 2529884 - RNA, 13 nt, Chlamydophila pneumoniae CWL029
caccaauuuuuuc

SEQ ID NO: 2529885 - RNA, 19 nt, Chlamydophila pneumoniae CWL029
caccacgaacuucagcaag

SEQ ID NO: 2529886 - RNA, 16 nt, Chlamydophila pneumoniae CWL029
caccacgaccuauacc

SEQ ID NO: 2529887 - RNA, 23 nt, Chlamydophila pneumoniae CWL029
caccagaagcaacuaaacucucc

SEQ ID NO: 2529888 - RNA, 22 nt, Chlamydophila pneumoniae CWL029
caccagacccucgaguaccgac

SEQ ID NO: 2529889 - RNA, 19 nt, Chlamydophila pneumoniae CWL029
ccucuuuuauauaccacua

SEQ ID NO: 2529890 - RNA, 13 nt, Chlamydophila pneumoniae CWL029
ccugaaaguacag

SEQ ID NO: 2529891 - RNA, 23 nt, Chlamydophila pneumoniae CWL029
ccugaaaguacagaaaggaccuc

SEQ ID NO: 2529892 - RNA, 16 nt, Chlamydophila pneumoniae CWL029
ccugaaauccugggca

SEQ ID NO: 2529893 - RNA, 17 nt, Chlamydophila pneumoniae CWL029
ccugaaauccugggcaa

SEQ ID NO: 2529894 - RNA, 12 nt, Chlamydophila pneumoniae CWL029
ccugaagaugag

SEQ ID NO: 2529895 - RNA, 17 nt, Chlamydophila pneumoniae CWL029
ccugaagccaugacaaa

SEQ ID NO: 2529896 - RNA, 23 nt, Chlamydophila pneumoniae CWL029
ccugacgcauagcacuaugaauu

SEQ ID NO: 2529897 - RNA, 18 nt, Chlamydophila pneumoniae CWL029
ccugagaccauaaaauca

SEQ ID NO: 2529898 - RNA, 23 nt, Chlamydophila pneumoniae CWL029
ccugagaccauaaaaucaacaag

SEQ ID NO: 2529899 - RNA, 14 nt, Chlamydophila pneumoniae CWL029
ccugaguaaaauca

SEQ ID NO: 2529900 - RNA, 21 nt, Chlamydophila pneumoniae CWL029
ccugaucuguagguguaauua

SEQ ID NO: 2529901 - RNA, 13 nt, Chlamydophila pneumoniae CWL029
ccugaugccuuuu

SEQ ID NO: 2529902 - RNA, 15 nt, Chlamydophila pneumoniae CWL029
ccugauguugcccua

SEQ ID NO: 2529903 - RNA, 17 nt, Chlamydophila pneumoniae CWL029
ccugauuccauccuguc

SEQ ID NO: 2529904 - RNA, 16 nt, Chlamydophila pneumoniae CWL029
ccugcaaacuccccag

SEQ ID NO: 2529905 - RNA, 17 nt, Chlamydophila pneumoniae CWL029
ccugcaccagacccucg

SEQ ID NO: 2529906 - RNA, 22 nt, Chlamydophila pneumoniae CWL029
ccugcaguauuauaaauagaaa

SEQ ID NO: 2529907 - RNA, 20 nt, Chlamydophila pneumoniae CWL029
ccugccgauguuuaugaaaa

SEQ ID NO: 2529908 - RNA, 21 nt, Chlamydophila pneumoniae CWL029
ccugcggaaggcuaaaaccua

SEQ ID NO: 2529909 - RNA, 16 nt, Chlamydophila pneumoniae CWL029
ccugcguuaaacccuu

SEQ ID NO: 2529910 - RNA, 20 nt, Chlamydophila pneumoniae CWL029
ccugcuaaacuuuuuuucaa

SEQ ID NO: 2529911 - RNA, 17 nt, Chlamydophila pneumoniae CWL029
ccugcuccaaaauggga

SEQ ID NO: 2529912 - RNA, 16 nt, Chlamydophila pneumoniae CWL029
ccugcuccucuucuuc

SEQ ID NO: 2529913 - RNA, 17 nt, Chlamydophila pneumoniae CWL029
ccugcugccaugcagcc

SEQ ID NO: 2529914 - RNA, 17 nt, Chlamydophila pneumoniae CWL029
ccugcuuuuuuucuaga

SEQ ID NO: 2529915 - RNA, 18 nt, Chlamydophila pneumoniae CWL029
ccuggacgauauaaucac

SEQ ID NO: 2529916 - RNA, 22 nt, Chlamydophila pneumoniae CWL029
ccuggacugcugacaucuccaa

SEQ ID NO: 2529917 - RNA, 16 nt, Chlamydophila pneumoniae CWL029
ccuggaugaacuccag

SEQ ID NO: 2529918 - RNA, 18 nt, Chlamydophila pneumoniae CWL029
ccuggauugauccacaga

SEQ ID NO: 2529919 - RNA, 21 nt, Chlamydophila pneumoniae CWL029
ccugggcuuauuauugaauaa

SEQ ID NO: 2529920 - RNA, 22 nt, Chlamydophila pneumoniae CWL029
ccugggcuuauuauugaauaag

SEQ ID NO: 2529921 - RNA, 19 nt, Chlamydophila pneumoniae CWL029
ccugguuugacuccucgcu

SEQ ID NO: 2529922 - RNA, 19 nt, Chlamydophila pneumoniae CWL029
ccuguacgguaaauccauu

SEQ ID NO: 2529923 - RNA, 15 nt, Chlamydophila pneumoniae CWL029
ccuguacuaucuuuu

SEQ ID NO: 2529924 - RNA, 13 nt, Chlamydophila pneumoniae CWL029
ccuguagaaacau

SEQ ID NO: 2529925 - RNA, 18 nt, Chlamydophila pneumoniae CWL029
ccuguagcgaagagagua

SEQ ID NO: 2529926 - RNA, 23 nt, Chlamydophila pneumoniae CWL029
ccuguaguuucuaaaacagaaau

SEQ ID NO: 2529927 - RNA, 23 nt, Chlamydophila pneumoniae CWL029
ccuguauauucugaaauuucuga

SEQ ID NO: 2529928 - RNA, 20 nt, Chlamydophila pneumoniae CWL029
ccugugagucugaugcccac

SEQ ID NO: 2529929 - RNA, 19 nt, Chlamydophila pneumoniae CWL029
ccugugauagguagcagcc

SEQ ID NO: 2529930 - RNA, 18 nt, Chlamydophila pneumoniae CWL029
ccuguucuagcaaaucua

SEQ ID NO: 2529931 - RNA, 22 nt, Chlamydophila pneumoniae CWL029
ccuguuucaacauaacaugaga

SEQ ID NO: 2529932 - RNA, 16 nt, Chlamydophila pneumoniae CWL029
ccuguuuuauugggaa

SEQ ID NO: 2529933 - RNA, 18 nt, Chlamydophila pneumoniae CWL029
ccuuaaagagaaucuccu

SEQ ID NO: 2529934 - RNA, 19 nt, Chlamydophila pneumoniae CWL029
ccuuaaagagaaucuccuc

SEQ ID NO: 2529935 - RNA, 15 nt, Chlamydophila pneumoniae CWL029
ccuuaacaacaucac

SEQ ID NO: 2529936 - RNA, 18 nt, Chlamydophila pneumoniae CWL029
ccuuaacaaccgccuuua

SEQ ID NO: 2529937 - RNA, 22 nt, Chlamydophila pneumoniae CWL029
ccuuacucccaugggauaggaa

SEQ ID NO: 2529938 - RNA, 18 nt, Chlamydophila pneumoniae CWL029
ccuuagcauuaggaaagu

SEQ ID NO: 2529939 - RNA, 14 nt, Chlamydophila pneumoniae CWL029
ccuuauaguccaua

SEQ ID NO: 2529940 - RNA, 23 nt, Chlamydophila pneumoniae CWL029
ccuuaucgcagcugauagggaaa

SEQ ID NO: 2529941 - RNA, 17 nt, Chlamydophila pneumoniae CWL029
ccuuaucuucagaaugc

SEQ ID NO: 2529942 - RNA, 17 nt, Chlamydophila pneumoniae CWL029
ccuuaucuugcugccca

SEQ ID NO: 2529943 - RNA, 23 nt, Chlamydophila pneumoniae CWL029
ccuuaugcucauuaauaauaucu

SEQ ID NO: 2529944 - RNA, 24 nt, Chlamydophila pneumoniae CWL029
ccuucaauacgcuagcucuuaaau

SEQ ID NO: 2529945 - RNA, 11 nt, Chlamydophila pneumoniae CWL029
ccuucagaucg

SEQ ID NO: 2529946 - RNA, 16 nt, Chlamydophila pneumoniae CWL029
ccuucaggauuuucca

SEQ ID NO: 2529947 - RNA, 13 nt, Chlamydophila pneumoniae CWL029
ccuucauucuuuc

SEQ ID NO: 2529948 - RNA, 19 nt, Chlamydophila pneumoniae CWL029
ccuuccaagugcucaguaa

SEQ ID NO: 2529949 - RNA, 23 nt, Chlamydophila pneumoniae CWL029
ccuuccauacggacaacaacagc

SEQ ID NO: 2529950 - RNA, 16 nt, Chlamydophila pneumoniae CWL029
ccuuccuuaucuucag

SEQ ID NO: 2529951 - RNA, 23 nt, Chlamydophila pneumoniae CWL029
ccuucgaagcggagcaucuuuuc

SEQ ID NO: 2529952 - RNA, 11 nt, Chlamydophila pneumoniae CWL029
ccuucggcuuc

SEQ ID NO: 2529953 - RNA, 23 nt, Chlamydophila pneumoniae CWL029
ccuucguaacgcuuuucuaauag

SEQ ID NO: 2529954 - RNA, 18 nt, Chlamydophila pneumoniae CWL029
ccuucuacagauugaugc

SEQ ID NO: 2529955 - RNA, 15 nt, Chlamydophila pneumoniae CWL029
ccuucugcaaucagu

SEQ ID NO: 2529956 - RNA, 22 nt, Chlamydophila pneumoniae CWL029
ccuucuggaugcccuggauagc

SEQ ID NO: 2529957 - RNA, 12 nt, Chlamydophila pneumoniae CWL029
ccuucuucuuca

SEQ ID NO: 2529958 - RNA, 13 nt, Chlamydophila pneumoniae CWL029
ccuucuucuucag

SEQ ID NO: 2529959 - RNA, 15 nt, Chlamydophila pneumoniae CWL029
ccuucuucuuuuaga

SEQ ID NO: 2529960 - RNA, 13 nt, Chlamydophila pneumoniae CWL029
ccuucuuuccaua

SEQ ID NO: 2529961 - RNA, 14 nt, Chlamydophila pneumoniae CWL029
ccuucuuuccauaa

SEQ ID NO: 2529962 - RNA, 15 nt, Chlamydophila pneumoniae CWL029
ccuucuuuccauaaa

SEQ ID NO: 2529963 - RNA, 22 nt, Chlamydophila pneumoniae CWL029
ccuugaaaaucaagaagagaaa

SEQ ID NO: 2529964 - RNA, 21 nt, Chlamydophila pneumoniae CWL029
ccuugaaagacucgcucuccu

SEQ ID NO: 2529965 - RNA, 19 nt, Chlamydophila pneumoniae CWL029
ccuugaaauugcucuugcu

SEQ ID NO: 2529966 - RNA, 22 nt, Chlamydophila pneumoniae CWL029
ccuugaaucauagagauaucau

SEQ ID NO: 2529967 - RNA, 16 nt, Chlamydophila pneumoniae CWL029
ccuugagacaaagaau

SEQ ID NO: 2529968 - RNA, 21 nt, Chlamydophila pneumoniae CWL029
ccuugagcuaacgacauugaa

SEQ ID NO: 2529969 - RNA, 21 nt, Chlamydophila pneumoniae CWL029
ccuugcagcgacaacacgccc

SEQ ID NO: 2529970 - RNA, 13 nt, Chlamydophila pneumoniae CWL029
ccuugcauuagau

SEQ ID NO: 2529971 - RNA, 20 nt, Chlamydophila pneumoniae CWL029
ccuugcauuagauucagcac

SEQ ID NO: 2529972 - RNA, 22 nt, Chlamydophila pneumoniae CWL029
ccuugcuaauaccucaaagcca

SEQ ID NO: 2529973 - RNA, 18 nt, Chlamydophila pneumoniae CWL029
ccuuggauuucuucuucu

SEQ ID NO: 2529974 - RNA, 23 nt, Chlamydophila pneumoniae CWL029
ccuuggauuucuucuucuaaagc

SEQ ID NO: 2529975 - RNA, 13 nt, Chlamydophila pneumoniae CWL029
ccuuggcagagcc

SEQ ID NO: 2529976 - RNA, 18 nt, Chlamydophila pneumoniae CWL029
ccuuggguuugucuccaa

SEQ ID NO: 2529977 - RNA, 22 nt, Chlamydophila pneumoniae CWL029
ccuuguuguauggcagccugga

SEQ ID NO: 2529978 - RNA, 23 nt, Chlamydophila pneumoniae CWL029
ccuuuagagacgcuuuuaucugu

SEQ ID NO: 2529979 - RNA, 18 nt, Chlamydophila pneumoniae CWL029
ccuuuagggaaaaaguag

SEQ ID NO: 2529980 - RNA, 17 nt, Chlamydophila pneumoniae CWL029
cgauagcaaugauguuu

SEQ ID NO: 2529981 - RNA, 19 nt, Chlamydophila pneumoniae CWL029
cgauagcauaacgacaugc

SEQ ID NO: 2529982 - RNA, 15 nt, Chlamydophila pneumoniae CWL029
cgauaggaucuucua

SEQ ID NO: 2529983 - RNA, 17 nt, Chlamydophila pneumoniae CWL029
cgauaucuauaaaugua

SEQ ID NO: 2529984 - RNA, 21 nt, Chlamydophila pneumoniae CWL029
cgauaucucuaccgaacagag

SEQ ID NO: 2529985 - RNA, 21 nt, Chlamydophila pneumoniae CWL029
cgauauuuagagagaaacauc

SEQ ID NO: 2529986 - RNA, 17 nt, Chlamydophila pneumoniae CWL029
cgaucgcgauaagaagc

SEQ ID NO: 2529987 - RNA, 14 nt, Chlamydophila pneumoniae CWL029
cgaucgucaguaaa

SEQ ID NO: 2529988 - RNA, 20 nt, Chlamydophila pneumoniae CWL029
cgaucucucuuccugcugcu

SEQ ID NO: 2529989 - RNA, 22 nt, Chlamydophila pneumoniae CWL029
cgaucuucucauccagacaaga

SEQ ID NO: 2529990 - RNA, 19 nt, Chlamydophila pneumoniae CWL029
cgaugaaacugaagguaaa

SEQ ID NO: 2529991 - RNA, 22 nt, Chlamydophila pneumoniae CWL029
cgauggcaguuuuaaugagagc

SEQ ID NO: 2529992 - RNA, 17 nt, Chlamydophila pneumoniae CWL029
cgaugggaauaaaaaug

SEQ ID NO: 2529993 - RNA, 13 nt, Chlamydophila pneumoniae CWL029
cgaugucuuucca

SEQ ID NO: 2529994 - RNA, 21 nt, Chlamydophila pneumoniae CWL029
cgauucgaaaaacgguaaaua

SEQ ID NO: 2529995 - RNA, 20 nt, Chlamydophila pneumoniae CWL029
cgauucucguguagaauuca

SEQ ID NO: 2529996 - RNA, 22 nt, Chlamydophila pneumoniae CWL029
cgauucucguguagaauucacu

SEQ ID NO: 2529997 - RNA, 18 nt, Chlamydophila pneumoniae CWL029
cgauuugaacaugaggau

SEQ ID NO: 2529998 - RNA, 18 nt, Chlamydophila pneumoniae CWL029
cgauuugaucuugcucag

SEQ ID NO: 2529999 - RNA, 15 nt, Chlamydophila pneumoniae CWL029
cgauuuggaagauug

SEQ ID NO: 2530000 - RNA, 19 nt, Chlamydophila pneumoniae CWL029
cgcaaaaagcuucuuucuu

SEQ ID NO: 2530001 - RNA, 17 nt, Chlamydophila pneumoniae CWL029
cgcaaaccaucugcguu

SEQ ID NO: 2530002 - RNA, 23 nt, Chlamydophila pneumoniae CWL029
cgcaaaccgagacuauuuuggaa

SEQ ID NO: 2530003 - RNA, 12 nt, Chlamydophila pneumoniae CWL029
cgcaaagaacuc

SEQ ID NO: 2530004 - RNA, 16 nt, Chlamydophila pneumoniae CWL029
cgcaaaggaaaagaua

SEQ ID NO: 2530005 - RNA, 18 nt, Chlamydophila pneumoniae CWL029
cgcaacaucucacagaua

SEQ ID NO: 2530006 - RNA, 21 nt, Chlamydophila pneumoniae CWL029
cgcaagagacaagaaaauauc

SEQ ID NO: 2530007 - RNA, 21 nt, Chlamydophila pneumoniae CWL029
cgcaagcacuuguuuuuucuu

SEQ ID NO: 2530008 - RNA, 14 nt, Chlamydophila pneumoniae CWL029
cgcaaucagcaaca

SEQ ID NO: 2530009 - RNA, 21 nt, Chlamydophila pneumoniae CWL029
cgcaauccaggaauagaaaga

SEQ ID NO: 2530010 - RNA, 14 nt, Chlamydophila pneumoniae CWL029
cgcacuucuauuuc

SEQ ID NO: 2530011 - RNA, 12 nt, Chlamydophila pneumoniae CWL029
cgcaguaaugcc

SEQ ID NO: 2530012 - RNA, 20 nt, Chlamydophila pneumoniae CWL029
cgcaguggacggggagagcc

SEQ ID NO: 2530013 - RNA, 13 nt, Chlamydophila pneumoniae CWL029
cgcauaagagaca

SEQ ID NO: 2530014 - RNA, 17 nt, Chlamydophila pneumoniae CWL029
cgcaucacgaaaaggag

SEQ ID NO: 2530015 - RNA, 18 nt, Chlamydophila pneumoniae CWL029
cgcauggcggucuuuguu

SEQ ID NO: 2530016 - RNA, 16 nt, Chlamydophila pneumoniae CWL029
cgcauuuccuagugcu

SEQ ID NO: 2530017 - RNA, 23 nt, Chlamydophila pneumoniae CWL029
cgccaaacgaauuucuuguucca

SEQ ID NO: 2530018 - RNA, 20 nt, Chlamydophila pneumoniae CWL029
cgccaaucugagcacauuuu

SEQ ID NO: 2530019 - RNA, 12 nt, Chlamydophila pneumoniae CWL029
cgccccaugaau

SEQ ID NO: 2530020 - RNA, 13 nt, Chlamydophila pneumoniae CWL029
cgccuagaauggc

SEQ ID NO: 2530021 - RNA, 20 nt, Chlamydophila pneumoniae CWL029
cgccuucaagucgagaaaca

SEQ ID NO: 2530022 - RNA, 17 nt, Chlamydophila pneumoniae CWL029
cgccuuucuacccuucc

SEQ ID NO: 2530023 - RNA, 15 nt, Chlamydophila pneumoniae CWL029
cgccuuuuccuaaau

SEQ ID NO: 2530024 - RNA, 13 nt, Chlamydophila pneumoniae CWL029
cgcgaagcuuucc

SEQ ID NO: 2530025 - RNA, 15 nt, Chlamydophila pneumoniae CWL029
cgcgaccugugauuu

SEQ ID NO: 2530026 - RNA, 23 nt, Chlamydophila pneumoniae CWL029
cgcgagcuauuuuacuuacuaaa

SEQ ID NO: 2530027 - RNA, 21 nt, Chlamydophila pneumoniae CWL029
cgcgauuuucaaccaagguug

SEQ ID NO: 2530028 - RNA, 12 nt, Chlamydophila pneumoniae CWL029
cgcggaucuucu

SEQ ID NO: 2530029 - RNA, 22 nt, Chlamydophila pneumoniae CWL029
cgcuaaaguagaauccuucucc

SEQ ID NO: 2530030 - RNA, 19 nt, Chlamydophila pneumoniae CWL029
cgcuaagcucuuaauuucu

SEQ ID NO: 2530031 - RNA, 17 nt, Chlamydophila pneumoniae CWL029
cgcuacgguacuuuaca

SEQ ID NO: 2530032 - RNA, 22 nt, Chlamydophila pneumoniae CWL029
cgcuagagacagccuguuuucu

SEQ ID NO: 2530033 - RNA, 15 nt, Chlamydophila pneumoniae CWL029
cgcuagccauagugu

SEQ ID NO: 2530034 - RNA, 21 nt, Chlamydophila pneumoniae CWL029
cgcuauccaugcuagaagaca

SEQ ID NO: 2530035 - RNA, 14 nt, Chlamydophila pneumoniae CWL029
cgcucguauugaua

SEQ ID NO: 2530036 - RNA, 21 nt, Chlamydophila pneumoniae CWL029
cgcucuugauagcuaagagca

SEQ ID NO: 2530037 - RNA, 22 nt, Chlamydophila pneumoniae CWL029
cgcuguaaauucagugauuccu

SEQ ID NO: 2530038 - RNA, 14 nt, Chlamydophila pneumoniae CWL029
cgcugugaggaaaa

SEQ ID NO: 2530039 - RNA, 21 nt, Chlamydophila pneumoniae CWL029
cgcuuaaaaucagcacacugc

SEQ ID NO: 2530040 - RNA, 13 nt, Chlamydophila pneumoniae CWL029
cgcuuacaaauaa

SEQ ID NO: 2530041 - RNA, 14 nt, Chlamydophila pneumoniae CWL029
cgcuuccagcuucu

SEQ ID NO: 2530042 - RNA, 20 nt, Chlamydophila pneumoniae CWL029
cgcuuccgacggagagagau

SEQ ID NO: 2530043 - RNA, 12 nt, Chlamydophila pneumoniae CWL029
cgcuugcaucuu

SEQ ID NO: 2530044 - RNA, 21 nt, Chlamydophila pneumoniae CWL029
cgcuugugguuagaggaagca

SEQ ID NO: 2530045 - RNA, 18 nt, Chlamydophila pneumoniae CWL029
cgcuuuauguuuuguccu

SEQ ID NO: 2530046 - RNA, 16 nt, Chlamydophila pneumoniae CWL029
cgcuuucgggaauaau

SEQ ID NO: 2530047 - RNA, 20 nt, Chlamydophila pneumoniae CWL029
cgcuuucgggaauaauagga

SEQ ID NO: 2530048 - RNA, 19 nt, Chlamydophila pneumoniae CWL029
cgcuuugauaauagucuuc

SEQ ID NO: 2530049 - RNA, 13 nt, Chlamydophila pneumoniae CWL029
cgcuuuuuacuga

SEQ ID NO: 2530050 - RNA, 22 nt, Chlamydophila pneumoniae CWL029
cgcuuuuucuugaaaaauccug

SEQ ID NO: 2530051 - RNA, 12 nt, Chlamydophila pneumoniae CWL029
cgcuuuuuuaaa

SEQ ID NO: 2530052 - RNA, 19 nt, Chlamydophila pneumoniae CWL029
cggaaaauacagccagcag

SEQ ID NO: 2530053 - RNA, 17 nt, Chlamydophila pneumoniae CWL029
cggaacaacuuugaggc

SEQ ID NO: 2530054 - RNA, 14 nt, Chlamydophila pneumoniae CWL029
cggaacguauccuu

SEQ ID NO: 2530055 - RNA, 14 nt, Chlamydophila pneumoniae CWL029
cggaacucauuaag

SEQ ID NO: 2530056 - RNA, 19 nt, Chlamydophila pneumoniae CWL029
cggaaggaguucuuuuuua

SEQ ID NO: 2530057 - RNA, 16 nt, Chlamydophila pneumoniae CWL029
cggaauacuucuccuc

SEQ ID NO: 2530058 - RNA, 17 nt, Chlamydophila pneumoniae CWL029
cggacgcuaauccuccu

SEQ ID NO: 2530059 - RNA, 15 nt, Chlamydophila pneumoniae CWL029
cggacgcuagagaca

SEQ ID NO: 2530060 - RNA, 22 nt, Chlamydophila pneumoniae CWL029
cggacuccgucuccuaucagag

SEQ ID NO: 2530061 - RNA, 17 nt, Chlamydophila pneumoniae CWL029
cggacuccugaugcucc

SEQ ID NO: 2530062 - RNA, 19 nt, Chlamydophila pneumoniae CWL029
cggagaacuuccugauucu

SEQ ID NO: 2530063 - RNA, 17 nt, Chlamydophila pneumoniae CWL029
cggagacucagagaaaa

SEQ ID NO: 2530064 - RNA, 19 nt, Chlamydophila pneumoniae CWL029
cggagacucagagaaaauc

SEQ ID NO: 2530065 - RNA, 17 nt, Chlamydophila pneumoniae CWL029
cggaguaacuaauaauc

SEQ ID NO: 2530066 - RNA, 14 nt, Chlamydophila pneumoniae CWL029
cggaguuaucaaaa

SEQ ID NO: 2530067 - RNA, 16 nt, Chlamydophila pneumoniae CWL029
cggaguuaucaaaagg

SEQ ID NO: 2530068 - RNA, 17 nt, Chlamydophila pneumoniae CWL029
cggaucccguaaaagaa

SEQ ID NO: 2530069 - RNA, 16 nt, Chlamydophila pneumoniae CWL029
cggauccuagaauagg

SEQ ID NO: 2530070 - RNA, 22 nt, Chlamydophila pneumoniae CWL029
cggaucgucgccuuuuccuaaa

SEQ ID NO: 2530071 - RNA, 12 nt, Chlamydophila pneumoniae CWL029
cggaucuguaau

SEQ ID NO: 2530072 - RNA, 19 nt, Chlamydophila pneumoniae CWL029
cggaucuucaauuggagga

SEQ ID NO: 2530073 - RNA, 14 nt, Chlamydophila pneumoniae CWL029
cggauuucaugauu

SEQ ID NO: 2530074 - RNA, 17 nt, Chlamydophila pneumoniae CWL029
cggauuuucucuacaca

SEQ ID NO: 2530075 - RNA, 15 nt, Chlamydophila pneumoniae CWL029
cggcaacauaaucau

SEQ ID NO: 2530076 - RNA, 13 nt, Chlamydophila pneumoniae CWL029
cggcaagaaucgc

SEQ ID NO: 2530077 - RNA, 19 nt, Chlamydophila pneumoniae CWL029
cguauggauuucuccagca

SEQ ID NO: 2530078 - RNA, 20 nt, Chlamydophila pneumoniae CWL029
cguauggauuucuccagcag

SEQ ID NO: 2530079 - RNA, 22 nt, Chlamydophila pneumoniae CWL029
cguauggauuucuccagcagcu

SEQ ID NO: 2530080 - RNA, 12 nt, Chlamydophila pneumoniae CWL029
cgucacugcgca

SEQ ID NO: 2530081 - RNA, 19 nt, Chlamydophila pneumoniae CWL029
cgucacuguuuuccagaaa

SEQ ID NO: 2530082 - RNA, 14 nt, Chlamydophila pneumoniae CWL029
cgucauauuuaaaa

SEQ ID NO: 2530083 - RNA, 23 nt, Chlamydophila pneumoniae CWL029
cgucaucgucgcgacugaaguca

SEQ ID NO: 2530084 - RNA, 16 nt, Chlamydophila pneumoniae CWL029
cguccacaagcuuuuc

SEQ ID NO: 2530085 - RNA, 18 nt, Chlamydophila pneumoniae CWL029
cguccagccugcaccaga

SEQ ID NO: 2530086 - RNA, 17 nt, Chlamydophila pneumoniae CWL029
cguccaguucuucauuc

SEQ ID NO: 2530087 - RNA, 18 nt, Chlamydophila pneumoniae CWL029
cguccaguucuucauucc

SEQ ID NO: 2530088 - RNA, 12 nt, Chlamydophila pneumoniae CWL029
cgucccacaaaa

SEQ ID NO: 2530089 - RNA, 15 nt, Chlamydophila pneumoniae CWL029
cgucgcuaaugcuau

SEQ ID NO: 2530090 - RNA, 17 nt, Chlamydophila pneumoniae CWL029
cgucgcuaaugcuaucc

SEQ ID NO: 2530091 - RNA, 20 nt, Chlamydophila pneumoniae CWL029
cgucguaaucuuuuuuaaag

SEQ ID NO: 2530092 - RNA, 22 nt, Chlamydophila pneumoniae CWL029
cgucuaaaauaaccccuccaaa

SEQ ID NO: 2530093 - RNA, 24 nt, Chlamydophila pneumoniae CWL029
cgucuaaacgcgagcuauuuuacu

SEQ ID NO: 2530094 - RNA, 14 nt, Chlamydophila pneumoniae CWL029
cgucuauuagauuu

SEQ ID NO: 2530095 - RNA, 17 nt, Chlamydophila pneumoniae CWL029
cgucuauuagauuuccu

SEQ ID NO: 2530096 - RNA, 21 nt, Chlamydophila pneumoniae CWL029
cgucugcgauaggaucuucua

SEQ ID NO: 2530097 - RNA, 20 nt, Chlamydophila pneumoniae CWL029
cgucuuagaauccaaagacu

SEQ ID NO: 2530098 - RNA, 17 nt, Chlamydophila pneumoniae CWL029
cgucuucaauagaacga

SEQ ID NO: 2530099 - RNA, 17 nt, Chlamydophila pneumoniae CWL029
cgucuuugcuuucuagg

SEQ ID NO: 2530100 - RNA, 13 nt, Chlamydophila pneumoniae CWL029
cgucuuuuaaaga

SEQ ID NO: 2530101 - RNA, 14 nt, Chlamydophila pneumoniae CWL029
cgugaacaaaaacu

SEQ ID NO: 2530102 - RNA, 16 nt, Chlamydophila pneumoniae CWL029
cgugaagcagaggguu

SEQ ID NO: 2530103 - RNA, 18 nt, Chlamydophila pneumoniae CWL029
cgugaauaucaucacuaa

SEQ ID NO: 2530104 - RNA, 23 nt, Chlamydophila pneumoniae CWL029
cgugaauauguacugaugugaag

SEQ ID NO: 2530105 - RNA, 13 nt, Chlamydophila pneumoniae CWL029
cgugacgugguuu

SEQ ID NO: 2530106 - RNA, 20 nt, Chlamydophila pneumoniae CWL029
cgugacugcguugauguauu

SEQ ID NO: 2530107 - RNA, 19 nt, Chlamydophila pneumoniae CWL029
cgugagaggaucgugaagu

SEQ ID NO: 2530108 - RNA, 13 nt, Chlamydophila pneumoniae CWL029
cgugcaggagaac

SEQ ID NO: 2530109 - RNA, 20 nt, Chlamydophila pneumoniae CWL029
cgugcaggagaacaauauca

SEQ ID NO: 2530110 - RNA, 14 nt, Chlamydophila pneumoniae CWL029
cgugcucucuucuu

SEQ ID NO: 2530111 - RNA, 12 nt, Chlamydophila pneumoniae CWL029
cgugcucuuaug

SEQ ID NO: 2530112 - RNA, 17 nt, Chlamydophila pneumoniae CWL029
cguggcuuuguaaaaau

SEQ ID NO: 2530113 - RNA, 18 nt, Chlamydophila pneumoniae CWL029
cgugguaucccugagcac

SEQ ID NO: 2530114 - RNA, 13 nt, Chlamydophila pneumoniae CWL029
cguguaaaagcuu

SEQ ID NO: 2530115 - RNA, 13 nt, Chlamydophila pneumoniae CWL029
cguuaauaaagag

SEQ ID NO: 2530116 - RNA, 14 nt, Chlamydophila pneumoniae CWL029
cguuaccaaaaacu

SEQ ID NO: 2530117 - RNA, 15 nt, Chlamydophila pneumoniae CWL029
cguuaccaaaaacug

SEQ ID NO: 2530118 - RNA, 17 nt, Chlamydophila pneumoniae CWL029
cguuagaacucgaauug

SEQ ID NO: 2530119 - RNA, 15 nt, Chlamydophila pneumoniae CWL029
cguuauccucgucuu

SEQ ID NO: 2530120 - RNA, 18 nt, Chlamydophila pneumoniae CWL029
cguucaucugucauuaaa

SEQ ID NO: 2530121 - RNA, 22 nt, Chlamydophila pneumoniae CWL029
cguucgacaacaacauaaagaa

SEQ ID NO: 2530122 - RNA, 21 nt, Chlamydophila pneumoniae CWL029
cguucguggagcaucauucca

SEQ ID NO: 2530123 - RNA, 16 nt, Chlamydophila pneumoniae CWL029
cguucuuucaauaaca

SEQ ID NO: 2530124 - RNA, 18 nt, Chlamydophila pneumoniae CWL029
cguucuuucaauaacaga

SEQ ID NO: 2530125 - RNA, 11 nt, Chlamydophila pneumoniae CWL029
cguugccuguu

SEQ ID NO: 2530126 - RNA, 17 nt, Chlamydophila pneumoniae CWL029
cguuggacugcaagagc

SEQ ID NO: 2530127 - RNA, 18 nt, Chlamydophila pneumoniae CWL029
cguuguaucccugugccu

SEQ ID NO: 2530128 - RNA, 13 nt, Chlamydophila pneumoniae CWL029
cguuuagcuauuu

SEQ ID NO: 2530129 - RNA, 18 nt, Chlamydophila pneumoniae CWL029
cguuuauaacaucaagaa

SEQ ID NO: 2530130 - RNA, 14 nt, Chlamydophila pneumoniae CWL029
cguuucaaauagga

SEQ ID NO: 2530131 - RNA, 14 nt, Chlamydophila pneumoniae CWL029
cguuucagaaguca

SEQ ID NO: 2530132 - RNA, 18 nt, Chlamydophila pneumoniae CWL029
cguuucagaagucacaaa

SEQ ID NO: 2530133 - RNA, 19 nt, Chlamydophila pneumoniae CWL029
cguuuccgaucauuuuugc

SEQ ID NO: 2530134 - RNA, 23 nt, Chlamydophila pneumoniae CWL029
cguuuugauucccuccuuccuua

SEQ ID NO: 2530135 - RNA, 18 nt, Chlamydophila pneumoniae CWL029
cguuuugcuguggaauuu

SEQ ID NO: 2530136 - RNA, 20 nt, Chlamydophila pneumoniae CWL029
cguuuuuaggguucaucuga

SEQ ID NO: 2530137 - RNA, 16 nt, Chlamydophila pneumoniae CWL029
cguuuuuuuugauuuc

SEQ ID NO: 2530138 - RNA, 13 nt, Chlamydophila pneumoniae CWL029
cuaaaaacucuuc

SEQ ID NO: 2530139 - RNA, 17 nt, Chlamydophila pneumoniae CWL029
cuaaaaacuucccaucu

SEQ ID NO: 2530140 - RNA, 18 nt, Chlamydophila pneumoniae CWL029
cuaaaaaggucagcccug

SEQ ID NO: 2530141 - RNA, 19 nt, Chlamydophila pneumoniae CWL029
cuaaaaaugcacuuugaau

SEQ ID NO: 2530142 - RNA, 15 nt, Chlamydophila pneumoniae CWL029
cuaaaaccacagaau

SEQ ID NO: 2530143 - RNA, 12 nt, Chlamydophila pneumoniae CWL029
cuaaaaccuaga

SEQ ID NO: 2530144 - RNA, 16 nt, Chlamydophila pneumoniae CWL029
cuaaaacuacaacagg

SEQ ID NO: 2530145 - RNA, 17 nt, Chlamydophila pneumoniae CWL029
cuaaaagcacuuaaaaa

SEQ ID NO: 2530146 - RNA, 14 nt, Chlamydophila pneumoniae CWL029
cuaaaaguuuuuua

SEQ ID NO: 2530147 - RNA, 21 nt, Chlamydophila pneumoniae CWL029
cuaaaauggugaagaauaaua

SEQ ID NO: 2530148 - RNA, 20 nt, Chlamydophila pneumoniae CWL029
cuaaacaacucccguuuugu

SEQ ID NO: 2530149 - RNA, 20 nt, Chlamydophila pneumoniae CWL029
cuaaacaagaaaaagcaucu

SEQ ID NO: 2530150 - RNA, 13 nt, Chlamydophila pneumoniae CWL029
cuaaacagggaau

SEQ ID NO: 2530151 - RNA, 22 nt, Chlamydophila pneumoniae CWL029
cuaaacccuguccaacuaaaac

SEQ ID NO: 2530152 - RNA, 18 nt, Chlamydophila pneumoniae CWL029
cuaaacgacguuuaauuc

SEQ ID NO: 2530153 - RNA, 23 nt, Chlamydophila pneumoniae CWL029
cuaaacgcgagcuauuuuacuua

SEQ ID NO: 2530154 - RNA, 12 nt, Chlamydophila pneumoniae CWL029
cuaaacucucca

SEQ ID NO: 2530155 - RNA, 13 nt, Chlamydophila pneumoniae CWL029
cuaaacucuccaa

SEQ ID NO: 2530156 - RNA, 20 nt, Chlamydophila pneumoniae CWL029
cuaaacucuccaaaagcucu

SEQ ID NO: 2530157 - RNA, 20 nt, Chlamydophila pneumoniae CWL029
cuaaacucucuuccuucucc

SEQ ID NO: 2530158 - RNA, 12 nt, Chlamydophila pneumoniae CWL029
cuaaacuuuuuu

SEQ ID NO: 2530159 - RNA, 22 nt, Chlamydophila pneumoniae CWL029
cuaaacuuuuuuucaaaucauc

SEQ ID NO: 2530160 - RNA, 19 nt, Chlamydophila pneumoniae CWL029
cuaaagaauuuguaacucu

SEQ ID NO: 2530161 - RNA, 22 nt, Chlamydophila pneumoniae CWL029
cuaaagaauuuguaacucuuaa

SEQ ID NO: 2530162 - RNA, 11 nt, Chlamydophila pneumoniae CWL029
cuaaagagaua

SEQ ID NO: 2530163 - RNA, 19 nt, Chlamydophila pneumoniae CWL029
cuaaagauacuuaucuuua

SEQ ID NO: 2530164 - RNA, 20 nt, Chlamydophila pneumoniae CWL029
cuaaagcaggagcaucauua

SEQ ID NO: 2530165 - RNA, 22 nt, Chlamydophila pneumoniae CWL029
cuaaagcugccagugacauaau

SEQ ID NO: 2530166 - RNA, 16 nt, Chlamydophila pneumoniae CWL029
cuaaagcugcuuuuuc

SEQ ID NO: 2530167 - RNA, 18 nt, Chlamydophila pneumoniae CWL029
cuaaagcugcuuuuucua

SEQ ID NO: 2530168 - RNA, 14 nt, Chlamydophila pneumoniae CWL029
cuaaagcuuuugcu

SEQ ID NO: 2530169 - RNA, 13 nt, Chlamydophila pneumoniae CWL029
cuaaaggaacugu

SEQ ID NO: 2530170 - RNA, 19 nt, Chlamydophila pneumoniae CWL029
cuaaaggaacugugccaua

SEQ ID NO: 2530171 - RNA, 15 nt, Chlamydophila pneumoniae CWL029
cuaaagguuuuaaau

SEQ ID NO: 2530172 - RNA, 19 nt, Chlamydophila pneumoniae CWL029
cuaaaguagaauccuucuc

SEQ ID NO: 2530173 - RNA, 13 nt, Chlamydophila pneumoniae CWL029
cuaaagugucaua

SEQ ID NO: 2530174 - RNA, 23 nt, Chlamydophila pneumoniae CWL029
cuaaauacuuaggaauuuuucua

SEQ ID NO: 2530175 - RNA, 19 nt, Chlamydophila pneumoniae CWL029
cuuaacaaccgccuuuaua

SEQ ID NO: 2530176 - RNA, 18 nt, Chlamydophila pneumoniae CWL029
cuuaaccuccucaagaau

SEQ ID NO: 2530177 - RNA, 16 nt, Chlamydophila pneumoniae CWL029
cuuaacgcuuagagaa

SEQ ID NO: 2530178 - RNA, 16 nt, Chlamydophila pneumoniae CWL029
cuuaacuggcaaucua

SEQ ID NO: 2530179 - RNA, 16 nt, Chlamydophila pneumoniae CWL029
cuuaacuuuaggcccu

SEQ ID NO: 2530180 - RNA, 17 nt, Chlamydophila pneumoniae CWL029
cuuaagaguuuuacauc

SEQ ID NO: 2530181 - RNA, 18 nt, Chlamydophila pneumoniae CWL029
cuuaagaguuuuacauca

SEQ ID NO: 2530182 - RNA, 15 nt, Chlamydophila pneumoniae CWL029
cuuaagauacuucuc

SEQ ID NO: 2530183 - RNA, 17 nt, Chlamydophila pneumoniae CWL029
cuuaagcucuaagucca

SEQ ID NO: 2530184 - RNA, 13 nt, Chlamydophila pneumoniae CWL029
cuuaauaaacauc

SEQ ID NO: 2530185 - RNA, 16 nt, Chlamydophila pneumoniae CWL029
cuuaauauaaaagaag

SEQ ID NO: 2530186 - RNA, 20 nt, Chlamydophila pneumoniae CWL029
cuuaaugguagcuuaagaau

SEQ ID NO: 2530187 - RNA, 21 nt, Chlamydophila pneumoniae CWL029
cuuaauuaaaaacugauagcg

SEQ ID NO: 2530188 - RNA, 18 nt, Chlamydophila pneumoniae CWL029
cuuacaagcuuccuuggu

SEQ ID NO: 2530189 - RNA, 15 nt, Chlamydophila pneumoniae CWL029
cuuacauaaaccuuu

SEQ ID NO: 2530190 - RNA, 19 nt, Chlamydophila pneumoniae CWL029
cuuacggccccuggaauuu

SEQ ID NO: 2530191 - RNA, 22 nt, Chlamydophila pneumoniae CWL029
cuuacggccccuggaauuucuc

SEQ ID NO: 2530192 - RNA, 17 nt, Chlamydophila pneumoniae CWL029
cuuacguaaacuauacu

SEQ ID NO: 2530193 - RNA, 16 nt, Chlamydophila pneumoniae CWL029
cuuacuaaagaaagag

SEQ ID NO: 2530194 - RNA, 20 nt, Chlamydophila pneumoniae CWL029
cuuacuaaagaaagagucuc

SEQ ID NO: 2530195 - RNA, 15 nt, Chlamydophila pneumoniae CWL029
cuuacuaaaggugaa

SEQ ID NO: 2530196 - RNA, 22 nt, Chlamydophila pneumoniae CWL029
cuuagaagggaaaguaccuuua

SEQ ID NO: 2530197 - RNA, 14 nt, Chlamydophila pneumoniae CWL029
cuuagaauccaaag

SEQ ID NO: 2530198 - RNA, 18 nt, Chlamydophila pneumoniae CWL029
cuuagaauccaaagacuu

SEQ ID NO: 2530199 - RNA, 22 nt, Chlamydophila pneumoniae CWL029
cuuagaaucuaagauccugaga

SEQ ID NO: 2530200 - RNA, 12 nt, Chlamydophila pneumoniae CWL029
cuuagagaauug

SEQ ID NO: 2530201 - RNA, 14 nt, Chlamydophila pneumoniae CWL029
cuuagaucuuuucu

SEQ ID NO: 2530202 - RNA, 16 nt, Chlamydophila pneumoniae CWL029
cuuagcaaucaguaaa

SEQ ID NO: 2530203 - RNA, 15 nt, Chlamydophila pneumoniae CWL029
cuuaggaaagagucu

SEQ ID NO: 2530204 - RNA, 15 nt, Chlamydophila pneumoniae CWL029
cuuaggaauuuuucu

SEQ ID NO: 2530205 - RNA, 18 nt, Chlamydophila pneumoniae CWL029
cuuaggaauuuuucuagu

SEQ ID NO: 2530206 - RNA, 15 nt, Chlamydophila pneumoniae CWL029
cuuaggauucuuauc

SEQ ID NO: 2530207 - RNA, 19 nt, Chlamydophila pneumoniae CWL029
cuuagggccguauucccag

SEQ ID NO: 2530208 - RNA, 16 nt, Chlamydophila pneumoniae CWL029
cuuaggguucucaaag

SEQ ID NO: 2530209 - RNA, 16 nt, Chlamydophila pneumoniae CWL029
cuuaguaucgagcucu

SEQ ID NO: 2530210 - RNA, 20 nt, Chlamydophila pneumoniae CWL029
cuuauaaacuucaaugaaga

SEQ ID NO: 2530211 - RNA, 17 nt, Chlamydophila pneumoniae CWL029
cuuauaacuauugggaa

SEQ ID NO: 2530212 - RNA, 14 nt, Chlamydophila pneumoniae CWL029
cuuauaagcugcuu

SEQ ID NO: 2530213 - RNA, 19 nt, Chlamydophila pneumoniae CWL029
cuuauacacuccaauaaga

SEQ ID NO: 2530214 - RNA, 19 nt, Chlamydophila pneumoniae CWL029
cuuauagggaauuuuuucu

SEQ ID NO: 2530215 - RNA, 20 nt, Chlamydophila pneumoniae CWL029
cuuauagggaauuuuuucug

SEQ ID NO: 2530216 - RNA, 14 nt, Chlamydophila pneumoniae CWL029
cuuauauaaaacuu

SEQ ID NO: 2530217 - RNA, 19 nt, Chlamydophila pneumoniae CWL029
cuuauauuggcuuucuaca

SEQ ID NO: 2530218 - RNA, 13 nt, Chlamydophila pneumoniae CWL029
cuuaucaggaaau

SEQ ID NO: 2530219 - RNA, 18 nt, Chlamydophila pneumoniae CWL029
cuuaucaugaaaaggauu

SEQ ID NO: 2530220 - RNA, 23 nt, Chlamydophila pneumoniae CWL029
cuuauccgucagccuuagcagca

SEQ ID NO: 2530221 - RNA, 14 nt, Chlamydophila pneumoniae CWL029
cuuauccucagggg

SEQ ID NO: 2530222 - RNA, 15 nt, Chlamydophila pneumoniae CWL029
cuuauccugaacauc

SEQ ID NO: 2530223 - RNA, 20 nt, Chlamydophila pneumoniae CWL029
cuuauccugaacaucuccag

SEQ ID NO: 2530224 - RNA, 23 nt, Chlamydophila pneumoniae CWL029
cuuaucgggggugccaaaaaauu

SEQ ID NO: 2530225 - RNA, 12 nt, Chlamydophila pneumoniae CWL029
cuuaucucuuuc

SEQ ID NO: 2530226 - RNA, 20 nt, Chlamydophila pneumoniae CWL029
cuuaucuuuaaauucgccaa

SEQ ID NO: 2530227 - RNA, 14 nt, Chlamydophila pneumoniae CWL029
cuuaugcucauuaa

SEQ ID NO: 2530228 - RNA, 17 nt, Chlamydophila pneumoniae CWL029
cuuauguagauugaucc

SEQ ID NO: 2530229 - RNA, 22 nt, Chlamydophila pneumoniae CWL029
cuuauguuaaaaauaccaagau

SEQ ID NO: 2530230 - RNA, 15 nt, Chlamydophila pneumoniae CWL029
cuuauuacagaaagg

SEQ ID NO: 2530231 - RNA, 22 nt, Chlamydophila pneumoniae CWL029
cuuauuacagaaaggcuuuucu

SEQ ID NO: 2530232 - RNA, 18 nt, Chlamydophila pneumoniae CWL029
cuuauugaagucuucuug

SEQ ID NO: 2530233 - RNA, 23 nt, Chlamydophila pneumoniae CWL029
cuucaaaagaccgccuucuaauu

SEQ ID NO: 2530234 - RNA, 21 nt, Chlamydophila pneumoniae CWL029
cuucaaaaguuccccaauuuc

SEQ ID NO: 2530235 - RNA, 18 nt, Chlamydophila pneumoniae CWL029
cuucaaaauguuuaucga

SEQ ID NO: 2530236 - RNA, 20 nt, Chlamydophila pneumoniae CWL029
cuucaaagauauagauucau

SEQ ID NO: 2530237 - RNA, 20 nt, Chlamydophila pneumoniae CWL029
cuucaaaggcaaccucugca

SEQ ID NO: 2530238 - RNA, 16 nt, Chlamydophila pneumoniae CWL029
cuucaagaaaaacccc

SEQ ID NO: 2530239 - RNA, 15 nt, Chlamydophila pneumoniae CWL029
cuucaagguacuuua

SEQ ID NO: 2530240 - RNA, 21 nt, Chlamydophila pneumoniae CWL029
cuucaauaggaauuagagaaa

SEQ ID NO: 2530241 - RNA, 23 nt, Chlamydophila pneumoniae CWL029
cuucaaugaagaaaaaucuacau

SEQ ID NO: 2530242 - RNA, 20 nt, Chlamydophila pneumoniae CWL029
cuucaaugauguguugauuu

SEQ ID NO: 2530243 - RNA, 13 nt, Chlamydophila pneumoniae CWL029
cuucaauuucuuc

SEQ ID NO: 2530244 - RNA, 17 nt, Chlamydophila pneumoniae CWL029
cuucacaucuuucucua

SEQ ID NO: 2530245 - RNA, 19 nt, Chlamydophila pneumoniae CWL029
cuucacucguugccaaucu

SEQ ID NO: 2530246 - RNA, 14 nt, Chlamydophila pneumoniae CWL029
cuucacucuuucug

SEQ ID NO: 2530247 - RNA, 18 nt, Chlamydophila pneumoniae CWL029
cuucacuuauaagcugcu

SEQ ID NO: 2530248 - RNA, 16 nt, Chlamydophila pneumoniae CWL029
cuucagaaucuuugug

SEQ ID NO: 2530249 - RNA, 17 nt, Chlamydophila pneumoniae CWL029
cuucagaaucuuuguga

SEQ ID NO: 2530250 - RNA, 16 nt, Chlamydophila pneumoniae CWL029
cuucagaauucucaag

SEQ ID NO: 2530251 - RNA, 18 nt, Chlamydophila pneumoniae CWL029
cuucagagagaacaggag

SEQ ID NO: 2530252 - RNA, 23 nt, Chlamydophila pneumoniae CWL029
cuucagagauuuuaaagccuccu

SEQ ID NO: 2530253 - RNA, 17 nt, Chlamydophila pneumoniae CWL029
cuucagcaacuaaagca

SEQ ID NO: 2530254 - RNA, 22 nt, Chlamydophila pneumoniae CWL029
cuucagcccacuguuuugcuuc

SEQ ID NO: 2530255 - RNA, 19 nt, Chlamydophila pneumoniae CWL029
cuucagcuuguuuuugcaa

SEQ ID NO: 2530256 - RNA, 14 nt, Chlamydophila pneumoniae CWL029
cuucaggaacagca

SEQ ID NO: 2530257 - RNA, 15 nt, Chlamydophila pneumoniae CWL029
cuucaggacaugccu

SEQ ID NO: 2530258 - RNA, 18 nt, Chlamydophila pneumoniae CWL029
cuucaggacgcacauuua

SEQ ID NO: 2530259 - RNA, 20 nt, Chlamydophila pneumoniae CWL029
cuucaggauuacggaaaaua

SEQ ID NO: 2530260 - RNA, 21 nt, Chlamydophila pneumoniae CWL029
cuucaggugaaggaagaucuu

SEQ ID NO: 2530261 - RNA, 15 nt, Chlamydophila pneumoniae CWL029
cuucagucugaugua

SEQ ID NO: 2530262 - RNA, 15 nt, Chlamydophila pneumoniae CWL029
cuucauaugcucucc

SEQ ID NO: 2530263 - RNA, 17 nt, Chlamydophila pneumoniae CWL029
cuucauaugcucucccg

SEQ ID NO: 2530264 - RNA, 15 nt, Chlamydophila pneumoniae CWL029
cuucaucacaaaauu

SEQ ID NO: 2530265 - RNA, 12 nt, Chlamydophila pneumoniae CWL029
cuucaucagaag

SEQ ID NO: 2530266 - RNA, 11 nt, Chlamydophila pneumoniae CWL029
cuucauucaca

SEQ ID NO: 2530267 - RNA, 19 nt, Chlamydophila pneumoniae CWL029
cuuccaaaaguaggggcag

SEQ ID NO: 2530268 - RNA, 18 nt, Chlamydophila pneumoniae CWL029
cuuccaacuucuguaucg

SEQ ID NO: 2530269 - RNA, 20 nt, Chlamydophila pneumoniae CWL029
cuuccacuguucuucuucag

SEQ ID NO: 2530270 - RNA, 14 nt, Chlamydophila pneumoniae CWL029
cuuccauaacaguu

SEQ ID NO: 2530271 - RNA, 11 nt, Chlamydophila pneumoniae CWL029
cuuccauacag

SEQ ID NO: 2530272 - RNA, 23 nt, Chlamydophila pneumoniae CWL029
cuuccauacaggcuccucugcua

SEQ ID NO: 2530273 - RNA, 17 nt, Chlamydophila pneumoniae CWL029
cucuuucgaugcuauuu

SEQ ID NO: 2530274 - RNA, 18 nt, Chlamydophila pneumoniae CWL029
cucuuucgaugcuauuuu

SEQ ID NO: 2530275 - RNA, 21 nt, Chlamydophila pneumoniae CWL029
cucuuucuauagcuccuuggc

SEQ ID NO: 2530276 - RNA, 23 nt, Chlamydophila pneumoniae CWL029
cucuuugacaucuaauuuuaaau

SEQ ID NO: 2530277 - RNA, 12 nt, Chlamydophila pneumoniae CWL029
cucuuugaggau

SEQ ID NO: 2530278 - RNA, 13 nt, Chlamydophila pneumoniae CWL029
cucuuuuaagaca

SEQ ID NO: 2530279 - RNA, 22 nt, Chlamydophila pneumoniae CWL029
cugaaaaugauucauaacauug

SEQ ID NO: 2530280 - RNA, 20 nt, Chlamydophila pneumoniae CWL029
cugaaaccuucucucuuaaa

SEQ ID NO: 2530281 - RNA, 17 nt, Chlamydophila pneumoniae CWL029
cugaaagaacacuccug

SEQ ID NO: 2530282 - RNA, 20 nt, Chlamydophila pneumoniae CWL029
cugaaagaacacuccugacu

SEQ ID NO: 2530283 - RNA, 15 nt, Chlamydophila pneumoniae CWL029
cugaaaucaaaaaaa

SEQ ID NO: 2530284 - RNA, 16 nt, Chlamydophila pneumoniae CWL029
cugaaaucaaaaaaaa

SEQ ID NO: 2530285 - RNA, 13 nt, Chlamydophila pneumoniae CWL029
cugaaauuaaguc

SEQ ID NO: 2530286 - RNA, 16 nt, Chlamydophila pneumoniae CWL029
cugaacaucuccagca

SEQ ID NO: 2530287 - RNA, 23 nt, Chlamydophila pneumoniae CWL029
cugaacaucuccagcagcaaaua

SEQ ID NO: 2530288 - RNA, 15 nt, Chlamydophila pneumoniae CWL029
cugaacauucuuaau

SEQ ID NO: 2530289 - RNA, 20 nt, Chlamydophila pneumoniae CWL029
cugaaccaaaucuaucugca

SEQ ID NO: 2530290 - RNA, 14 nt, Chlamydophila pneumoniae CWL029
cugaacgagguaac

SEQ ID NO: 2530291 - RNA, 17 nt, Chlamydophila pneumoniae CWL029
cugaacgccaucuccac

SEQ ID NO: 2530292 - RNA, 22 nt, Chlamydophila pneumoniae CWL029
cugaacuguucauaauccaaga

SEQ ID NO: 2530293 - RNA, 15 nt, Chlamydophila pneumoniae CWL029
cugaagaccccucuu

SEQ ID NO: 2530294 - RNA, 19 nt, Chlamydophila pneumoniae CWL029
cugaagagcaauuaagaaa

SEQ ID NO: 2530295 - RNA, 21 nt, Chlamydophila pneumoniae CWL029
cugaagagcaauuaagaaacu

SEQ ID NO: 2530296 - RNA, 20 nt, Chlamydophila pneumoniae CWL029
cugaagaucccugagccugu

SEQ ID NO: 2530297 - RNA, 19 nt, Chlamydophila pneumoniae CWL029
cugaagauggcaaggaaaa

SEQ ID NO: 2530298 - RNA, 10 nt, Chlamydophila pneumoniae CWL029
cugaagauuu

SEQ ID NO: 2530299 - RNA, 13 nt, Chlamydophila pneumoniae CWL029
cugaagauuuuuu

SEQ ID NO: 2530300 - RNA, 20 nt, Chlamydophila pneumoniae CWL029
cugaagccaugacaaagggu

SEQ ID NO: 2530301 - RNA, 16 nt, Chlamydophila pneumoniae CWL029
cugaagcuaaaaaauu

SEQ ID NO: 2530302 - RNA, 11 nt, Chlamydophila pneumoniae CWL029
cugaagcugca

SEQ ID NO: 2530303 - RNA, 20 nt, Chlamydophila pneumoniae CWL029
cugaagucagugcuucuugg

SEQ ID NO: 2530304 - RNA, 16 nt, Chlamydophila pneumoniae CWL029
cugaauagcucuuuuc

SEQ ID NO: 2530305 - RNA, 23 nt, Chlamydophila pneumoniae CWL029
cugaauagcucuuuucaugauaa

SEQ ID NO: 2530306 - RNA, 23 nt, Chlamydophila pneumoniae CWL029
cugaauaugcuuuucaaauauug

SEQ ID NO: 2530307 - RNA, 14 nt, Chlamydophila pneumoniae CWL029
cugaaucuuuuguu

SEQ ID NO: 2530308 - RNA, 14 nt, Chlamydophila pneumoniae CWL029
cugacacaacucuu

SEQ ID NO: 2530309 - RNA, 15 nt, Chlamydophila pneumoniae CWL029
cugacacuccucaga

SEQ ID NO: 2530310 - RNA, 17 nt, Chlamydophila pneumoniae CWL029
cugacacuccucagaau

SEQ ID NO: 2530311 - RNA, 18 nt, Chlamydophila pneumoniae CWL029
cugaccaucaaugagauc

SEQ ID NO: 2530312 - RNA, 20 nt, Chlamydophila pneumoniae CWL029
cugaccaucaaugagaucug

SEQ ID NO: 2530313 - RNA, 22 nt, Chlamydophila pneumoniae CWL029
cugacccuguagcgaagagagu

SEQ ID NO: 2530314 - RNA, 15 nt, Chlamydophila pneumoniae CWL029
cugacggaucuuagg

SEQ ID NO: 2530315 - RNA, 18 nt, Chlamydophila pneumoniae CWL029
cugacgucuccaacaguc

SEQ ID NO: 2530316 - RNA, 16 nt, Chlamydophila pneumoniae CWL029
cugacgugcauugaau

SEQ ID NO: 2530317 - RNA, 22 nt, Chlamydophila pneumoniae CWL029
cugacgugcauugaauccuucu

SEQ ID NO: 2530318 - RNA, 19 nt, Chlamydophila pneumoniae CWL029
cugacuugcaagcuucuug

SEQ ID NO: 2530319 - RNA, 17 nt, Chlamydophila pneumoniae CWL029
cugagaauacaacccuu

SEQ ID NO: 2530320 - RNA, 21 nt, Chlamydophila pneumoniae CWL029
cugagaauacaacccuuuaua

SEQ ID NO: 2530321 - RNA, 18 nt, Chlamydophila pneumoniae CWL029
cugagaccauaaaaucaa

SEQ ID NO: 2530322 - RNA, 18 nt, Chlamydophila pneumoniae CWL029
cugagagaagcagaaucu

SEQ ID NO: 2530323 - RNA, 20 nt, Chlamydophila pneumoniae CWL029
cugagagauagguuuuugua

SEQ ID NO: 2530324 - RNA, 23 nt, Chlamydophila pneumoniae CWL029
cugagaguguuguuggagcagaa

SEQ ID NO: 2530325 - RNA, 16 nt, Chlamydophila pneumoniae CWL029
cugagcaacuucuucg

SEQ ID NO: 2530326 - RNA, 23 nt, Chlamydophila pneumoniae CWL029
cugagcaacuucuucguuagaga

SEQ ID NO: 2530327 - RNA, 16 nt, Chlamydophila pneumoniae CWL029
cuuugaauaaugcauc

SEQ ID NO: 2530328 - RNA, 19 nt, Chlamydophila pneumoniae CWL029
cuuugaauuuccaaaggaa

SEQ ID NO: 2530329 - RNA, 21 nt, Chlamydophila pneumoniae CWL029
cuuugaccagaugauuuuuug

SEQ ID NO: 2530330 - RNA, 17 nt, Chlamydophila pneumoniae CWL029
cuuugagaucuugaaug

SEQ ID NO: 2530331 - RNA, 20 nt, Chlamydophila pneumoniae CWL029
cuuugaggauacgaauaagu

SEQ ID NO: 2530332 - RNA, 19 nt, Chlamydophila pneumoniae CWL029
cuuugaggcaagucucaaa

SEQ ID NO: 2530333 - RNA, 14 nt, Chlamydophila pneumoniae CWL029
cuuugaguagccag

SEQ ID NO: 2530334 - RNA, 19 nt, Chlamydophila pneumoniae CWL029
cuuugaguaggguguauuc

SEQ ID NO: 2530335 - RNA, 16 nt, Chlamydophila pneumoniae CWL029
cuuugagucuuuuuca

SEQ ID NO: 2530336 - RNA, 17 nt, Chlamydophila pneumoniae CWL029
cuuugaucgcuugugca

SEQ ID NO: 2530337 - RNA, 13 nt, Chlamydophila pneumoniae CWL029
cuuugcaugagga

SEQ ID NO: 2530338 - RNA, 21 nt, Chlamydophila pneumoniae CWL029
cuuugcaugaggagaccuuua

SEQ ID NO: 2530339 - RNA, 16 nt, Chlamydophila pneumoniae CWL029
cuuugccaacagcugg

SEQ ID NO: 2530340 - RNA, 15 nt, Chlamydophila pneumoniae CWL029
cuuugccaaggaccu

SEQ ID NO: 2530341 - RNA, 23 nt, Chlamydophila pneumoniae CWL029
cuuugcgaacgaagacuuguucu

SEQ ID NO: 2530342 - RNA, 19 nt, Chlamydophila pneumoniae CWL029
cuuugcuggagacaacuau

SEQ ID NO: 2530343 - RNA, 13 nt, Chlamydophila pneumoniae CWL029
cuuugcuuaaaaa

SEQ ID NO: 2530344 - RNA, 15 nt, Chlamydophila pneumoniae CWL029
cuuugcuuaaaaagu

SEQ ID NO: 2530345 - RNA, 22 nt, Chlamydophila pneumoniae CWL029
cuuugcuuaaaaagucugaauc

SEQ ID NO: 2530346 - RNA, 14 nt, Chlamydophila pneumoniae CWL029
cuuugcuuauuucc

SEQ ID NO: 2530347 - RNA, 14 nt, Chlamydophila pneumoniae CWL029
cuuugggauaaaaa

SEQ ID NO: 2530348 - RNA, 17 nt, Chlamydophila pneumoniae CWL029
cuuugucuaugauugcu

SEQ ID NO: 2530349 - RNA, 16 nt, Chlamydophila pneumoniae CWL029
cuuugugaguucuucc

SEQ ID NO: 2530350 - RNA, 19 nt, Chlamydophila pneumoniae CWL029
cuuugugaguucuuccuuc

SEQ ID NO: 2530351 - RNA, 22 nt, Chlamydophila pneumoniae CWL029
cuuugugaguucuuccuucuuc

SEQ ID NO: 2530352 - RNA, 18 nt, Chlamydophila pneumoniae CWL029
cuuuguggggauuuucag

SEQ ID NO: 2530353 - RNA, 18 nt, Chlamydophila pneumoniae CWL029
cuuuguuaauagaagauc

SEQ ID NO: 2530354 - RNA, 16 nt, Chlamydophila pneumoniae CWL029
cuuuuaauguguucuu

SEQ ID NO: 2530355 - RNA, 23 nt, Chlamydophila pneumoniae CWL029
cuuuuacgaaugagaucagcucc

SEQ ID NO: 2530356 - RNA, 20 nt, Chlamydophila pneumoniae CWL029
cuuuuacuguacuugcuaug

SEQ ID NO: 2530357 - RNA, 22 nt, Chlamydophila pneumoniae CWL029
cuuuuagacgugcucucuucuu

SEQ ID NO: 2530358 - RNA, 16 nt, Chlamydophila pneumoniae CWL029
cuuuuagguagagaau

SEQ ID NO: 2530359 - RNA, 16 nt, Chlamydophila pneumoniae CWL029
cuuuuauauuaagaau

SEQ ID NO: 2530360 - RNA, 16 nt, Chlamydophila pneumoniae CWL029
cuuuuaucuguuaaaa

SEQ ID NO: 2530361 - RNA, 12 nt, Chlamydophila pneumoniae CWL029
cuuuucaaaaga

SEQ ID NO: 2530362 - RNA, 23 nt, Chlamydophila pneumoniae CWL029
cuuuucagcaaacggagagcauu

SEQ ID NO: 2530363 - RNA, 13 nt, Chlamydophila pneumoniae CWL029
cuuuucauuuuua

SEQ ID NO: 2530364 - RNA, 17 nt, Chlamydophila pneumoniae CWL029
cuuuucauuuuuaggau

SEQ ID NO: 2530365 - RNA, 21 nt, Chlamydophila pneumoniae CWL029
cuuuuccggggagaacuucaa

SEQ ID NO: 2530366 - RNA, 18 nt, Chlamydophila pneumoniae CWL029
cuuuuccguuucagaagu

SEQ ID NO: 2530367 - RNA, 13 nt, Chlamydophila pneumoniae CWL029
cuuuuccuaaauc

SEQ ID NO: 2530368 - RNA, 19 nt, Chlamydophila pneumoniae CWL029
cuuuuccuucuguagauuu

SEQ ID NO: 2530369 - RNA, 19 nt, Chlamydophila pneumoniae CWL029
cuuuucggaucagaaugca

SEQ ID NO: 2530370 - RNA, 14 nt, Chlamydophila pneumoniae CWL029
cuuuucguauagag

SEQ ID NO: 2530371 - RNA, 16 nt, Chlamydophila pneumoniae CWL029
cuuuucuacaugcuca

SEQ ID NO: 2530372 - RNA, 10 nt, Chlamydophila pneumoniae CWL029
cuuuucuaga

SEQ ID NO: 2530373 - RNA, 13 nt, Chlamydophila pneumoniae CWL029
cuuuucuagaaaa

SEQ ID NO: 2530374 - RNA, 13 nt, Chlamydophila pneumoniae CWL029
cuuuucuccuucu

SEQ ID NO: 2530375 - RNA, 14 nt, Chlamydophila pneumoniae CWL029
cuuuucugaagauu

SEQ ID NO: 2530376 - RNA, 15 nt, Chlamydophila pneumoniae CWL029
cuuuucugcuccuga

SEQ ID NO: 2530377 - RNA, 18 nt, Chlamydophila pneumoniae CWL029
cuuuucuuccaaagacug

SEQ ID NO: 2530378 - RNA, 13 nt, Chlamydophila pneumoniae CWL029
cuuuucuuuuucu

SEQ ID NO: 2530379 - RNA, 17 nt, Chlamydophila pneumoniae CWL029
cuuuugaagauccugag

SEQ ID NO: 2530380 - RNA, 19 nt, Chlamydophila pneumoniae CWL029
cuuuugaagauccugagua

SEQ ID NO: 2530381 - RNA, 15 nt, Chlamydophila pneumoniae CWL029
cuuuugcaaaucuuc

SEQ ID NO: 2530382 - RNA, 13 nt, Chlamydophila pneumoniae CWL029
cuuuugcuacagc

SEQ ID NO: 2530383 - RNA, 14 nt, Chlamydophila pneumoniae CWL029
cuuuugcugcagca

SEQ ID NO: 2530384 - RNA, 23 nt, Chlamydophila pneumoniae CWL029
cuuuugcugcagcaaaacuagga

SEQ ID NO: 2530385 - RNA, 15 nt, Chlamydophila pneumoniae CWL029
cuuuugugauaccuc

SEQ ID NO: 2530386 - RNA, 18 nt, Chlamydophila pneumoniae CWL029
cuuuuguuguuuuugcug

SEQ ID NO: 2530387 - RNA, 20 nt, Chlamydophila pneumoniae CWL029
cuuuuuaggaaaggauaucu

SEQ ID NO: 2530388 - RNA, 21 nt, Chlamydophila pneumoniae CWL029
cuuuuuaguauacuaagacug

SEQ ID NO: 2530389 - RNA, 17 nt, Chlamydophila pneumoniae CWL029
cuuuuuaucaugagaau

SEQ ID NO: 2530390 - RNA, 18 nt, Chlamydophila pneumoniae CWL029
cuuuuuauugauaaugau

SEQ ID NO: 2530391 - RNA, 16 nt, Chlamydophila pneumoniae CWL029
cuuuuucaauagcagu

SEQ ID NO: 2530392 - RNA, 14 nt, Chlamydophila pneumoniae CWL029
cuuuuucagcuucu

SEQ ID NO: 2530393 - RNA, 11 nt, Chlamydophila pneumoniae CWL029
cuuuuucuagg

SEQ ID NO: 2530394 - RNA, 18 nt, Chlamydophila pneumoniae CWL029
cuuuuucuucaauaucuu

SEQ ID NO: 2530395 - RNA, 19 nt, Chlamydophila pneumoniae CWL029
cuuuuucuugauuagagaa

SEQ ID NO: 2530396 - RNA, 20 nt, Chlamydophila pneumoniae CWL029
cuuuuucuugauuagagaau

SEQ ID NO: 2530397 - RNA, 20 nt, Chlamydophila pneumoniae CWL029
cuuuuugauuagaguuuuug

SEQ ID NO: 2530398 - RNA, 14 nt, Chlamydophila pneumoniae CWL029
cuuuuugcagaucu

SEQ ID NO: 2530399 - RNA, 22 nt, Chlamydophila pneumoniae CWL029
cuuuuugcauagccuuccuguu

SEQ ID NO: 2530400 - RNA, 15 nt, Chlamydophila pneumoniae CWL029
cuuuuugccaauuuu

SEQ ID NO: 2530401 - RNA, 15 nt, Chlamydophila pneumoniae CWL029
cuuuuugccacaacu

SEQ ID NO: 2530402 - RNA, 13 nt, Chlamydophila pneumoniae CWL029
cuuuuuuuaaaaa

SEQ ID NO: 2530403 - RNA, 18 nt, Chlamydophila pneumoniae CWL029
cuuuuuuuauauaaagau

SEQ ID NO: 2530404 - RNA, 15 nt, Chlamydophila pneumoniae CWL029
cuuuuuuucuagagu

SEQ ID NO: 2530405 - RNA, 14 nt, Chlamydophila pneumoniae CWL029
cuuuuuuuuuucuu

SEQ ID NO: 2530406 - RNA, 14 nt, Chlamydophila pneumoniae CWL029
gaaaaaagaauaaa

SEQ ID NO: 2530407 - RNA, 23 nt, Chlamydophila pneumoniae CWL029
cuaaaucaacuacaucuccaagc

SEQ ID NO: 2530408 - RNA, 22 nt, Chlamydophila pneumoniae CWL029
cuaaaucugcuuuuaucucaau

SEQ ID NO: 2530409 - RNA, 14 nt, Chlamydophila pneumoniae CWL029
cuaaauuaguaaau

SEQ ID NO: 2530410 - RNA, 16 nt, Chlamydophila pneumoniae CWL029
cuaaauuaguaaaugc

SEQ ID NO: 2530411 - RNA, 18 nt, Chlamydophila pneumoniae CWL029
cuaaauuaguaaaugccu

SEQ ID NO: 2530412 - RNA, 20 nt, Chlamydophila pneumoniae CWL029
cuaaauuaguaaaugccucu

SEQ ID NO: 2530413 - RNA, 17 nt, Chlamydophila pneumoniae CWL029
cuaaauucuuaacaaua

SEQ ID NO: 2530414 - RNA, 17 nt, Chlamydophila pneumoniae CWL029
cuaaauuugucaucaca

SEQ ID NO: 2530415 - RNA, 18 nt, Chlamydophila pneumoniae CWL029
cuaaauuugucaucacau

SEQ ID NO: 2530416 - RNA, 12 nt, Chlamydophila pneumoniae CWL029
cuaacaacuccu

SEQ ID NO: 2530417 - RNA, 16 nt, Chlamydophila pneumoniae CWL029
cuaacaacuucugaca

SEQ ID NO: 2530418 - RNA, 19 nt, Chlamydophila pneumoniae CWL029
cuaacaagauaaccugaga

SEQ ID NO: 2530419 - RNA, 20 nt, Chlamydophila pneumoniae CWL029
cuaacgaagccucacagaau

SEQ ID NO: 2530420 - RNA, 15 nt, Chlamydophila pneumoniae CWL029
cuaacgacauugaag

SEQ ID NO: 2530421 - RNA, 20 nt, Chlamydophila pneumoniae CWL029
cuaacuaucucuguuuuuug

SEQ ID NO: 2530422 - RNA, 17 nt, Chlamydophila pneumoniae CWL029
cuaacuguacacuuuca

SEQ ID NO: 2530423 - RNA, 15 nt, Chlamydophila pneumoniae CWL029
cuaacuuauccucag

SEQ ID NO: 2530424 - RNA, 15 nt, Chlamydophila pneumoniae CWL029
cuaacuuaucgaaug

SEQ ID NO: 2530425 - RNA, 18 nt, Chlamydophila pneumoniae CWL029
cuaagaagcucacucuuu

SEQ ID NO: 2530426 - RNA, 13 nt, Chlamydophila pneumoniae CWL029
cuaagaauaugga

SEQ ID NO: 2530427 - RNA, 14 nt, Chlamydophila pneumoniae CWL029
cuaagaauauggac

SEQ ID NO: 2530428 - RNA, 15 nt, Chlamydophila pneumoniae CWL029
cuaagaaucuauaaa

SEQ ID NO: 2530429 - RNA, 20 nt, Chlamydophila pneumoniae CWL029
cuaagaaucuauaaauucaa

SEQ ID NO: 2530430 - RNA, 23 nt, Chlamydophila pneumoniae CWL029
cuaagacuagaucgucaagcucu

SEQ ID NO: 2530431 - RNA, 13 nt, Chlamydophila pneumoniae CWL029
cuaagacugucua

SEQ ID NO: 2530432 - RNA, 17 nt, Chlamydophila pneumoniae CWL029
cuaagagcccuugaauc

SEQ ID NO: 2530433 - RNA, 22 nt, Chlamydophila pneumoniae CWL029
cuaagagcccuugaaucauaga

SEQ ID NO: 2530434 - RNA, 16 nt, Chlamydophila pneumoniae CWL029
cuaagauaucuccagg

SEQ ID NO: 2530435 - RNA, 17 nt, Chlamydophila pneumoniae CWL029
cuaagauaucuuguaca

SEQ ID NO: 2530436 - RNA, 21 nt, Chlamydophila pneumoniae CWL029
cuaagaucuuuuguaaucguu

SEQ ID NO: 2530437 - RNA, 13 nt, Chlamydophila pneumoniae CWL029
cuaagcaaaaacu

SEQ ID NO: 2530438 - RNA, 17 nt, Chlamydophila pneumoniae CWL029
cuaagcaaagcggcucu

SEQ ID NO: 2530439 - RNA, 19 nt, Chlamydophila pneumoniae CWL029
cuaagcagccucuucucua

SEQ ID NO: 2530440 - RNA, 14 nt, Chlamydophila pneumoniae CWL029
cuaagcaucagaau

SEQ ID NO: 2530441 - RNA, 15 nt, Chlamydophila pneumoniae CWL029
cuaagcgaaccaaag

SEQ ID NO: 2530442 - RNA, 17 nt, Chlamydophila pneumoniae CWL029
cuaagcuauaucucaac

SEQ ID NO: 2530443 - RNA, 21 nt, Chlamydophila pneumoniae CWL029
cuaagcucuuaauuucugcug

SEQ ID NO: 2530444 - RNA, 20 nt, Chlamydophila pneumoniae CWL029
cuaagcugugcauuuucuuc

SEQ ID NO: 2530445 - RNA, 19 nt, Chlamydophila pneumoniae CWL029
cuaaggaaauuacaaucuc

SEQ ID NO: 2530446 - RNA, 19 nt, Chlamydophila pneumoniae CWL029
cuaagggcucuagauauuc

SEQ ID NO: 2530447 - RNA, 18 nt, Chlamydophila pneumoniae CWL029
cuaagguagcuagcguuu

SEQ ID NO: 2530448 - RNA, 19 nt, Chlamydophila pneumoniae CWL029
cuaaggugcuauuuuaaac

SEQ ID NO: 2530449 - RNA, 17 nt, Chlamydophila pneumoniae CWL029
cuaaguaaaacugcgcu

SEQ ID NO: 2530450 - RNA, 19 nt, Chlamydophila pneumoniae CWL029
cuaaguaacaguccucucc

SEQ ID NO: 2530451 - RNA, 18 nt, Chlamydophila pneumoniae CWL029
cuaaguccaacaucagcu

SEQ ID NO: 2530452 - RNA, 17 nt, Chlamydophila pneumoniae CWL029
cuaagucguuaacauca

SEQ ID NO: 2530453 - RNA, 18 nt, Chlamydophila pneumoniae CWL029
cuaagucguuaacaucaa

SEQ ID NO: 2530454 - RNA, 21 nt, Chlamydophila pneumoniae CWL029
cuaagucuccauaauucugca

SEQ ID NO: 2530455 - RNA, 22 nt, Chlamydophila pneumoniae CWL029
cuaauaaaauuggcuuuugaga

SEQ ID NO: 2530456 - RNA, 18 nt, Chlamydophila pneumoniae CWL029
cuaauaagauccaaaaau

SEQ ID NO: 2530457 - RNA, 20 nt, Chlamydophila pneumoniae CWL029
cuaauacacccgcaagcacu

SEQ ID NO: 2530458 - RNA, 17 nt, Chlamydophila pneumoniae CWL029
cuaauacaucaccacug

SEQ ID NO: 2530459 - RNA, 21 nt, Chlamydophila pneumoniae CWL029
cuaauaccuuucuaagaauuc

SEQ ID NO: 2530460 - RNA, 12 nt, Chlamydophila pneumoniae CWL029
cuaauauugauu

SEQ ID NO: 2530461 - RNA, 19 nt, Chlamydophila pneumoniae CWL029
cuaaucacagcgucaggga

SEQ ID NO: 2530462 - RNA, 20 nt, Chlamydophila pneumoniae CWL029
cuaaucacagcgucagggau

SEQ ID NO: 2530463 - RNA, 23 nt, Chlamydophila pneumoniae CWL029
cuaaucaccuuaggcuuaauaaa

SEQ ID NO: 2530464 - RNA, 19 nt, Chlamydophila pneumoniae CWL029
cuaaucuaugaaguccuga

SEQ ID NO: 2530465 - RNA, 13 nt, Chlamydophila pneumoniae CWL029
cuaaucugauuca

SEQ ID NO: 2530466 - RNA, 16 nt, Chlamydophila pneumoniae CWL029
cuaaucuucuuaaugg

SEQ ID NO: 2530467 - RNA, 13 nt, Chlamydophila pneumoniae CWL029
cuaaugacagcug

SEQ ID NO: 2530468 - RNA, 20 nt, Chlamydophila pneumoniae CWL029
cuaaugacagcugagaaauu

SEQ ID NO: 2530469 - RNA, 16 nt, Chlamydophila pneumoniae CWL029
cuaauucuucuacaga

SEQ ID NO: 2530470 - RNA, 12 nt, Chlamydophila pneumoniae CWL029
cuaauuucaaua

SEQ ID NO: 2530471 - RNA, 21 nt, Chlamydophila pneumoniae CWL029
cuaauuucaggagcuccugcg

SEQ ID NO: 2530472 - RNA, 17 nt, Chlamydophila pneumoniae CWL029
cuaauuuccuucaggau

SEQ ID NO: 2530473 - RNA, 15 nt, Chlamydophila pneumoniae CWL029
cuaauuuuaaauuuu

SEQ ID NO: 2530474 - RNA, 14 nt, Chlamydophila pneumoniae CWL029
cuaauuuuagaacu

SEQ ID NO: 2530475 - RNA, 15 nt, Chlamydophila pneumoniae CWL029
cuaauuuuagaacuu

SEQ ID NO: 2530476 - RNA, 13 nt, Chlamydophila pneumoniae CWL029
cuacaauacucug

SEQ ID NO: 2530477 - RNA, 19 nt, Chlamydophila pneumoniae CWL029
cuacaaucccgaguccuaa

SEQ ID NO: 2530478 - RNA, 23 nt, Chlamydophila pneumoniae CWL029
cuacaaucgccuuacaauuuaaa

SEQ ID NO: 2530479 - RNA, 14 nt, Chlamydophila pneumoniae CWL029
cuacaauuuccuug

SEQ ID NO: 2530480 - RNA, 22 nt, Chlamydophila pneumoniae CWL029
cuacaauuuccuugguauccca

SEQ ID NO: 2530481 - RNA, 21 nt, Chlamydophila pneumoniae CWL029
cuacacuguuguaauaaaauc

SEQ ID NO: 2530482 - RNA, 21 nt, Chlamydophila pneumoniae CWL029
cuacagaaagagcuaaagaaa

SEQ ID NO: 2530483 - RNA, 17 nt, Chlamydophila pneumoniae CWL029
cuacagaauaggaacaa

SEQ ID NO: 2530484 - RNA, 20 nt, Chlamydophila pneumoniae CWL029
cuacagaggaaucuauccuu

SEQ ID NO: 2530485 - RNA, 21 nt, Chlamydophila pneumoniae CWL029
cuacagaggaaucuauccuuc

SEQ ID NO: 2530486 - RNA, 17 nt, Chlamydophila pneumoniae CWL029
cuacagagggaauuuca

SEQ ID NO: 2530487 - RNA, 19 nt, Chlamydophila pneumoniae CWL029
cuacagagggcuucauucc

SEQ ID NO: 2530488 - RNA, 13 nt, Chlamydophila pneumoniae CWL029
cuacagauaugcu

SEQ ID NO: 2530489 - RNA, 22 nt, Chlamydophila pneumoniae CWL029
cuacagaucaggauucuaaaaa

SEQ ID NO: 2530490 - RNA, 18 nt, Chlamydophila pneumoniae CWL029
cuacagcuaacgaaguga

SEQ ID NO: 2530491 - RNA, 14 nt, Chlamydophila pneumoniae CWL029
cuacagcuucuuuu

SEQ ID NO: 2530492 - RNA, 16 nt, Chlamydophila pneumoniae CWL029
cuacagcuucuuuucc

SEQ ID NO: 2530493 - RNA, 17 nt, Chlamydophila pneumoniae CWL029
cuacauaaaaugagcuc

SEQ ID NO: 2530494 - RNA, 16 nt, Chlamydophila pneumoniae CWL029
cuacauagauccccuu

SEQ ID NO: 2530495 - RNA, 22 nt, Chlamydophila pneumoniae CWL029
cuacauaguuguucggacaaaa

SEQ ID NO: 2530496 - RNA, 21 nt, Chlamydophila pneumoniae CWL029
cuacauauacguggcuuccau

SEQ ID NO: 2530497 - RNA, 15 nt, Chlamydophila pneumoniae CWL029
cuacaucagacugaa

SEQ ID NO: 2530498 - RNA, 16 nt, Chlamydophila pneumoniae CWL029
cuacauguaaagcaag

SEQ ID NO: 2530499 - RNA, 15 nt, Chlamydophila pneumoniae CWL029
cuacauucuaacgcu

SEQ ID NO: 2530500 - RNA, 15 nt, Chlamydophila pneumoniae CWL029
cuacauuugcuauuu

SEQ ID NO: 2530501 - RNA, 18 nt, Chlamydophila pneumoniae CWL029
cuacauuugcuauuuucc

SEQ ID NO: 2530502 - RNA, 20 nt, Chlamydophila pneumoniae CWL029
cuacauuugcuauuuucccu

SEQ ID NO: 2530503 - RNA, 21 nt, Chlamydophila pneumoniae CWL029
cuaccaaagucgauacccaaa

SEQ ID NO: 2530504 - RNA, 21 nt, Chlamydophila pneumoniae CWL029
cuaccaauaaccgaaacuucu

SEQ ID NO: 2530505 - RNA, 21 nt, Chlamydophila pneumoniae CWL029
cuccugaagggacaaguacga

SEQ ID NO: 2530506 - RNA, 18 nt, Chlamydophila pneumoniae CWL029
cuccugacucuuauugca

SEQ ID NO: 2530507 - RNA, 20 nt, Chlamydophila pneumoniae CWL029
cuccugacucuuauugcaga

SEQ ID NO: 2530508 - RNA, 21 nt, Chlamydophila pneumoniae CWL029
cuccugacucuuuuaagacaa

SEQ ID NO: 2530509 - RNA, 23 nt, Chlamydophila pneumoniae CWL029
cuccugacucuuuuaagacaaua

SEQ ID NO: 2530510 - RNA, 16 nt, Chlamydophila pneumoniae CWL029
cuccugcaaaaaacca

SEQ ID NO: 2530511 - RNA, 23 nt, Chlamydophila pneumoniae CWL029
cuccugcagggggcauucccuga

SEQ ID NO: 2530512 - RNA, 13 nt, Chlamydophila pneumoniae CWL029
cuccuggaagaau

SEQ ID NO: 2530513 - RNA, 15 nt, Chlamydophila pneumoniae CWL029
cuccuucaaagauau

SEQ ID NO: 2530514 - RNA, 13 nt, Chlamydophila pneumoniae CWL029
cuccuucagaguu

SEQ ID NO: 2530515 - RNA, 19 nt, Chlamydophila pneumoniae CWL029
cuccuucauucacagcagu

SEQ ID NO: 2530516 - RNA, 13 nt, Chlamydophila pneumoniae CWL029
cuccuucucccug

SEQ ID NO: 2530517 - RNA, 20 nt, Chlamydophila pneumoniae CWL029
cuccuugacuaaauccacca

SEQ ID NO: 2530518 - RNA, 16 nt, Chlamydophila pneumoniae CWL029
cuccuugauaaaacgc

SEQ ID NO: 2530519 - RNA, 13 nt, Chlamydophila pneumoniae CWL029
cuccuuuaaauaa

SEQ ID NO: 2530520 - RNA, 17 nt, Chlamydophila pneumoniae CWL029
cuccuuugagucuuuuu

SEQ ID NO: 2530521 - RNA, 13 nt, Chlamydophila pneumoniae CWL029
cucgaaacucuuu

SEQ ID NO: 2530522 - RNA, 19 nt, Chlamydophila pneumoniae CWL029
cucgaaacucuuugaggau

SEQ ID NO: 2530523 - RNA, 12 nt, Chlamydophila pneumoniae CWL029
cucgaaauccua

SEQ ID NO: 2530524 - RNA, 19 nt, Chlamydophila pneumoniae CWL029
cucgaacaggagagagaag

SEQ ID NO: 2530525 - RNA, 18 nt, Chlamydophila pneumoniae CWL029
cucgaaccacuguccaug

SEQ ID NO: 2530526 - RNA, 19 nt, Chlamydophila pneumoniae CWL029
cucgaacucugaaguacac

SEQ ID NO: 2530527 - RNA, 12 nt, Chlamydophila pneumoniae CWL029
cucgaagaaaau

SEQ ID NO: 2530528 - RNA, 16 nt, Chlamydophila pneumoniae CWL029
cucgaagaaaauaaag

SEQ ID NO: 2530529 - RNA, 23 nt, Chlamydophila pneumoniae CWL029
cucgaauuguguguuuucauaaa

SEQ ID NO: 2530530 - RNA, 18 nt, Chlamydophila pneumoniae CWL029
cucgacaccgauucgcua

SEQ ID NO: 2530531 - RNA, 22 nt, Chlamydophila pneumoniae CWL029
cucgagauuuuuuauuuuuacu

SEQ ID NO: 2530532 - RNA, 21 nt, Chlamydophila pneumoniae CWL029
cucgagcagaaacuccaaaau

SEQ ID NO: 2530533 - RNA, 23 nt, Chlamydophila pneumoniae CWL029
cucgaggggacggaaaaucacac

SEQ ID NO: 2530534 - RNA, 17 nt, Chlamydophila pneumoniae CWL029
cucgauuugaucuugcu

SEQ ID NO: 2530535 - RNA, 22 nt, Chlamydophila pneumoniae CWL029
cucgcaguccuugagcuaacga

SEQ ID NO: 2530536 - RNA, 22 nt, Chlamydophila pneumoniae CWL029
cucgcuaaaguagaauccuucu

SEQ ID NO: 2530537 - RNA, 16 nt, Chlamydophila pneumoniae CWL029
cucgcuauuccauaaa

SEQ ID NO: 2530538 - RNA, 15 nt, Chlamydophila pneumoniae CWL029
cucggaaaucaggga

SEQ ID NO: 2530539 - RNA, 13 nt, Chlamydophila pneumoniae CWL029
cucgggagaacau

SEQ ID NO: 2530540 - RNA, 15 nt, Chlamydophila pneumoniae CWL029
cucgggauaaugcuc

SEQ ID NO: 2530541 - RNA, 19 nt, Chlamydophila pneumoniae CWL029
cucgguuauuuuuccagaa

SEQ ID NO: 2530542 - RNA, 22 nt, Chlamydophila pneumoniae CWL029
cucgguuuccugaagaugagaa

SEQ ID NO: 2530543 - RNA, 17 nt, Chlamydophila pneumoniae CWL029
cucguaauccuucuuuc

SEQ ID NO: 2530544 - RNA, 16 nt, Chlamydophila pneumoniae CWL029
cucguacguggaaagu

SEQ ID NO: 2530545 - RNA, 14 nt, Chlamydophila pneumoniae CWL029
cucgugcauaauga

SEQ ID NO: 2530546 - RNA, 15 nt, Chlamydophila pneumoniae CWL029
cucguugccaaucuu

SEQ ID NO: 2530547 - RNA, 21 nt, Chlamydophila pneumoniae CWL029
cucuaaaaaagauaaagcuac

SEQ ID NO: 2530548 - RNA, 21 nt, Chlamydophila pneumoniae CWL029
cucuaaaaacccuaguucauu

SEQ ID NO: 2530549 - RNA, 21 nt, Chlamydophila pneumoniae CWL029
cucuaaacauaaagacccuuc

SEQ ID NO: 2530550 - RNA, 14 nt, Chlamydophila pneumoniae CWL029
cucuaagaggguuu

SEQ ID NO: 2530551 - RNA, 17 nt, Chlamydophila pneumoniae CWL029
cucuaagcgaaacauua

SEQ ID NO: 2530552 - RNA, 21 nt, Chlamydophila pneumoniae CWL029
cucuaaggacaaaucucccaa

SEQ ID NO: 2530553 - RNA, 22 nt, Chlamydophila pneumoniae CWL029
ccaggagagcuaacagcacgua

SEQ ID NO: 2530554 - RNA, 15 nt, Chlamydophila pneumoniae CWL029
ccaggagcuccuccu

SEQ ID NO: 2530555 - RNA, 19 nt, Chlamydophila pneumoniae CWL029
ccaggcugcgcuacaccca

SEQ ID NO: 2530556 - RNA, 15 nt, Chlamydophila pneumoniae CWL029
ccagggaucuucauc

SEQ ID NO: 2530557 - RNA, 23 nt, Chlamydophila pneumoniae CWL029
ccagggaucuucaucccuacccu

SEQ ID NO: 2530558 - RNA, 20 nt, Chlamydophila pneumoniae CWL029
ccaggguguuugcauaguau

SEQ ID NO: 2530559 - RNA, 19 nt, Chlamydophila pneumoniae CWL029
ccagguguagguuccugcu

SEQ ID NO: 2530560 - RNA, 17 nt, Chlamydophila pneumoniae CWL029
ccaguuucuugauauuu

SEQ ID NO: 2530561 - RNA, 20 nt, Chlamydophila pneumoniae CWL029
ccauaaagccccacccacuc

SEQ ID NO: 2530562 - RNA, 21 nt, Chlamydophila pneumoniae CWL029
ccauaaauacaggccugaugu

SEQ ID NO: 2530563 - RNA, 10 nt, Chlamydophila pneumoniae CWL029
ccauaacagu

SEQ ID NO: 2530564 - RNA, 15 nt, Chlamydophila pneumoniae CWL029
ccauaagaucaauau

SEQ ID NO: 2530565 - RNA, 17 nt, Chlamydophila pneumoniae CWL029
ccauaagcuuuucuucc

SEQ ID NO: 2530566 - RNA, 19 nt, Chlamydophila pneumoniae CWL029
ccauaaggagauuccuaaa

SEQ ID NO: 2530567 - RNA, 16 nt, Chlamydophila pneumoniae CWL029
ccauaaguucacgauu

SEQ ID NO: 2530568 - RNA, 20 nt, Chlamydophila pneumoniae CWL029
ccauaaugagacagacaguc

SEQ ID NO: 2530569 - RNA, 22 nt, Chlamydophila pneumoniae CWL029
ccauaaugagacagacagucug

SEQ ID NO: 2530570 - RNA, 22 nt, Chlamydophila pneumoniae CWL029
ccauaauuagaacagcauggac

SEQ ID NO: 2530571 - RNA, 18 nt, Chlamydophila pneumoniae CWL029
ccauaauuucuuucacau

SEQ ID NO: 2530572 - RNA, 20 nt, Chlamydophila pneumoniae CWL029
ccauaauuucuuucacaucu

SEQ ID NO: 2530573 - RNA, 19 nt, Chlamydophila pneumoniae CWL029
ccauaauuuuagcuucuuu

SEQ ID NO: 2530574 - RNA, 15 nt, Chlamydophila pneumoniae CWL029
ccauacauagggaaa

SEQ ID NO: 2530575 - RNA, 12 nt, Chlamydophila pneumoniae CWL029
ccauacccaaau

SEQ ID NO: 2530576 - RNA, 16 nt, Chlamydophila pneumoniae CWL029
ccauacugauauacag

SEQ ID NO: 2530577 - RNA, 18 nt, Chlamydophila pneumoniae CWL029
ccauacugauauacaguu

SEQ ID NO: 2530578 - RNA, 17 nt, Chlamydophila pneumoniae CWL029
ccauagaguucgcacua

SEQ ID NO: 2530579 - RNA, 12 nt, Chlamydophila pneumoniae CWL029
ccauagcaaugc

SEQ ID NO: 2530580 - RNA, 19 nt, Chlamydophila pneumoniae CWL029
ccauagcgauagcuaaacc

SEQ ID NO: 2530581 - RNA, 15 nt, Chlamydophila pneumoniae CWL029
ccauauaauagauau

SEQ ID NO: 2530582 - RNA, 16 nt, Chlamydophila pneumoniae CWL029
ccauaucaaagaucug

SEQ ID NO: 2530583 - RNA, 18 nt, Chlamydophila pneumoniae CWL029
ccauauuugaauaaagga

SEQ ID NO: 2530584 - RNA, 17 nt, Chlamydophila pneumoniae CWL029
ccaucacuuccuguugu

SEQ ID NO: 2530585 - RNA, 23 nt, Chlamydophila pneumoniae CWL029
ccaucauaaaacgugauugcugc

SEQ ID NO: 2530586 - RNA, 17 nt, Chlamydophila pneumoniae CWL029
ccaucaucgaagaacuu

SEQ ID NO: 2530587 - RNA, 13 nt, Chlamydophila pneumoniae CWL029
ccauccacgaccu

SEQ ID NO: 2530588 - RNA, 18 nt, Chlamydophila pneumoniae CWL029
ccauccacgaccugcaaa

SEQ ID NO: 2530589 - RNA, 15 nt, Chlamydophila pneumoniae CWL029
ccaucccauauggau

SEQ ID NO: 2530590 - RNA, 22 nt, Chlamydophila pneumoniae CWL029
ccaucggaauuugccugaaauc

SEQ ID NO: 2530591 - RNA, 20 nt, Chlamydophila pneumoniae CWL029
ccaucggcauuucuccacau

SEQ ID NO: 2530592 - RNA, 15 nt, Chlamydophila pneumoniae CWL029
ccaucuaauccuguu

SEQ ID NO: 2530593 - RNA, 20 nt, Chlamydophila pneumoniae CWL029
ccaucucaugcggacuuuau

SEQ ID NO: 2530594 - RNA, 16 nt, Chlamydophila pneumoniae CWL029
ccaucuuguucuaaaa

SEQ ID NO: 2530595 - RNA, 15 nt, Chlamydophila pneumoniae CWL029
ccaugagaugggcua

SEQ ID NO: 2530596 - RNA, 15 nt, Chlamydophila pneumoniae CWL029
ccaugagcucaggca

SEQ ID NO: 2530597 - RNA, 20 nt, Chlamydophila pneumoniae CWL029
ccauggaauggcuacuuuaa

SEQ ID NO: 2530598 - RNA, 14 nt, Chlamydophila pneumoniae CWL029
ccauggcuggaaag

SEQ ID NO: 2530599 - RNA, 17 nt, Chlamydophila pneumoniae CWL029
ccauggcuggaaagcca

SEQ ID NO: 2530600 - RNA, 21 nt, Chlamydophila pneumoniae CWL029
ccaugucuaaagauuggaaua

SEQ ID NO: 2530601 - RNA, 15 nt, Chlamydophila pneumoniae CWL029
ccaugucuaaaggag

SEQ ID NO: 2530602 - RNA, 17 nt, Chlamydophila pneumoniae CWL029
ccaugucuaaaggagug

SEQ ID NO: 2530603 - RNA, 13 nt, Chlamydophila pneumoniae CWL029
ccauuaaggaauc

SEQ ID NO: 2530604 - RNA, 17 nt, Chlamydophila pneumoniae CWL029
ccauuaauaucccaguu

SEQ ID NO: 2530605 - RNA, 14 nt, Chlamydophila pneumoniae CWL029
ccauucacaaaucu

SEQ ID NO: 2530606 - RNA, 18 nt, Chlamydophila pneumoniae CWL029
ccauucacaaaucuuccc

SEQ ID NO: 2530607 - RNA, 20 nt, Chlamydophila pneumoniae CWL029
ccauucagauggucagucuc

SEQ ID NO: 2530608 - RNA, 15 nt, Chlamydophila pneumoniae CWL029
ccauuccuuaggaug

SEQ ID NO: 2530609 - RNA, 18 nt, Chlamydophila pneumoniae CWL029
ccauugaucagaaucuaa

SEQ ID NO: 2530610 - RNA, 22 nt, Chlamydophila pneumoniae CWL029
ccauugaucagaaucuaaguaa

SEQ ID NO: 2530611 - RNA, 18 nt, Chlamydophila pneumoniae CWL029
ccauuucauguaagaaug

SEQ ID NO: 2530612 - RNA, 20 nt, Chlamydophila pneumoniae CWL029
ccauuucuaggaauugcugu

SEQ ID NO: 2530613 - RNA, 14 nt, Chlamydophila pneumoniae CWL029
ccauuuggagagcu

SEQ ID NO: 2530614 - RNA, 17 nt, Chlamydophila pneumoniae CWL029
ccauuuucuaagagauc

SEQ ID NO: 2530615 - RNA, 13 nt, Chlamydophila pneumoniae CWL029
ccauuuuuccucc

SEQ ID NO: 2530616 - RNA, 15 nt, Chlamydophila pneumoniae CWL029
ccauuuuuccuccuc

SEQ ID NO: 2530617 - RNA, 18 nt, Chlamydophila pneumoniae CWL029
ccauuuuuggaaaaccau

SEQ ID NO: 2530618 - RNA, 12 nt, Chlamydophila pneumoniae CWL029
cccaaagcagau

SEQ ID NO: 2530619 - RNA, 15 nt, Chlamydophila pneumoniae CWL029
cccaaagcuaaaaug

SEQ ID NO: 2530620 - RNA, 19 nt, Chlamydophila pneumoniae CWL029
cccaaauagcuacagcgcu

SEQ ID NO: 2530621 - RNA, 13 nt, Chlamydophila pneumoniae CWL029
cccaagggccaga

SEQ ID NO: 2530622 - RNA, 20 nt, Chlamydophila pneumoniae CWL029
cccaagggccgaaccaaaau

SEQ ID NO: 2530623 - RNA, 16 nt, Chlamydophila pneumoniae CWL029
cccaauauccagaaau

SEQ ID NO: 2530624 - RNA, 18 nt, Chlamydophila pneumoniae CWL029
cccaaucaguucaucuag

SEQ ID NO: 2530625 - RNA, 14 nt, Chlamydophila pneumoniae CWL029
cccaauuucuuuuu

SEQ ID NO: 2530626 - RNA, 21 nt, Chlamydophila pneumoniae CWL029
cccaccaaagugacuuccucc

SEQ ID NO: 2530627 - RNA, 11 nt, Chlamydophila pneumoniae CWL029
cccaccagaag

SEQ ID NO: 2530628 - RNA, 16 nt, Chlamydophila pneumoniae CWL029
cccaccauucuugaag

SEQ ID NO: 2530629 - RNA, 14 nt, Chlamydophila pneumoniae CWL029
cccacuagcccuug

SEQ ID NO: 2530630 - RNA, 14 nt, Chlamydophila pneumoniae CWL029
cccauaaaaauuaa

SEQ ID NO: 2530631 - RNA, 14 nt, Chlamydophila pneumoniae CWL029
cccauagagccuug

SEQ ID NO: 2530632 - RNA, 13 nt, Chlamydophila pneumoniae CWL029
cccauagcaugag

SEQ ID NO: 2530633 - RNA, 13 nt, Chlamydophila pneumoniae CWL029
cccauauuccuau

SEQ ID NO: 2530634 - RNA, 12 nt, Chlamydophila pneumoniae CWL029
cccauguuucuu

SEQ ID NO: 2530635 - RNA, 11 nt, Chlamydophila pneumoniae CWL029
cccauuacagc

SEQ ID NO: 2530636 - RNA, 14 nt, Chlamydophila pneumoniae CWL029
cugagcuaucuuca

SEQ ID NO: 2530637 - RNA, 17 nt, Chlamydophila pneumoniae CWL029
cugagcuucuauuucua

SEQ ID NO: 2530638 - RNA, 12 nt, Chlamydophila pneumoniae CWL029
cugaggaaaucg

SEQ ID NO: 2530639 - RNA, 21 nt, Chlamydophila pneumoniae CWL029
cugaggaaaucgcauuacaaa

SEQ ID NO: 2530640 - RNA, 17 nt, Chlamydophila pneumoniae CWL029
cugaggacgcagagaug

SEQ ID NO: 2530641 - RNA, 16 nt, Chlamydophila pneumoniae CWL029
cugagguuauuuaauc

SEQ ID NO: 2530642 - RNA, 17 nt, Chlamydophila pneumoniae CWL029
cugaguauuuugcaaau

SEQ ID NO: 2530643 - RNA, 23 nt, Chlamydophila pneumoniae CWL029
cugagucauaagcucuauuucug

SEQ ID NO: 2530644 - RNA, 18 nt, Chlamydophila pneumoniae CWL029
cugauacaucaucagaag

SEQ ID NO: 2530645 - RNA, 19 nt, Chlamydophila pneumoniae CWL029
cugauacgcagcuagaggc

SEQ ID NO: 2530646 - RNA, 14 nt, Chlamydophila pneumoniae CWL029
cugauccagcucca

SEQ ID NO: 2530647 - RNA, 17 nt, Chlamydophila pneumoniae CWL029
cugauccagcuccauaa

SEQ ID NO: 2530648 - RNA, 15 nt, Chlamydophila pneumoniae CWL029
cugaugaccucaucu

SEQ ID NO: 2530649 - RNA, 17 nt, Chlamydophila pneumoniae CWL029
cugaugaccucaucucg

SEQ ID NO: 2530650 - RNA, 14 nt, Chlamydophila pneumoniae CWL029
cugaugccaagaaa

SEQ ID NO: 2530651 - RNA, 22 nt, Chlamydophila pneumoniae CWL029
cugaugcugaggacgcagagau

SEQ ID NO: 2530652 - RNA, 23 nt, Chlamydophila pneumoniae CWL029
cugauguaggugauauuuucuug

SEQ ID NO: 2530653 - RNA, 20 nt, Chlamydophila pneumoniae CWL029
cugauuaguucucuaagacu

SEQ ID NO: 2530654 - RNA, 20 nt, Chlamydophila pneumoniae CWL029
cugauuauuucuaaaaaaua

SEQ ID NO: 2530655 - RNA, 16 nt, Chlamydophila pneumoniae CWL029
cugauuucuuuuucag

SEQ ID NO: 2530656 - RNA, 21 nt, Chlamydophila pneumoniae CWL029
cugauuucuuuuucagcuucu

SEQ ID NO: 2530657 - RNA, 23 nt, Chlamydophila pneumoniae CWL029
cugcaaacgcaaugauuucucua

SEQ ID NO: 2530658 - RNA, 22 nt, Chlamydophila pneumoniae CWL029
cugcaaacuccccaguuuucca

SEQ ID NO: 2530659 - RNA, 21 nt, Chlamydophila pneumoniae CWL029
cugcaaagcccccucccccac

SEQ ID NO: 2530660 - RNA, 16 nt, Chlamydophila pneumoniae CWL029
cugcacuuucuuuuuu

SEQ ID NO: 2530661 - RNA, 18 nt, Chlamydophila pneumoniae CWL029
cugcacuuucuuuuuuaa

SEQ ID NO: 2530662 - RNA, 11 nt, Chlamydophila pneumoniae CWL029
cugcagaagua

SEQ ID NO: 2530663 - RNA, 18 nt, Chlamydophila pneumoniae CWL029
gaaagagcuaaagaaacu

SEQ ID NO: 2530664 - RNA, 16 nt, Chlamydophila pneumoniae CWL029
gaaagagucccugauu

SEQ ID NO: 2530665 - RNA, 18 nt, Chlamydophila pneumoniae CWL029
gaaagagugccaagagca

SEQ ID NO: 2530666 - RNA, 20 nt, Chlamydophila pneumoniae CWL029
gaaagauaucccaaagcuag

SEQ ID NO: 2530667 - RNA, 19 nt, Chlamydophila pneumoniae CWL029
gaaagauucugcccaaagc

SEQ ID NO: 2530668 - RNA, 13 nt, Chlamydophila pneumoniae CWL029
gaaagcacauaag

SEQ ID NO: 2530669 - RNA, 17 nt, Chlamydophila pneumoniae CWL029
gaaagccaagaagaugu

SEQ ID NO: 2530670 - RNA, 21 nt, Chlamydophila pneumoniae CWL029
gaaagccuuugcucacuguuu

SEQ ID NO: 2530671 - RNA, 22 nt, Chlamydophila pneumoniae CWL029
gaaagcguuucgauaauuuuca

SEQ ID NO: 2530672 - RNA, 14 nt, Chlamydophila pneumoniae CWL029
gaaagcuguauugg

SEQ ID NO: 2530673 - RNA, 14 nt, Chlamydophila pneumoniae CWL029
gaaaggaccuccuc

SEQ ID NO: 2530674 - RNA, 20 nt, Chlamydophila pneumoniae CWL029
gaaaggcacuccaaaacuca

SEQ ID NO: 2530675 - RNA, 18 nt, Chlamydophila pneumoniae CWL029
gaaaggcugauaagauca

SEQ ID NO: 2530676 - RNA, 16 nt, Chlamydophila pneumoniae CWL029
gaaagguaguuuucuu

SEQ ID NO: 2530677 - RNA, 19 nt, Chlamydophila pneumoniae CWL029
gaaaguaccuauugugcuu

SEQ ID NO: 2530678 - RNA, 19 nt, Chlamydophila pneumoniae CWL029
gaaaguagcaucccaaguu

SEQ ID NO: 2530679 - RNA, 23 nt, Chlamydophila pneumoniae CWL029
gcauuuaaaacggcuguacuucc

SEQ ID NO: 2530680 - RNA, 16 nt, Chlamydophila pneumoniae CWL029
gcauuuaaacuaagaa

SEQ ID NO: 2530681 - RNA, 22 nt, Chlamydophila pneumoniae CWL029
gcauuuaaacuaagaauaccua

SEQ ID NO: 2530682 - RNA, 15 nt, Chlamydophila pneumoniae CWL029
gcauuucuuucucuu

SEQ ID NO: 2530683 - RNA, 21 nt, Chlamydophila pneumoniae CWL029
gcauuugccccuuccaauacu

SEQ ID NO: 2530684 - RNA, 19 nt, Chlamydophila pneumoniae CWL029
gcauuuuacgaaucuuuuu

SEQ ID NO: 2530685 - RNA, 12 nt, Chlamydophila pneumoniae CWL029
gcauuuucucug

SEQ ID NO: 2530686 - RNA, 17 nt, Chlamydophila pneumoniae CWL029
gcauuuucuucuugcaa

SEQ ID NO: 2530687 - RNA, 20 nt, Chlamydophila pneumoniae CWL029
gccaaagucacucaaacccu

SEQ ID NO: 2530688 - RNA, 14 nt, Chlamydophila pneumoniae CWL029
gccaaauaccaagg

SEQ ID NO: 2530689 - RNA, 13 nt, Chlamydophila pneumoniae CWL029
gccaagaaauaua

SEQ ID NO: 2530690 - RNA, 20 nt, Chlamydophila pneumoniae CWL029
gccaagauacuacuuacaag

SEQ ID NO: 2530691 - RNA, 19 nt, Chlamydophila pneumoniae CWL029
gccaagggcuuggcuccug

SEQ ID NO: 2530692 - RNA, 12 nt, Chlamydophila pneumoniae CWL029
gccaaggucuuc

SEQ ID NO: 2530693 - RNA, 16 nt, Chlamydophila pneumoniae CWL029
gccaaggucuucccga

SEQ ID NO: 2530694 - RNA, 18 nt, Chlamydophila pneumoniae CWL029
gccaaucccuaagguuuc

SEQ ID NO: 2530695 - RNA, 22 nt, Chlamydophila pneumoniae CWL029
gccaaucccuaagguuuccaug

SEQ ID NO: 2530696 - RNA, 17 nt, Chlamydophila pneumoniae CWL029
gccaaucuuccuuaacc

SEQ ID NO: 2530697 - RNA, 16 nt, Chlamydophila pneumoniae CWL029
gccaauuuuuguagac

SEQ ID NO: 2530698 - RNA, 16 nt, Chlamydophila pneumoniae CWL029
gccacccccacuucuu

SEQ ID NO: 2530699 - RNA, 21 nt, Chlamydophila pneumoniae CWL029
gccacuaaguuuaggcaggaa

SEQ ID NO: 2530700 - RNA, 22 nt, Chlamydophila pneumoniae CWL029
gccacuaaguuuaggcaggaag

SEQ ID NO: 2530701 - RNA, 12 nt, Chlamydophila pneumoniae CWL029
gccagcagaagg

SEQ ID NO: 2530702 - RNA, 20 nt, Chlamydophila pneumoniae CWL029
gccagcagaaguuccuucag

SEQ ID NO: 2530703 - RNA, 23 nt, Chlamydophila pneumoniae CWL029
gccagcagcgaggaguuuuccaa

SEQ ID NO: 2530704 - RNA, 21 nt, Chlamydophila pneumoniae CWL029
gccagcgaucacauagaaaac

SEQ ID NO: 2530705 - RNA, 20 nt, Chlamydophila pneumoniae CWL029
gccaggagagcuaacagcac

SEQ ID NO: 2530706 - RNA, 22 nt, Chlamydophila pneumoniae CWL029
gccaguuacugucugcaaagag

SEQ ID NO: 2530707 - RNA, 15 nt, Chlamydophila pneumoniae CWL029
gccaguucuugaaac

SEQ ID NO: 2530708 - RNA, 18 nt, Chlamydophila pneumoniae CWL029
gccaguucuugaaacucu

SEQ ID NO: 2530709 - RNA, 21 nt, Chlamydophila pneumoniae CWL029
gccaguucuugaaacucuauc

SEQ ID NO: 2530710 - RNA, 18 nt, Chlamydophila pneumoniae CWL029
gccauaaauacaggccug

SEQ ID NO: 2530711 - RNA, 14 nt, Chlamydophila pneumoniae CWL029
gccaucaucaccag

SEQ ID NO: 2530712 - RNA, 15 nt, Chlamydophila pneumoniae CWL029
gccauucuuaucugc

SEQ ID NO: 2530713 - RNA, 15 nt, Chlamydophila pneumoniae CWL029
gccauugaucagaau

SEQ ID NO: 2530714 - RNA, 20 nt, Chlamydophila pneumoniae CWL029
gccauuugguaguuuuucag

SEQ ID NO: 2530715 - RNA, 15 nt, Chlamydophila pneumoniae CWL029
gccauuuucuaagag

SEQ ID NO: 2530716 - RNA, 15 nt, Chlamydophila pneumoniae CWL029
gcccaaggaaaaaca

SEQ ID NO: 2530717 - RNA, 23 nt, Chlamydophila pneumoniae CWL029
gcccaaguuguagugaaugagcu

SEQ ID NO: 2530718 - RNA, 18 nt, Chlamydophila pneumoniae CWL029
gcccagauucugaagaga

SEQ ID NO: 2530719 - RNA, 16 nt, Chlamydophila pneumoniae CWL029
gcccauaaaggcgucg

SEQ ID NO: 2530720 - RNA, 17 nt, Chlamydophila pneumoniae CWL029
gcccauuaacuaagaua

SEQ ID NO: 2530721 - RNA, 21 nt, Chlamydophila pneumoniae CWL029
gccccaugaaucacagcgcug

SEQ ID NO: 2530722 - RNA, 14 nt, Chlamydophila pneumoniae CWL029
gcccccaggcugca

SEQ ID NO: 2530723 - RNA, 16 nt, Chlamydophila pneumoniae CWL029
gcccccucccccacca

SEQ ID NO: 2530724 - RNA, 16 nt, Chlamydophila pneumoniae CWL029
gccccuccgauugcua

SEQ ID NO: 2530725 - RNA, 18 nt, Chlamydophila pneumoniae CWL029
gccccuggaauuucucca

SEQ ID NO: 2530726 - RNA, 23 nt, Chlamydophila pneumoniae CWL029
gcccgaaucuuucaaaagaaauc

SEQ ID NO: 2530727 - RNA, 24 nt, Chlamydophila pneumoniae CWL029
gcccgacucaucuaacgucagcug

SEQ ID NO: 2530728 - RNA, 23 nt, Chlamydophila pneumoniae CWL029
gcccgucuuagaauccaaagacu

SEQ ID NO: 2530729 - RNA, 15 nt, Chlamydophila pneumoniae CWL029
gcccuagauagcaaa

SEQ ID NO: 2530730 - RNA, 19 nt, Chlamydophila pneumoniae CWL029
gcccuagauagcaaaucaa

SEQ ID NO: 2530731 - RNA, 21 nt, Chlamydophila pneumoniae CWL029
gcccucauccccucagaaagg

SEQ ID NO: 2530732 - RNA, 23 nt, Chlamydophila pneumoniae CWL029
gcccucgguuauuuuuccagaaa

SEQ ID NO: 2530733 - RNA, 19 nt, Chlamydophila pneumoniae CWL029
gcccugucacuaucuucua

SEQ ID NO: 2530734 - RNA, 18 nt, Chlamydophila pneumoniae CWL029
gcccuugaaucauagaga

SEQ ID NO: 2530735 - RNA, 19 nt, Chlamydophila pneumoniae CWL029
gcccuugcagcgacaacac

SEQ ID NO: 2530736 - RNA, 22 nt, Chlamydophila pneumoniae CWL029
gcccuuucugcaaucugaaugc

SEQ ID NO: 2530737 - RNA, 16 nt, Chlamydophila pneumoniae CWL029
gccgaaccaaaaugag

SEQ ID NO: 2530738 - RNA, 15 nt, Chlamydophila pneumoniae CWL029
gccgaccaucauaau

SEQ ID NO: 2530739 - RNA, 20 nt, Chlamydophila pneumoniae CWL029
gccgacucuacaucuucuug

SEQ ID NO: 2530740 - RNA, 14 nt, Chlamydophila pneumoniae CWL029
gccgcauuucuuca

SEQ ID NO: 2530741 - RNA, 21 nt, Chlamydophila pneumoniae CWL029
gccguauagauuuuccgcaaa

SEQ ID NO: 2530742 - RNA, 21 nt, Chlamydophila pneumoniae CWL029
gccgugccuauagaaauuaga

SEQ ID NO: 2530743 - RNA, 20 nt, Chlamydophila pneumoniae CWL029
gccuaaagcuccgagaaaca

SEQ ID NO: 2530744 - RNA, 20 nt, Chlamydophila pneumoniae CWL029
gccuacaggcaaggagagcu

SEQ ID NO: 2530745 - RNA, 17 nt, Chlamydophila pneumoniae CWL029
gccuauagauuccccaa

SEQ ID NO: 2530746 - RNA, 23 nt, Chlamydophila pneumoniae CWL029
gccuaugggaggaauuccucuca

SEQ ID NO: 2530747 - RNA, 12 nt, Chlamydophila pneumoniae CWL029
gccucacagaau

SEQ ID NO: 2530748 - RNA, 12 nt, Chlamydophila pneumoniae CWL029
gccucauugccg

SEQ ID NO: 2530749 - RNA, 15 nt, Chlamydophila pneumoniae CWL029
gccuccaccugcagc

SEQ ID NO: 2530750 - RNA, 20 nt, Chlamydophila pneumoniae CWL029
gccuccaccugcagcgcagc

SEQ ID NO: 2530751 - RNA, 15 nt, Chlamydophila pneumoniae CWL029
gccucccgaagacaa

SEQ ID NO: 2530752 - RNA, 15 nt, Chlamydophila pneumoniae CWL029
gccuccuucauucac

SEQ ID NO: 2530753 - RNA, 23 nt, Chlamydophila pneumoniae CWL029
gccugaaaacaaggcaaaaaguu

SEQ ID NO: 2530754 - RNA, 18 nt, Chlamydophila pneumoniae CWL029
gccugagaccauaaaauc

SEQ ID NO: 2530755 - RNA, 19 nt, Chlamydophila pneumoniae CWL029
gccugaugucuccauacag

SEQ ID NO: 2530756 - RNA, 15 nt, Chlamydophila pneumoniae CWL029
gccugcacgucugca

SEQ ID NO: 2530757 - RNA, 17 nt, Chlamydophila pneumoniae CWL029
gccuggaaagcuucugg

SEQ ID NO: 2530758 - RNA, 19 nt, Chlamydophila pneumoniae CWL029
gccuggccaucaucaccag

SEQ ID NO: 2530759 - RNA, 23 nt, Chlamydophila pneumoniae CWL029
gccugucacaauaccaucucuuu

SEQ ID NO: 2530760 - RNA, 22 nt, Chlamydophila pneumoniae CWL029
gccugucuauaaaauaaauuuu

SEQ ID NO: 2530761 - RNA, 23 nt, Chlamydophila pneumoniae CWL029
gccuguuuucuucuaccuguagc

SEQ ID NO: 2530762 - RNA, 13 nt, Chlamydophila pneumoniae CWL029
gccuuaaauguau

SEQ ID NO: 2530763 - RNA, 12 nt, Chlamydophila pneumoniae CWL029
gccuucauucca

SEQ ID NO: 2530764 - RNA, 17 nt, Chlamydophila pneumoniae CWL029
gccuuccauaucuagaa

SEQ ID NO: 2530765 - RNA, 23 nt, Chlamydophila pneumoniae CWL029
gccuuccauaucuagaaguuuaa

SEQ ID NO: 2530766 - RNA, 19 nt, Chlamydophila pneumoniae CWL029
gccuucucauugcggcacc

SEQ ID NO: 2530767 - RNA, 20 nt, Chlamydophila pneumoniae CWL029
gccuugauccuuuccaagaa

SEQ ID NO: 2530768 - RNA, 17 nt, Chlamydophila pneumoniae CWL029
gccuugauugaacaguc

SEQ ID NO: 2530769 - RNA, 13 nt, Chlamydophila pneumoniae CWL029
gccuugcugcaua

SEQ ID NO: 2530770 - RNA, 19 nt, Chlamydophila pneumoniae CWL029
gccuuggguuugucuccaa

SEQ ID NO: 2530771 - RNA, 18 nt, Chlamydophila pneumoniae CWL029
gccuuuagggaaaaagua

SEQ ID NO: 2530772 - RNA, 11 nt, Chlamydophila pneumoniae CWL029
gccuuucucuu

SEQ ID NO: 2530773 - RNA, 12 nt, Chlamydophila pneumoniae CWL029
gccuuuucagau

SEQ ID NO: 2530774 - RNA, 20 nt, Chlamydophila pneumoniae CWL029
gccuuuuccuaaaucugcuu

SEQ ID NO: 2530775 - RNA, 11 nt, Chlamydophila pneumoniae CWL029
gccuuuuucuu

SEQ ID NO: 2530776 - RNA, 13 nt, Chlamydophila pneumoniae CWL029
gccuuuuuuucua

SEQ ID NO: 2530777 - RNA, 17 nt, Chlamydophila pneumoniae CWL029
gacuauguuuaaagcau

SEQ ID NO: 2530778 - RNA, 14 nt, Chlamydophila pneumoniae CWL029
gacuauuuuggaaa

SEQ ID NO: 2530779 - RNA, 21 nt, Chlamydophila pneumoniae CWL029
gacuauuuuggaaagcucuuu

SEQ ID NO: 2530780 - RNA, 19 nt, Chlamydophila pneumoniae CWL029
gacuccaagaauagcagga

SEQ ID NO: 2530781 - RNA, 22 nt, Chlamydophila pneumoniae CWL029
gacucgccgaaaguaucuucag

SEQ ID NO: 2530782 - RNA, 14 nt, Chlamydophila pneumoniae CWL029
gacucuagaguacc

SEQ ID NO: 2530783 - RNA, 17 nt, Chlamydophila pneumoniae CWL029
gacucuaguuuuucuuu

SEQ ID NO: 2530784 - RNA, 19 nt, Chlamydophila pneumoniae CWL029
gacucucacugaguguccc

SEQ ID NO: 2530785 - RNA, 23 nt, Chlamydophila pneumoniae CWL029
gacucucaucagcaaaacucccg

SEQ ID NO: 2530786 - RNA, 18 nt, Chlamydophila pneumoniae CWL029
gacucuuccaauuguaaa

SEQ ID NO: 2530787 - RNA, 12 nt, Chlamydophila pneumoniae CWL029
gacucuuuuaag

SEQ ID NO: 2530788 - RNA, 10 nt, Chlamydophila pneumoniae CWL029
gacugaaacu

SEQ ID NO: 2530789 - RNA, 11 nt, Chlamydophila pneumoniae CWL029
gacugaaacuc

SEQ ID NO: 2530790 - RNA, 17 nt, Chlamydophila pneumoniae CWL029
gacugcagauugcacuu

SEQ ID NO: 2530791 - RNA, 14 nt, Chlamydophila pneumoniae CWL029
gacugcuagagucc

SEQ ID NO: 2530792 - RNA, 15 nt, Chlamydophila pneumoniae CWL029
gacugcucuuucauu

SEQ ID NO: 2530793 - RNA, 18 nt, Chlamydophila pneumoniae CWL029
gacugcugacaucuccaa

SEQ ID NO: 2530794 - RNA, 18 nt, Chlamydophila pneumoniae CWL029
gacuggcgacuugccaau

SEQ ID NO: 2530795 - RNA, 15 nt, Chlamydophila pneumoniae CWL029
gacuguacaaaugca

SEQ ID NO: 2530796 - RNA, 20 nt, Chlamydophila pneumoniae CWL029
gacuucaccuugaaguuuuu

SEQ ID NO: 2530797 - RNA, 19 nt, Chlamydophila pneumoniae CWL029
gacuucgaugucuuuccag

SEQ ID NO: 2530798 - RNA, 15 nt, Chlamydophila pneumoniae CWL029
gacuucgcaaauuuu

SEQ ID NO: 2530799 - RNA, 13 nt, Chlamydophila pneumoniae CWL029
gacuucucaaaga

SEQ ID NO: 2530800 - RNA, 18 nt, Chlamydophila pneumoniae CWL029
gacuucuggaagcuguug

SEQ ID NO: 2530801 - RNA, 22 nt, Chlamydophila pneumoniae CWL029
gacuucuggaagcuguuguucu

SEQ ID NO: 2530802 - RNA, 20 nt, Chlamydophila pneumoniae CWL029
gacuucuuguccuguuaaga

SEQ ID NO: 2530803 - RNA, 20 nt, Chlamydophila pneumoniae CWL029
gacuugccaaucuuccuuaa

SEQ ID NO: 2530804 - RNA, 23 nt, Chlamydophila pneumoniae CWL029
gacuuuagaaauuccaauuuuug

SEQ ID NO: 2530805 - RNA, 17 nt, Chlamydophila pneumoniae CWL029
gacuuucauaugaauga

SEQ ID NO: 2530806 - RNA, 15 nt, Chlamydophila pneumoniae CWL029
gacuuuuuuaagagu

SEQ ID NO: 2530807 - RNA, 13 nt, Chlamydophila pneumoniae CWL029
gagaaaaucaacu

SEQ ID NO: 2530808 - RNA, 23 nt, Chlamydophila pneumoniae CWL029
gagaaacacaaauucaccaacca

SEQ ID NO: 2530809 - RNA, 19 nt, Chlamydophila pneumoniae CWL029
gagaaaggcgcucuuaccu

SEQ ID NO: 2530810 - RNA, 15 nt, Chlamydophila pneumoniae CWL029
gaacucuuuaaaagg

SEQ ID NO: 2530811 - RNA, 13 nt, Chlamydophila pneumoniae CWL029
gaacugaagaguc

SEQ ID NO: 2530812 - RNA, 15 nt, Chlamydophila pneumoniae CWL029
gaacuguacgaauuu

SEQ ID NO: 2530813 - RNA, 14 nt, Chlamydophila pneumoniae CWL029
gaacuuaaaauuca

SEQ ID NO: 2530814 - RNA, 14 nt, Chlamydophila pneumoniae CWL029
gaacuucagcaaga

SEQ ID NO: 2530815 - RNA, 18 nt, Chlamydophila pneumoniae CWL029
gaacuucagcaagaaaau

SEQ ID NO: 2530816 - RNA, 15 nt, Chlamydophila pneumoniae CWL029
gaacuuccugauucu

SEQ ID NO: 2530817 - RNA, 14 nt, Chlamydophila pneumoniae CWL029
gaacuugggaugcu

SEQ ID NO: 2530818 - RNA, 14 nt, Chlamydophila pneumoniae CWL029
gaacuuuagggaag

SEQ ID NO: 2530819 - RNA, 22 nt, Chlamydophila pneumoniae CWL029
gaacuuugaccagaugauuuuu

SEQ ID NO: 2530820 - RNA, 19 nt, Chlamydophila pneumoniae CWL029
gaagaaacuucucuaggaa

SEQ ID NO: 2530821 - RNA, 16 nt, Chlamydophila pneumoniae CWL029
gaagaacuuagcaaug

SEQ ID NO: 2530822 - RNA, 16 nt, Chlamydophila pneumoniae CWL029
gaagaaggacaacuag

SEQ ID NO: 2530823 - RNA, 15 nt, Chlamydophila pneumoniae CWL029
gagcuuccauagcuu

SEQ ID NO: 2530824 - RNA, 22 nt, Chlamydophila pneumoniae CWL029
gagcuuccauuggaauccuuug

SEQ ID NO: 2530825 - RNA, 17 nt, Chlamydophila pneumoniae CWL029
gagcuucuuuaucuagc

SEQ ID NO: 2530826 - RNA, 18 nt, Chlamydophila pneumoniae CWL029
gagcuugucuaggagcuu

SEQ ID NO: 2530827 - RNA, 13 nt, Chlamydophila pneumoniae CWL029
gagcuugucuucc

SEQ ID NO: 2530828 - RNA, 14 nt, Chlamydophila pneumoniae CWL029
gagcuugucuucca

SEQ ID NO: 2530829 - RNA, 15 nt, Chlamydophila pneumoniae CWL029
gagcuugucuuccac

SEQ ID NO: 2530830 - RNA, 20 nt, Chlamydophila pneumoniae CWL029
gagcuuuuagguagagaauc

SEQ ID NO: 2530831 - RNA, 15 nt, Chlamydophila pneumoniae CWL029
gagcuuuuaguaggu

SEQ ID NO: 2530832 - RNA, 21 nt, Chlamydophila pneumoniae CWL029
gagcuuuuugcuuuucccuuu

SEQ ID NO: 2530833 - RNA, 13 nt, Chlamydophila pneumoniae CWL029
gaggaacaauacu

SEQ ID NO: 2530834 - RNA, 15 nt, Chlamydophila pneumoniae CWL029
gaggaacgcacgcca

SEQ ID NO: 2530835 - RNA, 21 nt, Chlamydophila pneumoniae CWL029
gaggaacuucagcuuugcuua

SEQ ID NO: 2530836 - RNA, 22 nt, Chlamydophila pneumoniae CWL029
gaggaagcacaccaaguacagu

SEQ ID NO: 2530837 - RNA, 22 nt, Chlamydophila pneumoniae CWL029
gaggaaucauaaccaaaagaau

SEQ ID NO: 2530838 - RNA, 21 nt, Chlamydophila pneumoniae CWL029
gaggaaucugaaucucauaag

SEQ ID NO: 2530839 - RNA, 16 nt, Chlamydophila pneumoniae CWL029
gaggaauucuggaaca

SEQ ID NO: 2530840 - RNA, 23 nt, Chlamydophila pneumoniae CWL029
gaggaccgaaaaaccuucuccaa

SEQ ID NO: 2530841 - RNA, 20 nt, Chlamydophila pneumoniae CWL029
gaggagaauagcaagcacuu

SEQ ID NO: 2530842 - RNA, 19 nt, Chlamydophila pneumoniae CWL029
gaggagcgauagcucagcu

SEQ ID NO: 2530843 - RNA, 11 nt, Chlamydophila pneumoniae CWL029
gaggaggagca

SEQ ID NO: 2530844 - RNA, 15 nt, Chlamydophila pneumoniae CWL029
gaggagggaaacacc

SEQ ID NO: 2530845 - RNA, 19 nt, Chlamydophila pneumoniae CWL029
gaggaguccuucuagguau

SEQ ID NO: 2530846 - RNA, 19 nt, Chlamydophila pneumoniae CWL029
gaggauaaaugaguggguu

SEQ ID NO: 2530847 - RNA, 16 nt, Chlamydophila pneumoniae CWL029
gaggauugacaaucgc

SEQ ID NO: 2530848 - RNA, 16 nt, Chlamydophila pneumoniae CWL029
gaggcacauguaggau

SEQ ID NO: 2530849 - RNA, 13 nt, Chlamydophila pneumoniae CWL029
gaggcccgaagca

SEQ ID NO: 2530850 - RNA, 21 nt, Chlamydophila pneumoniae CWL029
gaggcggagguacguaucuuc

SEQ ID NO: 2530851 - RNA, 19 nt, Chlamydophila pneumoniae CWL029
gaggcuucugagcuugccu

SEQ ID NO: 2530852 - RNA, 21 nt, Chlamydophila pneumoniae CWL029
gagggaucauguagcagagcc

SEQ ID NO: 2530853 - RNA, 11 nt, Chlamydophila pneumoniae CWL029
gagggauuugu

SEQ ID NO: 2530854 - RNA, 18 nt, Chlamydophila pneumoniae CWL029
gaggggacggaaaaucac

SEQ ID NO: 2530855 - RNA, 13 nt, Chlamydophila pneumoniae CWL029
gagggucucagca

SEQ ID NO: 2530856 - RNA, 19 nt, Chlamydophila pneumoniae CWL029
gaggguggaacuauccugu

SEQ ID NO: 2530857 - RNA, 17 nt, Chlamydophila pneumoniae CWL029
gagguaaccagagagcu

SEQ ID NO: 2530858 - RNA, 18 nt, Chlamydophila pneumoniae CWL029
gaggucuuugaguagcca

SEQ ID NO: 2530859 - RNA, 20 nt, Chlamydophila pneumoniae CWL029
gaggucuuuucuuuuuagaa

SEQ ID NO: 2530860 - RNA, 15 nt, Chlamydophila pneumoniae CWL029
gagguugagcaagaa

SEQ ID NO: 2530861 - RNA, 23 nt, Chlamydophila pneumoniae CWL029
gagguuucgaagcguuaacaacu

SEQ ID NO: 2530862 - RNA, 17 nt, Chlamydophila pneumoniae CWL029
gaguaaggaacaaugua

SEQ ID NO: 2530863 - RNA, 19 nt, Chlamydophila pneumoniae CWL029
gaguaaggaacaauguaaa

SEQ ID NO: 2530864 - RNA, 23 nt, Chlamydophila pneumoniae CWL029
gaguaccgaccgaaucucuccag

SEQ ID NO: 2530865 - RNA, 13 nt, Chlamydophila pneumoniae CWL029
gaguagccccagc

SEQ ID NO: 2530866 - RNA, 23 nt, Chlamydophila pneumoniae CWL029
gaguagccccagcaacccgaauu

SEQ ID NO: 2530867 - RNA, 16 nt, Chlamydophila pneumoniae CWL029
gaguagcucaucuaga

SEQ ID NO: 2530868 - RNA, 15 nt, Chlamydophila pneumoniae CWL029
gaguaucuagcuuug

SEQ ID NO: 2530869 - RNA, 14 nt, Chlamydophila pneumoniae CWL029
gaguaugaggagau

SEQ ID NO: 2530870 - RNA, 19 nt, Chlamydophila pneumoniae CWL029
gaguauuuugcaaaugaaa

SEQ ID NO: 2530871 - RNA, 19 nt, Chlamydophila pneumoniae CWL029
gagucacggcaaugauagg

SEQ ID NO: 2530872 - RNA, 16 nt, Chlamydophila pneumoniae CWL029
gagucaggaagaugcu

SEQ ID NO: 2530873 - RNA, 17 nt, Chlamydophila pneumoniae CWL029
gagucaggaagaugcug

SEQ ID NO: 2530874 - RNA, 23 nt, Chlamydophila pneumoniae CWL029
gagucccuugucaacaaaagcua

SEQ ID NO: 2530875 - RNA, 23 nt, Chlamydophila pneumoniae CWL029
gaguccuuuuuguucaaagauug

SEQ ID NO: 2530876 - RNA, 15 nt, Chlamydophila pneumoniae CWL029
gagucgauuucccag

SEQ ID NO: 2530877 - RNA, 14 nt, Chlamydophila pneumoniae CWL029
gagucucuugauuc

SEQ ID NO: 2530878 - RNA, 20 nt, Chlamydophila pneumoniae CWL029
gagucucuugcuuuuguaga

SEQ ID NO: 2530879 - RNA, 13 nt, Chlamydophila pneumoniae CWL029
gagucucuuucag

SEQ ID NO: 2530880 - RNA, 19 nt, Chlamydophila pneumoniae CWL029
gagucucuuucagcucaag

SEQ ID NO: 2530881 - RNA, 22 nt, Chlamydophila pneumoniae CWL029
gagucugaacauucuuaauauc

SEQ ID NO: 2530882 - RNA, 21 nt, Chlamydophila pneumoniae CWL029
gagucugcagcagaugaaacu

SEQ ID NO: 2530883 - RNA, 14 nt, Chlamydophila pneumoniae CWL029
gagugacaccaaca

SEQ ID NO: 2530884 - RNA, 21 nt, Chlamydophila pneumoniae CWL029
gagugccaagagcaucacaaa

SEQ ID NO: 2530885 - RNA, 15 nt, Chlamydophila pneumoniae CWL029
gagugccuucuucaa

SEQ ID NO: 2530886 - RNA, 14 nt, Chlamydophila pneumoniae CWL029
gaguguauuguaaa

SEQ ID NO: 2530887 - RNA, 15 nt, Chlamydophila pneumoniae CWL029
gaguguauuguaaag

SEQ ID NO: 2530888 - RNA, 20 nt, Chlamydophila pneumoniae CWL029
gaguguuguuggagcagaaa

SEQ ID NO: 2530889 - RNA, 12 nt, Chlamydophila pneumoniae CWL029
gaguguuuucug

SEQ ID NO: 2530890 - RNA, 23 nt, Chlamydophila pneumoniae CWL029
gaguuccaagacaauaaaaaaga

SEQ ID NO: 2530891 - RNA, 20 nt, Chlamydophila pneumoniae CWL029
gaguuccgcaaauacagaca

SEQ ID NO: 2530892 - RNA, 19 nt, Chlamydophila pneumoniae CWL029
gaguucgcggaucuucuuc

SEQ ID NO: 2530893 - RNA, 17 nt, Chlamydophila pneumoniae CWL029
gaguucucucuucacuc

SEQ ID NO: 2530894 - RNA, 14 nt, Chlamydophila pneumoniae CWL029
gaguucuugauucu

SEQ ID NO: 2530895 - RNA, 17 nt, Chlamydophila pneumoniae CWL029
gaguucuuguaauaaaa

SEQ ID NO: 2530896 - RNA, 18 nt, Chlamydophila pneumoniae CWL029
gaguuucgaauucaauga

SEQ ID NO: 2530897 - RNA, 13 nt, Chlamydophila pneumoniae CWL029
gaguuucuaaugu

SEQ ID NO: 2530898 - RNA, 19 nt, Chlamydophila pneumoniae CWL029
gaguuucuuauucacugga

SEQ ID NO: 2530899 - RNA, 21 nt, Chlamydophila pneumoniae CWL029
gaguuuuaaacugcuacuuua

SEQ ID NO: 2530900 - RNA, 13 nt, Chlamydophila pneumoniae CWL029
gaguuuucaaacu

SEQ ID NO: 2530901 - RNA, 12 nt, Chlamydophila pneumoniae CWL029
gaguuuuccuaa

SEQ ID NO: 2530902 - RNA, 23 nt, Chlamydophila pneumoniae CWL029
gaguuuuuguguuugacugaaac

SEQ ID NO: 2530903 - RNA, 13 nt, Chlamydophila pneumoniae CWL029
gaguuuuuuucuu

SEQ ID NO: 2530904 - RNA, 22 nt, Chlamydophila pneumoniae CWL029
gaguuuuuuucuuauagggaau

SEQ ID NO: 2530905 - RNA, 17 nt, Chlamydophila pneumoniae CWL029
gauaaaacuauaaaagc

SEQ ID NO: 2530906 - RNA, 14 nt, Chlamydophila pneumoniae CWL029
gauaaaaucuucau

SEQ ID NO: 2530907 - RNA, 12 nt, Chlamydophila pneumoniae CWL029
gauaaacagcac

SEQ ID NO: 2530908 - RNA, 11 nt, Chlamydophila pneumoniae CWL029
gauaaacauac

SEQ ID NO: 2530909 - RNA, 19 nt, Chlamydophila pneumoniae CWL029
gauaaagacaucucuuuaa

SEQ ID NO: 2530910 - RNA, 16 nt, Chlamydophila pneumoniae CWL029
gauaaagccugcacga

SEQ ID NO: 2530911 - RNA, 19 nt, Chlamydophila pneumoniae CWL029
gauaaaggcauaacugugc

SEQ ID NO: 2530912 - RNA, 23 nt, Chlamydophila pneumoniae CWL029
gauaaauacccucggagacucag

SEQ ID NO: 2530913 - RNA, 15 nt, Chlamydophila pneumoniae CWL029
gauaaaucccgaaca

SEQ ID NO: 2530914 - RNA, 15 nt, Chlamydophila pneumoniae CWL029
gauaaauggaggaua

SEQ ID NO: 2530915 - RNA, 16 nt, Chlamydophila pneumoniae CWL029
gauaacguugccuguu

SEQ ID NO: 2530916 - RNA, 22 nt, Chlamydophila pneumoniae CWL029
gauaagaagcucguacuguucc

SEQ ID NO: 2530917 - RNA, 13 nt, Chlamydophila pneumoniae CWL029
gauaagauaaaga

SEQ ID NO: 2530918 - RNA, 15 nt, Chlamydophila pneumoniae CWL029
gauaagaucucuccg

SEQ ID NO: 2530919 - RNA, 13 nt, Chlamydophila pneumoniae CWL029
gauaaggaccagg

SEQ ID NO: 2530920 - RNA, 14 nt, Chlamydophila pneumoniae CWL029
gauaaguucuucca

SEQ ID NO: 2530921 - RNA, 15 nt, Chlamydophila pneumoniae CWL029
gauaaguucuuccaa

SEQ ID NO: 2530922 - RNA, 12 nt, Chlamydophila pneumoniae CWL029
gauaauagagaa

SEQ ID NO: 2530923 - RNA, 10 nt, Chlamydophila pneumoniae CWL029
gauaaucaaa

SEQ ID NO: 2530924 - RNA, 15 nt, Chlamydophila pneumoniae CWL029
gauaaucagaggagc

SEQ ID NO: 2530925 - RNA, 16 nt, Chlamydophila pneumoniae CWL029
gauaaucagaggagcc

SEQ ID NO: 2530926 - RNA, 22 nt, Chlamydophila pneumoniae CWL029
gauaaucgcacuucuauuucug

SEQ ID NO: 2530927 - RNA, 20 nt, Chlamydophila pneumoniae CWL029
gauaaugaaguuugcaugca

SEQ ID NO: 2530928 - RNA, 17 nt, Chlamydophila pneumoniae CWL029
gauaaugauuccuagaa

SEQ ID NO: 2530929 - RNA, 19 nt, Chlamydophila pneumoniae CWL029
gauaaugucuccaucggaa

SEQ ID NO: 2530930 - RNA, 14 nt, Chlamydophila pneumoniae CWL029
gauacacuucuaau

SEQ ID NO: 2530931 - RNA, 16 nt, Chlamydophila pneumoniae CWL029
gauaccaaaauaccau

SEQ ID NO: 2530932 - RNA, 22 nt, Chlamydophila pneumoniae CWL029
gauaccgcuguuuuauagcauc

SEQ ID NO: 2530933 - RNA, 21 nt, Chlamydophila pneumoniae CWL029
gauaccucuccgucauauuua

SEQ ID NO: 2530934 - RNA, 23 nt, Chlamydophila pneumoniae CWL029
gauacgugcagugaauccuucca

SEQ ID NO: 2530935 - RNA, 13 nt, Chlamydophila pneumoniae CWL029
gauacguggaacu

SEQ ID NO: 2530936 - RNA, 20 nt, Chlamydophila pneumoniae CWL029
gauacguuuuucccuuuaaa

SEQ ID NO: 2530937 - RNA, 18 nt, Chlamydophila pneumoniae CWL029
gauacucugaacaggaau

SEQ ID NO: 2530938 - RNA, 20 nt, Chlamydophila pneumoniae CWL029
gauacuuagcaaucaguaaa

SEQ ID NO: 2530939 - RNA, 13 nt, Chlamydophila pneumoniae CWL029
gauacuucuucca

SEQ ID NO: 2530940 - RNA, 22 nt, Chlamydophila pneumoniae CWL029
gauacuucuuccacgagauucu

SEQ ID NO: 2530941 - RNA, 19 nt, Chlamydophila pneumoniae CWL029
gauacuuguaccguaaaga

SEQ ID NO: 2530942 - RNA, 21 nt, Chlamydophila pneumoniae CWL029
gauagaccccccauuccaaag

SEQ ID NO: 2530943 - RNA, 18 nt, Chlamydophila pneumoniae CWL029
gauagagcuucuuuaucu

SEQ ID NO: 2530944 - RNA, 13 nt, Chlamydophila pneumoniae CWL029
gauagcaaaucaa

SEQ ID NO: 2530945 - RNA, 13 nt, Chlamydophila pneumoniae CWL029
gauagccauuaga

SEQ ID NO: 2530946 - RNA, 23 nt, Chlamydophila pneumoniae CWL029
gauagcgucuguuaacucagaga

SEQ ID NO: 2530947 - RNA, 19 nt, Chlamydophila pneumoniae CWL029
gauagcuaaaccuucagau

SEQ ID NO: 2530948 - RNA, 17 nt, Chlamydophila pneumoniae CWL029
gauaggguaagauugca

SEQ ID NO: 2530949 - RNA, 23 nt, Chlamydophila pneumoniae CWL029
gauaggugagguuugugcugcuu

SEQ ID NO: 2530950 - RNA, 22 nt, Chlamydophila pneumoniae CWL029
gauaguauuuuugaaaccaagg

SEQ ID NO: 2530951 - RNA, 22 nt, Chlamydophila pneumoniae CWL029
gauaguguucgagcaucucaag

SEQ ID NO: 2530952 - RNA, 21 nt, Chlamydophila pneumoniae CWL029
gauaguucacaagugcauuau

SEQ ID NO: 2530953 - RNA, 19 nt, Chlamydophila pneumoniae CWL029
gauaguuuuugcuguuucu

SEQ ID NO: 2530954 - RNA, 17 nt, Chlamydophila pneumoniae CWL029
gauauaacccaggacau

SEQ ID NO: 2530955 - RNA, 19 nt, Chlamydophila pneumoniae CWL029
gauauaagacuccaaguca

SEQ ID NO: 2530956 - RNA, 15 nt, Chlamydophila pneumoniae CWL029
gauauagagagaguc

SEQ ID NO: 2530957 - RNA, 20 nt, Chlamydophila pneumoniae CWL029
gauauagcguacaggaaguc

SEQ ID NO: 2530958 - RNA, 16 nt, Chlamydophila pneumoniae CWL029
gauaucaaagcauugc

SEQ ID NO: 2530959 - RNA, 11 nt, Chlamydophila pneumoniae CWL029
gauaucaccag

SEQ ID NO: 2530960 - RNA, 14 nt, Chlamydophila pneumoniae CWL029
gauaucaucaaaag

SEQ ID NO: 2530961 - RNA, 16 nt, Chlamydophila pneumoniae CWL029
gauauccaccuuacca

SEQ ID NO: 2530962 - RNA, 15 nt, Chlamydophila pneumoniae CWL029
gauaucgaccuuaaa

SEQ ID NO: 2530963 - RNA, 17 nt, Chlamydophila pneumoniae CWL029
gauaucuauaaauguag

SEQ ID NO: 2530964 - RNA, 20 nt, Chlamydophila pneumoniae CWL029
gauaucucuaccgaacagag

SEQ ID NO: 2530965 - RNA, 13 nt, Chlamydophila pneumoniae CWL029
gauaucuuguaca

SEQ ID NO: 2530966 - RNA, 15 nt, Chlamydophila pneumoniae CWL029
gauaugaagagacgu

SEQ ID NO: 2530967 - RNA, 22 nt, Chlamydophila pneumoniae CWL029
gauauguccgugagcaacaagc

SEQ ID NO: 2530968 - RNA, 13 nt, Chlamydophila pneumoniae CWL029
gauauuacagauu

SEQ ID NO: 2530969 - RNA, 14 nt, Chlamydophila pneumoniae CWL029
gauauugcggaaau

SEQ ID NO: 2530970 - RNA, 15 nt, Chlamydophila pneumoniae CWL029
gauauuguucuucca

SEQ ID NO: 2530971 - RNA, 17 nt, Chlamydophila pneumoniae CWL029
gaucaaagauuccuaag

SEQ ID NO: 2530972 - RNA, 17 nt, Chlamydophila pneumoniae CWL029
gaucaaauuccuucuca

SEQ ID NO: 2530973 - RNA, 19 nt, Chlamydophila pneumoniae CWL029
gaucaaauuccuucucaga

SEQ ID NO: 2530974 - RNA, 14 nt, Chlamydophila pneumoniae CWL029
gaucacaagaaaga

SEQ ID NO: 2530975 - RNA, 16 nt, Chlamydophila pneumoniae CWL029
gaucacaagaaagaau

SEQ ID NO: 2530976 - RNA, 16 nt, Chlamydophila pneumoniae CWL029
gaucacauagaaaaca

SEQ ID NO: 2530977 - RNA, 17 nt, Chlamydophila pneumoniae CWL029
gaucacauagaaaacau

SEQ ID NO: 2530978 - RNA, 11 nt, Chlamydophila pneumoniae CWL029
gaucacugaga

SEQ ID NO: 2530979 - RNA, 17 nt, Chlamydophila pneumoniae CWL029
gaucagaaaaaaugcgu

SEQ ID NO: 2530980 - RNA, 16 nt, Chlamydophila pneumoniae CWL029
gaucauaccgacaagc

SEQ ID NO: 2530981 - RNA, 19 nt, Chlamydophila pneumoniae CWL029
gaucauaucuuaugccuuu

SEQ ID NO: 2530982 - RNA, 21 nt, Chlamydophila pneumoniae CWL029
gaucauaugcaccgauuggcu

SEQ ID NO: 2530983 - RNA, 21 nt, Chlamydophila pneumoniae CWL029
gaucaucuacgauguuuucuu

SEQ ID NO: 2530984 - RNA, 16 nt, Chlamydophila pneumoniae CWL029
gaucaucuucacuaaa

SEQ ID NO: 2530985 - RNA, 23 nt, Chlamydophila pneumoniae CWL029
gaucauuagcaucaucuccugaa

SEQ ID NO: 2530986 - RNA, 16 nt, Chlamydophila pneumoniae CWL029
gaucauucuuuauaaa

SEQ ID NO: 2530987 - RNA, 21 nt, Chlamydophila pneumoniae CWL029
gauccacagacugcaggaaau

SEQ ID NO: 2530988 - RNA, 19 nt, Chlamydophila pneumoniae CWL029
gauccaucggcauuucucc

SEQ ID NO: 2530989 - RNA, 20 nt, Chlamydophila pneumoniae CWL029
gaucccaucaucgagcugau

SEQ ID NO: 2530990 - RNA, 23 nt, Chlamydophila pneumoniae CWL029
gaucccuguaguuucuaaaacag

SEQ ID NO: 2530991 - RNA, 15 nt, Chlamydophila pneumoniae CWL029
gauccgaaaagaacc

SEQ ID NO: 2530992 - RNA, 14 nt, Chlamydophila pneumoniae CWL029
gauccuagaauagg

SEQ ID NO: 2530993 - RNA, 21 nt, Chlamydophila pneumoniae CWL029
gauccuucaucagcuucccaa

SEQ ID NO: 2530994 - RNA, 16 nt, Chlamydophila pneumoniae CWL029
gauccuuuccaagaag

SEQ ID NO: 2530995 - RNA, 18 nt, Chlamydophila pneumoniae CWL029
gaucgggucuacaacagu

SEQ ID NO: 2530996 - RNA, 19 nt, Chlamydophila pneumoniae CWL029
gaucgucaagcucugagaa

SEQ ID NO: 2530997 - RNA, 15 nt, Chlamydophila pneumoniae CWL029
gaucuaaagcaucac

SEQ ID NO: 2530998 - RNA, 14 nt, Chlamydophila pneumoniae CWL029
gaucuacaaaaacu

SEQ ID NO: 2530999 - RNA, 17 nt, Chlamydophila pneumoniae CWL029
gaucuacaaaaacuaga

SEQ ID NO: 2531000 - RNA, 17 nt, Chlamydophila pneumoniae CWL029
gaucuacaaacagauuu

SEQ ID NO: 2531001 - RNA, 21 nt, Chlamydophila pneumoniae CWL029
gaucuacagauaggguaagau

SEQ ID NO: 2531002 - RNA, 23 nt, Chlamydophila pneumoniae CWL029
gaucuacagauaggguaagauug

SEQ ID NO: 2531003 - RNA, 17 nt, Chlamydophila pneumoniae CWL029
gaucucaguaggagcag

SEQ ID NO: 2531004 - RNA, 18 nt, Chlamydophila pneumoniae CWL029
gaucucaguaggagcagc

SEQ ID NO: 2531005 - RNA, 23 nt, Chlamydophila pneumoniae CWL029
gaucuccgauagagauucuuucu

SEQ ID NO: 2531006 - RNA, 19 nt, Chlamydophila pneumoniae CWL029
gaucucgucuuggaaugcu

SEQ ID NO: 2531007 - RNA, 19 nt, Chlamydophila pneumoniae CWL029
gaucucucuuccugcugcu

SEQ ID NO: 2531008 - RNA, 21 nt, Chlamydophila pneumoniae CWL029
gaucucuucaugaaaaaagaa

SEQ ID NO: 2531009 - RNA, 19 nt, Chlamydophila pneumoniae CWL029
gaucugaaguugaaaugag

SEQ ID NO: 2531010 - RNA, 22 nt, Chlamydophila pneumoniae CWL029
gaucuggaugagaggauuugaa

SEQ ID NO: 2531011 - RNA, 16 nt, Chlamydophila pneumoniae CWL029
gaucuuauauaaaacu

SEQ ID NO: 2531012 - RNA, 19 nt, Chlamydophila pneumoniae CWL029
gaucuuauauaaaacuuau

SEQ ID NO: 2531013 - RNA, 22 nt, Chlamydophila pneumoniae CWL029
gaucuucaauuggaggauaaau

SEQ ID NO: 2531014 - RNA, 14 nt, Chlamydophila pneumoniae CWL029
gaucuucauaacca

SEQ ID NO: 2531015 - RNA, 21 nt, Chlamydophila pneumoniae CWL029
gaucuucauaaccaaguaaau

SEQ ID NO: 2531016 - RNA, 12 nt, Chlamydophila pneumoniae CWL029
gaucuucauccc

SEQ ID NO: 2531017 - RNA, 15 nt, Chlamydophila pneumoniae CWL029
gaucuucuaaaacac

SEQ ID NO: 2531018 - RNA, 17 nt, Chlamydophila pneumoniae CWL029
gaucuucuaaaacaccu

SEQ ID NO: 2531019 - RNA, 18 nt, Chlamydophila pneumoniae CWL029
gaucuucuauuuuuuugg

SEQ ID NO: 2531020 - RNA, 16 nt, Chlamydophila pneumoniae CWL029
gaucuucucauccaga

SEQ ID NO: 2531021 - RNA, 17 nt, Chlamydophila pneumoniae CWL029
gaucuucugaaaucaaa

SEQ ID NO: 2531022 - RNA, 18 nt, Chlamydophila pneumoniae CWL029
gaucuugagaaaagaaca

SEQ ID NO: 2531023 - RNA, 23 nt, Chlamydophila pneumoniae CWL029
gaucuugcucaggagauacaagc

SEQ ID NO: 2531024 - RNA, 15 nt, Chlamydophila pneumoniae CWL029
gaucuuuagaauaag

SEQ ID NO: 2531025 - RNA, 20 nt, Chlamydophila pneumoniae CWL029
gaucuuuauuuuuaaaaaua

SEQ ID NO: 2531026 - RNA, 14 nt, Chlamydophila pneumoniae CWL029
gaucuuuucuuucu

SEQ ID NO: 2531027 - RNA, 20 nt, Chlamydophila pneumoniae CWL029
gaucuuuuugccaguucuug

SEQ ID NO: 2531028 - RNA, 21 nt, Chlamydophila pneumoniae CWL029
gaucuuuuugccaguucuuga

SEQ ID NO: 2531029 - RNA, 15 nt, Chlamydophila pneumoniae CWL029
gaugaacauaauucg

SEQ ID NO: 2531030 - RNA, 19 nt, Chlamydophila pneumoniae CWL029
gaugaagauaaaaucuuca

SEQ ID NO: 2531031 - RNA, 14 nt, Chlamydophila pneumoniae CWL029
gaugaauaccagaa

SEQ ID NO: 2531032 - RNA, 17 nt, Chlamydophila pneumoniae CWL029
gaugacagggaaagaac

SEQ ID NO: 2531033 - RNA, 15 nt, Chlamydophila pneumoniae CWL029
gaugaccucaucucg

SEQ ID NO: 2531034 - RNA, 15 nt, Chlamydophila pneumoniae CWL029
gaugacuuucagagc

SEQ ID NO: 2531035 - RNA, 16 nt, Chlamydophila pneumoniae CWL029
gaugacuuucagagca

SEQ ID NO: 2531036 - RNA, 18 nt, Chlamydophila pneumoniae CWL029
gaugagguugagcaagaa

SEQ ID NO: 2531037 - RNA, 21 nt, Chlamydophila pneumoniae CWL029
gaugauccacugcuuuaggcc

SEQ ID NO: 2531038 - RNA, 22 nt, Chlamydophila pneumoniae CWL029
gaugaugcccugacguuuugau

SEQ ID NO: 2531039 - RNA, 22 nt, Chlamydophila pneumoniae CWL029
gaugcaaauccuguagaaacau

SEQ ID NO: 2531040 - RNA, 19 nt, Chlamydophila pneumoniae CWL029
gaugcaaauuccagaaaaa

SEQ ID NO: 2531041 - RNA, 20 nt, Chlamydophila pneumoniae CWL029
gaugcaaauuccagaaaaag

SEQ ID NO: 2531042 - RNA, 16 nt, Chlamydophila pneumoniae CWL029
gaugcaaugguugucu

SEQ ID NO: 2531043 - RNA, 16 nt, Chlamydophila pneumoniae CWL029
gaugcaccauaauaua

SEQ ID NO: 2531044 - RNA, 17 nt, Chlamydophila pneumoniae CWL029
gaugcaccauaauauaa

SEQ ID NO: 2531045 - RNA, 12 nt, Chlamydophila pneumoniae CWL029
gaugcagaucau

SEQ ID NO: 2531046 - RNA, 14 nt, Chlamydophila pneumoniae CWL029
gaugcaggccagga

SEQ ID NO: 2531047 - RNA, 18 nt, Chlamydophila pneumoniae CWL029
gaugcaucucuuaaaaca

SEQ ID NO: 2531048 - RNA, 19 nt, Chlamydophila pneumoniae CWL029
gaugcaucucuuaaaacau

SEQ ID NO: 2531049 - RNA, 14 nt, Chlamydophila pneumoniae CWL029
gaugccaagaaaua

SEQ ID NO: 2531050 - RNA, 15 nt, Chlamydophila pneumoniae CWL029
gaugccaagaaauau

SEQ ID NO: 2531051 - RNA, 20 nt, Chlamydophila pneumoniae CWL029
gaugccauugaucagaaucu

SEQ ID NO: 2531052 - RNA, 18 nt, Chlamydophila pneumoniae CWL029
gaugccauuguagagauu

SEQ ID NO: 2531053 - RNA, 16 nt, Chlamydophila pneumoniae CWL029
gaugcggucagaaaca

SEQ ID NO: 2531054 - RNA, 19 nt, Chlamydophila pneumoniae CWL029
gaugcuaaagagucuuccu

SEQ ID NO: 2531055 - RNA, 13 nt, Chlamydophila pneumoniae CWL029
gaugcuaauaaaa

SEQ ID NO: 2531056 - RNA, 19 nt, Chlamydophila pneumoniae CWL029
gaugcuuagcaaaggcaac

SEQ ID NO: 2531057 - RNA, 14 nt, Chlamydophila pneumoniae CWL029
gaugcuucuuucaa

SEQ ID NO: 2531058 - RNA, 18 nt, Chlamydophila pneumoniae CWL029
gauggcauagcgaaaguc

SEQ ID NO: 2531059 - RNA, 17 nt, Chlamydophila pneumoniae CWL029
gauggucauaccaaccu

SEQ ID NO: 2531060 - RNA, 21 nt, Chlamydophila pneumoniae CWL029
gaugguugcuucuaagaaacu

SEQ ID NO: 2531061 - RNA, 23 nt, Chlamydophila pneumoniae CWL029
gauguaacuaguaacuuaaucaa

SEQ ID NO: 2531062 - RNA, 19 nt, Chlamydophila pneumoniae CWL029
gauguacaagcuucaucaa

SEQ ID NO: 2531063 - RNA, 19 nt, Chlamydophila pneumoniae CWL029
gauguauaaaguuuguaaa

SEQ ID NO: 2531064 - RNA, 20 nt, Chlamydophila pneumoniae CWL029
gaugugauguucugcugcuu

SEQ ID NO: 2531065 - RNA, 20 nt, Chlamydophila pneumoniae CWL029
gaugugccgugacuccagaa

SEQ ID NO: 2531066 - RNA, 21 nt, Chlamydophila pneumoniae CWL029
gaugugcggcgagcucuagga

SEQ ID NO: 2531067 - RNA, 15 nt, Chlamydophila pneumoniae CWL029
gauguugcccuacaa

SEQ ID NO: 2531068 - RNA, 17 nt, Chlamydophila pneumoniae CWL029
gauguuguggaucagaa

SEQ ID NO: 2531069 - RNA, 15 nt, Chlamydophila pneumoniae CWL029
gauguuuaauacaaa

SEQ ID NO: 2531070 - RNA, 20 nt, Chlamydophila pneumoniae CWL029
gauguuuaauacaaaaaaua

SEQ ID NO: 2531071 - RNA, 18 nt, Chlamydophila pneumoniae CWL029
gauguuuaugaaaaucug

SEQ ID NO: 2531072 - RNA, 22 nt, Chlamydophila pneumoniae CWL029
gauuacagcaucuauagaauuu

SEQ ID NO: 2531073 - RNA, 15 nt, Chlamydophila pneumoniae CWL029
gauuaguucucuaag

SEQ ID NO: 2531074 - RNA, 16 nt, Chlamydophila pneumoniae CWL029
gauuaucccaaacuuc

SEQ ID NO: 2531075 - RNA, 15 nt, Chlamydophila pneumoniae CWL029
gauuaugaugccuca

SEQ ID NO: 2531076 - RNA, 15 nt, Chlamydophila pneumoniae CWL029
gauuauuucuaaaaa

SEQ ID NO: 2531077 - RNA, 19 nt, Chlamydophila pneumoniae CWL029
gauuauuuguuucuuccau

SEQ ID NO: 2531078 - RNA, 22 nt, Chlamydophila pneumoniae CWL029
gauuauuuguuucuuccauaca

SEQ ID NO: 2531079 - RNA, 22 nt, Chlamydophila pneumoniae CWL029
gauucaaugcagcuaacgaagc

SEQ ID NO: 2531080 - RNA, 21 nt, Chlamydophila pneumoniae CWL029
gauucacaucuuaaaaacuac

SEQ ID NO: 2531081 - RNA, 19 nt, Chlamydophila pneumoniae CWL029
gauucagauccaaagacgu

SEQ ID NO: 2531082 - RNA, 19 nt, Chlamydophila pneumoniae CWL029
gauucaguuccucauccuc

SEQ ID NO: 2531083 - RNA, 23 nt, Chlamydophila pneumoniae CWL029
gauuccaaugacgggagcucuuu

SEQ ID NO: 2531084 - RNA, 13 nt, Chlamydophila pneumoniae CWL029
gauuccugaggcu

SEQ ID NO: 2531085 - RNA, 19 nt, Chlamydophila pneumoniae CWL029
gauuccugucauuccuaag

SEQ ID NO: 2531086 - RNA, 22 nt, Chlamydophila pneumoniae CWL029
gauucgaaaaacgguaaauauc

SEQ ID NO: 2531087 - RNA, 14 nt, Chlamydophila pneumoniae CWL029
gauucgaaagaacu

SEQ ID NO: 2531088 - RNA, 20 nt, Chlamydophila pneumoniae CWL029
gauucgcuacauaaaaugag

SEQ ID NO: 2531089 - RNA, 18 nt, Chlamydophila pneumoniae CWL029
gauucggggagagaacuu

SEQ ID NO: 2531090 - RNA, 14 nt, Chlamydophila pneumoniae CWL029
gauucguuauccuc

SEQ ID NO: 2531091 - RNA, 22 nt, Chlamydophila pneumoniae CWL029
gauucguuauccucgucuucaa

SEQ ID NO: 2531092 - RNA, 13 nt, Chlamydophila pneumoniae CWL029
gauucuaaaagag

SEQ ID NO: 2531093 - RNA, 14 nt, Chlamydophila pneumoniae CWL029
gauucuaaaucaac

SEQ ID NO: 2531094 - RNA, 21 nt, Chlamydophila pneumoniae CWL029
gauucuccagcuucuuucuag

SEQ ID NO: 2531095 - RNA, 16 nt, Chlamydophila pneumoniae CWL029
gauucucguguagaau

SEQ ID NO: 2531096 - RNA, 20 nt, Chlamydophila pneumoniae CWL029
gauucucucugccuaccaaa

SEQ ID NO: 2531097 - RNA, 15 nt, Chlamydophila pneumoniae CWL029
gauucugaagagaga

SEQ ID NO: 2531098 - RNA, 17 nt, Chlamydophila pneumoniae CWL029
gauucuuaucacaaauu

SEQ ID NO: 2531099 - RNA, 21 nt, Chlamydophila pneumoniae CWL029
gauugaggauaaguucuucca

SEQ ID NO: 2531100 - RNA, 15 nt, Chlamydophila pneumoniae CWL029
gauugcuaagauugc

SEQ ID NO: 2531101 - RNA, 23 nt, Chlamydophila pneumoniae CWL029
gauugcuuugcuggagacaacua

SEQ ID NO: 2531102 - RNA, 15 nt, Chlamydophila pneumoniae CWL029
gauuggaugagaauu

SEQ ID NO: 2531103 - RNA, 17 nt, Chlamydophila pneumoniae CWL029
gauugguaaggagaguc

SEQ ID NO: 2531104 - RNA, 15 nt, Chlamydophila pneumoniae CWL029
gauugugcucaauac

SEQ ID NO: 2531105 - RNA, 17 nt, Chlamydophila pneumoniae CWL029
gauuguuauugaguguu

SEQ ID NO: 2531106 - RNA, 18 nt, Chlamydophila pneumoniae CWL029
gauuguucaaaaauagau

SEQ ID NO: 2531107 - RNA, 22 nt, Chlamydophila pneumoniae CWL029
gauuuaaaagguuuugaagcuc

SEQ ID NO: 2531108 - RNA, 19 nt, Chlamydophila pneumoniae CWL029
gauuuaaaugcaagugcuu

SEQ ID NO: 2531109 - RNA, 17 nt, Chlamydophila pneumoniae CWL029
gauuuagaaaucucacu

SEQ ID NO: 2531110 - RNA, 15 nt, Chlamydophila pneumoniae CWL029
gauuuagauuaaaga

SEQ ID NO: 2531111 - RNA, 16 nt, Chlamydophila pneumoniae CWL029
gauuuagggaagaguu

SEQ ID NO: 2531112 - RNA, 16 nt, Chlamydophila pneumoniae CWL029
gauuuauuuugucuuu

SEQ ID NO: 2531113 - RNA, 17 nt, Chlamydophila pneumoniae CWL029
gauuuccccuucagagg

SEQ ID NO: 2531114 - RNA, 17 nt, Chlamydophila pneumoniae CWL029
gauuuccuagguucuuu

SEQ ID NO: 2531115 - RNA, 18 nt, Chlamydophila pneumoniae CWL029
gauuuccuuaagcuucug

SEQ ID NO: 2531116 - RNA, 15 nt, Chlamydophila pneumoniae CWL029
gauuuccuuuuggga

SEQ ID NO: 2531117 - RNA, 16 nt, Chlamydophila pneumoniae CWL029
gauuucuccagcagcu

SEQ ID NO: 2531118 - RNA, 14 nt, Chlamydophila pneumoniae CWL029
gauuucuucuucag

SEQ ID NO: 2531119 - RNA, 15 nt, Chlamydophila pneumoniae CWL029
gauuucuucuucaga

SEQ ID NO: 2531120 - RNA, 13 nt, Chlamydophila pneumoniae CWL029
gauuucuucuucu

SEQ ID NO: 2531121 - RNA, 16 nt, Chlamydophila pneumoniae CWL029
gauuucuucuucuaaa

SEQ ID NO: 2531122 - RNA, 18 nt, Chlamydophila pneumoniae CWL029
gauuucuuuauucccuuu

SEQ ID NO: 2531123 - RNA, 20 nt, Chlamydophila pneumoniae CWL029
gauuucuuuuucagcuucua

SEQ ID NO: 2531124 - RNA, 14 nt, Chlamydophila pneumoniae CWL029
gauuugcauuaccu

SEQ ID NO: 2531125 - RNA, 13 nt, Chlamydophila pneumoniae CWL029
gauuuuaaaauga

SEQ ID NO: 2531126 - RNA, 13 nt, Chlamydophila pneumoniae CWL029
gauuuuaaagccu

SEQ ID NO: 2531127 - RNA, 20 nt, Chlamydophila pneumoniae CWL029
gauuuuacucccugaaguug

SEQ ID NO: 2531128 - RNA, 12 nt, Chlamydophila pneumoniae CWL029
gauuuuccauua

SEQ ID NO: 2531129 - RNA, 21 nt, Chlamydophila pneumoniae CWL029
gauuuucuagaaacaacugaa

SEQ ID NO: 2531130 - RNA, 21 nt, Chlamydophila pneumoniae CWL029
gauuuugcagugauaaaccaa

SEQ ID NO: 2531131 - RNA, 20 nt, Chlamydophila pneumoniae CWL029
gauuuuuagaauagaagauc

SEQ ID NO: 2531132 - RNA, 14 nt, Chlamydophila pneumoniae CWL029
gauuuuucuuuuag

SEQ ID NO: 2531133 - RNA, 21 nt, Chlamydophila pneumoniae CWL029
gauuuuuuaaccucuuuucuu

SEQ ID NO: 2531134 - RNA, 13 nt, Chlamydophila pneumoniae CWL029
gcaaaaagcuucu

SEQ ID NO: 2531135 - RNA, 17 nt, Chlamydophila pneumoniae CWL029
gcaaaaaugaaagaaac

SEQ ID NO: 2531136 - RNA, 15 nt, Chlamydophila pneumoniae CWL029
gcaaaaauucuaggu

SEQ ID NO: 2531137 - RNA, 20 nt, Chlamydophila pneumoniae CWL029
gcaaaccgagacuauuuugg

SEQ ID NO: 2531138 - RNA, 17 nt, Chlamydophila pneumoniae CWL029
gcaaacggagagcauuu

SEQ ID NO: 2531139 - RNA, 14 nt, Chlamydophila pneumoniae CWL029
gcaaacuccccagu

SEQ ID NO: 2531140 - RNA, 14 nt, Chlamydophila pneumoniae CWL029
gcaaagauaaagaa

SEQ ID NO: 2531141 - RNA, 15 nt, Chlamydophila pneumoniae CWL029
gcaaagauaaagaag

SEQ ID NO: 2531142 - RNA, 14 nt, Chlamydophila pneumoniae CWL029
gcaaagaucaguuu

SEQ ID NO: 2531143 - RNA, 13 nt, Chlamydophila pneumoniae CWL029
gcaaagauuucca

SEQ ID NO: 2531144 - RNA, 18 nt, Chlamydophila pneumoniae CWL029
gcaaagcccccuccccca

SEQ ID NO: 2531145 - RNA, 15 nt, Chlamydophila pneumoniae CWL029
gcaaaggaaaagaua

SEQ ID NO: 2531146 - RNA, 21 nt, Chlamydophila pneumoniae CWL029
gcaaaggaccacaauuccuaa

SEQ ID NO: 2531147 - RNA, 13 nt, Chlamydophila pneumoniae CWL029
gcaaauaaaacaa

SEQ ID NO: 2531148 - RNA, 11 nt, Chlamydophila pneumoniae CWL029
gcaaauauagu

SEQ ID NO: 2531149 - RNA, 23 nt, Chlamydophila pneumoniae CWL029
gcaaauccugcucguaaaucugg

SEQ ID NO: 2531150 - RNA, 19 nt, Chlamydophila pneumoniae CWL029
gcaaauccuguagaaacau

SEQ ID NO: 2531151 - RNA, 15 nt, Chlamydophila pneumoniae CWL029
gcaaaucuaaaaccu

SEQ ID NO: 2531152 - RNA, 18 nt, Chlamydophila pneumoniae CWL029
gcaaaucuaaaaccugac

SEQ ID NO: 2531153 - RNA, 12 nt, Chlamydophila pneumoniae CWL029
gcaacaaccaaa

SEQ ID NO: 2531154 - RNA, 20 nt, Chlamydophila pneumoniae CWL029
gcaacaaccaaaagaauucc

SEQ ID NO: 2531155 - RNA, 19 nt, Chlamydophila pneumoniae CWL029
gcaacaacgccuacaugga

SEQ ID NO: 2531156 - RNA, 18 nt, Chlamydophila pneumoniae CWL029
gcaacaaucuuucuucua

SEQ ID NO: 2531157 - RNA, 22 nt, Chlamydophila pneumoniae CWL029
gcaacaguaauuauuuucuaca

SEQ ID NO: 2531158 - RNA, 17 nt, Chlamydophila pneumoniae CWL029
gcaacauccauucuuaa

SEQ ID NO: 2531159 - RNA, 16 nt, Chlamydophila pneumoniae CWL029
gcaacuaaacucucca

SEQ ID NO: 2531160 - RNA, 22 nt, Chlamydophila pneumoniae CWL029
gcaacuaaacugggaagaccac

SEQ ID NO: 2531161 - RNA, 18 nt, Chlamydophila pneumoniae CWL029
gcaagagacaagaaaaua

SEQ ID NO: 2531162 - RNA, 12 nt, Chlamydophila pneumoniae CWL029
gcaagagcuccg

SEQ ID NO: 2531163 - RNA, 17 nt, Chlamydophila pneumoniae CWL029
gcaagagcucuugagaa

SEQ ID NO: 2531164 - RNA, 15 nt, Chlamydophila pneumoniae CWL029
gcaagaucuaacuuc

SEQ ID NO: 2531165 - RNA, 23 nt, Chlamydophila pneumoniae CWL029
gcaagcccuccaguuuuacgaac

SEQ ID NO: 2531166 - RNA, 16 nt, Chlamydophila pneumoniae CWL029
gcaagccgcaaaccau

SEQ ID NO: 2531167 - RNA, 17 nt, Chlamydophila pneumoniae CWL029
gcaagccgcaaaccauc

SEQ ID NO: 2531168 - RNA, 18 nt, Chlamydophila pneumoniae CWL029
gcaagcucgcguauuuuc

SEQ ID NO: 2531169 - RNA, 21 nt, Chlamydophila pneumoniae CWL029
gcaagcucuggauugaaagag

SEQ ID NO: 2531170 - RNA, 11 nt, Chlamydophila pneumoniae CWL029
gcaaggaaaaa

SEQ ID NO: 2531171 - RNA, 13 nt, Chlamydophila pneumoniae CWL029
gcaaggcaaugau

SEQ ID NO: 2531172 - RNA, 14 nt, Chlamydophila pneumoniae CWL029
gcaaggcaaugaua

SEQ ID NO: 2531173 - RNA, 21 nt, Chlamydophila pneumoniae CWL029
gcaagguaacauccauagaga

SEQ ID NO: 2531174 - RNA, 13 nt, Chlamydophila pneumoniae CWL029
gcaaguaaagaaa

SEQ ID NO: 2531175 - RNA, 15 nt, Chlamydophila pneumoniae CWL029
gcaaguaaagaaauu

SEQ ID NO: 2531176 - RNA, 18 nt, Chlamydophila pneumoniae CWL029
gcaaguaaucaugauaaa

SEQ ID NO: 2531177 - RNA, 17 nt, Chlamydophila pneumoniae CWL029
gcaagucgguaauaccu

SEQ ID NO: 2531178 - RNA, 23 nt, Chlamydophila pneumoniae CWL029
gcaagugcgcuaccaggcugcgc

SEQ ID NO: 2531179 - RNA, 24 nt, Chlamydophila pneumoniae CWL029
gcaagugcgcuaccaggcugcgcu

SEQ ID NO: 2531180 - RNA, 21 nt, Chlamydophila pneumoniae CWL029
gcaauacaccaagggaugcca

SEQ ID NO: 2531181 - RNA, 15 nt, Chlamydophila pneumoniae CWL029
gcaauacuaagaagc

SEQ ID NO: 2531182 - RNA, 19 nt, Chlamydophila pneumoniae CWL029
gcaauagacacuugcuuaa

SEQ ID NO: 2531183 - RNA, 15 nt, Chlamydophila pneumoniae CWL029
gcaauaucuauagaa

SEQ ID NO: 2531184 - RNA, 23 nt, Chlamydophila pneumoniae CWL029
gcaauauuuugacguaaugcaga

SEQ ID NO: 2531185 - RNA, 14 nt, Chlamydophila pneumoniae CWL029
gcaaucagcaacau

SEQ ID NO: 2531186 - RNA, 21 nt, Chlamydophila pneumoniae CWL029
gcaaucagugcugccaugaca

SEQ ID NO: 2531187 - RNA, 18 nt, Chlamydophila pneumoniae CWL029
gcaauccaggaauagaaa

SEQ ID NO: 2531188 - RNA, 17 nt, Chlamydophila pneumoniae CWL029
gcaauccaguagaucuu

SEQ ID NO: 2531189 - RNA, 19 nt, Chlamydophila pneumoniae CWL029
gcaaucguuucuauagacu

SEQ ID NO: 2531190 - RNA, 16 nt, Chlamydophila pneumoniae CWL029
gcaaucugaaugccug

SEQ ID NO: 2531191 - RNA, 21 nt, Chlamydophila pneumoniae CWL029
gcaaugauagauaaaucccca

SEQ ID NO: 2531192 - RNA, 16 nt, Chlamydophila pneumoniae CWL029
gcaaugcuucuucagc

SEQ ID NO: 2531193 - RNA, 16 nt, Chlamydophila pneumoniae CWL029
gcaauuguuaaaagaa

SEQ ID NO: 2531194 - RNA, 18 nt, Chlamydophila pneumoniae CWL029
gcaauuucuccuaggucu

SEQ ID NO: 2531195 - RNA, 16 nt, Chlamydophila pneumoniae CWL029
gcacaaaauaaaaccc

SEQ ID NO: 2531196 - RNA, 15 nt, Chlamydophila pneumoniae CWL029
gcacaaacuaacaua

SEQ ID NO: 2531197 - RNA, 20 nt, Chlamydophila pneumoniae CWL029
gcacacugcuuacaauugaa

SEQ ID NO: 2531198 - RNA, 13 nt, Chlamydophila pneumoniae CWL029
gcacauaagauga

SEQ ID NO: 2531199 - RNA, 23 nt, Chlamydophila pneumoniae CWL029
gcacaucgcguauagaugcagca

SEQ ID NO: 2531200 - RNA, 17 nt, Chlamydophila pneumoniae CWL029
gcaccaaagaugcgcuc

SEQ ID NO: 2531201 - RNA, 17 nt, Chlamydophila pneumoniae CWL029
gcaccauaauggauacc

SEQ ID NO: 2531202 - RNA, 16 nt, Chlamydophila pneumoniae CWL029
gcaccuaauaaagaag

SEQ ID NO: 2531203 - RNA, 17 nt, Chlamydophila pneumoniae CWL029
gcaccuuuaggaagcug

SEQ ID NO: 2531204 - RNA, 15 nt, Chlamydophila pneumoniae CWL029
gcacgcuuucgucua

SEQ ID NO: 2531205 - RNA, 22 nt, Chlamydophila pneumoniae CWL029
gcacugacuuuaugaucucccg

SEQ ID NO: 2531206 - RNA, 22 nt, Chlamydophila pneumoniae CWL029
gcacuggcauggaaugccaaau

SEQ ID NO: 2531207 - RNA, 17 nt, Chlamydophila pneumoniae CWL029
gcacuuaaaaaacuucc

SEQ ID NO: 2531208 - RNA, 13 nt, Chlamydophila pneumoniae CWL029
gcacuuacuucaa

SEQ ID NO: 2531209 - RNA, 20 nt, Chlamydophila pneumoniae CWL029
gcacuuaucucuuucuugaa

SEQ ID NO: 2531210 - RNA, 21 nt, Chlamydophila pneumoniae CWL029
gcacuugcucuuuaauaaggc

SEQ ID NO: 2531211 - RNA, 14 nt, Chlamydophila pneumoniae CWL029
gcacuuguuuuuuc

SEQ ID NO: 2531212 - RNA, 10 nt, Chlamydophila pneumoniae CWL029
gcacuuuccg

SEQ ID NO: 2531213 - RNA, 13 nt, Chlamydophila pneumoniae CWL029
gcacuuucuuuuu

SEQ ID NO: 2531214 - RNA, 14 nt, Chlamydophila pneumoniae CWL029
gcacuuuuauuaug

SEQ ID NO: 2531215 - RNA, 17 nt, Chlamydophila pneumoniae CWL029
gcagaaacuuuaaaagc

SEQ ID NO: 2531216 - RNA, 17 nt, Chlamydophila pneumoniae CWL029
gcagaaguaaccgccug

SEQ ID NO: 2531217 - RNA, 20 nt, Chlamydophila pneumoniae CWL029
gcagaaguccuaucaaagca

SEQ ID NO: 2531218 - RNA, 17 nt, Chlamydophila pneumoniae CWL029
gcagaaguuccuucagg

SEQ ID NO: 2531219 - RNA, 21 nt, Chlamydophila pneumoniae CWL029
gcagacggggaucuaaagcau

SEQ ID NO: 2531220 - RNA, 22 nt, Chlamydophila pneumoniae CWL029
gcagagaacuuucgucuuugcu

SEQ ID NO: 2531221 - RNA, 18 nt, Chlamydophila pneumoniae CWL029
gcagagaugcuaacaacu

SEQ ID NO: 2531222 - RNA, 19 nt, Chlamydophila pneumoniae CWL029
gcagaguccuucuuuuccg

SEQ ID NO: 2531223 - RNA, 19 nt, Chlamydophila pneumoniae CWL029
gcagaguuuuucccucgcu

SEQ ID NO: 2531224 - RNA, 22 nt, Chlamydophila pneumoniae CWL029
gcagaguuuuucccucgcuaaa

SEQ ID NO: 2531225 - RNA, 15 nt, Chlamydophila pneumoniae CWL029
gcagauacuaaacuc

SEQ ID NO: 2531226 - RNA, 17 nt, Chlamydophila pneumoniae CWL029
gcagauagacaaccuag

SEQ ID NO: 2531227 - RNA, 16 nt, Chlamydophila pneumoniae CWL029
gcagauagcuuacaga

SEQ ID NO: 2531228 - RNA, 22 nt, Chlamydophila pneumoniae CWL029
gcagaucccgggagucuucagc

SEQ ID NO: 2531229 - RNA, 16 nt, Chlamydophila pneumoniae CWL029
gcagcaaauacuccag

SEQ ID NO: 2531230 - RNA, 23 nt, Chlamydophila pneumoniae CWL029
gcagcaaauccuuuauguauaac

SEQ ID NO: 2531231 - RNA, 17 nt, Chlamydophila pneumoniae CWL029
gcagcacucuuuuucua

SEQ ID NO: 2531232 - RNA, 14 nt, Chlamydophila pneumoniae CWL029
gcagccacagcccu

SEQ ID NO: 2531233 - RNA, 15 nt, Chlamydophila pneumoniae CWL029
gcagccucuucucua

SEQ ID NO: 2531234 - RNA, 18 nt, Chlamydophila pneumoniae CWL029
gcagcuucccaagcagaa

SEQ ID NO: 2531235 - RNA, 18 nt, Chlamydophila pneumoniae CWL029
gcagcuucuggagaaaaa

SEQ ID NO: 2531236 - RNA, 19 nt, Chlamydophila pneumoniae CWL029
gcaggaauaaucaaccaaa

SEQ ID NO: 2531237 - RNA, 21 nt, Chlamydophila pneumoniae CWL029
gcaggaauaaucaaccaaaau

SEQ ID NO: 2531238 - RNA, 13 nt, Chlamydophila pneumoniae CWL029
gcaggagaacaau

SEQ ID NO: 2531239 - RNA, 15 nt, Chlamydophila pneumoniae CWL029
gcaggaguuuucaag

SEQ ID NO: 2531240 - RNA, 14 nt, Chlamydophila pneumoniae CWL029
gcaggccaacucuc

SEQ ID NO: 2531241 - RNA, 14 nt, Chlamydophila pneumoniae CWL029
gcaggccaggagac

SEQ ID NO: 2531242 - RNA, 18 nt, Chlamydophila pneumoniae CWL029
gcagggaauccuguaaca

SEQ ID NO: 2531243 - RNA, 17 nt, Chlamydophila pneumoniae CWL029
gcagggggccugccaug

SEQ ID NO: 2531244 - RNA, 20 nt, Chlamydophila pneumoniae CWL029
gcaggugugugguaaaaaua

SEQ ID NO: 2531245 - RNA, 14 nt, Chlamydophila pneumoniae CWL029
gcagguucuugaau

SEQ ID NO: 2531246 - RNA, 22 nt, Chlamydophila pneumoniae CWL029
gcagguuugggugcuaaguugu

SEQ ID NO: 2531247 - RNA, 16 nt, Chlamydophila pneumoniae CWL029
gcaguaaugccaauau

SEQ ID NO: 2531248 - RNA, 18 nt, Chlamydophila pneumoniae CWL029
gcaguagguaagaagcug

SEQ ID NO: 2531249 - RNA, 23 nt, Chlamydophila pneumoniae CWL029
gcaguauagagaagauuucuaua

SEQ ID NO: 2531250 - RNA, 21 nt, Chlamydophila pneumoniae CWL029
gcagugaaauuuugcaacaaa

SEQ ID NO: 2531251 - RNA, 15 nt, Chlamydophila pneumoniae CWL029
gcaguggcuuauaga

SEQ ID NO: 2531252 - RNA, 14 nt, Chlamydophila pneumoniae CWL029
gcagugugcugauu

SEQ ID NO: 2531253 - RNA, 16 nt, Chlamydophila pneumoniae CWL029
gcaguugcaauaccaa

SEQ ID NO: 2531254 - RNA, 21 nt, Chlamydophila pneumoniae CWL029
gcaguugcuguggcauacucu

SEQ ID NO: 2531255 - RNA, 14 nt, Chlamydophila pneumoniae CWL029
gcaguuguacaauu

SEQ ID NO: 2531256 - RNA, 18 nt, Chlamydophila pneumoniae CWL029
gcauaaacaaagcgucua

SEQ ID NO: 2531257 - RNA, 21 nt, Chlamydophila pneumoniae CWL029
gcauaaggauucugagaaguu

SEQ ID NO: 2531258 - RNA, 13 nt, Chlamydophila pneumoniae CWL029
gcauaauuuuucu

SEQ ID NO: 2531259 - RNA, 14 nt, Chlamydophila pneumoniae CWL029
gcauaauuuuucuu

SEQ ID NO: 2531260 - RNA, 15 nt, Chlamydophila pneumoniae CWL029
gcauaauuuuucuua

SEQ ID NO: 2531261 - RNA, 22 nt, Chlamydophila pneumoniae CWL029
gcauagagagaaggaauuaaaa

SEQ ID NO: 2531262 - RNA, 17 nt, Chlamydophila pneumoniae CWL029
gcauagauacaaacauc

SEQ ID NO: 2531263 - RNA, 21 nt, Chlamydophila pneumoniae CWL029
gcauagcaacuacagagggcu

SEQ ID NO: 2531264 - RNA, 22 nt, Chlamydophila pneumoniae CWL029
gcauagcccgaaauucauuaaa

SEQ ID NO: 2531265 - RNA, 16 nt, Chlamydophila pneumoniae CWL029
gcauaggccaaucccu

SEQ ID NO: 2531266 - RNA, 16 nt, Chlamydophila pneumoniae CWL029
gcauaggcuaagacua

SEQ ID NO: 2531267 - RNA, 21 nt, Chlamydophila pneumoniae CWL029
gcauaguauggcauucuuuuu

SEQ ID NO: 2531268 - RNA, 19 nt, Chlamydophila pneumoniae CWL029
gcauaguauuaaucuuauu

SEQ ID NO: 2531269 - RNA, 17 nt, Chlamydophila pneumoniae CWL029
gcauauuuaaauauaaa

SEQ ID NO: 2531270 - RNA, 23 nt, Chlamydophila pneumoniae CWL029
gcaucacggaguguuugaagaug

SEQ ID NO: 2531271 - RNA, 19 nt, Chlamydophila pneumoniae CWL029
gcaucagaaucguucccau

SEQ ID NO: 2531272 - RNA, 21 nt, Chlamydophila pneumoniae CWL029
gcaucccccgcgccacaucaa

SEQ ID NO: 2531273 - RNA, 14 nt, Chlamydophila pneumoniae CWL029
gcaucccuucuucu

SEQ ID NO: 2531274 - RNA, 19 nt, Chlamydophila pneumoniae CWL029
gcaucccuucuucuuuuag

SEQ ID NO: 2531275 - RNA, 22 nt, Chlamydophila pneumoniae CWL029
gcauccuguagagcaagauucu

SEQ ID NO: 2531276 - RNA, 16 nt, Chlamydophila pneumoniae CWL029
gcaucgccuuaagcuc

SEQ ID NO: 2531277 - RNA, 13 nt, Chlamydophila pneumoniae CWL029
gcaucuaagccag

SEQ ID NO: 2531278 - RNA, 13 nt, Chlamydophila pneumoniae CWL029
gcaucuagagucu

SEQ ID NO: 2531279 - RNA, 14 nt, Chlamydophila pneumoniae CWL029
gcaucuagagucuc

SEQ ID NO: 2531280 - RNA, 19 nt, Chlamydophila pneumoniae CWL029
gcaucuagagucucuuuca

SEQ ID NO: 2531281 - RNA, 13 nt, Chlamydophila pneumoniae CWL029
gcaucucucucca

SEQ ID NO: 2531282 - RNA, 11 nt, Chlamydophila pneumoniae CWL029
gcaucucugca

SEQ ID NO: 2531283 - RNA, 15 nt, Chlamydophila pneumoniae CWL029
gcaucuuauggaaga

SEQ ID NO: 2531284 - RNA, 16 nt, Chlamydophila pneumoniae CWL029
gcaucuuauggaagag

SEQ ID NO: 2531285 - RNA, 20 nt, Chlamydophila pneumoniae CWL029
gcaucuuauggaagagagca

SEQ ID NO: 2531286 - RNA, 13 nt, Chlamydophila pneumoniae CWL029
gcaucuucucgaa

SEQ ID NO: 2531287 - RNA, 16 nt, Chlamydophila pneumoniae CWL029
gcaucuuggcgcacac

SEQ ID NO: 2531288 - RNA, 15 nt, Chlamydophila pneumoniae CWL029
gcaucuuucaucaau

SEQ ID NO: 2531289 - RNA, 18 nt, Chlamydophila pneumoniae CWL029
gcaugaacgugcaucucu

SEQ ID NO: 2531290 - RNA, 15 nt, Chlamydophila pneumoniae CWL029
gcaugaaucucuucu

SEQ ID NO: 2531291 - RNA, 22 nt, Chlamydophila pneumoniae CWL029
gcaugccauaaucuauaggauu

SEQ ID NO: 2531292 - RNA, 23 nt, Chlamydophila pneumoniae CWL029
gcaugccuacaggcaaggagagc

SEQ ID NO: 2531293 - RNA, 16 nt, Chlamydophila pneumoniae CWL029
gcauggacuccaagaa

SEQ ID NO: 2531294 - RNA, 23 nt, Chlamydophila pneumoniae CWL029
gcauggcguaaugcuccacggaa

SEQ ID NO: 2531295 - RNA, 21 nt, Chlamydophila pneumoniae CWL029
gcauggcuuugugagcugcug

SEQ ID NO: 2531296 - RNA, 19 nt, Chlamydophila pneumoniae CWL029
gcauguccauuaauauccc

SEQ ID NO: 2531297 - RNA, 16 nt, Chlamydophila pneumoniae CWL029
gcaugucguaggaagu

SEQ ID NO: 2531298 - RNA, 13 nt, Chlamydophila pneumoniae CWL029
gcauuaacgucau

SEQ ID NO: 2531299 - RNA, 19 nt, Chlamydophila pneumoniae CWL029
gcauuaagauaaacagcac

SEQ ID NO: 2531300 - RNA, 12 nt, Chlamydophila pneumoniae CWL029
gcauuaauaacu

SEQ ID NO: 2531301 - RNA, 18 nt, Chlamydophila pneumoniae CWL029
gcauuacgguuucuggga

SEQ ID NO: 2531302 - RNA, 16 nt, Chlamydophila pneumoniae CWL029
gcauuaucuaagaaua

SEQ ID NO: 2531303 - RNA, 22 nt, Chlamydophila pneumoniae CWL029
gcauuccaggacguaaaaagaa

SEQ ID NO: 2531304 - RNA, 22 nt, Chlamydophila pneumoniae CWL029
gcauuccgagcugcaaacacaa

SEQ ID NO: 2531305 - RNA, 15 nt, Chlamydophila pneumoniae CWL029
gcauucgauuuguaa

SEQ ID NO: 2531306 - RNA, 15 nt, Chlamydophila pneumoniae CWL029
gcauucucaauucug

SEQ ID NO: 2531307 - RNA, 22 nt, Chlamydophila pneumoniae CWL029
gcauucuguaauuuugagaagu

SEQ ID NO: 2531308 - RNA, 22 nt, Chlamydophila pneumoniae CWL029
gcauugaauccuucuauagcaa

SEQ ID NO: 2531309 - RNA, 18 nt, Chlamydophila pneumoniae CWL029
gcauugccauaauaaagg

SEQ ID NO: 2531310 - RNA, 18 nt, Chlamydophila pneumoniae CWL029
gcauuggaaaucuuauaa

SEQ ID NO: 2531311 - RNA, 22 nt, Chlamydophila pneumoniae CWL029
gcauuggacaacgcuucuuuuu

SEQ ID NO: 2531312 - RNA, 15 nt, Chlamydophila pneumoniae CWL029
gcauugggaaggauc

SEQ ID NO: 2531313 - RNA, 13 nt, Chlamydophila pneumoniae CWL029
gcauuuaaaacgg

SEQ ID NO: 2531314 - RNA, 21 nt, Chlamydophila pneumoniae CWL029
gcgaaacauuagucaauguau

SEQ ID NO: 2531315 - RNA, 16 nt, Chlamydophila pneumoniae CWL029
gcgaaagucaaagggc

SEQ ID NO: 2531316 - RNA, 15 nt, Chlamydophila pneumoniae CWL029
gcgaagggaggagaa

SEQ ID NO: 2531317 - RNA, 16 nt, Chlamydophila pneumoniae CWL029
gcgaauccuagagaac

SEQ ID NO: 2531318 - RNA, 15 nt, Chlamydophila pneumoniae CWL029
gcgaaugucguuaaa

SEQ ID NO: 2531319 - RNA, 17 nt, Chlamydophila pneumoniae CWL029
gcgaaugucguuaaaaa

SEQ ID NO: 2531320 - RNA, 16 nt, Chlamydophila pneumoniae CWL029
gcgacccauuugucuc

SEQ ID NO: 2531321 - RNA, 14 nt, Chlamydophila pneumoniae CWL029
gcgaccugcaaaug

SEQ ID NO: 2531322 - RNA, 14 nt, Chlamydophila pneumoniae CWL029
gcgacgucaucaua

SEQ ID NO: 2531323 - RNA, 18 nt, Chlamydophila pneumoniae CWL029
gcgagaggggaaccaagg

SEQ ID NO: 2531324 - RNA, 16 nt, Chlamydophila pneumoniae CWL029
gcgaguaccucaucuc

SEQ ID NO: 2531325 - RNA, 17 nt, Chlamydophila pneumoniae CWL029
gcgauacaauaaacaac

SEQ ID NO: 2531326 - RNA, 16 nt, Chlamydophila pneumoniae CWL029
gcgauaguaaacagaa

SEQ ID NO: 2531327 - RNA, 16 nt, Chlamydophila pneumoniae CWL029
gcgauaucuauaaaug

SEQ ID NO: 2531328 - RNA, 14 nt, Chlamydophila pneumoniae CWL029
gcgauguuccuuuu

SEQ ID NO: 2531329 - RNA, 18 nt, Chlamydophila pneumoniae CWL029
gcgcaccccaagcucaag

SEQ ID NO: 2531330 - RNA, 18 nt, Chlamydophila pneumoniae CWL029
gcgcaguggacggggaga

SEQ ID NO: 2531331 - RNA, 16 nt, Chlamydophila pneumoniae CWL029
gcgcauaugcuccaga

SEQ ID NO: 2531332 - RNA, 12 nt, Chlamydophila pneumoniae CWL029
gcgccuccaccu

SEQ ID NO: 2531333 - RNA, 15 nt, Chlamydophila pneumoniae CWL029
gcgccuccaccugca

SEQ ID NO: 2531334 - RNA, 21 nt, Chlamydophila pneumoniae CWL029
gcgcuaccuuaguuuuuucua

SEQ ID NO: 2531335 - RNA, 14 nt, Chlamydophila pneumoniae CWL029
gcgcuaucaucauu

SEQ ID NO: 2531336 - RNA, 15 nt, Chlamydophila pneumoniae CWL029
gcgcugugaggaaaa

SEQ ID NO: 2531337 - RNA, 15 nt, Chlamydophila pneumoniae CWL029
gcggacuuuagcgcu

SEQ ID NO: 2531338 - RNA, 21 nt, Chlamydophila pneumoniae CWL029
gcggagaauaucaucuuccuc

SEQ ID NO: 2531339 - RNA, 17 nt, Chlamydophila pneumoniae CWL029
gcggaguccuucuugca

SEQ ID NO: 2531340 - RNA, 21 nt, Chlamydophila pneumoniae CWL029
gcggcauggacaauauagaaa

SEQ ID NO: 2531341 - RNA, 12 nt, Chlamydophila pneumoniae CWL029
gcggcuaauuuc

SEQ ID NO: 2531342 - RNA, 14 nt, Chlamydophila pneumoniae CWL029
gcggcuuuuugcaa

SEQ ID NO: 2531343 - RNA, 12 nt, Chlamydophila pneumoniae CWL029
gcgggcucaaag

SEQ ID NO: 2531344 - RNA, 15 nt, Chlamydophila pneumoniae CWL029
gcgggcucaaagaaa

SEQ ID NO: 2531345 - RNA, 17 nt, Chlamydophila pneumoniae CWL029
gcggucucauguaacug

SEQ ID NO: 2531346 - RNA, 16 nt, Chlamydophila pneumoniae CWL029
gcgguuuuggauagaa

SEQ ID NO: 2531347 - RNA, 14 nt, Chlamydophila pneumoniae CWL029
gcguacguuuucuc

SEQ ID NO: 2531348 - RNA, 20 nt, Chlamydophila pneumoniae CWL029
gcgucaauaagcuugccagc

SEQ ID NO: 2531349 - RNA, 22 nt, Chlamydophila pneumoniae CWL029
gcgucaauaagcuugccagcag

SEQ ID NO: 2531350 - RNA, 23 nt, Chlamydophila pneumoniae CWL029
gcgucaauaagcuugccagcaga

SEQ ID NO: 2531351 - RNA, 19 nt, Chlamydophila pneumoniae CWL029
gcgucuccuugauuuggga

SEQ ID NO: 2531352 - RNA, 13 nt, Chlamydophila pneumoniae CWL029
gcgugccuuuuuu

SEQ ID NO: 2531353 - RNA, 15 nt, Chlamydophila pneumoniae CWL029
gcguguaaaagcuua

SEQ ID NO: 2531354 - RNA, 14 nt, Chlamydophila pneumoniae CWL029
gcguugcuaagcau

SEQ ID NO: 2531355 - RNA, 18 nt, Chlamydophila pneumoniae CWL029
gcguuuuuugaaaauuuu

SEQ ID NO: 2531356 - RNA, 22 nt, Chlamydophila pneumoniae CWL029
gcguuuuuuuugauuucagaag

SEQ ID NO: 2531357 - RNA, 18 nt, Chlamydophila pneumoniae CWL029
gcuaaagcaggagcauca

SEQ ID NO: 2531358 - RNA, 17 nt, Chlamydophila pneumoniae CWL029
gcuaaaggaucauuaaa

SEQ ID NO: 2531359 - RNA, 18 nt, Chlamydophila pneumoniae CWL029
gcuaaaggaucauuaaag

SEQ ID NO: 2531360 - RNA, 21 nt, Chlamydophila pneumoniae CWL029
gcuaaaggaucauuaaagucc

SEQ ID NO: 2531361 - RNA, 19 nt, Chlamydophila pneumoniae CWL029
gcuaaaguagaauccuucu

SEQ ID NO: 2531362 - RNA, 24 nt, Chlamydophila pneumoniae CWL029
gcuaaagugaugccuggacugcug

SEQ ID NO: 2531363 - RNA, 15 nt, Chlamydophila pneumoniae CWL029
gcuaacgaagccuca

SEQ ID NO: 2531364 - RNA, 17 nt, Chlamydophila pneumoniae CWL029
gcuaagagcaucuuugg

SEQ ID NO: 2531365 - RNA, 21 nt, Chlamydophila pneumoniae CWL029
gcuaagaucuuuagaauaaga

SEQ ID NO: 2531366 - RNA, 19 nt, Chlamydophila pneumoniae CWL029
gcuaagcauuuuacgaauu

SEQ ID NO: 2531367 - RNA, 21 nt, Chlamydophila pneumoniae CWL029
gcuaauaauuccugagguugg

SEQ ID NO: 2531368 - RNA, 17 nt, Chlamydophila pneumoniae CWL029
gcuaaucaauccaagaa

SEQ ID NO: 2531369 - RNA, 19 nt, Chlamydophila pneumoniae CWL029
gcuaaucauagccaucaua

SEQ ID NO: 2531370 - RNA, 14 nt, Chlamydophila pneumoniae CWL029
gcuaaucauuagag

SEQ ID NO: 2531371 - RNA, 16 nt, Chlamydophila pneumoniae CWL029
gcuacaaaauuauuaa

SEQ ID NO: 2531372 - RNA, 17 nt, Chlamydophila pneumoniae CWL029
gcuacaaaauuauuaaa

SEQ ID NO: 2531373 - RNA, 16 nt, Chlamydophila pneumoniae CWL029
gcuacaaacucuucca

SEQ ID NO: 2531374 - RNA, 17 nt, Chlamydophila pneumoniae CWL029
gcuacagauucuuguau

SEQ ID NO: 2531375 - RNA, 17 nt, Chlamydophila pneumoniae CWL029
gcuacagcuucuuuucc

SEQ ID NO: 2531376 - RNA, 17 nt, Chlamydophila pneumoniae CWL029
gcuacauaaaaugagcu

SEQ ID NO: 2531377 - RNA, 21 nt, Chlamydophila pneumoniae CWL029
gcuacauaguuuuuauuuuua

SEQ ID NO: 2531378 - RNA, 14 nt, Chlamydophila pneumoniae CWL029
gcuaccuagggucu

SEQ ID NO: 2531379 - RNA, 21 nt, Chlamydophila pneumoniae CWL029
gcuacgacuacaucuuguucu

SEQ ID NO: 2531380 - RNA, 23 nt, Chlamydophila pneumoniae CWL029
gcuacuguccauccaaauagagu

SEQ ID NO: 2531381 - RNA, 15 nt, Chlamydophila pneumoniae CWL029
gcuagaaaaucauac

SEQ ID NO: 2531382 - RNA, 19 nt, Chlamydophila pneumoniae CWL029
gcuagagcacauagaaaca

SEQ ID NO: 2531383 - RNA, 16 nt, Chlamydophila pneumoniae CWL029
gcuagagcagcuguag

SEQ ID NO: 2531384 - RNA, 17 nt, Chlamydophila pneumoniae CWL029
gcuagaggcaaacaggu

SEQ ID NO: 2531385 - RNA, 22 nt, Chlamydophila pneumoniae CWL029
gcuagaguccaagguucuggga

SEQ ID NO: 2531386 - RNA, 22 nt, Chlamydophila pneumoniae CWL029
gcuagaucacaagaaagaaugg

SEQ ID NO: 2531387 - RNA, 12 nt, Chlamydophila pneumoniae CWL029
gcuagaugaaga

SEQ ID NO: 2531388 - RNA, 14 nt, Chlamydophila pneumoniae CWL029
gcuagaugaagagu

SEQ ID NO: 2531389 - RNA, 13 nt, Chlamydophila pneumoniae CWL029
gcuagcuccagca

SEQ ID NO: 2531390 - RNA, 17 nt, Chlamydophila pneumoniae CWL029
gcuagcucuuaaaugug

SEQ ID NO: 2531391 - RNA, 15 nt, Chlamydophila pneumoniae CWL029
gcuaggaagaugaau

SEQ ID NO: 2531392 - RNA, 12 nt, Chlamydophila pneumoniae CWL029
gcuagguagugu

SEQ ID NO: 2531393 - RNA, 14 nt, Chlamydophila pneumoniae CWL029
gcuagucuucuuag

SEQ ID NO: 2531394 - RNA, 12 nt, Chlamydophila pneumoniae CWL029
gcuagucuuucu

SEQ ID NO: 2531395 - RNA, 14 nt, Chlamydophila pneumoniae CWL029
gcuaguuuaauagu

SEQ ID NO: 2531396 - RNA, 14 nt, Chlamydophila pneumoniae CWL029
gcuauaaauaauua

SEQ ID NO: 2531397 - RNA, 20 nt, Chlamydophila pneumoniae CWL029
gcuauacagaaaagaaugug

SEQ ID NO: 2531398 - RNA, 18 nt, Chlamydophila pneumoniae CWL029
gcuauaccuauauagaga

SEQ ID NO: 2531399 - RNA, 18 nt, Chlamydophila pneumoniae CWL029
gcuauagauacuuugcaa

SEQ ID NO: 2531400 - RNA, 21 nt, Chlamydophila pneumoniae CWL029
gcuauagauacuuugcaauac

SEQ ID NO: 2531401 - RNA, 18 nt, Chlamydophila pneumoniae CWL029
gcuauagccuuguaaaua

SEQ ID NO: 2531402 - RNA, 20 nt, Chlamydophila pneumoniae CWL029
gcuaucaaagacucaugaaa

SEQ ID NO: 2531403 - RNA, 16 nt, Chlamydophila pneumoniae CWL029
gcuaucaacauccccc

SEQ ID NO: 2531404 - RNA, 19 nt, Chlamydophila pneumoniae CWL029
gcuaucaaccauaaagaau

SEQ ID NO: 2531405 - RNA, 18 nt, Chlamydophila pneumoniae CWL029
gcuaucccacuaacaaga

SEQ ID NO: 2531406 - RNA, 20 nt, Chlamydophila pneumoniae CWL029
gcuaucccacuaacaagaua

SEQ ID NO: 2531407 - RNA, 23 nt, Chlamydophila pneumoniae CWL029
gcuaugaggaacugggcauagug

SEQ ID NO: 2531408 - RNA, 13 nt, Chlamydophila pneumoniae CWL029
gcuaugaugagaa

SEQ ID NO: 2531409 - RNA, 14 nt, Chlamydophila pneumoniae CWL029
gcuaugaugagaac

SEQ ID NO: 2531410 - RNA, 23 nt, Chlamydophila pneumoniae CWL029
gcuauggaagauaaacauacaug

SEQ ID NO: 2531411 - RNA, 20 nt, Chlamydophila pneumoniae CWL029
gcuauguaggcagauagaca

SEQ ID NO: 2531412 - RNA, 17 nt, Chlamydophila pneumoniae CWL029
gcuauuccauaaaaaug

SEQ ID NO: 2531413 - RNA, 19 nt, Chlamydophila pneumoniae CWL029
gcuuccccuaauaggggac

SEQ ID NO: 2531414 - RNA, 13 nt, Chlamydophila pneumoniae CWL029
gcuuccuguagug

SEQ ID NO: 2531415 - RNA, 13 nt, Chlamydophila pneumoniae CWL029
gcuucgcaaucuu

SEQ ID NO: 2531416 - RNA, 17 nt, Chlamydophila pneumoniae CWL029
gcuucuaagaaacuucc

SEQ ID NO: 2531417 - RNA, 16 nt, Chlamydophila pneumoniae CWL029
gcuucuacagcaucgg

SEQ ID NO: 2531418 - RNA, 18 nt, Chlamydophila pneumoniae CWL029
gcuucuacgguaagaucu

SEQ ID NO: 2531419 - RNA, 14 nt, Chlamydophila pneumoniae CWL029
gcuucuaucuugaa

SEQ ID NO: 2531420 - RNA, 15 nt, Chlamydophila pneumoniae CWL029
gcuucuccaaauaaa

SEQ ID NO: 2531421 - RNA, 14 nt, Chlamydophila pneumoniae CWL029
gcuucucccauagc

SEQ ID NO: 2531422 - RNA, 16 nt, Chlamydophila pneumoniae CWL029
gcuucuggagaaaaaa

SEQ ID NO: 2531423 - RNA, 23 nt, Chlamydophila pneumoniae CWL029
gcuucuggauucaaauuugcucu

SEQ ID NO: 2531424 - RNA, 18 nt, Chlamydophila pneumoniae CWL029
gcuucuuguuuuugugga

SEQ ID NO: 2531425 - RNA, 22 nt, Chlamydophila pneumoniae CWL029
gcuucuuuaucuagcucuucaa

SEQ ID NO: 2531426 - RNA, 14 nt, Chlamydophila pneumoniae CWL029
gcuucuuucaaagc

SEQ ID NO: 2531427 - RNA, 20 nt, Chlamydophila pneumoniae CWL029
gcuucuuucucggucuuucu

SEQ ID NO: 2531428 - RNA, 11 nt, Chlamydophila pneumoniae CWL029
gcuucuuucuu

SEQ ID NO: 2531429 - RNA, 12 nt, Chlamydophila pneumoniae CWL029
gcuucuuuucca

SEQ ID NO: 2531430 - RNA, 17 nt, Chlamydophila pneumoniae CWL029
gcuucuuuuuuuuucuu

SEQ ID NO: 2531431 - RNA, 15 nt, Chlamydophila pneumoniae CWL029
gcuugaccucaucag

SEQ ID NO: 2531432 - RNA, 15 nt, Chlamydophila pneumoniae CWL029
gcuugcguuuccuag

SEQ ID NO: 2531433 - RNA, 23 nt, Chlamydophila pneumoniae CWL029
gcuugcugauuucuuuuucagcu

SEQ ID NO: 2531434 - RNA, 18 nt, Chlamydophila pneumoniae CWL029
gcuugggcaaauaggaga

SEQ ID NO: 2531435 - RNA, 21 nt, Chlamydophila pneumoniae CWL029
gcuuggggguggucuagagau

SEQ ID NO: 2531436 - RNA, 21 nt, Chlamydophila pneumoniae CWL029
gcuugucuacagaggaaucua

SEQ ID NO: 2531437 - RNA, 21 nt, Chlamydophila pneumoniae CWL029
gcuugugcaugcaucuuauca

SEQ ID NO: 2531438 - RNA, 18 nt, Chlamydophila pneumoniae CWL029
gcuugugcuaaagcagga

SEQ ID NO: 2531439 - RNA, 13 nt, Chlamydophila pneumoniae CWL029
gcuuguuuuugca

SEQ ID NO: 2531440 - RNA, 15 nt, Chlamydophila pneumoniae CWL029
gcuuuaaauuuuuua

SEQ ID NO: 2531441 - RNA, 16 nt, Chlamydophila pneumoniae CWL029
gcuuuaaguguuucuu

SEQ ID NO: 2531442 - RNA, 18 nt, Chlamydophila pneumoniae CWL029
gcuuuacgaugagguuga

SEQ ID NO: 2531443 - RNA, 14 nt, Chlamydophila pneumoniae CWL029
ggagucacuggcau

SEQ ID NO: 2531444 - RNA, 20 nt, Chlamydophila pneumoniae CWL029
ggaguccuucuugcaaagau

SEQ ID NO: 2531445 - RNA, 14 nt, Chlamydophila pneumoniae CWL029
ggagucgugcagga

SEQ ID NO: 2531446 - RNA, 13 nt, Chlamydophila pneumoniae CWL029
ggagucuuggaua

SEQ ID NO: 2531447 - RNA, 20 nt, Chlamydophila pneumoniae CWL029
ggagugaggaaucauaacca

SEQ ID NO: 2531448 - RNA, 22 nt, Chlamydophila pneumoniae CWL029
ggaguuucuuauucacuggaau

SEQ ID NO: 2531449 - RNA, 17 nt, Chlamydophila pneumoniae CWL029
ggauaccauaaggagau

SEQ ID NO: 2531450 - RNA, 20 nt, Chlamydophila pneumoniae CWL029
ggauacucugaacaggaaua

SEQ ID NO: 2531451 - RNA, 12 nt, Chlamydophila pneumoniae CWL029
ggauacuuagca

SEQ ID NO: 2531452 - RNA, 17 nt, Chlamydophila pneumoniae CWL029
ggaucacagucuuaaau

SEQ ID NO: 2531453 - RNA, 15 nt, Chlamydophila pneumoniae CWL029
ggaucauguagcaga

SEQ ID NO: 2531454 - RNA, 12 nt, Chlamydophila pneumoniae CWL029
ggauccaggagu

SEQ ID NO: 2531455 - RNA, 15 nt, Chlamydophila pneumoniae CWL029
ggauccaucggcauu

SEQ ID NO: 2531456 - RNA, 18 nt, Chlamydophila pneumoniae CWL029
ggaucccaaaaaaugccc

SEQ ID NO: 2531457 - RNA, 13 nt, Chlamydophila pneumoniae CWL029
ggaucccaucauc

SEQ ID NO: 2531458 - RNA, 15 nt, Chlamydophila pneumoniae CWL029
ggaucccguaaaaga

SEQ ID NO: 2531459 - RNA, 20 nt, Chlamydophila pneumoniae CWL029
ggaucgcucucuccaugagc

SEQ ID NO: 2531460 - RNA, 18 nt, Chlamydophila pneumoniae CWL029
ggaucggucuuuucuaag

SEQ ID NO: 2531461 - RNA, 20 nt, Chlamydophila pneumoniae CWL029
ggaucucaucauaaauaggc

SEQ ID NO: 2531462 - RNA, 22 nt, Chlamydophila pneumoniae CWL029
ggaucucucuuuccuuagcauu

SEQ ID NO: 2531463 - RNA, 20 nt, Chlamydophila pneumoniae CWL029
ggaucuucaucccuacccuc

SEQ ID NO: 2531464 - RNA, 20 nt, Chlamydophila pneumoniae CWL029
ggaucuuuucuuucuaagau

SEQ ID NO: 2531465 - RNA, 17 nt, Chlamydophila pneumoniae CWL029
ggaugaggucuuuagca

SEQ ID NO: 2531466 - RNA, 13 nt, Chlamydophila pneumoniae CWL029
ggaugcuaauaaa

SEQ ID NO: 2531467 - RNA, 15 nt, Chlamydophila pneumoniae CWL029
ggauggucaggaaga

SEQ ID NO: 2531468 - RNA, 17 nt, Chlamydophila pneumoniae CWL029
ggaugucuuguugcaug

SEQ ID NO: 2531469 - RNA, 14 nt, Chlamydophila pneumoniae CWL029
ggauguugcguuag

SEQ ID NO: 2531470 - RNA, 22 nt, Chlamydophila pneumoniae CWL029
ggauuaucccaaacuucuucuc

SEQ ID NO: 2531471 - RNA, 17 nt, Chlamydophila pneumoniae CWL029
ggauuaucuuagggaau

SEQ ID NO: 2531472 - RNA, 20 nt, Chlamydophila pneumoniae CWL029
ggauucaaauuugcucuccu

SEQ ID NO: 2531473 - RNA, 15 nt, Chlamydophila pneumoniae CWL029
ggauucacaucuuaa

SEQ ID NO: 2531474 - RNA, 14 nt, Chlamydophila pneumoniae CWL029
ggauucuaaaaaga

SEQ ID NO: 2531475 - RNA, 18 nt, Chlamydophila pneumoniae CWL029
ggauucuuuugcaaugcu

SEQ ID NO: 2531476 - RNA, 20 nt, Chlamydophila pneumoniae CWL029
ggcaacaacgccuacaugga

SEQ ID NO: 2531477 - RNA, 15 nt, Chlamydophila pneumoniae CWL029
ggcaacaagagcgca

SEQ ID NO: 2531478 - RNA, 16 nt, Chlamydophila pneumoniae CWL029
ggcaaguguuuuucug

SEQ ID NO: 2531479 - RNA, 16 nt, Chlamydophila pneumoniae CWL029
ggcaauagcagcagcg

SEQ ID NO: 2531480 - RNA, 15 nt, Chlamydophila pneumoniae CWL029
ggcaauagcuuugaa

SEQ ID NO: 2531481 - RNA, 20 nt, Chlamydophila pneumoniae CWL029
ggcaauagcuuugaagagca

SEQ ID NO: 2531482 - RNA, 19 nt, Chlamydophila pneumoniae CWL029
ggcaccaacacuuuuaaag

SEQ ID NO: 2531483 - RNA, 14 nt, Chlamydophila pneumoniae CWL029
ggcacuggcaugga

SEQ ID NO: 2531484 - RNA, 17 nt, Chlamydophila pneumoniae CWL029
ggcaggaaugagcggca

SEQ ID NO: 2531485 - RNA, 23 nt, Chlamydophila pneumoniae CWL029
ggcaggacucuuuaagcaagagc

SEQ ID NO: 2531486 - RNA, 18 nt, Chlamydophila pneumoniae CWL029
ggcagguagucccuuucu

SEQ ID NO: 2531487 - RNA, 19 nt, Chlamydophila pneumoniae CWL029
ggcaguagguaagaagcug

SEQ ID NO: 2531488 - RNA, 17 nt, Chlamydophila pneumoniae CWL029
ggcauaaaaaaguccua

SEQ ID NO: 2531489 - RNA, 18 nt, Chlamydophila pneumoniae CWL029
ggcauaaaaaaguccuac

SEQ ID NO: 2531490 - RNA, 19 nt, Chlamydophila pneumoniae CWL029
ggcauacaguagaaacaug

SEQ ID NO: 2531491 - RNA, 18 nt, Chlamydophila pneumoniae CWL029
ggcauagauacaaacauc

SEQ ID NO: 2531492 - RNA, 23 nt, Chlamydophila pneumoniae CWL029
ggcauaguggcucaguguauugu

SEQ ID NO: 2531493 - RNA, 13 nt, Chlamydophila pneumoniae CWL029
ggcaucuaagcca

SEQ ID NO: 2531494 - RNA, 16 nt, Chlamydophila pneumoniae CWL029
ggcaugaaagauaaug

SEQ ID NO: 2531495 - RNA, 15 nt, Chlamydophila pneumoniae CWL029
ggcauguuuaauauc

SEQ ID NO: 2531496 - RNA, 21 nt, Chlamydophila pneumoniae CWL029
ggcauucuguaauuuugagaa

SEQ ID NO: 2531497 - RNA, 20 nt, Chlamydophila pneumoniae CWL029
ggccaagauucucacucuau

SEQ ID NO: 2531498 - RNA, 13 nt, Chlamydophila pneumoniae CWL029
ggccacauuaagc

SEQ ID NO: 2531499 - RNA, 15 nt, Chlamydophila pneumoniae CWL029
ggccagcgcauuaac

SEQ ID NO: 2531500 - RNA, 23 nt, Chlamydophila pneumoniae CWL029
ggccaguuacugucugcaaagag

SEQ ID NO: 2531501 - RNA, 17 nt, Chlamydophila pneumoniae CWL029
ggccaucauuaaguacu

SEQ ID NO: 2531502 - RNA, 18 nt, Chlamydophila pneumoniae CWL029
ggcccgauacaaauagcu

SEQ ID NO: 2531503 - RNA, 19 nt, Chlamydophila pneumoniae CWL029
ggcgccuucagcaacuaaa

SEQ ID NO: 2531504 - RNA, 20 nt, Chlamydophila pneumoniae CWL029
ggcggagaauaucaucuucc

SEQ ID NO: 2531505 - RNA, 21 nt, Chlamydophila pneumoniae CWL029
ggcguuccagcuccuuuugaa

SEQ ID NO: 2531506 - RNA, 12 nt, Chlamydophila pneumoniae CWL029
ggcguuuuugca

SEQ ID NO: 2531507 - RNA, 13 nt, Chlamydophila pneumoniae CWL029
ggcuaaagaaaag

SEQ ID NO: 2531508 - RNA, 14 nt, Chlamydophila pneumoniae CWL029
ggcuaaauaaacca

SEQ ID NO: 2531509 - RNA, 16 nt, Chlamydophila pneumoniae CWL029
ggcuacuuuaagaccu

SEQ ID NO: 2531510 - RNA, 24 nt, Chlamydophila pneumoniae CWL029
ggcuauaauuaacguuucuucgca

SEQ ID NO: 2531511 - RNA, 18 nt, Chlamydophila pneumoniae CWL029
ggcuauagaauacacagc

SEQ ID NO: 2531512 - RNA, 13 nt, Chlamydophila pneumoniae CWL029
ggcuauagauacu

SEQ ID NO: 2531513 - RNA, 21 nt, Chlamydophila pneumoniae CWL029
cuucuggauacguuuuucccu

SEQ ID NO: 2531514 - RNA, 22 nt, Chlamydophila pneumoniae CWL029
cuucuggauacguuuuucccuu

SEQ ID NO: 2531515 - RNA, 18 nt, Chlamydophila pneumoniae CWL029
cuucuggguucuccacau

SEQ ID NO: 2531516 - RNA, 10 nt, Chlamydophila pneumoniae CWL029
cuucuguaaa

SEQ ID NO: 2531517 - RNA, 20 nt, Chlamydophila pneumoniae CWL029
cuucuguaauuuuuuucaaa

SEQ ID NO: 2531518 - RNA, 23 nt, Chlamydophila pneumoniae CWL029
cuucuguaauuuuuuucaaagga

SEQ ID NO: 2531519 - RNA, 20 nt, Chlamydophila pneumoniae CWL029
cuucuguaguuuguucacuu

SEQ ID NO: 2531520 - RNA, 19 nt, Chlamydophila pneumoniae CWL029
cuucuguaucgacuguaca

SEQ ID NO: 2531521 - RNA, 14 nt, Chlamydophila pneumoniae CWL029
cuucugucuguauu

SEQ ID NO: 2531522 - RNA, 17 nt, Chlamydophila pneumoniae CWL029
cuucugugcaucaguca

SEQ ID NO: 2531523 - RNA, 18 nt, Chlamydophila pneumoniae CWL029
cuucuuagaagagaaagu

SEQ ID NO: 2531524 - RNA, 16 nt, Chlamydophila pneumoniae CWL029
cuucuuaguaaagaau

SEQ ID NO: 2531525 - RNA, 14 nt, Chlamydophila pneumoniae CWL029
cuucuuaucuucua

SEQ ID NO: 2531526 - RNA, 14 nt, Chlamydophila pneumoniae CWL029
cuucuucaagaaau

SEQ ID NO: 2531527 - RNA, 15 nt, Chlamydophila pneumoniae CWL029
cuucuucagcuuuuu

SEQ ID NO: 2531528 - RNA, 20 nt, Chlamydophila pneumoniae CWL029
cuucuucguaagcugcaauc

SEQ ID NO: 2531529 - RNA, 23 nt, Chlamydophila pneumoniae CWL029
cuucuucuaaagcugcuuuuucu

SEQ ID NO: 2531530 - RNA, 20 nt, Chlamydophila pneumoniae CWL029
cuucuucuggcugagagaag

SEQ ID NO: 2531531 - RNA, 22 nt, Chlamydophila pneumoniae CWL029
cuucuucuggcugagagaagca

SEQ ID NO: 2531532 - RNA, 15 nt, Chlamydophila pneumoniae CWL029
cuucuucuuguucuu

SEQ ID NO: 2531533 - RNA, 17 nt, Chlamydophila pneumoniae CWL029
cuucuugcaaucuuuga

SEQ ID NO: 2531534 - RNA, 21 nt, Chlamydophila pneumoniae CWL029
cuucuuggcguuccagcuccu

SEQ ID NO: 2531535 - RNA, 21 nt, Chlamydophila pneumoniae CWL029
cuucuuguguuagugcuucag

SEQ ID NO: 2531536 - RNA, 14 nt, Chlamydophila pneumoniae CWL029
cuucuuguuuuugu

SEQ ID NO: 2531537 - RNA, 17 nt, Chlamydophila pneumoniae CWL029
cuucuuguuuuugugga

SEQ ID NO: 2531538 - RNA, 20 nt, Chlamydophila pneumoniae CWL029
cuucuuuaggguaaagaaau

SEQ ID NO: 2531539 - RNA, 22 nt, Chlamydophila pneumoniae CWL029
cuucuuuaggguaaagaaauau

SEQ ID NO: 2531540 - RNA, 17 nt, Chlamydophila pneumoniae CWL029
guaaggcgaaaucuuca

SEQ ID NO: 2531541 - RNA, 17 nt, Chlamydophila pneumoniae CWL029
guaagguuaucuuuuug

SEQ ID NO: 2531542 - RNA, 22 nt, Chlamydophila pneumoniae CWL029
guaaguaaccaauacagcauaa

SEQ ID NO: 2531543 - RNA, 15 nt, Chlamydophila pneumoniae CWL029
guaaguacacauugu

SEQ ID NO: 2531544 - RNA, 22 nt, Chlamydophila pneumoniae CWL029
guaaguacacauugucucuuuu

SEQ ID NO: 2531545 - RNA, 22 nt, Chlamydophila pneumoniae CWL029
guaauagacaacgcaggaagaa

SEQ ID NO: 2531546 - RNA, 19 nt, Chlamydophila pneumoniae CWL029
guaauagcaggaguuuuca

SEQ ID NO: 2531547 - RNA, 21 nt, Chlamydophila pneumoniae CWL029
guaauagguuucaauagaagc

SEQ ID NO: 2531548 - RNA, 22 nt, Chlamydophila pneumoniae CWL029
guaauccuaauuccuucaaagc

SEQ ID NO: 2531549 - RNA, 14 nt, Chlamydophila pneumoniae CWL029
guaauccuucuuuc

SEQ ID NO: 2531550 - RNA, 18 nt, Chlamydophila pneumoniae CWL029
guaauccuucuuucugcu

SEQ ID NO: 2531551 - RNA, 19 nt, Chlamydophila pneumoniae CWL029
guaauccuucuuucugcuc

SEQ ID NO: 2531552 - RNA, 18 nt, Chlamydophila pneumoniae CWL029
guaaucgagagaagaaau

SEQ ID NO: 2531553 - RNA, 12 nt, Chlamydophila pneumoniae CWL029
guaaucuaagaa

SEQ ID NO: 2531554 - RNA, 14 nt, Chlamydophila pneumoniae CWL029
guaaugccagcagc

SEQ ID NO: 2531555 - RNA, 14 nt, Chlamydophila pneumoniae CWL029
guaauuacagaucu

SEQ ID NO: 2531556 - RNA, 22 nt, Chlamydophila pneumoniae CWL029
guaauuauuuucuacacuguug

SEQ ID NO: 2531557 - RNA, 20 nt, Chlamydophila pneumoniae CWL029
guaauuccaaaauaaaagga

SEQ ID NO: 2531558 - RNA, 17 nt, Chlamydophila pneumoniae CWL029
guacaagcuucaucaaa

SEQ ID NO: 2531559 - RNA, 18 nt, Chlamydophila pneumoniae CWL029
guacaauuugcuccucca

SEQ ID NO: 2531560 - RNA, 20 nt, Chlamydophila pneumoniae CWL029
guacacauugucucuuuuaa

SEQ ID NO: 2531561 - RNA, 15 nt, Chlamydophila pneumoniae CWL029
guacauagaggagau

SEQ ID NO: 2531562 - RNA, 15 nt, Chlamydophila pneumoniae CWL029
guaccacauacucuu

SEQ ID NO: 2531563 - RNA, 16 nt, Chlamydophila pneumoniae CWL029
guaccacauacucuuc

SEQ ID NO: 2531564 - RNA, 17 nt, Chlamydophila pneumoniae CWL029
guaccacauacucuuca

SEQ ID NO: 2531565 - RNA, 20 nt, Chlamydophila pneumoniae CWL029
guaccgaccgaaucucucca

SEQ ID NO: 2531566 - RNA, 14 nt, Chlamydophila pneumoniae CWL029
guaccuucucguca

SEQ ID NO: 2531567 - RNA, 21 nt, Chlamydophila pneumoniae CWL029
guaccuucucgucauucugca

SEQ ID NO: 2531568 - RNA, 18 nt, Chlamydophila pneumoniae CWL029
guacgcaaguaaagaaau

SEQ ID NO: 2531569 - RNA, 21 nt, Chlamydophila pneumoniae CWL029
guacgucuuucaccaacuccu

SEQ ID NO: 2531570 - RNA, 19 nt, Chlamydophila pneumoniae CWL029
guacuaauuacagaauccc

SEQ ID NO: 2531571 - RNA, 21 nt, Chlamydophila pneumoniae CWL029
guacuuaagcacugaugaaaa

SEQ ID NO: 2531572 - RNA, 19 nt, Chlamydophila pneumoniae CWL029
guacuuccccaaacaugga

SEQ ID NO: 2531573 - RNA, 21 nt, Chlamydophila pneumoniae CWL029
guacuucccucaugaagaauu

SEQ ID NO: 2531574 - RNA, 14 nt, Chlamydophila pneumoniae CWL029
guacuucuuacccu

SEQ ID NO: 2531575 - RNA, 14 nt, Chlamydophila pneumoniae CWL029
guacuuuacacuau

SEQ ID NO: 2531576 - RNA, 17 nt, Chlamydophila pneumoniae CWL029
guagaacuucucaagaa

SEQ ID NO: 2531577 - RNA, 13 nt, Chlamydophila pneumoniae CWL029
guagaauccuucu

SEQ ID NO: 2531578 - RNA, 18 nt, Chlamydophila pneumoniae CWL029
guagaauccuucucccuc

SEQ ID NO: 2531579 - RNA, 19 nt, Chlamydophila pneumoniae CWL029
guagaauccuucucccucu

SEQ ID NO: 2531580 - RNA, 20 nt, Chlamydophila pneumoniae CWL029
guagacaacaagucuucccu

SEQ ID NO: 2531581 - RNA, 14 nt, Chlamydophila pneumoniae CWL029
guagacgauuuucu

SEQ ID NO: 2531582 - RNA, 14 nt, Chlamydophila pneumoniae CWL029
guagagaauguucc

SEQ ID NO: 2531583 - RNA, 14 nt, Chlamydophila pneumoniae CWL029
guagagagaaucga

SEQ ID NO: 2531584 - RNA, 12 nt, Chlamydophila pneumoniae CWL029
guagagcaagau

SEQ ID NO: 2531585 - RNA, 16 nt, Chlamydophila pneumoniae CWL029
guagagcaagauucuu

SEQ ID NO: 2531586 - RNA, 14 nt, Chlamydophila pneumoniae CWL029
guagaguccacagu

SEQ ID NO: 2531587 - RNA, 21 nt, Chlamydophila pneumoniae CWL029
guagagucggccguauaacuu

SEQ ID NO: 2531588 - RNA, 18 nt, Chlamydophila pneumoniae CWL029
guagaucauaaacagcag

SEQ ID NO: 2531589 - RNA, 12 nt, Chlamydophila pneumoniae CWL029
guagauccauga

SEQ ID NO: 2531590 - RNA, 23 nt, Chlamydophila pneumoniae CWL029
guagauccuauaguaauuucucc

SEQ ID NO: 2531591 - RNA, 19 nt, Chlamydophila pneumoniae CWL029
guagaucuucugaaaucaa

SEQ ID NO: 2531592 - RNA, 18 nt, Chlamydophila pneumoniae CWL029
guagcauuucuuucucuu

SEQ ID NO: 2531593 - RNA, 11 nt, Chlamydophila pneumoniae CWL029
guagccccagc

SEQ ID NO: 2531594 - RNA, 15 nt, Chlamydophila pneumoniae CWL029
guagccccagcaacc

SEQ ID NO: 2531595 - RNA, 23 nt, Chlamydophila pneumoniae CWL029
guagccccggucgucuuagaauc

SEQ ID NO: 2531596 - RNA, 23 nt, Chlamydophila pneumoniae CWL029
guagccgaggcgauuuucaugga

SEQ ID NO: 2531597 - RNA, 21 nt, Chlamydophila pneumoniae CWL029
guagccguaggguagccaucc

SEQ ID NO: 2531598 - RNA, 19 nt, Chlamydophila pneumoniae CWL029
guagcguacguuuucucuu

SEQ ID NO: 2531599 - RNA, 19 nt, Chlamydophila pneumoniae CWL029
guagcgucucuucuuccuc

SEQ ID NO: 2531600 - RNA, 22 nt, Chlamydophila pneumoniae CWL029
guagcuacaaaauuauuaaacu

SEQ ID NO: 2531601 - RNA, 18 nt, Chlamydophila pneumoniae CWL029
guagcucaggaaaacuua

SEQ ID NO: 2531602 - RNA, 21 nt, Chlamydophila pneumoniae CWL029
guaggaccugugugcuuuaau

SEQ ID NO: 2531603 - RNA, 18 nt, Chlamydophila pneumoniae CWL029
guaggaugugaaggauca

SEQ ID NO: 2531604 - RNA, 21 nt, Chlamydophila pneumoniae CWL029
guaggucucccuggucuguau

SEQ ID NO: 2531605 - RNA, 21 nt, Chlamydophila pneumoniae CWL029
guaguaaggagagacuguguu

SEQ ID NO: 2531606 - RNA, 16 nt, Chlamydophila pneumoniae CWL029
guaguaggcacuuauc

SEQ ID NO: 2531607 - RNA, 22 nt, Chlamydophila pneumoniae CWL029
guagucaugauuuuucaaucaa

SEQ ID NO: 2531608 - RNA, 17 nt, Chlamydophila pneumoniae CWL029
guaguggugaacuaaau

SEQ ID NO: 2531609 - RNA, 14 nt, Chlamydophila pneumoniae CWL029
guaguuugccuucu

SEQ ID NO: 2531610 - RNA, 17 nt, Chlamydophila pneumoniae CWL029
guaguuugccuucuuau

SEQ ID NO: 2531611 - RNA, 22 nt, Chlamydophila pneumoniae CWL029
guauaaaguuuguaaaaacugu

SEQ ID NO: 2531612 - RNA, 16 nt, Chlamydophila pneumoniae CWL029
guauucuugagagucc

SEQ ID NO: 2531613 - RNA, 22 nt, Chlamydophila pneumoniae CWL029
guauugcaaauacguccuguga

SEQ ID NO: 2531614 - RNA, 20 nt, Chlamydophila pneumoniae CWL029
guauuguguucccucuucuu

SEQ ID NO: 2531615 - RNA, 14 nt, Chlamydophila pneumoniae CWL029
guauuuaaauucug

SEQ ID NO: 2531616 - RNA, 19 nt, Chlamydophila pneumoniae CWL029
guauuuucuucaacauaca

SEQ ID NO: 2531617 - RNA, 16 nt, Chlamydophila pneumoniae CWL029
guauuuugcaaaugaa

SEQ ID NO: 2531618 - RNA, 11 nt, Chlamydophila pneumoniae CWL029
gucaaaauauc

SEQ ID NO: 2531619 - RNA, 21 nt, Chlamydophila pneumoniae CWL029
gucaaaauaucauucacuauu

SEQ ID NO: 2531620 - RNA, 21 nt, Chlamydophila pneumoniae CWL029
gucaaacuuauacacuccaau

SEQ ID NO: 2531621 - RNA, 17 nt, Chlamydophila pneumoniae CWL029
gucaaauacuucuccug

SEQ ID NO: 2531622 - RNA, 21 nt, Chlamydophila pneumoniae CWL029
gucaagcucugagaaagaaua

SEQ ID NO: 2531623 - RNA, 22 nt, Chlamydophila pneumoniae CWL029
gucaauaagcuugccagcagaa

SEQ ID NO: 2531624 - RNA, 14 nt, Chlamydophila pneumoniae CWL029
gucacaaugaucuu

SEQ ID NO: 2531625 - RNA, 19 nt, Chlamydophila pneumoniae CWL029
gucacacugcgagagaaag

SEQ ID NO: 2531626 - RNA, 19 nt, Chlamydophila pneumoniae CWL029
gucaccuuaauggcuccua

SEQ ID NO: 2531627 - RNA, 21 nt, Chlamydophila pneumoniae CWL029
gucaccuuaauggcuccuacu

SEQ ID NO: 2531628 - RNA, 19 nt, Chlamydophila pneumoniae CWL029
gucacguucuuagaaagcg

SEQ ID NO: 2531629 - RNA, 19 nt, Chlamydophila pneumoniae CWL029
gucacuguuuuccagaaau

SEQ ID NO: 2531630 - RNA, 23 nt, Chlamydophila pneumoniae CWL029
gucagcccugccucacagcuaau

SEQ ID NO: 2531631 - RNA, 16 nt, Chlamydophila pneumoniae CWL029
gucaggagguggugga

SEQ ID NO: 2531632 - RNA, 15 nt, Chlamydophila pneumoniae CWL029
gucagguaaagagcu

SEQ ID NO: 2531633 - RNA, 13 nt, Chlamydophila pneumoniae CWL029
gucaguaaaacac

SEQ ID NO: 2531634 - RNA, 16 nt, Chlamydophila pneumoniae CWL029
gucauaaaaauuucau

SEQ ID NO: 2531635 - RNA, 23 nt, Chlamydophila pneumoniae CWL029
gucaucaguggcgacugcaacag

SEQ ID NO: 2531636 - RNA, 17 nt, Chlamydophila pneumoniae CWL029
gucaucucauaguuucu

SEQ ID NO: 2531637 - RNA, 12 nt, Chlamydophila pneumoniae CWL029
gucauuaaaaau

SEQ ID NO: 2531638 - RNA, 22 nt, Chlamydophila pneumoniae CWL029
gucauucuauggucucccucac

SEQ ID NO: 2531639 - RNA, 17 nt, Chlamydophila pneumoniae CWL029
guccaagguucugggaa

SEQ ID NO: 2531640 - RNA, 16 nt, Chlamydophila pneumoniae CWL029
guccacaagccucccu

SEQ ID NO: 2531641 - RNA, 18 nt, Chlamydophila pneumoniae CWL029
guccacagucauaaaaau

SEQ ID NO: 2531642 - RNA, 16 nt, Chlamydophila pneumoniae CWL029
guccagacuuuccucu

SEQ ID NO: 2531643 - RNA, 14 nt, Chlamydophila pneumoniae CWL029
guccauaauuucuu

SEQ ID NO: 2531644 - RNA, 22 nt, Chlamydophila pneumoniae CWL029
gucccucuaaugacagcugaga

SEQ ID NO: 2531645 - RNA, 24 nt, Chlamydophila pneumoniae CWL029
gucccugauuccauccugucuauu

SEQ ID NO: 2531646 - RNA, 17 nt, Chlamydophila pneumoniae CWL029
guccgucaggaacccug

SEQ ID NO: 2531647 - RNA, 16 nt, Chlamydophila pneumoniae CWL029
guccuaauuuuccucc

SEQ ID NO: 2531648 - RNA, 16 nt, Chlamydophila pneumoniae CWL029
guccuagcagagaaau

SEQ ID NO: 2531649 - RNA, 14 nt, Chlamydophila pneumoniae CWL029
guccuaggagagcu

SEQ ID NO: 2531650 - RNA, 15 nt, Chlamydophila pneumoniae CWL029
guccuaggagagcua

SEQ ID NO: 2531651 - RNA, 14 nt, Chlamydophila pneumoniae CWL029
guccuaggcugaga

SEQ ID NO: 2531652 - RNA, 17 nt, Chlamydophila pneumoniae CWL029
guccuaucaaagcaaaa

SEQ ID NO: 2531653 - RNA, 19 nt, Chlamydophila pneumoniae CWL029
guccugcaggcuucaccau

SEQ ID NO: 2531654 - RNA, 21 nt, Chlamydophila pneumoniae CWL029
guccuggacgauauaaucacg

SEQ ID NO: 2531655 - RNA, 22 nt, Chlamydophila pneumoniae CWL029
guccugggggaaauaccccauc

SEQ ID NO: 2531656 - RNA, 13 nt, Chlamydophila pneumoniae CWL029
guccuuauuucaa

SEQ ID NO: 2531657 - RNA, 15 nt, Chlamydophila pneumoniae CWL029
guccuucuugcaaag

SEQ ID NO: 2531658 - RNA, 19 nt, Chlamydophila pneumoniae CWL029
guccuugcagcccugcaua

SEQ ID NO: 2531659 - RNA, 20 nt, Chlamydophila pneumoniae CWL029
guccuuuauaauggugucuu

SEQ ID NO: 2531660 - RNA, 12 nt, Chlamydophila pneumoniae CWL029
gucgaagauuca

SEQ ID NO: 2531661 - RNA, 17 nt, Chlamydophila pneumoniae CWL029
gucgaagauucaaagaa

SEQ ID NO: 2531662 - RNA, 14 nt, Chlamydophila pneumoniae CWL029
gucgaaucuaaaaa

SEQ ID NO: 2531663 - RNA, 17 nt, Chlamydophila pneumoniae CWL029
gucgagaaccuccacca

SEQ ID NO: 2531664 - RNA, 15 nt, Chlamydophila pneumoniae CWL029
gucgauaaaaacucc

SEQ ID NO: 2531665 - RNA, 23 nt, Chlamydophila pneumoniae CWL029
gucgauacccaaagaggggagcu

SEQ ID NO: 2531666 - RNA, 17 nt, Chlamydophila pneumoniae CWL029
gucgcaguaaugccaau

SEQ ID NO: 2531667 - RNA, 17 nt, Chlamydophila pneumoniae CWL029
gucgcauaguggucaau

SEQ ID NO: 2531668 - RNA, 21 nt, Chlamydophila pneumoniae CWL029
gucgcgaaaguaaaauuucug

SEQ ID NO: 2531669 - RNA, 16 nt, Chlamydophila pneumoniae CWL029
gucgcgacaagacaau

SEQ ID NO: 2531670 - RNA, 20 nt, Chlamydophila pneumoniae CWL029
gucgcgacaagacaaugacu

SEQ ID NO: 2531671 - RNA, 17 nt, Chlamydophila pneumoniae CWL029
gucgcgaccgaaagucc

SEQ ID NO: 2531672 - RNA, 16 nt, Chlamydophila pneumoniae CWL029
gucgcgacugaaguca

SEQ ID NO: 2531673 - RNA, 20 nt, Chlamydophila pneumoniae CWL029
gucgcuagaucacaagaaag

SEQ ID NO: 2531674 - RNA, 18 nt, Chlamydophila pneumoniae CWL029
gucggagguucgaauccu

SEQ ID NO: 2531675 - RNA, 21 nt, Chlamydophila pneumoniae CWL029
gucguaaacggacgcuagaga

SEQ ID NO: 2531676 - RNA, 19 nt, Chlamydophila pneumoniae CWL029
gucguaaucuuuuuuaaag

SEQ ID NO: 2531677 - RNA, 14 nt, Chlamydophila pneumoniae CWL029
gucgucuuuuaaag

SEQ ID NO: 2531678 - RNA, 21 nt, Chlamydophila pneumoniae CWL029
gucuaaagauuggaauauaau

SEQ ID NO: 2531679 - RNA, 12 nt, Chlamydophila pneumoniae CWL029
gucuaaaggagu

SEQ ID NO: 2531680 - RNA, 18 nt, Chlamydophila pneumoniae CWL029
gucuaagaaucguucuua

SEQ ID NO: 2531681 - RNA, 16 nt, Chlamydophila pneumoniae CWL029
gucuagaacacucaga

SEQ ID NO: 2531682 - RNA, 20 nt, Chlamydophila pneumoniae CWL029
gucuagcaguugcaauacca

SEQ ID NO: 2531683 - RNA, 21 nt, Chlamydophila pneumoniae CWL029
gucucagcauuuuauccacug

SEQ ID NO: 2531684 - RNA, 17 nt, Chlamydophila pneumoniae CWL029
gucuccaaaaauuccca

SEQ ID NO: 2531685 - RNA, 15 nt, Chlamydophila pneumoniae CWL029
gucuccaaagauaca

SEQ ID NO: 2531686 - RNA, 22 nt, Chlamydophila pneumoniae CWL029
guucaacuuuguuaauagaaga

SEQ ID NO: 2531687 - RNA, 14 nt, Chlamydophila pneumoniae CWL029
guucacauuuucau

SEQ ID NO: 2531688 - RNA, 22 nt, Chlamydophila pneumoniae CWL029
guucaccacuaccgaauuuuca

SEQ ID NO: 2531689 - RNA, 22 nt, Chlamydophila pneumoniae CWL029
guucaucuagaugauaacguuu

SEQ ID NO: 2531690 - RNA, 19 nt, Chlamydophila pneumoniae CWL029
guucauuagcuaaaucaaa

SEQ ID NO: 2531691 - RNA, 12 nt, Chlamydophila pneumoniae CWL029
guuccaaaucuc

SEQ ID NO: 2531692 - RNA, 18 nt, Chlamydophila pneumoniae CWL029
guuccaagacaauaaaaa

SEQ ID NO: 2531693 - RNA, 24 nt, Chlamydophila pneumoniae CWL029
guuccacagagaccuucucuucag

SEQ ID NO: 2531694 - RNA, 23 nt, Chlamydophila pneumoniae CWL029
guuccagccugugagcucucgac

SEQ ID NO: 2531695 - RNA, 22 nt, Chlamydophila pneumoniae CWL029
guuccauagaguaucuaaaacu

SEQ ID NO: 2531696 - RNA, 17 nt, Chlamydophila pneumoniae CWL029
guucccaaauagaaaau

SEQ ID NO: 2531697 - RNA, 18 nt, Chlamydophila pneumoniae CWL029
guucccacuggacuucgu

SEQ ID NO: 2531698 - RNA, 19 nt, Chlamydophila pneumoniae CWL029
guucccaucacauaaauca

SEQ ID NO: 2531699 - RNA, 19 nt, Chlamydophila pneumoniae CWL029
guuccuacaggcaggccac

SEQ ID NO: 2531700 - RNA, 20 nt, Chlamydophila pneumoniae CWL029
guuccuacuucugcaggacu

SEQ ID NO: 2531701 - RNA, 19 nt, Chlamydophila pneumoniae CWL029
guuccuauaugaaugauuu

SEQ ID NO: 2531702 - RNA, 17 nt, Chlamydophila pneumoniae CWL029
guuccuauuuuuuguga

SEQ ID NO: 2531703 - RNA, 12 nt, Chlamydophila pneumoniae CWL029
guuccucauccu

SEQ ID NO: 2531704 - RNA, 14 nt, Chlamydophila pneumoniae CWL029
guuccucauccuca

SEQ ID NO: 2531705 - RNA, 18 nt, Chlamydophila pneumoniae CWL029
guuccucauccucaucau

SEQ ID NO: 2531706 - RNA, 23 nt, Chlamydophila pneumoniae CWL029
guuccugaucccuuagaaauucu

SEQ ID NO: 2531707 - RNA, 18 nt, Chlamydophila pneumoniae CWL029
gucuccagaagcaagaau

SEQ ID NO: 2531708 - RNA, 13 nt, Chlamydophila pneumoniae CWL029
gucucccucacaa

SEQ ID NO: 2531709 - RNA, 21 nt, Chlamydophila pneumoniae CWL029
gucucccuggucuguauuuuc

SEQ ID NO: 2531710 - RNA, 19 nt, Chlamydophila pneumoniae CWL029
gucuccuggaacaguauaa

SEQ ID NO: 2531711 - RNA, 21 nt, Chlamydophila pneumoniae CWL029
gucucgaaacucuuugaggau

SEQ ID NO: 2531712 - RNA, 22 nt, Chlamydophila pneumoniae CWL029
gucucuugcgucacauuuguug

SEQ ID NO: 2531713 - RNA, 14 nt, Chlamydophila pneumoniae CWL029
gucucuuucagcuc

SEQ ID NO: 2531714 - RNA, 23 nt, Chlamydophila pneumoniae CWL029
gucugcaaagagcaaaggagcgg

SEQ ID NO: 2531715 - RNA, 21 nt, Chlamydophila pneumoniae CWL029
gucugccaucgcccaauuuuu

SEQ ID NO: 2531716 - RNA, 21 nt, Chlamydophila pneumoniae CWL029
gucuguauuuucuucaacaua

SEQ ID NO: 2531717 - RNA, 17 nt, Chlamydophila pneumoniae CWL029
gucuuaucuaaagaaau

SEQ ID NO: 2531718 - RNA, 20 nt, Chlamydophila pneumoniae CWL029
gucuuaucuaaagaaaugua

SEQ ID NO: 2531719 - RNA, 19 nt, Chlamydophila pneumoniae CWL029
gucuucaauagaacgaauu

SEQ ID NO: 2531720 - RNA, 21 nt, Chlamydophila pneumoniae CWL029
gucuucagcuuguuuuugcaa

SEQ ID NO: 2531721 - RNA, 19 nt, Chlamydophila pneumoniae CWL029
gucuucauaugcucucccg

SEQ ID NO: 2531722 - RNA, 22 nt, Chlamydophila pneumoniae CWL029
gucuuccccccucacaauauaa

SEQ ID NO: 2531723 - RNA, 16 nt, Chlamydophila pneumoniae CWL029
gucuucccucuccuug

SEQ ID NO: 2531724 - RNA, 15 nt, Chlamydophila pneumoniae CWL029
gucuuccguauaagu

SEQ ID NO: 2531725 - RNA, 16 nt, Chlamydophila pneumoniae CWL029
gucuuccuagaccuau

SEQ ID NO: 2531726 - RNA, 20 nt, Chlamydophila pneumoniae CWL029
gucuucuguaauuuuuuuca

SEQ ID NO: 2531727 - RNA, 21 nt, Chlamydophila pneumoniae CWL029
gucuucuguaauuuuuuucaa

SEQ ID NO: 2531728 - RNA, 13 nt, Chlamydophila pneumoniae CWL029
guuuguagaggua

SEQ ID NO: 2531729 - RNA, 21 nt, Chlamydophila pneumoniae CWL029
guuuguaguguugaauaagau

SEQ ID NO: 2531730 - RNA, 20 nt, Chlamydophila pneumoniae CWL029
guuuguccuaggagagcuag

SEQ ID NO: 2531731 - RNA, 17 nt, Chlamydophila pneumoniae CWL029
guuugucguaauugcug

SEQ ID NO: 2531732 - RNA, 13 nt, Chlamydophila pneumoniae CWL029
guuugucuuccau

SEQ ID NO: 2531733 - RNA, 14 nt, Chlamydophila pneumoniae CWL029
guuuuaacucuaga

SEQ ID NO: 2531734 - RNA, 22 nt, Chlamydophila pneumoniae CWL029
guuuuaagaagguuuauuagaa

SEQ ID NO: 2531735 - RNA, 16 nt, Chlamydophila pneumoniae CWL029
guuuuaauuguagaga

SEQ ID NO: 2531736 - RNA, 19 nt, Chlamydophila pneumoniae CWL029
guuuuacgaacuaaaggaa

SEQ ID NO: 2531737 - RNA, 22 nt, Chlamydophila pneumoniae CWL029
guuuuauccaccaagacugaau

SEQ ID NO: 2531738 - RNA, 21 nt, Chlamydophila pneumoniae CWL029
guuuuaucggcaauuguuaaa

SEQ ID NO: 2531739 - RNA, 21 nt, Chlamydophila pneumoniae CWL029
guuuuaucuuuagagucugca

SEQ ID NO: 2531740 - RNA, 13 nt, Chlamydophila pneumoniae CWL029
guuuucacauggc

SEQ ID NO: 2531741 - RNA, 18 nt, Chlamydophila pneumoniae CWL029
guuuucauaauccaagaa

SEQ ID NO: 2531742 - RNA, 21 nt, Chlamydophila pneumoniae CWL029
guuuucggggucggagauugu

SEQ ID NO: 2531743 - RNA, 15 nt, Chlamydophila pneumoniae CWL029
uaaaccuucaaugau

SEQ ID NO: 2531744 - RNA, 17 nt, Chlamydophila pneumoniae CWL029
uaaaccuucagauccga

SEQ ID NO: 2531745 - RNA, 13 nt, Chlamydophila pneumoniae CWL029
uaaacgagacugc

SEQ ID NO: 2531746 - RNA, 14 nt, Chlamydophila pneumoniae CWL029
uaaacucuccaaaa

SEQ ID NO: 2531747 - RNA, 18 nt, Chlamydophila pneumoniae CWL029
uaaacucuccaaaagcuc

SEQ ID NO: 2531748 - RNA, 19 nt, Chlamydophila pneumoniae CWL029
uaaacucuccaaaagcucu

SEQ ID NO: 2531749 - RNA, 21 nt, Chlamydophila pneumoniae CWL029
uaaacucucuuccuucuccug

SEQ ID NO: 2531750 - RNA, 21 nt, Chlamydophila pneumoniae CWL029
uaaacugggaagaccacgaaa

SEQ ID NO: 2531751 - RNA, 18 nt, Chlamydophila pneumoniae CWL029
uaaacuuacagccaccuu

SEQ ID NO: 2531752 - RNA, 17 nt, Chlamydophila pneumoniae CWL029
uaaacuucaaugaagaa

SEQ ID NO: 2531753 - RNA, 22 nt, Chlamydophila pneumoniae CWL029
uaaacuucaaugaagaaaaauc

SEQ ID NO: 2531754 - RNA, 13 nt, Chlamydophila pneumoniae CWL029
uaaacuuucuucu

SEQ ID NO: 2531755 - RNA, 17 nt, Chlamydophila pneumoniae CWL029
uaaacuuucuucucuag

SEQ ID NO: 2531756 - RNA, 19 nt, Chlamydophila pneumoniae CWL029
uaaacuuuuuuucaaauca

SEQ ID NO: 2531757 - RNA, 15 nt, Chlamydophila pneumoniae CWL029
uaaagaaaagcaauc

SEQ ID NO: 2531758 - RNA, 14 nt, Chlamydophila pneumoniae CWL029
uaacagagcgccuc

SEQ ID NO: 2531759 - RNA, 18 nt, Chlamydophila pneumoniae CWL029
uaacagagcgccuccacc

SEQ ID NO: 2531760 - RNA, 19 nt, Chlamydophila pneumoniae CWL029
uaacagagcgccuccaccu

SEQ ID NO: 2531761 - RNA, 13 nt, Chlamydophila pneumoniae CWL029
uaacaucaagaau

SEQ ID NO: 2531762 - RNA, 14 nt, Chlamydophila pneumoniae CWL029
uaacaucaagaauu

SEQ ID NO: 2531763 - RNA, 19 nt, Chlamydophila pneumoniae CWL029
uaacaucuaaaaaugcacu

SEQ ID NO: 2531764 - RNA, 18 nt, Chlamydophila pneumoniae CWL029
uaacaugcgcagaauaaa

SEQ ID NO: 2531765 - RNA, 22 nt, Chlamydophila pneumoniae CWL029
uaacaugcgcagaauaaaaugg

SEQ ID NO: 2531766 - RNA, 22 nt, Chlamydophila pneumoniae CWL029
uaacauuuagauaaagaaagcg

SEQ ID NO: 2531767 - RNA, 18 nt, Chlamydophila pneumoniae CWL029
uaacauuucguuuuuucu

SEQ ID NO: 2531768 - RNA, 19 nt, Chlamydophila pneumoniae CWL029
uaacauuucguuuuuucuu

SEQ ID NO: 2531769 - RNA, 22 nt, Chlamydophila pneumoniae CWL029
uaacauuucguuuuuucuuauc

SEQ ID NO: 2531770 - RNA, 14 nt, Chlamydophila pneumoniae CWL029
uaaccaaaagaauu

SEQ ID NO: 2531771 - RNA, 17 nt, Chlamydophila pneumoniae CWL029
uaaccaacaucaaagaa

SEQ ID NO: 2531772 - RNA, 15 nt, Chlamydophila pneumoniae CWL029
uaaccaaguaaauca

SEQ ID NO: 2531773 - RNA, 16 nt, Chlamydophila pneumoniae CWL029
uaaccaaguuauuaua

SEQ ID NO: 2531774 - RNA, 13 nt, Chlamydophila pneumoniae CWL029
uaacccaccagaa

SEQ ID NO: 2531775 - RNA, 17 nt, Chlamydophila pneumoniae CWL029
uaaccgaaacuucucag

SEQ ID NO: 2531776 - RNA, 24 nt, Chlamydophila pneumoniae CWL029
uaaccuaauacaggagcuaaagcu

SEQ ID NO: 2531777 - RNA, 16 nt, Chlamydophila pneumoniae CWL029
uaaccuccucaagaau

SEQ ID NO: 2531778 - RNA, 14 nt, Chlamydophila pneumoniae CWL029
uaaccucuuuucuu

SEQ ID NO: 2531779 - RNA, 21 nt, Chlamydophila pneumoniae CWL029
uaaccuuugacaacaccacag

SEQ ID NO: 2531780 - RNA, 19 nt, Chlamydophila pneumoniae CWL029
uaacgaauugcuuuccccc

SEQ ID NO: 2531781 - RNA, 13 nt, Chlamydophila pneumoniae CWL029
uaacgcugcuaau

SEQ ID NO: 2531782 - RNA, 19 nt, Chlamydophila pneumoniae CWL029
uaacgcuuuuucaaacugu

SEQ ID NO: 2531783 - RNA, 19 nt, Chlamydophila pneumoniae CWL029
uaacguagucaaaaauucu

SEQ ID NO: 2531784 - RNA, 15 nt, Chlamydophila pneumoniae CWL029
uaacguauuucacaa

SEQ ID NO: 2531785 - RNA, 14 nt, Chlamydophila pneumoniae CWL029
uaacguugauugga

SEQ ID NO: 2531786 - RNA, 14 nt, Chlamydophila pneumoniae CWL029
uaacguugccuguu

SEQ ID NO: 2531787 - RNA, 18 nt, Chlamydophila pneumoniae CWL029
uaacuaaauucuuaacaa

SEQ ID NO: 2531788 - RNA, 20 nt, Chlamydophila pneumoniae CWL029
uaacuaaauucuuaacaaua

SEQ ID NO: 2531789 - RNA, 19 nt, Chlamydophila pneumoniae CWL029
uaacuaucuacacaguagc

SEQ ID NO: 2531790 - RNA, 23 nt, Chlamydophila pneumoniae CWL029
uaacuaucucuguuuuuugaaaa

SEQ ID NO: 2531791 - RNA, 18 nt, Chlamydophila pneumoniae CWL029
uaacucagagauugccag

SEQ ID NO: 2531792 - RNA, 14 nt, Chlamydophila pneumoniae CWL029
uaacuccagcgagg

SEQ ID NO: 2531793 - RNA, 21 nt, Chlamydophila pneumoniae CWL029
uaacuccaggggauaaaacua

SEQ ID NO: 2531794 - RNA, 20 nt, Chlamydophila pneumoniae CWL029
uaacuccucggcaacuacug

SEQ ID NO: 2531795 - RNA, 17 nt, Chlamydophila pneumoniae CWL029
uaacucuuaagaauaaa

SEQ ID NO: 2531796 - RNA, 19 nt, Chlamydophila pneumoniae CWL029
uaacugagcaacuucuucg

SEQ ID NO: 2531797 - RNA, 16 nt, Chlamydophila pneumoniae CWL029
uaacugaggcaaagau

SEQ ID NO: 2531798 - RNA, 16 nt, Chlamydophila pneumoniae CWL029
uaacugcaaagagaau

SEQ ID NO: 2531799 - RNA, 15 nt, Chlamydophila pneumoniae CWL029
uaacuggcaaucuaa

SEQ ID NO: 2531800 - RNA, 20 nt, Chlamydophila pneumoniae CWL029
uaacuuaaagacuugcuucc

SEQ ID NO: 2531801 - RNA, 18 nt, Chlamydophila pneumoniae CWL029
uaacuuaauagauucguu

SEQ ID NO: 2531802 - RNA, 17 nt, Chlamydophila pneumoniae CWL029
uaacuugaagaaguaca

SEQ ID NO: 2531803 - RNA, 21 nt, Chlamydophila pneumoniae CWL029
uaacuuggugagcagcuuuau

SEQ ID NO: 2531804 - RNA, 13 nt, Chlamydophila pneumoniae CWL029
uaagaaaauccua

SEQ ID NO: 2531805 - RNA, 18 nt, Chlamydophila pneumoniae CWL029
uaagaaaaugaggacaca

SEQ ID NO: 2531806 - RNA, 23 nt, Chlamydophila pneumoniae CWL029
uaagaaacuaguucuucuuuacu

SEQ ID NO: 2531807 - RNA, 14 nt, Chlamydophila pneumoniae CWL029
uaagaaacuuccaa

SEQ ID NO: 2531808 - RNA, 22 nt, Chlamydophila pneumoniae CWL029
uaagaaaggcacuccaaaacuc

SEQ ID NO: 2531809 - RNA, 24 nt, Chlamydophila pneumoniae CWL029
uaagaaaggcacuccaaaacucaa

SEQ ID NO: 2531810 - RNA, 12 nt, Chlamydophila pneumoniae CWL029
uaagaaauccca

SEQ ID NO: 2531811 - RNA, 13 nt, Chlamydophila pneumoniae CWL029
uaagaaaucccag

SEQ ID NO: 2531812 - RNA, 14 nt, Chlamydophila pneumoniae CWL029
uaagaaaucccagu

SEQ ID NO: 2531813 - RNA, 23 nt, Chlamydophila pneumoniae CWL029
uaagaacguauacgucccacaaa

SEQ ID NO: 2531814 - RNA, 15 nt, Chlamydophila pneumoniae CWL029
uaagaacuagaaaaa

SEQ ID NO: 2531815 - RNA, 21 nt, Chlamydophila pneumoniae CWL029
uaagaacuuuagggaagaaau

SEQ ID NO: 2531816 - RNA, 19 nt, Chlamydophila pneumoniae CWL029
uaagaagacuagcuuuuca

SEQ ID NO: 2531817 - RNA, 19 nt, Chlamydophila pneumoniae CWL029
uaagaagguuuauuagaag

SEQ ID NO: 2531818 - RNA, 18 nt, Chlamydophila pneumoniae CWL029
uaagaaucuauagaacua

SEQ ID NO: 2531819 - RNA, 20 nt, Chlamydophila pneumoniae CWL029
uaagaaugguuauuucuugu

SEQ ID NO: 2531820 - RNA, 20 nt, Chlamydophila pneumoniae CWL029
uaagaauguagcuguuccaa

SEQ ID NO: 2531821 - RNA, 22 nt, Chlamydophila pneumoniae CWL029
uaagacaagguggguagccagg

SEQ ID NO: 2531822 - RNA, 19 nt, Chlamydophila pneumoniae CWL029
uaagacaauauaagcacca

SEQ ID NO: 2531823 - RNA, 22 nt, Chlamydophila pneumoniae CWL029
uaagacauuauagaggucuuug

SEQ ID NO: 2531824 - RNA, 12 nt, Chlamydophila pneumoniae CWL029
uaagaccagaaa

SEQ ID NO: 2531825 - RNA, 18 nt, Chlamydophila pneumoniae CWL029
uaagacgcagaaacacug

SEQ ID NO: 2531826 - RNA, 16 nt, Chlamydophila pneumoniae CWL029
uaagacgugcaucgcu

SEQ ID NO: 2531827 - RNA, 16 nt, Chlamydophila pneumoniae CWL029
uaagacuaaaaaagag

SEQ ID NO: 2531828 - RNA, 18 nt, Chlamydophila pneumoniae CWL029
uaagacugucuaugaucc

SEQ ID NO: 2531829 - RNA, 15 nt, Chlamydophila pneumoniae CWL029
uaagagaaaggcgcu

SEQ ID NO: 2531830 - RNA, 15 nt, Chlamydophila pneumoniae CWL029
uaagagaacuuuaac

SEQ ID NO: 2531831 - RNA, 17 nt, Chlamydophila pneumoniae CWL029
uaagagacauuucuuga

SEQ ID NO: 2531832 - RNA, 15 nt, Chlamydophila pneumoniae CWL029
uaagagcaaacauca

SEQ ID NO: 2531833 - RNA, 17 nt, Chlamydophila pneumoniae CWL029
uaagagcaaacaucaaa

SEQ ID NO: 2531834 - RNA, 18 nt, Chlamydophila pneumoniae CWL029
uaagagcaaacaucaaag

SEQ ID NO: 2531835 - RNA, 12 nt, Chlamydophila pneumoniae CWL029
uaagaggaaagc

SEQ ID NO: 2531836 - RNA, 17 nt, Chlamydophila pneumoniae CWL029
uaagaggugauacauag

SEQ ID NO: 2531837 - RNA, 17 nt, Chlamydophila pneumoniae CWL029
uaagaguuccaagacaa

SEQ ID NO: 2531838 - RNA, 14 nt, Chlamydophila pneumoniae CWL029
uaagauaaacagca

SEQ ID NO: 2531839 - RNA, 15 nt, Chlamydophila pneumoniae CWL029
uaagauaaacagcac

SEQ ID NO: 2531840 - RNA, 14 nt, Chlamydophila pneumoniae CWL029
uaagauccaaaaau

SEQ ID NO: 2531841 - RNA, 22 nt, Chlamydophila pneumoniae CWL029
uaagauccugagaccauacaca

SEQ ID NO: 2531842 - RNA, 19 nt, Chlamydophila pneumoniae CWL029
uaagauccuuuaaagauuc

SEQ ID NO: 2531843 - RNA, 18 nt, Chlamydophila pneumoniae CWL029
uaagaucuuuagaauaag

SEQ ID NO: 2531844 - RNA, 22 nt, Chlamydophila pneumoniae CWL029
uaagaucuuuagaauaagagcu

SEQ ID NO: 2531845 - RNA, 17 nt, Chlamydophila pneumoniae CWL029
uaagaugcugaaccuuu

SEQ ID NO: 2531846 - RNA, 20 nt, Chlamydophila pneumoniae CWL029
uaagauguggucuuccguau

SEQ ID NO: 2531847 - RNA, 14 nt, Chlamydophila pneumoniae CWL029
uaagauuauuuguu

SEQ ID NO: 2531848 - RNA, 12 nt, Chlamydophila pneumoniae CWL029
uaagauuccuaa

SEQ ID NO: 2531849 - RNA, 22 nt, Chlamydophila pneumoniae CWL029
uaagauugccauguacaugcag

SEQ ID NO: 2531850 - RNA, 12 nt, Chlamydophila pneumoniae CWL029
uaagauuuugaa

SEQ ID NO: 2531851 - RNA, 15 nt, Chlamydophila pneumoniae CWL029
uaagauuuuuagaau

SEQ ID NO: 2531852 - RNA, 18 nt, Chlamydophila pneumoniae CWL029
uaagcaaagcggcucuua

SEQ ID NO: 2531853 - RNA, 22 nt, Chlamydophila pneumoniae CWL029
uaagcaagcaacugauguuuua

SEQ ID NO: 2531854 - RNA, 19 nt, Chlamydophila pneumoniae CWL029
uaagcaggaaaagcaaaau

SEQ ID NO: 2531855 - RNA, 19 nt, Chlamydophila pneumoniae CWL029
uaagcagugugcugauuuu

SEQ ID NO: 2531856 - RNA, 18 nt, Chlamydophila pneumoniae CWL029
uaagcauauuuaaauaua

SEQ ID NO: 2531857 - RNA, 14 nt, Chlamydophila pneumoniae CWL029
uaagccaaauacca

SEQ ID NO: 2531858 - RNA, 15 nt, Chlamydophila pneumoniae CWL029
uaagcgauggcaguu

SEQ ID NO: 2531859 - RNA, 21 nt, Chlamydophila pneumoniae CWL029
uaagcgauuucgacagcagca

SEQ ID NO: 2531860 - RNA, 21 nt, Chlamydophila pneumoniae CWL029
uaagcuaauaagauccaaaaa

SEQ ID NO: 2531861 - RNA, 17 nt, Chlamydophila pneumoniae CWL029
uaagcucauaagaaauu

SEQ ID NO: 2531862 - RNA, 15 nt, Chlamydophila pneumoniae CWL029
uaagcugaaagaaca

SEQ ID NO: 2531863 - RNA, 15 nt, Chlamydophila pneumoniae CWL029
uaagcugcaaucuca

SEQ ID NO: 2531864 - RNA, 20 nt, Chlamydophila pneumoniae CWL029
uaagcuggauucugucuaua

SEQ ID NO: 2531865 - RNA, 16 nt, Chlamydophila pneumoniae CWL029
uaagcuuuauguggag

SEQ ID NO: 2531866 - RNA, 15 nt, Chlamydophila pneumoniae CWL029
uaagcuuuucuucca

SEQ ID NO: 2531867 - RNA, 22 nt, Chlamydophila pneumoniae CWL029
uaagcuuuucuuccaaagacug

SEQ ID NO: 2531868 - RNA, 23 nt, Chlamydophila pneumoniae CWL029
uaaggaagaauuucgucuucaua

SEQ ID NO: 2531869 - RNA, 15 nt, Chlamydophila pneumoniae CWL029
uaaggacaaaucucc

SEQ ID NO: 2531870 - RNA, 22 nt, Chlamydophila pneumoniae CWL029
uaaggagagggguucccucucc

SEQ ID NO: 2531871 - RNA, 13 nt, Chlamydophila pneumoniae CWL029
uaaggcuccagca

SEQ ID NO: 2531872 - RNA, 20 nt, Chlamydophila pneumoniae CWL029
uaaggcuuccaaugcuauug

SEQ ID NO: 2531873 - RNA, 16 nt, Chlamydophila pneumoniae CWL029
uaagggcucuagauau

SEQ ID NO: 2531874 - RNA, 22 nt, Chlamydophila pneumoniae CWL029
uaagggggaucuucagagagaa

SEQ ID NO: 2531875 - RNA, 13 nt, Chlamydophila pneumoniae CWL029
uaaggguuuugaa

SEQ ID NO: 2531876 - RNA, 17 nt, Chlamydophila pneumoniae CWL029
uaaggugcuauuuuaaa

SEQ ID NO: 2531877 - RNA, 18 nt, Chlamydophila pneumoniae CWL029
uaagguuaucuuuuugga

SEQ ID NO: 2531878 - RNA, 19 nt, Chlamydophila pneumoniae CWL029
uaagguuuccaugagaaua

SEQ ID NO: 2531879 - RNA, 17 nt, Chlamydophila pneumoniae CWL029
uaaguaaccaauacagc

SEQ ID NO: 2531880 - RNA, 15 nt, Chlamydophila pneumoniae CWL029
uaaguccaacaucag

SEQ ID NO: 2531881 - RNA, 19 nt, Chlamydophila pneumoniae CWL029
uaaguccaacaucagcugu

SEQ ID NO: 2531882 - RNA, 15 nt, Chlamydophila pneumoniae CWL029
uaaguccuguuugaa

SEQ ID NO: 2531883 - RNA, 23 nt, Chlamydophila pneumoniae CWL029
uaaguccuucuucccagccuuga

SEQ ID NO: 2531884 - RNA, 20 nt, Chlamydophila pneumoniae CWL029
uaagucuccauaauucugca

SEQ ID NO: 2531885 - RNA, 16 nt, Chlamydophila pneumoniae CWL029
uaagugacuuuucuuc

SEQ ID NO: 2531886 - RNA, 20 nt, Chlamydophila pneumoniae CWL029
uaaguuacggaacucauuaa

SEQ ID NO: 2531887 - RNA, 17 nt, Chlamydophila pneumoniae CWL029
uaaguuagagacacaga

SEQ ID NO: 2531888 - RNA, 17 nt, Chlamydophila pneumoniae CWL029
uaaguugguccaucgag

SEQ ID NO: 2531889 - RNA, 18 nt, Chlamydophila pneumoniae CWL029
uaaguuuguagcagcaag

SEQ ID NO: 2531890 - RNA, 20 nt, Chlamydophila pneumoniae CWL029
uaaguuuguagcagcaagaa

SEQ ID NO: 2531891 - RNA, 14 nt, Chlamydophila pneumoniae CWL029
uaauaaaagaacau

SEQ ID NO: 2531892 - RNA, 15 nt, Chlamydophila pneumoniae CWL029
uaauaaaagaacauu

SEQ ID NO: 2531893 - RNA, 12 nt, Chlamydophila pneumoniae CWL029
uaauaaaaugcg

SEQ ID NO: 2531894 - RNA, 22 nt, Chlamydophila pneumoniae CWL029
uaauaaaauuuaaaaaaaucuu

SEQ ID NO: 2531895 - RNA, 22 nt, Chlamydophila pneumoniae CWL029
uaauaaagguugcuaagaucuu

SEQ ID NO: 2531896 - RNA, 12 nt, Chlamydophila pneumoniae CWL029
uaauaaaucuau

SEQ ID NO: 2531897 - RNA, 22 nt, Chlamydophila pneumoniae CWL029
uaauaaccugggggacuucaaa

SEQ ID NO: 2531898 - RNA, 17 nt, Chlamydophila pneumoniae CWL029
uaauaacuauaauauaa

SEQ ID NO: 2531899 - RNA, 15 nt, Chlamydophila pneumoniae CWL029
uaauaagaaccucua

SEQ ID NO: 2531900 - RNA, 18 nt, Chlamydophila pneumoniae CWL029
uaauaagcaggaaaagca

SEQ ID NO: 2531901 - RNA, 19 nt, Chlamydophila pneumoniae CWL029
uaauaagcauauuuaaaua

SEQ ID NO: 2531902 - RNA, 18 nt, Chlamydophila pneumoniae CWL029
uaauaagcggaguccuuc

SEQ ID NO: 2531903 - RNA, 21 nt, Chlamydophila pneumoniae CWL029
uaauacaaaaaauaaaaucaa

SEQ ID NO: 2531904 - RNA, 23 nt, Chlamydophila pneumoniae CWL029
uaauacggacuucacaaagaacc

SEQ ID NO: 2531905 - RNA, 13 nt, Chlamydophila pneumoniae CWL029
uaauacuuaaucc

SEQ ID NO: 2531906 - RNA, 14 nt, Chlamydophila pneumoniae CWL029
uaauagaagaucau

SEQ ID NO: 2531907 - RNA, 13 nt, Chlamydophila pneumoniae CWL029
uaauagagaagaa

SEQ ID NO: 2531908 - RNA, 21 nt, Chlamydophila pneumoniae CWL029
uaauagcgacaugagaaaucu

SEQ ID NO: 2531909 - RNA, 22 nt, Chlamydophila pneumoniae CWL029
uaauagcgacaugagaaaucuu

SEQ ID NO: 2531910 - RNA, 14 nt, Chlamydophila pneumoniae CWL029
uaauaggauaagaa

SEQ ID NO: 2531911 - RNA, 15 nt, Chlamydophila pneumoniae CWL029
uaauaggauaagaaa

SEQ ID NO: 2531912 - RNA, 16 nt, Chlamydophila pneumoniae CWL029
uaauaggauaagaaau

SEQ ID NO: 2531913 - RNA, 14 nt, Chlamydophila pneumoniae CWL029
uaauauaaaagaag

SEQ ID NO: 2531914 - RNA, 16 nt, Chlamydophila pneumoniae CWL029
uaauaucgguuucuuu

SEQ ID NO: 2531915 - RNA, 19 nt, Chlamydophila pneumoniae CWL029
uaauaucgguuucuuuuuu

SEQ ID NO: 2531916 - RNA, 19 nt, Chlamydophila pneumoniae CWL029
uaaucaaagguuuuugauu

SEQ ID NO: 2531917 - RNA, 12 nt, Chlamydophila pneumoniae CWL029
uaaucaaccaaa

SEQ ID NO: 2531918 - RNA, 13 nt, Chlamydophila pneumoniae CWL029
uaaucaaccaaaa

SEQ ID NO: 2531919 - RNA, 17 nt, Chlamydophila pneumoniae CWL029
uaaucaaccaaaaugca

SEQ ID NO: 2531920 - RNA, 17 nt, Chlamydophila pneumoniae CWL029
uaaucaagccuaaaucu

SEQ ID NO: 2531921 - RNA, 19 nt, Chlamydophila pneumoniae CWL029
uaaucaagccuaaaucuau

SEQ ID NO: 2531922 - RNA, 12 nt, Chlamydophila pneumoniae CWL029
uaaucaccuuag

SEQ ID NO: 2531923 - RNA, 14 nt, Chlamydophila pneumoniae CWL029
uaaucagaggagcc

SEQ ID NO: 2531924 - RNA, 21 nt, Chlamydophila pneumoniae CWL029
uaaucagaggagccuccauaa

SEQ ID NO: 2531925 - RNA, 16 nt, Chlamydophila pneumoniae CWL029
uaaucauuaagacuca

SEQ ID NO: 2531926 - RNA, 23 nt, Chlamydophila pneumoniae CWL029
uaauccagauuguucaaaaauag

SEQ ID NO: 2531927 - RNA, 16 nt, Chlamydophila pneumoniae CWL029
uagccccauagagccu

SEQ ID NO: 2531928 - RNA, 14 nt, Chlamydophila pneumoniae CWL029
uagccccuccaaca

SEQ ID NO: 2531929 - RNA, 19 nt, Chlamydophila pneumoniae CWL029
uagcccuacgaauccaaaa

SEQ ID NO: 2531930 - RNA, 11 nt, Chlamydophila pneumoniae CWL029
uagcccuugca

SEQ ID NO: 2531931 - RNA, 16 nt, Chlamydophila pneumoniae CWL029
uacguucuuucuuucu

SEQ ID NO: 2531932 - RNA, 17 nt, Chlamydophila pneumoniae CWL029
uacguuggacugcaaga

SEQ ID NO: 2531933 - RNA, 20 nt, Chlamydophila pneumoniae CWL029
uacguuggacugcaagagcc

SEQ ID NO: 2531934 - RNA, 21 nt, Chlamydophila pneumoniae CWL029
uacguugguucaaauccagcc

SEQ ID NO: 2531935 - RNA, 13 nt, Chlamydophila pneumoniae CWL029
uacguuuucucua

SEQ ID NO: 2531936 - RNA, 13 nt, Chlamydophila pneumoniae CWL029
uacuaaaaucuca

SEQ ID NO: 2531937 - RNA, 22 nt, Chlamydophila pneumoniae CWL029
uacuaaagaaagagucucacuc

SEQ ID NO: 2531938 - RNA, 19 nt, Chlamydophila pneumoniae CWL029
uacuaaauuaguaaaugcc

SEQ ID NO: 2531939 - RNA, 16 nt, Chlamydophila pneumoniae CWL029
uacuaagaagcucacu

SEQ ID NO: 2531940 - RNA, 11 nt, Chlamydophila pneumoniae CWL029
uacuacaugag

SEQ ID NO: 2531941 - RNA, 13 nt, Chlamydophila pneumoniae CWL029
uacuacucucauc

SEQ ID NO: 2531942 - RNA, 15 nt, Chlamydophila pneumoniae CWL029
uacuacuuacaagaa

SEQ ID NO: 2531943 - RNA, 17 nt, Chlamydophila pneumoniae CWL029
uacuacuuacaagaaca

SEQ ID NO: 2531944 - RNA, 18 nt, Chlamydophila pneumoniae CWL029
uacuacuuacaagaacaa

SEQ ID NO: 2531945 - RNA, 14 nt, Chlamydophila pneumoniae CWL029
uacuagauaguuca

SEQ ID NO: 2531946 - RNA, 16 nt, Chlamydophila pneumoniae CWL029
uacucauauuuugucu

SEQ ID NO: 2531947 - RNA, 19 nt, Chlamydophila pneumoniae CWL029
uacucucagcaaagacauc

SEQ ID NO: 2531948 - RNA, 12 nt, Chlamydophila pneumoniae CWL029
uacucucugcuu

SEQ ID NO: 2531949 - RNA, 20 nt, Chlamydophila pneumoniae CWL029
uacucugaacaggaauagaa

SEQ ID NO: 2531950 - RNA, 17 nt, Chlamydophila pneumoniae CWL029
uacucuugcuugcuagg

SEQ ID NO: 2531951 - RNA, 16 nt, Chlamydophila pneumoniae CWL029
uacucuuuaaaaauag

SEQ ID NO: 2531952 - RNA, 22 nt, Chlamydophila pneumoniae CWL029
uacugccagcgaucacauagaa

SEQ ID NO: 2531953 - RNA, 21 nt, Chlamydophila pneumoniae CWL029
uacuggagagguaaccagaga

SEQ ID NO: 2531954 - RNA, 21 nt, Chlamydophila pneumoniae CWL029
uacuguagaguuuucuuucac

SEQ ID NO: 2531955 - RNA, 17 nt, Chlamydophila pneumoniae CWL029
uacuguccauccaaaua

SEQ ID NO: 2531956 - RNA, 15 nt, Chlamydophila pneumoniae CWL029
uacuguuuuucuucc

SEQ ID NO: 2531957 - RNA, 19 nt, Chlamydophila pneumoniae CWL029
uacuuaagcacugaugaaa

SEQ ID NO: 2531958 - RNA, 15 nt, Chlamydophila pneumoniae CWL029
uacuuacaagaacaa

SEQ ID NO: 2531959 - RNA, 23 nt, Chlamydophila pneumoniae CWL029
uacuucggaugagauccaaagcc

SEQ ID NO: 2531960 - RNA, 18 nt, Chlamydophila pneumoniae CWL029
uacuucguuaugaagcuu

SEQ ID NO: 2531961 - RNA, 20 nt, Chlamydophila pneumoniae CWL029
uacuucuguaguuuguucac

SEQ ID NO: 2531962 - RNA, 15 nt, Chlamydophila pneumoniae CWL029
uacuugggagaugcu

SEQ ID NO: 2531963 - RNA, 14 nt, Chlamydophila pneumoniae CWL029
uacuuuaagaccua

SEQ ID NO: 2531964 - RNA, 16 nt, Chlamydophila pneumoniae CWL029
uacuuuacacuauaag

SEQ ID NO: 2531965 - RNA, 16 nt, Chlamydophila pneumoniae CWL029
uacuuuuacugaaauu

SEQ ID NO: 2531966 - RNA, 14 nt, Chlamydophila pneumoniae CWL029
uacuuuugugaaga

SEQ ID NO: 2531967 - RNA, 12 nt, Chlamydophila pneumoniae CWL029
uagaaaaagauc

SEQ ID NO: 2531968 - RNA, 10 nt, Chlamydophila pneumoniae CWL029
uagaaaagau

SEQ ID NO: 2531969 - RNA, 21 nt, Chlamydophila pneumoniae CWL029
uagaaaagguauuaggaagua

SEQ ID NO: 2531970 - RNA, 20 nt, Chlamydophila pneumoniae CWL029
uagaaacaacugaaaaacca

SEQ ID NO: 2531971 - RNA, 21 nt, Chlamydophila pneumoniae CWL029
uagaaacaacugaaaaaccau

SEQ ID NO: 2531972 - RNA, 19 nt, Chlamydophila pneumoniae CWL029
uagaaaccaugaugcaaug

SEQ ID NO: 2531973 - RNA, 13 nt, Chlamydophila pneumoniae CWL029
uagaaagacaaaa

SEQ ID NO: 2531974 - RNA, 14 nt, Chlamydophila pneumoniae CWL029
uagaaagacaaaaa

SEQ ID NO: 2531975 - RNA, 16 nt, Chlamydophila pneumoniae CWL029
uagaaagacaaaaaau

SEQ ID NO: 2531976 - RNA, 23 nt, Chlamydophila pneumoniae CWL029
uagaaagacauccuucuuuaccu

SEQ ID NO: 2531977 - RNA, 14 nt, Chlamydophila pneumoniae CWL029
uagaaagaguccuu

SEQ ID NO: 2531978 - RNA, 21 nt, Chlamydophila pneumoniae CWL029
uagaaagauuuauuuugucuu

SEQ ID NO: 2531979 - RNA, 22 nt, Chlamydophila pneumoniae CWL029
uagaaauauacucuugcuugcu

SEQ ID NO: 2531980 - RNA, 19 nt, Chlamydophila pneumoniae CWL029
uagaaaugaaacgaaagca

SEQ ID NO: 2531981 - RNA, 21 nt, Chlamydophila pneumoniae CWL029
uagaaauuccaauuuuugcau

SEQ ID NO: 2531982 - RNA, 14 nt, Chlamydophila pneumoniae CWL029
uagaaauucuaaga

SEQ ID NO: 2531983 - RNA, 20 nt, Chlamydophila pneumoniae CWL029
uagaacagcauggacuccaa

SEQ ID NO: 2531984 - RNA, 22 nt, Chlamydophila pneumoniae CWL029
uagaacagcauggacuccaaga

SEQ ID NO: 2531985 - RNA, 20 nt, Chlamydophila pneumoniae CWL029
uagaacaggauugauaaaua

SEQ ID NO: 2531986 - RNA, 20 nt, Chlamydophila pneumoniae CWL029
uagaacauacacgucuaaga

SEQ ID NO: 2531987 - RNA, 19 nt, Chlamydophila pneumoniae CWL029
uagaacuucucaagaaucu

SEQ ID NO: 2531988 - RNA, 12 nt, Chlamydophila pneumoniae CWL029
uagaagagaaag

SEQ ID NO: 2531989 - RNA, 22 nt, Chlamydophila pneumoniae CWL029
uagaagauccucaaagaguuuu

SEQ ID NO: 2531990 - RNA, 21 nt, Chlamydophila pneumoniae CWL029
uagaagcaugaagcagaaacu

SEQ ID NO: 2531991 - RNA, 23 nt, Chlamydophila pneumoniae CWL029
uagaagcauucucaauucuguau

SEQ ID NO: 2531992 - RNA, 18 nt, Chlamydophila pneumoniae CWL029
uagaagguguuuuggcug

SEQ ID NO: 2531993 - RNA, 21 nt, Chlamydophila pneumoniae CWL029
uagaagguguuuuggcugcuu

SEQ ID NO: 2531994 - RNA, 11 nt, Chlamydophila pneumoniae CWL029
uagaauagaag

SEQ ID NO: 2531995 - RNA, 16 nt, Chlamydophila pneumoniae CWL029
uagaaucacauaaaau

SEQ ID NO: 2531996 - RNA, 12 nt, Chlamydophila pneumoniae CWL029
uagaaucaccaa

SEQ ID NO: 2531997 - RNA, 16 nt, Chlamydophila pneumoniae CWL029
uagaaucaccaauuuu

SEQ ID NO: 2531998 - RNA, 22 nt, Chlamydophila pneumoniae CWL029
uagaaucagagggacuccugug

SEQ ID NO: 2531999 - RNA, 14 nt, Chlamydophila pneumoniae CWL029
uagaauccaaagac

SEQ ID NO: 2532000 - RNA, 16 nt, Chlamydophila pneumoniae CWL029
uagaauccaaagacuu

SEQ ID NO: 2532001 - RNA, 18 nt, Chlamydophila pneumoniae CWL029
uagaauccaaagacuuuu

SEQ ID NO: 2532002 - RNA, 13 nt, Chlamydophila pneumoniae CWL029
uagaauccucgga

SEQ ID NO: 2532003 - RNA, 12 nt, Chlamydophila pneumoniae CWL029
uagaauccucua

SEQ ID NO: 2532004 - RNA, 18 nt, Chlamydophila pneumoniae CWL029
uagaauccuucucccucu

SEQ ID NO: 2532005 - RNA, 22 nt, Chlamydophila pneumoniae CWL029
uagaaucucugugccaucugua

SEQ ID NO: 2532006 - RNA, 14 nt, Chlamydophila pneumoniae CWL029
uagaauuuguccuu

SEQ ID NO: 2532007 - RNA, 18 nt, Chlamydophila pneumoniae CWL029
uagacaacgcaggaagaa

SEQ ID NO: 2532008 - RNA, 22 nt, Chlamydophila pneumoniae CWL029
uagacaacgcaggaagaacaag

SEQ ID NO: 2532009 - RNA, 12 nt, Chlamydophila pneumoniae CWL029
uagacaagacac

SEQ ID NO: 2532010 - RNA, 13 nt, Chlamydophila pneumoniae CWL029
uagacaagacacc

SEQ ID NO: 2532011 - RNA, 17 nt, Chlamydophila pneumoniae CWL029
uagacaagacaccgaaa

SEQ ID NO: 2532012 - RNA, 14 nt, Chlamydophila pneumoniae CWL029
uagacaagagagag

SEQ ID NO: 2532013 - RNA, 21 nt, Chlamydophila pneumoniae CWL029
uagacaauaccagauaaagca

SEQ ID NO: 2532014 - RNA, 22 nt, Chlamydophila pneumoniae CWL029
uagacacuugcuuaaggaaaca

SEQ ID NO: 2532015 - RNA, 18 nt, Chlamydophila pneumoniae CWL029
uagacaggauggaaucag

SEQ ID NO: 2532016 - RNA, 17 nt, Chlamydophila pneumoniae CWL029
uagacaugcgaagggag

SEQ ID NO: 2532017 - RNA, 20 nt, Chlamydophila pneumoniae CWL029
uagacaugcgaagggaggag

SEQ ID NO: 2532018 - RNA, 23 nt, Chlamydophila pneumoniae CWL029
uagacgauucuaggccuaaagaa

SEQ ID NO: 2532019 - RNA, 13 nt, Chlamydophila pneumoniae CWL029
uagacgauuuucu

SEQ ID NO: 2532020 - RNA, 17 nt, Chlamydophila pneumoniae CWL029
uagacgucguccuacag

SEQ ID NO: 2532021 - RNA, 18 nt, Chlamydophila pneumoniae CWL029
uagacucucacugagugu

SEQ ID NO: 2532022 - RNA, 16 nt, Chlamydophila pneumoniae CWL029
uagacuuguauucuug

SEQ ID NO: 2532023 - RNA, 19 nt, Chlamydophila pneumoniae CWL029
uagacuuguauucuugaga

SEQ ID NO: 2532024 - RNA, 21 nt, Chlamydophila pneumoniae CWL029
uagacuuguauucuugagagu

SEQ ID NO: 2532025 - RNA, 14 nt, Chlamydophila pneumoniae CWL029
uagagaaacuuuug

SEQ ID NO: 2532026 - RNA, 18 nt, Chlamydophila pneumoniae CWL029
uagagaacgaacaguuca

SEQ ID NO: 2532027 - RNA, 15 nt, Chlamydophila pneumoniae CWL029
uagagaagaagcaaa

SEQ ID NO: 2532028 - RNA, 13 nt, Chlamydophila pneumoniae CWL029
uagagaagaggug

SEQ ID NO: 2532029 - RNA, 21 nt, Chlamydophila pneumoniae CWL029
uagucucgguuuccugaagau

SEQ ID NO: 2532030 - RNA, 13 nt, Chlamydophila pneumoniae CWL029
uagucuucuuaga

SEQ ID NO: 2532031 - RNA, 16 nt, Chlamydophila pneumoniae CWL029
uagucuucuuagaaag

SEQ ID NO: 2532032 - RNA, 14 nt, Chlamydophila pneumoniae CWL029
uagucuuucuaaga

SEQ ID NO: 2532033 - RNA, 16 nt, Chlamydophila pneumoniae CWL029
uagucuuucuaagaag

SEQ ID NO: 2532034 - RNA, 17 nt, Chlamydophila pneumoniae CWL029
uagugaacacucucuac

SEQ ID NO: 2532035 - RNA, 19 nt, Chlamydophila pneumoniae CWL029
uagugaagcugcuucuuca

SEQ ID NO: 2532036 - RNA, 15 nt, Chlamydophila pneumoniae CWL029
uagugacuccugguu

SEQ ID NO: 2532037 - RNA, 14 nt, Chlamydophila pneumoniae CWL029
uagugagauagucu

SEQ ID NO: 2532038 - RNA, 23 nt, Chlamydophila pneumoniae CWL029
uagugaggccuccauuucuagga

SEQ ID NO: 2532039 - RNA, 19 nt, Chlamydophila pneumoniae CWL029
uagugcauaccuuaccauc

SEQ ID NO: 2532040 - RNA, 19 nt, Chlamydophila pneumoniae CWL029
uagugcgaugggaagagag

SEQ ID NO: 2532041 - RNA, 15 nt, Chlamydophila pneumoniae CWL029
uagugcuagaugaag

SEQ ID NO: 2532042 - RNA, 17 nt, Chlamydophila pneumoniae CWL029
uaguggaaauugugaaa

SEQ ID NO: 2532043 - RNA, 16 nt, Chlamydophila pneumoniae CWL029
uaguggucaauugcau

SEQ ID NO: 2532044 - RNA, 16 nt, Chlamydophila pneumoniae CWL029
uaguguauaucagcaa

SEQ ID NO: 2532045 - RNA, 16 nt, Chlamydophila pneumoniae CWL029
uaguguucgagcaucu

SEQ ID NO: 2532046 - RNA, 13 nt, Chlamydophila pneumoniae CWL029
uaguguugaauaa

SEQ ID NO: 2532047 - RNA, 14 nt, Chlamydophila pneumoniae CWL029
uaguuacugaggaa

SEQ ID NO: 2532048 - RNA, 12 nt, Chlamydophila pneumoniae CWL029
uaguuagagaag

SEQ ID NO: 2532049 - RNA, 14 nt, Chlamydophila pneumoniae CWL029
uaguuauuaauaaa

SEQ ID NO: 2532050 - RNA, 21 nt, Chlamydophila pneumoniae CWL029
uaguucaccacuaccgaauuu

SEQ ID NO: 2532051 - RNA, 21 nt, Chlamydophila pneumoniae CWL029
uaguuguugcggauuugcauu

SEQ ID NO: 2532052 - RNA, 16 nt, Chlamydophila pneumoniae CWL029
uaguuucacauaguuu

SEQ ID NO: 2532053 - RNA, 23 nt, Chlamydophila pneumoniae CWL029
uaguuucacauaguuuaauaaau

SEQ ID NO: 2532054 - RNA, 18 nt, Chlamydophila pneumoniae CWL029
uaguuucccacuagcccu

SEQ ID NO: 2532055 - RNA, 14 nt, Chlamydophila pneumoniae CWL029
uaguuuguuuuaau

SEQ ID NO: 2532056 - RNA, 15 nt, Chlamydophila pneumoniae CWL029
uaguuuucuucuuua

SEQ ID NO: 2532057 - RNA, 15 nt, Chlamydophila pneumoniae CWL029
uaguuuuuacaugua

SEQ ID NO: 2532058 - RNA, 11 nt, Chlamydophila pneumoniae CWL029
uauaaaaaagg

SEQ ID NO: 2532059 - RNA, 20 nt, Chlamydophila pneumoniae CWL029
uauaaaacuuauaacuauug

SEQ ID NO: 2532060 - RNA, 21 nt, Chlamydophila pneumoniae CWL029
uauaaacuccacgaauucuuu

SEQ ID NO: 2532061 - RNA, 13 nt, Chlamydophila pneumoniae CWL029
uauaaagguuaca

SEQ ID NO: 2532062 - RNA, 17 nt, Chlamydophila pneumoniae CWL029
uauaaaguuuccaagug

SEQ ID NO: 2532063 - RNA, 17 nt, Chlamydophila pneumoniae CWL029
uauaaauaauuacaauu

SEQ ID NO: 2532064 - RNA, 19 nt, Chlamydophila pneumoniae CWL029
uauaaauagaaaucuuagu

SEQ ID NO: 2532065 - RNA, 22 nt, Chlamydophila pneumoniae CWL029
uauaaauucaagacuauagaaa

SEQ ID NO: 2532066 - RNA, 15 nt, Chlamydophila pneumoniae CWL029
uauaacaucuaaaaa

SEQ ID NO: 2532067 - RNA, 21 nt, Chlamydophila pneumoniae CWL029
uauaacuccaggggauaaaac

SEQ ID NO: 2532068 - RNA, 13 nt, Chlamydophila pneumoniae CWL029
uauaacucucuag

SEQ ID NO: 2532069 - RNA, 17 nt, Chlamydophila pneumoniae CWL029
uauaacugcauacaagg

SEQ ID NO: 2532070 - RNA, 15 nt, Chlamydophila pneumoniae CWL029
uauaagagguucucu

SEQ ID NO: 2532071 - RNA, 23 nt, Chlamydophila pneumoniae CWL029
uauaagauaauagagaagaagca

SEQ ID NO: 2532072 - RNA, 17 nt, Chlamydophila pneumoniae CWL029
uauaagggggaucuuca

SEQ ID NO: 2532073 - RNA, 23 nt, Chlamydophila pneumoniae CWL029
uauaagggggaucuucagagaga

SEQ ID NO: 2532074 - RNA, 14 nt, Chlamydophila pneumoniae CWL029
uauaaucacguccu

SEQ ID NO: 2532075 - RNA, 19 nt, Chlamydophila pneumoniae CWL029
uauacaaccacuuccugca

SEQ ID NO: 2532076 - RNA, 19 nt, Chlamydophila pneumoniae CWL029
uauacagacaagcaaggaa

SEQ ID NO: 2532077 - RNA, 20 nt, Chlamydophila pneumoniae CWL029
uauacagacaagcaaggaaa

SEQ ID NO: 2532078 - RNA, 21 nt, Chlamydophila pneumoniae CWL029
uauaccaccccaaagcagauc

SEQ ID NO: 2532079 - RNA, 15 nt, Chlamydophila pneumoniae CWL029
uauacccucugcuua

SEQ ID NO: 2532080 - RNA, 16 nt, Chlamydophila pneumoniae CWL029
uauaccuauauagaga

SEQ ID NO: 2532081 - RNA, 15 nt, Chlamydophila pneumoniae CWL029
uauacgcuuaacaug

SEQ ID NO: 2532082 - RNA, 19 nt, Chlamydophila pneumoniae CWL029
uauacguaauccagauugu

SEQ ID NO: 2532083 - RNA, 16 nt, Chlamydophila pneumoniae CWL029
uauacgucccacaaaa

SEQ ID NO: 2532084 - RNA, 13 nt, Chlamydophila pneumoniae CWL029
uauacucucugua

SEQ ID NO: 2532085 - RNA, 15 nt, Chlamydophila pneumoniae CWL029
uauacuguuuuucuu

SEQ ID NO: 2532086 - RNA, 16 nt, Chlamydophila pneumoniae CWL029
uauacuguuuuucuuc

SEQ ID NO: 2532087 - RNA, 18 nt, Chlamydophila pneumoniae CWL029
uauacuguuuuucuucca

SEQ ID NO: 2532088 - RNA, 19 nt, Chlamydophila pneumoniae CWL029
uauacuguuuuucuuccac

SEQ ID NO: 2532089 - RNA, 21 nt, Chlamydophila pneumoniae CWL029
uauacuguuuuucuuccacac

SEQ ID NO: 2532090 - RNA, 22 nt, Chlamydophila pneumoniae CWL029
uauacuguuuuucuuccacaca

SEQ ID NO: 2532091 - RNA, 15 nt, Chlamydophila pneumoniae CWL029
uauacuuauaccacc

SEQ ID NO: 2532092 - RNA, 17 nt, Chlamydophila pneumoniae CWL029
uauagaagcugcugcua

SEQ ID NO: 2532093 - RNA, 13 nt, Chlamydophila pneumoniae CWL029
uauagacaaugca

SEQ ID NO: 2532094 - RNA, 14 nt, Chlamydophila pneumoniae CWL029
uauagagaagauuu

SEQ ID NO: 2532095 - RNA, 14 nt, Chlamydophila pneumoniae CWL029
uauagaucuugaaa

SEQ ID NO: 2532096 - RNA, 15 nt, Chlamydophila pneumoniae CWL029
uauagcccucuccaa

SEQ ID NO: 2532097 - RNA, 22 nt, Chlamydophila pneumoniae CWL029
uauagcuggcaaugauauccuc

SEQ ID NO: 2532098 - RNA, 17 nt, Chlamydophila pneumoniae CWL029
uauaggaagcucuucua

SEQ ID NO: 2532099 - RNA, 19 nt, Chlamydophila pneumoniae CWL029
uauaggcgugugaaaucug

SEQ ID NO: 2532100 - RNA, 17 nt, Chlamydophila pneumoniae CWL029
uauaggcugcacacauc

SEQ ID NO: 2532101 - RNA, 21 nt, Chlamydophila pneumoniae CWL029
uauaguagcgaauccagaauu

SEQ ID NO: 2532102 - RNA, 20 nt, Chlamydophila pneumoniae CWL029
uauaguauaauagugagcuc

SEQ ID NO: 2532103 - RNA, 14 nt, Chlamydophila pneumoniae CWL029
uauauaaaacauag

SEQ ID NO: 2532104 - RNA, 18 nt, Chlamydophila pneumoniae CWL029
uauauaaagguuacaagc

SEQ ID NO: 2532105 - RNA, 19 nt, Chlamydophila pneumoniae CWL029
uauauaagauaauagagaa

SEQ ID NO: 2532106 - RNA, 14 nt, Chlamydophila pneumoniae CWL029
uauauagagcagac

SEQ ID NO: 2532107 - RNA, 14 nt, Chlamydophila pneumoniae CWL029
uauauauuuuacaa

SEQ ID NO: 2532108 - RNA, 14 nt, Chlamydophila pneumoniae CWL029
uauaucauuaagaa

SEQ ID NO: 2532109 - RNA, 22 nt, Chlamydophila pneumoniae CWL029
uauaucgccguuaaagacuucu

SEQ ID NO: 2532110 - RNA, 20 nt, Chlamydophila pneumoniae CWL029
uauaugcuacaaacucuucc

SEQ ID NO: 2532111 - RNA, 21 nt, Chlamydophila pneumoniae CWL029
uauaugcuacaaacucuucca

SEQ ID NO: 2532112 - RNA, 22 nt, Chlamydophila pneumoniae CWL029
uauauguaauuucccuaauucu

SEQ ID NO: 2532113 - RNA, 12 nt, Chlamydophila pneumoniae CWL029
uauauugacaac

SEQ ID NO: 2532114 - RNA, 16 nt, Chlamydophila pneumoniae CWL029
uauauuggcuuucuac

SEQ ID NO: 2532115 - RNA, 21 nt, Chlamydophila pneumoniae CWL029
uaucaaaaggaucguuuugug

SEQ ID NO: 2532116 - RNA, 19 nt, Chlamydophila pneumoniae CWL029
uaucaaaagguuuuauaaa

SEQ ID NO: 2532117 - RNA, 16 nt, Chlamydophila pneumoniae CWL029
uaucaaccauaaagaa

SEQ ID NO: 2532118 - RNA, 17 nt, Chlamydophila pneumoniae CWL029
uaucaaccauaaagaau

SEQ ID NO: 2532119 - RNA, 11 nt, Chlamydophila pneumoniae CWL029
uaucaauaaug

SEQ ID NO: 2532120 - RNA, 22 nt, Chlamydophila pneumoniae CWL029
uaucagcuggguaaguccacaa

SEQ ID NO: 2532121 - RNA, 15 nt, Chlamydophila pneumoniae CWL029
uaucauaucuucaaa

SEQ ID NO: 2532122 - RNA, 14 nt, Chlamydophila pneumoniae CWL029
uaucaucaaaagau

SEQ ID NO: 2532123 - RNA, 21 nt, Chlamydophila pneumoniae CWL029
uaucaucaaaagauaugucuu

SEQ ID NO: 2532124 - RNA, 19 nt, Chlamydophila pneumoniae CWL029
uaucauggacaagcaaaag

SEQ ID NO: 2532125 - RNA, 18 nt, Chlamydophila pneumoniae CWL029
uaucauuaagaagauucu

SEQ ID NO: 2532126 - RNA, 21 nt, Chlamydophila pneumoniae CWL029
uaucauugcuauugaaaaauc

SEQ ID NO: 2532127 - RNA, 23 nt, Chlamydophila pneumoniae CWL029
uacagaaagagcuaaagaaacuu

SEQ ID NO: 2532128 - RNA, 20 nt, Chlamydophila pneumoniae CWL029
uaguaauuacagcuuuaauc

SEQ ID NO: 2532129 - RNA, 21 nt, Chlamydophila pneumoniae CWL029
uaguauggcauucuuuuucua

SEQ ID NO: 2532130 - RNA, 14 nt, Chlamydophila pneumoniae CWL029
uaguauuuuuaaau

SEQ ID NO: 2532131 - RNA, 12 nt, Chlamydophila pneumoniae CWL029
uagucaaaaauu

SEQ ID NO: 2532132 - RNA, 14 nt, Chlamydophila pneumoniae CWL029
uaguccaucccugc

SEQ ID NO: 2532133 - RNA, 19 nt, Chlamydophila pneumoniae CWL029
uaguccuuauuucaaagaa

SEQ ID NO: 2532134 - RNA, 16 nt, Chlamydophila pneumoniae CWL029
uagucgggaccauaaa

SEQ ID NO: 2532135 - RNA, 18 nt, Chlamydophila pneumoniae CWL029
uagucgucuuuuaaagag

SEQ ID NO: 2532136 - RNA, 19 nt, Chlamydophila pneumoniae CWL029
uagucgucuuuuaaagagc

SEQ ID NO: 2532137 - RNA, 14 nt, Chlamydophila pneumoniae CWL029
uagucguuuucucg

SEQ ID NO: 2532138 - RNA, 20 nt, Chlamydophila pneumoniae CWL029
uauccaaguccgugagagga

SEQ ID NO: 2532139 - RNA, 15 nt, Chlamydophila pneumoniae CWL029
uauccaaugagagag

SEQ ID NO: 2532140 - RNA, 21 nt, Chlamydophila pneumoniae CWL029
uauccacaaucucuuuaaaaa

SEQ ID NO: 2532141 - RNA, 18 nt, Chlamydophila pneumoniae CWL029
uauccagaaauacgucca

SEQ ID NO: 2532142 - RNA, 23 nt, Chlamydophila pneumoniae CWL029
uauccagcucaaggcaucuagag

SEQ ID NO: 2532143 - RNA, 18 nt, Chlamydophila pneumoniae CWL029
uauccaggguagcgcuuu

SEQ ID NO: 2532144 - RNA, 13 nt, Chlamydophila pneumoniae CWL029
uauccauacggua

SEQ ID NO: 2532145 - RNA, 19 nt, Chlamydophila pneumoniae CWL029
uauccccagaucucuuuag

SEQ ID NO: 2532146 - RNA, 14 nt, Chlamydophila pneumoniae CWL029
uauccuauuggaag

SEQ ID NO: 2532147 - RNA, 14 nt, Chlamydophila pneumoniae CWL029
uauccucgucuuca

SEQ ID NO: 2532148 - RNA, 15 nt, Chlamydophila pneumoniae CWL029
uauccucgucuucaa

SEQ ID NO: 2532149 - RNA, 15 nt, Chlamydophila pneumoniae CWL029
uauccuuaucuugcu

SEQ ID NO: 2532150 - RNA, 18 nt, Chlamydophila pneumoniae CWL029
uauccuugaaauugcucu

SEQ ID NO: 2532151 - RNA, 19 nt, Chlamydophila pneumoniae CWL029
uaucgaagagcccucuuca

SEQ ID NO: 2532152 - RNA, 16 nt, Chlamydophila pneumoniae CWL029
uaucgaccuuaaaauu

SEQ ID NO: 2532153 - RNA, 17 nt, Chlamydophila pneumoniae CWL029
uaucgccguuaaagacu

SEQ ID NO: 2532154 - RNA, 17 nt, Chlamydophila pneumoniae CWL029
uaucggcaauuguuaaa

SEQ ID NO: 2532155 - RNA, 13 nt, Chlamydophila pneumoniae CWL029
uaucuaaaacuuc

SEQ ID NO: 2532156 - RNA, 14 nt, Chlamydophila pneumoniae CWL029
uaucuaagacuucu

SEQ ID NO: 2532157 - RNA, 13 nt, Chlamydophila pneumoniae CWL029
uaucuaauaaaau

SEQ ID NO: 2532158 - RNA, 22 nt, Chlamydophila pneumoniae CWL029
uaucuaaucaauucgcucagaa

SEQ ID NO: 2532159 - RNA, 12 nt, Chlamydophila pneumoniae CWL029
uaucuacagaga

SEQ ID NO: 2532160 - RNA, 18 nt, Chlamydophila pneumoniae CWL029
uaucuacagagagaaacu

SEQ ID NO: 2532161 - RNA, 13 nt, Chlamydophila pneumoniae CWL029
uaucuacgagcau

SEQ ID NO: 2532162 - RNA, 21 nt, Chlamydophila pneumoniae CWL029
uaucuagaaguuuaaacgucu

SEQ ID NO: 2532163 - RNA, 20 nt, Chlamydophila pneumoniae CWL029
uaucuauccuuaggugaaau

SEQ ID NO: 2532164 - RNA, 22 nt, Chlamydophila pneumoniae CWL029
uaucuauccuuaggugaaauau

SEQ ID NO: 2532165 - RNA, 18 nt, Chlamydophila pneumoniae CWL029
uaucucccaagacgagaa

SEQ ID NO: 2532166 - RNA, 20 nt, Chlamydophila pneumoniae CWL029
uaucuccgccauaacacuuu

SEQ ID NO: 2532167 - RNA, 20 nt, Chlamydophila pneumoniae CWL029
uaucuccggaacgcagaguu

SEQ ID NO: 2532168 - RNA, 19 nt, Chlamydophila pneumoniae CWL029
uaucuccgggaacaacugu

SEQ ID NO: 2532169 - RNA, 18 nt, Chlamydophila pneumoniae CWL029
uaucuccguuaccaaaaa

SEQ ID NO: 2532170 - RNA, 18 nt, Chlamydophila pneumoniae CWL029
uaucucuaccgaacagag

SEQ ID NO: 2532171 - RNA, 18 nt, Chlamydophila pneumoniae CWL029
uaucucuacgaugaacua

SEQ ID NO: 2532172 - RNA, 23 nt, Chlamydophila pneumoniae CWL029
uaucugagcauaacuugaagaag

SEQ ID NO: 2532173 - RNA, 15 nt, Chlamydophila pneumoniae CWL029
uaucugcguuucuuu

SEQ ID NO: 2532174 - RNA, 18 nt, Chlamydophila pneumoniae CWL029
uaucugcguuucuuucug

SEQ ID NO: 2532175 - RNA, 10 nt, Chlamydophila pneumoniae CWL029
uaucugcuau

SEQ ID NO: 2532176 - RNA, 14 nt, Chlamydophila pneumoniae CWL029
uaucugcuucuacg

SEQ ID NO: 2532177 - RNA, 19 nt, Chlamydophila pneumoniae CWL029
uaucuguauccuuccuuau

SEQ ID NO: 2532178 - RNA, 20 nt, Chlamydophila pneumoniae CWL029
uaucuguggcguaagcaaua

SEQ ID NO: 2532179 - RNA, 16 nt, Chlamydophila pneumoniae CWL029
uaucuugaaaguacag

SEQ ID NO: 2532180 - RNA, 16 nt, Chlamydophila pneumoniae CWL029
uaucuuuauuuaaaua

SEQ ID NO: 2532181 - RNA, 15 nt, Chlamydophila pneumoniae CWL029
uaugaaacccauaau

SEQ ID NO: 2532182 - RNA, 12 nt, Chlamydophila pneumoniae CWL029
uaugaaucacau

SEQ ID NO: 2532183 - RNA, 16 nt, Chlamydophila pneumoniae CWL029
uaugaaucacaucuaa

SEQ ID NO: 2532184 - RNA, 16 nt, Chlamydophila pneumoniae CWL029
uaugaaugacugcaga

SEQ ID NO: 2532185 - RNA, 15 nt, Chlamydophila pneumoniae CWL029
uaugaccaagaacau

SEQ ID NO: 2532186 - RNA, 19 nt, Chlamydophila pneumoniae CWL029
uaugacggauccuagaaua

SEQ ID NO: 2532187 - RNA, 18 nt, Chlamydophila pneumoniae CWL029
uaugagauaggaacucac

SEQ ID NO: 2532188 - RNA, 18 nt, Chlamydophila pneumoniae CWL029
uaugauagaacucuccuc

SEQ ID NO: 2532189 - RNA, 22 nt, Chlamydophila pneumoniae CWL029
uaugauccaauagccaaagacu

SEQ ID NO: 2532190 - RNA, 21 nt, Chlamydophila pneumoniae CWL029
uaugaugccucauugccgugg

SEQ ID NO: 2532191 - RNA, 16 nt, Chlamydophila pneumoniae CWL029
uaugauguauaaaguu

SEQ ID NO: 2532192 - RNA, 15 nt, Chlamydophila pneumoniae CWL029
uaugauuacaucuaa

SEQ ID NO: 2532193 - RNA, 14 nt, Chlamydophila pneumoniae CWL029
uaugcacaaaauaa

SEQ ID NO: 2532194 - RNA, 12 nt, Chlamydophila pneumoniae CWL029
uaugcaucaaug

SEQ ID NO: 2532195 - RNA, 17 nt, Chlamydophila pneumoniae CWL029
uaugccauaaauacagg

SEQ ID NO: 2532196 - RNA, 23 nt, Chlamydophila pneumoniae CWL029
uaugccucaggucugcugaggag

SEQ ID NO: 2532197 - RNA, 18 nt, Chlamydophila pneumoniae CWL029
uaugcgacccauuugucu

SEQ ID NO: 2532198 - RNA, 22 nt, Chlamydophila pneumoniae CWL029
uaugcucauuaauaauaucuaa

SEQ ID NO: 2532199 - RNA, 18 nt, Chlamydophila pneumoniae CWL029
uaugcugaauuccucuga

SEQ ID NO: 2532200 - RNA, 20 nt, Chlamydophila pneumoniae CWL029
uaugcugaauuccucugauu

SEQ ID NO: 2532201 - RNA, 21 nt, Chlamydophila pneumoniae CWL029
uaugcuguugcuccaagaguu

SEQ ID NO: 2532202 - RNA, 23 nt, Chlamydophila pneumoniae CWL029
uaugcuguugcuccaagaguucu

SEQ ID NO: 2532203 - RNA, 21 nt, Chlamydophila pneumoniae CWL029
uauggaagagagcaagauaau

SEQ ID NO: 2532204 - RNA, 22 nt, Chlamydophila pneumoniae CWL029
uauggaaggcggcuuuuugcaa

SEQ ID NO: 2532205 - RNA, 13 nt, Chlamydophila pneumoniae CWL029
uaugggaggaauu

SEQ ID NO: 2532206 - RNA, 15 nt, Chlamydophila pneumoniae CWL029
uaugguaguuugccu

SEQ ID NO: 2532207 - RNA, 17 nt, Chlamydophila pneumoniae CWL029
uaugguccauaauuucu

SEQ ID NO: 2532208 - RNA, 12 nt, Chlamydophila pneumoniae CWL029
uaugguccuagg

SEQ ID NO: 2532209 - RNA, 15 nt, Chlamydophila pneumoniae CWL029
uauguacuagauagu

SEQ ID NO: 2532210 - RNA, 18 nt, Chlamydophila pneumoniae CWL029
uauguacugaugugaagc

SEQ ID NO: 2532211 - RNA, 24 nt, Chlamydophila pneumoniae CWL029
uaugugaaagauuauucuagaguu

SEQ ID NO: 2532212 - RNA, 19 nt, Chlamydophila pneumoniae CWL029
uauguuuucucgaagaaaa

SEQ ID NO: 2532213 - RNA, 23 nt, Chlamydophila pneumoniae CWL029
uauguuuucucgaagaaaauaaa

SEQ ID NO: 2532214 - RNA, 20 nt, Chlamydophila pneumoniae CWL029
uauuaaagaugaaguuccca

SEQ ID NO: 2532215 - RNA, 14 nt, Chlamydophila pneumoniae CWL029
uauuaacccaccag

SEQ ID NO: 2532216 - RNA, 16 nt, Chlamydophila pneumoniae CWL029
uauuaacccaccagaa

SEQ ID NO: 2532217 - RNA, 21 nt, Chlamydophila pneumoniae CWL029
uauuacagaaaggcuuuucuu

SEQ ID NO: 2532218 - RNA, 14 nt, Chlamydophila pneumoniae CWL029
uauuacagauuucu

SEQ ID NO: 2532219 - RNA, 15 nt, Chlamydophila pneumoniae CWL029
uauuacagauuucuu

SEQ ID NO: 2532220 - RNA, 17 nt, Chlamydophila pneumoniae CWL029
uauuaggcuuuuuucua

SEQ ID NO: 2532221 - RNA, 18 nt, Chlamydophila pneumoniae CWL029
uauuaucuacagagagaa

SEQ ID NO: 2532222 - RNA, 14 nt, Chlamydophila pneumoniae CWL029
uauuauuuuaaagu

SEQ ID NO: 2532223 - RNA, 20 nt, Chlamydophila pneumoniae CWL029
uauucagguucugaaauugu

SEQ ID NO: 2532224 - RNA, 22 nt, Chlamydophila pneumoniae CWL029
uauucagugucuugaagagauu

SEQ ID NO: 2532225 - RNA, 14 nt, Chlamydophila pneumoniae CWL029
uccaacuucuguau

SEQ ID NO: 2532226 - RNA, 12 nt, Chlamydophila pneumoniae CWL029
uccaagaaguca

SEQ ID NO: 2532227 - RNA, 16 nt, Chlamydophila pneumoniae CWL029
uccaagaauagccaua

SEQ ID NO: 2532228 - RNA, 22 nt, Chlamydophila pneumoniae CWL029
uccaagacaacaccucccacca

SEQ ID NO: 2532229 - RNA, 13 nt, Chlamydophila pneumoniae CWL029
uccaagacaauaa

SEQ ID NO: 2532230 - RNA, 14 nt, Chlamydophila pneumoniae CWL029
uccaagaguucucu

SEQ ID NO: 2532231 - RNA, 16 nt, Chlamydophila pneumoniae CWL029
uccaagaucaaacgaa

SEQ ID NO: 2532232 - RNA, 13 nt, Chlamydophila pneumoniae CWL029
uccaagauugaau

SEQ ID NO: 2532233 - RNA, 19 nt, Chlamydophila pneumoniae CWL029
uccaagugaucagaaauga

SEQ ID NO: 2532234 - RNA, 19 nt, Chlamydophila pneumoniae CWL029
uccaagugcucaguaaaua

SEQ ID NO: 2532235 - RNA, 18 nt, Chlamydophila pneumoniae CWL029
uccaauaauuuucccaau

SEQ ID NO: 2532236 - RNA, 15 nt, Chlamydophila pneumoniae CWL029
uccaauacuaaaacu

SEQ ID NO: 2532237 - RNA, 19 nt, Chlamydophila pneumoniae CWL029
uccaauagccaaagacucu

SEQ ID NO: 2532238 - RNA, 19 nt, Chlamydophila pneumoniae CWL029
uccaauaggccagaaugua

SEQ ID NO: 2532239 - RNA, 19 nt, Chlamydophila pneumoniae CWL029
uccaauccauucugagaaa

SEQ ID NO: 2532240 - RNA, 18 nt, Chlamydophila pneumoniae CWL029
uccaaucugcugaaggga

SEQ ID NO: 2532241 - RNA, 15 nt, Chlamydophila pneumoniae CWL029
uccaaugcuauugga

SEQ ID NO: 2532242 - RNA, 17 nt, Chlamydophila pneumoniae CWL029
uccaauggcugagagau

SEQ ID NO: 2532243 - RNA, 16 nt, Chlamydophila pneumoniae CWL029
uccaauuguaaaucau

SEQ ID NO: 2532244 - RNA, 13 nt, Chlamydophila pneumoniae CWL029
uccacaagccucc

SEQ ID NO: 2532245 - RNA, 21 nt, Chlamydophila pneumoniae CWL029
uccacaaucucuuuaaaaauu

SEQ ID NO: 2532246 - RNA, 16 nt, Chlamydophila pneumoniae CWL029
uccacacaacucguuu

SEQ ID NO: 2532247 - RNA, 16 nt, Chlamydophila pneumoniae CWL029
uccacagacugcagga

SEQ ID NO: 2532248 - RNA, 17 nt, Chlamydophila pneumoniae CWL029
uccacagagaccuucuc

SEQ ID NO: 2532249 - RNA, 21 nt, Chlamydophila pneumoniae CWL029
uccacagaucguaaucuguau

SEQ ID NO: 2532250 - RNA, 21 nt, Chlamydophila pneumoniae CWL029
uccacaucuugagcuucaaaa

SEQ ID NO: 2532251 - RNA, 18 nt, Chlamydophila pneumoniae CWL029
uccacaugcccaaacauc

SEQ ID NO: 2532252 - RNA, 15 nt, Chlamydophila pneumoniae CWL029
uccaccaagacugaa

SEQ ID NO: 2532253 - RNA, 20 nt, Chlamydophila pneumoniae CWL029
uccaccaaugauaauuucau

SEQ ID NO: 2532254 - RNA, 15 nt, Chlamydophila pneumoniae CWL029
uccacgaaggaaucu

SEQ ID NO: 2532255 - RNA, 18 nt, Chlamydophila pneumoniae CWL029
uccacgaaggaaucugau

SEQ ID NO: 2532256 - RNA, 14 nt, Chlamydophila pneumoniae CWL029
uccacgaauucuuu

SEQ ID NO: 2532257 - RNA, 15 nt, Chlamydophila pneumoniae CWL029
uccacuacugucaau

SEQ ID NO: 2532258 - RNA, 19 nt, Chlamydophila pneumoniae CWL029
uccacugcagcagguguca

SEQ ID NO: 2532259 - RNA, 15 nt, Chlamydophila pneumoniae CWL029
uccacuguucuucuu

SEQ ID NO: 2532260 - RNA, 19 nt, Chlamydophila pneumoniae CWL029
uccacuuuuuucccuccac

SEQ ID NO: 2532261 - RNA, 21 nt, Chlamydophila pneumoniae CWL029
uccagaaacgcagcuuuccuu

SEQ ID NO: 2532262 - RNA, 12 nt, Chlamydophila pneumoniae CWL029
uccagaaaguau

SEQ ID NO: 2532263 - RNA, 19 nt, Chlamydophila pneumoniae CWL029
uccagaaauacguccagcc

SEQ ID NO: 2532264 - RNA, 18 nt, Chlamydophila pneumoniae CWL029
uccagaaauuacuguggu

SEQ ID NO: 2532265 - RNA, 19 nt, Chlamydophila pneumoniae CWL029
uccagaaauuacuguggua

SEQ ID NO: 2532266 - RNA, 15 nt, Chlamydophila pneumoniae CWL029
uccagaaauuuuuac

SEQ ID NO: 2532267 - RNA, 15 nt, Chlamydophila pneumoniae CWL029
uccagacaagacacu

SEQ ID NO: 2532268 - RNA, 20 nt, Chlamydophila pneumoniae CWL029
uccagacuuuccucucuuua

SEQ ID NO: 2532269 - RNA, 16 nt, Chlamydophila pneumoniae CWL029
uccagagacaaagcca

SEQ ID NO: 2532270 - RNA, 21 nt, Chlamydophila pneumoniae CWL029
uccagagacaaagccacagcc

SEQ ID NO: 2532271 - RNA, 16 nt, Chlamydophila pneumoniae CWL029
uccagauuagaaaaga

SEQ ID NO: 2532272 - RNA, 20 nt, Chlamydophila pneumoniae CWL029
uccagcaaagcgaccugcaa

SEQ ID NO: 2532273 - RNA, 10 nt, Chlamydophila pneumoniae CWL029
uccagccccc

SEQ ID NO: 2532274 - RNA, 17 nt, Chlamydophila pneumoniae CWL029
uccagcccccaggcugc

SEQ ID NO: 2532275 - RNA, 17 nt, Chlamydophila pneumoniae CWL029
uccagccugugagcucu

SEQ ID NO: 2532276 - RNA, 17 nt, Chlamydophila pneumoniae CWL029
uccagcgaggagaagua

SEQ ID NO: 2532277 - RNA, 22 nt, Chlamydophila pneumoniae CWL029
uccagcuccauaagcuuuucuu

SEQ ID NO: 2532278 - RNA, 14 nt, Chlamydophila pneumoniae CWL029
uccagcuguggugg

SEQ ID NO: 2532279 - RNA, 15 nt, Chlamydophila pneumoniae CWL029
uccagcuucuuucua

SEQ ID NO: 2532280 - RNA, 18 nt, Chlamydophila pneumoniae CWL029
uccaggacguaaaaagaa

SEQ ID NO: 2532281 - RNA, 17 nt, Chlamydophila pneumoniae CWL029
uccaggcucuaggaccc

SEQ ID NO: 2532282 - RNA, 21 nt, Chlamydophila pneumoniae CWL029
uccagguagcagaguuuuucc

SEQ ID NO: 2532283 - RNA, 23 nt, Chlamydophila pneumoniae CWL029
uccaguagagccucuaagaaaau

SEQ ID NO: 2532284 - RNA, 13 nt, Chlamydophila pneumoniae CWL029
uccaguucuucau

SEQ ID NO: 2532285 - RNA, 18 nt, Chlamydophila pneumoniae CWL029
uccaguuuguugaucucu

SEQ ID NO: 2532286 - RNA, 14 nt, Chlamydophila pneumoniae CWL029
uccaguuuuuuaaa

SEQ ID NO: 2532287 - RNA, 12 nt, Chlamydophila pneumoniae CWL029
uccauaaaaaug

SEQ ID NO: 2532288 - RNA, 20 nt, Chlamydophila pneumoniae CWL029
uccauaagcuuuucuuccaa

SEQ ID NO: 2532289 - RNA, 22 nt, Chlamydophila pneumoniae CWL029
uccauaagcuuuucuuccaaag

SEQ ID NO: 2532290 - RNA, 20 nt, Chlamydophila pneumoniae CWL029
uccauaaugcugagaugguc

SEQ ID NO: 2532291 - RNA, 13 nt, Chlamydophila pneumoniae CWL029
uccauaauuucuu

SEQ ID NO: 2532292 - RNA, 18 nt, Chlamydophila pneumoniae CWL029
uccauaauuucuuucaca

SEQ ID NO: 2532293 - RNA, 12 nt, Chlamydophila pneumoniae CWL029
uccauacaggcu

SEQ ID NO: 2532294 - RNA, 21 nt, Chlamydophila pneumoniae CWL029
uccauacccaaauuucuucug

SEQ ID NO: 2532295 - RNA, 15 nt, Chlamydophila pneumoniae CWL029
uccauagaguaucua

SEQ ID NO: 2532296 - RNA, 21 nt, Chlamydophila pneumoniae CWL029
uccauagaguaucuaaaacuu

SEQ ID NO: 2532297 - RNA, 22 nt, Chlamydophila pneumoniae CWL029
uccauagcgauagcuaaaccuu

SEQ ID NO: 2532298 - RNA, 18 nt, Chlamydophila pneumoniae CWL029
uccauagcuuuagaagcc

SEQ ID NO: 2532299 - RNA, 16 nt, Chlamydophila pneumoniae CWL029
uccauaggaacaaagc

SEQ ID NO: 2532300 - RNA, 18 nt, Chlamydophila pneumoniae CWL029
uccauaggaacaaagcca

SEQ ID NO: 2532301 - RNA, 16 nt, Chlamydophila pneumoniae CWL029
uccauaggaucugcau

SEQ ID NO: 2532302 - RNA, 18 nt, Chlamydophila pneumoniae CWL029
uccauaucaaagaucuga

SEQ ID NO: 2532303 - RNA, 17 nt, Chlamydophila pneumoniae CWL029
uccauaucuagaaguuu

SEQ ID NO: 2532304 - RNA, 21 nt, Chlamydophila pneumoniae CWL029
uccaucggggcggacuauguu

SEQ ID NO: 2532305 - RNA, 22 nt, Chlamydophila pneumoniae CWL029
uccaucugcucuuuugcaaguu

SEQ ID NO: 2532306 - RNA, 15 nt, Chlamydophila pneumoniae CWL029
uccauggaauggcua

SEQ ID NO: 2532307 - RNA, 22 nt, Chlamydophila pneumoniae CWL029
uccauggauauggaauggcuuu

SEQ ID NO: 2532308 - RNA, 20 nt, Chlamydophila pneumoniae CWL029
uccauguagaaggggguucu

SEQ ID NO: 2532309 - RNA, 21 nt, Chlamydophila pneumoniae CWL029
uccauuggcauagagccuaga

SEQ ID NO: 2532310 - RNA, 14 nt, Chlamydophila pneumoniae CWL029
uccauuuagaauga

SEQ ID NO: 2532311 - RNA, 12 nt, Chlamydophila pneumoniae CWL029
ucccaaaaaaug

SEQ ID NO: 2532312 - RNA, 14 nt, Chlamydophila pneumoniae CWL029
ucccaaaaaaugcc

SEQ ID NO: 2532313 - RNA, 18 nt, Chlamydophila pneumoniae CWL029
ucccaagcugaaagaaug

SEQ ID NO: 2532314 - RNA, 14 nt, Chlamydophila pneumoniae CWL029
ucccaagggccaga

SEQ ID NO: 2532315 - RNA, 14 nt, Chlamydophila pneumoniae CWL029
ucccaagucugcuu

SEQ ID NO: 2532316 - RNA, 16 nt, Chlamydophila pneumoniae CWL029
ucccaauauccagaaa

SEQ ID NO: 2532317 - RNA, 19 nt, Chlamydophila pneumoniae CWL029
ucccaaucaagauaaaggc

SEQ ID NO: 2532318 - RNA, 12 nt, Chlamydophila pneumoniae CWL029
ucccacagaaau

SEQ ID NO: 2532319 - RNA, 16 nt, Chlamydophila pneumoniae CWL029
ucccaccauauucuca

SEQ ID NO: 2532320 - RNA, 15 nt, Chlamydophila pneumoniae CWL029
ucccacuaagaauga

SEQ ID NO: 2532321 - RNA, 16 nt, Chlamydophila pneumoniae CWL029
ucccagauuacaagag

SEQ ID NO: 2532322 - RNA, 20 nt, Chlamydophila pneumoniae CWL029
ucccagauuuuuuugguugc

SEQ ID NO: 2532323 - RNA, 16 nt, Chlamydophila pneumoniae CWL029
ucccagucgugagaag

SEQ ID NO: 2532324 - RNA, 21 nt, Chlamydophila pneumoniae CWL029
ucccauaaauguauaggcauu

SEQ ID NO: 2532325 - RNA, 18 nt, Chlamydophila pneumoniae CWL029
ucccauagcaaugccuac

SEQ ID NO: 2532326 - RNA, 14 nt, Chlamydophila pneumoniae CWL029
ucccaucaaaggca

SEQ ID NO: 2532327 - RNA, 15 nt, Chlamydophila pneumoniae CWL029
ucccaucacauaaau

SEQ ID NO: 2532328 - RNA, 22 nt, Chlamydophila pneumoniae CWL029
ucccaucaucgagcugaucuuc

SEQ ID NO: 2532329 - RNA, 16 nt, Chlamydophila pneumoniae CWL029
ucccaucgucccuaaa

SEQ ID NO: 2532330 - RNA, 17 nt, Chlamydophila pneumoniae CWL029
ucccaucuuguucuaaa

SEQ ID NO: 2532331 - RNA, 19 nt, Chlamydophila pneumoniae CWL029
ucccaucuuguucuaaaau

SEQ ID NO: 2532332 - RNA, 12 nt, Chlamydophila pneumoniae CWL029
ucccaugggaua

SEQ ID NO: 2532333 - RNA, 16 nt, Chlamydophila pneumoniae CWL029
ucccauguaguaaauu

SEQ ID NO: 2532334 - RNA, 18 nt, Chlamydophila pneumoniae CWL029
ucccaugugcugaagacc

SEQ ID NO: 2532335 - RNA, 16 nt, Chlamydophila pneumoniae CWL029
ucccauuucuggagaa

SEQ ID NO: 2532336 - RNA, 20 nt, Chlamydophila pneumoniae CWL029
uccccaagcucucuccaucu

SEQ ID NO: 2532337 - RNA, 17 nt, Chlamydophila pneumoniae CWL029
uccccauaaccaauaaa

SEQ ID NO: 2532338 - RNA, 19 nt, Chlamydophila pneumoniae CWL029
uccccaugaaaauacaacg

SEQ ID NO: 2532339 - RNA, 17 nt, Chlamydophila pneumoniae CWL029
ucccccagaccuaaaaa

SEQ ID NO: 2532340 - RNA, 14 nt, Chlamydophila pneumoniae CWL029
ucccccauaaaaau

SEQ ID NO: 2532341 - RNA, 24 nt, Chlamydophila pneumoniae CWL029
uccccccucacaauauaaaugcua

SEQ ID NO: 2532342 - RNA, 12 nt, Chlamydophila pneumoniae CWL029
ucccccuaaggg

SEQ ID NO: 2532343 - RNA, 18 nt, Chlamydophila pneumoniae CWL029
uccccucccccaaucaca

SEQ ID NO: 2532344 - RNA, 14 nt, Chlamydophila pneumoniae CWL029
uccccugcaucucu

SEQ ID NO: 2532345 - RNA, 15 nt, Chlamydophila pneumoniae CWL029
uccccuucauucuuu

SEQ ID NO: 2532346 - RNA, 17 nt, Chlamydophila pneumoniae CWL029
ucccgagauaugaagag

SEQ ID NO: 2532347 - RNA, 21 nt, Chlamydophila pneumoniae CWL029
ucccgguaugaucaagaggag

SEQ ID NO: 2532348 - RNA, 22 nt, Chlamydophila pneumoniae CWL029
ucccuaaaguaacgauaagaag

SEQ ID NO: 2532349 - RNA, 21 nt, Chlamydophila pneumoniae CWL029
ucccuacccucaucauccuca

SEQ ID NO: 2532350 - RNA, 21 nt, Chlamydophila pneumoniae CWL029
ucccuagguuuuaucuuuaga

SEQ ID NO: 2532351 - RNA, 23 nt, Chlamydophila pneumoniae CWL029
ucccuauaaagcaaaugccugua

SEQ ID NO: 2532352 - RNA, 21 nt, Chlamydophila pneumoniae CWL029
ucccuauagaacaugaggcac

SEQ ID NO: 2532353 - RNA, 14 nt, Chlamydophila pneumoniae CWL029
ucccucacaagaag

SEQ ID NO: 2532354 - RNA, 23 nt, Chlamydophila pneumoniae CWL029
ucccuccuccucgucuaaagaag

SEQ ID NO: 2532355 - RNA, 12 nt, Chlamydophila pneumoniae CWL029
ucccuccuuccu

SEQ ID NO: 2532356 - RNA, 12 nt, Chlamydophila pneumoniae CWL029
ucccucuucuuc

SEQ ID NO: 2532357 - RNA, 15 nt, Chlamydophila pneumoniae CWL029
ucccucuucuuccaa

SEQ ID NO: 2532358 - RNA, 14 nt, Chlamydophila pneumoniae CWL029
ucccugacacagag

SEQ ID NO: 2532359 - RNA, 22 nt, Chlamydophila pneumoniae CWL029
ucccugagccugugauaguaga

SEQ ID NO: 2532360 - RNA, 20 nt, Chlamydophila pneumoniae CWL029
ucccugauguugcccuacaa

SEQ ID NO: 2532361 - RNA, 18 nt, Chlamydophila pneumoniae CWL029
ucccugauuccauccugu

SEQ ID NO: 2532362 - RNA, 19 nt, Chlamydophila pneumoniae CWL029
ucccugauuccauccuguc

SEQ ID NO: 2532363 - RNA, 18 nt, Chlamydophila pneumoniae CWL029
ucccuggauuucuucugu

SEQ ID NO: 2532364 - RNA, 18 nt, Chlamydophila pneumoniae CWL029
ucccuguaguuucuaaaa

SEQ ID NO: 2532365 - RNA, 16 nt, Chlamydophila pneumoniae CWL029
ucccuguauuaaagaa

SEQ ID NO: 2532366 - RNA, 18 nt, Chlamydophila pneumoniae CWL029
ucccuuagaaauucuaag

SEQ ID NO: 2532367 - RNA, 12 nt, Chlamydophila pneumoniae CWL029
ucccuucuucuu

SEQ ID NO: 2532368 - RNA, 13 nt, Chlamydophila pneumoniae CWL029
ucccuucuucuuu

SEQ ID NO: 2532369 - RNA, 17 nt, Chlamydophila pneumoniae CWL029
ucccuucuucuuuuaga

SEQ ID NO: 2532370 - RNA, 13 nt, Chlamydophila pneumoniae CWL029
ucccuuuuuaagu

SEQ ID NO: 2532371 - RNA, 14 nt, Chlamydophila pneumoniae CWL029
uccgaaaacucuua

SEQ ID NO: 2532372 - RNA, 19 nt, Chlamydophila pneumoniae CWL029
uccgaaaucugacagaccu

SEQ ID NO: 2532373 - RNA, 18 nt, Chlamydophila pneumoniae CWL029
uccgaagacuaccaaucc

SEQ ID NO: 2532374 - RNA, 23 nt, Chlamydophila pneumoniae CWL029
uccgaagacucaaagaacugcau

SEQ ID NO: 2532375 - RNA, 16 nt, Chlamydophila pneumoniae CWL029
uccgaauggagaagga

SEQ ID NO: 2532376 - RNA, 13 nt, Chlamydophila pneumoniae CWL029
uccgagaaacaac

SEQ ID NO: 2532377 - RNA, 17 nt, Chlamydophila pneumoniae CWL029
uccgagaaacaaccauc

SEQ ID NO: 2532378 - RNA, 16 nt, Chlamydophila pneumoniae CWL029
uccgaggagggaaaca

SEQ ID NO: 2532379 - RNA, 18 nt, Chlamydophila pneumoniae CWL029
uccgaggagggaaacacc

SEQ ID NO: 2532380 - RNA, 19 nt, Chlamydophila pneumoniae CWL029
uccgaucauaauuagagag

SEQ ID NO: 2532381 - RNA, 21 nt, Chlamydophila pneumoniae CWL029
uccgaucauaauuagagagaa

SEQ ID NO: 2532382 - RNA, 17 nt, Chlamydophila pneumoniae CWL029
uccgauuaacuuuauac

SEQ ID NO: 2532383 - RNA, 15 nt, Chlamydophila pneumoniae CWL029
uccgauuaguaauga

SEQ ID NO: 2532384 - RNA, 19 nt, Chlamydophila pneumoniae CWL029
uccgauuaguaaugaugua

SEQ ID NO: 2532385 - RNA, 17 nt, Chlamydophila pneumoniae CWL029
uccgcaaguaaucauga

SEQ ID NO: 2532386 - RNA, 18 nt, Chlamydophila pneumoniae CWL029
uccgcauuuccuagugcu

SEQ ID NO: 2532387 - RNA, 20 nt, Chlamydophila pneumoniae CWL029
uccgcuagaggaucuucaag

SEQ ID NO: 2532388 - RNA, 17 nt, Chlamydophila pneumoniae CWL029
uccggggagaacuucaa

SEQ ID NO: 2532389 - RNA, 20 nt, Chlamydophila pneumoniae CWL029
uccguaaggacuguagugaa

SEQ ID NO: 2532390 - RNA, 12 nt, Chlamydophila pneumoniae CWL029
uccguaaguaac

SEQ ID NO: 2532391 - RNA, 14 nt, Chlamydophila pneumoniae CWL029
uccgugagcaacaa

SEQ ID NO: 2532392 - RNA, 18 nt, Chlamydophila pneumoniae CWL029
uccguuaccaaaaacugg

SEQ ID NO: 2532393 - RNA, 17 nt, Chlamydophila pneumoniae CWL029
uccguugaauuaauaaa

SEQ ID NO: 2532394 - RNA, 16 nt, Chlamydophila pneumoniae CWL029
uccguuucagaaguca

SEQ ID NO: 2532395 - RNA, 15 nt, Chlamydophila pneumoniae CWL029
uccguuuuuucagau

SEQ ID NO: 2532396 - RNA, 11 nt, Chlamydophila pneumoniae CWL029
uccuaaaaaaa

SEQ ID NO: 2532397 - RNA, 23 nt, Chlamydophila pneumoniae CWL029
uccuaaaacaagaagaucaaaga

SEQ ID NO: 2532398 - RNA, 13 nt, Chlamydophila pneumoniae CWL029
uccuaaaucugcu

SEQ ID NO: 2532399 - RNA, 20 nt, Chlamydophila pneumoniae CWL029
uccuaaaucugcuuuuaucu

SEQ ID NO: 2532400 - RNA, 23 nt, Chlamydophila pneumoniae CWL029
uccuaaauuaaauaucuaauaaa

SEQ ID NO: 2532401 - RNA, 19 nt, Chlamydophila pneumoniae CWL029
uccuaacuucugaaggaaa

SEQ ID NO: 2532402 - RNA, 18 nt, Chlamydophila pneumoniae CWL029
uccuaagucguuaacauc

SEQ ID NO: 2532403 - RNA, 19 nt, Chlamydophila pneumoniae CWL029
uccuaagucguuaacauca

SEQ ID NO: 2532404 - RNA, 20 nt, Chlamydophila pneumoniae CWL029
uccuaagucguuaacaucaa

SEQ ID NO: 2532405 - RNA, 21 nt, Chlamydophila pneumoniae CWL029
uccuaaguuagagacacagaa

SEQ ID NO: 2532406 - RNA, 19 nt, Chlamydophila pneumoniae CWL029
uccuaccuacguagcauua

SEQ ID NO: 2532407 - RNA, 14 nt, Chlamydophila pneumoniae CWL029
uccuaccuauauuu

SEQ ID NO: 2532408 - RNA, 21 nt, Chlamydophila pneumoniae CWL029
uccuaccuauauuuuuuacau

SEQ ID NO: 2532409 - RNA, 16 nt, Chlamydophila pneumoniae CWL029
uccuacuccuaaagua

SEQ ID NO: 2532410 - RNA, 16 nt, Chlamydophila pneumoniae CWL029
uccuacuucugcagga

SEQ ID NO: 2532411 - RNA, 20 nt, Chlamydophila pneumoniae CWL029
uccuagacagccuugacucu

SEQ ID NO: 2532412 - RNA, 22 nt, Chlamydophila pneumoniae CWL029
uccuagacagccuugacucuaa

SEQ ID NO: 2532413 - RNA, 16 nt, Chlamydophila pneumoniae CWL029
uccuagacgaucuuca

SEQ ID NO: 2532414 - RNA, 15 nt, Chlamydophila pneumoniae CWL029
uccuagcagagaaau

SEQ ID NO: 2532415 - RNA, 17 nt, Chlamydophila pneumoniae CWL029
uccuaggcugagacaua

SEQ ID NO: 2532416 - RNA, 18 nt, Chlamydophila pneumoniae CWL029
uccuagggagugaggaau

SEQ ID NO: 2532417 - RNA, 16 nt, Chlamydophila pneumoniae CWL029
uccuauaguaauuucu

SEQ ID NO: 2532418 - RNA, 17 nt, Chlamydophila pneumoniae CWL029
uccuauaguaauuucuc

SEQ ID NO: 2532419 - RNA, 22 nt, Chlamydophila pneumoniae CWL029
uccuauaugaaugauuuccaua

SEQ ID NO: 2532420 - RNA, 18 nt, Chlamydophila pneumoniae CWL029
uccuaucaaagcaaaagu

SEQ ID NO: 2532421 - RNA, 19 nt, Chlamydophila pneumoniae CWL029
uccuaucaaagcaaaaguc

SEQ ID NO: 2532422 - RNA, 23 nt, Chlamydophila pneumoniae CWL029
ucauaaagugcgagguaugaaua

SEQ ID NO: 2532423 - RNA, 14 nt, Chlamydophila pneumoniae CWL029
ucauaaccugggca

SEQ ID NO: 2532424 - RNA, 12 nt, Chlamydophila pneumoniae CWL029
ucauaagaaauu

SEQ ID NO: 2532425 - RNA, 16 nt, Chlamydophila pneumoniae CWL029
ucauaagaguagacaa

SEQ ID NO: 2532426 - RNA, 18 nt, Chlamydophila pneumoniae CWL029
ucauaagcucuauuucug

SEQ ID NO: 2532427 - RNA, 21 nt, Chlamydophila pneumoniae CWL029
ucauaagcucuauuucugccu

SEQ ID NO: 2532428 - RNA, 23 nt, Chlamydophila pneumoniae CWL029
ucauaauuagagagaaugcccug

SEQ ID NO: 2532429 - RNA, 23 nt, Chlamydophila pneumoniae CWL029
ucauacgccgugccuauagaaau

SEQ ID NO: 2532430 - RNA, 22 nt, Chlamydophila pneumoniae CWL029
ucauagagauaucaucaaaaga

SEQ ID NO: 2532431 - RNA, 20 nt, Chlamydophila pneumoniae CWL029
ucauaucugcgccagcucuc

SEQ ID NO: 2532432 - RNA, 15 nt, Chlamydophila pneumoniae CWL029
ucauauuuaaaaggc

SEQ ID NO: 2532433 - RNA, 22 nt, Chlamydophila pneumoniae CWL029
ucauauuuugucuucaucauaa

SEQ ID NO: 2532434 - RNA, 18 nt, Chlamydophila pneumoniae CWL029
ucaucaaaacauaaugau

SEQ ID NO: 2532435 - RNA, 17 nt, Chlamydophila pneumoniae CWL029
ucaucacaauuuuaaaa

SEQ ID NO: 2532436 - RNA, 18 nt, Chlamydophila pneumoniae CWL029
ucaucagaaaucaaaggg

SEQ ID NO: 2532437 - RNA, 12 nt, Chlamydophila pneumoniae CWL029
ucaucagaagug

SEQ ID NO: 2532438 - RNA, 18 nt, Chlamydophila pneumoniae CWL029
ucaucagcaaaacucccg

SEQ ID NO: 2532439 - RNA, 16 nt, Chlamydophila pneumoniae CWL029
ucaucagcaaccuuuc

SEQ ID NO: 2532440 - RNA, 16 nt, Chlamydophila pneumoniae CWL029
ucaucaguaaaagacu

SEQ ID NO: 2532441 - RNA, 18 nt, Chlamydophila pneumoniae CWL029
ucaucauaacuaggguac

SEQ ID NO: 2532442 - RNA, 13 nt, Chlamydophila pneumoniae CWL029
ucaucauccucag

SEQ ID NO: 2532443 - RNA, 14 nt, Chlamydophila pneumoniae CWL029
ucaucauuucuaca

SEQ ID NO: 2532444 - RNA, 17 nt, Chlamydophila pneumoniae CWL029
ucauccagauuagaaaa

SEQ ID NO: 2532445 - RNA, 20 nt, Chlamydophila pneumoniae CWL029
ucauccagauuagaaaagau

SEQ ID NO: 2532446 - RNA, 17 nt, Chlamydophila pneumoniae CWL029
ucauccccucagaaagg

SEQ ID NO: 2532447 - RNA, 22 nt, Chlamydophila pneumoniae CWL029
ucaucccuacccucaucauccu

SEQ ID NO: 2532448 - RNA, 16 nt, Chlamydophila pneumoniae CWL029
ucauccucaucaucag

SEQ ID NO: 2532449 - RNA, 13 nt, Chlamydophila pneumoniae CWL029
ucaucgauaggau

SEQ ID NO: 2532450 - RNA, 21 nt, Chlamydophila pneumoniae CWL029
ucaucgcgagaggggaaccaa

SEQ ID NO: 2532451 - RNA, 21 nt, Chlamydophila pneumoniae CWL029
ucaucggaucuuuucuuucua

SEQ ID NO: 2532452 - RNA, 18 nt, Chlamydophila pneumoniae CWL029
ucaucggcauaacuuuau

SEQ ID NO: 2532453 - RNA, 18 nt, Chlamydophila pneumoniae CWL029
ucaucuacgauguuuucu

SEQ ID NO: 2532454 - RNA, 21 nt, Chlamydophila pneumoniae CWL029
ucaucucacaagcauccuaga

SEQ ID NO: 2532455 - RNA, 14 nt, Chlamydophila pneumoniae CWL029
ucaucucauaguuu

SEQ ID NO: 2532456 - RNA, 23 nt, Chlamydophila pneumoniae CWL029
ucaucucauaguuucuaucuaau

SEQ ID NO: 2532457 - RNA, 16 nt, Chlamydophila pneumoniae CWL029
ucaucuggaaaagccu

SEQ ID NO: 2532458 - RNA, 11 nt, Chlamydophila pneumoniae CWL029
ucaucuucuuu

SEQ ID NO: 2532459 - RNA, 13 nt, Chlamydophila pneumoniae CWL029
ucaugaaaaaaga

SEQ ID NO: 2532460 - RNA, 22 nt, Chlamydophila pneumoniae CWL029
ucaugaaaaaagaauaaaaaua

SEQ ID NO: 2532461 - RNA, 13 nt, Chlamydophila pneumoniae CWL029
ucaugaaaaggau

SEQ ID NO: 2532462 - RNA, 20 nt, Chlamydophila pneumoniae CWL029
ucaugaaagugcucuuuuaa

SEQ ID NO: 2532463 - RNA, 10 nt, Chlamydophila pneumoniae CWL029
ucaugaggac

SEQ ID NO: 2532464 - RNA, 14 nt, Chlamydophila pneumoniae CWL029
ucaugauaaaaauu

SEQ ID NO: 2532465 - RNA, 16 nt, Chlamydophila pneumoniae CWL029
ucaugauaaaaauuuu

SEQ ID NO: 2532466 - RNA, 20 nt, Chlamydophila pneumoniae CWL029
ucaugauauuuuuauuuaaa

SEQ ID NO: 2532467 - RNA, 20 nt, Chlamydophila pneumoniae CWL029
ucaugccgcauuucuucaau

SEQ ID NO: 2532468 - RNA, 17 nt, Chlamydophila pneumoniae CWL029
ucaugcgcuaccuuagu

SEQ ID NO: 2532469 - RNA, 18 nt, Chlamydophila pneumoniae CWL029
ucauggauuacugaagau

SEQ ID NO: 2532470 - RNA, 21 nt, Chlamydophila pneumoniae CWL029
ucauguccuccauggaaagaa

SEQ ID NO: 2532471 - RNA, 13 nt, Chlamydophila pneumoniae CWL029
ucauguccuucaa

SEQ ID NO: 2532472 - RNA, 17 nt, Chlamydophila pneumoniae CWL029
ucauguccuucaaaaug

SEQ ID NO: 2532473 - RNA, 12 nt, Chlamydophila pneumoniae CWL029
ucauuaaaaauu

SEQ ID NO: 2532474 - RNA, 15 nt, Chlamydophila pneumoniae CWL029
ucauuaaaaauuuaa

SEQ ID NO: 2532475 - RNA, 14 nt, Chlamydophila pneumoniae CWL029
ucauuaagauccuu

SEQ ID NO: 2532476 - RNA, 13 nt, Chlamydophila pneumoniae CWL029
ucauuaaguacug

SEQ ID NO: 2532477 - RNA, 14 nt, Chlamydophila pneumoniae CWL029
ucauuaauguugcu

SEQ ID NO: 2532478 - RNA, 19 nt, Chlamydophila pneumoniae CWL029
ucauuaccugcuaaacuuu

SEQ ID NO: 2532479 - RNA, 16 nt, Chlamydophila pneumoniae CWL029
ucauuacggaggcaua

SEQ ID NO: 2532480 - RNA, 16 nt, Chlamydophila pneumoniae CWL029
ucauuagcaagagcuc

SEQ ID NO: 2532481 - RNA, 22 nt, Chlamydophila pneumoniae CWL029
ucauuagcaucaucuccugaag

SEQ ID NO: 2532482 - RNA, 18 nt, Chlamydophila pneumoniae CWL029
ucauuaucaagaaauucu

SEQ ID NO: 2532483 - RNA, 11 nt, Chlamydophila pneumoniae CWL029
ucauuauuaaa

SEQ ID NO: 2532484 - RNA, 15 nt, Chlamydophila pneumoniae CWL029
ucauucaccuugauu

SEQ ID NO: 2532485 - RNA, 15 nt, Chlamydophila pneumoniae CWL029
ucauuccagcaucuu

SEQ ID NO: 2532486 - RNA, 18 nt, Chlamydophila pneumoniae CWL029
ucauuccagcaucuucuc

SEQ ID NO: 2532487 - RNA, 14 nt, Chlamydophila pneumoniae CWL029
ucauucccuuuuuc

SEQ ID NO: 2532488 - RNA, 18 nt, Chlamydophila pneumoniae CWL029
ucauugcggcaccaaaga

SEQ ID NO: 2532489 - RNA, 20 nt, Chlamydophila pneumoniae CWL029
ucauugcuauugaaaaaucc

SEQ ID NO: 2532490 - RNA, 19 nt, Chlamydophila pneumoniae CWL029
ucauuuaucugcguuucuu

SEQ ID NO: 2532491 - RNA, 20 nt, Chlamydophila pneumoniae CWL029
ucauuuaucugcguuucuuu

SEQ ID NO: 2532492 - RNA, 23 nt, Chlamydophila pneumoniae CWL029
ucauuucgauaacacuucuuucu

SEQ ID NO: 2532493 - RNA, 14 nt, Chlamydophila pneumoniae CWL029
ucauuuucauagca

SEQ ID NO: 2532494 - RNA, 15 nt, Chlamydophila pneumoniae CWL029
ucauuuucuuuuaag

SEQ ID NO: 2532495 - RNA, 13 nt, Chlamydophila pneumoniae CWL029
ucauuuuuuaaua

SEQ ID NO: 2532496 - RNA, 12 nt, Chlamydophila pneumoniae CWL029
uccaaaaaagag

SEQ ID NO: 2532497 - RNA, 21 nt, Chlamydophila pneumoniae CWL029
uccaaaaaaugcuccugcaaa

SEQ ID NO: 2532498 - RNA, 18 nt, Chlamydophila pneumoniae CWL029
uccaaaaacgauucgaaa

SEQ ID NO: 2532499 - RNA, 17 nt, Chlamydophila pneumoniae CWL029
uccaaaaacuucuaacu

SEQ ID NO: 2532500 - RNA, 16 nt, Chlamydophila pneumoniae CWL029
uccaaaauaaaaggag

SEQ ID NO: 2532501 - RNA, 12 nt, Chlamydophila pneumoniae CWL029
uccaaaaucauc

SEQ ID NO: 2532502 - RNA, 12 nt, Chlamydophila pneumoniae CWL029
uccaaaaucucu

SEQ ID NO: 2532503 - RNA, 19 nt, Chlamydophila pneumoniae CWL029
uccaaaaugucuuuuucaa

SEQ ID NO: 2532504 - RNA, 16 nt, Chlamydophila pneumoniae CWL029
uccaaacauuuuuaag

SEQ ID NO: 2532505 - RNA, 18 nt, Chlamydophila pneumoniae CWL029
uccaaacauuuuuaagga

SEQ ID NO: 2532506 - RNA, 19 nt, Chlamydophila pneumoniae CWL029
ucgacaggggaguuuucaa

SEQ ID NO: 2532507 - RNA, 14 nt, Chlamydophila pneumoniae CWL029
ucgaccuauuugca

SEQ ID NO: 2532508 - RNA, 20 nt, Chlamydophila pneumoniae CWL029
ucgacuucaccuugaaguuu

SEQ ID NO: 2532509 - RNA, 15 nt, Chlamydophila pneumoniae CWL029
ucgacuuccuucaau

SEQ ID NO: 2532510 - RNA, 21 nt, Chlamydophila pneumoniae CWL029
ucgagaaaugcucuucugcag

SEQ ID NO: 2532511 - RNA, 15 nt, Chlamydophila pneumoniae CWL029
ucgagaaccuccacc

SEQ ID NO: 2532512 - RNA, 18 nt, Chlamydophila pneumoniae CWL029
ucgagaacguagcagagg

SEQ ID NO: 2532513 - RNA, 15 nt, Chlamydophila pneumoniae CWL029
ucgagagaagaaauu

SEQ ID NO: 2532514 - RNA, 17 nt, Chlamydophila pneumoniae CWL029
ucgagagaagaaauucu

SEQ ID NO: 2532515 - RNA, 16 nt, Chlamydophila pneumoniae CWL029
ucgagauauugugagg

SEQ ID NO: 2532516 - RNA, 17 nt, Chlamydophila pneumoniae CWL029
ucgagaucuuuuugcca

SEQ ID NO: 2532517 - RNA, 19 nt, Chlamydophila pneumoniae CWL029
ucgagcagaaacuccaaaa

SEQ ID NO: 2532518 - RNA, 15 nt, Chlamydophila pneumoniae CWL029
ucgagcagaaaugau

SEQ ID NO: 2532519 - RNA, 17 nt, Chlamydophila pneumoniae CWL029
ucgaguauggcaaauaa

SEQ ID NO: 2532520 - RNA, 21 nt, Chlamydophila pneumoniae CWL029
ucgaguauggcaaauaaaaca

SEQ ID NO: 2532521 - RNA, 19 nt, Chlamydophila pneumoniae CWL029
ucgauaacacuucuuucuu

SEQ ID NO: 2532522 - RNA, 20 nt, Chlamydophila pneumoniae CWL029
ucgauaacacuucuuucuug

SEQ ID NO: 2532523 - RNA, 18 nt, Chlamydophila pneumoniae CWL029
ucgauaagaacuuuaggg

SEQ ID NO: 2532524 - RNA, 23 nt, Chlamydophila pneumoniae CWL029
ucgauaaucaaagguuuuugauu

SEQ ID NO: 2532525 - RNA, 15 nt, Chlamydophila pneumoniae CWL029
ucgauacccaaagag

SEQ ID NO: 2532526 - RNA, 16 nt, Chlamydophila pneumoniae CWL029
ucgauacgguuuuuau

SEQ ID NO: 2532527 - RNA, 17 nt, Chlamydophila pneumoniae CWL029
ucgauaggaagccaguc

SEQ ID NO: 2532528 - RNA, 22 nt, Chlamydophila pneumoniae CWL029
ucgauaucucuaccgaacagag

SEQ ID NO: 2532529 - RNA, 13 nt, Chlamydophila pneumoniae CWL029
ucgaucaaggugu

SEQ ID NO: 2532530 - RNA, 23 nt, Chlamydophila pneumoniae CWL029
ucgaucccggcuuugggcaucuc

SEQ ID NO: 2532531 - RNA, 17 nt, Chlamydophila pneumoniae CWL029
ucgaugagggaaaugcg

SEQ ID NO: 2532532 - RNA, 13 nt, Chlamydophila pneumoniae CWL029
ucgaugcuauuuu

SEQ ID NO: 2532533 - RNA, 17 nt, Chlamydophila pneumoniae CWL029
ucgaugcuauuuuucca

SEQ ID NO: 2532534 - RNA, 21 nt, Chlamydophila pneumoniae CWL029
ucgcaaaaauccgauaagaua

SEQ ID NO: 2532535 - RNA, 23 nt, Chlamydophila pneumoniae CWL029
ucgcaacuuaagauacuucucca

SEQ ID NO: 2532536 - RNA, 16 nt, Chlamydophila pneumoniae CWL029
ucgcaauccaggaaua

SEQ ID NO: 2532537 - RNA, 13 nt, Chlamydophila pneumoniae CWL029
ucgcaguaaugcc

SEQ ID NO: 2532538 - RNA, 13 nt, Chlamydophila pneumoniae CWL029
ucgccaaaccaug

SEQ ID NO: 2532539 - RNA, 13 nt, Chlamydophila pneumoniae CWL029
ucgccucuuguca

SEQ ID NO: 2532540 - RNA, 19 nt, Chlamydophila pneumoniae CWL029
ucgccuuccuuaacaacau

SEQ ID NO: 2532541 - RNA, 15 nt, Chlamydophila pneumoniae CWL029
ucgcggaucuucuuc

SEQ ID NO: 2532542 - RNA, 16 nt, Chlamydophila pneumoniae CWL029
ucgcuacauaaaauga

SEQ ID NO: 2532543 - RNA, 15 nt, Chlamydophila pneumoniae CWL029
ucgcuagaucacaag

SEQ ID NO: 2532544 - RNA, 17 nt, Chlamydophila pneumoniae CWL029
ucgcuagaucacaagaa

SEQ ID NO: 2532545 - RNA, 23 nt, Chlamydophila pneumoniae CWL029
ucgcuagguauacgguaaugcca

SEQ ID NO: 2532546 - RNA, 20 nt, Chlamydophila pneumoniae CWL029
ucgcucagaaaauguaaaaa

SEQ ID NO: 2532547 - RNA, 17 nt, Chlamydophila pneumoniae CWL029
ucgcuccuaagcuuuua

SEQ ID NO: 2532548 - RNA, 14 nt, Chlamydophila pneumoniae CWL029
ucgcucuccucucg

SEQ ID NO: 2532549 - RNA, 18 nt, Chlamydophila pneumoniae CWL029
ucgcuguaaauucaguga

SEQ ID NO: 2532550 - RNA, 18 nt, Chlamydophila pneumoniae CWL029
ucggaaaaaauagauccu

SEQ ID NO: 2532551 - RNA, 22 nt, Chlamydophila pneumoniae CWL029
ucggaaaaaauagauccugaaa

SEQ ID NO: 2532552 - RNA, 21 nt, Chlamydophila pneumoniae CWL029
ucggaagauagcccaaguugu

SEQ ID NO: 2532553 - RNA, 21 nt, Chlamydophila pneumoniae CWL029
ucggaauuugccugaaauccu

SEQ ID NO: 2532554 - RNA, 18 nt, Chlamydophila pneumoniae CWL029
ucggaccuacguuuucuc

SEQ ID NO: 2532555 - RNA, 19 nt, Chlamydophila pneumoniae CWL029
ucggaccuacguuuucucu

SEQ ID NO: 2532556 - RNA, 13 nt, Chlamydophila pneumoniae CWL029
ucggagaccaaaa

SEQ ID NO: 2532557 - RNA, 17 nt, Chlamydophila pneumoniae CWL029
ucggagacucagagaaa

SEQ ID NO: 2532558 - RNA, 15 nt, Chlamydophila pneumoniae CWL029
ucggaguuaucaaaa

SEQ ID NO: 2532559 - RNA, 20 nt, Chlamydophila pneumoniae CWL029
ucggaucuuuucuuucuaag

SEQ ID NO: 2532560 - RNA, 14 nt, Chlamydophila pneumoniae CWL029
ucggaugagaucca

SEQ ID NO: 2532561 - RNA, 21 nt, Chlamydophila pneumoniae CWL029
ucggauuuagauuaaagagac

SEQ ID NO: 2532562 - RNA, 17 nt, Chlamydophila pneumoniae CWL029
ucggauuucaugauucc

SEQ ID NO: 2532563 - RNA, 18 nt, Chlamydophila pneumoniae CWL029
ucggauuuuacucccuga

SEQ ID NO: 2532564 - RNA, 13 nt, Chlamydophila pneumoniae CWL029
ucggcuaaagaaa

SEQ ID NO: 2532565 - RNA, 13 nt, Chlamydophila pneumoniae CWL029
ucggggagaacac

SEQ ID NO: 2532566 - RNA, 18 nt, Chlamydophila pneumoniae CWL029
ucgguuauuuuuccagaa

SEQ ID NO: 2532567 - RNA, 16 nt, Chlamydophila pneumoniae CWL029
ucguaacgcuuuucua

SEQ ID NO: 2532568 - RNA, 18 nt, Chlamydophila pneumoniae CWL029
ucguaacgcuuuucuaau

SEQ ID NO: 2532569 - RNA, 19 nt, Chlamydophila pneumoniae CWL029
ucguaauagcgacaugaga

SEQ ID NO: 2532570 - RNA, 21 nt, Chlamydophila pneumoniae CWL029
ucguaauagcgacaugagaaa

SEQ ID NO: 2532571 - RNA, 22 nt, Chlamydophila pneumoniae CWL029
ucguaauccuucuuucugcucu

SEQ ID NO: 2532572 - RNA, 19 nt, Chlamydophila pneumoniae CWL029
ucguaaucuuuuuuaaagc

SEQ ID NO: 2532573 - RNA, 19 nt, Chlamydophila pneumoniae CWL029
ucguaaugcccgauauccu

SEQ ID NO: 2532574 - RNA, 18 nt, Chlamydophila pneumoniae CWL029
ucguacaguuuuuuucua

SEQ ID NO: 2532575 - RNA, 16 nt, Chlamydophila pneumoniae CWL029
ucguaccugcugcuuc

SEQ ID NO: 2532576 - RNA, 21 nt, Chlamydophila pneumoniae CWL029
ucguagacaacaagucuuccc

SEQ ID NO: 2532577 - RNA, 19 nt, Chlamydophila pneumoniae CWL029
ucguagccccauagagccu

SEQ ID NO: 2532578 - RNA, 17 nt, Chlamydophila pneumoniae CWL029
ucguagccuuacguaaa

SEQ ID NO: 2532579 - RNA, 18 nt, Chlamydophila pneumoniae CWL029
ucguauagguacgcuuuu

SEQ ID NO: 2532580 - RNA, 13 nt, Chlamydophila pneumoniae CWL029
ucguauuuuccug

SEQ ID NO: 2532581 - RNA, 13 nt, Chlamydophila pneumoniae CWL029
ucgucaaauucau

SEQ ID NO: 2532582 - RNA, 12 nt, Chlamydophila pneumoniae CWL029
ucgucaccugag

SEQ ID NO: 2532583 - RNA, 13 nt, Chlamydophila pneumoniae CWL029
ucgucauucugca

SEQ ID NO: 2532584 - RNA, 14 nt, Chlamydophila pneumoniae CWL029
ucgucauucugcaa

SEQ ID NO: 2532585 - RNA, 22 nt, Chlamydophila pneumoniae CWL029
ucguccugacacaacucuuaaa

SEQ ID NO: 2532586 - RNA, 15 nt, Chlamydophila pneumoniae CWL029
ucgucuccaaaaauu

SEQ ID NO: 2532587 - RNA, 21 nt, Chlamydophila pneumoniae CWL029
ucucucaagucuauuugaaaa

SEQ ID NO: 2532588 - RNA, 14 nt, Chlamydophila pneumoniae CWL029
ucucucucugcagc

SEQ ID NO: 2532589 - RNA, 17 nt, Chlamydophila pneumoniae CWL029
ucucucugccuaccaaa

SEQ ID NO: 2532590 - RNA, 14 nt, Chlamydophila pneumoniae CWL029
ucucucuuccugcu

SEQ ID NO: 2532591 - RNA, 19 nt, Chlamydophila pneumoniae CWL029
ucucugaccaucaaugaga

SEQ ID NO: 2532592 - RNA, 22 nt, Chlamydophila pneumoniae CWL029
ucucugaucccucaaaaucaca

SEQ ID NO: 2532593 - RNA, 19 nt, Chlamydophila pneumoniae CWL029
ucucugauucucauaaagg

SEQ ID NO: 2532594 - RNA, 17 nt, Chlamydophila pneumoniae CWL029
ucucugcauauugcucu

SEQ ID NO: 2532595 - RNA, 16 nt, Chlamydophila pneumoniae CWL029
ucucugccuaccaaag

SEQ ID NO: 2532596 - RNA, 15 nt, Chlamydophila pneumoniae CWL029
ucucuggaauacauu

SEQ ID NO: 2532597 - RNA, 21 nt, Chlamydophila pneumoniae CWL029
ucucuggaauacauuccuagc

SEQ ID NO: 2532598 - RNA, 19 nt, Chlamydophila pneumoniae CWL029
ucucuggcauaauccugaa

SEQ ID NO: 2532599 - RNA, 15 nt, Chlamydophila pneumoniae CWL029
ucucuguuuuuugaa

SEQ ID NO: 2532600 - RNA, 16 nt, Chlamydophila pneumoniae CWL029
ucucuguuuuuugaaa

SEQ ID NO: 2532601 - RNA, 13 nt, Chlamydophila pneumoniae CWL029
ucucuuaaaauau

SEQ ID NO: 2532602 - RNA, 14 nt, Chlamydophila pneumoniae CWL029
ucucuuaaaauauu

SEQ ID NO: 2532603 - RNA, 21 nt, Chlamydophila pneumoniae CWL029
ucucuuaacuggcaaucuaaa

SEQ ID NO: 2532604 - RNA, 22 nt, Chlamydophila pneumoniae CWL029
ucucuucaugaaaaaagaauaa

SEQ ID NO: 2532605 - RNA, 18 nt, Chlamydophila pneumoniae CWL029
ucucuucauugcaaaaau

SEQ ID NO: 2532606 - RNA, 13 nt, Chlamydophila pneumoniae CWL029
ucucuuccaaaag

SEQ ID NO: 2532607 - RNA, 19 nt, Chlamydophila pneumoniae CWL029
ucucuucccuuguuaugaa

SEQ ID NO: 2532608 - RNA, 12 nt, Chlamydophila pneumoniae CWL029
ucucuuccuucu

SEQ ID NO: 2532609 - RNA, 15 nt, Chlamydophila pneumoniae CWL029
ucucuuccuucuccu

SEQ ID NO: 2532610 - RNA, 20 nt, Chlamydophila pneumoniae CWL029
ucucuugaagcacuuugacu

SEQ ID NO: 2532611 - RNA, 21 nt, Chlamydophila pneumoniae CWL029
ucucuugccaaugcauuuguu

SEQ ID NO: 2532612 - RNA, 12 nt, Chlamydophila pneumoniae CWL029
ucucuuuaaaaa

SEQ ID NO: 2532613 - RNA, 14 nt, Chlamydophila pneumoniae CWL029
ucucuuuaaaaauu

SEQ ID NO: 2532614 - RNA, 17 nt, Chlamydophila pneumoniae CWL029
ucucuuuaacuucuaaa

SEQ ID NO: 2532615 - RNA, 19 nt, Chlamydophila pneumoniae CWL029
ucucuuuagcaaucucuuu

SEQ ID NO: 2532616 - RNA, 23 nt, Chlamydophila pneumoniae CWL029
ucucuuucgaugcuauuuuucca

SEQ ID NO: 2532617 - RNA, 15 nt, Chlamydophila pneumoniae CWL029
ucucuuugacaucua

SEQ ID NO: 2532618 - RNA, 19 nt, Chlamydophila pneumoniae CWL029
ucucuuugacaucuaauuu

SEQ ID NO: 2532619 - RNA, 19 nt, Chlamydophila pneumoniae CWL029
ucucuuugacggauaggau

SEQ ID NO: 2532620 - RNA, 24 nt, Chlamydophila pneumoniae CWL029
ucucuuuuggaagaccuuuggauu

SEQ ID NO: 2532621 - RNA, 18 nt, Chlamydophila pneumoniae CWL029
ucugaacaggaauagaaa

SEQ ID NO: 2532622 - RNA, 15 nt, Chlamydophila pneumoniae CWL029
ucugaagagagaaua

SEQ ID NO: 2532623 - RNA, 22 nt, Chlamydophila pneumoniae CWL029
ucugaagauauauuuuuaaaga

SEQ ID NO: 2532624 - RNA, 15 nt, Chlamydophila pneumoniae CWL029
ucugaagauuuuuua

SEQ ID NO: 2532625 - RNA, 12 nt, Chlamydophila pneumoniae CWL029
ucugaagcugca

SEQ ID NO: 2532626 - RNA, 23 nt, Chlamydophila pneumoniae CWL029
ucugaaucucauaaguauagaga

SEQ ID NO: 2532627 - RNA, 17 nt, Chlamydophila pneumoniae CWL029
ucugacaauaacaugcg

SEQ ID NO: 2532628 - RNA, 22 nt, Chlamydophila pneumoniae CWL029
ucugacaauaacaugcgcagaa

SEQ ID NO: 2532629 - RNA, 19 nt, Chlamydophila pneumoniae CWL029
ucugacccuguagcgaaga

SEQ ID NO: 2532630 - RNA, 13 nt, Chlamydophila pneumoniae CWL029
ucugagaaguuaa

SEQ ID NO: 2532631 - RNA, 18 nt, Chlamydophila pneumoniae CWL029
ucugagcuugccuaccca

SEQ ID NO: 2532632 - RNA, 15 nt, Chlamydophila pneumoniae CWL029
ucugauaaagcuaca

SEQ ID NO: 2532633 - RNA, 17 nt, Chlamydophila pneumoniae CWL029
ucugaucccucaaaauc

SEQ ID NO: 2532634 - RNA, 16 nt, Chlamydophila pneumoniae CWL029
ucugauccgaaaagaa

SEQ ID NO: 2532635 - RNA, 21 nt, Chlamydophila pneumoniae CWL029
ucugaucguacaggacuguuu

SEQ ID NO: 2532636 - RNA, 17 nt, Chlamydophila pneumoniae CWL029
ucugaugaccucaucuc

SEQ ID NO: 2532637 - RNA, 18 nt, Chlamydophila pneumoniae CWL029
ucugaugacguuaauaaa

SEQ ID NO: 2532638 - RNA, 20 nt, Chlamydophila pneumoniae CWL029
ucugauguaggugauauuuu

SEQ ID NO: 2532639 - RNA, 19 nt, Chlamydophila pneumoniae CWL029
ucugauuaguucucuaaga

SEQ ID NO: 2532640 - RNA, 16 nt, Chlamydophila pneumoniae CWL029
ucugauuauuucuaaa

SEQ ID NO: 2532641 - RNA, 17 nt, Chlamydophila pneumoniae CWL029
ucugauuauuucuaaaa

SEQ ID NO: 2532642 - RNA, 23 nt, Chlamydophila pneumoniae CWL029
ucugcaaacgcaaugauuucucu

SEQ ID NO: 2532643 - RNA, 18 nt, Chlamydophila pneumoniae CWL029
ucugcaacaaguugcauu

SEQ ID NO: 2532644 - RNA, 21 nt, Chlamydophila pneumoniae CWL029
ucugcaauuccgaagaagaaa

SEQ ID NO: 2532645 - RNA, 12 nt, Chlamydophila pneumoniae CWL029
ucugcagcagau

SEQ ID NO: 2532646 - RNA, 17 nt, Chlamydophila pneumoniae CWL029
ucugcaggacugucuag

SEQ ID NO: 2532647 - RNA, 15 nt, Chlamydophila pneumoniae CWL029
ucugcagguaaggga

SEQ ID NO: 2532648 - RNA, 23 nt, Chlamydophila pneumoniae CWL029
ucugcagguaagggaugcucuag

SEQ ID NO: 2532649 - RNA, 22 nt, Chlamydophila pneumoniae CWL029
ucugcauauaaagacucucuuc

SEQ ID NO: 2532650 - RNA, 16 nt, Chlamydophila pneumoniae CWL029
ucugcauauugcucuu

SEQ ID NO: 2532651 - RNA, 19 nt, Chlamydophila pneumoniae CWL029
ucugcccaaagcuaaaaug

SEQ ID NO: 2532652 - RNA, 16 nt, Chlamydophila pneumoniae CWL029
ucugcccgucuuagaa

SEQ ID NO: 2532653 - RNA, 22 nt, Chlamydophila pneumoniae CWL029
ucugcccgucuuagaauccaaa

SEQ ID NO: 2532654 - RNA, 17 nt, Chlamydophila pneumoniae CWL029
ucugccuuaugcucauu

SEQ ID NO: 2532655 - RNA, 20 nt, Chlamydophila pneumoniae CWL029
ucugcgauaggaucuucuau

SEQ ID NO: 2532656 - RNA, 21 nt, Chlamydophila pneumoniae CWL029
ucugcgcugagguuauuuaau

SEQ ID NO: 2532657 - RNA, 24 nt, Chlamydophila pneumoniae CWL029
ucugcgugucguugguucaaaucc

SEQ ID NO: 2532658 - RNA, 17 nt, Chlamydophila pneumoniae CWL029
ucugcuagagcuuucag

SEQ ID NO: 2532659 - RNA, 15 nt, Chlamydophila pneumoniae CWL029
ucugcucuauauauc

SEQ ID NO: 2532660 - RNA, 12 nt, Chlamydophila pneumoniae CWL029
ucugcugaaauc

SEQ ID NO: 2532661 - RNA, 13 nt, Chlamydophila pneumoniae CWL029
ucugcugaggaga

SEQ ID NO: 2532662 - RNA, 22 nt, Chlamydophila pneumoniae CWL029
ucugcuucuccaaauaaagcaa

SEQ ID NO: 2532663 - RNA, 13 nt, Chlamydophila pneumoniae CWL029
ucugcuugucuac

SEQ ID NO: 2532664 - RNA, 22 nt, Chlamydophila pneumoniae CWL029
ucuggaaaagccucgaaauuuu

SEQ ID NO: 2532665 - RNA, 19 nt, Chlamydophila pneumoniae CWL029
uccuauugguguaucucuu

SEQ ID NO: 2532666 - RNA, 13 nt, Chlamydophila pneumoniae CWL029
uccucaagaauau

SEQ ID NO: 2532667 - RNA, 17 nt, Chlamydophila pneumoniae CWL029
uccucaagaauaugaac

SEQ ID NO: 2532668 - RNA, 19 nt, Chlamydophila pneumoniae CWL029
uccucaagauaaaucccac

SEQ ID NO: 2532669 - RNA, 16 nt, Chlamydophila pneumoniae CWL029
uccucacaucuccuuu

SEQ ID NO: 2532670 - RNA, 16 nt, Chlamydophila pneumoniae CWL029
uccucacauguuucac

SEQ ID NO: 2532671 - RNA, 15 nt, Chlamydophila pneumoniae CWL029
uccucaccgaucuca

SEQ ID NO: 2532672 - RNA, 16 nt, Chlamydophila pneumoniae CWL029
uccucagaauccauuu

SEQ ID NO: 2532673 - RNA, 12 nt, Chlamydophila pneumoniae CWL029
uccucagucucu

SEQ ID NO: 2532674 - RNA, 13 nt, Chlamydophila pneumoniae CWL029
uccuccaaaauua

SEQ ID NO: 2532675 - RNA, 18 nt, Chlamydophila pneumoniae CWL029
uccuccaaugagcucuau

SEQ ID NO: 2532676 - RNA, 18 nt, Chlamydophila pneumoniae CWL029
uccuccuagguucuuuuu

SEQ ID NO: 2532677 - RNA, 20 nt, Chlamydophila pneumoniae CWL029
uccuccucgucuaaagaaga

SEQ ID NO: 2532678 - RNA, 23 nt, Chlamydophila pneumoniae CWL029
uccuccuucugcaaucagugcug

SEQ ID NO: 2532679 - RNA, 16 nt, Chlamydophila pneumoniae CWL029
uccucgaauggagugc

SEQ ID NO: 2532680 - RNA, 23 nt, Chlamydophila pneumoniae CWL029
uccucgauacuguugauccuucu

SEQ ID NO: 2532681 - RNA, 16 nt, Chlamydophila pneumoniae CWL029
uccucggcaacuacug

SEQ ID NO: 2532682 - RNA, 16 nt, Chlamydophila pneumoniae CWL029
uccucguuaauaagaa

SEQ ID NO: 2532683 - RNA, 23 nt, Chlamydophila pneumoniae CWL029
uccucuaaggacaaaucucccaa

SEQ ID NO: 2532684 - RNA, 22 nt, Chlamydophila pneumoniae CWL029
uccucuauauuuuuucccacaa

SEQ ID NO: 2532685 - RNA, 14 nt, Chlamydophila pneumoniae CWL029
uccucuauccauca

SEQ ID NO: 2532686 - RNA, 22 nt, Chlamydophila pneumoniae CWL029
uccucuauccaucaucgaagaa

SEQ ID NO: 2532687 - RNA, 14 nt, Chlamydophila pneumoniae CWL029
uccucucaugaaau

SEQ ID NO: 2532688 - RNA, 14 nt, Chlamydophila pneumoniae CWL029
uccucugaaggauu

SEQ ID NO: 2532689 - RNA, 15 nt, Chlamydophila pneumoniae CWL029
uccucugauuccagu

SEQ ID NO: 2532690 - RNA, 17 nt, Chlamydophila pneumoniae CWL029
uccucuuaggagagcuu

SEQ ID NO: 2532691 - RNA, 17 nt, Chlamydophila pneumoniae CWL029
uccucuucuauucugau

SEQ ID NO: 2532692 - RNA, 20 nt, Chlamydophila pneumoniae CWL029
uccucuucuucaucuucuaa

SEQ ID NO: 2532693 - RNA, 18 nt, Chlamydophila pneumoniae CWL029
uccugaacggcucuuucu

SEQ ID NO: 2532694 - RNA, 19 nt, Chlamydophila pneumoniae CWL029
uccugaagaugagaaaauc

SEQ ID NO: 2532695 - RNA, 13 nt, Chlamydophila pneumoniae CWL029
uccugaagcagcu

SEQ ID NO: 2532696 - RNA, 22 nt, Chlamydophila pneumoniae CWL029
uccugaagccaugacaaagggu

SEQ ID NO: 2532697 - RNA, 21 nt, Chlamydophila pneumoniae CWL029
uccugaauggcucugucacua

SEQ ID NO: 2532698 - RNA, 16 nt, Chlamydophila pneumoniae CWL029
uccugacacaacucuu

SEQ ID NO: 2532699 - RNA, 15 nt, Chlamydophila pneumoniae CWL029
uccugacucuuuuaa

SEQ ID NO: 2532700 - RNA, 19 nt, Chlamydophila pneumoniae CWL029
uccugaggcuauagaauac

SEQ ID NO: 2532701 - RNA, 21 nt, Chlamydophila pneumoniae CWL029
uccugagguugggcagaagcu

SEQ ID NO: 2532702 - RNA, 14 nt, Chlamydophila pneumoniae CWL029
uccugaguaaaauc

SEQ ID NO: 2532703 - RNA, 23 nt, Chlamydophila pneumoniae CWL029
uccugaucccuuagaaauucuaa

SEQ ID NO: 2532704 - RNA, 22 nt, Chlamydophila pneumoniae CWL029
uccugcagcagccuuggcucua

SEQ ID NO: 2532705 - RNA, 21 nt, Chlamydophila pneumoniae CWL029
uccugcagggggcauucccug

SEQ ID NO: 2532706 - RNA, 13 nt, Chlamydophila pneumoniae CWL029
uccugcauggcuu

SEQ ID NO: 2532707 - RNA, 23 nt, Chlamydophila pneumoniae CWL029
uccugcggaucgucgccuuuucc

SEQ ID NO: 2532708 - RNA, 15 nt, Chlamydophila pneumoniae CWL029
uccugcuccaaaaug

SEQ ID NO: 2532709 - RNA, 22 nt, Chlamydophila pneumoniae CWL029
uccuggggugcguaucaguuuu

SEQ ID NO: 2532710 - RNA, 15 nt, Chlamydophila pneumoniae CWL029
uccuggucuccagaa

SEQ ID NO: 2532711 - RNA, 15 nt, Chlamydophila pneumoniae CWL029
uccuguagagcaaga

SEQ ID NO: 2532712 - RNA, 13 nt, Chlamydophila pneumoniae CWL029
uccuguagccacu

SEQ ID NO: 2532713 - RNA, 16 nt, Chlamydophila pneumoniae CWL029
uccuguauauucugaa

SEQ ID NO: 2532714 - RNA, 23 nt, Chlamydophila pneumoniae CWL029
uccugucuauuucuuaauuuccu

SEQ ID NO: 2532715 - RNA, 15 nt, Chlamydophila pneumoniae CWL029
uccuguuccauauca

SEQ ID NO: 2532716 - RNA, 21 nt, Chlamydophila pneumoniae CWL029
uccuguuucaacauaacauga

SEQ ID NO: 2532717 - RNA, 22 nt, Chlamydophila pneumoniae CWL029
uccuuaacaacaucacuuauau

SEQ ID NO: 2532718 - RNA, 21 nt, Chlamydophila pneumoniae CWL029
uccuuaaugagaguuucuaau

SEQ ID NO: 2532719 - RNA, 22 nt, Chlamydophila pneumoniae CWL029
uccuuaccaauaugcucugcca

SEQ ID NO: 2532720 - RNA, 14 nt, Chlamydophila pneumoniae CWL029
uccuuacucccaug

SEQ ID NO: 2532721 - RNA, 17 nt, Chlamydophila pneumoniae CWL029
uccuuauccgucagccu

SEQ ID NO: 2532722 - RNA, 20 nt, Chlamydophila pneumoniae CWL029
uccuucaaaauguuuaucga

SEQ ID NO: 2532723 - RNA, 14 nt, Chlamydophila pneumoniae CWL029
uccuucaacacacc

SEQ ID NO: 2532724 - RNA, 20 nt, Chlamydophila pneumoniae CWL029
uccuucaggauuuuccauua

SEQ ID NO: 2532725 - RNA, 11 nt, Chlamydophila pneumoniae CWL029
uccuuccuuaa

SEQ ID NO: 2532726 - RNA, 14 nt, Chlamydophila pneumoniae CWL029
uccuucuauagcaa

SEQ ID NO: 2532727 - RNA, 16 nt, Chlamydophila pneumoniae CWL029
uccuucuauagcaaga

SEQ ID NO: 2532728 - RNA, 15 nt, Chlamydophila pneumoniae CWL029
uccuucucagaaaga

SEQ ID NO: 2532729 - RNA, 12 nt, Chlamydophila pneumoniae CWL029
uccuucucccuc

SEQ ID NO: 2532730 - RNA, 20 nt, Chlamydophila pneumoniae CWL029
uccuucucccucuaaacaua

SEQ ID NO: 2532731 - RNA, 12 nt, Chlamydophila pneumoniae CWL029
uccuucuccugu

SEQ ID NO: 2532732 - RNA, 14 nt, Chlamydophila pneumoniae CWL029
uccuucugcaauca

SEQ ID NO: 2532733 - RNA, 15 nt, Chlamydophila pneumoniae CWL029
uccuucuggagugac

SEQ ID NO: 2532734 - RNA, 11 nt, Chlamydophila pneumoniae CWL029
uccuucuucuu

SEQ ID NO: 2532735 - RNA, 12 nt, Chlamydophila pneumoniae CWL029
uccuucuugcaa

SEQ ID NO: 2532736 - RNA, 15 nt, Chlamydophila pneumoniae CWL029
uccuucuuucugcuc

SEQ ID NO: 2532737 - RNA, 21 nt, Chlamydophila pneumoniae CWL029
uccuucuuucugcucuucuau

SEQ ID NO: 2532738 - RNA, 18 nt, Chlamydophila pneumoniae CWL029
uccuugaaauugcucuug

SEQ ID NO: 2532739 - RNA, 15 nt, Chlamydophila pneumoniae CWL029
uccuugaauuaguuu

SEQ ID NO: 2532740 - RNA, 15 nt, Chlamydophila pneumoniae CWL029
uccuugacaaauaag

SEQ ID NO: 2532741 - RNA, 19 nt, Chlamydophila pneumoniae CWL029
uccuugacaaauaaguccu

SEQ ID NO: 2532742 - RNA, 18 nt, Chlamydophila pneumoniae CWL029
uccuugauaaaacgcuau

SEQ ID NO: 2532743 - RNA, 19 nt, Chlamydophila pneumoniae CWL029
uccuuguacuguauagaaa

SEQ ID NO: 2532744 - RNA, 22 nt, Chlamydophila pneumoniae CWL029
uccuuugcuaagaacuagcaug

SEQ ID NO: 2532745 - RNA, 13 nt, Chlamydophila pneumoniae CWL029
uccuuuuaaaauu

SEQ ID NO: 2532746 - RNA, 21 nt, Chlamydophila pneumoniae CWL029
uccuuuuuaggacgcuauccu

SEQ ID NO: 2532747 - RNA, 17 nt, Chlamydophila pneumoniae CWL029
ucuagguuucaggaaau

SEQ ID NO: 2532748 - RNA, 14 nt, Chlamydophila pneumoniae CWL029
ucuaguucuagaaa

SEQ ID NO: 2532749 - RNA, 13 nt, Chlamydophila pneumoniae CWL029
ucuaguuuuucuu

SEQ ID NO: 2532750 - RNA, 18 nt, Chlamydophila pneumoniae CWL029
ucuaguuuuucuuuagag

SEQ ID NO: 2532751 - RNA, 13 nt, Chlamydophila pneumoniae CWL029
ucuauaaauucaa

SEQ ID NO: 2532752 - RNA, 18 nt, Chlamydophila pneumoniae CWL029
ucuauaauuaauccuuga

SEQ ID NO: 2532753 - RNA, 14 nt, Chlamydophila pneumoniae CWL029
ucuauagaucuuga

SEQ ID NO: 2532754 - RNA, 16 nt, Chlamydophila pneumoniae CWL029
ucuauagaucuugaaa

SEQ ID NO: 2532755 - RNA, 14 nt, Chlamydophila pneumoniae CWL029
ucuauauauccuga

SEQ ID NO: 2532756 - RNA, 18 nt, Chlamydophila pneumoniae CWL029
ucuauaucauuaagaaga

SEQ ID NO: 2532757 - RNA, 13 nt, Chlamydophila pneumoniae CWL029
ucuauccaucauc

SEQ ID NO: 2532758 - RNA, 19 nt, Chlamydophila pneumoniae CWL029
ucuaucgauagccauuaga

SEQ ID NO: 2532759 - RNA, 17 nt, Chlamydophila pneumoniae CWL029
ucuaucugcacuuucuu

SEQ ID NO: 2532760 - RNA, 16 nt, Chlamydophila pneumoniae CWL029
ucuaucuugaaaguac

SEQ ID NO: 2532761 - RNA, 16 nt, Chlamydophila pneumoniae CWL029
ucuaucuuuauuuaaa

SEQ ID NO: 2532762 - RNA, 18 nt, Chlamydophila pneumoniae CWL029
ucuaugagaguaaguuuu

SEQ ID NO: 2532763 - RNA, 19 nt, Chlamydophila pneumoniae CWL029
ucuaugagaguaaguuuuu

SEQ ID NO: 2532764 - RNA, 23 nt, Chlamydophila pneumoniae CWL029
ucuaugagaguaaguuuuuaauc

SEQ ID NO: 2532765 - RNA, 17 nt, Chlamydophila pneumoniae CWL029
ucuaugagauaggaacu

SEQ ID NO: 2532766 - RNA, 22 nt, Chlamydophila pneumoniae CWL029
ucuaugauccaauagccaaaga

SEQ ID NO: 2532767 - RNA, 19 nt, Chlamydophila pneumoniae CWL029
ucuaugauccgaaaacucu

SEQ ID NO: 2532768 - RNA, 19 nt, Chlamydophila pneumoniae CWL029
ucuaugccauaaauacagg

SEQ ID NO: 2532769 - RNA, 19 nt, Chlamydophila pneumoniae CWL029
ucuauggacuaaacaagaa

SEQ ID NO: 2532770 - RNA, 14 nt, Chlamydophila pneumoniae CWL029
ucuauguguucucg

SEQ ID NO: 2532771 - RNA, 13 nt, Chlamydophila pneumoniae CWL029
ucuauuaaaaaua

SEQ ID NO: 2532772 - RNA, 14 nt, Chlamydophila pneumoniae CWL029
ucuauuagauuucc

SEQ ID NO: 2532773 - RNA, 14 nt, Chlamydophila pneumoniae CWL029
ucuauuucugccuu

SEQ ID NO: 2532774 - RNA, 14 nt, Chlamydophila pneumoniae CWL029
ucuauuuucaggag

SEQ ID NO: 2532775 - RNA, 16 nt, Chlamydophila pneumoniae CWL029
ucucaaagaucaucua

SEQ ID NO: 2532776 - RNA, 13 nt, Chlamydophila pneumoniae CWL029
ucucaaauuucaa

SEQ ID NO: 2532777 - RNA, 15 nt, Chlamydophila pneumoniae CWL029
ucucaacgcaauagg

SEQ ID NO: 2532778 - RNA, 20 nt, Chlamydophila pneumoniae CWL029
ucucaagaguaggcaauaca

SEQ ID NO: 2532779 - RNA, 22 nt, Chlamydophila pneumoniae CWL029
ucucaagaguaggcaauacaga

SEQ ID NO: 2532780 - RNA, 14 nt, Chlamydophila pneumoniae CWL029
ucucaagaucuuca

SEQ ID NO: 2532781 - RNA, 17 nt, Chlamydophila pneumoniae CWL029
ucucaagaucuucauca

SEQ ID NO: 2532782 - RNA, 22 nt, Chlamydophila pneumoniae CWL029
ucucaaggaucuuauauaaaac

SEQ ID NO: 2532783 - RNA, 18 nt, Chlamydophila pneumoniae CWL029
ucucaaucgauaaucaaa

SEQ ID NO: 2532784 - RNA, 14 nt, Chlamydophila pneumoniae CWL029
ucucacucuaugag

SEQ ID NO: 2532785 - RNA, 15 nt, Chlamydophila pneumoniae CWL029
ucucacucuuuucua

SEQ ID NO: 2532786 - RNA, 11 nt, Chlamydophila pneumoniae CWL029
ucucacugagu

SEQ ID NO: 2532787 - RNA, 16 nt, Chlamydophila pneumoniae CWL029
ucucacuggcuccuaa

SEQ ID NO: 2532788 - RNA, 18 nt, Chlamydophila pneumoniae CWL029
ucucagaaagccuuugcu

SEQ ID NO: 2532789 - RNA, 16 nt, Chlamydophila pneumoniae CWL029
ucucagcaaagacauc

SEQ ID NO: 2532790 - RNA, 22 nt, Chlamydophila pneumoniae CWL029
ucucaggaaagguaguuuucuu

SEQ ID NO: 2532791 - RNA, 14 nt, Chlamydophila pneumoniae CWL029
ucucagugaacucu

SEQ ID NO: 2532792 - RNA, 17 nt, Chlamydophila pneumoniae CWL029
ucucaguuaaagagcau

SEQ ID NO: 2532793 - RNA, 17 nt, Chlamydophila pneumoniae CWL029
ucucauaaguauagaga

SEQ ID NO: 2532794 - RNA, 20 nt, Chlamydophila pneumoniae CWL029
ucucauagcuuccuguagug

SEQ ID NO: 2532795 - RNA, 16 nt, Chlamydophila pneumoniae CWL029
ucucaucagcaaaacu

SEQ ID NO: 2532796 - RNA, 18 nt, Chlamydophila pneumoniae CWL029
ucucauccagacaagaca

SEQ ID NO: 2532797 - RNA, 15 nt, Chlamydophila pneumoniae CWL029
ucucaucggcauaac

SEQ ID NO: 2532798 - RNA, 21 nt, Chlamydophila pneumoniae CWL029
ucucaucggcauaacuuuauc

SEQ ID NO: 2532799 - RNA, 14 nt, Chlamydophila pneumoniae CWL029
ucucaugaaauuuu

SEQ ID NO: 2532800 - RNA, 22 nt, Chlamydophila pneumoniae CWL029
ucucaugcggacuuuauucucu

SEQ ID NO: 2532801 - RNA, 14 nt, Chlamydophila pneumoniae CWL029
ucucauguaacuga

SEQ ID NO: 2532802 - RNA, 17 nt, Chlamydophila pneumoniae CWL029
ucucauuccagcaucuu

SEQ ID NO: 2532803 - RNA, 23 nt, Chlamydophila pneumoniae CWL029
ucucauuccagcaucuucucgaa

SEQ ID NO: 2532804 - RNA, 22 nt, Chlamydophila pneumoniae CWL029
ucucauugcggcaccaaagaug

SEQ ID NO: 2532805 - RNA, 21 nt, Chlamydophila pneumoniae CWL029
ucucauuucguagacgcucua

SEQ ID NO: 2532806 - RNA, 18 nt, Chlamydophila pneumoniae CWL029
ucuccaaaagcucuacaa

SEQ ID NO: 2532807 - RNA, 21 nt, Chlamydophila pneumoniae CWL029
ucuccaaagagucucuugcuu

SEQ ID NO: 2532808 - RNA, 17 nt, Chlamydophila pneumoniae CWL029
ucuccacagcuucuucg

SEQ ID NO: 2532809 - RNA, 16 nt, Chlamydophila pneumoniae CWL029
ucuccagguagcagag

SEQ ID NO: 2532810 - RNA, 17 nt, Chlamydophila pneumoniae CWL029
ucuccagguagcagagu

SEQ ID NO: 2532811 - RNA, 14 nt, Chlamydophila pneumoniae CWL029
ucuccauccucagu

SEQ ID NO: 2532812 - RNA, 16 nt, Chlamydophila pneumoniae CWL029
ucuccauccucagucu

SEQ ID NO: 2532813 - RNA, 17 nt, Chlamydophila pneumoniae CWL029
ucuccauccucagucuc

SEQ ID NO: 2532814 - RNA, 18 nt, Chlamydophila pneumoniae CWL029
ucucccaauauccagaaa

SEQ ID NO: 2532815 - RNA, 18 nt, Chlamydophila pneumoniae CWL029
ucucccauagcaaugccu

SEQ ID NO: 2532816 - RNA, 21 nt, Chlamydophila pneumoniae CWL029
ucucccauguaguaaauuccu

SEQ ID NO: 2532817 - RNA, 15 nt, Chlamydophila pneumoniae CWL029
ucuccccauucacaa

SEQ ID NO: 2532818 - RNA, 20 nt, Chlamydophila pneumoniae CWL029
ucucccgugaacaaaaacug

SEQ ID NO: 2532819 - RNA, 15 nt, Chlamydophila pneumoniae CWL029
ucucccucacaagaa

SEQ ID NO: 2532820 - RNA, 12 nt, Chlamydophila pneumoniae CWL029
ucucccucuaaa

SEQ ID NO: 2532821 - RNA, 19 nt, Chlamydophila pneumoniae CWL029
ucucccucuaaacauaaag

SEQ ID NO: 2532822 - RNA, 22 nt, Chlamydophila pneumoniae CWL029
ucucccuggucuguauuuucuu

SEQ ID NO: 2532823 - RNA, 15 nt, Chlamydophila pneumoniae CWL029
ucucccuuaaggaaa

SEQ ID NO: 2532824 - RNA, 15 nt, Chlamydophila pneumoniae CWL029
ucuccgaagacuacc

SEQ ID NO: 2532825 - RNA, 18 nt, Chlamydophila pneumoniae CWL029
ucuccgggaacaacugug

SEQ ID NO: 2532826 - RNA, 17 nt, Chlamydophila pneumoniae CWL029
ucuccuaaaccaucacu

SEQ ID NO: 2532827 - RNA, 22 nt, Chlamydophila pneumoniae CWL029
ucuccugaaccgcaaaaagcuu

SEQ ID NO: 2532828 - RNA, 12 nt, Chlamydophila pneumoniae CWL029
ucuccugcaaaa

SEQ ID NO: 2532829 - RNA, 14 nt, Chlamydophila pneumoniae CWL029
ucuccugcaaaaag

SEQ ID NO: 2532830 - RNA, 23 nt, Chlamydophila pneumoniae CWL029
ucuccugcaaaaaguuucaaucu

SEQ ID NO: 2532831 - RNA, 13 nt, Chlamydophila pneumoniae CWL029
ucuccuggaacag

SEQ ID NO: 2532832 - RNA, 13 nt, Chlamydophila pneumoniae CWL029
ucuccuugacaaa

SEQ ID NO: 2532833 - RNA, 23 nt, Chlamydophila pneumoniae CWL029
ucuccuugacaaauaaguccugu

SEQ ID NO: 2532834 - RNA, 18 nt, Chlamydophila pneumoniae CWL029
ucuccuuuaaauaaaauc

SEQ ID NO: 2532835 - RNA, 16 nt, Chlamydophila pneumoniae CWL029
ucucgaaauccuaaaa

SEQ ID NO: 2532836 - RNA, 17 nt, Chlamydophila pneumoniae CWL029
ucucgaaauccuaaaaa

SEQ ID NO: 2532837 - RNA, 21 nt, Chlamydophila pneumoniae CWL029
ucucgacacuauguguuuccu

SEQ ID NO: 2532838 - RNA, 22 nt, Chlamydophila pneumoniae CWL029
ucucgacacuauguguuuccuu

SEQ ID NO: 2532839 - RNA, 17 nt, Chlamydophila pneumoniae CWL029
ucucgcuauuccauaaa

SEQ ID NO: 2532840 - RNA, 17 nt, Chlamydophila pneumoniae CWL029
ucucgggagaacaugcc

SEQ ID NO: 2532841 - RNA, 21 nt, Chlamydophila pneumoniae CWL029
ucucgggagaacaugccccca

SEQ ID NO: 2532842 - RNA, 17 nt, Chlamydophila pneumoniae CWL029
ucucgguuuaaggcaau

SEQ ID NO: 2532843 - RNA, 19 nt, Chlamydophila pneumoniae CWL029
ucucgugaauuacaggccc

SEQ ID NO: 2532844 - RNA, 15 nt, Chlamydophila pneumoniae CWL029
ucucgugcauaauga

SEQ ID NO: 2532845 - RNA, 20 nt, Chlamydophila pneumoniae CWL029
ucuuccugaaucagcuuauc

SEQ ID NO: 2532846 - RNA, 14 nt, Chlamydophila pneumoniae CWL029
ucuuccugcugcuu

SEQ ID NO: 2532847 - RNA, 14 nt, Chlamydophila pneumoniae CWL029
ucuucgaauuuuug

SEQ ID NO: 2532848 - RNA, 19 nt, Chlamydophila pneumoniae CWL029
ucuucgaggccuaaaauca

SEQ ID NO: 2532849 - RNA, 19 nt, Chlamydophila pneumoniae CWL029
ucuucgauuguaacuucgu

SEQ ID NO: 2532850 - RNA, 14 nt, Chlamydophila pneumoniae CWL029
ucuucgauuucuag

SEQ ID NO: 2532851 - RNA, 20 nt, Chlamydophila pneumoniae CWL029
ucuucgcaaauauaguuuuc

SEQ ID NO: 2532852 - RNA, 20 nt, Chlamydophila pneumoniae CWL029
ucuucgcccauuaacuaaga

SEQ ID NO: 2532853 - RNA, 15 nt, Chlamydophila pneumoniae CWL029
ucuucgcuggcaugu

SEQ ID NO: 2532854 - RNA, 17 nt, Chlamydophila pneumoniae CWL029
ucuucggaucuguaaua

SEQ ID NO: 2532855 - RNA, 21 nt, Chlamydophila pneumoniae CWL029
ucuucguaagcugcaaucuca

SEQ ID NO: 2532856 - RNA, 17 nt, Chlamydophila pneumoniae CWL029
ucuucguuagagaagag

SEQ ID NO: 2532857 - RNA, 16 nt, Chlamydophila pneumoniae CWL029
ucuucguuuauaacau

SEQ ID NO: 2532858 - RNA, 18 nt, Chlamydophila pneumoniae CWL029
ucuucguuucuuugaguu

SEQ ID NO: 2532859 - RNA, 18 nt, Chlamydophila pneumoniae CWL029
ucuucuagagcuucaagu

SEQ ID NO: 2532860 - RNA, 21 nt, Chlamydophila pneumoniae CWL029
ucuucuagagcuucaaguuuc

SEQ ID NO: 2532861 - RNA, 14 nt, Chlamydophila pneumoniae CWL029
ucuucuauuuuuuu

SEQ ID NO: 2532862 - RNA, 22 nt, Chlamydophila pneumoniae CWL029
ucuucucgaacaggagagagaa

SEQ ID NO: 2532863 - RNA, 17 nt, Chlamydophila pneumoniae CWL029
ucuucucgguuuaaggc

SEQ ID NO: 2532864 - RNA, 13 nt, Chlamydophila pneumoniae CWL029
ucuucucuaccca

SEQ ID NO: 2532865 - RNA, 17 nt, Chlamydophila pneumoniae CWL029
ucuucucuaugaacgau

SEQ ID NO: 2532866 - RNA, 16 nt, Chlamydophila pneumoniae CWL029
ucuucugaaaucaaaa

SEQ ID NO: 2532867 - RNA, 19 nt, Chlamydophila pneumoniae CWL029
ucuucugaaaucaaaaaaa

SEQ ID NO: 2532868 - RNA, 20 nt, Chlamydophila pneumoniae CWL029
ucuucugaauagcucuuuuc

SEQ ID NO: 2532869 - RNA, 21 nt, Chlamydophila pneumoniae CWL029
ucuucugauacaucaucagaa

SEQ ID NO: 2532870 - RNA, 23 nt, Chlamydophila pneumoniae CWL029
ucuucuggauacguuuuucccuu

SEQ ID NO: 2532871 - RNA, 17 nt, Chlamydophila pneumoniae CWL029
ucuucuggcugagagaa

SEQ ID NO: 2532872 - RNA, 17 nt, Chlamydophila pneumoniae CWL029
ucuucuguaauuuuuuu

SEQ ID NO: 2532873 - RNA, 21 nt, Chlamydophila pneumoniae CWL029
ucuucuguaauuuuuuucaaa

SEQ ID NO: 2532874 - RNA, 21 nt, Chlamydophila pneumoniae CWL029
ucuucuguaggaacaaucgua

SEQ ID NO: 2532875 - RNA, 14 nt, Chlamydophila pneumoniae CWL029
ucuucuuagaaaca

SEQ ID NO: 2532876 - RNA, 16 nt, Chlamydophila pneumoniae CWL029
ucuucuuagaagagaa

SEQ ID NO: 2532877 - RNA, 18 nt, Chlamydophila pneumoniae CWL029
ucuucuuagaagagaaag

SEQ ID NO: 2532878 - RNA, 15 nt, Chlamydophila pneumoniae CWL029
ucuucuuagccaaaa

SEQ ID NO: 2532879 - RNA, 19 nt, Chlamydophila pneumoniae CWL029
ucuucuuccaaaaucucua

SEQ ID NO: 2532880 - RNA, 17 nt, Chlamydophila pneumoniae CWL029
ucuucuucccuuucaaa

SEQ ID NO: 2532881 - RNA, 22 nt, Chlamydophila pneumoniae CWL029
ucuucuucgguguagaucuuuu

SEQ ID NO: 2532882 - RNA, 22 nt, Chlamydophila pneumoniae CWL029
ucuucuugcaaucuuugaagcu

SEQ ID NO: 2532883 - RNA, 14 nt, Chlamydophila pneumoniae CWL029
ucuucuuugccaau

SEQ ID NO: 2532884 - RNA, 15 nt, Chlamydophila pneumoniae CWL029
ucuucuuuggaugcu

SEQ ID NO: 2532885 - RNA, 16 nt, Chlamydophila pneumoniae CWL029
ucuucuuuggaugcua

SEQ ID NO: 2532886 - RNA, 23 nt, Chlamydophila pneumoniae CWL029
ucuugaaaguacaggcuccauca

SEQ ID NO: 2532887 - RNA, 14 nt, Chlamydophila pneumoniae CWL029
ucuugaagaucucc

SEQ ID NO: 2532888 - RNA, 22 nt, Chlamydophila pneumoniae CWL029
ucuugaaguucuucaagaugau

SEQ ID NO: 2532889 - RNA, 14 nt, Chlamydophila pneumoniae CWL029
ucuugaauucucaa

SEQ ID NO: 2532890 - RNA, 18 nt, Chlamydophila pneumoniae CWL029
ucuugacaacgguguuca

SEQ ID NO: 2532891 - RNA, 22 nt, Chlamydophila pneumoniae CWL029
ucuugacggcaggacucuuuaa

SEQ ID NO: 2532892 - RNA, 13 nt, Chlamydophila pneumoniae CWL029
ucuugacuuguuu

SEQ ID NO: 2532893 - RNA, 17 nt, Chlamydophila pneumoniae CWL029
ucuugagcauccaaaau

SEQ ID NO: 2532894 - RNA, 18 nt, Chlamydophila pneumoniae CWL029
ucuugagccacuuuuaau

SEQ ID NO: 2532895 - RNA, 13 nt, Chlamydophila pneumoniae CWL029
ucuugauaaaaga

SEQ ID NO: 2532896 - RNA, 20 nt, Chlamydophila pneumoniae CWL029
ucuugauccaucugcucuuu

SEQ ID NO: 2532897 - RNA, 16 nt, Chlamydophila pneumoniae CWL029
ucuugaugaccucuau

SEQ ID NO: 2532898 - RNA, 18 nt, Chlamydophila pneumoniae CWL029
ucuugaugaccucuauac

SEQ ID NO: 2532899 - RNA, 17 nt, Chlamydophila pneumoniae CWL029
ucuugauguacaguaaa

SEQ ID NO: 2532900 - RNA, 14 nt, Chlamydophila pneumoniae CWL029
ucuugauuagagaa

SEQ ID NO: 2532901 - RNA, 14 nt, Chlamydophila pneumoniae CWL029
ucuugauuccuuaa

SEQ ID NO: 2532902 - RNA, 13 nt, Chlamydophila pneumoniae CWL029
ucuugccaaugug

SEQ ID NO: 2532903 - RNA, 19 nt, Chlamydophila pneumoniae CWL029
ucuugcucaggagauacaa

SEQ ID NO: 2532904 - RNA, 15 nt, Chlamydophila pneumoniae CWL029
ucuugcugauuuuug

SEQ ID NO: 2532905 - RNA, 17 nt, Chlamydophila pneumoniae CWL029
ucuugcugauuuuugcu

SEQ ID NO: 2532906 - RNA, 19 nt, Chlamydophila pneumoniae CWL029
ucuugcuuauugucuuaaa

SEQ ID NO: 2532907 - RNA, 18 nt, Chlamydophila pneumoniae CWL029
ucuuggucggaguuuuuu

SEQ ID NO: 2532908 - RNA, 14 nt, Chlamydophila pneumoniae CWL029
ucuugguguauagu

SEQ ID NO: 2532909 - RNA, 15 nt, Chlamydophila pneumoniae CWL029
ucuugguguauagua

SEQ ID NO: 2532910 - RNA, 16 nt, Chlamydophila pneumoniae CWL029
ucuugguguauaguau

SEQ ID NO: 2532911 - RNA, 16 nt, Chlamydophila pneumoniae CWL029
ucuuguaaacgagcuu

SEQ ID NO: 2532912 - RNA, 21 nt, Chlamydophila pneumoniae CWL029
ucuuguaagacuaaaaaagag

SEQ ID NO: 2532913 - RNA, 18 nt, Chlamydophila pneumoniae CWL029
ucuugugguuuuucuccu

SEQ ID NO: 2532914 - RNA, 15 nt, Chlamydophila pneumoniae CWL029
ucuuuaaaaaauucu

SEQ ID NO: 2532915 - RNA, 14 nt, Chlamydophila pneumoniae CWL029
ucuuuaaaaauaua

SEQ ID NO: 2532916 - RNA, 16 nt, Chlamydophila pneumoniae CWL029
ucuuuaagauuuccuu

SEQ ID NO: 2532917 - RNA, 22 nt, Chlamydophila pneumoniae CWL029
ucuuuaauccaguuuuuuaaau

SEQ ID NO: 2532918 - RNA, 13 nt, Chlamydophila pneumoniae CWL029
ucuuuaauuaaaa

SEQ ID NO: 2532919 - RNA, 19 nt, Chlamydophila pneumoniae CWL029
ucuuuaauugugcucucua

SEQ ID NO: 2532920 - RNA, 13 nt, Chlamydophila pneumoniae CWL029
ucuuuaccagaaa

SEQ ID NO: 2532921 - RNA, 16 nt, Chlamydophila pneumoniae CWL029
ucuuuacuaacaaaau

SEQ ID NO: 2532922 - RNA, 23 nt, Chlamydophila pneumoniae CWL029
ucuuuacuacaugaggauacacu

SEQ ID NO: 2532923 - RNA, 18 nt, Chlamydophila pneumoniae CWL029
ucuuuagaauaagagcua

SEQ ID NO: 2532924 - RNA, 16 nt, Chlamydophila pneumoniae CWL029
ucuuuagcuacagaaa

SEQ ID NO: 2532925 - RNA, 22 nt, Chlamydophila pneumoniae CWL029
ucuuuaggauagaggccuuuua

SEQ ID NO: 2532926 - RNA, 19 nt, Chlamydophila pneumoniae CWL029
ucuuuaggguaaagaaaua

SEQ ID NO: 2532927 - RNA, 21 nt, Chlamydophila pneumoniae CWL029
ucuuuauaaauacaggagaau

SEQ ID NO: 2532928 - RNA, 21 nt, Chlamydophila pneumoniae CWL029
ucuuuaucuagcucuucaagg

SEQ ID NO: 2532929 - RNA, 12 nt, Chlamydophila pneumoniae CWL029
ucuuuauuuaaa

SEQ ID NO: 2532930 - RNA, 15 nt, Chlamydophila pneumoniae CWL029
ucuuuauuuuuaaaa

SEQ ID NO: 2532931 - RNA, 18 nt, Chlamydophila pneumoniae CWL029
ucuuuauuuuuaaaaaua

SEQ ID NO: 2532932 - RNA, 12 nt, Chlamydophila pneumoniae CWL029
ucuuucaaaaga

SEQ ID NO: 2532933 - RNA, 15 nt, Chlamydophila pneumoniae CWL029
ucuuucaaggaacau

SEQ ID NO: 2532934 - RNA, 13 nt, Chlamydophila pneumoniae CWL029
ucuuucacaucuu

SEQ ID NO: 2532935 - RNA, 19 nt, Chlamydophila pneumoniae CWL029
ucuuucacaucuuuagaau

SEQ ID NO: 2532936 - RNA, 22 nt, Chlamydophila pneumoniae CWL029
ucuuucaccaacuccucuaagg

SEQ ID NO: 2532937 - RNA, 16 nt, Chlamydophila pneumoniae CWL029
ucuuucauacuaaaau

SEQ ID NO: 2532938 - RNA, 19 nt, Chlamydophila pneumoniae CWL029
ucuuucaucaaugcgauua

SEQ ID NO: 2532939 - RNA, 15 nt, Chlamydophila pneumoniae CWL029
ucuuucauucccuuu

SEQ ID NO: 2532940 - RNA, 18 nt, Chlamydophila pneumoniae CWL029
ucuuuccauagccaagga

SEQ ID NO: 2532941 - RNA, 19 nt, Chlamydophila pneumoniae CWL029
ucuuucgaugcuauuuuuc

SEQ ID NO: 2532942 - RNA, 21 nt, Chlamydophila pneumoniae CWL029
ucuuucgaugcuauuuuucca

SEQ ID NO: 2532943 - RNA, 18 nt, Chlamydophila pneumoniae CWL029
ucuuucggugucucuaga

SEQ ID NO: 2532944 - RNA, 20 nt, Chlamydophila pneumoniae CWL029
ucuuucuaaaacaucagcaa

SEQ ID NO: 2532945 - RNA, 14 nt, Chlamydophila pneumoniae CWL029
ucuuucuaagaaga

SEQ ID NO: 2532946 - RNA, 11 nt, Chlamydophila pneumoniae CWL029
ucuuucuagaa

SEQ ID NO: 2532947 - RNA, 21 nt, Chlamydophila pneumoniae CWL029
ucuuucuaggaucucuaguaa

SEQ ID NO: 2532948 - RNA, 16 nt, Chlamydophila pneumoniae CWL029
ucuuucuaggccggga

SEQ ID NO: 2532949 - RNA, 15 nt, Chlamydophila pneumoniae CWL029
ucuuucuauagcucc

SEQ ID NO: 2532950 - RNA, 22 nt, Chlamydophila pneumoniae CWL029
ucuuucucgaggggacggaaaa

SEQ ID NO: 2532951 - RNA, 11 nt, Chlamydophila pneumoniae CWL029
ucuuucucuaa

SEQ ID NO: 2532952 - RNA, 20 nt, Chlamydophila pneumoniae CWL029
ucuuucugauuuaaaagguu

SEQ ID NO: 2532953 - RNA, 14 nt, Chlamydophila pneumoniae CWL029
ucuuucugcucuuc

SEQ ID NO: 2532954 - RNA, 16 nt, Chlamydophila pneumoniae CWL029
ucuuucugcucuucua

SEQ ID NO: 2532955 - RNA, 14 nt, Chlamydophila pneumoniae CWL029
ucuuucuuaggaaa

SEQ ID NO: 2532956 - RNA, 18 nt, Chlamydophila pneumoniae CWL029
ucuuucuugcucugacaa

SEQ ID NO: 2532957 - RNA, 22 nt, Chlamydophila pneumoniae CWL029
ucuuugaagaacaaaaaaucaa

SEQ ID NO: 2532958 - RNA, 21 nt, Chlamydophila pneumoniae CWL029
ucuuugaagcucgaccucuag

SEQ ID NO: 2532959 - RNA, 20 nt, Chlamydophila pneumoniae CWL029
ucuuugagaucuugaaugau

SEQ ID NO: 2532960 - RNA, 18 nt, Chlamydophila pneumoniae CWL029
ucuuugaggauacgaaua

SEQ ID NO: 2532961 - RNA, 22 nt, Chlamydophila pneumoniae CWL029
ucuuugauuuucaggagaccag

SEQ ID NO: 2532962 - RNA, 19 nt, Chlamydophila pneumoniae CWL029
ucuuugcgaacgaagacuu

SEQ ID NO: 2532963 - RNA, 19 nt, Chlamydophila pneumoniae CWL029
ucuuugggauaaaaaguuu

SEQ ID NO: 2532964 - RNA, 16 nt, Chlamydophila pneumoniae CWL029
ucuuuggguucuucca

SEQ ID NO: 2532965 - RNA, 23 nt, Chlamydophila pneumoniae CWL029
ucuuuuagacgugcucucuucuu

SEQ ID NO: 2532966 - RNA, 23 nt, Chlamydophila pneumoniae CWL029
ucuuuuauauaccacuacugagc

SEQ ID NO: 2532967 - RNA, 17 nt, Chlamydophila pneumoniae CWL029
ucuuuuauauuaagaau

SEQ ID NO: 2532968 - RNA, 17 nt, Chlamydophila pneumoniae CWL029
ucuuuucggaucagaau

SEQ ID NO: 2532969 - RNA, 16 nt, Chlamydophila pneumoniae CWL029
uguuuaugaaaaucug

SEQ ID NO: 2532970 - RNA, 17 nt, Chlamydophila pneumoniae CWL029
uguuuaugaaaaucugc

SEQ ID NO: 2532971 - RNA, 19 nt, Chlamydophila pneumoniae CWL029
uguuuauuaucuacagaga

SEQ ID NO: 2532972 - RNA, 22 nt, Chlamydophila pneumoniae CWL029
uguuucaaacaauaguaaagca

SEQ ID NO: 2532973 - RNA, 12 nt, Chlamydophila pneumoniae CWL029
uguuucacuuaa

SEQ ID NO: 2532974 - RNA, 20 nt, Chlamydophila pneumoniae CWL029
uguuuccuucgaagcggagc

SEQ ID NO: 2532975 - RNA, 20 nt, Chlamydophila pneumoniae CWL029
uguuucuagaaaaucucuaa

SEQ ID NO: 2532976 - RNA, 23 nt, Chlamydophila pneumoniae CWL029
uguuucuaugugaugucgcgaaa

SEQ ID NO: 2532977 - RNA, 15 nt, Chlamydophila pneumoniae CWL029
uguuucuuuaucuaa

SEQ ID NO: 2532978 - RNA, 19 nt, Chlamydophila pneumoniae CWL029
uguuugaaaauauccuaaa

SEQ ID NO: 2532979 - RNA, 21 nt, Chlamydophila pneumoniae CWL029
uguuuggccaacagcuaauac

SEQ ID NO: 2532980 - RNA, 13 nt, Chlamydophila pneumoniae CWL029
uguuuguccuagg

SEQ ID NO: 2532981 - RNA, 21 nt, Chlamydophila pneumoniae CWL029
uguuuuagauggaucuauaag

SEQ ID NO: 2532982 - RNA, 17 nt, Chlamydophila pneumoniae CWL029
uguuuuauccaccaaga

SEQ ID NO: 2532983 - RNA, 22 nt, Chlamydophila pneumoniae CWL029
uguuuucacauggccaaaaauc

SEQ ID NO: 2532984 - RNA, 16 nt, Chlamydophila pneumoniae CWL029
uguuuuccagaaaucu

SEQ ID NO: 2532985 - RNA, 12 nt, Chlamydophila pneumoniae CWL029
uguuuuccugag

SEQ ID NO: 2532986 - RNA, 16 nt, Chlamydophila pneumoniae CWL029
uguuuucguaaauaug

SEQ ID NO: 2532987 - RNA, 12 nt, Chlamydophila pneumoniae CWL029
uguuuucuucua

SEQ ID NO: 2532988 - RNA, 11 nt, Chlamydophila pneumoniae CWL029
uguuuuuaaac

SEQ ID NO: 2532989 - RNA, 13 nt, Chlamydophila pneumoniae CWL029
uguuuuuaggagu

SEQ ID NO: 2532990 - RNA, 17 nt, Chlamydophila pneumoniae CWL029
uguuuuucuaaaaugcu

SEQ ID NO: 2532991 - RNA, 18 nt, Chlamydophila pneumoniae CWL029
uguuuuucuuccacacaa

SEQ ID NO: 2532992 - RNA, 18 nt, Chlamydophila pneumoniae CWL029
uguuuuuugaaaacuuca

SEQ ID NO: 2532993 - RNA, 19 nt, Chlamydophila pneumoniae CWL029
uuaaaaaauuaucuccaaa

SEQ ID NO: 2532994 - RNA, 14 nt, Chlamydophila pneumoniae CWL029
uuaaaacccauguu

SEQ ID NO: 2532995 - RNA, 15 nt, Chlamydophila pneumoniae CWL029
uuaaaacccauguuu

SEQ ID NO: 2532996 - RNA, 22 nt, Chlamydophila pneumoniae CWL029
uuaaaagcauaguguauaucag

SEQ ID NO: 2532997 - RNA, 14 nt, Chlamydophila pneumoniae CWL029
uuaaaaguucagca

SEQ ID NO: 2532998 - RNA, 20 nt, Chlamydophila pneumoniae CWL029
uuaaaaguuccaaaucucaa

SEQ ID NO: 2532999 - RNA, 14 nt, Chlamydophila pneumoniae CWL029
uuaaacagaucuuu

SEQ ID NO: 2533000 - RNA, 17 nt, Chlamydophila pneumoniae CWL029
uuaaacagaucuuuauc

SEQ ID NO: 2533001 - RNA, 20 nt, Chlamydophila pneumoniae CWL029
uuaaacccaauucuuaaaaa

SEQ ID NO: 2533002 - RNA, 22 nt, Chlamydophila pneumoniae CWL029
uuaaaccuuuuuuuaaaaauau

SEQ ID NO: 2533003 - RNA, 13 nt, Chlamydophila pneumoniae CWL029
uuaaacuaagaau

SEQ ID NO: 2533004 - RNA, 21 nt, Chlamydophila pneumoniae CWL029
uuaaacucugacgucuccaac

SEQ ID NO: 2533005 - RNA, 22 nt, Chlamydophila pneumoniae CWL029
uuaaacucugacgucuccaaca

SEQ ID NO: 2533006 - RNA, 16 nt, Chlamydophila pneumoniae CWL029
uuaaacuuacagccac

SEQ ID NO: 2533007 - RNA, 15 nt, Chlamydophila pneumoniae CWL029
uuaaagagaaucucc

SEQ ID NO: 2533008 - RNA, 11 nt, Chlamydophila pneumoniae CWL029
uuaaagagcau

SEQ ID NO: 2533009 - RNA, 24 nt, Chlamydophila pneumoniae CWL029
uuaaagagcauccuguagccacua

SEQ ID NO: 2533010 - RNA, 14 nt, Chlamydophila pneumoniae CWL029
uuaaagcaaaaauu

SEQ ID NO: 2533011 - RNA, 16 nt, Chlamydophila pneumoniae CWL029
uuaaagcuugagaaaa

SEQ ID NO: 2533012 - RNA, 17 nt, Chlamydophila pneumoniae CWL029
uuaaaguggcaaucuuu

SEQ ID NO: 2533013 - RNA, 21 nt, Chlamydophila pneumoniae CWL029
uuaaaguuaaacaaaguagga

SEQ ID NO: 2533014 - RNA, 14 nt, Chlamydophila pneumoniae CWL029
uuaaauaaaaccac

SEQ ID NO: 2533015 - RNA, 17 nt, Chlamydophila pneumoniae CWL029
uuaaauauaaauuuaua

SEQ ID NO: 2533016 - RNA, 17 nt, Chlamydophila pneumoniae CWL029
uuaaauuuccaaagauc

SEQ ID NO: 2533017 - RNA, 13 nt, Chlamydophila pneumoniae CWL029
uuaacaaacuugu

SEQ ID NO: 2533018 - RNA, 13 nt, Chlamydophila pneumoniae CWL029
uuaacaacaucac

SEQ ID NO: 2533019 - RNA, 13 nt, Chlamydophila pneumoniae CWL029
uuaacaacaugcg

SEQ ID NO: 2533020 - RNA, 13 nt, Chlamydophila pneumoniae CWL029
uuaacagagcgcc

SEQ ID NO: 2533021 - RNA, 14 nt, Chlamydophila pneumoniae CWL029
uuaacccaccagaa

SEQ ID NO: 2533022 - RNA, 15 nt, Chlamydophila pneumoniae CWL029
uuaacccaccagaag

SEQ ID NO: 2533023 - RNA, 18 nt, Chlamydophila pneumoniae CWL029
uuaacccgcuugcaucuu

SEQ ID NO: 2533024 - RNA, 16 nt, Chlamydophila pneumoniae CWL029
uuaacgcuaagcucuu

SEQ ID NO: 2533025 - RNA, 13 nt, Chlamydophila pneumoniae CWL029
uuaacguuucuuc

SEQ ID NO: 2533026 - RNA, 15 nt, Chlamydophila pneumoniae CWL029
uuaagaagaagcuga

SEQ ID NO: 2533027 - RNA, 21 nt, Chlamydophila pneumoniae CWL029
uuaagaagcacuucuuuagga

SEQ ID NO: 2533028 - RNA, 17 nt, Chlamydophila pneumoniae CWL029
uuaagacaauauaagca

SEQ ID NO: 2533029 - RNA, 21 nt, Chlamydophila pneumoniae CWL029
uuaagacucaauacuucagga

SEQ ID NO: 2533030 - RNA, 16 nt, Chlamydophila pneumoniae CWL029
uuaagauaaacagcac

SEQ ID NO: 2533031 - RNA, 15 nt, Chlamydophila pneumoniae CWL029
uuaagauaaacauua

SEQ ID NO: 2533032 - RNA, 20 nt, Chlamydophila pneumoniae CWL029
uuaagauaaacauuaaguga

SEQ ID NO: 2533033 - RNA, 21 nt, Chlamydophila pneumoniae CWL029
uuaagauagacucucacugag

SEQ ID NO: 2533034 - RNA, 19 nt, Chlamydophila pneumoniae CWL029
uuaagauaucgaccuuaaa

SEQ ID NO: 2533035 - RNA, 13 nt, Chlamydophila pneumoniae CWL029
uuaagaucucuuu

SEQ ID NO: 2533036 - RNA, 22 nt, Chlamydophila pneumoniae CWL029
uuaagcucuaaguccaacauca

SEQ ID NO: 2533037 - RNA, 14 nt, Chlamydophila pneumoniae CWL029
uuaaggaaacagug

SEQ ID NO: 2533038 - RNA, 23 nt, Chlamydophila pneumoniae CWL029
uuaaggaaacagugguaugcuuu

SEQ ID NO: 2533039 - RNA, 16 nt, Chlamydophila pneumoniae CWL029
uuaaggaucccaucau

SEQ ID NO: 2533040 - RNA, 14 nt, Chlamydophila pneumoniae CWL029
uuaagucacacuuu

SEQ ID NO: 2533041 - RNA, 20 nt, Chlamydophila pneumoniae CWL029
uuaagugauggggauuaucc

SEQ ID NO: 2533042 - RNA, 17 nt, Chlamydophila pneumoniae CWL029
uuaaguguuucuucaua

SEQ ID NO: 2533043 - RNA, 15 nt, Chlamydophila pneumoniae CWL029
uuaauaaaucuauau

SEQ ID NO: 2533044 - RNA, 18 nt, Chlamydophila pneumoniae CWL029
uuaauaaauuuaucugcu

SEQ ID NO: 2533045 - RNA, 19 nt, Chlamydophila pneumoniae CWL029
uuaauaagaaccucuaauu

SEQ ID NO: 2533046 - RNA, 20 nt, Chlamydophila pneumoniae CWL029
uuaauaagaaccucuaauuu

SEQ ID NO: 2533047 - RNA, 14 nt, Chlamydophila pneumoniae CWL029
uuaauaauguuuua

SEQ ID NO: 2533048 - RNA, 22 nt, Chlamydophila pneumoniae CWL029
uuaauacaaaaaauaaaaucaa

SEQ ID NO: 2533049 - RNA, 16 nt, Chlamydophila pneumoniae CWL029
uuaauauuugagaaga

SEQ ID NO: 2533050 - RNA, 17 nt, Chlamydophila pneumoniae CWL029
uuaauccaaaaacuucu

SEQ ID NO: 2533051 - RNA, 13 nt, Chlamydophila pneumoniae CWL029
uuaauccuugagg

SEQ ID NO: 2533052 - RNA, 15 nt, Chlamydophila pneumoniae CWL029
uuaaugaacucaggc

SEQ ID NO: 2533053 - RNA, 21 nt, Chlamydophila pneumoniae CWL029
uuaaugcaagcaacucuucag

SEQ ID NO: 2533054 - RNA, 24 nt, Chlamydophila pneumoniae CWL029
uuaauuccaacuacauaauaagca

SEQ ID NO: 2533055 - RNA, 13 nt, Chlamydophila pneumoniae CWL029
uuaauuccuugga

SEQ ID NO: 2533056 - RNA, 10 nt, Chlamydophila pneumoniae CWL029
uuaauucucu

SEQ ID NO: 2533057 - RNA, 16 nt, Chlamydophila pneumoniae CWL029
uuaauuguagagagaa

SEQ ID NO: 2533058 - RNA, 12 nt, Chlamydophila pneumoniae CWL029
uuaauuuuucua

SEQ ID NO: 2533059 - RNA, 22 nt, Chlamydophila pneumoniae CWL029
uuacaaauggcaugaaagauaa

SEQ ID NO: 2533060 - RNA, 22 nt, Chlamydophila pneumoniae CWL029
uuacaaugaagucuucuuuccc

SEQ ID NO: 2533061 - RNA, 19 nt, Chlamydophila pneumoniae CWL029
uuacaauuuaaaucugcaa

SEQ ID NO: 2533062 - RNA, 19 nt, Chlamydophila pneumoniae CWL029
uuacaauuuuagauacgcu

SEQ ID NO: 2533063 - RNA, 14 nt, Chlamydophila pneumoniae CWL029
uuacacaacucuuu

SEQ ID NO: 2533064 - RNA, 15 nt, Chlamydophila pneumoniae CWL029
uuacacaacucuuuc

SEQ ID NO: 2533065 - RNA, 16 nt, Chlamydophila pneumoniae CWL029
uuacagaucugcauaa

SEQ ID NO: 2533066 - RNA, 20 nt, Chlamydophila pneumoniae CWL029
uuacagaugcaugauccuau

SEQ ID NO: 2533067 - RNA, 18 nt, Chlamydophila pneumoniae CWL029
uuacagccuauugcaggg

SEQ ID NO: 2533068 - RNA, 24 nt, Chlamydophila pneumoniae CWL029
ucuuuucggaucagaaugcaucuu

SEQ ID NO: 2533069 - RNA, 12 nt, Chlamydophila pneumoniae CWL029
ucuuuucuaagc

SEQ ID NO: 2533070 - RNA, 14 nt, Chlamydophila pneumoniae CWL029
ucuuuucuagaaaa

SEQ ID NO: 2533071 - RNA, 14 nt, Chlamydophila pneumoniae CWL029
ucuuuucugaagau

SEQ ID NO: 2533072 - RNA, 20 nt, Chlamydophila pneumoniae CWL029
ucuuuuuaagguucucugaa

SEQ ID NO: 2533073 - RNA, 19 nt, Chlamydophila pneumoniae CWL029
ucuuuuuauugauaaugau

SEQ ID NO: 2533074 - RNA, 13 nt, Chlamydophila pneumoniae CWL029
ucuuuuucagaaa

SEQ ID NO: 2533075 - RNA, 15 nt, Chlamydophila pneumoniae CWL029
ucuuuuucagaaagc

SEQ ID NO: 2533076 - RNA, 13 nt, Chlamydophila pneumoniae CWL029
ucuuuuucuaaga

SEQ ID NO: 2533077 - RNA, 19 nt, Chlamydophila pneumoniae CWL029
ucuuuuuuuugaagugcuu

SEQ ID NO: 2533078 - RNA, 13 nt, Chlamydophila pneumoniae CWL029
ugaaaaaauucua

SEQ ID NO: 2533079 - RNA, 17 nt, Chlamydophila pneumoniae CWL029
ugaaaacaaggcaaaaa

SEQ ID NO: 2533080 - RNA, 13 nt, Chlamydophila pneumoniae CWL029
ugaaaacuucaaa

SEQ ID NO: 2533081 - RNA, 20 nt, Chlamydophila pneumoniae CWL029
ugaaaagauuugcgaaucua

SEQ ID NO: 2533082 - RNA, 22 nt, Chlamydophila pneumoniae CWL029
ugaaaagcauucugcuagagcu

SEQ ID NO: 2533083 - RNA, 13 nt, Chlamydophila pneumoniae CWL029
ugaaaaucuuuaa

SEQ ID NO: 2533084 - RNA, 17 nt, Chlamydophila pneumoniae CWL029
ugaaaaugauucauaac

SEQ ID NO: 2533085 - RNA, 17 nt, Chlamydophila pneumoniae CWL029
ugaaaccguaacugagg

SEQ ID NO: 2533086 - RNA, 20 nt, Chlamydophila pneumoniae CWL029
ugaaaccguaacugaggcaa

SEQ ID NO: 2533087 - RNA, 18 nt, Chlamydophila pneumoniae CWL029
ugaaacgcccuucaggac

SEQ ID NO: 2533088 - RNA, 13 nt, Chlamydophila pneumoniae CWL029
ugaaacuuuagga

SEQ ID NO: 2533089 - RNA, 18 nt, Chlamydophila pneumoniae CWL029
ugaaacuuuuuuucuucu

SEQ ID NO: 2533090 - RNA, 20 nt, Chlamydophila pneumoniae CWL029
ugaaacuuuuuuucuucucu

SEQ ID NO: 2533091 - RNA, 19 nt, Chlamydophila pneumoniae CWL029
ugaaagauuauucuagagu

SEQ ID NO: 2533092 - RNA, 13 nt, Chlamydophila pneumoniae CWL029
ugaaaguacagaa

SEQ ID NO: 2533093 - RNA, 21 nt, Chlamydophila pneumoniae CWL029
ugaaaguacaggcuccaucac

SEQ ID NO: 2533094 - RNA, 23 nt, Chlamydophila pneumoniae CWL029
ugaaauacuccacuuuuuucccu

SEQ ID NO: 2533095 - RNA, 12 nt, Chlamydophila pneumoniae CWL029
ugaaaucaaaaa

SEQ ID NO: 2533096 - RNA, 17 nt, Chlamydophila pneumoniae CWL029
ugaaauuucugaaacaa

SEQ ID NO: 2533097 - RNA, 19 nt, Chlamydophila pneumoniae CWL029
ugaaauuucugaaacaaug

SEQ ID NO: 2533098 - RNA, 19 nt, Chlamydophila pneumoniae CWL029
ugaacaaaaaggacucuuu

SEQ ID NO: 2533099 - RNA, 20 nt, Chlamydophila pneumoniae CWL029
ugaacaaaaucgaacagaga

SEQ ID NO: 2533100 - RNA, 14 nt, Chlamydophila pneumoniae CWL029
ugaacacucucuac

SEQ ID NO: 2533101 - RNA, 13 nt, Chlamydophila pneumoniae CWL029
ugaacaucuccag

SEQ ID NO: 2533102 - RNA, 16 nt, Chlamydophila pneumoniae CWL029
ugaaccuuugguagaa

SEQ ID NO: 2533103 - RNA, 22 nt, Chlamydophila pneumoniae CWL029
ugaacuccaggguguuugcaua

SEQ ID NO: 2533104 - RNA, 17 nt, Chlamydophila pneumoniae CWL029
ugaagaacaaaaaauca

SEQ ID NO: 2533105 - RNA, 16 nt, Chlamydophila pneumoniae CWL029
ugaagacaaguaaaca

SEQ ID NO: 2533106 - RNA, 22 nt, Chlamydophila pneumoniae CWL029
ugaagacaaguaaacagcaaag

SEQ ID NO: 2533107 - RNA, 19 nt, Chlamydophila pneumoniae CWL029
ugaagacguucgacaacaa

SEQ ID NO: 2533108 - RNA, 23 nt, Chlamydophila pneumoniae CWL029
ugaagagucaaacuuauacacuc

SEQ ID NO: 2533109 - RNA, 16 nt, Chlamydophila pneumoniae CWL029
ugaagauauuaucgau

SEQ ID NO: 2533110 - RNA, 19 nt, Chlamydophila pneumoniae CWL029
ugaagaucuccgaagacua

SEQ ID NO: 2533111 - RNA, 15 nt, Chlamydophila pneumoniae CWL029
ugaagauuuuuucuu

SEQ ID NO: 2533112 - RNA, 14 nt, Chlamydophila pneumoniae CWL029
ugaagcagaaacuu

SEQ ID NO: 2533113 - RNA, 17 nt, Chlamydophila pneumoniae CWL029
ugaagcagaaacuuuaa

SEQ ID NO: 2533114 - RNA, 20 nt, Chlamydophila pneumoniae CWL029
ugaagcagaggguuccaaga

SEQ ID NO: 2533115 - RNA, 16 nt, Chlamydophila pneumoniae CWL029
ugaagcagggaaaaug

SEQ ID NO: 2533116 - RNA, 23 nt, Chlamydophila pneumoniae CWL029
ugaagccaaaaggcacaacaaug

SEQ ID NO: 2533117 - RNA, 15 nt, Chlamydophila pneumoniae CWL029
ugaagccaugacaaa

SEQ ID NO: 2533118 - RNA, 13 nt, Chlamydophila pneumoniae CWL029
ugaagcuccucac

SEQ ID NO: 2533119 - RNA, 22 nt, Chlamydophila pneumoniae CWL029
ugaagcugcuucuucagaguug

SEQ ID NO: 2533120 - RNA, 13 nt, Chlamydophila pneumoniae CWL029
ugaagcuucuuua

SEQ ID NO: 2533121 - RNA, 22 nt, Chlamydophila pneumoniae CWL029
ugaaggaucauaccgacaagca

SEQ ID NO: 2533122 - RNA, 17 nt, Chlamydophila pneumoniae CWL029
ugaagggacagucuccu

SEQ ID NO: 2533123 - RNA, 23 nt, Chlamydophila pneumoniae CWL029
ugaaggggugacccagagaaugu

SEQ ID NO: 2533124 - RNA, 16 nt, Chlamydophila pneumoniae CWL029
ugaagucguuuagauu

SEQ ID NO: 2533125 - RNA, 14 nt, Chlamydophila pneumoniae CWL029
ugaagucuucuugc

SEQ ID NO: 2533126 - RNA, 15 nt, Chlamydophila pneumoniae CWL029
ugaagucuucuugcu

SEQ ID NO: 2533127 - RNA, 16 nt, Chlamydophila pneumoniae CWL029
ugaaguucucaaagac

SEQ ID NO: 2533128 - RNA, 19 nt, Chlamydophila pneumoniae CWL029
ugaaguugagucgauuucc

SEQ ID NO: 2533129 - RNA, 22 nt, Chlamydophila pneumoniae CWL029
ugaaguugagucgauuucccag

SEQ ID NO: 2533130 - RNA, 23 nt, Chlamydophila pneumoniae CWL029
ugaaguuuugguuuuagaaaugu

SEQ ID NO: 2533131 - RNA, 15 nt, Chlamydophila pneumoniae CWL029
ugaaguuuuuucucu

SEQ ID NO: 2533132 - RNA, 15 nt, Chlamydophila pneumoniae CWL029
ugaauaagauuuuga

SEQ ID NO: 2533133 - RNA, 12 nt, Chlamydophila pneumoniae CWL029
ugaauaaugcau

SEQ ID NO: 2533134 - RNA, 15 nt, Chlamydophila pneumoniae CWL029
ugaauaccaaaauua

SEQ ID NO: 2533135 - RNA, 17 nt, Chlamydophila pneumoniae CWL029
ugaauaccagaagcaaa

SEQ ID NO: 2533136 - RNA, 21 nt, Chlamydophila pneumoniae CWL029
ugaauaccguuucaggaaacu

SEQ ID NO: 2533137 - RNA, 21 nt, Chlamydophila pneumoniae CWL029
ugagaauuuucaugauauuuu

SEQ ID NO: 2533138 - RNA, 22 nt, Chlamydophila pneumoniae CWL029
ugagacagacagucugugagaa

SEQ ID NO: 2533139 - RNA, 15 nt, Chlamydophila pneumoniae CWL029
ugagagauuuuuuca

SEQ ID NO: 2533140 - RNA, 21 nt, Chlamydophila pneumoniae CWL029
ugagaggaucgugaaguacau

SEQ ID NO: 2533141 - RNA, 19 nt, Chlamydophila pneumoniae CWL029
ugagagucaggaagaugcu

SEQ ID NO: 2533142 - RNA, 22 nt, Chlamydophila pneumoniae CWL029
ugagaguguuguuggagcagaa

SEQ ID NO: 2533143 - RNA, 18 nt, Chlamydophila pneumoniae CWL029
ugagauacggaggauuau

SEQ ID NO: 2533144 - RNA, 13 nt, Chlamydophila pneumoniae CWL029
ugagauagucuug

SEQ ID NO: 2533145 - RNA, 22 nt, Chlamydophila pneumoniae CWL029
ugagauccaaagccugaaaaau

SEQ ID NO: 2533146 - RNA, 19 nt, Chlamydophila pneumoniae CWL029
ugagaucgaaucuuuauuu

SEQ ID NO: 2533147 - RNA, 13 nt, Chlamydophila pneumoniae CWL029
ugagaucugcaaa

SEQ ID NO: 2533148 - RNA, 13 nt, Chlamydophila pneumoniae CWL029
ugagcaacaagcu

SEQ ID NO: 2533149 - RNA, 16 nt, Chlamydophila pneumoniae CWL029
ugagcaacaagcugcu

SEQ ID NO: 2533150 - RNA, 15 nt, Chlamydophila pneumoniae CWL029
ugagcagcaaaaauu

SEQ ID NO: 2533151 - RNA, 20 nt, Chlamydophila pneumoniae CWL029
ugagcagcaaaaauuguuuu

SEQ ID NO: 2533152 - RNA, 17 nt, Chlamydophila pneumoniae CWL029
ugagcagcuuuaucagg

SEQ ID NO: 2533153 - RNA, 22 nt, Chlamydophila pneumoniae CWL029
ugagcaguaauguuaacgaauu

SEQ ID NO: 2533154 - RNA, 14 nt, Chlamydophila pneumoniae CWL029
ugagcauccaaaau

SEQ ID NO: 2533155 - RNA, 20 nt, Chlamydophila pneumoniae CWL029
ugagcauccaaaaugucuuu

SEQ ID NO: 2533156 - RNA, 17 nt, Chlamydophila pneumoniae CWL029
ugagcuccaaaauaauc

SEQ ID NO: 2533157 - RNA, 16 nt, Chlamydophila pneumoniae CWL029
ugagcuugccuaccca

SEQ ID NO: 2533158 - RNA, 17 nt, Chlamydophila pneumoniae CWL029
ugaggacacaacucuuu

SEQ ID NO: 2533159 - RNA, 20 nt, Chlamydophila pneumoniae CWL029
ugaggacacaacucuuuaau

SEQ ID NO: 2533160 - RNA, 19 nt, Chlamydophila pneumoniae CWL029
ugaggacgcagagaugcua

SEQ ID NO: 2533161 - RNA, 20 nt, Chlamydophila pneumoniae CWL029
ugaggagcucccucuagagc

SEQ ID NO: 2533162 - RNA, 18 nt, Chlamydophila pneumoniae CWL029
ugaggauaaguucuucca

SEQ ID NO: 2533163 - RNA, 19 nt, Chlamydophila pneumoniae CWL029
ugaggauaaguucuuccaa

SEQ ID NO: 2533164 - RNA, 18 nt, Chlamydophila pneumoniae CWL029
ugaggauacgaauaaguu

SEQ ID NO: 2533165 - RNA, 21 nt, Chlamydophila pneumoniae CWL029
ugaggcaaagauuuccaaucc

SEQ ID NO: 2533166 - RNA, 23 nt, Chlamydophila pneumoniae CWL029
ugaggcaaagauuuccaauccau

SEQ ID NO: 2533167 - RNA, 14 nt, Chlamydophila pneumoniae CWL029
ugaggcaagucuca

SEQ ID NO: 2533168 - RNA, 16 nt, Chlamydophila pneumoniae CWL029
ugaggcacauguagga

SEQ ID NO: 2533169 - RNA, 14 nt, Chlamydophila pneumoniae CWL029
ugaggcuauagaau

SEQ ID NO: 2533170 - RNA, 17 nt, Chlamydophila pneumoniae CWL029
ugagguuugugcugcuu

SEQ ID NO: 2533171 - RNA, 20 nt, Chlamydophila pneumoniae CWL029
ugaguaaaaucauaggcuau

SEQ ID NO: 2533172 - RNA, 17 nt, Chlamydophila pneumoniae CWL029
ugagugucccauggcug

SEQ ID NO: 2533173 - RNA, 20 nt, Chlamydophila pneumoniae CWL029
ugaguuagcuuuugugauac

SEQ ID NO: 2533174 - RNA, 12 nt, Chlamydophila pneumoniae CWL029
ugaguucuuccu

SEQ ID NO: 2533175 - RNA, 22 nt, Chlamydophila pneumoniae CWL029
ugaguucuuuuguuugucuucc

SEQ ID NO: 2533176 - RNA, 21 nt, Chlamydophila pneumoniae CWL029
ugaguuuacuaacucuguaau

SEQ ID NO: 2533177 - RNA, 14 nt, Chlamydophila pneumoniae CWL029
ugauaaaaauuuuc

SEQ ID NO: 2533178 - RNA, 14 nt, Chlamydophila pneumoniae CWL029
ugauaaaagauagu

SEQ ID NO: 2533179 - RNA, 19 nt, Chlamydophila pneumoniae CWL029
ugauaaaauaaacucuugu

SEQ ID NO: 2533180 - RNA, 12 nt, Chlamydophila pneumoniae CWL029
ugauaaagccug

SEQ ID NO: 2533181 - RNA, 14 nt, Chlamydophila pneumoniae CWL029
ugauaacuuugcau

SEQ ID NO: 2533182 - RNA, 22 nt, Chlamydophila pneumoniae CWL029
ugauaaggaagaauuucgucuu

SEQ ID NO: 2533183 - RNA, 18 nt, Chlamydophila pneumoniae CWL029
ugauaauuacagaaguuc

SEQ ID NO: 2533184 - RNA, 16 nt, Chlamydophila pneumoniae CWL029
ugauaauuucauuaua

SEQ ID NO: 2533185 - RNA, 17 nt, Chlamydophila pneumoniae CWL029
ugauaccaccuaaaaug

SEQ ID NO: 2533186 - RNA, 21 nt, Chlamydophila pneumoniae CWL029
ugauaccaccuaaaaugcagg

SEQ ID NO: 2533187 - RNA, 22 nt, Chlamydophila pneumoniae CWL029
ugauagaggaaguguuucuuug

SEQ ID NO: 2533188 - RNA, 17 nt, Chlamydophila pneumoniae CWL029
ugauagcugaugcugag

SEQ ID NO: 2533189 - RNA, 19 nt, Chlamydophila pneumoniae CWL029
ugauaucaccagguccuuc

SEQ ID NO: 2533190 - RNA, 13 nt, Chlamydophila pneumoniae CWL029
ugauauuccuuga

SEQ ID NO: 2533191 - RNA, 14 nt, Chlamydophila pneumoniae CWL029
ugauauuuucuugu

SEQ ID NO: 2533192 - RNA, 19 nt, Chlamydophila pneumoniae CWL029
ugauauuuuuauuuaaaau

SEQ ID NO: 2533193 - RNA, 21 nt, Chlamydophila pneumoniae CWL029
ugaucaaaaaugauaccaccu

SEQ ID NO: 2533194 - RNA, 17 nt, Chlamydophila pneumoniae CWL029
ugaucaaaauuauccag

SEQ ID NO: 2533195 - RNA, 20 nt, Chlamydophila pneumoniae CWL029
ugaucaagaggagugaaagc

SEQ ID NO: 2533196 - RNA, 15 nt, Chlamydophila pneumoniae CWL029
ugaucagaaaugaag

SEQ ID NO: 2533197 - RNA, 22 nt, Chlamydophila pneumoniae CWL029
ugaucagaaaugaagccaaaag

SEQ ID NO: 2533198 - RNA, 12 nt, Chlamydophila pneumoniae CWL029
ugaucagaaucu

SEQ ID NO: 2533199 - RNA, 13 nt, Chlamydophila pneumoniae CWL029
ugaucagaaucua

SEQ ID NO: 2533200 - RNA, 22 nt, Chlamydophila pneumoniae CWL029
ugauccaauagccaaagacucu

SEQ ID NO: 2533201 - RNA, 17 nt, Chlamydophila pneumoniae CWL029
ugauccagcccccaggc

SEQ ID NO: 2533202 - RNA, 21 nt, Chlamydophila pneumoniae CWL029
ugauccagcccccaggcugca

SEQ ID NO: 2533203 - RNA, 16 nt, Chlamydophila pneumoniae CWL029
ugauccagcuccauaa

SEQ ID NO: 2533204 - RNA, 17 nt, Chlamydophila pneumoniae CWL029
ugauccaucugcucuuu

SEQ ID NO: 2533205 - RNA, 18 nt, Chlamydophila pneumoniae CWL029
ugauccgaaaacucuuag

SEQ ID NO: 2533206 - RNA, 19 nt, Chlamydophila pneumoniae CWL029
ugauccgaaaacucuuaga

SEQ ID NO: 2533207 - RNA, 14 nt, Chlamydophila pneumoniae CWL029
ugauccuucuuaug

SEQ ID NO: 2533208 - RNA, 16 nt, Chlamydophila pneumoniae CWL029
ugauccuugcaaaaca

SEQ ID NO: 2533209 - RNA, 13 nt, Chlamydophila pneumoniae CWL029
ugaucuacaaaaa

SEQ ID NO: 2533210 - RNA, 21 nt, Chlamydophila pneumoniae CWL029
ugaucuacaaaaacuagaaua

SEQ ID NO: 2533211 - RNA, 23 nt, Chlamydophila pneumoniae CWL029
ugaucugaaauagcaaagacauc

SEQ ID NO: 2533212 - RNA, 21 nt, Chlamydophila pneumoniae CWL029
ugaucugaaguugaaaugagu

SEQ ID NO: 2533213 - RNA, 17 nt, Chlamydophila pneumoniae CWL029
ugaucuucuagaugugu

SEQ ID NO: 2533214 - RNA, 18 nt, Chlamydophila pneumoniae CWL029
ugaucuugcucaggagau

SEQ ID NO: 2533215 - RNA, 15 nt, Chlamydophila pneumoniae CWL029
ugaucuuuccucuca

SEQ ID NO: 2533216 - RNA, 14 nt, Chlamydophila pneumoniae CWL029
ugaugacauugcaa

SEQ ID NO: 2533217 - RNA, 19 nt, Chlamydophila pneumoniae CWL029
ugaugauuuuuuaugacaa

SEQ ID NO: 2533218 - RNA, 20 nt, Chlamydophila pneumoniae CWL029
ugaugauuuuuuaugacaaa

SEQ ID NO: 2533219 - RNA, 21 nt, Chlamydophila pneumoniae CWL029
ugaugcaaugguugucuuuac

SEQ ID NO: 2533220 - RNA, 23 nt, Chlamydophila pneumoniae CWL029
ugaugcaccauaauauaauagug

SEQ ID NO: 2533221 - RNA, 15 nt, Chlamydophila pneumoniae CWL029
ugaugccaagaaaua

SEQ ID NO: 2533222 - RNA, 18 nt, Chlamydophila pneumoniae CWL029
ugaugcccugacguuuug

SEQ ID NO: 2533223 - RNA, 15 nt, Chlamydophila pneumoniae CWL029
ugaugcuucuuucaa

SEQ ID NO: 2533224 - RNA, 16 nt, Chlamydophila pneumoniae CWL029
ugaugcuucuuucaaa

SEQ ID NO: 2533225 - RNA, 19 nt, Chlamydophila pneumoniae CWL029
ugaugcuucuuucaaagcc

SEQ ID NO: 2533226 - RNA, 15 nt, Chlamydophila pneumoniae CWL029
ugauggggauuaucc

SEQ ID NO: 2533227 - RNA, 19 nt, Chlamydophila pneumoniae CWL029
ugauguaggugauauuuuc

SEQ ID NO: 2533228 - RNA, 15 nt, Chlamydophila pneumoniae CWL029
ugauguguugauuuc

SEQ ID NO: 2533229 - RNA, 16 nt, Chlamydophila pneumoniae CWL029
ugauguugcccuacaa

SEQ ID NO: 2533230 - RNA, 20 nt, Chlamydophila pneumoniae CWL029
ugauuacagcaucuauagaa

SEQ ID NO: 2533231 - RNA, 15 nt, Chlamydophila pneumoniae CWL029
ugauuagagaauccg

SEQ ID NO: 2533232 - RNA, 13 nt, Chlamydophila pneumoniae CWL029
ugauuaggaacaa

SEQ ID NO: 2533233 - RNA, 19 nt, Chlamydophila pneumoniae CWL029
ugauuaggcuucagagauu

SEQ ID NO: 2533234 - RNA, 17 nt, Chlamydophila pneumoniae CWL029
ugauuaguucucuaaga

SEQ ID NO: 2533235 - RNA, 14 nt, Chlamydophila pneumoniae CWL029
ugcugaagggacag

SEQ ID NO: 2533236 - RNA, 22 nt, Chlamydophila pneumoniae CWL029
ugcugaauauaguuuaaauguc

SEQ ID NO: 2533237 - RNA, 21 nt, Chlamydophila pneumoniae CWL029
ugcugacagcuccauuuaaau

SEQ ID NO: 2533238 - RNA, 16 nt, Chlamydophila pneumoniae CWL029
ugcugacaucuccaag

SEQ ID NO: 2533239 - RNA, 21 nt, Chlamydophila pneumoniae CWL029
ugcugaggacgcagagaugcu

SEQ ID NO: 2533240 - RNA, 20 nt, Chlamydophila pneumoniae CWL029
ugcugagggaucuucucuau

SEQ ID NO: 2533241 - RNA, 21 nt, Chlamydophila pneumoniae CWL029
ugcugagggaucuucucuaug

SEQ ID NO: 2533242 - RNA, 22 nt, Chlamydophila pneumoniae CWL029
ugcugcagcaaaacuaggaaaa

SEQ ID NO: 2533243 - RNA, 23 nt, Chlamydophila pneumoniae CWL029
ugcugcagcaaaacuaggaaaag

SEQ ID NO: 2533244 - RNA, 15 nt, Chlamydophila pneumoniae CWL029
ugcugccaugacaua

SEQ ID NO: 2533245 - RNA, 20 nt, Chlamydophila pneumoniae CWL029
ugcugccaugacauaggcaa

SEQ ID NO: 2533246 - RNA, 13 nt, Chlamydophila pneumoniae CWL029
ugcugcucuccaa

SEQ ID NO: 2533247 - RNA, 23 nt, Chlamydophila pneumoniae CWL029
ugcuggaguagcucaauuggcag

SEQ ID NO: 2533248 - RNA, 18 nt, Chlamydophila pneumoniae CWL029
ugcugggggagcuagaaa

SEQ ID NO: 2533249 - RNA, 12 nt, Chlamydophila pneumoniae CWL029
ugcugucagaac

SEQ ID NO: 2533250 - RNA, 16 nt, Chlamydophila pneumoniae CWL029
ugcuguuccauaauuu

SEQ ID NO: 2533251 - RNA, 17 nt, Chlamydophila pneumoniae CWL029
ugcuguugauucaaugc

SEQ ID NO: 2533252 - RNA, 17 nt, Chlamydophila pneumoniae CWL029
ugcuguuguaauaaaag

SEQ ID NO: 2533253 - RNA, 16 nt, Chlamydophila pneumoniae CWL029
ugcuuaaaauucugua

SEQ ID NO: 2533254 - RNA, 19 nt, Chlamydophila pneumoniae CWL029
ugcuuaagaguuuuacauc

SEQ ID NO: 2533255 - RNA, 11 nt, Chlamydophila pneumoniae CWL029
ugcuuaaggaa

SEQ ID NO: 2533256 - RNA, 23 nt, Chlamydophila pneumoniae CWL029
ugcuuaaggaaacagugguaugc

SEQ ID NO: 2533257 - RNA, 18 nt, Chlamydophila pneumoniae CWL029
ugcuuagcgaucucucuu

SEQ ID NO: 2533258 - RNA, 20 nt, Chlamydophila pneumoniae CWL029
ugcuuagcgaucucucuucc

SEQ ID NO: 2533259 - RNA, 22 nt, Chlamydophila pneumoniae CWL029
ugcuuauuuccccgaacaaauu

SEQ ID NO: 2533260 - RNA, 21 nt, Chlamydophila pneumoniae CWL029
ugcuuccaacggacauuuuca

SEQ ID NO: 2533261 - RNA, 17 nt, Chlamydophila pneumoniae CWL029
ugcuucgggaacgugcu

SEQ ID NO: 2533262 - RNA, 18 nt, Chlamydophila pneumoniae CWL029
ugcuucuaagaaacuucc

SEQ ID NO: 2533263 - RNA, 17 nt, Chlamydophila pneumoniae CWL029
ugcuucuauuuuagaau

SEQ ID NO: 2533264 - RNA, 11 nt, Chlamydophila pneumoniae CWL029
ugcuucuucag

SEQ ID NO: 2533265 - RNA, 14 nt, Chlamydophila pneumoniae CWL029
ugcuucuucagagu

SEQ ID NO: 2533266 - RNA, 17 nt, Chlamydophila pneumoniae CWL029
ugcuucuuggcguucca

SEQ ID NO: 2533267 - RNA, 15 nt, Chlamydophila pneumoniae CWL029
ugcuugaauauuucc

SEQ ID NO: 2533268 - RNA, 21 nt, Chlamydophila pneumoniae CWL029
ugcuugaccucaucagaagug

SEQ ID NO: 2533269 - RNA, 17 nt, Chlamydophila pneumoniae CWL029
ugcuuguauaaaugcug

SEQ ID NO: 2533270 - RNA, 14 nt, Chlamydophila pneumoniae CWL029
ugcuuguugguuaa

SEQ ID NO: 2533271 - RNA, 14 nt, Chlamydophila pneumoniae CWL029
ugcuuuaacagaag

SEQ ID NO: 2533272 - RNA, 15 nt, Chlamydophila pneumoniae CWL029
ugcuuuaauccugca

SEQ ID NO: 2533273 - RNA, 23 nt, Chlamydophila pneumoniae CWL029
ugcuuucuagcugcucuuuuaga

SEQ ID NO: 2533274 - RNA, 19 nt, Chlamydophila pneumoniae CWL029
ugcuuugccgccucagcac

SEQ ID NO: 2533275 - RNA, 13 nt, Chlamydophila pneumoniae CWL029
ugcuuuuccuucu

SEQ ID NO: 2533276 - RNA, 21 nt, Chlamydophila pneumoniae CWL029
uggaaaagccucgaaauuuuc

SEQ ID NO: 2533277 - RNA, 18 nt, Chlamydophila pneumoniae CWL029
uggaaagagucccugauu

SEQ ID NO: 2533278 - RNA, 19 nt, Chlamydophila pneumoniae CWL029
uggaaagcuucuggauuca

SEQ ID NO: 2533279 - RNA, 23 nt, Chlamydophila pneumoniae CWL029
uggaaaucaccagcauuaagaua

SEQ ID NO: 2533280 - RNA, 21 nt, Chlamydophila pneumoniae CWL029
uggaaauccguaaagguugua

SEQ ID NO: 2533281 - RNA, 16 nt, Chlamydophila pneumoniae CWL029
uggaaauugugaaaaa

SEQ ID NO: 2533282 - RNA, 22 nt, Chlamydophila pneumoniae CWL029
uggaacaguauaaucagaagug

SEQ ID NO: 2533283 - RNA, 19 nt, Chlamydophila pneumoniae CWL029
uggaacgcauaagagacau

SEQ ID NO: 2533284 - RNA, 17 nt, Chlamydophila pneumoniae CWL029
uggaagaauuucauaag

SEQ ID NO: 2533285 - RNA, 17 nt, Chlamydophila pneumoniae CWL029
uggaagcaaagaaaauu

SEQ ID NO: 2533286 - RNA, 21 nt, Chlamydophila pneumoniae CWL029
uggaagcuuuuacgagcuuuu

SEQ ID NO: 2533287 - RNA, 16 nt, Chlamydophila pneumoniae CWL029
uggaaguaaucuggaa

SEQ ID NO: 2533288 - RNA, 19 nt, Chlamydophila pneumoniae CWL029
uggaaguaaucuggaagca

SEQ ID NO: 2533289 - RNA, 20 nt, Chlamydophila pneumoniae CWL029
uggaauaucaggacaaugaa

SEQ ID NO: 2533290 - RNA, 18 nt, Chlamydophila pneumoniae CWL029
uggaaucagggacucuuu

SEQ ID NO: 2533291 - RNA, 15 nt, Chlamydophila pneumoniae CWL029
uggaaucuaugaaua

SEQ ID NO: 2533292 - RNA, 13 nt, Chlamydophila pneumoniae CWL029
uggaaugccaaau

SEQ ID NO: 2533293 - RNA, 18 nt, Chlamydophila pneumoniae CWL029
uggaauucaaacuccuuu

SEQ ID NO: 2533294 - RNA, 18 nt, Chlamydophila pneumoniae CWL029
uggacaacgcuucuuuuu

SEQ ID NO: 2533295 - RNA, 23 nt, Chlamydophila pneumoniae CWL029
uggacagcggccacaugaagucc

SEQ ID NO: 2533296 - RNA, 22 nt, Chlamydophila pneumoniae CWL029
uggaccagaugcuaaagagucu

SEQ ID NO: 2533297 - RNA, 17 nt, Chlamydophila pneumoniae CWL029
uggacuacugaaacacu

SEQ ID NO: 2533298 - RNA, 12 nt, Chlamydophila pneumoniae CWL029
uggacuccaaga

SEQ ID NO: 2533299 - RNA, 16 nt, Chlamydophila pneumoniae CWL029
uggacucuagggucaa

SEQ ID NO: 2533300 - RNA, 21 nt, Chlamydophila pneumoniae CWL029
uggacugcugacaucuccaag

SEQ ID NO: 2533301 - RNA, 21 nt, Chlamydophila pneumoniae CWL029
uggacuucugguuuuucgauu

SEQ ID NO: 2533302 - RNA, 20 nt, Chlamydophila pneumoniae CWL029
uggagaauaaucucuuucau

SEQ ID NO: 2533303 - RNA, 11 nt, Chlamydophila pneumoniae CWL029
uggagacacac

SEQ ID NO: 2533304 - RNA, 20 nt, Chlamydophila pneumoniae CWL029
uggagacuaggguaaguccc

SEQ ID NO: 2533305 - RNA, 16 nt, Chlamydophila pneumoniae CWL029
uggagcagaaacucca

SEQ ID NO: 2533306 - RNA, 16 nt, Chlamydophila pneumoniae CWL029
uggaggauaaaugagu

SEQ ID NO: 2533307 - RNA, 14 nt, Chlamydophila pneumoniae CWL029
uggaggccaaagaa

SEQ ID NO: 2533308 - RNA, 15 nt, Chlamydophila pneumoniae CWL029
uggagucuaaaaaau

SEQ ID NO: 2533309 - RNA, 16 nt, Chlamydophila pneumoniae CWL029
uggagugacaccaaca

SEQ ID NO: 2533310 - RNA, 16 nt, Chlamydophila pneumoniae CWL029
uggauaccggcaaaua

SEQ ID NO: 2533311 - RNA, 17 nt, Chlamydophila pneumoniae CWL029
uggauaccggcaaauaa

SEQ ID NO: 2533312 - RNA, 17 nt, Chlamydophila pneumoniae CWL029
uggauauugucaagagg

SEQ ID NO: 2533313 - RNA, 14 nt, Chlamydophila pneumoniae CWL029
uggaucaaggagua

SEQ ID NO: 2533314 - RNA, 13 nt, Chlamydophila pneumoniae CWL029
uggaucauucuuu

SEQ ID NO: 2533315 - RNA, 21 nt, Chlamydophila pneumoniae CWL029
uggauccaucggcauuucucc

SEQ ID NO: 2533316 - RNA, 22 nt, Chlamydophila pneumoniae CWL029
uggauccaucggcauuucucca

SEQ ID NO: 2533317 - RNA, 15 nt, Chlamydophila pneumoniae CWL029
uggauccuucaucag

SEQ ID NO: 2533318 - RNA, 16 nt, Chlamydophila pneumoniae CWL029
uggaugcuaauaaaau

SEQ ID NO: 2533319 - RNA, 13 nt, Chlamydophila pneumoniae CWL029
uggauuucuccag

SEQ ID NO: 2533320 - RNA, 22 nt, Chlamydophila pneumoniae CWL029
uggauuucuccagcagcuuccc

SEQ ID NO: 2533321 - RNA, 15 nt, Chlamydophila pneumoniae CWL029
uggauuucuucuguu

SEQ ID NO: 2533322 - RNA, 21 nt, Chlamydophila pneumoniae CWL029
uggauuuuaaagcaaaaauuc

SEQ ID NO: 2533323 - RNA, 18 nt, Chlamydophila pneumoniae CWL029
uggcaaauaaaacaagcu

SEQ ID NO: 2533324 - RNA, 20 nt, Chlamydophila pneumoniae CWL029
uggcaaauaaaacaagcuuu

SEQ ID NO: 2533325 - RNA, 13 nt, Chlamydophila pneumoniae CWL029
uggcaaggaaaau

SEQ ID NO: 2533326 - RNA, 15 nt, Chlamydophila pneumoniae CWL029
uggcaaucuaaaauc

SEQ ID NO: 2533327 - RNA, 17 nt, Chlamydophila pneumoniae CWL029
uggcagcaggaauaauc

SEQ ID NO: 2533328 - RNA, 16 nt, Chlamydophila pneumoniae CWL029
uggcaguuuuaaugag

SEQ ID NO: 2533329 - RNA, 21 nt, Chlamydophila pneumoniae CWL029
uggcauaaagaccgagaagcu

SEQ ID NO: 2533330 - RNA, 17 nt, Chlamydophila pneumoniae CWL029
uggcauagcgaaaguca

SEQ ID NO: 2533331 - RNA, 15 nt, Chlamydophila pneumoniae CWL029
uggcaugaaagauaa

SEQ ID NO: 2533332 - RNA, 19 nt, Chlamydophila pneumoniae CWL029
ugucacacugcgagagaaa

SEQ ID NO: 2533333 - RNA, 14 nt, Chlamydophila pneumoniae CWL029
ugucacuagagaaa

SEQ ID NO: 2533334 - RNA, 17 nt, Chlamydophila pneumoniae CWL029
ugucacuaucuucuaaa

SEQ ID NO: 2533335 - RNA, 19 nt, Chlamydophila pneumoniae CWL029
ugucacuaucuucuaaaac

SEQ ID NO: 2533336 - RNA, 19 nt, Chlamydophila pneumoniae CWL029
ugucacucuagaaaauauu

SEQ ID NO: 2533337 - RNA, 12 nt, Chlamydophila pneumoniae CWL029
ugucagaacaag

SEQ ID NO: 2533338 - RNA, 13 nt, Chlamydophila pneumoniae CWL029
ugucagaacaaga

SEQ ID NO: 2533339 - RNA, 13 nt, Chlamydophila pneumoniae CWL029
ugucaucucauag

SEQ ID NO: 2533340 - RNA, 13 nt, Chlamydophila pneumoniae CWL029
ugucauuaaaaau

SEQ ID NO: 2533341 - RNA, 19 nt, Chlamydophila pneumoniae CWL029
ugucauuaaaaauuuaaaa

SEQ ID NO: 2533342 - RNA, 15 nt, Chlamydophila pneumoniae CWL029
uguccaacuaaaaca

SEQ ID NO: 2533343 - RNA, 11 nt, Chlamydophila pneumoniae CWL029
uguccagagac

SEQ ID NO: 2533344 - RNA, 18 nt, Chlamydophila pneumoniae CWL029
uguccagagacaaagcca

SEQ ID NO: 2533345 - RNA, 22 nt, Chlamydophila pneumoniae CWL029
uguccagucuauagccucuucu

SEQ ID NO: 2533346 - RNA, 17 nt, Chlamydophila pneumoniae CWL029
uguccauccaaauagag

SEQ ID NO: 2533347 - RNA, 20 nt, Chlamydophila pneumoniae CWL029
uguccauccaaauagaguga

SEQ ID NO: 2533348 - RNA, 19 nt, Chlamydophila pneumoniae CWL029
uguccaugcacgagauucu

SEQ ID NO: 2533349 - RNA, 21 nt, Chlamydophila pneumoniae CWL029
ugucccauggcuggaaagcca

SEQ ID NO: 2533350 - RNA, 21 nt, Chlamydophila pneumoniae CWL029
uguccuccauggaaagaaaca

SEQ ID NO: 2533351 - RNA, 13 nt, Chlamydophila pneumoniae CWL029
uguccuugcagcc

SEQ ID NO: 2533352 - RNA, 17 nt, Chlamydophila pneumoniae CWL029
ugucgcuuucauuugua

SEQ ID NO: 2533353 - RNA, 18 nt, Chlamydophila pneumoniae CWL029
ugucgcuuuugcuagaga

SEQ ID NO: 2533354 - RNA, 13 nt, Chlamydophila pneumoniae CWL029
ugucguuaaaaac

SEQ ID NO: 2533355 - RNA, 22 nt, Chlamydophila pneumoniae CWL029
ugucuacagaggaaucuauccu

SEQ ID NO: 2533356 - RNA, 15 nt, Chlamydophila pneumoniae CWL029
ugucuaugauugcua

SEQ ID NO: 2533357 - RNA, 21 nt, Chlamydophila pneumoniae CWL029
ugucuccaaauguucucucca

SEQ ID NO: 2533358 - RNA, 16 nt, Chlamydophila pneumoniae CWL029
ugucugaguuagcuuu

SEQ ID NO: 2533359 - RNA, 20 nt, Chlamydophila pneumoniae CWL029
ugucugauuaguucucuaag

SEQ ID NO: 2533360 - RNA, 13 nt, Chlamydophila pneumoniae CWL029
ugucuuaucuaaa

SEQ ID NO: 2533361 - RNA, 15 nt, Chlamydophila pneumoniae CWL029
ugucuugcugauuuu

SEQ ID NO: 2533362 - RNA, 12 nt, Chlamydophila pneumoniae CWL029
ugucuuuccagg

SEQ ID NO: 2533363 - RNA, 18 nt, Chlamydophila pneumoniae CWL029
ugugaauuuuauuuauua

SEQ ID NO: 2533364 - RNA, 15 nt, Chlamydophila pneumoniae CWL029
ugugacgacaaauca

SEQ ID NO: 2533365 - RNA, 14 nt, Chlamydophila pneumoniae CWL029
ugugaguucuuccu

SEQ ID NO: 2533366 - RNA, 23 nt, Chlamydophila pneumoniae CWL029
ugugauaccuccuccaaucugcu

SEQ ID NO: 2533367 - RNA, 14 nt, Chlamydophila pneumoniae CWL029
ugugauauucuugg

SEQ ID NO: 2533368 - RNA, 20 nt, Chlamydophila pneumoniae CWL029
ugugauccuugcaaaacagc

SEQ ID NO: 2533369 - RNA, 15 nt, Chlamydophila pneumoniae CWL029
ugugcaauaggaaaa

SEQ ID NO: 2533370 - RNA, 22 nt, Chlamydophila pneumoniae CWL029
ugugcagaagguuccacagaga

SEQ ID NO: 2533371 - RNA, 20 nt, Chlamydophila pneumoniae CWL029
ugugcaucuauaauuaaucc

SEQ ID NO: 2533372 - RNA, 13 nt, Chlamydophila pneumoniae CWL029
ugugcaugcaucu

SEQ ID NO: 2533373 - RNA, 15 nt, Chlamydophila pneumoniae CWL029
ugugcaugcaucuua

SEQ ID NO: 2533374 - RNA, 15 nt, Chlamydophila pneumoniae CWL029
ugugcauuuucuucu

SEQ ID NO: 2533375 - RNA, 16 nt, Chlamydophila pneumoniae CWL029
ugugcauuuucuucuu

SEQ ID NO: 2533376 - RNA, 15 nt, Chlamydophila pneumoniae CWL029
ugugccaauuuuugu

SEQ ID NO: 2533377 - RNA, 14 nt, Chlamydophila pneumoniae CWL029
ugugccagaauaua

SEQ ID NO: 2533378 - RNA, 22 nt, Chlamydophila pneumoniae CWL029
ugugcgcacaagggauucuugu

SEQ ID NO: 2533379 - RNA, 17 nt, Chlamydophila pneumoniae CWL029
ugugcggcgagcucuag

SEQ ID NO: 2533380 - RNA, 17 nt, Chlamydophila pneumoniae CWL029
ugugcucaauacagaua

SEQ ID NO: 2533381 - RNA, 21 nt, Chlamydophila pneumoniae CWL029
ugugcucgacguauuugccaa

SEQ ID NO: 2533382 - RNA, 14 nt, Chlamydophila pneumoniae CWL029
ugugcuuuucucuu

SEQ ID NO: 2533383 - RNA, 18 nt, Chlamydophila pneumoniae CWL029
uguggaauaucaggacaa

SEQ ID NO: 2533384 - RNA, 21 nt, Chlamydophila pneumoniae CWL029
uguggguaaugccaauauggu

SEQ ID NO: 2533385 - RNA, 22 nt, Chlamydophila pneumoniae CWL029
ugugguaaaaauauaggcugca

SEQ ID NO: 2533386 - RNA, 15 nt, Chlamydophila pneumoniae CWL029
ugugguuagaggaag

SEQ ID NO: 2533387 - RNA, 13 nt, Chlamydophila pneumoniae CWL029
uguguaaaaguua

SEQ ID NO: 2533388 - RNA, 13 nt, Chlamydophila pneumoniae CWL029
uguguaaugagcu

SEQ ID NO: 2533389 - RNA, 18 nt, Chlamydophila pneumoniae CWL029
uguguaugaaucacaucu

SEQ ID NO: 2533390 - RNA, 13 nt, Chlamydophila pneumoniae CWL029
ugugucuuaaagc

SEQ ID NO: 2533391 - RNA, 22 nt, Chlamydophila pneumoniae CWL029
uguguuauggaaaucaccagca

SEQ ID NO: 2533392 - RNA, 23 nt, Chlamydophila pneumoniae CWL029
uguguuuuauccaccaagacuga

SEQ ID NO: 2533393 - RNA, 19 nt, Chlamydophila pneumoniae CWL029
uguuaacaagauucucagc

SEQ ID NO: 2533394 - RNA, 18 nt, Chlamydophila pneumoniae CWL029
uguuaacaaguaccaaga

SEQ ID NO: 2533395 - RNA, 20 nt, Chlamydophila pneumoniae CWL029
uguuaacaaguaccaagaaa

SEQ ID NO: 2533396 - RNA, 21 nt, Chlamydophila pneumoniae CWL029
uguuaacaaguaccaagaaaa

SEQ ID NO: 2533397 - RNA, 23 nt, Chlamydophila pneumoniae CWL029
uguuaacaaguaccaagaaaaua

SEQ ID NO: 2533398 - RNA, 22 nt, Chlamydophila pneumoniae CWL029
uguuaagauguggucuuccgua

SEQ ID NO: 2533399 - RNA, 20 nt, Chlamydophila pneumoniae CWL029
uguuaaggcuuccaaugcua

SEQ ID NO: 2533400 - RNA, 13 nt, Chlamydophila pneumoniae CWL029
uguuaaucuaauu

SEQ ID NO: 2533401 - RNA, 15 nt, Chlamydophila pneumoniae CWL029
uguuaugaguuuuua

SEQ ID NO: 2533402 - RNA, 18 nt, Chlamydophila pneumoniae CWL029
uguuaugaguuuuuaauu

SEQ ID NO: 2533403 - RNA, 14 nt, Chlamydophila pneumoniae CWL029
uguuauuguuucua

SEQ ID NO: 2533404 - RNA, 15 nt, Chlamydophila pneumoniae CWL029
uguucauaaucagaa

SEQ ID NO: 2533405 - RNA, 13 nt, Chlamydophila pneumoniae CWL029
uguuccaauagag

SEQ ID NO: 2533406 - RNA, 13 nt, Chlamydophila pneumoniae CWL029
uguuccacuugcu

SEQ ID NO: 2533407 - RNA, 23 nt, Chlamydophila pneumoniae CWL029
uguuccauaauuuuagcuucuuu

SEQ ID NO: 2533408 - RNA, 18 nt, Chlamydophila pneumoniae CWL029
uguucccucuucuuccaa

SEQ ID NO: 2533409 - RNA, 20 nt, Chlamydophila pneumoniae CWL029
uguuccuuuuuuuuuucuuc

SEQ ID NO: 2533410 - RNA, 15 nt, Chlamydophila pneumoniae CWL029
uguucgaguucuuua

SEQ ID NO: 2533411 - RNA, 13 nt, Chlamydophila pneumoniae CWL029
uguucgauuuucu

SEQ ID NO: 2533412 - RNA, 18 nt, Chlamydophila pneumoniae CWL029
uguucgcuccuaauggaa

SEQ ID NO: 2533413 - RNA, 17 nt, Chlamydophila pneumoniae CWL029
uguucugcacguggcuu

SEQ ID NO: 2533414 - RNA, 11 nt, Chlamydophila pneumoniae CWL029
uguucugcugc

SEQ ID NO: 2533415 - RNA, 20 nt, Chlamydophila pneumoniae CWL029
uguucuucuucagucauucu

SEQ ID NO: 2533416 - RNA, 15 nt, Chlamydophila pneumoniae CWL029
uguucuuuacuacau

SEQ ID NO: 2533417 - RNA, 21 nt, Chlamydophila pneumoniae CWL029
uguugauaaaagguauuucuc

SEQ ID NO: 2533418 - RNA, 17 nt, Chlamydophila pneumoniae CWL029
uguugauccuucuuaug

SEQ ID NO: 2533419 - RNA, 13 nt, Chlamydophila pneumoniae CWL029
uguugauuuccaa

SEQ ID NO: 2533420 - RNA, 21 nt, Chlamydophila pneumoniae CWL029
uguugcaauagcaauggcuuu

SEQ ID NO: 2533421 - RNA, 22 nt, Chlamydophila pneumoniae CWL029
uguugcaauucuucaugcugcu

SEQ ID NO: 2533422 - RNA, 13 nt, Chlamydophila pneumoniae CWL029
uguugcuuucugu

SEQ ID NO: 2533423 - RNA, 13 nt, Chlamydophila pneumoniae CWL029
uguugggagcuuc

SEQ ID NO: 2533424 - RNA, 16 nt, Chlamydophila pneumoniae CWL029
uguuguaauaaaagaa

SEQ ID NO: 2533425 - RNA, 13 nt, Chlamydophila pneumoniae CWL029
uguugucacuaag

SEQ ID NO: 2533426 - RNA, 15 nt, Chlamydophila pneumoniae CWL029
uguuguggaucagaa

SEQ ID NO: 2533427 - RNA, 13 nt, Chlamydophila pneumoniae CWL029
uguuguuuuugcu

SEQ ID NO: 2533428 - RNA, 13 nt, Chlamydophila pneumoniae CWL029
uguuuacagaugc

SEQ ID NO: 2533429 - RNA, 22 nt, Chlamydophila pneumoniae CWL029
uguuuagaauuuguccuuugcu

SEQ ID NO: 2533430 - RNA, 21 nt, Chlamydophila pneumoniae CWL029
uguuuagcauagagcucuaaa

SEQ ID NO: 2533431 - RNA, 21 nt, Chlamydophila pneumoniae CWL029
uuaguggaaauugugaaaaaa

SEQ ID NO: 2533432 - RNA, 18 nt, Chlamydophila pneumoniae CWL029
uuaguuaacuccuucaau

SEQ ID NO: 2533433 - RNA, 14 nt, Chlamydophila pneumoniae CWL029
uuaguuuuuucuaa

SEQ ID NO: 2533434 - RNA, 14 nt, Chlamydophila pneumoniae CWL029
uuauaaacuucaau

SEQ ID NO: 2533435 - RNA, 22 nt, Chlamydophila pneumoniae CWL029
uuauaaagaucgggucuacaac

SEQ ID NO: 2533436 - RNA, 14 nt, Chlamydophila pneumoniae CWL029
uuauacacuccaau

SEQ ID NO: 2533437 - RNA, 18 nt, Chlamydophila pneumoniae CWL029
uuauacuuuuuuuauaua

SEQ ID NO: 2533438 - RNA, 22 nt, Chlamydophila pneumoniae CWL029
uuauagauagggccgugaagca

SEQ ID NO: 2533439 - RNA, 15 nt, Chlamydophila pneumoniae CWL029
uuauagauaugccuc

SEQ ID NO: 2533440 - RNA, 17 nt, Chlamydophila pneumoniae CWL029
uuauaggaauaacacca

SEQ ID NO: 2533441 - RNA, 20 nt, Chlamydophila pneumoniae CWL029
uuauaggaauaacaccaaaa

SEQ ID NO: 2533442 - RNA, 23 nt, Chlamydophila pneumoniae CWL029
uuauaggaauaacaccaaaagaa

SEQ ID NO: 2533443 - RNA, 20 nt, Chlamydophila pneumoniae CWL029
uuauaguagcgaauccagaa

SEQ ID NO: 2533444 - RNA, 16 nt, Chlamydophila pneumoniae CWL029
uuauauaaagaucuuu

SEQ ID NO: 2533445 - RNA, 11 nt, Chlamydophila pneumoniae CWL029
uuauauuaaga

SEQ ID NO: 2533446 - RNA, 20 nt, Chlamydophila pneumoniae CWL029
uuaucaaaagguuuuauaaa

SEQ ID NO: 2533447 - RNA, 15 nt, Chlamydophila pneumoniae CWL029
uuaucaaagugaacg

SEQ ID NO: 2533448 - RNA, 12 nt, Chlamydophila pneumoniae CWL029
uuaucaggaaau

SEQ ID NO: 2533449 - RNA, 15 nt, Chlamydophila pneumoniae CWL029
uuaucauagauguca

SEQ ID NO: 2533450 - RNA, 18 nt, Chlamydophila pneumoniae CWL029
uuaucaugagaauuuuca

SEQ ID NO: 2533451 - RNA, 19 nt, Chlamydophila pneumoniae CWL029
uuaucaugagaauuuucau

SEQ ID NO: 2533452 - RNA, 15 nt, Chlamydophila pneumoniae CWL029
uuaucccaaacuucu

SEQ ID NO: 2533453 - RNA, 14 nt, Chlamydophila pneumoniae CWL029
uuauccguggggac

SEQ ID NO: 2533454 - RNA, 19 nt, Chlamydophila pneumoniae CWL029
uuauccugaacaucuccag

SEQ ID NO: 2533455 - RNA, 21 nt, Chlamydophila pneumoniae CWL029
uuauccugaacaucuccagca

SEQ ID NO: 2533456 - RNA, 19 nt, Chlamydophila pneumoniae CWL029
uuauccuugaaauugcucu

SEQ ID NO: 2533457 - RNA, 23 nt, Chlamydophila pneumoniae CWL029
uuaucgauaauaaaagcacccuc

SEQ ID NO: 2533458 - RNA, 18 nt, Chlamydophila pneumoniae CWL029
uuaucgggggugccaaaa

SEQ ID NO: 2533459 - RNA, 20 nt, Chlamydophila pneumoniae CWL029
uuaucgggggugccaaaaaa

SEQ ID NO: 2533460 - RNA, 19 nt, Chlamydophila pneumoniae CWL029
uuaucuaagaauauggaca

SEQ ID NO: 2533461 - RNA, 15 nt, Chlamydophila pneumoniae CWL029
uuaucuagcucuuca

SEQ ID NO: 2533462 - RNA, 19 nt, Chlamydophila pneumoniae CWL029
uuaucuagcucuucaaggu

SEQ ID NO: 2533463 - RNA, 21 nt, Chlamydophila pneumoniae CWL029
uuaucuaggucgauaucccac

SEQ ID NO: 2533464 - RNA, 15 nt, Chlamydophila pneumoniae CWL029
uuaucuccaaagauc

SEQ ID NO: 2533465 - RNA, 13 nt, Chlamydophila pneumoniae CWL029
uuaucucccaaga

SEQ ID NO: 2533466 - RNA, 19 nt, Chlamydophila pneumoniae CWL029
uuaucuccccauucacaaa

SEQ ID NO: 2533467 - RNA, 19 nt, Chlamydophila pneumoniae CWL029
uuaucugcguuucuuucug

SEQ ID NO: 2533468 - RNA, 15 nt, Chlamydophila pneumoniae CWL029
uuaucuguuaaaaac

SEQ ID NO: 2533469 - RNA, 15 nt, Chlamydophila pneumoniae CWL029
uuaugaaaaucugcu

SEQ ID NO: 2533470 - RNA, 17 nt, Chlamydophila pneumoniae CWL029
uuaugacaaacucuauu

SEQ ID NO: 2533471 - RNA, 13 nt, Chlamydophila pneumoniae CWL029
uuaugaccaagaa

SEQ ID NO: 2533472 - RNA, 20 nt, Chlamydophila pneumoniae CWL029
uuaugaguuuuuaauuuucu

SEQ ID NO: 2533473 - RNA, 17 nt, Chlamydophila pneumoniae CWL029
uuauggauuaucuuagg

SEQ ID NO: 2533474 - RNA, 22 nt, Chlamydophila pneumoniae CWL029
uuauguagaucauaaacagcag

SEQ ID NO: 2533475 - RNA, 21 nt, Chlamydophila pneumoniae CWL029
uuauguagaucuacaagacua

SEQ ID NO: 2533476 - RNA, 21 nt, Chlamydophila pneumoniae CWL029
uuauguuaaaaauaccaagau

SEQ ID NO: 2533477 - RNA, 22 nt, Chlamydophila pneumoniae CWL029
uuauguuaaaaauaccaagaug

SEQ ID NO: 2533478 - RNA, 16 nt, Chlamydophila pneumoniae CWL029
uuauguuuucucgaag

SEQ ID NO: 2533479 - RNA, 20 nt, Chlamydophila pneumoniae CWL029
uuauguuuucucgaagaaaa

SEQ ID NO: 2533480 - RNA, 22 nt, Chlamydophila pneumoniae CWL029
uuauguuuucucgaagaaaaua

SEQ ID NO: 2533481 - RNA, 12 nt, Chlamydophila pneumoniae CWL029
uuauuacagaaa

SEQ ID NO: 2533482 - RNA, 16 nt, Chlamydophila pneumoniae CWL029
uuauugaauaagcuuu

SEQ ID NO: 2533483 - RNA, 19 nt, Chlamydophila pneumoniae CWL029
uuauugaauaagcuuuccu

SEQ ID NO: 2533484 - RNA, 15 nt, Chlamydophila pneumoniae CWL029
uuauuuaaaauuucu

SEQ ID NO: 2533485 - RNA, 21 nt, Chlamydophila pneumoniae CWL029
uuauuucuaaaaaauagauaa

SEQ ID NO: 2533486 - RNA, 22 nt, Chlamydophila pneumoniae CWL029
uuauuuggacguacuaagauac

SEQ ID NO: 2533487 - RNA, 18 nt, Chlamydophila pneumoniae CWL029
uuauuuguuucuuccaua

SEQ ID NO: 2533488 - RNA, 15 nt, Chlamydophila pneumoniae CWL029
uuauuuucuacacug

SEQ ID NO: 2533489 - RNA, 13 nt, Chlamydophila pneumoniae CWL029
uuauuuuuaaaua

SEQ ID NO: 2533490 - RNA, 14 nt, Chlamydophila pneumoniae CWL029
uucaaaagaaaaga

SEQ ID NO: 2533491 - RNA, 22 nt, Chlamydophila pneumoniae CWL029
uucaaaagaaaucaaacauuac

SEQ ID NO: 2533492 - RNA, 13 nt, Chlamydophila pneumoniae CWL029
uucaaacuccuuu

SEQ ID NO: 2533493 - RNA, 12 nt, Chlamydophila pneumoniae CWL029
uucaaagauugc

SEQ ID NO: 2533494 - RNA, 21 nt, Chlamydophila pneumoniae CWL029
uucaaauauugcgaacuuuug

SEQ ID NO: 2533495 - RNA, 15 nt, Chlamydophila pneumoniae CWL029
uucaaaucaucaaaa

SEQ ID NO: 2533496 - RNA, 18 nt, Chlamydophila pneumoniae CWL029
uucaaaucaucaaaaaga

SEQ ID NO: 2533497 - RNA, 17 nt, Chlamydophila pneumoniae CWL029
uucaaauuugcucuccu

SEQ ID NO: 2533498 - RNA, 21 nt, Chlamydophila pneumoniae CWL029
uucaaauuugcucuccugcaa

SEQ ID NO: 2533499 - RNA, 19 nt, Chlamydophila pneumoniae CWL029
uucaacauaacaugagaaa

SEQ ID NO: 2533500 - RNA, 16 nt, Chlamydophila pneumoniae CWL029
uucaacauguuaauaa

SEQ ID NO: 2533501 - RNA, 22 nt, Chlamydophila pneumoniae CWL029
uucaacauguuaauaagcauau

SEQ ID NO: 2533502 - RNA, 20 nt, Chlamydophila pneumoniae CWL029
uucaacucuaucgaagagcc

SEQ ID NO: 2533503 - RNA, 23 nt, Chlamydophila pneumoniae CWL029
uucaacuuuguuaauagaagauc

SEQ ID NO: 2533504 - RNA, 14 nt, Chlamydophila pneumoniae CWL029
uucaagaacuccuu

SEQ ID NO: 2533505 - RNA, 16 nt, Chlamydophila pneumoniae CWL029
uucaagcaaaucuccg

SEQ ID NO: 2533506 - RNA, 12 nt, Chlamydophila pneumoniae CWL029
uucaagcuuucg

SEQ ID NO: 2533507 - RNA, 19 nt, Chlamydophila pneumoniae CWL029
uucaagguacuuuauagaa

SEQ ID NO: 2533508 - RNA, 20 nt, Chlamydophila pneumoniae CWL029
uucaagguacuuuauagaaa

SEQ ID NO: 2533509 - RNA, 17 nt, Chlamydophila pneumoniae CWL029
uucaagucgagaaacaa

SEQ ID NO: 2533510 - RNA, 12 nt, Chlamydophila pneumoniae CWL029
uucaaguuucuu

SEQ ID NO: 2533511 - RNA, 13 nt, Chlamydophila pneumoniae CWL029
uucaaguuucuuu

SEQ ID NO: 2533512 - RNA, 22 nt, Chlamydophila pneumoniae CWL029
uucaauaagaucucgugaauua

SEQ ID NO: 2533513 - RNA, 23 nt, Chlamydophila pneumoniae CWL029
uucaauaauaucgguuccuauau

SEQ ID NO: 2533514 - RNA, 22 nt, Chlamydophila pneumoniae CWL029
uucaauacgcuagcucuuaaau

SEQ ID NO: 2533515 - RNA, 19 nt, Chlamydophila pneumoniae CWL029
uucaauagcaaagauuucu

SEQ ID NO: 2533516 - RNA, 23 nt, Chlamydophila pneumoniae CWL029
uucaauaggaauuagagaaauuu

SEQ ID NO: 2533517 - RNA, 20 nt, Chlamydophila pneumoniae CWL029
uucaauagguaaggaaacga

SEQ ID NO: 2533518 - RNA, 16 nt, Chlamydophila pneumoniae CWL029
uucaauaucuugaauu

SEQ ID NO: 2533519 - RNA, 19 nt, Chlamydophila pneumoniae CWL029
uucaauaucuugaauucuc

SEQ ID NO: 2533520 - RNA, 19 nt, Chlamydophila pneumoniae CWL029
uucaaucucuccuugacaa

SEQ ID NO: 2533521 - RNA, 13 nt, Chlamydophila pneumoniae CWL029
uucaaugaaagcu

SEQ ID NO: 2533522 - RNA, 13 nt, Chlamydophila pneumoniae CWL029
uucaaugaagaaa

SEQ ID NO: 2533523 - RNA, 15 nt, Chlamydophila pneumoniae CWL029
uucaaugagcaucug

SEQ ID NO: 2533524 - RNA, 14 nt, Chlamydophila pneumoniae CWL029
uucaaugauguguu

SEQ ID NO: 2533525 - RNA, 15 nt, Chlamydophila pneumoniae CWL029
uucaaugauguguug

SEQ ID NO: 2533526 - RNA, 20 nt, Chlamydophila pneumoniae CWL029
uucaauuccuuucuccagca

SEQ ID NO: 2533527 - RNA, 18 nt, Chlamydophila pneumoniae CWL029
uucaauugagacaaaaaa

SEQ ID NO: 2533528 - RNA, 14 nt, Chlamydophila pneumoniae CWL029
uucaauuguaagca

SEQ ID NO: 2533529 - RNA, 20 nt, Chlamydophila pneumoniae CWL029
uuccuucaggauuacggaaa

SEQ ID NO: 2533530 - RNA, 12 nt, Chlamydophila pneumoniae CWL029
uuccuucucaga

SEQ ID NO: 2533531 - RNA, 22 nt, Chlamydophila pneumoniae CWL029
uuccuucuccagagcaagauuu

SEQ ID NO: 2533532 - RNA, 12 nt, Chlamydophila pneumoniae CWL029
uuccuucuccug

SEQ ID NO: 2533533 - RNA, 23 nt, Chlamydophila pneumoniae CWL029
uuccuugacuaugguaagcauuu

SEQ ID NO: 2533534 - RNA, 17 nt, Chlamydophila pneumoniae CWL029
uuccuuggauuucuucu

SEQ ID NO: 2533535 - RNA, 22 nt, Chlamydophila pneumoniae CWL029
uuccuuggauuucuucuucuaa

SEQ ID NO: 2533536 - RNA, 22 nt, Chlamydophila pneumoniae CWL029
uuccuuggcguacucuauuaag

SEQ ID NO: 2533537 - RNA, 12 nt, Chlamydophila pneumoniae CWL029
uuccuuuucucc

SEQ ID NO: 2533538 - RNA, 18 nt, Chlamydophila pneumoniae CWL029
uucgaagcgcucuacaaa

SEQ ID NO: 2533539 - RNA, 14 nt, Chlamydophila pneumoniae CWL029
uucgaauucucaga

SEQ ID NO: 2533540 - RNA, 21 nt, Chlamydophila pneumoniae CWL029
uucgacaacaacauaaagaag

SEQ ID NO: 2533541 - RNA, 18 nt, Chlamydophila pneumoniae CWL029
uucgacaaccaaaacaga

SEQ ID NO: 2533542 - RNA, 15 nt, Chlamydophila pneumoniae CWL029
uucgaccuauuugca

SEQ ID NO: 2533543 - RNA, 18 nt, Chlamydophila pneumoniae CWL029
uucgaugucuuuccaggc

SEQ ID NO: 2533544 - RNA, 13 nt, Chlamydophila pneumoniae CWL029
uucgauuccugag

SEQ ID NO: 2533545 - RNA, 23 nt, Chlamydophila pneumoniae CWL029
uucgcaaauauaguuuucauaau

SEQ ID NO: 2533546 - RNA, 20 nt, Chlamydophila pneumoniae CWL029
uucgcacgcaacaucucaca

SEQ ID NO: 2533547 - RNA, 16 nt, Chlamydophila pneumoniae CWL029
uucgcacuaauuuccu

SEQ ID NO: 2533548 - RNA, 20 nt, Chlamydophila pneumoniae CWL029
uucgcacuaauuuccuucag

SEQ ID NO: 2533549 - RNA, 21 nt, Chlamydophila pneumoniae CWL029
uucgccaaacgaauuucuugu

SEQ ID NO: 2533550 - RNA, 19 nt, Chlamydophila pneumoniae CWL029
uucgccuuggguuugucuc

SEQ ID NO: 2533551 - RNA, 19 nt, Chlamydophila pneumoniae CWL029
uucggggagagaacuuuug

SEQ ID NO: 2533552 - RNA, 19 nt, Chlamydophila pneumoniae CWL029
uucguaacgcuuuucuaau

SEQ ID NO: 2533553 - RNA, 18 nt, Chlamydophila pneumoniae CWL029
uucguaagagaauuauua

SEQ ID NO: 2533554 - RNA, 23 nt, Chlamydophila pneumoniae CWL029
uucguaagcugagguagcaucuc

SEQ ID NO: 2533555 - RNA, 19 nt, Chlamydophila pneumoniae CWL029
uucguagacgcucuaaacu

SEQ ID NO: 2533556 - RNA, 17 nt, Chlamydophila pneumoniae CWL029
uucguauagcuggcaau

SEQ ID NO: 2533557 - RNA, 18 nt, Chlamydophila pneumoniae CWL029
uucguauagcuggcaaug

SEQ ID NO: 2533558 - RNA, 16 nt, Chlamydophila pneumoniae CWL029
uucgucuaaaauaacc

SEQ ID NO: 2533559 - RNA, 20 nt, Chlamydophila pneumoniae CWL029
uucgucuaaaauaaccccuc

SEQ ID NO: 2533560 - RNA, 13 nt, Chlamydophila pneumoniae CWL029
uucgucuucauaa

SEQ ID NO: 2533561 - RNA, 15 nt, Chlamydophila pneumoniae CWL029
uucgugagagcguug

SEQ ID NO: 2533562 - RNA, 16 nt, Chlamydophila pneumoniae CWL029
uucguggagugcucua

SEQ ID NO: 2533563 - RNA, 17 nt, Chlamydophila pneumoniae CWL029
uucguggagugcucuac

SEQ ID NO: 2533564 - RNA, 22 nt, Chlamydophila pneumoniae CWL029
uucgugugcacccaaucgguau

SEQ ID NO: 2533565 - RNA, 20 nt, Chlamydophila pneumoniae CWL029
uucuaaaaagaaaagaccuc

SEQ ID NO: 2533566 - RNA, 16 nt, Chlamydophila pneumoniae CWL029
uucuaaaagagcaaga

SEQ ID NO: 2533567 - RNA, 21 nt, Chlamydophila pneumoniae CWL029
uucuaaaucccgccuuucuac

SEQ ID NO: 2533568 - RNA, 13 nt, Chlamydophila pneumoniae CWL029
uucuaagauaucu

SEQ ID NO: 2533569 - RNA, 13 nt, Chlamydophila pneumoniae CWL029
uucuaagauuccu

SEQ ID NO: 2533570 - RNA, 23 nt, Chlamydophila pneumoniae CWL029
uucuaagauuccuaacuucugaa

SEQ ID NO: 2533571 - RNA, 17 nt, Chlamydophila pneumoniae CWL029
uucuaagcaauauuucu

SEQ ID NO: 2533572 - RNA, 19 nt, Chlamydophila pneumoniae CWL029
uucuaagcaauauuucugu

SEQ ID NO: 2533573 - RNA, 19 nt, Chlamydophila pneumoniae CWL029
uucuaagcugaaagaacac

SEQ ID NO: 2533574 - RNA, 23 nt, Chlamydophila pneumoniae CWL029
uucuaauguagggggauugauaa

SEQ ID NO: 2533575 - RNA, 23 nt, Chlamydophila pneumoniae CWL029
uucuaccaauaaccgaaacuucu

SEQ ID NO: 2533576 - RNA, 16 nt, Chlamydophila pneumoniae CWL029
uucuagaaaagauucu

SEQ ID NO: 2533577 - RNA, 16 nt, Chlamydophila pneumoniae CWL029
uucuagaaacugcucc

SEQ ID NO: 2533578 - RNA, 21 nt, Chlamydophila pneumoniae CWL029
uucuagaaacugcuccugaag

SEQ ID NO: 2533579 - RNA, 15 nt, Chlamydophila pneumoniae CWL029
uucuagaaugaugca

SEQ ID NO: 2533580 - RNA, 20 nt, Chlamydophila pneumoniae CWL029
uucuagagcuucaaguuucu

SEQ ID NO: 2533581 - RNA, 21 nt, Chlamydophila pneumoniae CWL029
uucuagcucauuaucaagaaa

SEQ ID NO: 2533582 - RNA, 15 nt, Chlamydophila pneumoniae CWL029
uucuagguauuuguu

SEQ ID NO: 2533583 - RNA, 16 nt, Chlamydophila pneumoniae CWL029
uucuagguauuuguuu

SEQ ID NO: 2533584 - RNA, 14 nt, Chlamydophila pneumoniae CWL029
uucuauaacuacaa

SEQ ID NO: 2533585 - RNA, 23 nt, Chlamydophila pneumoniae CWL029
uucuauacgcuuaacaugaaaag

SEQ ID NO: 2533586 - RNA, 16 nt, Chlamydophila pneumoniae CWL029
uucuauagcaagacga

SEQ ID NO: 2533587 - RNA, 21 nt, Chlamydophila pneumoniae CWL029
uucccuuguuaugaaaaucuu

SEQ ID NO: 2533588 - RNA, 23 nt, Chlamydophila pneumoniae CWL029
uuccgaauugcgaauccugagga

SEQ ID NO: 2533589 - RNA, 20 nt, Chlamydophila pneumoniae CWL029
uuccgacccagucaaaauau

SEQ ID NO: 2533590 - RNA, 21 nt, Chlamydophila pneumoniae CWL029
uuccgauuaguaaugauguag

SEQ ID NO: 2533591 - RNA, 15 nt, Chlamydophila pneumoniae CWL029
uuccgcggccaucau

SEQ ID NO: 2533592 - RNA, 19 nt, Chlamydophila pneumoniae CWL029
uuccggggagaacuucaac

SEQ ID NO: 2533593 - RNA, 20 nt, Chlamydophila pneumoniae CWL029
uuccgucugaauguaacucc

SEQ ID NO: 2533594 - RNA, 14 nt, Chlamydophila pneumoniae CWL029
uuccuaaaucugcu

SEQ ID NO: 2533595 - RNA, 15 nt, Chlamydophila pneumoniae CWL029
uuccuaaaucugcuu

SEQ ID NO: 2533596 - RNA, 16 nt, Chlamydophila pneumoniae CWL029
uuccuaaaucugcuuu

SEQ ID NO: 2533597 - RNA, 17 nt, Chlamydophila pneumoniae CWL029
uuccuaaccauugcucu

SEQ ID NO: 2533598 - RNA, 19 nt, Chlamydophila pneumoniae CWL029
uuccuaacuaucucuguuu

SEQ ID NO: 2533599 - RNA, 21 nt, Chlamydophila pneumoniae CWL029
uuccuacaucugugauuaauc

SEQ ID NO: 2533600 - RNA, 12 nt, Chlamydophila pneumoniae CWL029
uuccuagagucg

SEQ ID NO: 2533601 - RNA, 20 nt, Chlamydophila pneumoniae CWL029
uuccuaguccucuaugguuu

SEQ ID NO: 2533602 - RNA, 17 nt, Chlamydophila pneumoniae CWL029
uuccuagugcuagauga

SEQ ID NO: 2533603 - RNA, 21 nt, Chlamydophila pneumoniae CWL029
uuccuauaugaaugauuucca

SEQ ID NO: 2533604 - RNA, 19 nt, Chlamydophila pneumoniae CWL029
uuccucauccucaucauca

SEQ ID NO: 2533605 - RNA, 21 nt, Chlamydophila pneumoniae CWL029
uuccuccgaggagggaaacac

SEQ ID NO: 2533606 - RNA, 22 nt, Chlamydophila pneumoniae CWL029
uuccucgaguauggcaaauaaa

SEQ ID NO: 2533607 - RNA, 16 nt, Chlamydophila pneumoniae CWL029
uuccucucaugaaauu

SEQ ID NO: 2533608 - RNA, 13 nt, Chlamydophila pneumoniae CWL029
uuccucuccaaaa

SEQ ID NO: 2533609 - RNA, 17 nt, Chlamydophila pneumoniae CWL029
uuccucuucaauuucuu

SEQ ID NO: 2533610 - RNA, 13 nt, Chlamydophila pneumoniae CWL029
uuccugaaucagc

SEQ ID NO: 2533611 - RNA, 16 nt, Chlamydophila pneumoniae CWL029
uuccugacuauaaaau

SEQ ID NO: 2533612 - RNA, 18 nt, Chlamydophila pneumoniae CWL029
uuccugacuauaaaaugc

SEQ ID NO: 2533613 - RNA, 23 nt, Chlamydophila pneumoniae CWL029
uuccugcauggcuuugugagcug

SEQ ID NO: 2533614 - RNA, 19 nt, Chlamydophila pneumoniae CWL029
uuccugcuugauuuccuga

SEQ ID NO: 2533615 - RNA, 15 nt, Chlamydophila pneumoniae CWL029
uuccuuaaagaguuu

SEQ ID NO: 2533616 - RNA, 23 nt, Chlamydophila pneumoniae CWL029
uuccuuaagggaagaucugaaau

SEQ ID NO: 2533617 - RNA, 23 nt, Chlamydophila pneumoniae CWL029
uuccuuaaugagaguuucuaaug

SEQ ID NO: 2533618 - RNA, 19 nt, Chlamydophila pneumoniae CWL029
uuccuuaaugguagcuuaa

SEQ ID NO: 2533619 - RNA, 20 nt, Chlamydophila pneumoniae CWL029
uuccuuacaagcuuccuugg

SEQ ID NO: 2533620 - RNA, 19 nt, Chlamydophila pneumoniae CWL029
uuccuuauccgucagccuu

SEQ ID NO: 2533621 - RNA, 18 nt, Chlamydophila pneumoniae CWL029
uuccuucaaagcuuguuc

SEQ ID NO: 2533622 - RNA, 23 nt, Chlamydophila pneumoniae CWL029
uucuuucuaggaucucuaguaag

SEQ ID NO: 2533623 - RNA, 19 nt, Chlamydophila pneumoniae CWL029
uucuuucucggucuuucuu

SEQ ID NO: 2533624 - RNA, 20 nt, Chlamydophila pneumoniae CWL029
uucuuucugcuugucuacag

SEQ ID NO: 2533625 - RNA, 12 nt, Chlamydophila pneumoniae CWL029
uucuuucuuacu

SEQ ID NO: 2533626 - RNA, 20 nt, Chlamydophila pneumoniae CWL029
uucuuugaagaacaaaaaau

SEQ ID NO: 2533627 - RNA, 21 nt, Chlamydophila pneumoniae CWL029
uucuuugaagaacaaaaaauc

SEQ ID NO: 2533628 - RNA, 13 nt, Chlamydophila pneumoniae CWL029
uucuuuuccugca

SEQ ID NO: 2533629 - RNA, 14 nt, Chlamydophila pneumoniae CWL029
uucuuuuccugcag

SEQ ID NO: 2533630 - RNA, 19 nt, Chlamydophila pneumoniae CWL029
uugaaaauauccuaaauau

SEQ ID NO: 2533631 - RNA, 21 nt, Chlamydophila pneumoniae CWL029
uugaaaccguaacugaggcaa

SEQ ID NO: 2533632 - RNA, 20 nt, Chlamydophila pneumoniae CWL029
uugaaacgcccuucaggaca

SEQ ID NO: 2533633 - RNA, 14 nt, Chlamydophila pneumoniae CWL029
uugaaauugcucuu

SEQ ID NO: 2533634 - RNA, 14 nt, Chlamydophila pneumoniae CWL029
uugaacaacuccuu

SEQ ID NO: 2533635 - RNA, 20 nt, Chlamydophila pneumoniae CWL029
uugaacaacuccuuaaacuu

SEQ ID NO: 2533636 - RNA, 20 nt, Chlamydophila pneumoniae CWL029
uugaacucucaguuaaagag

SEQ ID NO: 2533637 - RNA, 20 nt, Chlamydophila pneumoniae CWL029
uugaagaacaaaaaaucaau

SEQ ID NO: 2533638 - RNA, 15 nt, Chlamydophila pneumoniae CWL029
uugaaguucuucaag

SEQ ID NO: 2533639 - RNA, 21 nt, Chlamydophila pneumoniae CWL029
uugaaguuuugguuuuagaaa

SEQ ID NO: 2533640 - RNA, 19 nt, Chlamydophila pneumoniae CWL029
uugaauaagauuuugaaaa

SEQ ID NO: 2533641 - RNA, 19 nt, Chlamydophila pneumoniae CWL029
uugaauccuucuauagcaa

SEQ ID NO: 2533642 - RNA, 23 nt, Chlamydophila pneumoniae CWL029
uugaaugcagcacggaacaaguc

SEQ ID NO: 2533643 - RNA, 17 nt, Chlamydophila pneumoniae CWL029
uugaauuaaaaguucca

SEQ ID NO: 2533644 - RNA, 17 nt, Chlamydophila pneumoniae CWL029
uugaauuuccaaaggaa

SEQ ID NO: 2533645 - RNA, 22 nt, Chlamydophila pneumoniae CWL029
uugacaacgguguucauaauca

SEQ ID NO: 2533646 - RNA, 14 nt, Chlamydophila pneumoniae CWL029
uugacaauaagaaa

SEQ ID NO: 2533647 - RNA, 19 nt, Chlamydophila pneumoniae CWL029
uugacaauaagaaaauccu

SEQ ID NO: 2533648 - RNA, 18 nt, Chlamydophila pneumoniae CWL029
uugacaauaggcacccaa

SEQ ID NO: 2533649 - RNA, 19 nt, Chlamydophila pneumoniae CWL029
uugacaaucgcuguaaauu

SEQ ID NO: 2533650 - RNA, 14 nt, Chlamydophila pneumoniae CWL029
uugaccuuuuucau

SEQ ID NO: 2533651 - RNA, 23 nt, Chlamydophila pneumoniae CWL029
uugacuaaauccaccaaugauaa

SEQ ID NO: 2533652 - RNA, 14 nt, Chlamydophila pneumoniae CWL029
uugacuagcucucu

SEQ ID NO: 2533653 - RNA, 15 nt, Chlamydophila pneumoniae CWL029
uugacuauugggagg

SEQ ID NO: 2533654 - RNA, 12 nt, Chlamydophila pneumoniae CWL029
uugacuuguccc

SEQ ID NO: 2533655 - RNA, 22 nt, Chlamydophila pneumoniae CWL029
uugacuuucauaugaaugacug

SEQ ID NO: 2533656 - RNA, 15 nt, Chlamydophila pneumoniae CWL029
uugagaaaagaacag

SEQ ID NO: 2533657 - RNA, 22 nt, Chlamydophila pneumoniae CWL029
uugagaaugaacaauagaaaga

SEQ ID NO: 2533658 - RNA, 15 nt, Chlamydophila pneumoniae CWL029
uugagcaucacggag

SEQ ID NO: 2533659 - RNA, 19 nt, Chlamydophila pneumoniae CWL029
uugagccaacagguucacu

SEQ ID NO: 2533660 - RNA, 10 nt, Chlamydophila pneumoniae CWL029
uugagcucuc

SEQ ID NO: 2533661 - RNA, 13 nt, Chlamydophila pneumoniae CWL029
uugagcucucuag

SEQ ID NO: 2533662 - RNA, 11 nt, Chlamydophila pneumoniae CWL029
uugaggaaagg

SEQ ID NO: 2533663 - RNA, 14 nt, Chlamydophila pneumoniae CWL029
uugaggaaaggagg

SEQ ID NO: 2533664 - RNA, 18 nt, Chlamydophila pneumoniae CWL029
uugaggaacgcacgccaa

SEQ ID NO: 2533665 - RNA, 20 nt, Chlamydophila pneumoniae CWL029
uugaggaaucugaaucucau

SEQ ID NO: 2533666 - RNA, 22 nt, Chlamydophila pneumoniae CWL029
uugaggauacgaauaaguuuug

SEQ ID NO: 2533667 - RNA, 17 nt, Chlamydophila pneumoniae CWL029
uugaggauuucuugcaa

SEQ ID NO: 2533668 - RNA, 20 nt, Chlamydophila pneumoniae CWL029
uugaggauuucuugcaagga

SEQ ID NO: 2533669 - RNA, 17 nt, Chlamydophila pneumoniae CWL029
uugaggcaagucucaaa

SEQ ID NO: 2533670 - RNA, 19 nt, Chlamydophila pneumoniae CWL029
uugaguuccgaauaggcau

SEQ ID NO: 2533671 - RNA, 15 nt, Chlamydophila pneumoniae CWL029
uugaguugguuuugu

SEQ ID NO: 2533672 - RNA, 13 nt, Chlamydophila pneumoniae CWL029
uugauaaaacgcu

SEQ ID NO: 2533673 - RNA, 19 nt, Chlamydophila pneumoniae CWL029
uugauaaauucaucggcau

SEQ ID NO: 2533674 - RNA, 16 nt, Chlamydophila pneumoniae CWL029
uugauaauuacagaag

SEQ ID NO: 2533675 - RNA, 14 nt, Chlamydophila pneumoniae CWL029
uugauagaccggau

SEQ ID NO: 2533676 - RNA, 17 nt, Chlamydophila pneumoniae CWL029
uugauaguguucgagca

SEQ ID NO: 2533677 - RNA, 13 nt, Chlamydophila pneumoniae CWL029
uugauauccaggg

SEQ ID NO: 2533678 - RNA, 17 nt, Chlamydophila pneumoniae CWL029
uugauauuaucuuguaa

SEQ ID NO: 2533679 - RNA, 15 nt, Chlamydophila pneumoniae CWL029
uugaucgcuugugca

SEQ ID NO: 2533680 - RNA, 14 nt, Chlamydophila pneumoniae CWL029
uugaucuacaaaaa

SEQ ID NO: 2533681 - RNA, 21 nt, Chlamydophila pneumoniae CWL029
uugaucuacaaaaacuagaau

SEQ ID NO: 2533682 - RNA, 17 nt, Chlamydophila pneumoniae CWL029
uugaugagaaaaagaau

SEQ ID NO: 2533683 - RNA, 19 nt, Chlamydophila pneumoniae CWL029
uugauguacaguaaaguau

SEQ ID NO: 2533684 - RNA, 23 nt, Chlamydophila pneumoniae CWL029
uugaugugcggcgagcucuagga

SEQ ID NO: 2533685 - RNA, 13 nt, Chlamydophila pneumoniae CWL029
uugauguuccuug

SEQ ID NO: 2533686 - RNA, 14 nt, Chlamydophila pneumoniae CWL029
uugauuauucccaa

SEQ ID NO: 2533687 - RNA, 12 nt, Chlamydophila pneumoniae CWL029
uugauucaaugc

SEQ ID NO: 2533688 - RNA, 15 nt, Chlamydophila pneumoniae CWL029
uugauucauaaagag

SEQ ID NO: 2533689 - RNA, 16 nt, Chlamydophila pneumoniae CWL029
uugauugaacagucuu

SEQ ID NO: 2533690 - RNA, 17 nt, Chlamydophila pneumoniae CWL029
uugcaaaugaaaagaga

SEQ ID NO: 2533691 - RNA, 18 nt, Chlamydophila pneumoniae CWL029
uugcaacaaucuuucuuc

SEQ ID NO: 2533692 - RNA, 10 nt, Chlamydophila pneumoniae CWL029
uugcaacucu

SEQ ID NO: 2533693 - RNA, 21 nt, Chlamydophila pneumoniae CWL029
uugcaagagccggaacuucag

SEQ ID NO: 2533694 - RNA, 14 nt, Chlamydophila pneumoniae CWL029
uugcaaucuuugaa

SEQ ID NO: 2533695 - RNA, 19 nt, Chlamydophila pneumoniae CWL029
uugcacucgauuauuucuu

SEQ ID NO: 2533696 - RNA, 16 nt, Chlamydophila pneumoniae CWL029
uugcagcaaggagagu

SEQ ID NO: 2533697 - RNA, 16 nt, Chlamydophila pneumoniae CWL029
uugcagcucggaaugc

SEQ ID NO: 2533698 - RNA, 19 nt, Chlamydophila pneumoniae CWL029
uugcagcucggaaugcucu

SEQ ID NO: 2533699 - RNA, 13 nt, Chlamydophila pneumoniae CWL029
uugcaguggcuua

SEQ ID NO: 2533700 - RNA, 16 nt, Chlamydophila pneumoniae CWL029
uugcauagacaugcga

SEQ ID NO: 2533701 - RNA, 13 nt, Chlamydophila pneumoniae CWL029
uugcaugaggaga

SEQ ID NO: 2533702 - RNA, 14 nt, Chlamydophila pneumoniae CWL029
uugcaugaggagac

SEQ ID NO: 2533703 - RNA, 18 nt, Chlamydophila pneumoniae CWL029
uugcaugaugcuguugau

SEQ ID NO: 2533704 - RNA, 17 nt, Chlamydophila pneumoniae CWL029
uugcaugcaacggagaa

SEQ ID NO: 2533705 - RNA, 22 nt, Chlamydophila pneumoniae CWL029
uugcaugcuugaaguucucaaa

SEQ ID NO: 2533706 - RNA, 21 nt, Chlamydophila pneumoniae CWL029
uugcauuagauacgcucucug

SEQ ID NO: 2533707 - RNA, 22 nt, Chlamydophila pneumoniae CWL029
uugcauucagggggaaagccaa

SEQ ID NO: 2533708 - RNA, 22 nt, Chlamydophila pneumoniae CWL029
uugccaaucuuccuuaaccucc

SEQ ID NO: 2533709 - RNA, 22 nt, Chlamydophila pneumoniae CWL029
uugccaauguggugauuucuuu

SEQ ID NO: 2533710 - RNA, 12 nt, Chlamydophila pneumoniae CWL029
uugccagcagaa

SEQ ID NO: 2533711 - RNA, 19 nt, Chlamydophila pneumoniae CWL029
uugcccauugaccugcuuu

SEQ ID NO: 2533712 - RNA, 17 nt, Chlamydophila pneumoniae CWL029
uugccguauagauuuuc

SEQ ID NO: 2533713 - RNA, 20 nt, Chlamydophila pneumoniae CWL029
uugccgugaguugcaauugc

SEQ ID NO: 2533714 - RNA, 12 nt, Chlamydophila pneumoniae CWL029
uugccuucuucu

SEQ ID NO: 2533715 - RNA, 14 nt, Chlamydophila pneumoniae CWL029
uugccuuuagagac

SEQ ID NO: 2533716 - RNA, 22 nt, Chlamydophila pneumoniae CWL029
uugccuuuagggaaaaaguagu

SEQ ID NO: 2533717 - RNA, 12 nt, Chlamydophila pneumoniae CWL029
uugccuuucucu

SEQ ID NO: 2533718 - RNA, 19 nt, Chlamydophila pneumoniae CWL029
uugcgaacagcuccuggau

SEQ ID NO: 2533719 - RNA, 21 nt, Chlamydophila pneumoniae CWL029
uugcgcggcgcauuuuuuccu

SEQ ID NO: 2533720 - RNA, 16 nt, Chlamydophila pneumoniae CWL029
uugcggaaauugaaua

SEQ ID NO: 2533721 - RNA, 19 nt, Chlamydophila pneumoniae CWL029
uugcggauuugcauuaccu

SEQ ID NO: 2533722 - RNA, 15 nt, Chlamydophila pneumoniae CWL029
uugcuaagcauuuua

SEQ ID NO: 2533723 - RNA, 20 nt, Chlamydophila pneumoniae CWL029
uugcuaagcgaaccaaaguc

SEQ ID NO: 2533724 - RNA, 16 nt, Chlamydophila pneumoniae CWL029
uugcuauacagaaaag

SEQ ID NO: 2533725 - RNA, 15 nt, Chlamydophila pneumoniae CWL029
uugcuauugaaaaau

SEQ ID NO: 2533726 - RNA, 18 nt, Chlamydophila pneumoniae CWL029
uugcuauugaaaaauccc

SEQ ID NO: 2533727 - RNA, 20 nt, Chlamydophila pneumoniae CWL029
uugcucuggauguagaggau

SEQ ID NO: 2533728 - RNA, 11 nt, Chlamydophila pneumoniae CWL029
uugcugaagau

SEQ ID NO: 2533729 - RNA, 20 nt, Chlamydophila pneumoniae CWL029
uugcugaagauuuuuucuug

SEQ ID NO: 2533730 - RNA, 23 nt, Chlamydophila pneumoniae CWL029
uugcugaagauuuuuucuugguc

SEQ ID NO: 2533731 - RNA, 23 nt, Chlamydophila pneumoniae CWL029
uugcugcgaaugucguuaaaaac

SEQ ID NO: 2533732 - RNA, 15 nt, Chlamydophila pneumoniae CWL029
uugcugcucuccaaa

SEQ ID NO: 2533733 - RNA, 19 nt, Chlamydophila pneumoniae CWL029
uugcuguagcgcuuccagc

SEQ ID NO: 2533734 - RNA, 14 nt, Chlamydophila pneumoniae CWL029
uugcuguggaauuu

SEQ ID NO: 2533735 - RNA, 23 nt, Chlamydophila pneumoniae CWL029
uugcuguggcauacucuuugcag

SEQ ID NO: 2533736 - RNA, 18 nt, Chlamydophila pneumoniae CWL029
uugcuguuucuucugaau

SEQ ID NO: 2533737 - RNA, 20 nt, Chlamydophila pneumoniae CWL029
uugcuuauugucuuaaaauu

SEQ ID NO: 2533738 - RNA, 23 nt, Chlamydophila pneumoniae CWL029
uugcuuccaacggacauuuucaa

SEQ ID NO: 2533739 - RNA, 16 nt, Chlamydophila pneumoniae CWL029
uugcuugcgcaucagc

SEQ ID NO: 2533740 - RNA, 22 nt, Chlamydophila pneumoniae CWL029
uugcuugcuauagggaucuccu

SEQ ID NO: 2533741 - RNA, 23 nt, Chlamydophila pneumoniae CWL029
uugcuuugugaguucuuccuucu

SEQ ID NO: 2533742 - RNA, 15 nt, Chlamydophila pneumoniae CWL029
uugcuuuucuaggau

SEQ ID NO: 2533743 - RNA, 17 nt, Chlamydophila pneumoniae CWL029
uuggaagauugaaggca

SEQ ID NO: 2533744 - RNA, 13 nt, Chlamydophila pneumoniae CWL029
uuggaagugcguu

SEQ ID NO: 2533745 - RNA, 19 nt, Chlamydophila pneumoniae CWL029
uuggacguacuaagauacg

SEQ ID NO: 2533746 - RNA, 15 nt, Chlamydophila pneumoniae CWL029
uuggauuucuucuuc

SEQ ID NO: 2533747 - RNA, 18 nt, Chlamydophila pneumoniae CWL029
uuggauuucuucuucuaa

SEQ ID NO: 2533748 - RNA, 14 nt, Chlamydophila pneumoniae CWL029
uuggcacaauccuc

SEQ ID NO: 2533749 - RNA, 23 nt, Chlamydophila pneumoniae CWL029
uuggcuccuguuauuguuucuau

SEQ ID NO: 2533750 - RNA, 16 nt, Chlamydophila pneumoniae CWL029
uuggcucuagaaauau

SEQ ID NO: 2533751 - RNA, 17 nt, Chlamydophila pneumoniae CWL029
uuggcuuuugagauuca

SEQ ID NO: 2533752 - RNA, 14 nt, Chlamydophila pneumoniae CWL029
uugggaaaagaaaa

SEQ ID NO: 2533753 - RNA, 22 nt, Chlamydophila pneumoniae CWL029
uugggaaugcauuucaugaauu

SEQ ID NO: 2533754 - RNA, 19 nt, Chlamydophila pneumoniae CWL029
uugggagaugcuauuuacu

SEQ ID NO: 2533755 - RNA, 17 nt, Chlamydophila pneumoniae CWL029
uugggauaggugcauca

SEQ ID NO: 2533756 - RNA, 23 nt, Chlamydophila pneumoniae CWL029
uugggaugacuggcgacuugcca

SEQ ID NO: 2533757 - RNA, 19 nt, Chlamydophila pneumoniae CWL029
uugggcaaauaggagagca

SEQ ID NO: 2533758 - RNA, 20 nt, Chlamydophila pneumoniae CWL029
uugguaugcagaguuuuaaa

SEQ ID NO: 2533759 - RNA, 21 nt, Chlamydophila pneumoniae CWL029
uugguaugccgcaucuagaag

SEQ ID NO: 2533760 - RNA, 15 nt, Chlamydophila pneumoniae CWL029
uuggucgaucaaggu

SEQ ID NO: 2533761 - RNA, 22 nt, Chlamydophila pneumoniae CWL029
uugguguaucucuuaaaauauu

SEQ ID NO: 2533762 - RNA, 13 nt, Chlamydophila pneumoniae CWL029
uugguucaaaucc

SEQ ID NO: 2533763 - RNA, 20 nt, Chlamydophila pneumoniae CWL029
uuguaaauaguauacaagcg

SEQ ID NO: 2533764 - RNA, 19 nt, Chlamydophila pneumoniae CWL029
uuguaacgcugcuaauguu

SEQ ID NO: 2533765 - RNA, 19 nt, Chlamydophila pneumoniae CWL029
uuguaacucaagguauugu

SEQ ID NO: 2533766 - RNA, 18 nt, Chlamydophila pneumoniae CWL029
uuguaacuucguuagaaa

SEQ ID NO: 2533767 - RNA, 17 nt, Chlamydophila pneumoniae CWL029
uuguaagaaucauaaca

SEQ ID NO: 2533768 - RNA, 22 nt, Chlamydophila pneumoniae CWL029
uuguaagcgugcaaguucacac

SEQ ID NO: 2533769 - RNA, 14 nt, Chlamydophila pneumoniae CWL029
uuguaauaaaauca

SEQ ID NO: 2533770 - RNA, 20 nt, Chlamydophila pneumoniae CWL029
uuguaauuucuaaauagaaa

SEQ ID NO: 2533771 - RNA, 18 nt, Chlamydophila pneumoniae CWL029
uuguacuuuuacugaaau

SEQ ID NO: 2533772 - RNA, 16 nt, Chlamydophila pneumoniae CWL029
uuguacuuuuugccac

SEQ ID NO: 2533773 - RNA, 21 nt, Chlamydophila pneumoniae CWL029
uuguagagacauagccuauau

SEQ ID NO: 2533774 - RNA, 18 nt, Chlamydophila pneumoniae CWL029
uuguagcagcaagaacau

SEQ ID NO: 2533775 - RNA, 17 nt, Chlamydophila pneumoniae CWL029
uuguaguccacaucuug

SEQ ID NO: 2533776 - RNA, 13 nt, Chlamydophila pneumoniae CWL029
uuguaguucuuug

SEQ ID NO: 2533777 - RNA, 14 nt, Chlamydophila pneumoniae CWL029
uuguauaagagcaa

SEQ ID NO: 2533778 - RNA, 15 nt, Chlamydophila pneumoniae CWL029
uuguauaagagcaag

SEQ ID NO: 2533779 - RNA, 21 nt, Chlamydophila pneumoniae CWL029
uuguauauccacgaucuagaa

SEQ ID NO: 2533780 - RNA, 23 nt, Chlamydophila pneumoniae CWL029
uuguauggaauucaaacuccuuu

SEQ ID NO: 2533781 - RNA, 11 nt, Chlamydophila pneumoniae CWL029
uuguauuaaag

SEQ ID NO: 2533782 - RNA, 16 nt, Chlamydophila pneumoniae CWL029
uuguauucagugucuu

SEQ ID NO: 2533783 - RNA, 19 nt, Chlamydophila pneumoniae CWL029
uuguauuccuuggauuucu

SEQ ID NO: 2533784 - RNA, 20 nt, Chlamydophila pneumoniae CWL029
uuguauuccuuggauuucuu

SEQ ID NO: 2533785 - RNA, 21 nt, Chlamydophila pneumoniae CWL029
uugucacacugcgagagaaag

SEQ ID NO: 2533786 - RNA, 19 nt, Chlamydophila pneumoniae CWL029
uuguccugcaagcauuguu

SEQ ID NO: 2533787 - RNA, 14 nt, Chlamydophila pneumoniae CWL029
uugucugaggacag

SEQ ID NO: 2533788 - RNA, 23 nt, Chlamydophila pneumoniae CWL029
uugucugaggacaguauucccuc

SEQ ID NO: 2533789 - RNA, 20 nt, Chlamydophila pneumoniae CWL029
uugucugauuaguucucuaa

SEQ ID NO: 2533790 - RNA, 23 nt, Chlamydophila pneumoniae CWL029
uugucuuccacgaaggaaucuga

SEQ ID NO: 2533791 - RNA, 13 nt, Chlamydophila pneumoniae CWL029
uugucuuccauaa

SEQ ID NO: 2533792 - RNA, 21 nt, Chlamydophila pneumoniae CWL029
uugugaaaaucgcaccuugac

SEQ ID NO: 2533793 - RNA, 22 nt, Chlamydophila pneumoniae CWL029
uugugaagauaagaccagaaag

SEQ ID NO: 2533794 - RNA, 12 nt, Chlamydophila pneumoniae CWL029
uugugaauuuua

SEQ ID NO: 2533795 - RNA, 17 nt, Chlamydophila pneumoniae CWL029
uugugauccuugcaaaa

SEQ ID NO: 2533796 - RNA, 22 nt, Chlamydophila pneumoniae CWL029
uugugcaucuauaauuaauccu

SEQ ID NO: 2533797 - RNA, 22 nt, Chlamydophila pneumoniae CWL029
uugugcuaaagcaggagcauca

SEQ ID NO: 2533798 - RNA, 21 nt, Chlamydophila pneumoniae CWL029
uugugcuaggcucucgacacu

SEQ ID NO: 2533799 - RNA, 22 nt, Chlamydophila pneumoniae CWL029
uugugcugcuuccccuaauagg

SEQ ID NO: 2533800 - RNA, 23 nt, Chlamydophila pneumoniae CWL029
uuguggacaacgauuguaaaagu

SEQ ID NO: 2533801 - RNA, 17 nt, Chlamydophila pneumoniae CWL029
uuguguucccucuucuu

SEQ ID NO: 2533802 - RNA, 18 nt, Chlamydophila pneumoniae CWL029
uuguguucccucuucuuc

SEQ ID NO: 2533803 - RNA, 18 nt, Chlamydophila pneumoniae CWL029
uuguuaauggcagcuugg

SEQ ID NO: 2533804 - RNA, 12 nt, Chlamydophila pneumoniae CWL029
uuguuagcaucg

SEQ ID NO: 2533805 - RNA, 15 nt, Chlamydophila pneumoniae CWL029
uuguucagcuagagc

SEQ ID NO: 2533806 - RNA, 16 nt, Chlamydophila pneumoniae CWL029
uuguucagcuagagca

SEQ ID NO: 2533807 - RNA, 19 nt, Chlamydophila pneumoniae CWL029
uuguuccaauagagucucu

SEQ ID NO: 2533808 - RNA, 14 nt, Chlamydophila pneumoniae CWL029
uuguucuaaaauga

SEQ ID NO: 2533809 - RNA, 17 nt, Chlamydophila pneumoniae CWL029
uuguucuugaaguucuu

SEQ ID NO: 2533810 - RNA, 21 nt, Chlamydophila pneumoniae CWL029
uuguugaggaauuggcaggua

SEQ ID NO: 2533811 - RNA, 17 nt, Chlamydophila pneumoniae CWL029
uuguugcaucgccuuaa

SEQ ID NO: 2533812 - RNA, 14 nt, Chlamydophila pneumoniae CWL029
uuguuguuuuugcu

SEQ ID NO: 2533813 - RNA, 18 nt, Chlamydophila pneumoniae CWL029
uuguuuaugcauacguua

SEQ ID NO: 2533814 - RNA, 13 nt, Chlamydophila pneumoniae CWL029
uuguuucaucuuc

SEQ ID NO: 2533815 - RNA, 17 nt, Chlamydophila pneumoniae CWL029
uuguuucaucuucuuuc

SEQ ID NO: 2533816 - RNA, 14 nt, Chlamydophila pneumoniae CWL029
uuguuuguaucaaa

SEQ ID NO: 2533817 - RNA, 13 nt, Chlamydophila pneumoniae CWL029
uuguuuguuuucu

SEQ ID NO: 2533818 - RNA, 18 nt, Chlamydophila pneumoniae CWL029
uuuuuguucauccagaag

SEQ ID NO: 2533819 - RNA, 19 nt, Chlamydophila pneumoniae CWL029
uuuuuuaaagcuauuguuu

SEQ ID NO: 2533820 - RNA, 16 nt, Chlamydophila pneumoniae CWL029
ugccacaacucauccu

SEQ ID NO: 2533821 - RNA, 22 nt, Chlamydophila pneumoniae CWL029
ugccacaacucauccuaaauua

SEQ ID NO: 2533822 - RNA, 11 nt, Chlamydophila pneumoniae CWL029
ugccagcagaa

SEQ ID NO: 2533823 - RNA, 15 nt, Chlamydophila pneumoniae CWL029
ugccagcagaaguuc

SEQ ID NO: 2533824 - RNA, 15 nt, Chlamydophila pneumoniae CWL029
ugccagcagcgagga

SEQ ID NO: 2533825 - RNA, 13 nt, Chlamydophila pneumoniae CWL029
ugccagcccaugu

SEQ ID NO: 2533826 - RNA, 18 nt, Chlamydophila pneumoniae CWL029
ugccagugacauaaucac

SEQ ID NO: 2533827 - RNA, 18 nt, Chlamydophila pneumoniae CWL029
ugccauaaguccaugcua

SEQ ID NO: 2533828 - RNA, 20 nt, Chlamydophila pneumoniae CWL029
ugccaugaauccaugggauc

SEQ ID NO: 2533829 - RNA, 22 nt, Chlamydophila pneumoniae CWL029
ugccauugaucagaaucuaagu

SEQ ID NO: 2533830 - RNA, 13 nt, Chlamydophila pneumoniae CWL029
ugcccaaacauca

SEQ ID NO: 2533831 - RNA, 13 nt, Chlamydophila pneumoniae CWL029
ugcccaaggaaaa

SEQ ID NO: 2533832 - RNA, 14 nt, Chlamydophila pneumoniae CWL029
ugcccaaggaaaaa

SEQ ID NO: 2533833 - RNA, 15 nt, Chlamydophila pneumoniae CWL029
ugcccacagaccaaa

SEQ ID NO: 2533834 - RNA, 12 nt, Chlamydophila pneumoniae CWL029
ugcccacuucua

SEQ ID NO: 2533835 - RNA, 18 nt, Chlamydophila pneumoniae CWL029
ugcccuacaauuuccuug

SEQ ID NO: 2533836 - RNA, 22 nt, Chlamydophila pneumoniae CWL029
ugcccugucacuaucuucuaaa

SEQ ID NO: 2533837 - RNA, 15 nt, Chlamydophila pneumoniae CWL029
ugcccuguucuaugc

SEQ ID NO: 2533838 - RNA, 21 nt, Chlamydophila pneumoniae CWL029
ugcccuucguaacgcuuuucu

SEQ ID NO: 2533839 - RNA, 15 nt, Chlamydophila pneumoniae CWL029
ugccgugcucuuaug

SEQ ID NO: 2533840 - RNA, 17 nt, Chlamydophila pneumoniae CWL029
ugccuaaagagauauag

SEQ ID NO: 2533841 - RNA, 18 nt, Chlamydophila pneumoniae CWL029
ugccucaggucugcugag

SEQ ID NO: 2533842 - RNA, 20 nt, Chlamydophila pneumoniae CWL029
ugccucauugccguggugag

SEQ ID NO: 2533843 - RNA, 13 nt, Chlamydophila pneumoniae CWL029
ugccugaaaacaa

SEQ ID NO: 2533844 - RNA, 18 nt, Chlamydophila pneumoniae CWL029
ugccugccaauccaaugg

SEQ ID NO: 2533845 - RNA, 20 nt, Chlamydophila pneumoniae CWL029
ugccuuacgaacuauagcaa

SEQ ID NO: 2533846 - RNA, 13 nt, Chlamydophila pneumoniae CWL029
ugccuuaggcuuu

SEQ ID NO: 2533847 - RNA, 13 nt, Chlamydophila pneumoniae CWL029
ugccuuaugcuca

SEQ ID NO: 2533848 - RNA, 18 nt, Chlamydophila pneumoniae CWL029
ugccuucuuaucuucuaa

SEQ ID NO: 2533849 - RNA, 19 nt, Chlamydophila pneumoniae CWL029
ugccuucuuaucuucuaaa

SEQ ID NO: 2533850 - RNA, 17 nt, Chlamydophila pneumoniae CWL029
uguagcagcaagaacau

SEQ ID NO: 2533851 - RNA, 14 nt, Chlamydophila pneumoniae CWL029
uguagccuuucuuu

SEQ ID NO: 2533852 - RNA, 17 nt, Chlamydophila pneumoniae CWL029
uguagccuuucuuuuua

SEQ ID NO: 2533853 - RNA, 16 nt, Chlamydophila pneumoniae CWL029
uguagcuacagauucu

SEQ ID NO: 2533854 - RNA, 12 nt, Chlamydophila pneumoniae CWL029
uguaguucuuug

SEQ ID NO: 2533855 - RNA, 21 nt, Chlamydophila pneumoniae CWL029
uguaguucuuugaauuuccaa

SEQ ID NO: 2533856 - RNA, 23 nt, Chlamydophila pneumoniae CWL029
uguauaaacuccacgaauucuuu

SEQ ID NO: 2533857 - RNA, 12 nt, Chlamydophila pneumoniae CWL029
uguauaaaguuu

SEQ ID NO: 2533858 - RNA, 18 nt, Chlamydophila pneumoniae CWL029
uguauaaaguuuguaaaa

SEQ ID NO: 2533859 - RNA, 23 nt, Chlamydophila pneumoniae CWL029
uguauacauaucuccuuuaaaua

SEQ ID NO: 2533860 - RNA, 23 nt, Chlamydophila pneumoniae CWL029
uguauauccacgaucuagaagau

SEQ ID NO: 2533861 - RNA, 16 nt, Chlamydophila pneumoniae CWL029
uguauaugcuuggcaa

SEQ ID NO: 2533862 - RNA, 22 nt, Chlamydophila pneumoniae CWL029
uguauaugcuuggcaauagcuu

SEQ ID NO: 2533863 - RNA, 13 nt, Chlamydophila pneumoniae CWL029
uguauauucugaa

SEQ ID NO: 2533864 - RNA, 16 nt, Chlamydophila pneumoniae CWL029
uguauauucugaaauu

SEQ ID NO: 2533865 - RNA, 18 nt, Chlamydophila pneumoniae CWL029
uguauccguagugagguu

SEQ ID NO: 2533866 - RNA, 23 nt, Chlamydophila pneumoniae CWL029
uguauccguagugagguuugcaa

SEQ ID NO: 2533867 - RNA, 18 nt, Chlamydophila pneumoniae CWL029
uguaucucuuaaaauauu

SEQ ID NO: 2533868 - RNA, 16 nt, Chlamydophila pneumoniae CWL029
uguaucuguauccuuc

SEQ ID NO: 2533869 - RNA, 18 nt, Chlamydophila pneumoniae CWL029
uguaucuguauccuuccu

SEQ ID NO: 2533870 - RNA, 15 nt, Chlamydophila pneumoniae CWL029
uguauggcagccugg

SEQ ID NO: 2533871 - RNA, 22 nt, Chlamydophila pneumoniae CWL029
uguauggugcgcgucuccuuga

SEQ ID NO: 2533872 - RNA, 13 nt, Chlamydophila pneumoniae CWL029
uguaugugaaaga

SEQ ID NO: 2533873 - RNA, 18 nt, Chlamydophila pneumoniae CWL029
uguauucagugucuugaa

SEQ ID NO: 2533874 - RNA, 22 nt, Chlamydophila pneumoniae CWL029
uguauucgcuaagcuauaucuc

SEQ ID NO: 2533875 - RNA, 13 nt, Chlamydophila pneumoniae CWL029
uguauugggaaug

SEQ ID NO: 2533876 - RNA, 18 nt, Chlamydophila pneumoniae CWL029
uguauuguguucccucuu

SEQ ID NO: 2533877 - RNA, 13 nt, Chlamydophila pneumoniae CWL029
uguauuuccuucu

SEQ ID NO: 2533878 - RNA, 19 nt, Chlamydophila pneumoniae CWL029
uguauuugcagaagcauug

SEQ ID NO: 2533879 - RNA, 15 nt, Chlamydophila pneumoniae CWL029
uguauuuucuucaac

SEQ ID NO: 2533880 - RNA, 21 nt, Chlamydophila pneumoniae CWL029
ugucaagaggcuguccuugca

SEQ ID NO: 2533881 - RNA, 18 nt, Chlamydophila pneumoniae CWL029
ugucacaauaccaucucu

SEQ ID NO: 2533882 - RNA, 20 nt, Chlamydophila pneumoniae CWL029
cuacggaacggacaaugcua

SEQ ID NO: 2533883 - RNA, 21 nt, Chlamydophila pneumoniae CWL029
cuacggaugggcacucuucca

SEQ ID NO: 2533884 - RNA, 22 nt, Chlamydophila pneumoniae CWL029
cuacucuacaguaguaaauaau

SEQ ID NO: 2533885 - RNA, 17 nt, Chlamydophila pneumoniae CWL029
cuacuguccauccaaau

SEQ ID NO: 2533886 - RNA, 19 nt, Chlamydophila pneumoniae CWL029
cuacuuaaauccuaagcau

SEQ ID NO: 2533887 - RNA, 18 nt, Chlamydophila pneumoniae CWL029
cuacuucugcaggacugu

SEQ ID NO: 2533888 - RNA, 21 nt, Chlamydophila pneumoniae CWL029
cuacuugucugauuaguucuc

SEQ ID NO: 2533889 - RNA, 13 nt, Chlamydophila pneumoniae CWL029
cuagaaaauauuc

SEQ ID NO: 2533890 - RNA, 19 nt, Chlamydophila pneumoniae CWL029
cuagaaaaucucuaagaau

SEQ ID NO: 2533891 - RNA, 14 nt, Chlamydophila pneumoniae CWL029
cuagaaaaugaaga

SEQ ID NO: 2533892 - RNA, 14 nt, Chlamydophila pneumoniae CWL029
cuagaaacugcucc

SEQ ID NO: 2533893 - RNA, 16 nt, Chlamydophila pneumoniae CWL029
cuagaaacugcuccug

SEQ ID NO: 2533894 - RNA, 18 nt, Chlamydophila pneumoniae CWL029
cuagaaacugcuccugaa

SEQ ID NO: 2533895 - RNA, 22 nt, Chlamydophila pneumoniae CWL029
cuagaaacugcuccugaagcug

SEQ ID NO: 2533896 - RNA, 19 nt, Chlamydophila pneumoniae CWL029
cuagaaagauuuauuuugu

SEQ ID NO: 2533897 - RNA, 16 nt, Chlamydophila pneumoniae CWL029
cuagaacacucagaga

SEQ ID NO: 2533898 - RNA, 16 nt, Chlamydophila pneumoniae CWL029
cuagaacuugggaugc

SEQ ID NO: 2533899 - RNA, 19 nt, Chlamydophila pneumoniae CWL029
cuagaacuugggaugcuac

SEQ ID NO: 2533900 - RNA, 18 nt, Chlamydophila pneumoniae CWL029
cuagaagacauucauuuu

SEQ ID NO: 2533901 - RNA, 23 nt, Chlamydophila pneumoniae CWL029
cuagaagagcgucguaacaauuc

SEQ ID NO: 2533902 - RNA, 22 nt, Chlamydophila pneumoniae CWL029
cuagaagaugaguguucucaau

SEQ ID NO: 2533903 - RNA, 14 nt, Chlamydophila pneumoniae CWL029
cuagaagcgcuuua

SEQ ID NO: 2533904 - RNA, 14 nt, Chlamydophila pneumoniae CWL029
cuagaaguuuaaac

SEQ ID NO: 2533905 - RNA, 20 nt, Chlamydophila pneumoniae CWL029
cuagaauaccguuuuaggaa

SEQ ID NO: 2533906 - RNA, 17 nt, Chlamydophila pneumoniae CWL029
cuagaaucacauaaaau

SEQ ID NO: 2533907 - RNA, 19 nt, Chlamydophila pneumoniae CWL029
cuagaaucacauaaaauaa

SEQ ID NO: 2533908 - RNA, 20 nt, Chlamydophila pneumoniae CWL029
cuagaaucaccaauuuuuuc

SEQ ID NO: 2533909 - RNA, 14 nt, Chlamydophila pneumoniae CWL029
cuagaccaauaaau

SEQ ID NO: 2533910 - RNA, 17 nt, Chlamydophila pneumoniae CWL029
cuagaccugccaagaua

SEQ ID NO: 2533911 - RNA, 15 nt, Chlamydophila pneumoniae CWL029
cuagagauccaauga

SEQ ID NO: 2533912 - RNA, 16 nt, Chlamydophila pneumoniae CWL029
cuagagauuguaauuu

SEQ ID NO: 2533913 - RNA, 21 nt, Chlamydophila pneumoniae CWL029
cuagagauuguaauuuccuua

SEQ ID NO: 2533914 - RNA, 15 nt, Chlamydophila pneumoniae CWL029
cuagagauuuuucua

SEQ ID NO: 2533915 - RNA, 17 nt, Chlamydophila pneumoniae CWL029
cuagagauuuuucuagg

SEQ ID NO: 2533916 - RNA, 16 nt, Chlamydophila pneumoniae CWL029
cuagagcacauagaaa

SEQ ID NO: 2533917 - RNA, 20 nt, Chlamydophila pneumoniae CWL029
cuagagcacauagaaacagu

SEQ ID NO: 2533918 - RNA, 18 nt, Chlamydophila pneumoniae CWL029
cuagagcucugaaauaaa

SEQ ID NO: 2533919 - RNA, 23 nt, Chlamydophila pneumoniae CWL029
cuagagcuucaaguuucuuuugc

SEQ ID NO: 2533920 - RNA, 19 nt, Chlamydophila pneumoniae CWL029
cuagagcuuucagaaaaga

SEQ ID NO: 2533921 - RNA, 18 nt, Chlamydophila pneumoniae CWL029
cuagaggagcgaugacuu

SEQ ID NO: 2533922 - RNA, 15 nt, Chlamydophila pneumoniae CWL029
cuagaggaucuucaa

SEQ ID NO: 2533923 - RNA, 18 nt, Chlamydophila pneumoniae CWL029
cuagaguacccccgggcg

SEQ ID NO: 2533924 - RNA, 19 nt, Chlamydophila pneumoniae CWL029
cuagagucacuagcagaag

SEQ ID NO: 2533925 - RNA, 13 nt, Chlamydophila pneumoniae CWL029
cuagaguccaagg

SEQ ID NO: 2533926 - RNA, 22 nt, Chlamydophila pneumoniae CWL029
cuagaguccaagguucugggaa

SEQ ID NO: 2533927 - RNA, 14 nt, Chlamydophila pneumoniae CWL029
cuagagucucuuuc

SEQ ID NO: 2533928 - RNA, 17 nt, Chlamydophila pneumoniae CWL029
cuagaucacaagaaaga

SEQ ID NO: 2533929 - RNA, 12 nt, Chlamydophila pneumoniae CWL029
cuagaucuucaa

SEQ ID NO: 2533930 - RNA, 15 nt, Chlamydophila pneumoniae CWL029
cuagaugaagagugg

SEQ ID NO: 2533931 - RNA, 15 nt, Chlamydophila pneumoniae CWL029
cuagauuucuacaaa

SEQ ID NO: 2533932 - RNA, 21 nt, Chlamydophila pneumoniae CWL029
cuagauuuugagaaugaacaa

SEQ ID NO: 2533933 - RNA, 20 nt, Chlamydophila pneumoniae CWL029
cuagcaaaucuaaaaccuga

SEQ ID NO: 2533934 - RNA, 20 nt, Chlamydophila pneumoniae CWL029
cuagcagaaguccuaucaaa

SEQ ID NO: 2533935 - RNA, 16 nt, Chlamydophila pneumoniae CWL029
cuagcaguugcaauac

SEQ ID NO: 2533936 - RNA, 14 nt, Chlamydophila pneumoniae CWL029
cuagcucaaaucuc

SEQ ID NO: 2533937 - RNA, 19 nt, Chlamydophila pneumoniae CWL029
cuagcuuucuuggagaaga

SEQ ID NO: 2533938 - RNA, 14 nt, Chlamydophila pneumoniae CWL029
cuagcuuuuuuuau

SEQ ID NO: 2533939 - RNA, 23 nt, Chlamydophila pneumoniae CWL029
cuaggacguaauuacgcucucca

SEQ ID NO: 2533940 - RNA, 12 nt, Chlamydophila pneumoniae CWL029
cuaggagagcua

SEQ ID NO: 2533941 - RNA, 12 nt, Chlamydophila pneumoniae CWL029
cuaggauaucau

SEQ ID NO: 2533942 - RNA, 20 nt, Chlamydophila pneumoniae CWL029
cuaggccgggauuuuaauuc

SEQ ID NO: 2533943 - RNA, 22 nt, Chlamydophila pneumoniae CWL029
cuaggccuaaagaauuuguaac

SEQ ID NO: 2533944 - RNA, 21 nt, Chlamydophila pneumoniae CWL029
cuaggcgcauaugcuccagaa

SEQ ID NO: 2533945 - RNA, 23 nt, Chlamydophila pneumoniae CWL029
cuaggcugagacauauugaagau

SEQ ID NO: 2533946 - RNA, 19 nt, Chlamydophila pneumoniae CWL029
cuagggacuucucaaagac

SEQ ID NO: 2533947 - RNA, 17 nt, Chlamydophila pneumoniae CWL029
cuaggguuucuacagga

SEQ ID NO: 2533948 - RNA, 20 nt, Chlamydophila pneumoniae CWL029
cuaggguuucuacaggauau

SEQ ID NO: 2533949 - RNA, 15 nt, Chlamydophila pneumoniae CWL029
cuagguauuuguuuc

SEQ ID NO: 2533950 - RNA, 11 nt, Chlamydophila pneumoniae CWL029
cuagguucucc

SEQ ID NO: 2533951 - RNA, 14 nt, Chlamydophila pneumoniae CWL029
cuagguucuuuucg

SEQ ID NO: 2533952 - RNA, 20 nt, Chlamydophila pneumoniae CWL029
cuaguaagaaacccgcaacu

SEQ ID NO: 2533953 - RNA, 17 nt, Chlamydophila pneumoniae CWL029
cuaguauuaagauagac

SEQ ID NO: 2533954 - RNA, 13 nt, Chlamydophila pneumoniae CWL029
cuagucuuucaac

SEQ ID NO: 2533955 - RNA, 18 nt, Chlamydophila pneumoniae CWL029
cuagugcugcuauacaac

SEQ ID NO: 2533956 - RNA, 16 nt, Chlamydophila pneumoniae CWL029
cuaguuuuucuuuaga

SEQ ID NO: 2533957 - RNA, 18 nt, Chlamydophila pneumoniae CWL029
cuauaaaaaccuuaucgc

SEQ ID NO: 2533958 - RNA, 12 nt, Chlamydophila pneumoniae CWL029
cuauaaaauaaa

SEQ ID NO: 2533959 - RNA, 18 nt, Chlamydophila pneumoniae CWL029
cuauaagagguucucuua

SEQ ID NO: 2533960 - RNA, 17 nt, Chlamydophila pneumoniae CWL029
cuauaauuaauccuuga

SEQ ID NO: 2533961 - RNA, 24 nt, Chlamydophila pneumoniae CWL029
cuauacucucuguagcacuucuca

SEQ ID NO: 2533962 - RNA, 22 nt, Chlamydophila pneumoniae CWL029
cuauagaauacacagcuaugau

SEQ ID NO: 2533963 - RNA, 12 nt, Chlamydophila pneumoniae CWL029
cuauagagacac

SEQ ID NO: 2533964 - RNA, 23 nt, Chlamydophila pneumoniae CWL029
cuauagauacuuugcaauacacc

SEQ ID NO: 2533965 - RNA, 15 nt, Chlamydophila pneumoniae CWL029
cuauagaucuugaaa

SEQ ID NO: 2533966 - RNA, 19 nt, Chlamydophila pneumoniae CWL029
cuauagaucuugaaaagau

SEQ ID NO: 2533967 - RNA, 19 nt, Chlamydophila pneumoniae CWL029
cuauagaugccauaagucc

SEQ ID NO: 2533968 - RNA, 17 nt, Chlamydophila pneumoniae CWL029
cuauagauugguaagga

SEQ ID NO: 2533969 - RNA, 17 nt, Chlamydophila pneumoniae CWL029
cuauagauuuaagaguc

SEQ ID NO: 2533970 - RNA, 13 nt, Chlamydophila pneumoniae CWL029
cuauagcaacagg

SEQ ID NO: 2533971 - RNA, 16 nt, Chlamydophila pneumoniae CWL029
cuauagcaauccauag

SEQ ID NO: 2533972 - RNA, 14 nt, Chlamydophila pneumoniae CWL029
cuauagcauagccu

SEQ ID NO: 2533973 - RNA, 19 nt, Chlamydophila pneumoniae CWL029
cuauagccucuucuacacc

SEQ ID NO: 2533974 - RNA, 18 nt, Chlamydophila pneumoniae CWL029
cuauaggaagcucuucua

SEQ ID NO: 2533975 - RNA, 13 nt, Chlamydophila pneumoniae CWL029
cuauagggaucuc

SEQ ID NO: 2533976 - RNA, 20 nt, Chlamydophila pneumoniae CWL029
cuauagggaucuccuugaga

SEQ ID NO: 2533977 - RNA, 14 nt, Chlamydophila pneumoniae CWL029
cuauaguagaagaa

SEQ ID NO: 2533978 - RNA, 22 nt, Chlamydophila pneumoniae CWL029
cuauaguauaauagugagcucc

SEQ ID NO: 2533979 - RNA, 21 nt, Chlamydophila pneumoniae CWL029
cuauagucuguuuuggaaaga

SEQ ID NO: 2533980 - RNA, 22 nt, Chlamydophila pneumoniae CWL029
cuauagucuguuuuggaaagaa

SEQ ID NO: 2533981 - RNA, 23 nt, Chlamydophila pneumoniae CWL029
cuauagucuguuuuggaaagaag

SEQ ID NO: 2533982 - RNA, 21 nt, Chlamydophila pneumoniae CWL029
cuauaucgccguuaaagacuu

SEQ ID NO: 2533983 - RNA, 14 nt, Chlamydophila pneumoniae CWL029
cuauaucuacagcu

SEQ ID NO: 2533984 - RNA, 20 nt, Chlamydophila pneumoniae CWL029
cuauaugaaugauuuccaua

SEQ ID NO: 2533985 - RNA, 20 nt, Chlamydophila pneumoniae CWL029
cuaucagcuggguaagucca

SEQ ID NO: 2533986 - RNA, 17 nt, Chlamydophila pneumoniae CWL029
cuaucccacuaacaaga

SEQ ID NO: 2533987 - RNA, 16 nt, Chlamydophila pneumoniae CWL029
cuauccgcacucauag

SEQ ID NO: 2533988 - RNA, 15 nt, Chlamydophila pneumoniae CWL029
cuauccuguuucaac

SEQ ID NO: 2533989 - RNA, 22 nt, Chlamydophila pneumoniae CWL029
cuauccuucgaccuauuugcaa

SEQ ID NO: 2533990 - RNA, 18 nt, Chlamydophila pneumoniae CWL029
cuaucgguuuaaacagau

SEQ ID NO: 2533991 - RNA, 14 nt, Chlamydophila pneumoniae CWL029
cuaucuaaucaauu

SEQ ID NO: 2533992 - RNA, 14 nt, Chlamydophila pneumoniae CWL029
cuaucuaucuauag

SEQ ID NO: 2533993 - RNA, 11 nt, Chlamydophila pneumoniae CWL029
cuaucuccaga

SEQ ID NO: 2533994 - RNA, 12 nt, Chlamydophila pneumoniae CWL029
cuaucuccagaa

SEQ ID NO: 2533995 - RNA, 20 nt, Chlamydophila pneumoniae CWL029
cuaucuccagaaauuuuuac

SEQ ID NO: 2533996 - RNA, 16 nt, Chlamydophila pneumoniae CWL029
cuaucucuguuuuuug

SEQ ID NO: 2533997 - RNA, 12 nt, Chlamydophila pneumoniae CWL029
cuaucuucaagu

SEQ ID NO: 2533998 - RNA, 19 nt, Chlamydophila pneumoniae CWL029
cuaucuuuacuaacaaaau

SEQ ID NO: 2533999 - RNA, 23 nt, Chlamydophila pneumoniae CWL029
cuaucuuuauuuaaauaaaacca

SEQ ID NO: 2534000 - RNA, 22 nt, Chlamydophila pneumoniae CWL029
cuaucuuugguaugcagaguuu

SEQ ID NO: 2534001 - RNA, 13 nt, Chlamydophila pneumoniae CWL029
cuaugacuucuug

SEQ ID NO: 2534002 - RNA, 18 nt, Chlamydophila pneumoniae CWL029
cuaugagauaggaacuca

SEQ ID NO: 2534003 - RNA, 15 nt, Chlamydophila pneumoniae CWL029
cuaugauaucaccag

SEQ ID NO: 2534004 - RNA, 23 nt, Chlamydophila pneumoniae CWL029
cuaugaugagaacguccucaccu

SEQ ID NO: 2534005 - RNA, 15 nt, Chlamydophila pneumoniae CWL029
cuaugcacaaaauaa

SEQ ID NO: 2534006 - RNA, 19 nt, Chlamydophila pneumoniae CWL029
cuaugcgcucuaagagccc

SEQ ID NO: 2534007 - RNA, 19 nt, Chlamydophila pneumoniae CWL029
cuauggaagauaaacauac

SEQ ID NO: 2534008 - RNA, 22 nt, Chlamydophila pneumoniae CWL029
cuauggcagcaggaauaaucaa

SEQ ID NO: 2534009 - RNA, 18 nt, Chlamydophila pneumoniae CWL029
cuaugggaggaauuccuc

SEQ ID NO: 2534010 - RNA, 21 nt, Chlamydophila pneumoniae CWL029
cuaugggaggaauuccucuca

SEQ ID NO: 2534011 - RNA, 15 nt, Chlamydophila pneumoniae CWL029
cuaugguaaucaccu

SEQ ID NO: 2534012 - RNA, 20 nt, Chlamydophila pneumoniae CWL029
cuauggucucccucacaaga

SEQ ID NO: 2534013 - RNA, 21 nt, Chlamydophila pneumoniae CWL029
cuauggucucccucacaagaa

SEQ ID NO: 2534014 - RNA, 15 nt, Chlamydophila pneumoniae CWL029
cuauggugcaugccu

SEQ ID NO: 2534015 - RNA, 23 nt, Chlamydophila pneumoniae CWL029
cuaugugaugucgcgaaaguaaa

SEQ ID NO: 2534016 - RNA, 15 nt, Chlamydophila pneumoniae CWL029
cuauguguucucgaa

SEQ ID NO: 2534017 - RNA, 18 nt, Chlamydophila pneumoniae CWL029
cuauuaaggauuccuuga

SEQ ID NO: 2534018 - RNA, 18 nt, Chlamydophila pneumoniae CWL029
cuauuagcgcggucacuu

SEQ ID NO: 2534019 - RNA, 22 nt, Chlamydophila pneumoniae CWL029
cuauuagcgcggucacuucaau

SEQ ID NO: 2534020 - RNA, 14 nt, Chlamydophila pneumoniae CWL029
cuauuaucugcaga

SEQ ID NO: 2534021 - RNA, 14 nt, Chlamydophila pneumoniae CWL029
cuauuauuuuaaag

SEQ ID NO: 2534022 - RNA, 22 nt, Chlamydophila pneumoniae CWL029
cuauuccauaaaaauguaauuu

SEQ ID NO: 2534023 - RNA, 12 nt, Chlamydophila pneumoniae CWL029
cuauuccccucc

SEQ ID NO: 2534024 - RNA, 21 nt, Chlamydophila pneumoniae CWL029
cuauucccgacucggagacca

SEQ ID NO: 2534025 - RNA, 22 nt, Chlamydophila pneumoniae CWL029
cuauucugauuagagccccaac

SEQ ID NO: 2534026 - RNA, 20 nt, Chlamydophila pneumoniae CWL029
cuauugcugcggccacauua

SEQ ID NO: 2534027 - RNA, 17 nt, Chlamydophila pneumoniae CWL029
cuauugggaaugcauuu

SEQ ID NO: 2534028 - RNA, 21 nt, Chlamydophila pneumoniae CWL029
cuauugguguaucucuuaaaa

SEQ ID NO: 2534029 - RNA, 14 nt, Chlamydophila pneumoniae CWL029
cuauuguuuguccu

SEQ ID NO: 2534030 - RNA, 15 nt, Chlamydophila pneumoniae CWL029
cuauuucauauaaag

SEQ ID NO: 2534031 - RNA, 18 nt, Chlamydophila pneumoniae CWL029
cuauuucauauaaaguuu

SEQ ID NO: 2534032 - RNA, 20 nt, Chlamydophila pneumoniae CWL029
cuauuucuuaauuuccuucu

SEQ ID NO: 2534033 - RNA, 13 nt, Chlamydophila pneumoniae CWL029
cuauuugaaaaga

SEQ ID NO: 2534034 - RNA, 21 nt, Chlamydophila pneumoniae CWL029
cuauuugcaacaaucuuucuu

SEQ ID NO: 2534035 - RNA, 12 nt, Chlamydophila pneumoniae CWL029
cuauuuuaaacu

SEQ ID NO: 2534036 - RNA, 14 nt, Chlamydophila pneumoniae CWL029
cuauuuuaaacuua

SEQ ID NO: 2534037 - RNA, 18 nt, Chlamydophila pneumoniae CWL029
cuauuuuaaacuuacagc

SEQ ID NO: 2534038 - RNA, 14 nt, Chlamydophila pneumoniae CWL029
cuauuuucccuuug

SEQ ID NO: 2534039 - RNA, 23 nt, Chlamydophila pneumoniae CWL029
cuauuuuugaggaacgcacgcca

SEQ ID NO: 2534040 - RNA, 12 nt, Chlamydophila pneumoniae CWL029
cuauuuuuuaag

SEQ ID NO: 2534041 - RNA, 14 nt, Chlamydophila pneumoniae CWL029
cuauuuuuugugaa

SEQ ID NO: 2534042 - RNA, 17 nt, Chlamydophila pneumoniae CWL029
cuauuuuuugugaauuu

SEQ ID NO: 2534043 - RNA, 23 nt, Chlamydophila pneumoniae CWL029
cucaaaauuuaaauauagaaaau

SEQ ID NO: 2534044 - RNA, 17 nt, Chlamydophila pneumoniae CWL029
cucaaacccucuccaga

SEQ ID NO: 2534045 - RNA, 14 nt, Chlamydophila pneumoniae CWL029
cucaaagaaagucu

SEQ ID NO: 2534046 - RNA, 20 nt, Chlamydophila pneumoniae CWL029
cucaaagaaagucucucuaa

SEQ ID NO: 2534047 - RNA, 23 nt, Chlamydophila pneumoniae CWL029
cucaacuuaaguugaccuuuuuc

SEQ ID NO: 2534048 - RNA, 19 nt, Chlamydophila pneumoniae CWL029
cucaagaagaugauuggac

SEQ ID NO: 2534049 - RNA, 15 nt, Chlamydophila pneumoniae CWL029
cucaagaauaugaac

SEQ ID NO: 2534050 - RNA, 20 nt, Chlamydophila pneumoniae CWL029
cucaagaauaugaacugccu

SEQ ID NO: 2534051 - RNA, 14 nt, Chlamydophila pneumoniae CWL029
cucaagagcaugcu

SEQ ID NO: 2534052 - RNA, 21 nt, Chlamydophila pneumoniae CWL029
cucaagagcaugcuugaggaa

SEQ ID NO: 2534053 - RNA, 13 nt, Chlamydophila pneumoniae CWL029
cucaagaucuuca

SEQ ID NO: 2534054 - RNA, 16 nt, Chlamydophila pneumoniae CWL029
cucaaggaucuuauau

SEQ ID NO: 2534055 - RNA, 18 nt, Chlamydophila pneumoniae CWL029
cucaaggaucuuauauaa

SEQ ID NO: 2534056 - RNA, 22 nt, Chlamydophila pneumoniae CWL029
cucaaggaucuuauauaaaacu

SEQ ID NO: 2534057 - RNA, 20 nt, Chlamydophila pneumoniae CWL029
cucaaggcaucuagagucuc

SEQ ID NO: 2534058 - RNA, 20 nt, Chlamydophila pneumoniae CWL029
cucaaggucacagcauuuuc

SEQ ID NO: 2534059 - RNA, 22 nt, Chlamydophila pneumoniae CWL029
cucaaggucacagcauuuucuc

SEQ ID NO: 2534060 - RNA, 21 nt, Chlamydophila pneumoniae CWL029
cucaaguaagaagucuucagg

SEQ ID NO: 2534061 - RNA, 20 nt, Chlamydophila pneumoniae CWL029
cucaagucuauuugaaaaga

SEQ ID NO: 2534062 - RNA, 21 nt, Chlamydophila pneumoniae CWL029
cucaagucuauuugaaaagaa

SEQ ID NO: 2534063 - RNA, 14 nt, Chlamydophila pneumoniae CWL029
cucaauacuucagg

SEQ ID NO: 2534064 - RNA, 15 nt, Chlamydophila pneumoniae CWL029
cucaauacuucagga

SEQ ID NO: 2534065 - RNA, 15 nt, Chlamydophila pneumoniae CWL029
cucaaucaaauucaa

SEQ ID NO: 2534066 - RNA, 19 nt, Chlamydophila pneumoniae CWL029
cucaaucgauaaucaaagg

SEQ ID NO: 2534067 - RNA, 14 nt, Chlamydophila pneumoniae CWL029
cucacaaacaacag

SEQ ID NO: 2534068 - RNA, 13 nt, Chlamydophila pneumoniae CWL029
cucacaucuccuu

SEQ ID NO: 2534069 - RNA, 15 nt, Chlamydophila pneumoniae CWL029
cucacaucuccuuuc

SEQ ID NO: 2534070 - RNA, 24 nt, Chlamydophila pneumoniae CWL029
cucacaucuccuuucaagagcagu

SEQ ID NO: 2534071 - RNA, 17 nt, Chlamydophila pneumoniae CWL029
cucacauguuucacuua

SEQ ID NO: 2534072 - RNA, 23 nt, Chlamydophila pneumoniae CWL029
cucaccacggaagauaugucgcu

SEQ ID NO: 2534073 - RNA, 16 nt, Chlamydophila pneumoniae CWL029
cucacucuaugagaac

SEQ ID NO: 2534074 - RNA, 13 nt, Chlamydophila pneumoniae CWL029
cucacucuuuucu

SEQ ID NO: 2534075 - RNA, 14 nt, Chlamydophila pneumoniae CWL029
cucacucuuuucua

SEQ ID NO: 2534076 - RNA, 15 nt, Chlamydophila pneumoniae CWL029
cucacucuuuucuag

SEQ ID NO: 2534077 - RNA, 12 nt, Chlamydophila pneumoniae CWL029
cucacugagugu

SEQ ID NO: 2534078 - RNA, 17 nt, Chlamydophila pneumoniae CWL029
cucacuggcuccuaaac

SEQ ID NO: 2534079 - RNA, 22 nt, Chlamydophila pneumoniae CWL029
cucacuguuuuucguaagcuga

SEQ ID NO: 2534080 - RNA, 22 nt, Chlamydophila pneumoniae CWL029
cucagaaaauguaaaaaauuau

SEQ ID NO: 2534081 - RNA, 23 nt, Chlamydophila pneumoniae CWL029
cucagaaaggagauccacagacu

SEQ ID NO: 2534082 - RNA, 17 nt, Chlamydophila pneumoniae CWL029
cucagaauccauuuugc

SEQ ID NO: 2534083 - RNA, 20 nt, Chlamydophila pneumoniae CWL029
cucagaauccauuuugccca

SEQ ID NO: 2534084 - RNA, 16 nt, Chlamydophila pneumoniae CWL029
cucagcuaauuuaaau

SEQ ID NO: 2534085 - RNA, 22 nt, Chlamydophila pneumoniae CWL029
cucaggaaagguaguuuucuuc

SEQ ID NO: 2534086 - RNA, 18 nt, Chlamydophila pneumoniae CWL029
cucaggagauacaagcaa

SEQ ID NO: 2534087 - RNA, 15 nt, Chlamydophila pneumoniae CWL029
cucaggauauauaga

SEQ ID NO: 2534088 - RNA, 16 nt, Chlamydophila pneumoniae CWL029
cucaguaggagcagcg

SEQ ID NO: 2534089 - RNA, 19 nt, Chlamydophila pneumoniae CWL029
cucagugaacucuucaaga

SEQ ID NO: 2534090 - RNA, 14 nt, Chlamydophila pneumoniae CWL029
cucauagcuuccug

SEQ ID NO: 2534091 - RNA, 16 nt, Chlamydophila pneumoniae CWL029
cucauagcuuccugua

SEQ ID NO: 2534092 - RNA, 18 nt, Chlamydophila pneumoniae CWL029
cucauagcuuccuguagu

SEQ ID NO: 2534093 - RNA, 15 nt, Chlamydophila pneumoniae CWL029
cucauauuuugucuu

SEQ ID NO: 2534094 - RNA, 19 nt, Chlamydophila pneumoniae CWL029
cucaucacaauuuuaaaau

SEQ ID NO: 2534095 - RNA, 20 nt, Chlamydophila pneumoniae CWL029
cucaucacaauuuuaaaauc

SEQ ID NO: 2534096 - RNA, 18 nt, Chlamydophila pneumoniae CWL029
cucaucacguaagguguc

SEQ ID NO: 2534097 - RNA, 22 nt, Chlamydophila pneumoniae CWL029
cucaucagaaguggccuugcca

SEQ ID NO: 2534098 - RNA, 20 nt, Chlamydophila pneumoniae CWL029
cucaucagcaaaacucccga

SEQ ID NO: 2534099 - RNA, 14 nt, Chlamydophila pneumoniae CWL029
cucaucagcaaccu

SEQ ID NO: 2534100 - RNA, 19 nt, Chlamydophila pneumoniae CWL029
cucauccagacaagacacu

SEQ ID NO: 2534101 - RNA, 16 nt, Chlamydophila pneumoniae CWL029
cucauccccucagaaa

SEQ ID NO: 2534102 - RNA, 16 nt, Chlamydophila pneumoniae CWL029
cucauccuaaauuaaa

SEQ ID NO: 2534103 - RNA, 20 nt, Chlamydophila pneumoniae CWL029
cucauccuaaauuaaauauc

SEQ ID NO: 2534104 - RNA, 16 nt, Chlamydophila pneumoniae CWL029
cucauccucaucauca

SEQ ID NO: 2534105 - RNA, 16 nt, Chlamydophila pneumoniae CWL029
cucaucggaucuuuuc

SEQ ID NO: 2534106 - RNA, 17 nt, Chlamydophila pneumoniae CWL029
cucaucggaucuuuucu

SEQ ID NO: 2534107 - RNA, 20 nt, Chlamydophila pneumoniae CWL029
cucaucggaucuuuucuuuc

SEQ ID NO: 2534108 - RNA, 21 nt, Chlamydophila pneumoniae CWL029
cucaucuaacgucagcugucc

SEQ ID NO: 2534109 - RNA, 16 nt, Chlamydophila pneumoniae CWL029
cucaucuagaaagauu

SEQ ID NO: 2534110 - RNA, 22 nt, Chlamydophila pneumoniae CWL029
cucaucucgcaguccaaagacu

SEQ ID NO: 2534111 - RNA, 21 nt, Chlamydophila pneumoniae CWL029
cucaugaaauuucauucucac

SEQ ID NO: 2534112 - RNA, 20 nt, Chlamydophila pneumoniae CWL029
cucauggauuacugaagauc

SEQ ID NO: 2534113 - RNA, 19 nt, Chlamydophila pneumoniae CWL029
cucauuaagaggagucccc

SEQ ID NO: 2534114 - RNA, 16 nt, Chlamydophila pneumoniae CWL029
cucauuaucaagaaau

SEQ ID NO: 2534115 - RNA, 18 nt, Chlamydophila pneumoniae CWL029
cucauuccagcaucuucu

SEQ ID NO: 2534116 - RNA, 19 nt, Chlamydophila pneumoniae CWL029
cucauuccagcaucuucuc

SEQ ID NO: 2534117 - RNA, 22 nt, Chlamydophila pneumoniae CWL029
cucauugcggcaccaaagaugc

SEQ ID NO: 2534118 - RNA, 15 nt, Chlamydophila pneumoniae CWL029
cuccaaaacucaagg

SEQ ID NO: 2534119 - RNA, 14 nt, Chlamydophila pneumoniae CWL029
cuccaaaauaaucu

SEQ ID NO: 2534120 - RNA, 17 nt, Chlamydophila pneumoniae CWL029
cuccaaaauaaucucgc

SEQ ID NO: 2534121 - RNA, 14 nt, Chlamydophila pneumoniae CWL029
cuccaaacauuuuu

SEQ ID NO: 2534122 - RNA, 20 nt, Chlamydophila pneumoniae CWL029
cuccaaacauuuuuaaggaa

SEQ ID NO: 2534123 - RNA, 23 nt, Chlamydophila pneumoniae CWL029
cuccaacaccgaaggcacuggca

SEQ ID NO: 2534124 - RNA, 20 nt, Chlamydophila pneumoniae CWL029
cuccaacuuccauaugaggu

SEQ ID NO: 2534125 - RNA, 14 nt, Chlamydophila pneumoniae CWL029
cuccaagaauagca

SEQ ID NO: 2534126 - RNA, 19 nt, Chlamydophila pneumoniae CWL029
cuccaagaauagcaggaag

SEQ ID NO: 2534127 - RNA, 19 nt, Chlamydophila pneumoniae CWL029
cuccaagcuuggucgcaag

SEQ ID NO: 2534128 - RNA, 13 nt, Chlamydophila pneumoniae CWL029
cuccaaugggcag

SEQ ID NO: 2534129 - RNA, 20 nt, Chlamydophila pneumoniae CWL029
cuccaauuuucuucagcacu

SEQ ID NO: 2534130 - RNA, 15 nt, Chlamydophila pneumoniae CWL029
cuccacagcuucuuc

SEQ ID NO: 2534131 - RNA, 18 nt, Chlamydophila pneumoniae CWL029
cuccacaugcccaaacau

SEQ ID NO: 2534132 - RNA, 22 nt, Chlamydophila pneumoniae CWL029
cuccacaugcccaaacaucauu

SEQ ID NO: 2534133 - RNA, 12 nt, Chlamydophila pneumoniae CWL029
cuccaccagaag

SEQ ID NO: 2534134 - RNA, 13 nt, Chlamydophila pneumoniae CWL029
cuccaccaggagc

SEQ ID NO: 2534135 - RNA, 21 nt, Chlamydophila pneumoniae CWL029
cuccaccaggagcuccuccuu

SEQ ID NO: 2534136 - RNA, 18 nt, Chlamydophila pneumoniae CWL029
cuccagaaaguauuccuc

SEQ ID NO: 2534137 - RNA, 16 nt, Chlamydophila pneumoniae CWL029
cuccagaaauuuuuac

SEQ ID NO: 2534138 - RNA, 14 nt, Chlamydophila pneumoniae CWL029
cuccagagcaagau

SEQ ID NO: 2534139 - RNA, 14 nt, Chlamydophila pneumoniae CWL029
cuccagcagcuucc

SEQ ID NO: 2534140 - RNA, 13 nt, Chlamydophila pneumoniae CWL029
cuccagcauaagg

SEQ ID NO: 2534141 - RNA, 23 nt, Chlamydophila pneumoniae CWL029
cuccagcauaaggauucugagaa

SEQ ID NO: 2534142 - RNA, 17 nt, Chlamydophila pneumoniae CWL029
cuccaggggauaaaacu

SEQ ID NO: 2534143 - RNA, 17 nt, Chlamydophila pneumoniae CWL029
cuccaguaucuucucuu

SEQ ID NO: 2534144 - RNA, 15 nt, Chlamydophila pneumoniae CWL029
cuccauaagcuuuuc

SEQ ID NO: 2534145 - RNA, 16 nt, Chlamydophila pneumoniae CWL029
cuccauccucagucuc

SEQ ID NO: 2534146 - RNA, 23 nt, Chlamydophila pneumoniae CWL029
cuccaucggaauuugccugaaau

SEQ ID NO: 2534147 - RNA, 17 nt, Chlamydophila pneumoniae CWL029
cuccaucuauacagaca

SEQ ID NO: 2534148 - RNA, 18 nt, Chlamydophila pneumoniae CWL029
cuccauuuagaaugaccg

SEQ ID NO: 2534149 - RNA, 17 nt, Chlamydophila pneumoniae CWL029
cuccauuuagacaagac

SEQ ID NO: 2534150 - RNA, 20 nt, Chlamydophila pneumoniae CWL029
cuccauuuagacaagacacc

SEQ ID NO: 2534151 - RNA, 13 nt, Chlamydophila pneumoniae CWL029
cuccauuucuagg

SEQ ID NO: 2534152 - RNA, 14 nt, Chlamydophila pneumoniae CWL029
cuccauuucuagga

SEQ ID NO: 2534153 - RNA, 15 nt, Chlamydophila pneumoniae CWL029
cuccauuucuaggaa

SEQ ID NO: 2534154 - RNA, 18 nt, Chlamydophila pneumoniae CWL029
cucccaaauuggagguca

SEQ ID NO: 2534155 - RNA, 16 nt, Chlamydophila pneumoniae CWL029
cucccaagacgagaac

SEQ ID NO: 2534156 - RNA, 15 nt, Chlamydophila pneumoniae CWL029
cucccaauauccaga

SEQ ID NO: 2534157 - RNA, 16 nt, Chlamydophila pneumoniae CWL029
cucccaccaaggggcg

SEQ ID NO: 2534158 - RNA, 15 nt, Chlamydophila pneumoniae CWL029
cucccauagcaaugc

SEQ ID NO: 2534159 - RNA, 17 nt, Chlamydophila pneumoniae CWL029
cucccauagcaaugccu

SEQ ID NO: 2534160 - RNA, 19 nt, Chlamydophila pneumoniae CWL029
cucccauguaguaaauucc

SEQ ID NO: 2534161 - RNA, 23 nt, Chlamydophila pneumoniae CWL029
cucccgugagcaugcucacggga

SEQ ID NO: 2534162 - RNA, 20 nt, Chlamydophila pneumoniae CWL029
cucccguuccuuuagccugg

SEQ ID NO: 2534163 - RNA, 19 nt, Chlamydophila pneumoniae CWL029
cucccuagguuuuaucuuu

SEQ ID NO: 2534164 - RNA, 20 nt, Chlamydophila pneumoniae CWL029
cucccuagguuuuaucuuua

SEQ ID NO: 2534165 - RNA, 22 nt, Chlamydophila pneumoniae CWL029
cucccuagguuuuaucuuuaga

SEQ ID NO: 2534166 - RNA, 17 nt, Chlamydophila pneumoniae CWL029
cucccuaugccaguucc

SEQ ID NO: 2534167 - RNA, 21 nt, Chlamydophila pneumoniae CWL029
cucccuggucuguauuuucuu

SEQ ID NO: 2534168 - RNA, 12 nt, Chlamydophila pneumoniae CWL029
cuccgaagacua

SEQ ID NO: 2534169 - RNA, 15 nt, Chlamydophila pneumoniae CWL029
cuccgaagacuacca

SEQ ID NO: 2534170 - RNA, 20 nt, Chlamydophila pneumoniae CWL029
cuccgaauggagaaggacac

SEQ ID NO: 2534171 - RNA, 15 nt, Chlamydophila pneumoniae CWL029
cuccgaggcuucuga

SEQ ID NO: 2534172 - RNA, 16 nt, Chlamydophila pneumoniae CWL029
cuccgauaugggcuuu

SEQ ID NO: 2534173 - RNA, 16 nt, Chlamydophila pneumoniae CWL029
cuccgccuacaauacu

SEQ ID NO: 2534174 - RNA, 19 nt, Chlamydophila pneumoniae CWL029
cuccgcuagaggaucuuca

SEQ ID NO: 2534175 - RNA, 12 nt, Chlamydophila pneumoniae CWL029
cuccgcucuaag

SEQ ID NO: 2534176 - RNA, 21 nt, Chlamydophila pneumoniae CWL029
cuccgcucuaagcugugcauu

SEQ ID NO: 2534177 - RNA, 14 nt, Chlamydophila pneumoniae CWL029
cuccguagucuuag

SEQ ID NO: 2534178 - RNA, 21 nt, Chlamydophila pneumoniae CWL029
cuccguauacugcugcuaagc

SEQ ID NO: 2534179 - RNA, 20 nt, Chlamydophila pneumoniae CWL029
cuccgucauauuuaaaaggc

SEQ ID NO: 2534180 - RNA, 19 nt, Chlamydophila pneumoniae CWL029
cuccguggcggauaaucaa

SEQ ID NO: 2534181 - RNA, 16 nt, Chlamydophila pneumoniae CWL029
cuccuaaaccaucacu

SEQ ID NO: 2534182 - RNA, 21 nt, Chlamydophila pneumoniae CWL029
cuccuaaaccaucacuuccug

SEQ ID NO: 2534183 - RNA, 12 nt, Chlamydophila pneumoniae CWL029
cuccuaaagcau

SEQ ID NO: 2534184 - RNA, 13 nt, Chlamydophila pneumoniae CWL029
cuccucaaaagau

SEQ ID NO: 2534185 - RNA, 23 nt, Chlamydophila pneumoniae CWL029
cuccucagaauccauuuugccca

SEQ ID NO: 2534186 - RNA, 22 nt, Chlamydophila pneumoniae CWL029
cuccucaucagaggccaccaaa

SEQ ID NO: 2534187 - RNA, 17 nt, Chlamydophila pneumoniae CWL029
cuccuccaaucugcuga

SEQ ID NO: 2534188 - RNA, 15 nt, Chlamydophila pneumoniae CWL029
cuccuccuuugacac

SEQ ID NO: 2534189 - RNA, 15 nt, Chlamydophila pneumoniae CWL029
cuccucgucuaaaga

SEQ ID NO: 2534190 - RNA, 19 nt, Chlamydophila pneumoniae CWL029
cuccucgucuaaagaagau

SEQ ID NO: 2534191 - RNA, 12 nt, Chlamydophila pneumoniae CWL029
cuccucugcuaa

SEQ ID NO: 2534192 - RNA, 18 nt, Chlamydophila pneumoniae CWL029
cuccugaagccaugacaa

SEQ ID NO: 2534193 - RNA, 23 nt, Chlamydophila pneumoniae CWL029
cuccugaagccaugacaaagggu

SEQ ID NO: 2534194 - RNA, 12 nt, Chlamydophila pneumoniae CWL029
cuccugaagcug

SEQ ID NO: 2534195 - RNA, 21 nt, Chlamydophila pneumoniae CWL029
cuccugaagcugagaauacaa

SEQ ID NO: 2534196 - RNA, 20 nt, Chlamydophila pneumoniae CWL029
cuccugaagggacaaguacg

SEQ ID NO: 2534197 - RNA, 22 nt, Chlamydophila pneumoniae CWL029
cuccuggaagaauuucauaaga

SEQ ID NO: 2534198 - RNA, 19 nt, Chlamydophila pneumoniae CWL029
cuccuucaauacgcuagcu

SEQ ID NO: 2534199 - RNA, 14 nt, Chlamydophila pneumoniae CWL029
cuccuuucaagagc

SEQ ID NO: 2534200 - RNA, 18 nt, Chlamydophila pneumoniae CWL029
cuccuuuguauucagugu

SEQ ID NO: 2534201 - RNA, 23 nt, Chlamydophila pneumoniae CWL029
cuccuuuuuaggacgcuauccua

SEQ ID NO: 2534202 - RNA, 18 nt, Chlamydophila pneumoniae CWL029
cucgaagcuugcugauuu

SEQ ID NO: 2534203 - RNA, 18 nt, Chlamydophila pneumoniae CWL029
cucgacacuauguguuuc

SEQ ID NO: 2534204 - RNA, 20 nt, Chlamydophila pneumoniae CWL029
cucgacguauuugccaaaau

SEQ ID NO: 2534205 - RNA, 22 nt, Chlamydophila pneumoniae CWL029
cucgacguauuugccaaaauaa

SEQ ID NO: 2534206 - RNA, 21 nt, Chlamydophila pneumoniae CWL029
cucgauacuguugauccuucu

SEQ ID NO: 2534207 - RNA, 22 nt, Chlamydophila pneumoniae CWL029
cucgauuaucgggguuguauuu

SEQ ID NO: 2534208 - RNA, 14 nt, Chlamydophila pneumoniae CWL029
cucgauuauuucuu

SEQ ID NO: 2534209 - RNA, 14 nt, Chlamydophila pneumoniae CWL029
cucgcaaaagcugu

SEQ ID NO: 2534210 - RNA, 19 nt, Chlamydophila pneumoniae CWL029
cucgcaauccaggaauaga

SEQ ID NO: 2534211 - RNA, 21 nt, Chlamydophila pneumoniae CWL029
cucgccaaaccaugaggcugc

SEQ ID NO: 2534212 - RNA, 23 nt, Chlamydophila pneumoniae CWL029
cucgcuaaaguagaauccuucuc

SEQ ID NO: 2534213 - RNA, 18 nt, Chlamydophila pneumoniae CWL029
cucgcuguuucaacaccu

SEQ ID NO: 2534214 - RNA, 22 nt, Chlamydophila pneumoniae CWL029
cucggauggacuacugaaacac

SEQ ID NO: 2534215 - RNA, 20 nt, Chlamydophila pneumoniae CWL029
cucguagcuauuuuugagga

SEQ ID NO: 2534216 - RNA, 15 nt, Chlamydophila pneumoniae CWL029
cucgucugauagagg

SEQ ID NO: 2534217 - RNA, 23 nt, Chlamydophila pneumoniae CWL029
cucgugcaaggccuaaucuugua

SEQ ID NO: 2534218 - RNA, 21 nt, Chlamydophila pneumoniae CWL029
cucguguagaauucacucccu

SEQ ID NO: 2534219 - RNA, 17 nt, Chlamydophila pneumoniae CWL029
cucguuauauuuuucug

SEQ ID NO: 2534220 - RNA, 14 nt, Chlamydophila pneumoniae CWL029
cucuaaaaaagaua

SEQ ID NO: 2534221 - RNA, 16 nt, Chlamydophila pneumoniae CWL029
cucuaaacauaaagac

SEQ ID NO: 2534222 - RNA, 18 nt, Chlamydophila pneumoniae CWL029
cucuaaacucucuuccuu

SEQ ID NO: 2534223 - RNA, 14 nt, Chlamydophila pneumoniae CWL029
cucuaacuucauua

SEQ ID NO: 2534224 - RNA, 16 nt, Chlamydophila pneumoniae CWL029
cucuaagaaucuauag

SEQ ID NO: 2534225 - RNA, 12 nt, Chlamydophila pneumoniae CWL029
cucuaagacugu

SEQ ID NO: 2534226 - RNA, 18 nt, Chlamydophila pneumoniae CWL029
cucuaagcagccucuucu

SEQ ID NO: 2534227 - RNA, 16 nt, Chlamydophila pneumoniae CWL029
cucuaagcgaaacauu

SEQ ID NO: 2534228 - RNA, 19 nt, Chlamydophila pneumoniae CWL029
cucuaagcugugcauuuuc

SEQ ID NO: 2534229 - RNA, 21 nt, Chlamydophila pneumoniae CWL029
cucuaagcugugcauuuucuu

SEQ ID NO: 2534230 - RNA, 22 nt, Chlamydophila pneumoniae CWL029
cucuaaggacaaaucucccaaa

SEQ ID NO: 2534231 - RNA, 18 nt, Chlamydophila pneumoniae CWL029
cucuaaguccaacaucag

SEQ ID NO: 2534232 - RNA, 18 nt, Chlamydophila pneumoniae CWL029
cucuaauucuucuacaga

SEQ ID NO: 2534233 - RNA, 16 nt, Chlamydophila pneumoniae CWL029
cucuacaggagaagcg

SEQ ID NO: 2534234 - RNA, 16 nt, Chlamydophila pneumoniae CWL029
cucuaccaacugagcu

SEQ ID NO: 2534235 - RNA, 15 nt, Chlamydophila pneumoniae CWL029
cucuaccaucaugaa

SEQ ID NO: 2534236 - RNA, 16 nt, Chlamydophila pneumoniae CWL029
cucuaccccacgcuaa

SEQ ID NO: 2534237 - RNA, 19 nt, Chlamydophila pneumoniae CWL029
cucuaccccacgcuaaacu

SEQ ID NO: 2534238 - RNA, 22 nt, Chlamydophila pneumoniae CWL029
cucuacgcuauucuuaagcuac

SEQ ID NO: 2534239 - RNA, 20 nt, Chlamydophila pneumoniae CWL029
cucuacuaaaaucucauuuc

SEQ ID NO: 2534240 - RNA, 14 nt, Chlamydophila pneumoniae CWL029
cucuacucuacagu

SEQ ID NO: 2534241 - RNA, 19 nt, Chlamydophila pneumoniae CWL029
cucuagaaaacgcucuccu

SEQ ID NO: 2534242 - RNA, 20 nt, Chlamydophila pneumoniae CWL029
cucuagaaaacgcucuccua

SEQ ID NO: 2534243 - RNA, 22 nt, Chlamydophila pneumoniae CWL029
cucuagaaauauacucuugcuu

SEQ ID NO: 2534244 - RNA, 22 nt, Chlamydophila pneumoniae CWL029
cucuagaggagcgaugacuugg

SEQ ID NO: 2534245 - RNA, 23 nt, Chlamydophila pneumoniae CWL029
cucuagcaccuaauaaagaaggu

SEQ ID NO: 2534246 - RNA, 21 nt, Chlamydophila pneumoniae CWL029
cucuagccaccaacaguccug

SEQ ID NO: 2534247 - RNA, 17 nt, Chlamydophila pneumoniae CWL029
cucuagcucaaaucuca

SEQ ID NO: 2534248 - RNA, 13 nt, Chlamydophila pneumoniae CWL029
cucuaguaagaaa

SEQ ID NO: 2534249 - RNA, 13 nt, Chlamydophila pneumoniae CWL029
cucuaguuuuucu

SEQ ID NO: 2534250 - RNA, 13 nt, Chlamydophila pneumoniae CWL029
cucuauagcauua

SEQ ID NO: 2534251 - RNA, 23 nt, Chlamydophila pneumoniae CWL029
cucuauagugcauaccuuaccau

SEQ ID NO: 2534252 - RNA, 17 nt, Chlamydophila pneumoniae CWL029
cucuauauuuuuuccca

SEQ ID NO: 2534253 - RNA, 23 nt, Chlamydophila pneumoniae CWL029
cucuaucagggcuacgguaaaau

SEQ ID NO: 2534254 - RNA, 16 nt, Chlamydophila pneumoniae CWL029
cucucaagucuauuug

SEQ ID NO: 2534255 - RNA, 13 nt, Chlamydophila pneumoniae CWL029
cucucaauaagau

SEQ ID NO: 2534256 - RNA, 19 nt, Chlamydophila pneumoniae CWL029
cucucaguuaaagagcauc

SEQ ID NO: 2534257 - RNA, 13 nt, Chlamydophila pneumoniae CWL029
cucucaugaaauu

SEQ ID NO: 2534258 - RNA, 16 nt, Chlamydophila pneumoniae CWL029
cucuccagcuugauca

SEQ ID NO: 2534259 - RNA, 21 nt, Chlamydophila pneumoniae CWL029
cucuccguccaguucuucauu

SEQ ID NO: 2534260 - RNA, 16 nt, Chlamydophila pneumoniae CWL029
cucuccugcaaaaagu

SEQ ID NO: 2534261 - RNA, 13 nt, Chlamydophila pneumoniae CWL029
cucucgcuaagca

SEQ ID NO: 2534262 - RNA, 16 nt, Chlamydophila pneumoniae CWL029
cucucuccaugagcuc

SEQ ID NO: 2534263 - RNA, 13 nt, Chlamydophila pneumoniae CWL029
cucucucugcagc

SEQ ID NO: 2534264 - RNA, 15 nt, Chlamydophila pneumoniae CWL029
cucucugccuaccaa

SEQ ID NO: 2534265 - RNA, 16 nt, Chlamydophila pneumoniae CWL029
cucucugccuaccaaa

SEQ ID NO: 2534266 - RNA, 14 nt, Chlamydophila pneumoniae CWL029
cucucuuaaauuua

SEQ ID NO: 2534267 - RNA, 13 nt, Chlamydophila pneumoniae CWL029
cucucuuccaaaa

SEQ ID NO: 2534268 - RNA, 14 nt, Chlamydophila pneumoniae CWL029
cucucuuccaaaag

SEQ ID NO: 2534269 - RNA, 14 nt, Chlamydophila pneumoniae CWL029
cucucuucccccag

SEQ ID NO: 2534270 - RNA, 19 nt, Chlamydophila pneumoniae CWL029
cucucuuccugcugcuuug

SEQ ID NO: 2534271 - RNA, 14 nt, Chlamydophila pneumoniae CWL029
cucucuuccuucuc

SEQ ID NO: 2534272 - RNA, 15 nt, Chlamydophila pneumoniae CWL029
cucucuuuaaaaaua

SEQ ID NO: 2534273 - RNA, 17 nt, Chlamydophila pneumoniae CWL029
cucucuuuaaaaauaua

SEQ ID NO: 2534274 - RNA, 23 nt, Chlamydophila pneumoniae CWL029
cucucuuuaaaaauauaucuuca

SEQ ID NO: 2534275 - RNA, 15 nt, Chlamydophila pneumoniae CWL029
cucucuuuaucuuua

SEQ ID NO: 2534276 - RNA, 13 nt, Chlamydophila pneumoniae CWL029
cucugaacaggaa

SEQ ID NO: 2534277 - RNA, 20 nt, Chlamydophila pneumoniae CWL029
cucugaagaccccucuugcu

SEQ ID NO: 2534278 - RNA, 23 nt, Chlamydophila pneumoniae CWL029
cucugaagaccccucuugcuuuu

SEQ ID NO: 2534279 - RNA, 12 nt, Chlamydophila pneumoniae CWL029
cucugaaggauu

SEQ ID NO: 2534280 - RNA, 14 nt, Chlamydophila pneumoniae CWL029
cucugaccaucaau

SEQ ID NO: 2534281 - RNA, 22 nt, Chlamydophila pneumoniae CWL029
cucugaccaucaaugagaucug

SEQ ID NO: 2534282 - RNA, 21 nt, Chlamydophila pneumoniae CWL029
cucugacuugcaagcuucuug

SEQ ID NO: 2534283 - RNA, 15 nt, Chlamydophila pneumoniae CWL029
cucugagcagcuucg

SEQ ID NO: 2534284 - RNA, 18 nt, Chlamydophila pneumoniae CWL029
cucugagucgacaugcag

SEQ ID NO: 2534285 - RNA, 12 nt, Chlamydophila pneumoniae CWL029
cucugcagggaa

SEQ ID NO: 2534286 - RNA, 14 nt, Chlamydophila pneumoniae CWL029
cucugcagggaauc

SEQ ID NO: 2534287 - RNA, 13 nt, Chlamydophila pneumoniae CWL029
cucugcauauaaa

SEQ ID NO: 2534288 - RNA, 16 nt, Chlamydophila pneumoniae CWL029
cucugcauauugcucu

SEQ ID NO: 2534289 - RNA, 22 nt, Chlamydophila pneumoniae CWL029
cucugcauguugcaaagcauga

SEQ ID NO: 2534290 - RNA, 19 nt, Chlamydophila pneumoniae CWL029
cucugccaugucuaaagga

SEQ ID NO: 2534291 - RNA, 20 nt, Chlamydophila pneumoniae CWL029
cucugccaugucuaaaggag

SEQ ID NO: 2534292 - RNA, 21 nt, Chlamydophila pneumoniae CWL029
cucugccaugucuaaaggagu

SEQ ID NO: 2534293 - RNA, 15 nt, Chlamydophila pneumoniae CWL029
cucugccuaccaaag

SEQ ID NO: 2534294 - RNA, 20 nt, Chlamydophila pneumoniae CWL029
cucuguaagaacguggggaa

SEQ ID NO: 2534295 - RNA, 18 nt, Chlamydophila pneumoniae CWL029
cucuguaguaaagccaca

SEQ ID NO: 2534296 - RNA, 18 nt, Chlamydophila pneumoniae CWL029
cucuguauuggaaaguau

SEQ ID NO: 2534297 - RNA, 20 nt, Chlamydophila pneumoniae CWL029
cucugugccaucuguagacc

SEQ ID NO: 2534298 - RNA, 16 nt, Chlamydophila pneumoniae CWL029
cucugugguuccugga

SEQ ID NO: 2534299 - RNA, 23 nt, Chlamydophila pneumoniae CWL029
cucugugguuccuggauuuagga

SEQ ID NO: 2534300 - RNA, 23 nt, Chlamydophila pneumoniae CWL029
cucugugguuuuuauucuuaaug

SEQ ID NO: 2534301 - RNA, 22 nt, Chlamydophila pneumoniae CWL029
cucuguugggagcuuccuccaa

SEQ ID NO: 2534302 - RNA, 14 nt, Chlamydophila pneumoniae CWL029
cucuguuuccuugu

SEQ ID NO: 2534303 - RNA, 17 nt, Chlamydophila pneumoniae CWL029
cucuuaaaauauuaaau

SEQ ID NO: 2534304 - RNA, 23 nt, Chlamydophila pneumoniae CWL029
cucuuaaaugugaaaucguaucu

SEQ ID NO: 2534305 - RNA, 14 nt, Chlamydophila pneumoniae CWL029
cucuuaauuaaaaa

SEQ ID NO: 2534306 - RNA, 23 nt, Chlamydophila pneumoniae CWL029
cucuuaucgugacucuuaucugg

SEQ ID NO: 2534307 - RNA, 15 nt, Chlamydophila pneumoniae CWL029
cucuuauguuaaaaa

SEQ ID NO: 2534308 - RNA, 17 nt, Chlamydophila pneumoniae CWL029
cucuucaaagacaggcu

SEQ ID NO: 2534309 - RNA, 14 nt, Chlamydophila pneumoniae CWL029
cucuucaagagcuu

SEQ ID NO: 2534310 - RNA, 22 nt, Chlamydophila pneumoniae CWL029
cucuucacuauuaggcuuuuuu

SEQ ID NO: 2534311 - RNA, 14 nt, Chlamydophila pneumoniae CWL029
cucuucauuuucuu

SEQ ID NO: 2534312 - RNA, 13 nt, Chlamydophila pneumoniae CWL029
cucuuccaaaagu

SEQ ID NO: 2534313 - RNA, 15 nt, Chlamydophila pneumoniae CWL029
cucuucccuuguuau

SEQ ID NO: 2534314 - RNA, 15 nt, Chlamydophila pneumoniae CWL029
cucuuccugcugcuu

SEQ ID NO: 2534315 - RNA, 15 nt, Chlamydophila pneumoniae CWL029
cucuuccuucuauug

SEQ ID NO: 2534316 - RNA, 21 nt, Chlamydophila pneumoniae CWL029
cucuucgcuggcauguuuaau

SEQ ID NO: 2534317 - RNA, 15 nt, Chlamydophila pneumoniae CWL029
cucuucuacuuuaag

SEQ ID NO: 2534318 - RNA, 23 nt, Chlamydophila pneumoniae CWL029
cucuucuacuuuaagaagcacuu

SEQ ID NO: 2534319 - RNA, 20 nt, Chlamydophila pneumoniae CWL029
cucuucuauguguucucgaa

SEQ ID NO: 2534320 - RNA, 13 nt, Chlamydophila pneumoniae CWL029
cucuucucuauaa

SEQ ID NO: 2534321 - RNA, 16 nt, Chlamydophila pneumoniae CWL029
cucuucucuauaaaaa

SEQ ID NO: 2534322 - RNA, 12 nt, Chlamydophila pneumoniae CWL029
cucuucugcagc

SEQ ID NO: 2534323 - RNA, 14 nt, Chlamydophila pneumoniae CWL029
cucuugaggaccuu

SEQ ID NO: 2534324 - RNA, 20 nt, Chlamydophila pneumoniae CWL029
cucuugcgucacauuuguug

SEQ ID NO: 2534325 - RNA, 22 nt, Chlamydophila pneumoniae CWL029
cucuugcgucacauuuguuguc

SEQ ID NO: 2534326 - RNA, 15 nt, Chlamydophila pneumoniae CWL029
cucuuggaugaccuu

SEQ ID NO: 2534327 - RNA, 20 nt, Chlamydophila pneumoniae CWL029
cucuuuaaaaauagaaauaa

SEQ ID NO: 2534328 - RNA, 21 nt, Chlamydophila pneumoniae CWL029
cucuuuaaaaauuaaagugaa

SEQ ID NO: 2534329 - RNA, 13 nt, Chlamydophila pneumoniae CWL029
cucuuuaaaaggg

SEQ ID NO: 2534330 - RNA, 22 nt, Chlamydophila pneumoniae CWL029
cucuuuaaaagggcgcuucccu

SEQ ID NO: 2534331 - RNA, 18 nt, Chlamydophila pneumoniae CWL029
cucuuuaaauguugggau

SEQ ID NO: 2534332 - RNA, 19 nt, Chlamydophila pneumoniae CWL029
cucuuuaagcaagagcucc

SEQ ID NO: 2534333 - RNA, 21 nt, Chlamydophila pneumoniae CWL029
cucuuuagcaaacauuuuuau

SEQ ID NO: 2534334 - RNA, 16 nt, Chlamydophila pneumoniae CWL029
cucuuuauauuuuuug

SEQ ID NO: 2534335 - RNA, 20 nt, Chlamydophila pneumoniae CWL029
cucuuuauauuuuuugagaa

SEQ ID NO: 2534336 - RNA, 14 nt, Chlamydophila pneumoniae CWL029
cucuuucagcucaa

SEQ ID NO: 2534337 - RNA, 16 nt, Chlamydophila pneumoniae CWL029
cucuuucagcucaagu

SEQ ID NO: 2534338 - RNA, 20 nt, Chlamydophila pneumoniae CWL029
cucuuucauacuaaaaucuu

SEQ ID NO: 2534339 - RNA, 16 nt, Chlamydophila pneumoniae CWL029
cucuuuccuuagcauu

SEQ ID NO: 2534340 - RNA, 16 nt, Chlamydophila pneumoniae CWL029
cucuuucuaaaacauc

SEQ ID NO: 2534341 - RNA, 15 nt, Chlamydophila pneumoniae CWL029
cucuuuuaaagugag

SEQ ID NO: 2534342 - RNA, 18 nt, Chlamydophila pneumoniae CWL029
cucuuuuagagccuuuuc

SEQ ID NO: 2534343 - RNA, 15 nt, Chlamydophila pneumoniae CWL029
cugaaaguacgcaua

SEQ ID NO: 2534344 - RNA, 15 nt, Chlamydophila pneumoniae CWL029
cugaaauccugggca

SEQ ID NO: 2534345 - RNA, 16 nt, Chlamydophila pneumoniae CWL029
cugaaauuaagucaca

SEQ ID NO: 2534346 - RNA, 18 nt, Chlamydophila pneumoniae CWL029
cugaaauugucuucagug

SEQ ID NO: 2534347 - RNA, 15 nt, Chlamydophila pneumoniae CWL029
cugaacaucuccagc

SEQ ID NO: 2534348 - RNA, 23 nt, Chlamydophila pneumoniae CWL029
cugaaccgcaaaaagcuucuuuc

SEQ ID NO: 2534349 - RNA, 16 nt, Chlamydophila pneumoniae CWL029
cugaacuugauuuguu

SEQ ID NO: 2534350 - RNA, 15 nt, Chlamydophila pneumoniae CWL029
cugaagaggccugca

SEQ ID NO: 2534351 - RNA, 20 nt, Chlamydophila pneumoniae CWL029
cugaagauauauuuuuaaag

SEQ ID NO: 2534352 - RNA, 21 nt, Chlamydophila pneumoniae CWL029
cugaagauauauuuuuaaaga

SEQ ID NO: 2534353 - RNA, 14 nt, Chlamydophila pneumoniae CWL029
cugaagaugagaaa

SEQ ID NO: 2534354 - RNA, 24 nt, Chlamydophila pneumoniae CWL029
cugaagcagcuucugcaggauuug

SEQ ID NO: 2534355 - RNA, 16 nt, Chlamydophila pneumoniae CWL029
cugaagccaugacaaa

SEQ ID NO: 2534356 - RNA, 12 nt, Chlamydophila pneumoniae CWL029
cugaagcugcaa

SEQ ID NO: 2534357 - RNA, 15 nt, Chlamydophila pneumoniae CWL029
cugaagcugcaaacu

SEQ ID NO: 2534358 - RNA, 17 nt, Chlamydophila pneumoniae CWL029
cugaagcugcaaacuga

SEQ ID NO: 2534359 - RNA, 16 nt, Chlamydophila pneumoniae CWL029
cugaagggacagucuc

SEQ ID NO: 2534360 - RNA, 17 nt, Chlamydophila pneumoniae CWL029
cugaauaccguuucagg

SEQ ID NO: 2534361 - RNA, 15 nt, Chlamydophila pneumoniae CWL029
cugaauagcucuuuu

SEQ ID NO: 2534362 - RNA, 17 nt, Chlamydophila pneumoniae CWL029
cugaauagcucuuuuca

SEQ ID NO: 2534363 - RNA, 22 nt, Chlamydophila pneumoniae CWL029
cugaauagcucuuuucaugaua

SEQ ID NO: 2534364 - RNA, 20 nt, Chlamydophila pneumoniae CWL029
cugaauauaguuuaaauguc

SEQ ID NO: 2534365 - RNA, 18 nt, Chlamydophila pneumoniae CWL029
cugaauaugcuuuucaaa

SEQ ID NO: 2534366 - RNA, 20 nt, Chlamydophila pneumoniae CWL029
cugaaucagcuuaucuauag

SEQ ID NO: 2534367 - RNA, 18 nt, Chlamydophila pneumoniae CWL029
cugaaucccguuaaaaaa

SEQ ID NO: 2534368 - RNA, 15 nt, Chlamydophila pneumoniae CWL029
cugaauguaacucca

SEQ ID NO: 2534369 - RNA, 19 nt, Chlamydophila pneumoniae CWL029
cugaauguaacuccagagc

SEQ ID NO: 2534370 - RNA, 17 nt, Chlamydophila pneumoniae CWL029
cugacaaauagaaagga

SEQ ID NO: 2534371 - RNA, 15 nt, Chlamydophila pneumoniae CWL029
cugacacagagcuuc

SEQ ID NO: 2534372 - RNA, 18 nt, Chlamydophila pneumoniae CWL029
cugacacucagcucccau

SEQ ID NO: 2534373 - RNA, 19 nt, Chlamydophila pneumoniae CWL029
cugacagcuccauuuaaau

SEQ ID NO: 2534374 - RNA, 23 nt, Chlamydophila pneumoniae CWL029
cugacgugcauugaauccuucua

SEQ ID NO: 2534375 - RNA, 22 nt, Chlamydophila pneumoniae CWL029
cugacguuguguagcugaaauc

SEQ ID NO: 2534376 - RNA, 15 nt, Chlamydophila pneumoniae CWL029
cugacuauaaaaugc

SEQ ID NO: 2534377 - RNA, 22 nt, Chlamydophila pneumoniae CWL029
cugacuauagggagacucuuga

SEQ ID NO: 2534378 - RNA, 20 nt, Chlamydophila pneumoniae CWL029
cugacucuuauugcagaauc

SEQ ID NO: 2534379 - RNA, 19 nt, Chlamydophila pneumoniae CWL029
cugacucuuuuaagacaau

SEQ ID NO: 2534380 - RNA, 14 nt, Chlamydophila pneumoniae CWL029
cugacugcauagac

SEQ ID NO: 2534381 - RNA, 15 nt, Chlamydophila pneumoniae CWL029
cugagaaagaagucc

SEQ ID NO: 2534382 - RNA, 15 nt, Chlamydophila pneumoniae CWL029
cugagaaguuaagac

SEQ ID NO: 2534383 - RNA, 13 nt, Chlamydophila pneumoniae CWL029
cugagaauacaac

SEQ ID NO: 2534384 - RNA, 18 nt, Chlamydophila pneumoniae CWL029
cugagaauacaacccuuu

SEQ ID NO: 2534385 - RNA, 23 nt, Chlamydophila pneumoniae CWL029
cugagaauacaacccuuuauacu

SEQ ID NO: 2534386 - RNA, 23 nt, Chlamydophila pneumoniae CWL029
cugagacauauugaagauauuau

SEQ ID NO: 2534387 - RNA, 16 nt, Chlamydophila pneumoniae CWL029
cugagaccauaaaauc

SEQ ID NO: 2534388 - RNA, 19 nt, Chlamydophila pneumoniae CWL029
cugagaccauaaaaucaac

SEQ ID NO: 2534389 - RNA, 17 nt, Chlamydophila pneumoniae CWL029
cugagaccauacacaaa

SEQ ID NO: 2534390 - RNA, 12 nt, Chlamydophila pneumoniae CWL029
cugagagaagca

SEQ ID NO: 2534391 - RNA, 17 nt, Chlamydophila pneumoniae CWL029
cugagagauuuuuucau

SEQ ID NO: 2534392 - RNA, 17 nt, Chlamydophila pneumoniae CWL029
cugagcacgaguucucc

SEQ ID NO: 2534393 - RNA, 13 nt, Chlamydophila pneumoniae CWL029
cugagcagcuucg

SEQ ID NO: 2534394 - RNA, 16 nt, Chlamydophila pneumoniae CWL029
cugagcuaucuucaag

SEQ ID NO: 2534395 - RNA, 23 nt, Chlamydophila pneumoniae CWL029
cugagcuuuuaguagguaauccc

SEQ ID NO: 2534396 - RNA, 15 nt, Chlamydophila pneumoniae CWL029
cugaggacgcagaga

SEQ ID NO: 2534397 - RNA, 22 nt, Chlamydophila pneumoniae CWL029
cugaggcuauagaauacacagc

SEQ ID NO: 2534398 - RNA, 17 nt, Chlamydophila pneumoniae CWL029
cugagggaucuucucua

SEQ ID NO: 2534399 - RNA, 21 nt, Chlamydophila pneumoniae CWL029
cugagguuauuuaauccaaaa

SEQ ID NO: 2534400 - RNA, 14 nt, Chlamydophila pneumoniae CWL029
cugagguugggcag

SEQ ID NO: 2534401 - RNA, 21 nt, Chlamydophila pneumoniae CWL029
cugaguauuuugcaaaugaaa

SEQ ID NO: 2534402 - RNA, 21 nt, Chlamydophila pneumoniae CWL029
cugagucauaagcucuauuuc

SEQ ID NO: 2534403 - RNA, 16 nt, Chlamydophila pneumoniae CWL029
cugagugauguuugac

SEQ ID NO: 2534404 - RNA, 13 nt, Chlamydophila pneumoniae CWL029
cugauaaaauaaa

SEQ ID NO: 2534405 - RNA, 17 nt, Chlamydophila pneumoniae CWL029
cugauaaaauaaacucu

SEQ ID NO: 2534406 - RNA, 15 nt, Chlamydophila pneumoniae CWL029
cugauaagaucauag

SEQ ID NO: 2534407 - RNA, 20 nt, Chlamydophila pneumoniae CWL029
cugauaaucagaggagccuc

SEQ ID NO: 2534408 - RNA, 21 nt, Chlamydophila pneumoniae CWL029
cugauagccuccauuuagaca

SEQ ID NO: 2534409 - RNA, 16 nt, Chlamydophila pneumoniae CWL029
cugaucccucaaaauc

SEQ ID NO: 2534410 - RNA, 15 nt, Chlamydophila pneumoniae CWL029
cugaucccuuagaaa

SEQ ID NO: 2534411 - RNA, 21 nt, Chlamydophila pneumoniae CWL029
cugauccucggcaucuuuggc

SEQ ID NO: 2534412 - RNA, 16 nt, Chlamydophila pneumoniae CWL029
cugaugaaaaagcuga

SEQ ID NO: 2534413 - RNA, 14 nt, Chlamydophila pneumoniae CWL029
cugaugaccucauc

SEQ ID NO: 2534414 - RNA, 16 nt, Chlamydophila pneumoniae CWL029
cugaugaccucaucuc

SEQ ID NO: 2534415 - RNA, 22 nt, Chlamydophila pneumoniae CWL029
cugaugccaagaaauauacugc

SEQ ID NO: 2534416 - RNA, 16 nt, Chlamydophila pneumoniae CWL029
cugaugccuuuuucuu

SEQ ID NO: 2534417 - RNA, 21 nt, Chlamydophila pneumoniae CWL029
cugauguaggugauauuuucu

SEQ ID NO: 2534418 - RNA, 17 nt, Chlamydophila pneumoniae CWL029
cugaugucuccauacag

SEQ ID NO: 2534419 - RNA, 22 nt, Chlamydophila pneumoniae CWL029
cugauguugcccuacaauuucc

SEQ ID NO: 2534420 - RNA, 17 nt, Chlamydophila pneumoniae CWL029
cugauguuuuauagaua

SEQ ID NO: 2534421 - RNA, 14 nt, Chlamydophila pneumoniae CWL029
cugauucaauugag

SEQ ID NO: 2534422 - RNA, 23 nt, Chlamydophila pneumoniae CWL029
cugauuccauccugucuauuucu

SEQ ID NO: 2534423 - RNA, 12 nt, Chlamydophila pneumoniae CWL029
cugauucuccca

SEQ ID NO: 2534424 - RNA, 13 nt, Chlamydophila pneumoniae CWL029
cugauucucccaa

SEQ ID NO: 2534425 - RNA, 19 nt, Chlamydophila pneumoniae CWL029
cugauucucccaauaucca

SEQ ID NO: 2534426 - RNA, 22 nt, Chlamydophila pneumoniae CWL029
cugauucucccaauauccagaa

SEQ ID NO: 2534427 - RNA, 23 nt, Chlamydophila pneumoniae CWL029
cugauucuccgucccccggcucu

SEQ ID NO: 2534428 - RNA, 18 nt, Chlamydophila pneumoniae CWL029
cugauucuguauaaacaa

SEQ ID NO: 2534429 - RNA, 18 nt, Chlamydophila pneumoniae CWL029
cugauugagaauaaaacu

SEQ ID NO: 2534430 - RNA, 20 nt, Chlamydophila pneumoniae CWL029
cugauuuuucaagaccuaag

SEQ ID NO: 2534431 - RNA, 19 nt, Chlamydophila pneumoniae CWL029
cugcaaaaaguuucaaucu

SEQ ID NO: 2534432 - RNA, 23 nt, Chlamydophila pneumoniae CWL029
cugcaaucagugcugccaugaca

SEQ ID NO: 2534433 - RNA, 14 nt, Chlamydophila pneumoniae CWL029
cugcacaguucaca

SEQ ID NO: 2534434 - RNA, 20 nt, Chlamydophila pneumoniae CWL029
cugcacgaucgcgauaagaa

SEQ ID NO: 2534435 - RNA, 23 nt, Chlamydophila pneumoniae CWL029
cugcacgaucgcgauaagaagcu

SEQ ID NO: 2534436 - RNA, 20 nt, Chlamydophila pneumoniae CWL029
cugcacguggcuuuuguauu

SEQ ID NO: 2534437 - RNA, 17 nt, Chlamydophila pneumoniae CWL029
cugcagagaaauucaug

SEQ ID NO: 2534438 - RNA, 12 nt, Chlamydophila pneumoniae CWL029
cugcagcaaaac

SEQ ID NO: 2534439 - RNA, 23 nt, Chlamydophila pneumoniae CWL029
cugcagcagccuuggcucuagaa

SEQ ID NO: 2534440 - RNA, 19 nt, Chlamydophila pneumoniae CWL029
cugcagcaggugucagacu

SEQ ID NO: 2534441 - RNA, 19 nt, Chlamydophila pneumoniae CWL029
cugcagcguuucuagggac

SEQ ID NO: 2534442 - RNA, 18 nt, Chlamydophila pneumoniae CWL029
cugcauaaucucaccaga

SEQ ID NO: 2534443 - RNA, 20 nt, Chlamydophila pneumoniae CWL029
cugcauaaucucaccagaag

SEQ ID NO: 2534444 - RNA, 15 nt, Chlamydophila pneumoniae CWL029
cugcauaauuuuucu

SEQ ID NO: 2534445 - RNA, 16 nt, Chlamydophila pneumoniae CWL029
cugcauaauuuuucuu

SEQ ID NO: 2534446 - RNA, 13 nt, Chlamydophila pneumoniae CWL029
cugcaugaauaua

SEQ ID NO: 2534447 - RNA, 18 nt, Chlamydophila pneumoniae CWL029
cugcauggcuuugugagc

SEQ ID NO: 2534448 - RNA, 14 nt, Chlamydophila pneumoniae CWL029
cugcauguugcaaa

SEQ ID NO: 2534449 - RNA, 13 nt, Chlamydophila pneumoniae CWL029
cugcauuccagga

SEQ ID NO: 2534450 - RNA, 19 nt, Chlamydophila pneumoniae CWL029
cugccagugacauaaucac

SEQ ID NO: 2534451 - RNA, 23 nt, Chlamydophila pneumoniae CWL029
cugcccauuuuuggaaaaccaug

SEQ ID NO: 2534452 - RNA, 16 nt, Chlamydophila pneumoniae CWL029
cugcccgucuuagaau

SEQ ID NO: 2534453 - RNA, 15 nt, Chlamydophila pneumoniae CWL029
cugcccuuucugcaa

SEQ ID NO: 2534454 - RNA, 15 nt, Chlamydophila pneumoniae CWL029
cugccucacagcuaa

SEQ ID NO: 2534455 - RNA, 22 nt, Chlamydophila pneumoniae CWL029
cugcgacacgaauuucuaacuu

SEQ ID NO: 2534456 - RNA, 15 nt, Chlamydophila pneumoniae CWL029
cugcgccaugcacaa

SEQ ID NO: 2534457 - RNA, 17 nt, Chlamydophila pneumoniae CWL029
cugcgcuagcuccagca

SEQ ID NO: 2534458 - RNA, 15 nt, Chlamydophila pneumoniae CWL029
cugcggaaggcuaaa

SEQ ID NO: 2534459 - RNA, 16 nt, Chlamydophila pneumoniae CWL029
cugcgguagccuggag

SEQ ID NO: 2534460 - RNA, 13 nt, Chlamydophila pneumoniae CWL029
cugcgucaauaag

SEQ ID NO: 2534461 - RNA, 17 nt, Chlamydophila pneumoniae CWL029
cugcgucaauaagcuug

SEQ ID NO: 2534462 - RNA, 20 nt, Chlamydophila pneumoniae CWL029
cugcgucaauaagcuugcca

SEQ ID NO: 2534463 - RNA, 12 nt, Chlamydophila pneumoniae CWL029
cugcgugacgug

SEQ ID NO: 2534464 - RNA, 17 nt, Chlamydophila pneumoniae CWL029
cugcgugauuauuuaag

SEQ ID NO: 2534465 - RNA, 20 nt, Chlamydophila pneumoniae CWL029
cugcguuaaacccuucaagc

SEQ ID NO: 2534466 - RNA, 16 nt, Chlamydophila pneumoniae CWL029
cugcguuucuuucuga

SEQ ID NO: 2534467 - RNA, 15 nt, Chlamydophila pneumoniae CWL029
cugcuaaacagggaa

SEQ ID NO: 2534468 - RNA, 18 nt, Chlamydophila pneumoniae CWL029
cugcuaaacuuuuuuuca

SEQ ID NO: 2534469 - RNA, 12 nt, Chlamydophila pneumoniae CWL029
cugcuagagcuu

SEQ ID NO: 2534470 - RNA, 23 nt, Chlamydophila pneumoniae CWL029
cugcuagagcuuucagaaaagaa

SEQ ID NO: 2534471 - RNA, 19 nt, Chlamydophila pneumoniae CWL029
cugcuagaguccaagguuc

SEQ ID NO: 2534472 - RNA, 14 nt, Chlamydophila pneumoniae CWL029
cugcucaaugacac

SEQ ID NO: 2534473 - RNA, 12 nt, Chlamydophila pneumoniae CWL029
cugcuccaaaau

SEQ ID NO: 2534474 - RNA, 14 nt, Chlamydophila pneumoniae CWL029
cugcuccaaaaugg

SEQ ID NO: 2534475 - RNA, 11 nt, Chlamydophila pneumoniae CWL029
cugcuccugaa

SEQ ID NO: 2534476 - RNA, 22 nt, Chlamydophila pneumoniae CWL029
cugcucuauagcauuauucccu

SEQ ID NO: 2534477 - RNA, 22 nt, Chlamydophila pneumoniae CWL029
cugcucuauauauccugaguga

SEQ ID NO: 2534478 - RNA, 13 nt, Chlamydophila pneumoniae CWL029
cugcugaaaucau

SEQ ID NO: 2534479 - RNA, 15 nt, Chlamydophila pneumoniae CWL029
cugcugagcagcaaa

SEQ ID NO: 2534480 - RNA, 20 nt, Chlamydophila pneumoniae CWL029
cugcugaggagaguaagguc

SEQ ID NO: 2534481 - RNA, 16 nt, Chlamydophila pneumoniae CWL029
cugcugcuaagccaaa

SEQ ID NO: 2534482 - RNA, 14 nt, Chlamydophila pneumoniae CWL029
cugcugcuuugaca

SEQ ID NO: 2534483 - RNA, 19 nt, Chlamydophila pneumoniae CWL029
cugcuuacaauugaaaauu

SEQ ID NO: 2534484 - RNA, 22 nt, Chlamydophila pneumoniae CWL029
cugcuucaaaacauaaccuccu

SEQ ID NO: 2534485 - RNA, 17 nt, Chlamydophila pneumoniae CWL029
cugcuucuauagagaca

SEQ ID NO: 2534486 - RNA, 12 nt, Chlamydophila pneumoniae CWL029
cugcuucuccaa

SEQ ID NO: 2534487 - RNA, 15 nt, Chlamydophila pneumoniae CWL029
cugcuugugaggcua

SEQ ID NO: 2534488 - RNA, 22 nt, Chlamydophila pneumoniae CWL029
cugcuugugaggcuauagcaua

SEQ ID NO: 2534489 - RNA, 24 nt, Chlamydophila pneumoniae CWL029
cugcuuugacgacucugccauguc

SEQ ID NO: 2534490 - RNA, 21 nt, Chlamydophila pneumoniae CWL029
cugcuuuuguuguuuuugcug

SEQ ID NO: 2534491 - RNA, 19 nt, Chlamydophila pneumoniae CWL029
cugcuuuuuugaucugaag

SEQ ID NO: 2534492 - RNA, 15 nt, Chlamydophila pneumoniae CWL029
cugcuuuuuuucuag

SEQ ID NO: 2534493 - RNA, 14 nt, Chlamydophila pneumoniae CWL029
cuggaaagccaagc

SEQ ID NO: 2534494 - RNA, 22 nt, Chlamydophila pneumoniae CWL029
cuggaaagccaagcuuccaacu

SEQ ID NO: 2534495 - RNA, 21 nt, Chlamydophila pneumoniae CWL029
cuggagaaugccccuucguua

SEQ ID NO: 2534496 - RNA, 21 nt, Chlamydophila pneumoniae CWL029
cuggagacaacuauguuaucc

SEQ ID NO: 2534497 - RNA, 17 nt, Chlamydophila pneumoniae CWL029
cuggaggcuguguaaaa

SEQ ID NO: 2534498 - RNA, 15 nt, Chlamydophila pneumoniae CWL029
cuggaguagcucaau

SEQ ID NO: 2534499 - RNA, 16 nt, Chlamydophila pneumoniae CWL029
cuggaguggaggauac

SEQ ID NO: 2534500 - RNA, 18 nt, Chlamydophila pneumoniae CWL029
cuggauugauccacagau

SEQ ID NO: 2534501 - RNA, 20 nt, Chlamydophila pneumoniae CWL029
cuggcaaucuaaaaucacac

SEQ ID NO: 2534502 - RNA, 13 nt, Chlamydophila pneumoniae CWL029
cuggccaucauca

SEQ ID NO: 2534503 - RNA, 13 nt, Chlamydophila pneumoniae CWL029
cuggcuaaaggau

SEQ ID NO: 2534504 - RNA, 20 nt, Chlamydophila pneumoniae CWL029
cuggcuaaaggaucauuaaa

SEQ ID NO: 2534505 - RNA, 18 nt, Chlamydophila pneumoniae CWL029
cuggcuccuaaacucaau

SEQ ID NO: 2534506 - RNA, 20 nt, Chlamydophila pneumoniae CWL029
cuggcuccuaaacucaauua

SEQ ID NO: 2534507 - RNA, 13 nt, Chlamydophila pneumoniae CWL029
cugggaagaccac

SEQ ID NO: 2534508 - RNA, 17 nt, Chlamydophila pneumoniae CWL029
cugggaagaccacgaaa

SEQ ID NO: 2534509 - RNA, 15 nt, Chlamydophila pneumoniae CWL029
cugggaagacucuca

SEQ ID NO: 2534510 - RNA, 19 nt, Chlamydophila pneumoniae CWL029
cugggaaggggagauuccc

SEQ ID NO: 2534511 - RNA, 20 nt, Chlamydophila pneumoniae CWL029
cugggaauucuuuuccugca

SEQ ID NO: 2534512 - RNA, 18 nt, Chlamydophila pneumoniae CWL029
cugggaauuguucuugaa

SEQ ID NO: 2534513 - RNA, 14 nt, Chlamydophila pneumoniae CWL029
cugggauucguaau

SEQ ID NO: 2534514 - RNA, 16 nt, Chlamydophila pneumoniae CWL029
cugggcgucuucuucg

SEQ ID NO: 2534515 - RNA, 19 nt, Chlamydophila pneumoniae CWL029
cugggcuuauuauugaaua

SEQ ID NO: 2534516 - RNA, 20 nt, Chlamydophila pneumoniae CWL029
cugggggagcuagaaagucc

SEQ ID NO: 2534517 - RNA, 21 nt, Chlamydophila pneumoniae CWL029
cuggguaaguccacaagccuc

SEQ ID NO: 2534518 - RNA, 21 nt, Chlamydophila pneumoniae CWL029
cuggguucuccacaugcccaa

SEQ ID NO: 2534519 - RNA, 19 nt, Chlamydophila pneumoniae CWL029
cugguaaaggauauugaua

SEQ ID NO: 2534520 - RNA, 17 nt, Chlamydophila pneumoniae CWL029
cugguacuuauguacug

SEQ ID NO: 2534521 - RNA, 17 nt, Chlamydophila pneumoniae CWL029
cugguauagacuccuua

SEQ ID NO: 2534522 - RNA, 18 nt, Chlamydophila pneumoniae CWL029
cugguccuaaaaaaagac

SEQ ID NO: 2534523 - RNA, 16 nt, Chlamydophila pneumoniae CWL029
cuggucuccagaagca

SEQ ID NO: 2534524 - RNA, 19 nt, Chlamydophila pneumoniae CWL029
cuggucuguauuuucuuca

SEQ ID NO: 2534525 - RNA, 21 nt, Chlamydophila pneumoniae CWL029
cugguuaagcaccauaaugga

SEQ ID NO: 2534526 - RNA, 15 nt, Chlamydophila pneumoniae CWL029
cugguuuuucgauuu

SEQ ID NO: 2534527 - RNA, 17 nt, Chlamydophila pneumoniae CWL029
cugguuuuucuccugac

SEQ ID NO: 2534528 - RNA, 15 nt, Chlamydophila pneumoniae CWL029
cuguaaagaccaaau

SEQ ID NO: 2534529 - RNA, 21 nt, Chlamydophila pneumoniae CWL029
cuguaaagaccaaauagagag

SEQ ID NO: 2534530 - RNA, 13 nt, Chlamydophila pneumoniae CWL029
cuguaaagauucu

SEQ ID NO: 2534531 - RNA, 12 nt, Chlamydophila pneumoniae CWL029
cuguaaauccgg

SEQ ID NO: 2534532 - RNA, 15 nt, Chlamydophila pneumoniae CWL029
cuguaacacuuccua

SEQ ID NO: 2534533 - RNA, 23 nt, Chlamydophila pneumoniae CWL029
cuguaauuuuuuucaaaggagaa

SEQ ID NO: 2534534 - RNA, 16 nt, Chlamydophila pneumoniae CWL029
cuguaccacauacucu

SEQ ID NO: 2534535 - RNA, 16 nt, Chlamydophila pneumoniae CWL029
cuguacgguaaaucca

SEQ ID NO: 2534536 - RNA, 14 nt, Chlamydophila pneumoniae CWL029
cuguacuuccccaa

SEQ ID NO: 2534537 - RNA, 21 nt, Chlamydophila pneumoniae CWL029
cuguagagcgcccgaaucuuu

SEQ ID NO: 2534538 - RNA, 13 nt, Chlamydophila pneumoniae CWL029
cuguagauuuucc

SEQ ID NO: 2534539 - RNA, 18 nt, Chlamydophila pneumoniae CWL029
cuguagccacuaaguuua

SEQ ID NO: 2534540 - RNA, 22 nt, Chlamydophila pneumoniae CWL029
cuguagguuuuuccaacuucaa

SEQ ID NO: 2534541 - RNA, 19 nt, Chlamydophila pneumoniae CWL029
cuguaguuagcauugcuug

SEQ ID NO: 2534542 - RNA, 19 nt, Chlamydophila pneumoniae CWL029
cuguaucgacuguacaaau

SEQ ID NO: 2534543 - RNA, 21 nt, Chlamydophila pneumoniae CWL029
cuguaucgauaacgauuucuu

SEQ ID NO: 2534544 - RNA, 21 nt, Chlamydophila pneumoniae CWL029
cuguaucgauaguuuuugcug

SEQ ID NO: 2534545 - RNA, 21 nt, Chlamydophila pneumoniae CWL029
cugucacuagagaaaaagccc

SEQ ID NO: 2534546 - RNA, 15 nt, Chlamydophila pneumoniae CWL029
cugucacuaucuucu

SEQ ID NO: 2534547 - RNA, 17 nt, Chlamydophila pneumoniae CWL029
cugucacuaucuucuaa

SEQ ID NO: 2534548 - RNA, 15 nt, Chlamydophila pneumoniae CWL029
cugucagaacaagaa

SEQ ID NO: 2534549 - RNA, 14 nt, Chlamydophila pneumoniae CWL029
cugucauccuugcg

SEQ ID NO: 2534550 - RNA, 20 nt, Chlamydophila pneumoniae CWL029
cugucauguauccgaaaucu

SEQ ID NO: 2534551 - RNA, 14 nt, Chlamydophila pneumoniae CWL029
cugucauuaaaaau

SEQ ID NO: 2534552 - RNA, 21 nt, Chlamydophila pneumoniae CWL029
cugucauuaaaaauuuaaaag

SEQ ID NO: 2534553 - RNA, 23 nt, Chlamydophila pneumoniae CWL029
cugucauuaaaaauuuaaaagau

SEQ ID NO: 2534554 - RNA, 21 nt, Chlamydophila pneumoniae CWL029
cuguccaacuaaaacagccua

SEQ ID NO: 2534555 - RNA, 14 nt, Chlamydophila pneumoniae CWL029
cuguccauccaaau

SEQ ID NO: 2534556 - RNA, 15 nt, Chlamydophila pneumoniae CWL029
cuguccauccaaaua

SEQ ID NO: 2534557 - RNA, 14 nt, Chlamydophila pneumoniae CWL029
cuguccuccgagaa

SEQ ID NO: 2534558 - RNA, 17 nt, Chlamydophila pneumoniae CWL029
cuguccuugcagcccug

SEQ ID NO: 2534559 - RNA, 16 nt, Chlamydophila pneumoniae CWL029
cugugaggaaaauucc

SEQ ID NO: 2534560 - RNA, 14 nt, Chlamydophila pneumoniae CWL029
cugugauaguagaa

SEQ ID NO: 2534561 - RNA, 12 nt, Chlamydophila pneumoniae CWL029
cugugcauuuuc

SEQ ID NO: 2534562 - RNA, 13 nt, Chlamydophila pneumoniae CWL029
cugugcauuuucu

SEQ ID NO: 2534563 - RNA, 16 nt, Chlamydophila pneumoniae CWL029
cugugcuccauagcau

SEQ ID NO: 2534564 - RNA, 16 nt, Chlamydophila pneumoniae CWL029
cugugguuccuggauu

SEQ ID NO: 2534565 - RNA, 21 nt, Chlamydophila pneumoniae CWL029
cuguguaaaaguuagguagau

SEQ ID NO: 2534566 - RNA, 23 nt, Chlamydophila pneumoniae CWL029
cuguguuuuauccaccaagacug

SEQ ID NO: 2534567 - RNA, 14 nt, Chlamydophila pneumoniae CWL029
cuguguuuucuagu

SEQ ID NO: 2534568 - RNA, 13 nt, Chlamydophila pneumoniae CWL029
cuguuaacucaga

SEQ ID NO: 2534569 - RNA, 18 nt, Chlamydophila pneumoniae CWL029
cuguuccugaguacuuug

SEQ ID NO: 2534570 - RNA, 17 nt, Chlamydophila pneumoniae CWL029
cuguucgauaagaacuu

SEQ ID NO: 2534571 - RNA, 14 nt, Chlamydophila pneumoniae CWL029
cuguugaucuucua

SEQ ID NO: 2534572 - RNA, 15 nt, Chlamydophila pneumoniae CWL029
cuguugcacuuuccg

SEQ ID NO: 2534573 - RNA, 20 nt, Chlamydophila pneumoniae CWL029
cuguuguaauaaaagaaaga

SEQ ID NO: 2534574 - RNA, 21 nt, Chlamydophila pneumoniae CWL029
cuguuguacuaucacagccau

SEQ ID NO: 2534575 - RNA, 23 nt, Chlamydophila pneumoniae CWL029
cuguuguacuaucacagccaucg

SEQ ID NO: 2534576 - RNA, 13 nt, Chlamydophila pneumoniae CWL029
cuguuuacagaug

SEQ ID NO: 2534577 - RNA, 23 nt, Chlamydophila pneumoniae CWL029
cuguuucaacauaacaugagaaa

SEQ ID NO: 2534578 - RNA, 13 nt, Chlamydophila pneumoniae CWL029
cuguuuguuuauu

SEQ ID NO: 2534579 - RNA, 15 nt, Chlamydophila pneumoniae CWL029
cuguuuucuuuucug

SEQ ID NO: 2534580 - RNA, 17 nt, Chlamydophila pneumoniae CWL029
cuguuuuucuuccacac

SEQ ID NO: 2534581 - RNA, 21 nt, Chlamydophila pneumoniae CWL029
cuguuuuucuuccacacaacu

SEQ ID NO: 2534582 - RNA, 15 nt, Chlamydophila pneumoniae CWL029
cuguuuuuugaaaac

SEQ ID NO: 2534583 - RNA, 14 nt, Chlamydophila pneumoniae CWL029
cuuaaaacaugaga

SEQ ID NO: 2534584 - RNA, 19 nt, Chlamydophila pneumoniae CWL029
cuuaaaagagaacauguuu

SEQ ID NO: 2534585 - RNA, 12 nt, Chlamydophila pneumoniae CWL029
cuuaaaauauua

SEQ ID NO: 2534586 - RNA, 20 nt, Chlamydophila pneumoniae CWL029
cuuaaaauucuguaaaguga

SEQ ID NO: 2534587 - RNA, 20 nt, Chlamydophila pneumoniae CWL029
cuuaaagagaaucuccucau

SEQ ID NO: 2534588 - RNA, 12 nt, Chlamydophila pneumoniae CWL029
cuuaaagaguuu

SEQ ID NO: 2534589 - RNA, 11 nt, Chlamydophila pneumoniae CWL029
cuuaacaacau

SEQ ID NO: 2534590 - RNA, 20 nt, Chlamydophila pneumoniae CWL029
cuuaacaacaucacuuauau

SEQ ID NO: 2534591 - RNA, 20 nt, Chlamydophila pneumoniae CWL029
cuuaacaaccgccuuuauau

SEQ ID NO: 2534592 - RNA, 13 nt, Chlamydophila pneumoniae CWL029
cuuaaccuccuca

SEQ ID NO: 2534593 - RNA, 17 nt, Chlamydophila pneumoniae CWL029
cuuaaccuccucaagaa

SEQ ID NO: 2534594 - RNA, 21 nt, Chlamydophila pneumoniae CWL029
cuuaacuggcaaucuaaaauc

SEQ ID NO: 2534595 - RNA, 22 nt, Chlamydophila pneumoniae CWL029
cuuaacuggcaaucuaaaauca

SEQ ID NO: 2534596 - RNA, 22 nt, Chlamydophila pneumoniae CWL029
cuuaacuuuaggcccugacuua

SEQ ID NO: 2534597 - RNA, 20 nt, Chlamydophila pneumoniae CWL029
cuuaagaauaaaauaggaaa

SEQ ID NO: 2534598 - RNA, 22 nt, Chlamydophila pneumoniae CWL029
cuuaagaauaaaauaggaaagu

SEQ ID NO: 2534599 - RNA, 22 nt, Chlamydophila pneumoniae CWL029
cuuaagaguuuuacaucaauga

SEQ ID NO: 2534600 - RNA, 15 nt, Chlamydophila pneumoniae CWL029
cuuaauaauguuuua

SEQ ID NO: 2534601 - RNA, 17 nt, Chlamydophila pneumoniae CWL029
cuuaauaauguuuuaau

SEQ ID NO: 2534602 - RNA, 22 nt, Chlamydophila pneumoniae CWL029
cuuaauagggccauuagcaauc

SEQ ID NO: 2534603 - RNA, 14 nt, Chlamydophila pneumoniae CWL029
cuuaauauaaaaga

SEQ ID NO: 2534604 - RNA, 18 nt, Chlamydophila pneumoniae CWL029
cuuaauauaaaagaagac

SEQ ID NO: 2534605 - RNA, 20 nt, Chlamydophila pneumoniae CWL029
cuuaaugagaguuucuaaug

SEQ ID NO: 2534606 - RNA, 13 nt, Chlamydophila pneumoniae CWL029
cuuaauuaaaaac

SEQ ID NO: 2534607 - RNA, 21 nt, Chlamydophila pneumoniae CWL029
cuuaauuacucgcucugcacg

SEQ ID NO: 2534608 - RNA, 13 nt, Chlamydophila pneumoniae CWL029
cuuaauuuccuuc

SEQ ID NO: 2534609 - RNA, 17 nt, Chlamydophila pneumoniae CWL029
cuuaauuuccuucucca

SEQ ID NO: 2534610 - RNA, 21 nt, Chlamydophila pneumoniae CWL029
cuuacaauuuaaaucugcaag

SEQ ID NO: 2534611 - RNA, 14 nt, Chlamydophila pneumoniae CWL029
cuuacagagaaauu

SEQ ID NO: 2534612 - RNA, 21 nt, Chlamydophila pneumoniae CWL029
cuuacagccaccuuggcuucu

SEQ ID NO: 2534613 - RNA, 16 nt, Chlamydophila pneumoniae CWL029
cuuacauccaauuuug

SEQ ID NO: 2534614 - RNA, 19 nt, Chlamydophila pneumoniae CWL029
cuuacauuggcuuguaccg

SEQ ID NO: 2534615 - RNA, 15 nt, Chlamydophila pneumoniae CWL029
cuuacgaaucuuagc

SEQ ID NO: 2534616 - RNA, 23 nt, Chlamydophila pneumoniae CWL029
cuuacggauacguugguucaaau

SEQ ID NO: 2534617 - RNA, 23 nt, Chlamydophila pneumoniae CWL029
cuuacggccccuggaauuucucc

SEQ ID NO: 2534618 - RNA, 21 nt, Chlamydophila pneumoniae CWL029
cuuacuaaaggugaaaguaca

SEQ ID NO: 2534619 - RNA, 14 nt, Chlamydophila pneumoniae CWL029
cuuacugaagaagu

SEQ ID NO: 2534620 - RNA, 22 nt, Chlamydophila pneumoniae CWL029
cuuacugaagaaguaagcgauu

SEQ ID NO: 2534621 - RNA, 18 nt, Chlamydophila pneumoniae CWL029
cuuagaaucuaagauccu

SEQ ID NO: 2534622 - RNA, 20 nt, Chlamydophila pneumoniae CWL029
cuuagagcgaauguagccaa

SEQ ID NO: 2534623 - RNA, 19 nt, Chlamydophila pneumoniae CWL029
cuuagagucuucgacaagg

SEQ ID NO: 2534624 - RNA, 17 nt, Chlamydophila pneumoniae CWL029
cuuagcaaugaaggcca

SEQ ID NO: 2534625 - RNA, 15 nt, Chlamydophila pneumoniae CWL029
cuuagcagcacccau

SEQ ID NO: 2534626 - RNA, 17 nt, Chlamydophila pneumoniae CWL029
cuuagcauuaggaaagu

SEQ ID NO: 2534627 - RNA, 13 nt, Chlamydophila pneumoniae CWL029
cuuagccccucca

SEQ ID NO: 2534628 - RNA, 16 nt, Chlamydophila pneumoniae CWL029
cuuagccccuccaaca

SEQ ID NO: 2534629 - RNA, 20 nt, Chlamydophila pneumoniae CWL029
cuuaggaggaggcaguagua

SEQ ID NO: 2534630 - RNA, 16 nt, Chlamydophila pneumoniae CWL029
cuuaggauucuuauca

SEQ ID NO: 2534631 - RNA, 20 nt, Chlamydophila pneumoniae CWL029
cuuaggauucuuaucacaaa

SEQ ID NO: 2534632 - RNA, 15 nt, Chlamydophila pneumoniae CWL029
cuuaggguucucaaa

SEQ ID NO: 2534633 - RNA, 21 nt, Chlamydophila pneumoniae CWL029
cuuaguccgguuucuucuacc

SEQ ID NO: 2534634 - RNA, 23 nt, Chlamydophila pneumoniae CWL029
cuuaguccgguuucuucuaccaa

SEQ ID NO: 2534635 - RNA, 12 nt, Chlamydophila pneumoniae CWL029
cuuauaaaaaag

SEQ ID NO: 2534636 - RNA, 13 nt, Chlamydophila pneumoniae CWL029
cuuauacacucca

SEQ ID NO: 2534637 - RNA, 16 nt, Chlamydophila pneumoniae CWL029
cuuauacccacaaaga

SEQ ID NO: 2534638 - RNA, 17 nt, Chlamydophila pneumoniae CWL029
cuuauacccacaaagau

SEQ ID NO: 2534639 - RNA, 20 nt, Chlamydophila pneumoniae CWL029
cuuauacccacaaagaucac

SEQ ID NO: 2534640 - RNA, 17 nt, Chlamydophila pneumoniae CWL029
cuuaucaagagcucgua

SEQ ID NO: 2534641 - RNA, 16 nt, Chlamydophila pneumoniae CWL029
cuuaucccauaaaugu

SEQ ID NO: 2534642 - RNA, 21 nt, Chlamydophila pneumoniae CWL029
cuuauccgucagccuuagcag

SEQ ID NO: 2534643 - RNA, 13 nt, Chlamydophila pneumoniae CWL029
cuuauccuuuuca

SEQ ID NO: 2534644 - RNA, 14 nt, Chlamydophila pneumoniae CWL029
cuuaucuaaagaaa

SEQ ID NO: 2534645 - RNA, 16 nt, Chlamydophila pneumoniae CWL029
cuuaucuaaagaaaug

SEQ ID NO: 2534646 - RNA, 17 nt, Chlamydophila pneumoniae CWL029
cuuaucuaaagaaaugu

SEQ ID NO: 2534647 - RNA, 21 nt, Chlamydophila pneumoniae CWL029
cuuaucuaggucgauauccca

SEQ ID NO: 2534648 - RNA, 19 nt, Chlamydophila pneumoniae CWL029
cuuaucuauagcauuguuu

SEQ ID NO: 2534649 - RNA, 22 nt, Chlamydophila pneumoniae CWL029
cuuaucuugcugcccaaauuga

SEQ ID NO: 2534650 - RNA, 14 nt, Chlamydophila pneumoniae CWL029
cuuaucuuuaaauu

SEQ ID NO: 2534651 - RNA, 22 nt, Chlamydophila pneumoniae CWL029
cuuaugguuuuucaguuguuuc

SEQ ID NO: 2534652 - RNA, 21 nt, Chlamydophila pneumoniae CWL029
cuuauguagauugauccagcc

SEQ ID NO: 2534653 - RNA, 16 nt, Chlamydophila pneumoniae CWL029
cuuauguuaaaaauac

SEQ ID NO: 2534654 - RNA, 17 nt, Chlamydophila pneumoniae CWL029
cuuauuauugaauaagc

SEQ ID NO: 2534655 - RNA, 19 nt, Chlamydophila pneumoniae CWL029
cuuauuauugaauaagcuu

SEQ ID NO: 2534656 - RNA, 17 nt, Chlamydophila pneumoniae CWL029
cuuauugaagucuucuu

SEQ ID NO: 2534657 - RNA, 15 nt, Chlamydophila pneumoniae CWL029
cuuauugcagaaucu

SEQ ID NO: 2534658 - RNA, 13 nt, Chlamydophila pneumoniae CWL029
cuuauuucaaaga

SEQ ID NO: 2534659 - RNA, 14 nt, Chlamydophila pneumoniae CWL029
cuucaaaaaacaac

SEQ ID NO: 2534660 - RNA, 12 nt, Chlamydophila pneumoniae CWL029
cuucaaaaagcu

SEQ ID NO: 2534661 - RNA, 18 nt, Chlamydophila pneumoniae CWL029
cuucaaagucaaauacuu

SEQ ID NO: 2534662 - RNA, 13 nt, Chlamydophila pneumoniae CWL029
cuucaaaugaaau

SEQ ID NO: 2534663 - RNA, 12 nt, Chlamydophila pneumoniae CWL029
cuucaacucuau

SEQ ID NO: 2534664 - RNA, 15 nt, Chlamydophila pneumoniae CWL029
cuucaagaaaugccc

SEQ ID NO: 2534665 - RNA, 19 nt, Chlamydophila pneumoniae CWL029
cuucaagagcuuuuacaaa

SEQ ID NO: 2534666 - RNA, 19 nt, Chlamydophila pneumoniae CWL029
cuucaaggcaucuucuuug

SEQ ID NO: 2534667 - RNA, 23 nt, Chlamydophila pneumoniae CWL029
cuucaaggcaucuucuuugccaa

SEQ ID NO: 2534668 - RNA, 16 nt, Chlamydophila pneumoniae CWL029
cuucaagguacuuuau

SEQ ID NO: 2534669 - RNA, 18 nt, Chlamydophila pneumoniae CWL029
cuucaagucgagaaacaa

SEQ ID NO: 2534670 - RNA, 21 nt, Chlamydophila pneumoniae CWL029
cuucaagucgagaaacaaaau

SEQ ID NO: 2534671 - RNA, 19 nt, Chlamydophila pneumoniae CWL029
cuucaaguuucuuuugcaa

SEQ ID NO: 2534672 - RNA, 22 nt, Chlamydophila pneumoniae CWL029
cuucaaguuucuuuugcaaauc

SEQ ID NO: 2534673 - RNA, 22 nt, Chlamydophila pneumoniae CWL029
cuucaauacgcuagcucuuaaa

SEQ ID NO: 2534674 - RNA, 18 nt, Chlamydophila pneumoniae CWL029
cuucaauccccugcaucu

SEQ ID NO: 2534675 - RNA, 18 nt, Chlamydophila pneumoniae CWL029
cuucaaugacuucuggau

SEQ ID NO: 2534676 - RNA, 15 nt, Chlamydophila pneumoniae CWL029
cuucaaugauguguu

SEQ ID NO: 2534677 - RNA, 17 nt, Chlamydophila pneumoniae CWL029
cuucaaugauuucuuua

SEQ ID NO: 2534678 - RNA, 15 nt, Chlamydophila pneumoniae CWL029
cuucacaaagaacca

SEQ ID NO: 2534679 - RNA, 14 nt, Chlamydophila pneumoniae CWL029
cuucacaagaaaac

SEQ ID NO: 2534680 - RNA, 16 nt, Chlamydophila pneumoniae CWL029
cuucacaaucuaaaua

SEQ ID NO: 2534681 - RNA, 17 nt, Chlamydophila pneumoniae CWL029
cuucacaaucuaaauaa

SEQ ID NO: 2534682 - RNA, 18 nt, Chlamydophila pneumoniae CWL029
cuucacgacauacaucaa

SEQ ID NO: 2534683 - RNA, 21 nt, Chlamydophila pneumoniae CWL029
cuucacuauuaggcuuuuuuc

SEQ ID NO: 2534684 - RNA, 16 nt, Chlamydophila pneumoniae CWL029
cuucacucuuucugua

SEQ ID NO: 2534685 - RNA, 22 nt, Chlamydophila pneumoniae CWL029
cuucacucuuuuauuuuaggaa

SEQ ID NO: 2534686 - RNA, 19 nt, Chlamydophila pneumoniae CWL029
cuucacuuauaagcugcuu

SEQ ID NO: 2534687 - RNA, 11 nt, Chlamydophila pneumoniae CWL029
cuucagagaga

SEQ ID NO: 2534688 - RNA, 16 nt, Chlamydophila pneumoniae CWL029
cuucagagagaacagg

SEQ ID NO: 2534689 - RNA, 20 nt, Chlamydophila pneumoniae CWL029
cuucagauccgauauacuua

SEQ ID NO: 2534690 - RNA, 16 nt, Chlamydophila pneumoniae CWL029
cuucagauuuacagac

SEQ ID NO: 2534691 - RNA, 21 nt, Chlamydophila pneumoniae CWL029
cuucagcacgaauaaagcccu

SEQ ID NO: 2534692 - RNA, 22 nt, Chlamydophila pneumoniae CWL029
cuucagcauagagagaaggaau

SEQ ID NO: 2534693 - RNA, 13 nt, Chlamydophila pneumoniae CWL029
cuucagcuuuuuc

SEQ ID NO: 2534694 - RNA, 16 nt, Chlamydophila pneumoniae CWL029
cuucaggauuacggaa

SEQ ID NO: 2534695 - RNA, 15 nt, Chlamydophila pneumoniae CWL029
cuucaguuguugcuu

SEQ ID NO: 2534696 - RNA, 21 nt, Chlamydophila pneumoniae CWL029
cuucauauaaaacgaucccua

SEQ ID NO: 2534697 - RNA, 16 nt, Chlamydophila pneumoniae CWL029
cuucauaugcucuccc

SEQ ID NO: 2534698 - RNA, 19 nt, Chlamydophila pneumoniae CWL029
cuucaucaaaacauaauga

SEQ ID NO: 2534699 - RNA, 21 nt, Chlamydophila pneumoniae CWL029
cuucaucagaagguaaauuuu

SEQ ID NO: 2534700 - RNA, 15 nt, Chlamydophila pneumoniae CWL029
cuucaucauaacuag

SEQ ID NO: 2534701 - RNA, 11 nt, Chlamydophila pneumoniae CWL029
cuucauccccg

SEQ ID NO: 2534702 - RNA, 21 nt, Chlamydophila pneumoniae CWL029
cuucauccgaagacucaaaga

SEQ ID NO: 2534703 - RNA, 18 nt, Chlamydophila pneumoniae CWL029
cuucaucuucuaaauccc

SEQ ID NO: 2534704 - RNA, 19 nt, Chlamydophila pneumoniae CWL029
cuucaugaaaaaagaauaa

SEQ ID NO: 2534705 - RNA, 13 nt, Chlamydophila pneumoniae CWL029
cuucaugcugcuu

SEQ ID NO: 2534706 - RNA, 17 nt, Chlamydophila pneumoniae CWL029
cuucaugcugcuuugac

SEQ ID NO: 2534707 - RNA, 14 nt, Chlamydophila pneumoniae CWL029
cuucauuaucuucg

SEQ ID NO: 2534708 - RNA, 14 nt, Chlamydophila pneumoniae CWL029
cuucauuccaugag

SEQ ID NO: 2534709 - RNA, 14 nt, Chlamydophila pneumoniae CWL029
cuucauugcaaaaa

SEQ ID NO: 2534710 - RNA, 18 nt, Chlamydophila pneumoniae CWL029
cuucauugcaaaaaugaa

SEQ ID NO: 2534711 - RNA, 18 nt, Chlamydophila pneumoniae CWL029
cuucauuuucuuuuaaga

SEQ ID NO: 2534712 - RNA, 19 nt, Chlamydophila pneumoniae CWL029
cuuccaaaacgauccuguu

SEQ ID NO: 2534713 - RNA, 17 nt, Chlamydophila pneumoniae CWL029
cuuccaaaaguaggggc

SEQ ID NO: 2534714 - RNA, 22 nt, Chlamydophila pneumoniae CWL029
cuuccaaagacugagcuucuau

SEQ ID NO: 2534715 - RNA, 18 nt, Chlamydophila pneumoniae CWL029
cuuccaacggacauuuuc

SEQ ID NO: 2534716 - RNA, 23 nt, Chlamydophila pneumoniae CWL029
cuuccaacggacauuuucaagcu

SEQ ID NO: 2534717 - RNA, 16 nt, Chlamydophila pneumoniae CWL029
cuuccaacuucuguau

SEQ ID NO: 2534718 - RNA, 16 nt, Chlamydophila pneumoniae CWL029
cuuccaagugcucagu

SEQ ID NO: 2534719 - RNA, 16 nt, Chlamydophila pneumoniae CWL029
cuuccaauuguaaauc

SEQ ID NO: 2534720 - RNA, 23 nt, Chlamydophila pneumoniae CWL029
cuuccacaauguuuagaauuugu

SEQ ID NO: 2534721 - RNA, 21 nt, Chlamydophila pneumoniae CWL029
cuuccacacaacucguuucag

SEQ ID NO: 2534722 - RNA, 13 nt, Chlamydophila pneumoniae CWL029
cuuccagcuucuc

SEQ ID NO: 2534723 - RNA, 21 nt, Chlamydophila pneumoniae CWL029
cuuccauagcuuuagaagccc

SEQ ID NO: 2534724 - RNA, 14 nt, Chlamydophila pneumoniae CWL029
cuuccauaucuaga

SEQ ID NO: 2534725 - RNA, 23 nt, Chlamydophila pneumoniae CWL029
cuuccauaugagguaauccucga

SEQ ID NO: 2534726 - RNA, 20 nt, Chlamydophila pneumoniae CWL029
cuucccaagcagaagacccu

SEQ ID NO: 2534727 - RNA, 15 nt, Chlamydophila pneumoniae CWL029
cuucccaucuuguuc

SEQ ID NO: 2534728 - RNA, 22 nt, Chlamydophila pneumoniae CWL029
cuucccgaaggggaagaggaau

SEQ ID NO: 2534729 - RNA, 21 nt, Chlamydophila pneumoniae CWL029
cuuccgucugaauguaacucc

SEQ ID NO: 2534730 - RNA, 20 nt, Chlamydophila pneumoniae CWL029
cuuccgugcgauuuccccuu

SEQ ID NO: 2534731 - RNA, 13 nt, Chlamydophila pneumoniae CWL029
cuuccuccaaaau

SEQ ID NO: 2534732 - RNA, 16 nt, Chlamydophila pneumoniae CWL029
cuuccucuuuuauaua

SEQ ID NO: 2534733 - RNA, 17 nt, Chlamydophila pneumoniae CWL029
cuuccugauucuguaua

SEQ ID NO: 2534734 - RNA, 17 nt, Chlamydophila pneumoniae CWL029
cuuccuuaaccuccuca

SEQ ID NO: 2534735 - RNA, 18 nt, Chlamydophila pneumoniae CWL029
cuucgaagcggagcaucu

SEQ ID NO: 2534736 - RNA, 20 nt, Chlamydophila pneumoniae CWL029
cuucgaagcggagcaucuuu

SEQ ID NO: 2534737 - RNA, 16 nt, Chlamydophila pneumoniae CWL029
cuucgaauuuuuguuu

SEQ ID NO: 2534738 - RNA, 15 nt, Chlamydophila pneumoniae CWL029
cuucgacaaggaagc

SEQ ID NO: 2534739 - RNA, 18 nt, Chlamydophila pneumoniae CWL029
cuucgacuucaccuugaa

SEQ ID NO: 2534740 - RNA, 21 nt, Chlamydophila pneumoniae CWL029
cuucgacuucaccuugaaguu

SEQ ID NO: 2534741 - RNA, 15 nt, Chlamydophila pneumoniae CWL029
cuucgaugucuuucc

SEQ ID NO: 2534742 - RNA, 18 nt, Chlamydophila pneumoniae CWL029
cuucgaugucuuuccagg

SEQ ID NO: 2534743 - RNA, 19 nt, Chlamydophila pneumoniae CWL029
cuucgaugucuuuccaggc

SEQ ID NO: 2534744 - RNA, 19 nt, Chlamydophila pneumoniae CWL029
cuucgauguuauaagugac

SEQ ID NO: 2534745 - RNA, 17 nt, Chlamydophila pneumoniae CWL029
cuucgauuguaacuucg

SEQ ID NO: 2534746 - RNA, 20 nt, Chlamydophila pneumoniae CWL029
cuucgcaaucuuugaucgcu

SEQ ID NO: 2534747 - RNA, 17 nt, Chlamydophila pneumoniae CWL029
cuucggaauacugcgca

SEQ ID NO: 2534748 - RNA, 14 nt, Chlamydophila pneumoniae CWL029
cuucggaucuguaa

SEQ ID NO: 2534749 - RNA, 15 nt, Chlamydophila pneumoniae CWL029
cuucggaucuguaau

SEQ ID NO: 2534750 - RNA, 17 nt, Chlamydophila pneumoniae CWL029
cuucguggaacuuucug

SEQ ID NO: 2534751 - RNA, 22 nt, Chlamydophila pneumoniae CWL029
cuucguuagaaaccaugaugca

SEQ ID NO: 2534752 - RNA, 15 nt, Chlamydophila pneumoniae CWL029
cuucguuucgcuuug

SEQ ID NO: 2534753 - RNA, 19 nt, Chlamydophila pneumoniae CWL029
cuucuaaaaacucuucauc

SEQ ID NO: 2534754 - RNA, 20 nt, Chlamydophila pneumoniae CWL029
cuucuaaggaaauuacaauc

SEQ ID NO: 2534755 - RNA, 12 nt, Chlamydophila pneumoniae CWL029
cuucuacaccau

SEQ ID NO: 2534756 - RNA, 13 nt, Chlamydophila pneumoniae CWL029
cuucuacagcauc

SEQ ID NO: 2534757 - RNA, 24 nt, Chlamydophila pneumoniae CWL029
cuucuaccaauucucucucugcag

SEQ ID NO: 2534758 - RNA, 19 nt, Chlamydophila pneumoniae CWL029
cuucuagguauuuguuuca

SEQ ID NO: 2534759 - RNA, 14 nt, Chlamydophila pneumoniae CWL029
cuucuaugaauuga

SEQ ID NO: 2534760 - RNA, 18 nt, Chlamydophila pneumoniae CWL029
cuucuaugauaucaccag

SEQ ID NO: 2534761 - RNA, 22 nt, Chlamydophila pneumoniae CWL029
cuucuaugguaaucaccuuaga

SEQ ID NO: 2534762 - RNA, 15 nt, Chlamydophila pneumoniae CWL029
cuucuauuucuauua

SEQ ID NO: 2534763 - RNA, 11 nt, Chlamydophila pneumoniae CWL029
cuucucaaaga

SEQ ID NO: 2534764 - RNA, 14 nt, Chlamydophila pneumoniae CWL029
cuucucaaagacaa

SEQ ID NO: 2534765 - RNA, 16 nt, Chlamydophila pneumoniae CWL029
cuucucaaagacaaug

SEQ ID NO: 2534766 - RNA, 18 nt, Chlamydophila pneumoniae CWL029
cuucucaagaucuucauc

SEQ ID NO: 2534767 - RNA, 11 nt, Chlamydophila pneumoniae CWL029
cuucucagaaa

SEQ ID NO: 2534768 - RNA, 15 nt, Chlamydophila pneumoniae CWL029
cuucuccaaauaaag

SEQ ID NO: 2534769 - RNA, 14 nt, Chlamydophila pneumoniae CWL029
cuucuccagagcaa

SEQ ID NO: 2534770 - RNA, 13 nt, Chlamydophila pneumoniae CWL029
cuucucccucuaa

SEQ ID NO: 2534771 - RNA, 16 nt, Chlamydophila pneumoniae CWL029
cuucuccucgcaaucc

SEQ ID NO: 2534772 - RNA, 11 nt, Chlamydophila pneumoniae CWL029
cuucuccugaa

SEQ ID NO: 2534773 - RNA, 14 nt, Chlamydophila pneumoniae CWL029
cuucucuacuaaaa

SEQ ID NO: 2534774 - RNA, 14 nt, Chlamydophila pneumoniae CWL029
cuucucuauaaaaa

SEQ ID NO: 2534775 - RNA, 15 nt, Chlamydophila pneumoniae CWL029
cuucucucuuaaauu

SEQ ID NO: 2534776 - RNA, 16 nt, Chlamydophila pneumoniae CWL029
cuucugaaaucaaaaa

SEQ ID NO: 2534777 - RNA, 19 nt, Chlamydophila pneumoniae CWL029
cuucugaaaucaaaaaaaa

SEQ ID NO: 2534778 - RNA, 22 nt, Chlamydophila pneumoniae CWL029
cuucugaacuguucauaaucca

SEQ ID NO: 2534779 - RNA, 16 nt, Chlamydophila pneumoniae CWL029
cuucugacaauaacau

SEQ ID NO: 2534780 - RNA, 17 nt, Chlamydophila pneumoniae CWL029
cuucugauacaucauca

SEQ ID NO: 2534781 - RNA, 15 nt, Chlamydophila pneumoniae CWL029
cuucugcaggauuug

SEQ ID NO: 2534782 - RNA, 15 nt, Chlamydophila pneumoniae CWL029
cuucuggagaaaaaa

SEQ ID NO: 2534783 - RNA, 23 nt, Chlamydophila pneumoniae CWL029
cuucuggauacguuuuucccuuu

SEQ ID NO: 2534784 - RNA, 16 nt, Chlamydophila pneumoniae CWL029
cuucuggcugagagaa

SEQ ID NO: 2534785 - RNA, 15 nt, Chlamydophila pneumoniae CWL029
cuucuguaggaacaa

SEQ ID NO: 2534786 - RNA, 12 nt, Chlamydophila pneumoniae CWL029
cuucugugcauc

SEQ ID NO: 2534787 - RNA, 22 nt, Chlamydophila pneumoniae CWL029
cuucuuagaaacacaguuugag

SEQ ID NO: 2534788 - RNA, 17 nt, Chlamydophila pneumoniae CWL029
cuucuuagccaaaauuu

SEQ ID NO: 2534789 - RNA, 15 nt, Chlamydophila pneumoniae CWL029
cuucuucaaagucaa

SEQ ID NO: 2534790 - RNA, 14 nt, Chlamydophila pneumoniae CWL029
cuucuucagagcuc

SEQ ID NO: 2534791 - RNA, 12 nt, Chlamydophila pneumoniae CWL029
cuucuucagagu

SEQ ID NO: 2534792 - RNA, 13 nt, Chlamydophila pneumoniae CWL029
cuucuucagcuuu

SEQ ID NO: 2534793 - RNA, 22 nt, Chlamydophila pneumoniae CWL029
cuucuucagcuuuuucaauagc

SEQ ID NO: 2534794 - RNA, 18 nt, Chlamydophila pneumoniae CWL029
cuucuucccagccuugau

SEQ ID NO: 2534795 - RNA, 20 nt, Chlamydophila pneumoniae CWL029
cuucuucccuuucaaaggca

SEQ ID NO: 2534796 - RNA, 17 nt, Chlamydophila pneumoniae CWL029
cuucuucgccuacaagu

SEQ ID NO: 2534797 - RNA, 15 nt, Chlamydophila pneumoniae CWL029
cuucuucggaucugu

SEQ ID NO: 2534798 - RNA, 15 nt, Chlamydophila pneumoniae CWL029
cuucuucuauagaau

SEQ ID NO: 2534799 - RNA, 13 nt, Chlamydophila pneumoniae CWL029
cuucuucuucaaa

SEQ ID NO: 2534800 - RNA, 14 nt, Chlamydophila pneumoniae CWL029
cuucuugauuaaga

SEQ ID NO: 2534801 - RNA, 12 nt, Chlamydophila pneumoniae CWL029
cuucuugcaaag

SEQ ID NO: 2534802 - RNA, 16 nt, Chlamydophila pneumoniae CWL029
cuucuugcaaagauaa

SEQ ID NO: 2534803 - RNA, 15 nt, Chlamydophila pneumoniae CWL029
cuucuugugauccuu

SEQ ID NO: 2534804 - RNA, 16 nt, Chlamydophila pneumoniae CWL029
cuucuuuacucaagug

SEQ ID NO: 2534805 - RNA, 19 nt, Chlamydophila pneumoniae CWL029
cuucuuuaucuagcucuuc

SEQ ID NO: 2534806 - RNA, 12 nt, Chlamydophila pneumoniae CWL029
cuucuuucaaag

SEQ ID NO: 2534807 - RNA, 13 nt, Chlamydophila pneumoniae CWL029
cuucuuucaaagc

SEQ ID NO: 2534808 - RNA, 15 nt, Chlamydophila pneumoniae CWL029
cuucuuucaaagccu

SEQ ID NO: 2534809 - RNA, 20 nt, Chlamydophila pneumoniae CWL029
cuucuuuccauagaucccua

SEQ ID NO: 2534810 - RNA, 14 nt, Chlamydophila pneumoniae CWL029
cuucuuucugcucu

SEQ ID NO: 2534811 - RNA, 23 nt, Chlamydophila pneumoniae CWL029
cuucuuuuauauuaagaauggau

SEQ ID NO: 2534812 - RNA, 12 nt, Chlamydophila pneumoniae CWL029
cuucuuuuucuu

SEQ ID NO: 2534813 - RNA, 13 nt, Chlamydophila pneumoniae CWL029
cuugaaacucuau

SEQ ID NO: 2534814 - RNA, 23 nt, Chlamydophila pneumoniae CWL029
cuugaaaguacaggcuccaucac

SEQ ID NO: 2534815 - RNA, 14 nt, Chlamydophila pneumoniae CWL029
cuugaacagagacu

SEQ ID NO: 2534816 - RNA, 13 nt, Chlamydophila pneumoniae CWL029
cuugaagaucucc

SEQ ID NO: 2534817 - RNA, 15 nt, Chlamydophila pneumoniae CWL029
cuugaaguucucaaa

SEQ ID NO: 2534818 - RNA, 15 nt, Chlamydophila pneumoniae CWL029
cuugaaguucuucaa

SEQ ID NO: 2534819 - RNA, 20 nt, Chlamydophila pneumoniae CWL029
cuugaaguuuugguuuuaga

SEQ ID NO: 2534820 - RNA, 15 nt, Chlamydophila pneumoniae CWL029
cuugaauucucaagg

SEQ ID NO: 2534821 - RNA, 23 nt, Chlamydophila pneumoniae CWL029
cuugaccucaucagaaguggccu

SEQ ID NO: 2534822 - RNA, 22 nt, Chlamydophila pneumoniae CWL029
cuugacucuaauucagaaagac

SEQ ID NO: 2534823 - RNA, 18 nt, Chlamydophila pneumoniae CWL029
cuugagcauccaaaaugu

SEQ ID NO: 2534824 - RNA, 23 nt, Chlamydophila pneumoniae CWL029
cuugagccaacagguucacuuca

SEQ ID NO: 2534825 - RNA, 15 nt, Chlamydophila pneumoniae CWL029
cuugaggaauucuuu

SEQ ID NO: 2534826 - RNA, 23 nt, Chlamydophila pneumoniae CWL029
cuugaggaccuuccuuaucuuca

SEQ ID NO: 2534827 - RNA, 20 nt, Chlamydophila pneumoniae CWL029
cuugaggaggauugacaauc

SEQ ID NO: 2534828 - RNA, 23 nt, Chlamydophila pneumoniae CWL029
cuugaggaggauugacaaucgcu

SEQ ID NO: 2534829 - RNA, 20 nt, Chlamydophila pneumoniae CWL029
cuugauaaaacgcuauuguu

SEQ ID NO: 2534830 - RNA, 17 nt, Chlamydophila pneumoniae CWL029
cuugauaaaagauagug

SEQ ID NO: 2534831 - RNA, 16 nt, Chlamydophila pneumoniae CWL029
cuugauacugaauccc

SEQ ID NO: 2534832 - RNA, 15 nt, Chlamydophila pneumoniae CWL029
cuugauauuguucuu

SEQ ID NO: 2534833 - RNA, 17 nt, Chlamydophila pneumoniae CWL029
cuugauauuguucuucc

SEQ ID NO: 2534834 - RNA, 22 nt, Chlamydophila pneumoniae CWL029
cuugaucaggauggucauacca

SEQ ID NO: 2534835 - RNA, 17 nt, Chlamydophila pneumoniae CWL029
cuugauccuuuccaaga

SEQ ID NO: 2534836 - RNA, 13 nt, Chlamydophila pneumoniae CWL029
cuugaucuacaaa

SEQ ID NO: 2534837 - RNA, 23 nt, Chlamydophila pneumoniae CWL029
cuugauguacaguaaaguaugca

SEQ ID NO: 2534838 - RNA, 19 nt, Chlamydophila pneumoniae CWL029
cuugauuaagaucuucguc

SEQ ID NO: 2534839 - RNA, 15 nt, Chlamydophila pneumoniae CWL029
cuugauucucuucca

SEQ ID NO: 2534840 - RNA, 14 nt, Chlamydophila pneumoniae CWL029
cuugauuugggaug

SEQ ID NO: 2534841 - RNA, 18 nt, Chlamydophila pneumoniae CWL029
cuugauuuguuuagcaua

SEQ ID NO: 2534842 - RNA, 17 nt, Chlamydophila pneumoniae CWL029
cuugcaaaacagcauca

SEQ ID NO: 2534843 - RNA, 24 nt, Chlamydophila pneumoniae CWL029
cuugcaaaacagcaucaggauucu

SEQ ID NO: 2534844 - RNA, 16 nt, Chlamydophila pneumoniae CWL029
cuugcaaagauaacca

SEQ ID NO: 2534845 - RNA, 18 nt, Chlamydophila pneumoniae CWL029
cuugcagcgacaacacgc

SEQ ID NO: 2534846 - RNA, 15 nt, Chlamydophila pneumoniae CWL029
cuugccaaucuuccu

SEQ ID NO: 2534847 - RNA, 15 nt, Chlamydophila pneumoniae CWL029
cuugcgacauaacca

SEQ ID NO: 2534848 - RNA, 19 nt, Chlamydophila pneumoniae CWL029
cuugcgauacaauaaacaa

SEQ ID NO: 2534849 - RNA, 23 nt, Chlamydophila pneumoniae CWL029
cuugcgauacaauaaacaacgau

SEQ ID NO: 2534850 - RNA, 13 nt, Chlamydophila pneumoniae CWL029
cuugcgcagcuuc

SEQ ID NO: 2534851 - RNA, 14 nt, Chlamydophila pneumoniae CWL029
cuugcucugaagcu

SEQ ID NO: 2534852 - RNA, 20 nt, Chlamydophila pneumoniae CWL029
cuugcugauuuuugcuaaga

SEQ ID NO: 2534853 - RNA, 21 nt, Chlamydophila pneumoniae CWL029
cuugcuuugugaguucuuccu

SEQ ID NO: 2534854 - RNA, 23 nt, Chlamydophila pneumoniae CWL029
cuugcuuugugaguucuuccuuc

SEQ ID NO: 2534855 - RNA, 15 nt, Chlamydophila pneumoniae CWL029
cuuggaaaucagaau

SEQ ID NO: 2534856 - RNA, 19 nt, Chlamydophila pneumoniae CWL029
cuuggaugggaaucuugaa

SEQ ID NO: 2534857 - RNA, 13 nt, Chlamydophila pneumoniae CWL029
cuuggauuucuuc

SEQ ID NO: 2534858 - RNA, 19 nt, Chlamydophila pneumoniae CWL029
cuuggauuucuucuucuaa

SEQ ID NO: 2534859 - RNA, 14 nt, Chlamydophila pneumoniae CWL029
cuuggcguacucua

SEQ ID NO: 2534860 - RNA, 16 nt, Chlamydophila pneumoniae CWL029
cuuggcucuagaaaua

SEQ ID NO: 2534861 - RNA, 15 nt, Chlamydophila pneumoniae CWL029
cuugggacauuuccc

SEQ ID NO: 2534862 - RNA, 19 nt, Chlamydophila pneumoniae CWL029
cuugguagcgucucuucuu

SEQ ID NO: 2534863 - RNA, 20 nt, Chlamydophila pneumoniae CWL029
cuugguaggaugucgcuuuu

SEQ ID NO: 2534864 - RNA, 18 nt, Chlamydophila pneumoniae CWL029
cuuggucggaguuuuuuu

SEQ ID NO: 2534865 - RNA, 18 nt, Chlamydophila pneumoniae CWL029
cuugguguauaguauuuu

SEQ ID NO: 2534866 - RNA, 19 nt, Chlamydophila pneumoniae CWL029
cuugguuuucuccuucucc

SEQ ID NO: 2534867 - RNA, 18 nt, Chlamydophila pneumoniae CWL029
cuuguaagacuaaaaaag

SEQ ID NO: 2534868 - RNA, 18 nt, Chlamydophila pneumoniae CWL029
cuuguaccguaaagaaaa

SEQ ID NO: 2534869 - RNA, 21 nt, Chlamydophila pneumoniae CWL029
cuuguagcucccguuccuuua

SEQ ID NO: 2534870 - RNA, 14 nt, Chlamydophila pneumoniae CWL029
cuuguauuguacuu

SEQ ID NO: 2534871 - RNA, 19 nt, Chlamydophila pneumoniae CWL029
cuugucgcgacaagacaau

SEQ ID NO: 2534872 - RNA, 16 nt, Chlamydophila pneumoniae CWL029
cuugucuaggagcuuc

SEQ ID NO: 2534873 - RNA, 21 nt, Chlamydophila pneumoniae CWL029
cuugucuuccacgaaggaauc

SEQ ID NO: 2534874 - RNA, 22 nt, Chlamydophila pneumoniae CWL029
cuugugcuaaagcaggagcauc

SEQ ID NO: 2534875 - RNA, 18 nt, Chlamydophila pneumoniae CWL029
cuugugguuagaggaagc

SEQ ID NO: 2534876 - RNA, 23 nt, Chlamydophila pneumoniae CWL029
cuugugguuuuucuccucuuucu

SEQ ID NO: 2534877 - RNA, 13 nt, Chlamydophila pneumoniae CWL029
cuuguuaugaaaa

SEQ ID NO: 2534878 - RNA, 16 nt, Chlamydophila pneumoniae CWL029
cuuguucuaaaaugaa

SEQ ID NO: 2534879 - RNA, 13 nt, Chlamydophila pneumoniae CWL029
cuuguucuucauu

SEQ ID NO: 2534880 - RNA, 18 nt, Chlamydophila pneumoniae CWL029
cuuguucuucuugauuaa

SEQ ID NO: 2534881 - RNA, 22 nt, Chlamydophila pneumoniae CWL029
cuuguucuucuugauuaagauc

SEQ ID NO: 2534882 - RNA, 18 nt, Chlamydophila pneumoniae CWL029
cuuguuggauugaaaagc

SEQ ID NO: 2534883 - RNA, 22 nt, Chlamydophila pneumoniae CWL029
cuuguuggcauagcgagaacac

SEQ ID NO: 2534884 - RNA, 18 nt, Chlamydophila pneumoniae CWL029
cuuguugguuaaaauaga

SEQ ID NO: 2534885 - RNA, 18 nt, Chlamydophila pneumoniae CWL029
cuuguuucguaagagaau

SEQ ID NO: 2534886 - RNA, 18 nt, Chlamydophila pneumoniae CWL029
cuuguuuuccuguguggu

SEQ ID NO: 2534887 - RNA, 13 nt, Chlamydophila pneumoniae CWL029
cuuuaaaaaccca

SEQ ID NO: 2534888 - RNA, 20 nt, Chlamydophila pneumoniae CWL029
cuuuaaauucgccaaacgaa

SEQ ID NO: 2534889 - RNA, 12 nt, Chlamydophila pneumoniae CWL029
cuuuaaauuuuu

SEQ ID NO: 2534890 - RNA, 18 nt, Chlamydophila pneumoniae CWL029
cuuuaaauuuuuuaggau

SEQ ID NO: 2534891 - RNA, 17 nt, Chlamydophila pneumoniae CWL029
cuuuaacgaagaaggga

SEQ ID NO: 2534892 - RNA, 16 nt, Chlamydophila pneumoniae CWL029
cuuuaacuucuaaaag

SEQ ID NO: 2534893 - RNA, 16 nt, Chlamydophila pneumoniae CWL029
cuuuaagauuuuuaga

SEQ ID NO: 2534894 - RNA, 18 nt, Chlamydophila pneumoniae CWL029
cuuuaagguugcuuuucu

SEQ ID NO: 2534895 - RNA, 21 nt, Chlamydophila pneumoniae CWL029
cuuuaaucaagccuaaaucua

SEQ ID NO: 2534896 - RNA, 17 nt, Chlamydophila pneumoniae CWL029
cuuuaauccaguuuuuu

SEQ ID NO: 2534897 - RNA, 15 nt, Chlamydophila pneumoniae CWL029
cuuuaauccugcaau

SEQ ID NO: 2534898 - RNA, 23 nt, Chlamydophila pneumoniae CWL029
cuuuacgaugagguugagcaaga

SEQ ID NO: 2534899 - RNA, 21 nt, Chlamydophila pneumoniae CWL029
cuuuacuucggaugagaucca

SEQ ID NO: 2534900 - RNA, 17 nt, Chlamydophila pneumoniae CWL029
cuuuagaaaagugcccu

SEQ ID NO: 2534901 - RNA, 23 nt, Chlamydophila pneumoniae CWL029
cuuuagaaauuccaauuuuugca

SEQ ID NO: 2534902 - RNA, 22 nt, Chlamydophila pneumoniae CWL029
cuuuagagacgcuuuuaucugu

SEQ ID NO: 2534903 - RNA, 15 nt, Chlamydophila pneumoniae CWL029
cuuuaggaacuugaa

SEQ ID NO: 2534904 - RNA, 11 nt, Chlamydophila pneumoniae CWL029
cuuuagggaag

SEQ ID NO: 2534905 - RNA, 17 nt, Chlamydophila pneumoniae CWL029
cuuuauacuguuuuucu

SEQ ID NO: 2534906 - RNA, 20 nt, Chlamydophila pneumoniae CWL029
cuuuauacuguuuuucuucc

SEQ ID NO: 2534907 - RNA, 16 nt, Chlamydophila pneumoniae CWL029
cuuuauagaaaguaca

SEQ ID NO: 2534908 - RNA, 22 nt, Chlamydophila pneumoniae CWL029
cuuuauagauaugccucagguc

SEQ ID NO: 2534909 - RNA, 23 nt, Chlamydophila pneumoniae CWL029
cuuuaucuagcucuucaagguac

SEQ ID NO: 2534910 - RNA, 20 nt, Chlamydophila pneumoniae CWL029
cuuuauggcucaacuuaagu

SEQ ID NO: 2534911 - RNA, 15 nt, Chlamydophila pneumoniae CWL029
cuuuauguauaacau

SEQ ID NO: 2534912 - RNA, 16 nt, Chlamydophila pneumoniae CWL029
cuuuauguauaacauc

SEQ ID NO: 2534913 - RNA, 16 nt, Chlamydophila pneumoniae CWL029
cuuuauguuuuguccu

SEQ ID NO: 2534914 - RNA, 10 nt, Chlamydophila pneumoniae CWL029
cuuucaaagg

SEQ ID NO: 2534915 - RNA, 15 nt, Chlamydophila pneumoniae CWL029
cuuucaauagcuucc

SEQ ID NO: 2534916 - RNA, 18 nt, Chlamydophila pneumoniae CWL029
cuuucaauguaauugcgc

SEQ ID NO: 2534917 - RNA, 14 nt, Chlamydophila pneumoniae CWL029
cuuucacaaagaau

SEQ ID NO: 2534918 - RNA, 23 nt, Chlamydophila pneumoniae CWL029
cuuucacaaaggcgaucuucuuc

SEQ ID NO: 2534919 - RNA, 13 nt, Chlamydophila pneumoniae CWL029
cuuucagaaagaa

SEQ ID NO: 2534920 - RNA, 14 nt, Chlamydophila pneumoniae CWL029
cuuucagcucaagu

SEQ ID NO: 2534921 - RNA, 23 nt, Chlamydophila pneumoniae CWL029
cuuucauaagauagagcgacuuc

SEQ ID NO: 2534922 - RNA, 19 nt, Chlamydophila pneumoniae CWL029
cuuucauucccuuuuucca

SEQ ID NO: 2534923 - RNA, 21 nt, Chlamydophila pneumoniae CWL029
cuuucauucccuuuuuccaua

SEQ ID NO: 2534924 - RNA, 22 nt, Chlamydophila pneumoniae CWL029
cuuuccauaaagccccacccac

SEQ ID NO: 2534925 - RNA, 23 nt, Chlamydophila pneumoniae CWL029
cuuuccauaaagccccacccacu

SEQ ID NO: 2534926 - RNA, 20 nt, Chlamydophila pneumoniae CWL029
cuuucccuaagcaaaaacuu

SEQ ID NO: 2534927 - RNA, 16 nt, Chlamydophila pneumoniae CWL029
cuuuccguugaugaca

SEQ ID NO: 2534928 - RNA, 13 nt, Chlamydophila pneumoniae CWL029
cuuuccuaaaaua

SEQ ID NO: 2534929 - RNA, 11 nt, Chlamydophila pneumoniae CWL029
cuuuccucucu

SEQ ID NO: 2534930 - RNA, 14 nt, Chlamydophila pneumoniae CWL029
cuuuccuuagcauu

SEQ ID NO: 2534931 - RNA, 13 nt, Chlamydophila pneumoniae CWL029
cuuucgaugcuau

SEQ ID NO: 2534932 - RNA, 17 nt, Chlamydophila pneumoniae CWL029
cuuucgucccucuaauc

SEQ ID NO: 2534933 - RNA, 23 nt, Chlamydophila pneumoniae CWL029
cuuucuaagaauucuuugccaag

SEQ ID NO: 2534934 - RNA, 14 nt, Chlamydophila pneumoniae CWL029
cuuucuagcugcuc

SEQ ID NO: 2534935 - RNA, 13 nt, Chlamydophila pneumoniae CWL029
cuuucuaggaucu

SEQ ID NO: 2534936 - RNA, 17 nt, Chlamydophila pneumoniae CWL029
cuuucuaggaucucuag

SEQ ID NO: 2534937 - RNA, 22 nt, Chlamydophila pneumoniae CWL029
cuuucuauuucgucgucauccc

SEQ ID NO: 2534938 - RNA, 19 nt, Chlamydophila pneumoniae CWL029
cuuucuccagcauuuuugg

SEQ ID NO: 2534939 - RNA, 19 nt, Chlamydophila pneumoniae CWL029
cuuucugauugagaauaaa

SEQ ID NO: 2534940 - RNA, 19 nt, Chlamydophila pneumoniae CWL029
cuuucugauuuaaaagguu

SEQ ID NO: 2534941 - RNA, 16 nt, Chlamydophila pneumoniae CWL029
cuuucugcucuucuau

SEQ ID NO: 2534942 - RNA, 14 nt, Chlamydophila pneumoniae CWL029
cuuucugcuugucu

SEQ ID NO: 2534943 - RNA, 16 nt, Chlamydophila pneumoniae CWL029
cuuucugcuugucuac

SEQ ID NO: 2534944 - RNA, 15 nt, Chlamydophila pneumoniae CWL029
cuuucuuauuacaga

SEQ ID NO: 2534945 - RNA, 22 nt, Chlamydophila pneumoniae CWL029
cuuucuuuaaagaauagcauga

SEQ ID NO: 2534946 - RNA, 12 nt, Chlamydophila pneumoniae CWL029
cuuucuuuuagc

SEQ ID NO: 2534947 - RNA, 18 nt, Chlamydophila pneumoniae CWL029
cuuucuuuuagcuacuuc

SEQ ID NO: 2534948 - RNA, 19 nt, Chlamydophila pneumoniae CWL029
cuuugaagcucgaccucua

SEQ ID NO: 2534949 - RNA, 23 nt, Chlamydophila pneumoniae CWL029
cuuugaagcucgaccucuagcuc

SEQ ID NO: 2534950 - RNA, 15 nt, Chlamydophila pneumoniae CWL029
cuuugaauaaugcau

SEQ ID NO: 2534951 - RNA, 21 nt, Chlamydophila pneumoniae CWL029
cuuugaauaaugcaucccccg

SEQ ID NO: 2534952 - RNA, 14 nt, Chlamydophila pneumoniae CWL029
cuuugaauuuccaa

SEQ ID NO: 2534953 - RNA, 16 nt, Chlamydophila pneumoniae CWL029
cuuugaauuuccaaag

SEQ ID NO: 2534954 - RNA, 16 nt, Chlamydophila pneumoniae CWL029
cuuugacaucuaauuu

SEQ ID NO: 2534955 - RNA, 15 nt, Chlamydophila pneumoniae CWL029
cuuugacauugaauc

SEQ ID NO: 2534956 - RNA, 14 nt, Chlamydophila pneumoniae CWL029
cuuugacuuucaua

SEQ ID NO: 2534957 - RNA, 15 nt, Chlamydophila pneumoniae CWL029
cuuugagaucuugaa

SEQ ID NO: 2534958 - RNA, 14 nt, Chlamydophila pneumoniae CWL029
cuuugagucuuuuu

SEQ ID NO: 2534959 - RNA, 15 nt, Chlamydophila pneumoniae CWL029
cuuugagucuuuuuc

SEQ ID NO: 2534960 - RNA, 15 nt, Chlamydophila pneumoniae CWL029
cuuugaguuaagcaa

SEQ ID NO: 2534961 - RNA, 17 nt, Chlamydophila pneumoniae CWL029
cuuugauuuucaggaga

SEQ ID NO: 2534962 - RNA, 16 nt, Chlamydophila pneumoniae CWL029
cuuugcaucccuaggg

SEQ ID NO: 2534963 - RNA, 14 nt, Chlamydophila pneumoniae CWL029
cuuugcaugaggag

SEQ ID NO: 2534964 - RNA, 17 nt, Chlamydophila pneumoniae CWL029
cuuugccaacagcuggg

SEQ ID NO: 2534965 - RNA, 20 nt, Chlamydophila pneumoniae CWL029
cuuugccaacagcugggauc

SEQ ID NO: 2534966 - RNA, 16 nt, Chlamydophila pneumoniae CWL029
cuuugcuuauuucccc

SEQ ID NO: 2534967 - RNA, 23 nt, Chlamydophila pneumoniae CWL029
cuuugcuuauuuccccgaacaaa

SEQ ID NO: 2534968 - RNA, 16 nt, Chlamydophila pneumoniae CWL029
cuuugugauuacagca

SEQ ID NO: 2534969 - RNA, 18 nt, Chlamydophila pneumoniae CWL029
cuuuuaaaaacucuuuca

SEQ ID NO: 2534970 - RNA, 22 nt, Chlamydophila pneumoniae CWL029
cuuuuaaagagcgcguuucaaa

SEQ ID NO: 2534971 - RNA, 14 nt, Chlamydophila pneumoniae CWL029
cuuuuaagacaaua

SEQ ID NO: 2534972 - RNA, 23 nt, Chlamydophila pneumoniae CWL029
cuuuuaagacaauauaagcacca

SEQ ID NO: 2534973 - RNA, 19 nt, Chlamydophila pneumoniae CWL029
cuuuuaauguguucuuauc

SEQ ID NO: 2534974 - RNA, 14 nt, Chlamydophila pneumoniae CWL029
cuuuuacugaaauu

SEQ ID NO: 2534975 - RNA, 17 nt, Chlamydophila pneumoniae CWL029
cuuuuagagccuuuuca

SEQ ID NO: 2534976 - RNA, 20 nt, Chlamydophila pneumoniae CWL029
cuuuuagagccuuuucagau

SEQ ID NO: 2534977 - RNA, 23 nt, Chlamydophila pneumoniae CWL029
cuuuuagagccuuuucagauuuu

SEQ ID NO: 2534978 - RNA, 13 nt, Chlamydophila pneumoniae CWL029
cuuuuaugaugua

SEQ ID NO: 2534979 - RNA, 15 nt, Chlamydophila pneumoniae CWL029
cuuuuauuaagggaa

SEQ ID NO: 2534980 - RNA, 15 nt, Chlamydophila pneumoniae CWL029
cuuuucagauuuuuu

SEQ ID NO: 2534981 - RNA, 20 nt, Chlamydophila pneumoniae CWL029
cuuuuccaaauuccuucaua

SEQ ID NO: 2534982 - RNA, 20 nt, Chlamydophila pneumoniae CWL029
cuuuuccggggagaacuuca

SEQ ID NO: 2534983 - RNA, 15 nt, Chlamydophila pneumoniae CWL029
cuuuuccugcagcag

SEQ ID NO: 2534984 - RNA, 23 nt, Chlamydophila pneumoniae CWL029
cuuuuccugcagcagccuuggcu

SEQ ID NO: 2534985 - RNA, 15 nt, Chlamydophila pneumoniae CWL029
cuuuucgcagauacu

SEQ ID NO: 2534986 - RNA, 22 nt, Chlamydophila pneumoniae CWL029
cuuuucuaagcaauauuucugu

SEQ ID NO: 2534987 - RNA, 15 nt, Chlamydophila pneumoniae CWL029
cuuuucuacaugcuc

SEQ ID NO: 2534988 - RNA, 19 nt, Chlamydophila pneumoniae CWL029
cuuuucuacaugcucaaga

SEQ ID NO: 2534989 - RNA, 23 nt, Chlamydophila pneumoniae CWL029
cuuuucuagaaacugcuccugaa

SEQ ID NO: 2534990 - RNA, 19 nt, Chlamydophila pneumoniae CWL029
cuuuucuccuucuggaugc

SEQ ID NO: 2534991 - RNA, 15 nt, Chlamydophila pneumoniae CWL029
cuuuucucuucaaaa

SEQ ID NO: 2534992 - RNA, 17 nt, Chlamydophila pneumoniae CWL029
cuuuucugaagauuuuu

SEQ ID NO: 2534993 - RNA, 18 nt, Chlamydophila pneumoniae CWL029
cuuuucugaagauuuuuu

SEQ ID NO: 2534994 - RNA, 19 nt, Chlamydophila pneumoniae CWL029
cuuuucugaagauuuuuua

SEQ ID NO: 2534995 - RNA, 21 nt, Chlamydophila pneumoniae CWL029
cuuuucugaaucuuuuguuuu

SEQ ID NO: 2534996 - RNA, 12 nt, Chlamydophila pneumoniae CWL029
cuuuucuuauca

SEQ ID NO: 2534997 - RNA, 14 nt, Chlamydophila pneumoniae CWL029
cuuuucuucuucgg

SEQ ID NO: 2534998 - RNA, 21 nt, Chlamydophila pneumoniae CWL029
cuuuucuuuuuagaauccuga

SEQ ID NO: 2534999 - RNA, 17 nt, Chlamydophila pneumoniae CWL029
cuuuucuuuuucuaggg

SEQ ID NO: 2535000 - RNA, 17 nt, Chlamydophila pneumoniae CWL029
cuuuugacaauaagaaa

SEQ ID NO: 2535001 - RNA, 13 nt, Chlamydophila pneumoniae CWL029
cuuuugcaaguuu

SEQ ID NO: 2535002 - RNA, 23 nt, Chlamydophila pneumoniae CWL029
cuuuugcuacagcuucuuuucca

SEQ ID NO: 2535003 - RNA, 14 nt, Chlamydophila pneumoniae CWL029
cuuuuguagauuag

SEQ ID NO: 2535004 - RNA, 13 nt, Chlamydophila pneumoniae CWL029
cuuuuguauuaaa

SEQ ID NO: 2535005 - RNA, 17 nt, Chlamydophila pneumoniae CWL029
cuuuugugaagauaaga

SEQ ID NO: 2535006 - RNA, 15 nt, Chlamydophila pneumoniae CWL029
cuuuuguuugucuuc

SEQ ID NO: 2535007 - RNA, 17 nt, Chlamydophila pneumoniae CWL029
cuuuuguuugucuucca

SEQ ID NO: 2535008 - RNA, 19 nt, Chlamydophila pneumoniae CWL029
cuuuuguuugucuuccaua

SEQ ID NO: 2535009 - RNA, 18 nt, Chlamydophila pneumoniae CWL029
cuuuuguuuuagcucuuu

SEQ ID NO: 2535010 - RNA, 19 nt, Chlamydophila pneumoniae CWL029
cuuuuucagcuucuacagc

SEQ ID NO: 2535011 - RNA, 12 nt, Chlamydophila pneumoniae CWL029
cuuuuuccaaaa

SEQ ID NO: 2535012 - RNA, 20 nt, Chlamydophila pneumoniae CWL029
cuuuuuccauacccaaauuu

SEQ ID NO: 2535013 - RNA, 20 nt, Chlamydophila pneumoniae CWL029
cuuuuucuugaaaaauccug

SEQ ID NO: 2535014 - RNA, 23 nt, Chlamydophila pneumoniae CWL029
cuuuuucuugaaaaauccugaga

SEQ ID NO: 2535015 - RNA, 21 nt, Chlamydophila pneumoniae CWL029
cuuuuuggaaguuguuuuuug

SEQ ID NO: 2535016 - RNA, 23 nt, Chlamydophila pneumoniae CWL029
cuuuuuggaaguuguuuuuugag

SEQ ID NO: 2535017 - RNA, 20 nt, Chlamydophila pneumoniae CWL029
cuuuuuuacuaucuccuaga

SEQ ID NO: 2535018 - RNA, 23 nt, Chlamydophila pneumoniae CWL029
cuuuuuuauguccguauuuuuua

SEQ ID NO: 2535019 - RNA, 21 nt, Chlamydophila pneumoniae CWL029
cuuuuuuucuucucuaagaaa

SEQ ID NO: 2535020 - RNA, 15 nt, Chlamydophila pneumoniae CWL029
gaaaaaaaaucugcu

SEQ ID NO: 2535021 - RNA, 16 nt, Chlamydophila pneumoniae CWL029
gaaaaaaaaucugcua

SEQ ID NO: 2535022 - RNA, 12 nt, Chlamydophila pneumoniae CWL029
gaaaaaauagau

SEQ ID NO: 2535023 - RNA, 11 nt, Chlamydophila pneumoniae CWL029
gaaaaaauucu

SEQ ID NO: 2535024 - RNA, 20 nt, Chlamydophila pneumoniae CWL029
gaaaaagccuaugggaggaa

SEQ ID NO: 2535025 - RNA, 21 nt, Chlamydophila pneumoniae CWL029
gaaaaagccuaugggaggaau

SEQ ID NO: 2535026 - RNA, 13 nt, Chlamydophila pneumoniae CWL029
gaaaaaggaggau

SEQ ID NO: 2535027 - RNA, 19 nt, Chlamydophila pneumoniae CWL029
gaaaaaguaguuuuaagaa

SEQ ID NO: 2535028 - RNA, 16 nt, Chlamydophila pneumoniae CWL029
gaaaaaucccuguucu

SEQ ID NO: 2535029 - RNA, 14 nt, Chlamydophila pneumoniae CWL029
gaaaacauagagau

SEQ ID NO: 2535030 - RNA, 16 nt, Chlamydophila pneumoniae CWL029
gaaaacgccaacugua

SEQ ID NO: 2535031 - RNA, 12 nt, Chlamydophila pneumoniae CWL029
gaaaagaaaaga

SEQ ID NO: 2535032 - RNA, 13 nt, Chlamydophila pneumoniae CWL029
gaaaagaaagaau

SEQ ID NO: 2535033 - RNA, 22 nt, Chlamydophila pneumoniae CWL029
gaaaagauucuaaaucaacuac

SEQ ID NO: 2535034 - RNA, 22 nt, Chlamydophila pneumoniae CWL029
gaaaagauuugcgaaucuaaga

SEQ ID NO: 2535035 - RNA, 21 nt, Chlamydophila pneumoniae CWL029
gaaaagccucgaaauuuucag

SEQ ID NO: 2535036 - RNA, 16 nt, Chlamydophila pneumoniae CWL029
gaaaaggaugcaucuc

SEQ ID NO: 2535037 - RNA, 16 nt, Chlamydophila pneumoniae CWL029
gaaaauaagaagcagc

SEQ ID NO: 2535038 - RNA, 18 nt, Chlamydophila pneumoniae CWL029
gaaaauacagccagcaga

SEQ ID NO: 2535039 - RNA, 19 nt, Chlamydophila pneumoniae CWL029
gaaaauacagccagcagaa

SEQ ID NO: 2535040 - RNA, 23 nt, Chlamydophila pneumoniae CWL029
gaaaauaguacgcuuuuuacuga

SEQ ID NO: 2535041 - RNA, 23 nt, Chlamydophila pneumoniae CWL029
gaaaauaucaccuacaucagacu

SEQ ID NO: 2535042 - RNA, 18 nt, Chlamydophila pneumoniae CWL029
gaaaaucaagaagagaaa

SEQ ID NO: 2535043 - RNA, 11 nt, Chlamydophila pneumoniae CWL029
gaaaaucacac

SEQ ID NO: 2535044 - RNA, 16 nt, Chlamydophila pneumoniae CWL029
gaaaaucauucaaaua

SEQ ID NO: 2535045 - RNA, 20 nt, Chlamydophila pneumoniae CWL029
gaaaauccuaacaaaaggau

SEQ ID NO: 2535046 - RNA, 17 nt, Chlamydophila pneumoniae CWL029
gaaaauccuuaggggcg

SEQ ID NO: 2535047 - RNA, 15 nt, Chlamydophila pneumoniae CWL029
gaaaaucugcucucu

SEQ ID NO: 2535048 - RNA, 22 nt, Chlamydophila pneumoniae CWL029
gaaaaucuuuaagguugcuuuu

SEQ ID NO: 2535049 - RNA, 15 nt, Chlamydophila pneumoniae CWL029
gaaaauguaaaaaau

SEQ ID NO: 2535050 - RNA, 18 nt, Chlamydophila pneumoniae CWL029
gaaaauguaaaaaauuau

SEQ ID NO: 2535051 - RNA, 19 nt, Chlamydophila pneumoniae CWL029
gaaaauucaguauaagaug

SEQ ID NO: 2535052 - RNA, 16 nt, Chlamydophila pneumoniae CWL029
gaaacaaccaucccau

SEQ ID NO: 2535053 - RNA, 12 nt, Chlamydophila pneumoniae CWL029
gaaacaacugaa

SEQ ID NO: 2535054 - RNA, 13 nt, Chlamydophila pneumoniae CWL029
gaaacacucauga

SEQ ID NO: 2535055 - RNA, 20 nt, Chlamydophila pneumoniae CWL029
gaaacacucaugaaagugcu

SEQ ID NO: 2535056 - RNA, 24 nt, Chlamydophila pneumoniae CWL029
gaaacacuuuggauaggauaggag

SEQ ID NO: 2535057 - RNA, 24 nt, Chlamydophila pneumoniae CWL029
gaaacaucggagaacuuccugauu

SEQ ID NO: 2535058 - RNA, 19 nt, Chlamydophila pneumoniae CWL029
gaaaccauauugcaaagca

SEQ ID NO: 2535059 - RNA, 15 nt, Chlamydophila pneumoniae CWL029
gaaaccaugaugcaa

SEQ ID NO: 2535060 - RNA, 23 nt, Chlamydophila pneumoniae CWL029
gaaaccggacugacuucuaugau

SEQ ID NO: 2535061 - RNA, 13 nt, Chlamydophila pneumoniae CWL029
gaaacgaaagcag

SEQ ID NO: 2535062 - RNA, 17 nt, Chlamydophila pneumoniae CWL029
gaaacgcagcuuuccuu

SEQ ID NO: 2535063 - RNA, 22 nt, Chlamydophila pneumoniae CWL029
gaaacgcccuucaggacaugcc

SEQ ID NO: 2535064 - RNA, 13 nt, Chlamydophila pneumoniae CWL029
gaaacuagauuuc

SEQ ID NO: 2535065 - RNA, 21 nt, Chlamydophila pneumoniae CWL029
gaaacuucucagauaaaaaga

SEQ ID NO: 2535066 - RNA, 17 nt, Chlamydophila pneumoniae CWL029
gaaacuucugacccugu

SEQ ID NO: 2535067 - RNA, 23 nt, Chlamydophila pneumoniae CWL029
gaaacuuuugucgcaauaacaaa

SEQ ID NO: 2535068 - RNA, 18 nt, Chlamydophila pneumoniae CWL029
gaaacuuuuuuucuucuc

SEQ ID NO: 2535069 - RNA, 21 nt, Chlamydophila pneumoniae CWL029
gaaacuuuuuuucuucucuaa

SEQ ID NO: 2535070 - RNA, 22 nt, Chlamydophila pneumoniae CWL029
gaaacuuuuuuucuucucuaag

SEQ ID NO: 2535071 - RNA, 12 nt, Chlamydophila pneumoniae CWL029
gaaagaaacaaa

SEQ ID NO: 2535072 - RNA, 13 nt, Chlamydophila pneumoniae CWL029
gaaagaacuacuu

SEQ ID NO: 2535073 - RNA, 17 nt, Chlamydophila pneumoniae CWL029
gaaagaacuacuuaaau

SEQ ID NO: 2535074 - RNA, 23 nt, Chlamydophila pneumoniae CWL029
gaaagaaguccuagggagugagg

SEQ ID NO: 2535075 - RNA, 14 nt, Chlamydophila pneumoniae CWL029
gaaagaaugacaca

SEQ ID NO: 2535076 - RNA, 16 nt, Chlamydophila pneumoniae CWL029
gaaagaaugccauucu

SEQ ID NO: 2535077 - RNA, 19 nt, Chlamydophila pneumoniae CWL029
gaaagaauuguaguucuuu

SEQ ID NO: 2535078 - RNA, 23 nt, Chlamydophila pneumoniae CWL029
gaaagaauuguaguucuuugaau

SEQ ID NO: 2535079 - RNA, 18 nt, Chlamydophila pneumoniae CWL029
gaaagacucaucuuugaa

SEQ ID NO: 2535080 - RNA, 13 nt, Chlamydophila pneumoniae CWL029
gaaagacucgcuc

SEQ ID NO: 2535081 - RNA, 15 nt, Chlamydophila pneumoniae CWL029
gaaagagucccugau

SEQ ID NO: 2535082 - RNA, 22 nt, Chlamydophila pneumoniae CWL029
gaaagagucucacucuuuucua

SEQ ID NO: 2535083 - RNA, 14 nt, Chlamydophila pneumoniae CWL029
gaaagauaaugucu

SEQ ID NO: 2535084 - RNA, 23 nt, Chlamydophila pneumoniae CWL029
gaaagaucagaggaaucuaagaa

SEQ ID NO: 2535085 - RNA, 18 nt, Chlamydophila pneumoniae CWL029
gaaagcagcgaagauuua

SEQ ID NO: 2535086 - RNA, 15 nt, Chlamydophila pneumoniae CWL029
gaaagcaucuuucau

SEQ ID NO: 2535087 - RNA, 16 nt, Chlamydophila pneumoniae CWL029
gaaagcccaugagaug

SEQ ID NO: 2535088 - RNA, 18 nt, Chlamydophila pneumoniae CWL029
gaaagcgcgaugaacagc

SEQ ID NO: 2535089 - RNA, 23 nt, Chlamydophila pneumoniae CWL029
gaaagcguuucgauaauuuucac

SEQ ID NO: 2535090 - RNA, 18 nt, Chlamydophila pneumoniae CWL029
gaaagcuggaaggucgcu

SEQ ID NO: 2535091 - RNA, 17 nt, Chlamydophila pneumoniae CWL029
gaaagcuucuggauuca

SEQ ID NO: 2535092 - RNA, 17 nt, Chlamydophila pneumoniae CWL029
gaaaggaccuccucaca

SEQ ID NO: 2535093 - RNA, 21 nt, Chlamydophila pneumoniae CWL029
gaaaggcuuuucuuuuucuag

SEQ ID NO: 2535094 - RNA, 17 nt, Chlamydophila pneumoniae CWL029
gaaaguaaaauuucugu

SEQ ID NO: 2535095 - RNA, 18 nt, Chlamydophila pneumoniae CWL029
gaaaguaaaauuucugua

SEQ ID NO: 2535096 - RNA, 21 nt, Chlamydophila pneumoniae CWL029
gaaaguaccuauugugcuuuu

SEQ ID NO: 2535097 - RNA, 15 nt, Chlamydophila pneumoniae CWL029
gaaaguucacaagca

SEQ ID NO: 2535098 - RNA, 16 nt, Chlamydophila pneumoniae CWL029
gaaauaagcaucuaga

SEQ ID NO: 2535099 - RNA, 22 nt, Chlamydophila pneumoniae CWL029
gaaauaccacagcuguacagaa

SEQ ID NO: 2535100 - RNA, 16 nt, Chlamydophila pneumoniae CWL029
gaaauauaacucucua

SEQ ID NO: 2535101 - RNA, 13 nt, Chlamydophila pneumoniae CWL029
gaaauauacucuu

SEQ ID NO: 2535102 - RNA, 19 nt, Chlamydophila pneumoniae CWL029
gaaauauuaacccaccaga

SEQ ID NO: 2535103 - RNA, 18 nt, Chlamydophila pneumoniae CWL029
gaaauccguaaagguugu

SEQ ID NO: 2535104 - RNA, 14 nt, Chlamydophila pneumoniae CWL029
gaaauccugggcaa

SEQ ID NO: 2535105 - RNA, 22 nt, Chlamydophila pneumoniae CWL029
gaaauccugggcaaugaucaaa

SEQ ID NO: 2535106 - RNA, 18 nt, Chlamydophila pneumoniae CWL029
gaaaucgcauuacaaaug

SEQ ID NO: 2535107 - RNA, 20 nt, Chlamydophila pneumoniae CWL029
gaaaucguaucuuuuugcag

SEQ ID NO: 2535108 - RNA, 13 nt, Chlamydophila pneumoniae CWL029
gaaaugagugaga

SEQ ID NO: 2535109 - RNA, 17 nt, Chlamydophila pneumoniae CWL029
gaaauguuuuuaaaccu

SEQ ID NO: 2535110 - RNA, 13 nt, Chlamydophila pneumoniae CWL029
gaaauuaaagcua

SEQ ID NO: 2535111 - RNA, 19 nt, Chlamydophila pneumoniae CWL029
gaaauuaaagcuaacaacu

SEQ ID NO: 2535112 - RNA, 20 nt, Chlamydophila pneumoniae CWL029
gaaauuaaguaggccuccuu

SEQ ID NO: 2535113 - RNA, 15 nt, Chlamydophila pneumoniae CWL029
gaaauuagguagugg

SEQ ID NO: 2535114 - RNA, 22 nt, Chlamydophila pneumoniae CWL029
gaaauugaauaucgaguucuuu

SEQ ID NO: 2535115 - RNA, 14 nt, Chlamydophila pneumoniae CWL029
gaaauugcucuugc

SEQ ID NO: 2535116 - RNA, 21 nt, Chlamydophila pneumoniae CWL029
gaaauuuaggucgacuuccuu

SEQ ID NO: 2535117 - RNA, 14 nt, Chlamydophila pneumoniae CWL029
gaaauuucauucuc

SEQ ID NO: 2535118 - RNA, 12 nt, Chlamydophila pneumoniae CWL029
gaaauuuucuaa

SEQ ID NO: 2535119 - RNA, 15 nt, Chlamydophila pneumoniae CWL029
gaacaaaaaaucaau

SEQ ID NO: 2535120 - RNA, 21 nt, Chlamydophila pneumoniae CWL029
gaacaaaaaaucaaucuugau

SEQ ID NO: 2535121 - RNA, 13 nt, Chlamydophila pneumoniae CWL029
gaacaaaaacugc

SEQ ID NO: 2535122 - RNA, 15 nt, Chlamydophila pneumoniae CWL029
gaacaaagcucuccu

SEQ ID NO: 2535123 - RNA, 17 nt, Chlamydophila pneumoniae CWL029
gaacaaagcucuccuuc

SEQ ID NO: 2535124 - RNA, 20 nt, Chlamydophila pneumoniae CWL029
gaacaaagcucuccuucaga

SEQ ID NO: 2535125 - RNA, 19 nt, Chlamydophila pneumoniae CWL029
gaacaacgcugcuucucua

SEQ ID NO: 2535126 - RNA, 21 nt, Chlamydophila pneumoniae CWL029
gaacaacgcugcuucucuacu

SEQ ID NO: 2535127 - RNA, 13 nt, Chlamydophila pneumoniae CWL029
gaacaaggcuccg

SEQ ID NO: 2535128 - RNA, 20 nt, Chlamydophila pneumoniae CWL029
gaacaaguuuuuucaauccu

SEQ ID NO: 2535129 - RNA, 16 nt, Chlamydophila pneumoniae CWL029
gaacaccauaaaacaa

SEQ ID NO: 2535130 - RNA, 20 nt, Chlamydophila pneumoniae CWL029
gaacacccccgcagcuucuc

SEQ ID NO: 2535131 - RNA, 13 nt, Chlamydophila pneumoniae CWL029
gaacagagaugca

SEQ ID NO: 2535132 - RNA, 21 nt, Chlamydophila pneumoniae CWL029
gaacagaggaucuagaaaaug

SEQ ID NO: 2535133 - RNA, 22 nt, Chlamydophila pneumoniae CWL029
gaacagcacucucugcagggaa

SEQ ID NO: 2535134 - RNA, 23 nt, Chlamydophila pneumoniae CWL029
gaacagcacucucugcagggaau

SEQ ID NO: 2535135 - RNA, 12 nt, Chlamydophila pneumoniae CWL029
gaacaggagaga

SEQ ID NO: 2535136 - RNA, 13 nt, Chlamydophila pneumoniae CWL029
gaacaggaggugu

SEQ ID NO: 2535137 - RNA, 21 nt, Chlamydophila pneumoniae CWL029
gaacaggagguguauccguag

SEQ ID NO: 2535138 - RNA, 20 nt, Chlamydophila pneumoniae CWL029
gaacaggcacagcaaucaca

SEQ ID NO: 2535139 - RNA, 18 nt, Chlamydophila pneumoniae CWL029
gaacaguauaaucagaag

SEQ ID NO: 2535140 - RNA, 21 nt, Chlamydophila pneumoniae CWL029
gaacaguauaaucagaaguga

SEQ ID NO: 2535141 - RNA, 19 nt, Chlamydophila pneumoniae CWL029
gaacagucuugcgccagca

SEQ ID NO: 2535142 - RNA, 18 nt, Chlamydophila pneumoniae CWL029
gaacaguuccuauuuuuu

SEQ ID NO: 2535143 - RNA, 17 nt, Chlamydophila pneumoniae CWL029
gaacaguuugcucugga

SEQ ID NO: 2535144 - RNA, 14 nt, Chlamydophila pneumoniae CWL029
gaacaugccaaaua

SEQ ID NO: 2535145 - RNA, 18 nt, Chlamydophila pneumoniae CWL029
gaacaugccaaauaucuc

SEQ ID NO: 2535146 - RNA, 23 nt, Chlamydophila pneumoniae CWL029
gaacaugcccccacaaaaccugg

SEQ ID NO: 2535147 - RNA, 17 nt, Chlamydophila pneumoniae CWL029
gaacaugccugaaaaca

SEQ ID NO: 2535148 - RNA, 19 nt, Chlamydophila pneumoniae CWL029
gaaccaaaucuaucugcac

SEQ ID NO: 2535149 - RNA, 20 nt, Chlamydophila pneumoniae CWL029
gaaccacuuuagaauuuucu

SEQ ID NO: 2535150 - RNA, 17 nt, Chlamydophila pneumoniae CWL029
gaacccuggaugaacau

SEQ ID NO: 2535151 - RNA, 21 nt, Chlamydophila pneumoniae CWL029
gaaccgucgagcucgcaaaag

SEQ ID NO: 2535152 - RNA, 17 nt, Chlamydophila pneumoniae CWL029
gaaccucuaauuugaug

SEQ ID NO: 2535153 - RNA, 13 nt, Chlamydophila pneumoniae CWL029
gaacgaagaaaac

SEQ ID NO: 2535154 - RNA, 19 nt, Chlamydophila pneumoniae CWL029
gaacgaagacuuguucuuc

SEQ ID NO: 2535155 - RNA, 15 nt, Chlamydophila pneumoniae CWL029
gaacgcugaguguau

SEQ ID NO: 2535156 - RNA, 21 nt, Chlamydophila pneumoniae CWL029
gaacggacaaugcuaucucca

SEQ ID NO: 2535157 - RNA, 16 nt, Chlamydophila pneumoniae CWL029
gaacguacuuagguaa

SEQ ID NO: 2535158 - RNA, 23 nt, Chlamydophila pneumoniae CWL029
gaacguagcagaggcagguaguc

SEQ ID NO: 2535159 - RNA, 23 nt, Chlamydophila pneumoniae CWL029
gaacgucuaaagacgaagggagu

SEQ ID NO: 2535160 - RNA, 19 nt, Chlamydophila pneumoniae CWL029
gaacuaaaaguuuuuuauu

SEQ ID NO: 2535161 - RNA, 14 nt, Chlamydophila pneumoniae CWL029
gaacuaaagagauc

SEQ ID NO: 2535162 - RNA, 18 nt, Chlamydophila pneumoniae CWL029
gaacuaaaggaacugugc

SEQ ID NO: 2535163 - RNA, 13 nt, Chlamydophila pneumoniae CWL029
gaacuaacuguaa

SEQ ID NO: 2535164 - RNA, 16 nt, Chlamydophila pneumoniae CWL029
gaacuaacuguaauuu

SEQ ID NO: 2535165 - RNA, 23 nt, Chlamydophila pneumoniae CWL029
gaacuaccuaccuauuuaaggga

SEQ ID NO: 2535166 - RNA, 22 nt, Chlamydophila pneumoniae CWL029
gaacuacgggcaauauauccag

SEQ ID NO: 2535167 - RNA, 17 nt, Chlamydophila pneumoniae CWL029
gaacuacuuaaauccua

SEQ ID NO: 2535168 - RNA, 13 nt, Chlamydophila pneumoniae CWL029
gaacuagaaaaaa

SEQ ID NO: 2535169 - RNA, 20 nt, Chlamydophila pneumoniae CWL029
gaacuauccuguuucaacau

SEQ ID NO: 2535170 - RNA, 17 nt, Chlamydophila pneumoniae CWL029
gaacuccuuugagucuu

SEQ ID NO: 2535171 - RNA, 21 nt, Chlamydophila pneumoniae CWL029
gaacuccuuugagucuuuuuc

SEQ ID NO: 2535172 - RNA, 19 nt, Chlamydophila pneumoniae CWL029
gaacucugcccgucuuaga

SEQ ID NO: 2535173 - RNA, 18 nt, Chlamydophila pneumoniae CWL029
gaacugggcauaguggcu

SEQ ID NO: 2535174 - RNA, 22 nt, Chlamydophila pneumoniae CWL029
gaacuguaacuugcauuuuuug

SEQ ID NO: 2535175 - RNA, 16 nt, Chlamydophila pneumoniae CWL029
gaacuuaaaauucaaa

SEQ ID NO: 2535176 - RNA, 19 nt, Chlamydophila pneumoniae CWL029
gaacuucagcaagaaaaua

SEQ ID NO: 2535177 - RNA, 23 nt, Chlamydophila pneumoniae CWL029
gaacuucagcuuugcuuaaaaag

SEQ ID NO: 2535178 - RNA, 20 nt, Chlamydophila pneumoniae CWL029
gaacuuuagggaagaaauua

SEQ ID NO: 2535179 - RNA, 16 nt, Chlamydophila pneumoniae CWL029
gaacuuucgucuuugc

SEQ ID NO: 2535180 - RNA, 21 nt, Chlamydophila pneumoniae CWL029
gaacuuucgucuuugcuuucu

SEQ ID NO: 2535181 - RNA, 22 nt, Chlamydophila pneumoniae CWL029
gaacuuuugggcccucucuuga

SEQ ID NO: 2535182 - RNA, 15 nt, Chlamydophila pneumoniae CWL029
gaagaaaggaccauu

SEQ ID NO: 2535183 - RNA, 14 nt, Chlamydophila pneumoniae CWL029
gaagaaauuaacaa

SEQ ID NO: 2535184 - RNA, 23 nt, Chlamydophila pneumoniae CWL029
gaagaaauuaaguaggccuccuu

SEQ ID NO: 2535185 - RNA, 23 nt, Chlamydophila pneumoniae CWL029
gaagaaguacaagugaagacaag

SEQ ID NO: 2535186 - RNA, 17 nt, Chlamydophila pneumoniae CWL029
gaagaauuucauaagag

SEQ ID NO: 2535187 - RNA, 18 nt, Chlamydophila pneumoniae CWL029
gaagaauuucgucuucau

SEQ ID NO: 2535188 - RNA, 21 nt, Chlamydophila pneumoniae CWL029
gaagacaaguaaacagcaaag

SEQ ID NO: 2535189 - RNA, 14 nt, Chlamydophila pneumoniae CWL029
gaagacacagggga

SEQ ID NO: 2535190 - RNA, 22 nt, Chlamydophila pneumoniae CWL029
gaagaccccucuugcuuuuccg

SEQ ID NO: 2535191 - RNA, 24 nt, Chlamydophila pneumoniae CWL029
gaagacguucgacaacaacauaaa

SEQ ID NO: 2535192 - RNA, 19 nt, Chlamydophila pneumoniae CWL029
gaagacucucaucagcaaa

SEQ ID NO: 2535193 - RNA, 22 nt, Chlamydophila pneumoniae CWL029
gaagacucucaucagcaaaacu

SEQ ID NO: 2535194 - RNA, 14 nt, Chlamydophila pneumoniae CWL029
gaagacuugcucug

SEQ ID NO: 2535195 - RNA, 17 nt, Chlamydophila pneumoniae CWL029
gaagacuuguucuucau

SEQ ID NO: 2535196 - RNA, 15 nt, Chlamydophila pneumoniae CWL029
gaagagaaaguagag

SEQ ID NO: 2535197 - RNA, 20 nt, Chlamydophila pneumoniae CWL029
gaagagaguauagucugguu

SEQ ID NO: 2535198 - RNA, 20 nt, Chlamydophila pneumoniae CWL029
gaagagcaauuaagaaacua

SEQ ID NO: 2535199 - RNA, 18 nt, Chlamydophila pneumoniae CWL029
gaagagcauuuaaaacgg

SEQ ID NO: 2535200 - RNA, 13 nt, Chlamydophila pneumoniae CWL029
gaagagcuuccau

SEQ ID NO: 2535201 - RNA, 13 nt, Chlamydophila pneumoniae CWL029
gaagaggaaugcc

SEQ ID NO: 2535202 - RNA, 17 nt, Chlamydophila pneumoniae CWL029
gaagagguguccauaau

SEQ ID NO: 2535203 - RNA, 21 nt, Chlamydophila pneumoniae CWL029
gaagauauuaucgauaggaag

SEQ ID NO: 2535204 - RNA, 16 nt, Chlamydophila pneumoniae CWL029
gaagauccuagagaau

SEQ ID NO: 2535205 - RNA, 13 nt, Chlamydophila pneumoniae CWL029
gaagauccugagu

SEQ ID NO: 2535206 - RNA, 20 nt, Chlamydophila pneumoniae CWL029
gaagauccugaguauuuugc

SEQ ID NO: 2535207 - RNA, 19 nt, Chlamydophila pneumoniae CWL029
gaagaucgucggaagacuu

SEQ ID NO: 2535208 - RNA, 17 nt, Chlamydophila pneumoniae CWL029
gaagaucuugaacagag

SEQ ID NO: 2535209 - RNA, 18 nt, Chlamydophila pneumoniae CWL029
gaagaucuugaacagaga

SEQ ID NO: 2535210 - RNA, 22 nt, Chlamydophila pneumoniae CWL029
gaagaugagcgagguauucucu

SEQ ID NO: 2535211 - RNA, 14 nt, Chlamydophila pneumoniae CWL029
gaagaugauauucu

SEQ ID NO: 2535212 - RNA, 17 nt, Chlamydophila pneumoniae CWL029
gaagauggcaaggaaaa

SEQ ID NO: 2535213 - RNA, 12 nt, Chlamydophila pneumoniae CWL029
gaagauucaagc

SEQ ID NO: 2535214 - RNA, 13 nt, Chlamydophila pneumoniae CWL029
gaagauucuuuaa

SEQ ID NO: 2535215 - RNA, 15 nt, Chlamydophila pneumoniae CWL029
gaagcaaagaaaauu

SEQ ID NO: 2535216 - RNA, 17 nt, Chlamydophila pneumoniae CWL029
gaagcaacuaaacucuc

SEQ ID NO: 2535217 - RNA, 12 nt, Chlamydophila pneumoniae CWL029
gaagcagaaacu

SEQ ID NO: 2535218 - RNA, 17 nt, Chlamydophila pneumoniae CWL029
gaagcagaaacuuuaaa

SEQ ID NO: 2535219 - RNA, 18 nt, Chlamydophila pneumoniae CWL029
gaagcagaaacuuuaaaa

SEQ ID NO: 2535220 - RNA, 15 nt, Chlamydophila pneumoniae CWL029
gaagcaguuuaggua

SEQ ID NO: 2535221 - RNA, 14 nt, Chlamydophila pneumoniae CWL029
gaagcaucuucgau

SEQ ID NO: 2535222 - RNA, 23 nt, Chlamydophila pneumoniae CWL029
gaagcauucccgacucaaucaaa

SEQ ID NO: 2535223 - RNA, 14 nt, Chlamydophila pneumoniae CWL029
gaagccaccaucug

SEQ ID NO: 2535224 - RNA, 16 nt, Chlamydophila pneumoniae CWL029
gaagccaccaucuguu

SEQ ID NO: 2535225 - RNA, 23 nt, Chlamydophila pneumoniae CWL029
gaagccagucuucauaagaguag

SEQ ID NO: 2535226 - RNA, 21 nt, Chlamydophila pneumoniae CWL029
gaagcgccgcauuacagggaa

SEQ ID NO: 2535227 - RNA, 17 nt, Chlamydophila pneumoniae CWL029
gaagcgcgaggagcgau

SEQ ID NO: 2535228 - RNA, 15 nt, Chlamydophila pneumoniae CWL029
gaagcggagcaucuu

SEQ ID NO: 2535229 - RNA, 23 nt, Chlamydophila pneumoniae CWL029
gaagcuaucauuauacuucguua

SEQ ID NO: 2535230 - RNA, 21 nt, Chlamydophila pneumoniae CWL029
gaagcucuaucuuugguaugc

SEQ ID NO: 2535231 - RNA, 17 nt, Chlamydophila pneumoniae CWL029
gaagcucuucuacuuua

SEQ ID NO: 2535232 - RNA, 13 nt, Chlamydophila pneumoniae CWL029
gaagcugcugcua

SEQ ID NO: 2535233 - RNA, 16 nt, Chlamydophila pneumoniae CWL029
gaagcugcuucuucag

SEQ ID NO: 2535234 - RNA, 23 nt, Chlamydophila pneumoniae CWL029
gaagcugucgcaaaugcagucuc

SEQ ID NO: 2535235 - RNA, 19 nt, Chlamydophila pneumoniae CWL029
gaagcugucguccuaauuu

SEQ ID NO: 2535236 - RNA, 14 nt, Chlamydophila pneumoniae CWL029
gaagcuucaaugau

SEQ ID NO: 2535237 - RNA, 15 nt, Chlamydophila pneumoniae CWL029
gaagcuugcugauuu

SEQ ID NO: 2535238 - RNA, 18 nt, Chlamydophila pneumoniae CWL029
gaaggaaaaggcccccua

SEQ ID NO: 2535239 - RNA, 13 nt, Chlamydophila pneumoniae CWL029
gaaggaaaucaca

SEQ ID NO: 2535240 - RNA, 17 nt, Chlamydophila pneumoniae CWL029
gaaggaggaguccuucu

SEQ ID NO: 2535241 - RNA, 12 nt, Chlamydophila pneumoniae CWL029
gaaggaguucuu

SEQ ID NO: 2535242 - RNA, 16 nt, Chlamydophila pneumoniae CWL029
gaaggcuuguuucugu

SEQ ID NO: 2535243 - RNA, 20 nt, Chlamydophila pneumoniae CWL029
gaagggauguuuaauacaaa

SEQ ID NO: 2535244 - RNA, 18 nt, Chlamydophila pneumoniae CWL029
gaagguccaugucuaaag

SEQ ID NO: 2535245 - RNA, 15 nt, Chlamydophila pneumoniae CWL029
gaagguuuauuagaa

SEQ ID NO: 2535246 - RNA, 18 nt, Chlamydophila pneumoniae CWL029
gaaguaagcgauggcagu

SEQ ID NO: 2535247 - RNA, 20 nt, Chlamydophila pneumoniae CWL029
gaaguacaagugaagacaag

SEQ ID NO: 2535248 - RNA, 21 nt, Chlamydophila pneumoniae CWL029
gaaguacaagugaagacaagu

SEQ ID NO: 2535249 - RNA, 19 nt, Chlamydophila pneumoniae CWL029
gaaguauucgauuccugag

SEQ ID NO: 2535250 - RNA, 21 nt, Chlamydophila pneumoniae CWL029
gaaguccauguacagaaaaua

SEQ ID NO: 2535251 - RNA, 17 nt, Chlamydophila pneumoniae CWL029
gaagucccacaaaugau

SEQ ID NO: 2535252 - RNA, 18 nt, Chlamydophila pneumoniae CWL029
gaagucccacaaaugaua

SEQ ID NO: 2535253 - RNA, 22 nt, Chlamydophila pneumoniae CWL029
gaaguccuagggagugaggaau

SEQ ID NO: 2535254 - RNA, 22 nt, Chlamydophila pneumoniae CWL029
gaaguccuggauuuuaaagcaa

SEQ ID NO: 2535255 - RNA, 19 nt, Chlamydophila pneumoniae CWL029
gaagucgcaguaaugccaa

SEQ ID NO: 2535256 - RNA, 13 nt, Chlamydophila pneumoniae CWL029
gaagucguuuaga

SEQ ID NO: 2535257 - RNA, 13 nt, Chlamydophila pneumoniae CWL029
gaagucuucaggu

SEQ ID NO: 2535258 - RNA, 16 nt, Chlamydophila pneumoniae CWL029
gaagucuucaggugaa

SEQ ID NO: 2535259 - RNA, 16 nt, Chlamydophila pneumoniae CWL029
gaagucuucuugcuga

SEQ ID NO: 2535260 - RNA, 13 nt, Chlamydophila pneumoniae CWL029
gaaguguuucuuu

SEQ ID NO: 2535261 - RNA, 15 nt, Chlamydophila pneumoniae CWL029
gaaguuccuucagga

SEQ ID NO: 2535262 - RNA, 17 nt, Chlamydophila pneumoniae CWL029
gaaguuuacaaauaaaa

SEQ ID NO: 2535263 - RNA, 20 nt, Chlamydophila pneumoniae CWL029
gaaguuuuuuaagugcuuuu

SEQ ID NO: 2535264 - RNA, 23 nt, Chlamydophila pneumoniae CWL029
gaaguuuuuuaagugcuuuuaga

SEQ ID NO: 2535265 - RNA, 13 nt, Chlamydophila pneumoniae CWL029
gaaguuuuuucuc

SEQ ID NO: 2535266 - RNA, 14 nt, Chlamydophila pneumoniae CWL029
gaaguuuuuucucu

SEQ ID NO: 2535267 - RNA, 15 nt, Chlamydophila pneumoniae CWL029
gaaguuuuuucucuc

SEQ ID NO: 2535268 - RNA, 15 nt, Chlamydophila pneumoniae CWL029
gaauaaaacuuucuu

SEQ ID NO: 2535269 - RNA, 19 nt, Chlamydophila pneumoniae CWL029
gaauaaaggacauagacuu

SEQ ID NO: 2535270 - RNA, 17 nt, Chlamydophila pneumoniae CWL029
gaauaacaccaaaagaa

SEQ ID NO: 2535271 - RNA, 20 nt, Chlamydophila pneumoniae CWL029
gaauaagauuuugaaaauug

SEQ ID NO: 2535272 - RNA, 14 nt, Chlamydophila pneumoniae CWL029
gaauaaucaaccaa

SEQ ID NO: 2535273 - RNA, 15 nt, Chlamydophila pneumoniae CWL029
gaauaaucaaccaaa

SEQ ID NO: 2535274 - RNA, 13 nt, Chlamydophila pneumoniae CWL029
gaauaccagaagc

SEQ ID NO: 2535275 - RNA, 17 nt, Chlamydophila pneumoniae CWL029
gaauaccguuuuaggaa

SEQ ID NO: 2535276 - RNA, 17 nt, Chlamydophila pneumoniae CWL029
gaauaccucaagaugca

SEQ ID NO: 2535277 - RNA, 17 nt, Chlamydophila pneumoniae CWL029
gaauacuguucgauaag

SEQ ID NO: 2535278 - RNA, 18 nt, Chlamydophila pneumoniae CWL029
gaauagaauguaugugaa

SEQ ID NO: 2535279 - RNA, 18 nt, Chlamydophila pneumoniae CWL029
gaauagcaagcacuuucg

SEQ ID NO: 2535280 - RNA, 12 nt, Chlamydophila pneumoniae CWL029
gaauagcaggaa

SEQ ID NO: 2535281 - RNA, 19 nt, Chlamydophila pneumoniae CWL029
gaauagcuucugacucugu

SEQ ID NO: 2535282 - RNA, 12 nt, Chlamydophila pneumoniae CWL029
gaauaguuguga

SEQ ID NO: 2535283 - RNA, 21 nt, Chlamydophila pneumoniae CWL029
gaauaguugugagacuuucug

SEQ ID NO: 2535284 - RNA, 12 nt, Chlamydophila pneumoniae CWL029
gaauauagacuu

SEQ ID NO: 2535285 - RNA, 18 nt, Chlamydophila pneumoniae CWL029
gaauaucaucacuaagau

SEQ ID NO: 2535286 - RNA, 14 nt, Chlamydophila pneumoniae CWL029
gaauaucaucuucc

SEQ ID NO: 2535287 - RNA, 22 nt, Chlamydophila pneumoniae CWL029
gaauauccguauggauuucucc

SEQ ID NO: 2535288 - RNA, 17 nt, Chlamydophila pneumoniae CWL029
gaauaucuuuugaaucu

SEQ ID NO: 2535289 - RNA, 14 nt, Chlamydophila pneumoniae CWL029
gaauaugcuuuuca

SEQ ID NO: 2535290 - RNA, 18 nt, Chlamydophila pneumoniae CWL029
gaauaugcuuuucaaaua

SEQ ID NO: 2535291 - RNA, 13 nt, Chlamydophila pneumoniae CWL029
gaaucacucucua

SEQ ID NO: 2535292 - RNA, 19 nt, Chlamydophila pneumoniae CWL029
gaaucacuguaucagcaag

SEQ ID NO: 2535293 - RNA, 22 nt, Chlamydophila pneumoniae CWL029
gaaucacuguaucagcaagccc

SEQ ID NO: 2535294 - RNA, 14 nt, Chlamydophila pneumoniae CWL029
gaaucagauuagag

SEQ ID NO: 2535295 - RNA, 14 nt, Chlamydophila pneumoniae CWL029
gaauccaaagacuu

SEQ ID NO: 2535296 - RNA, 13 nt, Chlamydophila pneumoniae CWL029
gaaucccaaggga

SEQ ID NO: 2535297 - RNA, 17 nt, Chlamydophila pneumoniae CWL029
gaauccccaauguuuuc

SEQ ID NO: 2535298 - RNA, 17 nt, Chlamydophila pneumoniae CWL029
gaauccgaucauaauua

SEQ ID NO: 2535299 - RNA, 16 nt, Chlamydophila pneumoniae CWL029
gaauccucuauccauc

SEQ ID NO: 2535300 - RNA, 18 nt, Chlamydophila pneumoniae CWL029
gaauccucuauccaucau

SEQ ID NO: 2535301 - RNA, 20 nt, Chlamydophila pneumoniae CWL029
gaauccucuauccaucaucg

SEQ ID NO: 2535302 - RNA, 15 nt, Chlamydophila pneumoniae CWL029
gaauccuguucuaca

SEQ ID NO: 2535303 - RNA, 11 nt, Chlamydophila pneumoniae CWL029
gaauccuucuc

SEQ ID NO: 2535304 - RNA, 16 nt, Chlamydophila pneumoniae CWL029
gaauccuugaaagacu

SEQ ID NO: 2535305 - RNA, 22 nt, Chlamydophila pneumoniae CWL029
gaauccuugaaagacucgcucu

SEQ ID NO: 2535306 - RNA, 23 nt, Chlamydophila pneumoniae CWL029
gaaucgccgcuugaggaggauug

SEQ ID NO: 2535307 - RNA, 14 nt, Chlamydophila pneumoniae CWL029
gaaucggaucuuca

SEQ ID NO: 2535308 - RNA, 12 nt, Chlamydophila pneumoniae CWL029
gaaucuaagaug

SEQ ID NO: 2535309 - RNA, 18 nt, Chlamydophila pneumoniae CWL029
gaaucucauaaguauaga

SEQ ID NO: 2535310 - RNA, 21 nt, Chlamydophila pneumoniae CWL029
gaaucucauaaguauagagag

SEQ ID NO: 2535311 - RNA, 15 nt, Chlamydophila pneumoniae CWL029
gaaucuccucaucag

SEQ ID NO: 2535312 - RNA, 21 nt, Chlamydophila pneumoniae CWL029
gaaucuccucgucugauagag

SEQ ID NO: 2535313 - RNA, 12 nt, Chlamydophila pneumoniae CWL029
gaaucucuucug

SEQ ID NO: 2535314 - RNA, 20 nt, Chlamydophila pneumoniae CWL029
gaaucugguuccuuaaagag

SEQ ID NO: 2535315 - RNA, 14 nt, Chlamydophila pneumoniae CWL029
gaaucuuucaaaag

SEQ ID NO: 2535316 - RNA, 15 nt, Chlamydophila pneumoniae CWL029
gaaugaagagaguuc

SEQ ID NO: 2535317 - RNA, 17 nt, Chlamydophila pneumoniae CWL029
gaaugacacagagaaca

SEQ ID NO: 2535318 - RNA, 20 nt, Chlamydophila pneumoniae CWL029
gaaugacugcagauugcacu

SEQ ID NO: 2535319 - RNA, 21 nt, Chlamydophila pneumoniae CWL029
gaaugagcuucacaucuuucu

SEQ ID NO: 2535320 - RNA, 21 nt, Chlamydophila pneumoniae CWL029
gaaugauauuacagauuucuu

SEQ ID NO: 2535321 - RNA, 23 nt, Chlamydophila pneumoniae CWL029
gaaugaucccuaacgaugcaggc

SEQ ID NO: 2535322 - RNA, 21 nt, Chlamydophila pneumoniae CWL029
gaaugccauucuuaucugcug

SEQ ID NO: 2535323 - RNA, 17 nt, Chlamydophila pneumoniae CWL029
gaaugccugccaaucca

SEQ ID NO: 2535324 - RNA, 14 nt, Chlamydophila pneumoniae CWL029
gaauggauguugcg

SEQ ID NO: 2535325 - RNA, 19 nt, Chlamydophila pneumoniae CWL029
gaauguacauagaggagau

SEQ ID NO: 2535326 - RNA, 19 nt, Chlamydophila pneumoniae CWL029
gaauguagccaauccuucc

SEQ ID NO: 2535327 - RNA, 19 nt, Chlamydophila pneumoniae CWL029
gaauguaugugaaagauua

SEQ ID NO: 2535328 - RNA, 13 nt, Chlamydophila pneumoniae CWL029
gaauguucccaaa

SEQ ID NO: 2535329 - RNA, 23 nt, Chlamydophila pneumoniae CWL029
gaauuaaaaguuccaaaucucaa

SEQ ID NO: 2535330 - RNA, 18 nt, Chlamydophila pneumoniae CWL029
gaauuaaacuuucuucuc

SEQ ID NO: 2535331 - RNA, 21 nt, Chlamydophila pneumoniae CWL029
gaauuauuauuaguuaauuau

SEQ ID NO: 2535332 - RNA, 14 nt, Chlamydophila pneumoniae CWL029
gaauucaaacuccu

SEQ ID NO: 2535333 - RNA, 21 nt, Chlamydophila pneumoniae CWL029
gaauucaaacuccuuuuaaaa

SEQ ID NO: 2535334 - RNA, 23 nt, Chlamydophila pneumoniae CWL029
gaauucaaacuccuuuuaaaauu

SEQ ID NO: 2535335 - RNA, 16 nt, Chlamydophila pneumoniae CWL029
gaauuccucugauucc

SEQ ID NO: 2535336 - RNA, 20 nt, Chlamydophila pneumoniae CWL029
gaauucucagaaagccuuug

SEQ ID NO: 2535337 - RNA, 14 nt, Chlamydophila pneumoniae CWL029
gaauucugaugacc

SEQ ID NO: 2535338 - RNA, 15 nt, Chlamydophila pneumoniae CWL029
gaauucuuugccaag

SEQ ID NO: 2535339 - RNA, 14 nt, Chlamydophila pneumoniae CWL029
gaauugcauuaaga

SEQ ID NO: 2535340 - RNA, 15 nt, Chlamydophila pneumoniae CWL029
gaauuggaagcuuuu

SEQ ID NO: 2535341 - RNA, 15 nt, Chlamydophila pneumoniae CWL029
gaauugucaucucau

SEQ ID NO: 2535342 - RNA, 17 nt, Chlamydophila pneumoniae CWL029
gaauuguguguuuucau

SEQ ID NO: 2535343 - RNA, 19 nt, Chlamydophila pneumoniae CWL029
gaauuucggacgauauuua

SEQ ID NO: 2535344 - RNA, 20 nt, Chlamydophila pneumoniae CWL029
gaauuugauuuuucaaauuc

SEQ ID NO: 2535345 - RNA, 18 nt, Chlamydophila pneumoniae CWL029
gaauuuguccuuugcuaa

SEQ ID NO: 2535346 - RNA, 14 nt, Chlamydophila pneumoniae CWL029
gaauuuuaucagaa

SEQ ID NO: 2535347 - RNA, 22 nt, Chlamydophila pneumoniae CWL029
gaauuuucucauagcuuccugu

SEQ ID NO: 2535348 - RNA, 16 nt, Chlamydophila pneumoniae CWL029
gaauuuucuuuugcag

SEQ ID NO: 2535349 - RNA, 13 nt, Chlamydophila pneumoniae CWL029
gaauuuuucuagu

SEQ ID NO: 2535350 - RNA, 20 nt, Chlamydophila pneumoniae CWL029
gaauuuuucuaguucguuca

SEQ ID NO: 2535351 - RNA, 22 nt, Chlamydophila pneumoniae CWL029
gaauuuuuguuuuaacucuaga

SEQ ID NO: 2535352 - RNA, 13 nt, Chlamydophila pneumoniae CWL029
gacaaaaaugccu

SEQ ID NO: 2535353 - RNA, 12 nt, Chlamydophila pneumoniae CWL029
gacaaacucuau

SEQ ID NO: 2535354 - RNA, 14 nt, Chlamydophila pneumoniae CWL029
gacaaauaaguccu

SEQ ID NO: 2535355 - RNA, 21 nt, Chlamydophila pneumoniae CWL029
gacaacaaauugaugauuuuu

SEQ ID NO: 2535356 - RNA, 16 nt, Chlamydophila pneumoniae CWL029
gacaacaccucccacc

SEQ ID NO: 2535357 - RNA, 20 nt, Chlamydophila pneumoniae CWL029
gacaacagagacaagaccgu

SEQ ID NO: 2535358 - RNA, 15 nt, Chlamydophila pneumoniae CWL029
gacaagacaaugacu

SEQ ID NO: 2535359 - RNA, 23 nt, Chlamydophila pneumoniae CWL029
gacaagcaaggaaaaaaaaucug

SEQ ID NO: 2535360 - RNA, 19 nt, Chlamydophila pneumoniae CWL029
gacaaggagucgugcagga

SEQ ID NO: 2535361 - RNA, 20 nt, Chlamydophila pneumoniae CWL029
gacaagguggguagccagga

SEQ ID NO: 2535362 - RNA, 15 nt, Chlamydophila pneumoniae CWL029
gacaauaaaaaagag

SEQ ID NO: 2535363 - RNA, 16 nt, Chlamydophila pneumoniae CWL029
gacaauaaaauagccc

SEQ ID NO: 2535364 - RNA, 22 nt, Chlamydophila pneumoniae CWL029
gacaauauagaaaucgacaggg

SEQ ID NO: 2535365 - RNA, 14 nt, Chlamydophila pneumoniae CWL029
gacaauauagagau

SEQ ID NO: 2535366 - RNA, 18 nt, Chlamydophila pneumoniae CWL029
gacaaucaacauucuucu

SEQ ID NO: 2535367 - RNA, 19 nt, Chlamydophila pneumoniae CWL029
gacaaucgcuguaaauuca

SEQ ID NO: 2535368 - RNA, 16 nt, Chlamydophila pneumoniae CWL029
gacaaugacuguagga

SEQ ID NO: 2535369 - RNA, 23 nt, Chlamydophila pneumoniae CWL029
gacaaugcaaccuguaaagacca

SEQ ID NO: 2535370 - RNA, 21 nt, Chlamydophila pneumoniae CWL029
gacacaaaaagcuuuuuucuc

SEQ ID NO: 2535371 - RNA, 12 nt, Chlamydophila pneumoniae CWL029
gacacaacucuu

SEQ ID NO: 2535372 - RNA, 22 nt, Chlamydophila pneumoniae CWL029
gacacacuuucuuuaaagaaua

SEQ ID NO: 2535373 - RNA, 21 nt, Chlamydophila pneumoniae CWL029
gacacagagaacaauaaacga

SEQ ID NO: 2535374 - RNA, 15 nt, Chlamydophila pneumoniae CWL029
gacacagagcuucua

SEQ ID NO: 2535375 - RNA, 19 nt, Chlamydophila pneumoniae CWL029
gacacgaacuuugaccaga

SEQ ID NO: 2535376 - RNA, 19 nt, Chlamydophila pneumoniae CWL029
gacacgaauuccaagaucu

SEQ ID NO: 2535377 - RNA, 15 nt, Chlamydophila pneumoniae CWL029
gacacgccuccuuca

SEQ ID NO: 2535378 - RNA, 20 nt, Chlamydophila pneumoniae CWL029
gacacgccuccuucaaagau

SEQ ID NO: 2535379 - RNA, 23 nt, Chlamydophila pneumoniae CWL029
gacacgccuccuucaaagauaua

SEQ ID NO: 2535380 - RNA, 19 nt, Chlamydophila pneumoniae CWL029
gacacuugcuuaaggaaac

SEQ ID NO: 2535381 - RNA, 19 nt, Chlamydophila pneumoniae CWL029
gacagacagucugugagaa

SEQ ID NO: 2535382 - RNA, 17 nt, Chlamydophila pneumoniae CWL029
gacagcguauaggaaac

SEQ ID NO: 2535383 - RNA, 21 nt, Chlamydophila pneumoniae CWL029
gacagcugagaaauuccuaaa

SEQ ID NO: 2535384 - RNA, 13 nt, Chlamydophila pneumoniae CWL029
gacagggaaagaa

SEQ ID NO: 2535385 - RNA, 14 nt, Chlamydophila pneumoniae CWL029
gacagucugugaga

SEQ ID NO: 2535386 - RNA, 20 nt, Chlamydophila pneumoniae CWL029
gacagucugugagaaauagg

SEQ ID NO: 2535387 - RNA, 16 nt, Chlamydophila pneumoniae CWL029
gacauacaucaaaaug

SEQ ID NO: 2535388 - RNA, 18 nt, Chlamydophila pneumoniae CWL029
gacauacaucaaaaugcu

SEQ ID NO: 2535389 - RNA, 20 nt, Chlamydophila pneumoniae CWL029
gacauauccaaugagagaga

SEQ ID NO: 2535390 - RNA, 14 nt, Chlamydophila pneumoniae CWL029
gacaucuaauuuua

SEQ ID NO: 2535391 - RNA, 15 nt, Chlamydophila pneumoniae CWL029
gacaucuccaagaua

SEQ ID NO: 2535392 - RNA, 19 nt, Chlamydophila pneumoniae CWL029
gacaugagggcaugccuau

SEQ ID NO: 2535393 - RNA, 19 nt, Chlamydophila pneumoniae CWL029
gacauuuccccaugaaaau

SEQ ID NO: 2535394 - RNA, 16 nt, Chlamydophila pneumoniae CWL029
gacauuuucaagcuuu

SEQ ID NO: 2535395 - RNA, 19 nt, Chlamydophila pneumoniae CWL029
gaccaaaaauaaacauauu

SEQ ID NO: 2535396 - RNA, 23 nt, Chlamydophila pneumoniae CWL029
gaccaaaaauaaacauauucucc

SEQ ID NO: 2535397 - RNA, 16 nt, Chlamydophila pneumoniae CWL029
gaccaaauaauuaaau

SEQ ID NO: 2535398 - RNA, 13 nt, Chlamydophila pneumoniae CWL029
gaccaaauagaga

SEQ ID NO: 2535399 - RNA, 20 nt, Chlamydophila pneumoniae CWL029
gaccaacagauaggauggag

SEQ ID NO: 2535400 - RNA, 17 nt, Chlamydophila pneumoniae CWL029
gaccagaugauuuuuug

SEQ ID NO: 2535401 - RNA, 23 nt, Chlamydophila pneumoniae CWL029
gaccagaugauuuuuugaauccu

SEQ ID NO: 2535402 - RNA, 22 nt, Chlamydophila pneumoniae CWL029
gaccagaugcuaaagagucuuc

SEQ ID NO: 2535403 - RNA, 22 nt, Chlamydophila pneumoniae CWL029
gaccagguguagguuccugcuu

SEQ ID NO: 2535404 - RNA, 17 nt, Chlamydophila pneumoniae CWL029
gaccaguggcaggaaug

SEQ ID NO: 2535405 - RNA, 14 nt, Chlamydophila pneumoniae CWL029
gaccauaaaaucaa

SEQ ID NO: 2535406 - RNA, 13 nt, Chlamydophila pneumoniae CWL029
gaccgaaucucuc

SEQ ID NO: 2535407 - RNA, 20 nt, Chlamydophila pneumoniae CWL029
gaccgcaaggagucacuggc

SEQ ID NO: 2535408 - RNA, 21 nt, Chlamydophila pneumoniae CWL029
gaccgcaaggagucacuggca

SEQ ID NO: 2535409 - RNA, 15 nt, Chlamydophila pneumoniae CWL029
gaccuacguuuucuc

SEQ ID NO: 2535410 - RNA, 17 nt, Chlamydophila pneumoniae CWL029
gaccuacuuauuguucu

SEQ ID NO: 2535411 - RNA, 15 nt, Chlamydophila pneumoniae CWL029
gaccucaucagaagu

SEQ ID NO: 2535412 - RNA, 16 nt, Chlamydophila pneumoniae CWL029
gaccugcuuuuuuucu

SEQ ID NO: 2535413 - RNA, 18 nt, Chlamydophila pneumoniae CWL029
gaccugcuuuuuuucuag

SEQ ID NO: 2535414 - RNA, 15 nt, Chlamydophila pneumoniae CWL029
gaccuguaguaaaau

SEQ ID NO: 2535415 - RNA, 23 nt, Chlamydophila pneumoniae CWL029
gaccuguaguaaaauaagaaauc

SEQ ID NO: 2535416 - RNA, 13 nt, Chlamydophila pneumoniae CWL029
gaccuguuuucuu

SEQ ID NO: 2535417 - RNA, 17 nt, Chlamydophila pneumoniae CWL029
gaccuuccuuaucuuca

SEQ ID NO: 2535418 - RNA, 20 nt, Chlamydophila pneumoniae CWL029
gaccuuccuuaucuucagaa

SEQ ID NO: 2535419 - RNA, 19 nt, Chlamydophila pneumoniae CWL029
gaccuucucaagaucuuca

SEQ ID NO: 2535420 - RNA, 12 nt, Chlamydophila pneumoniae CWL029
gaccuucucuuc

SEQ ID NO: 2535421 - RNA, 17 nt, Chlamydophila pneumoniae CWL029
gaccuuggacucuaggg

SEQ ID NO: 2535422 - RNA, 22 nt, Chlamydophila pneumoniae CWL029
gaccuuuaggaacuugaauacc

SEQ ID NO: 2535423 - RNA, 23 nt, Chlamydophila pneumoniae CWL029
gacgaaagcacauaagaugaagu

SEQ ID NO: 2535424 - RNA, 22 nt, Chlamydophila pneumoniae CWL029
gacgaacaugccugaaaacaag

SEQ ID NO: 2535425 - RNA, 15 nt, Chlamydophila pneumoniae CWL029
gacgacaaggagucg

SEQ ID NO: 2535426 - RNA, 22 nt, Chlamydophila pneumoniae CWL029
gacgaccuacacguuacgaaug

SEQ ID NO: 2535427 - RNA, 23 nt, Chlamydophila pneumoniae CWL029
gacgagaacaugaccuuuaggaa

SEQ ID NO: 2535428 - RNA, 21 nt, Chlamydophila pneumoniae CWL029
gacgagcaugcuaagcaucag

SEQ ID NO: 2535429 - RNA, 22 nt, Chlamydophila pneumoniae CWL029
gacgagcccuagauagcaaauc

SEQ ID NO: 2535430 - RNA, 23 nt, Chlamydophila pneumoniae CWL029
gacgaguugaaguuuugcucucu

SEQ ID NO: 2535431 - RNA, 18 nt, Chlamydophila pneumoniae CWL029
gacgauauuuagagagaa

SEQ ID NO: 2535432 - RNA, 23 nt, Chlamydophila pneumoniae CWL029
gacgaucuugagccacuuuuaau

SEQ ID NO: 2535433 - RNA, 15 nt, Chlamydophila pneumoniae CWL029
gacgcacauuuagaa

SEQ ID NO: 2535434 - RNA, 21 nt, Chlamydophila pneumoniae CWL029
gacgcgcuucuucaagaaaug

SEQ ID NO: 2535435 - RNA, 16 nt, Chlamydophila pneumoniae CWL029
gacgcggaacucucuu

SEQ ID NO: 2535436 - RNA, 22 nt, Chlamydophila pneumoniae CWL029
gacgcggaacucucuuccccca

SEQ ID NO: 2535437 - RNA, 20 nt, Chlamydophila pneumoniae CWL029
gacgcucuaaacucucuucc

SEQ ID NO: 2535438 - RNA, 15 nt, Chlamydophila pneumoniae CWL029
gacgcuuuuaucugu

SEQ ID NO: 2535439 - RNA, 14 nt, Chlamydophila pneumoniae CWL029
gacggaaaaucaca

SEQ ID NO: 2535440 - RNA, 17 nt, Chlamydophila pneumoniae CWL029
gacggauaaauggagga

SEQ ID NO: 2535441 - RNA, 14 nt, Chlamydophila pneumoniae CWL029
gacggauccuagaa

SEQ ID NO: 2535442 - RNA, 20 nt, Chlamydophila pneumoniae CWL029
gacguaauuacgcucuccau

SEQ ID NO: 2535443 - RNA, 17 nt, Chlamydophila pneumoniae CWL029
gacguacuaagauacgu

SEQ ID NO: 2535444 - RNA, 16 nt, Chlamydophila pneumoniae CWL029
gacgucuccaacaguc

SEQ ID NO: 2535445 - RNA, 20 nt, Chlamydophila pneumoniae CWL029
gacgucuucuuagaagagaa

SEQ ID NO: 2535446 - RNA, 21 nt, Chlamydophila pneumoniae CWL029
gacgucuucuuagaagagaaa

SEQ ID NO: 2535447 - RNA, 20 nt, Chlamydophila pneumoniae CWL029
gacgugguaagguuaucuuu

SEQ ID NO: 2535448 - RNA, 14 nt, Chlamydophila pneumoniae CWL029
gacgugguuuuugc

SEQ ID NO: 2535449 - RNA, 14 nt, Chlamydophila pneumoniae CWL029
gacguuccuuucuc

SEQ ID NO: 2535450 - RNA, 23 nt, Chlamydophila pneumoniae CWL029
gacguucgacaacaacauaaaga

SEQ ID NO: 2535451 - RNA, 20 nt, Chlamydophila pneumoniae CWL029
gacguugcgaacagcuccug

SEQ ID NO: 2535452 - RNA, 21 nt, Chlamydophila pneumoniae CWL029
gacguuguugcaauucuucau

SEQ ID NO: 2535453 - RNA, 16 nt, Chlamydophila pneumoniae CWL029
gacguuugaucuucuc

SEQ ID NO: 2535454 - RNA, 14 nt, Chlamydophila pneumoniae CWL029
gacuaaaaaagaga

SEQ ID NO: 2535455 - RNA, 14 nt, Chlamydophila pneumoniae CWL029
gacuaaaagaauaa

SEQ ID NO: 2535456 - RNA, 16 nt, Chlamydophila pneumoniae CWL029
gacuaaaagaauaaua

SEQ ID NO: 2535457 - RNA, 16 nt, Chlamydophila pneumoniae CWL029
gacuaauaccuuucua

SEQ ID NO: 2535458 - RNA, 13 nt, Chlamydophila pneumoniae CWL029
gacuacaagauag

SEQ ID NO: 2535459 - RNA, 20 nt, Chlamydophila pneumoniae CWL029
gacuacaucuuguucugcac

SEQ ID NO: 2535460 - RNA, 15 nt, Chlamydophila pneumoniae CWL029
gacuagcuuuucaug

SEQ ID NO: 2535461 - RNA, 16 nt, Chlamydophila pneumoniae CWL029
gacuauagaaaaggau

SEQ ID NO: 2535462 - RNA, 18 nt, Chlamydophila pneumoniae CWL029
gacuauagaaaaggaugc

SEQ ID NO: 2535463 - RNA, 15 nt, Chlamydophila pneumoniae CWL029
gacuauagaugccau

SEQ ID NO: 2535464 - RNA, 21 nt, Chlamydophila pneumoniae CWL029
gacuauagaugccauaagucc

SEQ ID NO: 2535465 - RNA, 12 nt, Chlamydophila pneumoniae CWL029
gacuauuuucau

SEQ ID NO: 2535466 - RNA, 16 nt, Chlamydophila pneumoniae CWL029
gacucaaucaaauuca

SEQ ID NO: 2535467 - RNA, 18 nt, Chlamydophila pneumoniae CWL029
gacucagagaaaaucaac

SEQ ID NO: 2535468 - RNA, 21 nt, Chlamydophila pneumoniae CWL029
gacucaugaaauaguguuucu

SEQ ID NO: 2535469 - RNA, 15 nt, Chlamydophila pneumoniae CWL029
gacuccaagaauagc

SEQ ID NO: 2535470 - RNA, 11 nt, Chlamydophila pneumoniae CWL029
gacucccaagg

SEQ ID NO: 2535471 - RNA, 21 nt, Chlamydophila pneumoniae CWL029
gacucgccgaaaguaucuuca

SEQ ID NO: 2535472 - RNA, 16 nt, Chlamydophila pneumoniae CWL029
gacucgcgucaugcau

SEQ ID NO: 2535473 - RNA, 16 nt, Chlamydophila pneumoniae CWL029
gacucuaauucagaaa

SEQ ID NO: 2535474 - RNA, 22 nt, Chlamydophila pneumoniae CWL029
gacucuaguuuuucuuuagaga

SEQ ID NO: 2535475 - RNA, 21 nt, Chlamydophila pneumoniae CWL029
gacucugccaugucuaaagga

SEQ ID NO: 2535476 - RNA, 23 nt, Chlamydophila pneumoniae CWL029
gacugaaaagaucguuaucaaaa

SEQ ID NO: 2535477 - RNA, 14 nt, Chlamydophila pneumoniae CWL029
gacugcaaaggaag

SEQ ID NO: 2535478 - RNA, 12 nt, Chlamydophila pneumoniae CWL029
gacugcauagac

SEQ ID NO: 2535479 - RNA, 17 nt, Chlamydophila pneumoniae CWL029
gacugcucuuucauuuc

SEQ ID NO: 2535480 - RNA, 16 nt, Chlamydophila pneumoniae CWL029
gacugucuaugaucca

SEQ ID NO: 2535481 - RNA, 19 nt, Chlamydophila pneumoniae CWL029
gacugugauugcguauaga

SEQ ID NO: 2535482 - RNA, 14 nt, Chlamydophila pneumoniae CWL029
gacuguuuguuuau

SEQ ID NO: 2535483 - RNA, 21 nt, Chlamydophila pneumoniae CWL029
gacuucaccuugaaguuuuuu

SEQ ID NO: 2535484 - RNA, 23 nt, Chlamydophila pneumoniae CWL029
gacuucaccuugaaguuuuuucu

SEQ ID NO: 2535485 - RNA, 16 nt, Chlamydophila pneumoniae CWL029
gacuuccuccaaaauu

SEQ ID NO: 2535486 - RNA, 22 nt, Chlamydophila pneumoniae CWL029
gacuuccucuucaauuucuuca

SEQ ID NO: 2535487 - RNA, 16 nt, Chlamydophila pneumoniae CWL029
gacuugcaagcuucuu

SEQ ID NO: 2535488 - RNA, 20 nt, Chlamydophila pneumoniae CWL029
gacuugcaagcuucuuguuu

SEQ ID NO: 2535489 - RNA, 13 nt, Chlamydophila pneumoniae CWL029
gacuuguucuuca

SEQ ID NO: 2535490 - RNA, 14 nt, Chlamydophila pneumoniae CWL029
gacuuguuucuccu

SEQ ID NO: 2535491 - RNA, 12 nt, Chlamydophila pneumoniae CWL029
gacuuuccucaa

SEQ ID NO: 2535492 - RNA, 12 nt, Chlamydophila pneumoniae CWL029
gacuuuccucuc

SEQ ID NO: 2535493 - RNA, 15 nt, Chlamydophila pneumoniae CWL029
gacuuuccucucuuu

SEQ ID NO: 2535494 - RNA, 17 nt, Chlamydophila pneumoniae CWL029
gacuuuggucuucugua

SEQ ID NO: 2535495 - RNA, 19 nt, Chlamydophila pneumoniae CWL029
gagaaaagguaacauugga

SEQ ID NO: 2535496 - RNA, 16 nt, Chlamydophila pneumoniae CWL029
gagaaaaucugcagca

SEQ ID NO: 2535497 - RNA, 23 nt, Chlamydophila pneumoniae CWL029
gagaaacuuaguuuugaaaagau

SEQ ID NO: 2535498 - RNA, 16 nt, Chlamydophila pneumoniae CWL029
gagaaagagugccaag

SEQ ID NO: 2535499 - RNA, 17 nt, Chlamydophila pneumoniae CWL029
gagaaagcuucuaugaa

SEQ ID NO: 2535500 - RNA, 18 nt, Chlamydophila pneumoniae CWL029
gagaaaugcucuucugca

SEQ ID NO: 2535501 - RNA, 21 nt, Chlamydophila pneumoniae CWL029
gagaaauuuuuaauuuuucua

SEQ ID NO: 2535502 - RNA, 22 nt, Chlamydophila pneumoniae CWL029
gagaaccuucacaagaaaacaa

SEQ ID NO: 2535503 - RNA, 17 nt, Chlamydophila pneumoniae CWL029
gagaacguagcagaggc

SEQ ID NO: 2535504 - RNA, 15 nt, Chlamydophila pneumoniae CWL029
gagaacuuccugauu

SEQ ID NO: 2535505 - RNA, 22 nt, Chlamydophila pneumoniae CWL029
gagaacuuuaacgaagaaggga

SEQ ID NO: 2535506 - RNA, 22 nt, Chlamydophila pneumoniae CWL029
gagaacuuuugaauuaaaaguu

SEQ ID NO: 2535507 - RNA, 19 nt, Chlamydophila pneumoniae CWL029
gagaagcucaucagcaacc

SEQ ID NO: 2535508 - RNA, 18 nt, Chlamydophila pneumoniae CWL029
gagaauacagagucugug

SEQ ID NO: 2535509 - RNA, 13 nt, Chlamydophila pneumoniae CWL029
gagaauaucaucu

SEQ ID NO: 2535510 - RNA, 16 nt, Chlamydophila pneumoniae CWL029
gagaaucuccucauca

SEQ ID NO: 2535511 - RNA, 16 nt, Chlamydophila pneumoniae CWL029
gagaaugacuuuagaa

SEQ ID NO: 2535512 - RNA, 16 nt, Chlamydophila pneumoniae CWL029
gagaaugcccuguucu

SEQ ID NO: 2535513 - RNA, 12 nt, Chlamydophila pneumoniae CWL029
gagaaugcugua

SEQ ID NO: 2535514 - RNA, 22 nt, Chlamydophila pneumoniae CWL029
gagaauguucccaaauagaaaa

SEQ ID NO: 2535515 - RNA, 14 nt, Chlamydophila pneumoniae CWL029
gagaauuucuccag

SEQ ID NO: 2535516 - RNA, 12 nt, Chlamydophila pneumoniae CWL029
gagaauuuucau

SEQ ID NO: 2535517 - RNA, 16 nt, Chlamydophila pneumoniae CWL029
gagacaaagccacagc

SEQ ID NO: 2535518 - RNA, 14 nt, Chlamydophila pneumoniae CWL029
gagacaagaaaaua

SEQ ID NO: 2535519 - RNA, 19 nt, Chlamydophila pneumoniae CWL029
gagacaaguucaucaaaua

SEQ ID NO: 2535520 - RNA, 22 nt, Chlamydophila pneumoniae CWL029
gagacagacagucugugagaaa

SEQ ID NO: 2535521 - RNA, 15 nt, Chlamydophila pneumoniae CWL029
gagacauuucuugau

SEQ ID NO: 2535522 - RNA, 18 nt, Chlamydophila pneumoniae CWL029
gagaccuacuuauuguuc

SEQ ID NO: 2535523 - RNA, 21 nt, Chlamydophila pneumoniae CWL029
gagaccuacuuauuguucuug

SEQ ID NO: 2535524 - RNA, 13 nt, Chlamydophila pneumoniae CWL029
gagaccuucucuu

SEQ ID NO: 2535525 - RNA, 15 nt, Chlamydophila pneumoniae CWL029
gagaccuucucuuca

SEQ ID NO: 2535526 - RNA, 13 nt, Chlamydophila pneumoniae CWL029
gagacgcuuuuau

SEQ ID NO: 2535527 - RNA, 13 nt, Chlamydophila pneumoniae CWL029
gagacguuguugc

SEQ ID NO: 2535528 - RNA, 18 nt, Chlamydophila pneumoniae CWL029
gagacucuaguuuuucuu

SEQ ID NO: 2535529 - RNA, 13 nt, Chlamydophila pneumoniae CWL029
gagacuuccucuu

SEQ ID NO: 2535530 - RNA, 15 nt, Chlamydophila pneumoniae CWL029
gagacuuccucuuca

SEQ ID NO: 2535531 - RNA, 22 nt, Chlamydophila pneumoniae CWL029
gagagaaacaucggagaacuuc

SEQ ID NO: 2535532 - RNA, 13 nt, Chlamydophila pneumoniae CWL029
gagagaacuuuug

SEQ ID NO: 2535533 - RNA, 13 nt, Chlamydophila pneumoniae CWL029
gagagaagaaauu

SEQ ID NO: 2535534 - RNA, 21 nt, Chlamydophila pneumoniae CWL029
gagagaagcagaaucugugag

SEQ ID NO: 2535535 - RNA, 18 nt, Chlamydophila pneumoniae CWL029
gagagaaggaauuaaaau

SEQ ID NO: 2535536 - RNA, 13 nt, Chlamydophila pneumoniae CWL029
gagagagcucuuc

SEQ ID NO: 2535537 - RNA, 13 nt, Chlamydophila pneumoniae CWL029
gagagagcuggac

SEQ ID NO: 2535538 - RNA, 21 nt, Chlamydophila pneumoniae CWL029
gagagagcuggacuucugguu

SEQ ID NO: 2535539 - RNA, 19 nt, Chlamydophila pneumoniae CWL029
gagagaucuggaugagagg

SEQ ID NO: 2535540 - RNA, 14 nt, Chlamydophila pneumoniae CWL029
gagagccuuuccua

SEQ ID NO: 2535541 - RNA, 19 nt, Chlamydophila pneumoniae CWL029
gagagcuugguuuucuccu

SEQ ID NO: 2535542 - RNA, 22 nt, Chlamydophila pneumoniae CWL029
gagagcuugguuuucuccuucu

SEQ ID NO: 2535543 - RNA, 21 nt, Chlamydophila pneumoniae CWL029
gagagcuuucgcuccuaagcu

SEQ ID NO: 2535544 - RNA, 20 nt, Chlamydophila pneumoniae CWL029
gagagcuuuuagguagagaa

SEQ ID NO: 2535545 - RNA, 22 nt, Chlamydophila pneumoniae CWL029
gagagguaaccagagagcuuuu

SEQ ID NO: 2535546 - RNA, 18 nt, Chlamydophila pneumoniae CWL029
gagaguagugaacacucu

SEQ ID NO: 2535547 - RNA, 21 nt, Chlamydophila pneumoniae CWL029
gagaguccugggguucucuaa

SEQ ID NO: 2535548 - RNA, 22 nt, Chlamydophila pneumoniae CWL029
gagaguucuuguaauaaaagaa

SEQ ID NO: 2535549 - RNA, 19 nt, Chlamydophila pneumoniae CWL029
gagauaaucgcacuucuau

SEQ ID NO: 2535550 - RNA, 18 nt, Chlamydophila pneumoniae CWL029
gagauauugugaggggau

SEQ ID NO: 2535551 - RNA, 15 nt, Chlamydophila pneumoniae CWL029
gagaucauuagcauc

SEQ ID NO: 2535552 - RNA, 23 nt, Chlamydophila pneumoniae CWL029
gagaucauuagcaucaucuccug

SEQ ID NO: 2535553 - RNA, 14 nt, Chlamydophila pneumoniae CWL029
gagauccuaagaga

SEQ ID NO: 2535554 - RNA, 19 nt, Chlamydophila pneumoniae CWL029
gagaucuuauagacaggua

SEQ ID NO: 2535555 - RNA, 13 nt, Chlamydophila pneumoniae CWL029
gagaucuuugaga

SEQ ID NO: 2535556 - RNA, 21 nt, Chlamydophila pneumoniae CWL029
gagaugccauaagcaagcaac

SEQ ID NO: 2535557 - RNA, 17 nt, Chlamydophila pneumoniae CWL029
gagauuaccgaagagcc

SEQ ID NO: 2535558 - RNA, 22 nt, Chlamydophila pneumoniae CWL029
gagauuccuaaaccuaaaaugg

SEQ ID NO: 2535559 - RNA, 15 nt, Chlamydophila pneumoniae CWL029
gagauucgaaagaac

SEQ ID NO: 2535560 - RNA, 14 nt, Chlamydophila pneumoniae CWL029
gagauugauuucuu

SEQ ID NO: 2535561 - RNA, 14 nt, Chlamydophila pneumoniae CWL029
gagcaacaguaauu

SEQ ID NO: 2535562 - RNA, 23 nt, Chlamydophila pneumoniae CWL029
gagcaacuucuucguuagagaag

SEQ ID NO: 2535563 - RNA, 15 nt, Chlamydophila pneumoniae CWL029
gagcacauuuuucua

SEQ ID NO: 2535564 - RNA, 18 nt, Chlamydophila pneumoniae CWL029
gagcagaaacuccaaaau

SEQ ID NO: 2535565 - RNA, 23 nt, Chlamydophila pneumoniae CWL029
gagcagcuuuaucaggaucuuga

SEQ ID NO: 2535566 - RNA, 16 nt, Chlamydophila pneumoniae CWL029
gagcaucauuaauucc

SEQ ID NO: 2535567 - RNA, 14 nt, Chlamydophila pneumoniae CWL029
gagcauccaaaaug

SEQ ID NO: 2535568 - RNA, 14 nt, Chlamydophila pneumoniae CWL029
gagcaucuuuucaa

SEQ ID NO: 2535569 - RNA, 19 nt, Chlamydophila pneumoniae CWL029
gagcauugacuugggauuc

SEQ ID NO: 2535570 - RNA, 21 nt, Chlamydophila pneumoniae CWL029
gagcauuuaaccccacaauca

SEQ ID NO: 2535571 - RNA, 23 nt, Chlamydophila pneumoniae CWL029
gagcauuuccaaacccauauucc

SEQ ID NO: 2535572 - RNA, 21 nt, Chlamydophila pneumoniae CWL029
gagccaacagguucacuucau

SEQ ID NO: 2535573 - RNA, 20 nt, Chlamydophila pneumoniae CWL029
gagccacuuuuaauuucuua

SEQ ID NO: 2535574 - RNA, 16 nt, Chlamydophila pneumoniae CWL029
gagccggaacuucagg

SEQ ID NO: 2535575 - RNA, 20 nt, Chlamydophila pneumoniae CWL029
gagccgucuacuuuugugaa

SEQ ID NO: 2535576 - RNA, 18 nt, Chlamydophila pneumoniae CWL029
gagccuagagaguucuug

SEQ ID NO: 2535577 - RNA, 13 nt, Chlamydophila pneumoniae CWL029
gagcgccuccacc

SEQ ID NO: 2535578 - RNA, 18 nt, Chlamydophila pneumoniae CWL029
gagcgguucuuucuagaa

SEQ ID NO: 2535579 - RNA, 11 nt, Chlamydophila pneumoniae CWL029
gagcuaagucu

SEQ ID NO: 2535580 - RNA, 18 nt, Chlamydophila pneumoniae CWL029
gagcuacaagaacugaag

SEQ ID NO: 2535581 - RNA, 16 nt, Chlamydophila pneumoniae CWL029
gagcuagaaugucuug

SEQ ID NO: 2535582 - RNA, 12 nt, Chlamydophila pneumoniae CWL029
gagcuaucuuca

SEQ ID NO: 2535583 - RNA, 16 nt, Chlamydophila pneumoniae CWL029
gagcuauuuaggcaug

SEQ ID NO: 2535584 - RNA, 12 nt, Chlamydophila pneumoniae CWL029
gagcuccuccuu

SEQ ID NO: 2535585 - RNA, 16 nt, Chlamydophila pneumoniae CWL029
gagcucgcaaaagcug

SEQ ID NO: 2535586 - RNA, 17 nt, Chlamydophila pneumoniae CWL029
gagcucgcaaaagcugu

SEQ ID NO: 2535587 - RNA, 20 nt, Chlamydophila pneumoniae CWL029
gagcucguaauccuucuuuc

SEQ ID NO: 2535588 - RNA, 17 nt, Chlamydophila pneumoniae CWL029
gagcucuacucuacagu

SEQ ID NO: 2535589 - RNA, 13 nt, Chlamydophila pneumoniae CWL029
gagcucuugagaa

SEQ ID NO: 2535590 - RNA, 18 nt, Chlamydophila pneumoniae CWL029
gagcugauccagcuccau

SEQ ID NO: 2535591 - RNA, 14 nt, Chlamydophila pneumoniae CWL029
gagcugcugguccu

SEQ ID NO: 2535592 - RNA, 23 nt, Chlamydophila pneumoniae CWL029
gagcuggaagacuugcucugaag

SEQ ID NO: 2535593 - RNA, 19 nt, Chlamydophila pneumoniae CWL029
gagcuucacaucuuucucu

SEQ ID NO: 2535594 - RNA, 16 nt, Chlamydophila pneumoniae CWL029
gagcuucuaagaucuu

SEQ ID NO: 2535595 - RNA, 13 nt, Chlamydophila pneumoniae CWL029
gagcuucuaucuu

SEQ ID NO: 2535596 - RNA, 22 nt, Chlamydophila pneumoniae CWL029
gagcuuguucuguaacacuucc

SEQ ID NO: 2535597 - RNA, 15 nt, Chlamydophila pneumoniae CWL029
gagcuuuuacaaacc

SEQ ID NO: 2535598 - RNA, 20 nt, Chlamydophila pneumoniae CWL029
gaggaacguuacgucuuagg

SEQ ID NO: 2535599 - RNA, 13 nt, Chlamydophila pneumoniae CWL029
gaggaaucuaaga

SEQ ID NO: 2535600 - RNA, 12 nt, Chlamydophila pneumoniae CWL029
gaggaaugaaga

SEQ ID NO: 2535601 - RNA, 13 nt, Chlamydophila pneumoniae CWL029
gaggaaugaagag

SEQ ID NO: 2535602 - RNA, 12 nt, Chlamydophila pneumoniae CWL029
gaggaaugaucc

SEQ ID NO: 2535603 - RNA, 14 nt, Chlamydophila pneumoniae CWL029
gaggaauucuggaa

SEQ ID NO: 2535604 - RNA, 14 nt, Chlamydophila pneumoniae CWL029
gaggacgaaucaau

SEQ ID NO: 2535605 - RNA, 15 nt, Chlamydophila pneumoniae CWL029
gaggacgcagagaug

SEQ ID NO: 2535606 - RNA, 23 nt, Chlamydophila pneumoniae CWL029
gaggagacuugaucuacaaaaac

SEQ ID NO: 2535607 - RNA, 13 nt, Chlamydophila pneumoniae CWL029
gaggagauaaaga

SEQ ID NO: 2535608 - RNA, 16 nt, Chlamydophila pneumoniae CWL029
gaggagccuccauaau

SEQ ID NO: 2535609 - RNA, 18 nt, Chlamydophila pneumoniae CWL029
gaggagcgauagcucagc

SEQ ID NO: 2535610 - RNA, 23 nt, Chlamydophila pneumoniae CWL029
gaggagcuauuaaauuaucagag

SEQ ID NO: 2535611 - RNA, 18 nt, Chlamydophila pneumoniae CWL029
gaggagcucccucuagag

SEQ ID NO: 2535612 - RNA, 21 nt, Chlamydophila pneumoniae CWL029
gaggagcuuggggguggucua

SEQ ID NO: 2535613 - RNA, 14 nt, Chlamydophila pneumoniae CWL029
gaggaguuuuccaa

SEQ ID NO: 2535614 - RNA, 16 nt, Chlamydophila pneumoniae CWL029
gaggauucuuuuugau

SEQ ID NO: 2535615 - RNA, 11 nt, Chlamydophila pneumoniae CWL029
gaggcaaagau

SEQ ID NO: 2535616 - RNA, 15 nt, Chlamydophila pneumoniae CWL029
gaggcaagucucaaa

SEQ ID NO: 2535617 - RNA, 14 nt, Chlamydophila pneumoniae CWL029
gaggcuagaaaauc

SEQ ID NO: 2535618 - RNA, 21 nt, Chlamydophila pneumoniae CWL029
gaggcuagaaaaucauacgcc

SEQ ID NO: 2535619 - RNA, 22 nt, Chlamydophila pneumoniae CWL029
gaggcuucugagcuugccuacc

SEQ ID NO: 2535620 - RNA, 19 nt, Chlamydophila pneumoniae CWL029
gagggaucuucucuaugaa

SEQ ID NO: 2535621 - RNA, 22 nt, Chlamydophila pneumoniae CWL029
gaggggccuaaagcuccgagaa

SEQ ID NO: 2535622 - RNA, 23 nt, Chlamydophila pneumoniae CWL029
gagggguaaaccaauugagcucu

SEQ ID NO: 2535623 - RNA, 16 nt, Chlamydophila pneumoniae CWL029
gaggguuccaagagcu

SEQ ID NO: 2535624 - RNA, 14 nt, Chlamydophila pneumoniae CWL029
gagguaaccagaga

SEQ ID NO: 2535625 - RNA, 20 nt, Chlamydophila pneumoniae CWL029
gagguagcaucucucuccaa

SEQ ID NO: 2535626 - RNA, 16 nt, Chlamydophila pneumoniae CWL029
gagguaugaauaggaa

SEQ ID NO: 2535627 - RNA, 23 nt, Chlamydophila pneumoniae CWL029
gagguccuuggcauucaggagca

SEQ ID NO: 2535628 - RNA, 13 nt, Chlamydophila pneumoniae CWL029
gagguuauguacu

SEQ ID NO: 2535629 - RNA, 16 nt, Chlamydophila pneumoniae CWL029
gagguucgcagaacuu

SEQ ID NO: 2535630 - RNA, 20 nt, Chlamydophila pneumoniae CWL029
gagguucgcagaacuucucc

SEQ ID NO: 2535631 - RNA, 22 nt, Chlamydophila pneumoniae CWL029
gagguucgcagaacuucuccaa

SEQ ID NO: 2535632 - RNA, 21 nt, Chlamydophila pneumoniae CWL029
gagguuucccgguaugaucaa

SEQ ID NO: 2535633 - RNA, 15 nt, Chlamydophila pneumoniae CWL029
gaguaaaaucauagg

SEQ ID NO: 2535634 - RNA, 21 nt, Chlamydophila pneumoniae CWL029
gaguagacaagagagagcugg

SEQ ID NO: 2535635 - RNA, 19 nt, Chlamydophila pneumoniae CWL029
gaguagccagacuggucua

SEQ ID NO: 2535636 - RNA, 19 nt, Chlamydophila pneumoniae CWL029
gaguaggguguauucugaa

SEQ ID NO: 2535637 - RNA, 20 nt, Chlamydophila pneumoniae CWL029
gaguaucuagcuuugucucu

SEQ ID NO: 2535638 - RNA, 19 nt, Chlamydophila pneumoniae CWL029
gaguaugaggagauaaaga

SEQ ID NO: 2535639 - RNA, 16 nt, Chlamydophila pneumoniae CWL029
gaguauggcaaauaaa

SEQ ID NO: 2535640 - RNA, 20 nt, Chlamydophila pneumoniae CWL029
gagucacuggcaucagugga

SEQ ID NO: 2535641 - RNA, 15 nt, Chlamydophila pneumoniae CWL029
gagucaggaagaugc

SEQ ID NO: 2535642 - RNA, 18 nt, Chlamydophila pneumoniae CWL029
gagucagguaaagagcuu

SEQ ID NO: 2535643 - RNA, 18 nt, Chlamydophila pneumoniae CWL029
gaguccaagguucuggga

SEQ ID NO: 2535644 - RNA, 19 nt, Chlamydophila pneumoniae CWL029
gagucccuugucaacaaaa

SEQ ID NO: 2535645 - RNA, 19 nt, Chlamydophila pneumoniae CWL029
gaguccuaaaauuucuagg

SEQ ID NO: 2535646 - RNA, 14 nt, Chlamydophila pneumoniae CWL029
gaguccuucuuuuc

SEQ ID NO: 2535647 - RNA, 22 nt, Chlamydophila pneumoniae CWL029
gagucgaaacacucaugaaagu

SEQ ID NO: 2535648 - RNA, 13 nt, Chlamydophila pneumoniae CWL029
gagucgauuuccc

SEQ ID NO: 2535649 - RNA, 16 nt, Chlamydophila pneumoniae CWL029
gagucgugcaggagaa

SEQ ID NO: 2535650 - RNA, 21 nt, Chlamydophila pneumoniae CWL029
gagucucacucuuuucuagaa

SEQ ID NO: 2535651 - RNA, 19 nt, Chlamydophila pneumoniae CWL029
gagucugcgucguuuuuga

SEQ ID NO: 2535652 - RNA, 21 nt, Chlamydophila pneumoniae CWL029
gagucuucagcuuguuuuugc

SEQ ID NO: 2535653 - RNA, 18 nt, Chlamydophila pneumoniae CWL029
gagucuuuuucagaaagc

SEQ ID NO: 2535654 - RNA, 21 nt, Chlamydophila pneumoniae CWL029
gagugacaccaacaacaauaa

SEQ ID NO: 2535655 - RNA, 15 nt, Chlamydophila pneumoniae CWL029
gagugaccauagcau

SEQ ID NO: 2535656 - RNA, 13 nt, Chlamydophila pneumoniae CWL029
gagugacucauca

SEQ ID NO: 2535657 - RNA, 22 nt, Chlamydophila pneumoniae CWL029
gagugcguacucuucuuuggau

SEQ ID NO: 2535658 - RNA, 22 nt, Chlamydophila pneumoniae CWL029
gagugcucuaccccacgcuaaa

SEQ ID NO: 2535659 - RNA, 13 nt, Chlamydophila pneumoniae CWL029
gaguuagcuuuug

SEQ ID NO: 2535660 - RNA, 21 nt, Chlamydophila pneumoniae CWL029
gaguucgcacuaauuuccuuc

SEQ ID NO: 2535661 - RNA, 23 nt, Chlamydophila pneumoniae CWL029
gaguucgcacuaauuuccuucag

SEQ ID NO: 2535662 - RNA, 20 nt, Chlamydophila pneumoniae CWL029
gaguucgcgaccugugauuu

SEQ ID NO: 2535663 - RNA, 15 nt, Chlamydophila pneumoniae CWL029
gaguucuuccuucuu

SEQ ID NO: 2535664 - RNA, 16 nt, Chlamydophila pneumoniae CWL029
gaguucuuccuucuuc

SEQ ID NO: 2535665 - RNA, 18 nt, Chlamydophila pneumoniae CWL029
gaguucuuguaauaaaag

SEQ ID NO: 2535666 - RNA, 16 nt, Chlamydophila pneumoniae CWL029
gaguucuuuuguuugu

SEQ ID NO: 2535667 - RNA, 15 nt, Chlamydophila pneumoniae CWL029
gaguugccaggaaac

SEQ ID NO: 2535668 - RNA, 22 nt, Chlamydophila pneumoniae CWL029
gaguugccaggaaacguucuuu

SEQ ID NO: 2535669 - RNA, 19 nt, Chlamydophila pneumoniae CWL029
gaguuggagaauugaaaau

SEQ ID NO: 2535670 - RNA, 13 nt, Chlamydophila pneumoniae CWL029
gaguuuuacauca

SEQ ID NO: 2535671 - RNA, 19 nt, Chlamydophila pneumoniae CWL029
gauaaaacgcuauuguuug

SEQ ID NO: 2535672 - RNA, 13 nt, Chlamydophila pneumoniae CWL029
gauaaaacuauaa

SEQ ID NO: 2535673 - RNA, 16 nt, Chlamydophila pneumoniae CWL029
gauaaaagguauuucu

SEQ ID NO: 2535674 - RNA, 19 nt, Chlamydophila pneumoniae CWL029
gauaaaagguauuucucuc

SEQ ID NO: 2535675 - RNA, 14 nt, Chlamydophila pneumoniae CWL029
gauaaacagcacag

SEQ ID NO: 2535676 - RNA, 17 nt, Chlamydophila pneumoniae CWL029
gauaaacauuaagugau

SEQ ID NO: 2535677 - RNA, 21 nt, Chlamydophila pneumoniae CWL029
gauaaagaaguuuacaaauaa

SEQ ID NO: 2535678 - RNA, 15 nt, Chlamydophila pneumoniae CWL029
gauaaauccccacca

SEQ ID NO: 2535679 - RNA, 14 nt, Chlamydophila pneumoniae CWL029
gauaaauccgcaga

SEQ ID NO: 2535680 - RNA, 14 nt, Chlamydophila pneumoniae CWL029
gauaacacuucuuu

SEQ ID NO: 2535681 - RNA, 18 nt, Chlamydophila pneumoniae CWL029
gauaaccacuauacccuc

SEQ ID NO: 2535682 - RNA, 19 nt, Chlamydophila pneumoniae CWL029
gauaaccacuauacccucu

SEQ ID NO: 2535683 - RNA, 18 nt, Chlamydophila pneumoniae CWL029
gauaagaacuuuagggaa

SEQ ID NO: 2535684 - RNA, 16 nt, Chlamydophila pneumoniae CWL029
gauaagaccagaaagg

SEQ ID NO: 2535685 - RNA, 15 nt, Chlamydophila pneumoniae CWL029
gauaagauaaagaau

SEQ ID NO: 2535686 - RNA, 16 nt, Chlamydophila pneumoniae CWL029
gauaaguuacuuucug

SEQ ID NO: 2535687 - RNA, 12 nt, Chlamydophila pneumoniae CWL029
gauaaucagagg

SEQ ID NO: 2535688 - RNA, 19 nt, Chlamydophila pneumoniae CWL029
gauaaucagaggagccucc

SEQ ID NO: 2535689 - RNA, 19 nt, Chlamydophila pneumoniae CWL029
gauaaucuguaagaaaaug

SEQ ID NO: 2535690 - RNA, 10 nt, Chlamydophila pneumoniae CWL029
gauaaugauu

SEQ ID NO: 2535691 - RNA, 15 nt, Chlamydophila pneumoniae CWL029
gauacaucaucagaa

SEQ ID NO: 2535692 - RNA, 19 nt, Chlamydophila pneumoniae CWL029
gauacauccucacuagaga

SEQ ID NO: 2535693 - RNA, 20 nt, Chlamydophila pneumoniae CWL029
gauaccaagaugaagaaacu

SEQ ID NO: 2535694 - RNA, 16 nt, Chlamydophila pneumoniae CWL029
gauaccaccuaaaaug

SEQ ID NO: 2535695 - RNA, 23 nt, Chlamydophila pneumoniae CWL029
gauaccacgcaucuuaagagaaa

SEQ ID NO: 2535696 - RNA, 15 nt, Chlamydophila pneumoniae CWL029
gauaccaucaccuuc

SEQ ID NO: 2535697 - RNA, 17 nt, Chlamydophila pneumoniae CWL029
gauacccaaagagggga

SEQ ID NO: 2535698 - RNA, 14 nt, Chlamydophila pneumoniae CWL029
gauacccaucuaga

SEQ ID NO: 2535699 - RNA, 16 nt, Chlamydophila pneumoniae CWL029
gauacccaucuagaaa

SEQ ID NO: 2535700 - RNA, 16 nt, Chlamydophila pneumoniae CWL029
gauaccggcaaauaaa

SEQ ID NO: 2535701 - RNA, 16 nt, Chlamydophila pneumoniae CWL029
gauacgaauaaguuuu

SEQ ID NO: 2535702 - RNA, 20 nt, Chlamydophila pneumoniae CWL029
gauacgugcagugaauccuu

SEQ ID NO: 2535703 - RNA, 17 nt, Chlamydophila pneumoniae CWL029
gauacguuuuucccuuu

SEQ ID NO: 2535704 - RNA, 17 nt, Chlamydophila pneumoniae CWL029
gauacucucagcaaaga

SEQ ID NO: 2535705 - RNA, 17 nt, Chlamydophila pneumoniae CWL029
gauacuguuuuuuaucu

SEQ ID NO: 2535706 - RNA, 20 nt, Chlamydophila pneumoniae CWL029
gauacuguuuuuuaucuccu

SEQ ID NO: 2535707 - RNA, 15 nt, Chlamydophila pneumoniae CWL029
gauacuuaucuuuaa

SEQ ID NO: 2535708 - RNA, 13 nt, Chlamydophila pneumoniae CWL029
gauagagauucuu

SEQ ID NO: 2535709 - RNA, 22 nt, Chlamydophila pneumoniae CWL029
gauagaucacaucaagauagag

SEQ ID NO: 2535710 - RNA, 17 nt, Chlamydophila pneumoniae CWL029
gauagcaaugauguuuu

SEQ ID NO: 2535711 - RNA, 24 nt, Chlamydophila pneumoniae CWL029
gauagcauugucgaguauaauuga

SEQ ID NO: 2535712 - RNA, 19 nt, Chlamydophila pneumoniae CWL029
gauagccaucauaaaacgu

SEQ ID NO: 2535713 - RNA, 18 nt, Chlamydophila pneumoniae CWL029
gauagcuaaaccuucaga

SEQ ID NO: 2535714 - RNA, 23 nt, Chlamydophila pneumoniae CWL029
gauagcucagcucuaauucuucu

SEQ ID NO: 2535715 - RNA, 15 nt, Chlamydophila pneumoniae CWL029
gauagcugaugcuga

SEQ ID NO: 2535716 - RNA, 13 nt, Chlamydophila pneumoniae CWL029
gauaggaaccacu

SEQ ID NO: 2535717 - RNA, 21 nt, Chlamydophila pneumoniae CWL029
gauaggaaccacuuuagaauu

SEQ ID NO: 2535718 - RNA, 20 nt, Chlamydophila pneumoniae CWL029
gauaggaucuucuauuuuuu

SEQ ID NO: 2535719 - RNA, 17 nt, Chlamydophila pneumoniae CWL029
gauaggcuggaacuguu

SEQ ID NO: 2535720 - RNA, 13 nt, Chlamydophila pneumoniae CWL029
gauagggaauuuc

SEQ ID NO: 2535721 - RNA, 16 nt, Chlamydophila pneumoniae CWL029
gauaguaucguaagcc

SEQ ID NO: 2535722 - RNA, 18 nt, Chlamydophila pneumoniae CWL029
gauauagauucaugaaau

SEQ ID NO: 2535723 - RNA, 11 nt, Chlamydophila pneumoniae CWL029
gauauauagag

SEQ ID NO: 2535724 - RNA, 14 nt, Chlamydophila pneumoniae CWL029
gauauauagagcag

SEQ ID NO: 2535725 - RNA, 16 nt, Chlamydophila pneumoniae CWL029
gauauauagagcagac

SEQ ID NO: 2535726 - RNA, 15 nt, Chlamydophila pneumoniae CWL029
gauauauuuuuaaag

SEQ ID NO: 2535727 - RNA, 22 nt, Chlamydophila pneumoniae CWL029
gauaucaugcaauacuuuucuc

SEQ ID NO: 2535728 - RNA, 16 nt, Chlamydophila pneumoniae CWL029
gauaucccacagaaau

SEQ ID NO: 2535729 - RNA, 19 nt, Chlamydophila pneumoniae CWL029
gauaucccacagaaauguc

SEQ ID NO: 2535730 - RNA, 19 nt, Chlamydophila pneumoniae CWL029
gauaucggaccuacguuuu

SEQ ID NO: 2535731 - RNA, 16 nt, Chlamydophila pneumoniae CWL029
gauaucguagacaaca

SEQ ID NO: 2535732 - RNA, 12 nt, Chlamydophila pneumoniae CWL029
gauaucucuacc

SEQ ID NO: 2535733 - RNA, 17 nt, Chlamydophila pneumoniae CWL029
gauaucugcucccuccu

SEQ ID NO: 2535734 - RNA, 21 nt, Chlamydophila pneumoniae CWL029
gauaucugcucccuccuccuc

SEQ ID NO: 2535735 - RNA, 15 nt, Chlamydophila pneumoniae CWL029
gauaugcugaauucc

SEQ ID NO: 2535736 - RNA, 23 nt, Chlamydophila pneumoniae CWL029
gauauucugauucuccguccccc

SEQ ID NO: 2535737 - RNA, 20 nt, Chlamydophila pneumoniae CWL029
gauauugauaaaucccgaac

SEQ ID NO: 2535738 - RNA, 16 nt, Chlamydophila pneumoniae CWL029
gauauugcggaaauug

SEQ ID NO: 2535739 - RNA, 13 nt, Chlamydophila pneumoniae CWL029
gauauugucaaga

SEQ ID NO: 2535740 - RNA, 19 nt, Chlamydophila pneumoniae CWL029
gauauuuuuauuuaaaauu

SEQ ID NO: 2535741 - RNA, 17 nt, Chlamydophila pneumoniae CWL029
gaucaaagaacaauaaa

SEQ ID NO: 2535742 - RNA, 22 nt, Chlamydophila pneumoniae CWL029
gaucaauauagagaacuccauu

SEQ ID NO: 2535743 - RNA, 13 nt, Chlamydophila pneumoniae CWL029
gaucacagggaca

SEQ ID NO: 2535744 - RNA, 17 nt, Chlamydophila pneumoniae CWL029
gaucaggauucuaaaaa

SEQ ID NO: 2535745 - RNA, 23 nt, Chlamydophila pneumoniae CWL029
gaucaggauucuaaaaagaaaag

SEQ ID NO: 2535746 - RNA, 15 nt, Chlamydophila pneumoniae CWL029
gaucauaaacagcag

SEQ ID NO: 2535747 - RNA, 23 nt, Chlamydophila pneumoniae CWL029
gaucauaucggcagcagcauaag

SEQ ID NO: 2535748 - RNA, 23 nt, Chlamydophila pneumoniae CWL029
gaucauggauucacaucuuaaaa

SEQ ID NO: 2535749 - RNA, 21 nt, Chlamydophila pneumoniae CWL029
gaucauuaaaguccaagauca

SEQ ID NO: 2535750 - RNA, 16 nt, Chlamydophila pneumoniae CWL029
gaucauuuuugcuaga

SEQ ID NO: 2535751 - RNA, 18 nt, Chlamydophila pneumoniae CWL029
gauccagcccccaggcug

SEQ ID NO: 2535752 - RNA, 20 nt, Chlamydophila pneumoniae CWL029
gauccagcccccaggcugca

SEQ ID NO: 2535753 - RNA, 14 nt, Chlamydophila pneumoniae CWL029
gauccauaaccuuu

SEQ ID NO: 2535754 - RNA, 13 nt, Chlamydophila pneumoniae CWL029
gauccaucugcuc

SEQ ID NO: 2535755 - RNA, 15 nt, Chlamydophila pneumoniae CWL029
gauccccuucauucu

SEQ ID NO: 2535756 - RNA, 17 nt, Chlamydophila pneumoniae CWL029
gaucccgaagcaaucca

SEQ ID NO: 2535757 - RNA, 18 nt, Chlamydophila pneumoniae CWL029
gaucccgggagucuucag

SEQ ID NO: 2535758 - RNA, 18 nt, Chlamydophila pneumoniae CWL029
gaucccuaacgaugcagg

SEQ ID NO: 2535759 - RNA, 15 nt, Chlamydophila pneumoniae CWL029
gauccuagaauagga

SEQ ID NO: 2535760 - RNA, 16 nt, Chlamydophila pneumoniae CWL029
gauccugaaaguacag

SEQ ID NO: 2535761 - RNA, 12 nt, Chlamydophila pneumoniae CWL029
gaucgaaaaaua

SEQ ID NO: 2535762 - RNA, 19 nt, Chlamydophila pneumoniae CWL029
gaucgaaucuuuauuucug

SEQ ID NO: 2535763 - RNA, 21 nt, Chlamydophila pneumoniae CWL029
gaucggaguuaucaaaaggau

SEQ ID NO: 2535764 - RNA, 17 nt, Chlamydophila pneumoniae CWL029
gaucgucaguaaaacac

SEQ ID NO: 2535765 - RNA, 15 nt, Chlamydophila pneumoniae CWL029
gaucguuagagaccc

SEQ ID NO: 2535766 - RNA, 20 nt, Chlamydophila pneumoniae CWL029
gaucuaaaagcacuuaaaaa

SEQ ID NO: 2535767 - RNA, 23 nt, Chlamydophila pneumoniae CWL029
gaucuaaaagcacuuaaaaaacu

SEQ ID NO: 2535768 - RNA, 21 nt, Chlamydophila pneumoniae CWL029
gaucuaacuucaccauauaau

SEQ ID NO: 2535769 - RNA, 17 nt, Chlamydophila pneumoniae CWL029
gaucuagaaaaugaaga

SEQ ID NO: 2535770 - RNA, 22 nt, Chlamydophila pneumoniae CWL029
gaucuagaaaaugaagagcuuc

SEQ ID NO: 2535771 - RNA, 22 nt, Chlamydophila pneumoniae CWL029
gaucucaguaggagcagcggca

SEQ ID NO: 2535772 - RNA, 14 nt, Chlamydophila pneumoniae CWL029
gaucucaucauaaa

SEQ ID NO: 2535773 - RNA, 14 nt, Chlamydophila pneumoniae CWL029
gaucucccgugagc

SEQ ID NO: 2535774 - RNA, 17 nt, Chlamydophila pneumoniae CWL029
gaucucuaguucuagaa

SEQ ID NO: 2535775 - RNA, 18 nt, Chlamydophila pneumoniae CWL029
gaucucucuuccugcugc

SEQ ID NO: 2535776 - RNA, 14 nt, Chlamydophila pneumoniae CWL029
gaucucucuuuccu

SEQ ID NO: 2535777 - RNA, 19 nt, Chlamydophila pneumoniae CWL029
gaucucucuuuccuuagca

SEQ ID NO: 2535778 - RNA, 19 nt, Chlamydophila pneumoniae CWL029
gaucucuuuuggaagaccu

SEQ ID NO: 2535779 - RNA, 14 nt, Chlamydophila pneumoniae CWL029
gaucugauagaaca

SEQ ID NO: 2535780 - RNA, 22 nt, Chlamydophila pneumoniae CWL029
gaucugcaaacgcaaugauuuc

SEQ ID NO: 2535781 - RNA, 19 nt, Chlamydophila pneumoniae CWL029
gaucugcagcguuucuagg

SEQ ID NO: 2535782 - RNA, 21 nt, Chlamydophila pneumoniae CWL029
gaucugcagcguuucuaggga

SEQ ID NO: 2535783 - RNA, 19 nt, Chlamydophila pneumoniae CWL029
gaucuggagagggaaggaa

SEQ ID NO: 2535784 - RNA, 17 nt, Chlamydophila pneumoniae CWL029
gaucuguaauagcagga

SEQ ID NO: 2535785 - RNA, 17 nt, Chlamydophila pneumoniae CWL029
gaucuucagagagaaca

SEQ ID NO: 2535786 - RNA, 18 nt, Chlamydophila pneumoniae CWL029
gaucuucagagagaacag

SEQ ID NO: 2535787 - RNA, 16 nt, Chlamydophila pneumoniae CWL029
gaucuucuaaaacacc

SEQ ID NO: 2535788 - RNA, 16 nt, Chlamydophila pneumoniae CWL029
gaucuucuagaugugu

SEQ ID NO: 2535789 - RNA, 20 nt, Chlamydophila pneumoniae CWL029
gaucuugaacagagacuucc

SEQ ID NO: 2535790 - RNA, 19 nt, Chlamydophila pneumoniae CWL029
gaucuugagaaaagaacag

SEQ ID NO: 2535791 - RNA, 16 nt, Chlamydophila pneumoniae CWL029
gaucuuuguugagaag

SEQ ID NO: 2535792 - RNA, 23 nt, Chlamydophila pneumoniae CWL029
gaucuuuucuacuucaggaaaua

SEQ ID NO: 2535793 - RNA, 20 nt, Chlamydophila pneumoniae CWL029
gaucuuuucuuucuaagaua

SEQ ID NO: 2535794 - RNA, 23 nt, Chlamydophila pneumoniae CWL029
gaucuuuugauaacuuugcauga

SEQ ID NO: 2535795 - RNA, 17 nt, Chlamydophila pneumoniae CWL029
gaugaaacuuuaggauu

SEQ ID NO: 2535796 - RNA, 17 nt, Chlamydophila pneumoniae CWL029
gaugaacagccucugug

SEQ ID NO: 2535797 - RNA, 12 nt, Chlamydophila pneumoniae CWL029
gaugaacauaau

SEQ ID NO: 2535798 - RNA, 23 nt, Chlamydophila pneumoniae CWL029
gaugaacguauagggaaccuuga

SEQ ID NO: 2535799 - RNA, 13 nt, Chlamydophila pneumoniae CWL029
gaugaagauaaaa

SEQ ID NO: 2535800 - RNA, 23 nt, Chlamydophila pneumoniae CWL029
gaugaauccaaaauaaauagaag

SEQ ID NO: 2535801 - RNA, 16 nt, Chlamydophila pneumoniae CWL029
gaugagguaucccacg

SEQ ID NO: 2535802 - RNA, 19 nt, Chlamydophila pneumoniae CWL029
gaugaggucuuuagcaaaa

SEQ ID NO: 2535803 - RNA, 19 nt, Chlamydophila pneumoniae CWL029
gaugauccacugcuuuagg

SEQ ID NO: 2535804 - RNA, 17 nt, Chlamydophila pneumoniae CWL029
gaugauccgcauuuccu

SEQ ID NO: 2535805 - RNA, 21 nt, Chlamydophila pneumoniae CWL029
gaugauuuuuuaugacaaacu

SEQ ID NO: 2535806 - RNA, 18 nt, Chlamydophila pneumoniae CWL029
gaugcaaauccuguagaa

SEQ ID NO: 2535807 - RNA, 19 nt, Chlamydophila pneumoniae CWL029
gaugcaaauccuguagaaa

SEQ ID NO: 2535808 - RNA, 14 nt, Chlamydophila pneumoniae CWL029
gaugcaccauaaua

SEQ ID NO: 2535809 - RNA, 22 nt, Chlamydophila pneumoniae CWL029
gaugcagcauuuguaagaauca

SEQ ID NO: 2535810 - RNA, 23 nt, Chlamydophila pneumoniae CWL029
gaugcagcauuuguaagaaucau

SEQ ID NO: 2535811 - RNA, 16 nt, Chlamydophila pneumoniae CWL029
gaugcaggccaggaga

SEQ ID NO: 2535812 - RNA, 13 nt, Chlamydophila pneumoniae CWL029
gaugccaagaaau

SEQ ID NO: 2535813 - RNA, 17 nt, Chlamydophila pneumoniae CWL029
gaugcuaaagagucuuc

SEQ ID NO: 2535814 - RNA, 15 nt, Chlamydophila pneumoniae CWL029
gaugcuacuuuccac

SEQ ID NO: 2535815 - RNA, 14 nt, Chlamydophila pneumoniae CWL029
gaugcuauuuuucc

SEQ ID NO: 2535816 - RNA, 15 nt, Chlamydophila pneumoniae CWL029
gaugcuauuuuucca

SEQ ID NO: 2535817 - RNA, 20 nt, Chlamydophila pneumoniae CWL029
gaugcuccgggaaacaucag

SEQ ID NO: 2535818 - RNA, 23 nt, Chlamydophila pneumoniae CWL029
gaugcucuagaaaacgcucuccu

SEQ ID NO: 2535819 - RNA, 17 nt, Chlamydophila pneumoniae CWL029
gaugcugaggacgcaga

SEQ ID NO: 2535820 - RNA, 13 nt, Chlamydophila pneumoniae CWL029
gaugcuucuuuca

SEQ ID NO: 2535821 - RNA, 17 nt, Chlamydophila pneumoniae CWL029
gaugcuugugagaugaa

SEQ ID NO: 2535822 - RNA, 21 nt, Chlamydophila pneumoniae CWL029
gauggaguuucuuauucacug

SEQ ID NO: 2535823 - RNA, 14 nt, Chlamydophila pneumoniae CWL029
gauggcaaggaaaa

SEQ ID NO: 2535824 - RNA, 19 nt, Chlamydophila pneumoniae CWL029
gaugggaucggucuuuucu

SEQ ID NO: 2535825 - RNA, 15 nt, Chlamydophila pneumoniae CWL029
gauggucaggaagaa

SEQ ID NO: 2535826 - RNA, 13 nt, Chlamydophila pneumoniae CWL029
gaugguugcuucu

SEQ ID NO: 2535827 - RNA, 12 nt, Chlamydophila pneumoniae CWL029
gauguagagucg

SEQ ID NO: 2535828 - RNA, 15 nt, Chlamydophila pneumoniae CWL029
gauguaggugauauu

SEQ ID NO: 2535829 - RNA, 22 nt, Chlamydophila pneumoniae CWL029
gaugucaccacgaacuucagca

SEQ ID NO: 2535830 - RNA, 15 nt, Chlamydophila pneumoniae CWL029
gaugucgcuuuugcu

SEQ ID NO: 2535831 - RNA, 14 nt, Chlamydophila pneumoniae CWL029
gaugucuagaaaag

SEQ ID NO: 2535832 - RNA, 15 nt, Chlamydophila pneumoniae CWL029
gauguuaaggcuucc

SEQ ID NO: 2535833 - RNA, 22 nt, Chlamydophila pneumoniae CWL029
gauguuauaagugacuuuucuu

SEQ ID NO: 2535834 - RNA, 21 nt, Chlamydophila pneumoniae CWL029
gauguucucgcaaugcuucuu

SEQ ID NO: 2535835 - RNA, 16 nt, Chlamydophila pneumoniae CWL029
gauguuuaauacaaaa

SEQ ID NO: 2535836 - RNA, 17 nt, Chlamydophila pneumoniae CWL029
gauguuuaugaaaaucu

SEQ ID NO: 2535837 - RNA, 16 nt, Chlamydophila pneumoniae CWL029
gauuaaagagacugug

SEQ ID NO: 2535838 - RNA, 20 nt, Chlamydophila pneumoniae CWL029
gauuaaguucgucuaccauu

SEQ ID NO: 2535839 - RNA, 18 nt, Chlamydophila pneumoniae CWL029
gauuagaaaagauaaaac

SEQ ID NO: 2535840 - RNA, 19 nt, Chlamydophila pneumoniae CWL029
gauuaggaacaagucggca

SEQ ID NO: 2535841 - RNA, 14 nt, Chlamydophila pneumoniae CWL029
gauuaguaacuaaa

SEQ ID NO: 2535842 - RNA, 13 nt, Chlamydophila pneumoniae CWL029
gauuaguaaugau

SEQ ID NO: 2535843 - RNA, 20 nt, Chlamydophila pneumoniae CWL029
gauuaguucucuaagacugu

SEQ ID NO: 2535844 - RNA, 23 nt, Chlamydophila pneumoniae CWL029
gauuaugaauccuugaaagacuc

SEQ ID NO: 2535845 - RNA, 14 nt, Chlamydophila pneumoniae CWL029
gauuauucuagagu

SEQ ID NO: 2535846 - RNA, 15 nt, Chlamydophila pneumoniae CWL029
gauucaaagaagucg

SEQ ID NO: 2535847 - RNA, 17 nt, Chlamydophila pneumoniae CWL029
gauucaaugcagcuaac

SEQ ID NO: 2535848 - RNA, 19 nt, Chlamydophila pneumoniae CWL029
gauucacaucuuaaaaacu

SEQ ID NO: 2535849 - RNA, 11 nt, Chlamydophila pneumoniae CWL029
gauucaccaag

SEQ ID NO: 2535850 - RNA, 19 nt, Chlamydophila pneumoniae CWL029
gauuccaguagagccucua

SEQ ID NO: 2535851 - RNA, 16 nt, Chlamydophila pneumoniae CWL029
gauucccugcggacag

SEQ ID NO: 2535852 - RNA, 14 nt, Chlamydophila pneumoniae CWL029
gauuccuagaaucu

SEQ ID NO: 2535853 - RNA, 18 nt, Chlamydophila pneumoniae CWL029
gauuccugucauuccuaa

SEQ ID NO: 2535854 - RNA, 14 nt, Chlamydophila pneumoniae CWL029
gauucuaaaagagc

SEQ ID NO: 2535855 - RNA, 13 nt, Chlamydophila pneumoniae CWL029
gauucuacaaauu

SEQ ID NO: 2535856 - RNA, 15 nt, Chlamydophila pneumoniae CWL029
gauucucauaaaggc

SEQ ID NO: 2535857 - RNA, 22 nt, Chlamydophila pneumoniae CWL029
gauucucauaaaggcucuuuua

SEQ ID NO: 2535858 - RNA, 23 nt, Chlamydophila pneumoniae CWL029
gauucucauaaaggcucuuuuag

SEQ ID NO: 2535859 - RNA, 17 nt, Chlamydophila pneumoniae CWL029
gauucuccgucccccgg

SEQ ID NO: 2535860 - RNA, 18 nt, Chlamydophila pneumoniae CWL029
gauucucguguagaauuc

SEQ ID NO: 2535861 - RNA, 21 nt, Chlamydophila pneumoniae CWL029
gauucucucugccuaccaaag

SEQ ID NO: 2535862 - RNA, 13 nt, Chlamydophila pneumoniae CWL029
gauucugcccaaa

SEQ ID NO: 2535863 - RNA, 16 nt, Chlamydophila pneumoniae CWL029
gauucugcccaaagcu

SEQ ID NO: 2535864 - RNA, 16 nt, Chlamydophila pneumoniae CWL029
gauucuguauaaacaa

SEQ ID NO: 2535865 - RNA, 21 nt, Chlamydophila pneumoniae CWL029
gauucuguauaaacaauaaga

SEQ ID NO: 2535866 - RNA, 13 nt, Chlamydophila pneumoniae CWL029
gauucuucagaau

SEQ ID NO: 2535867 - RNA, 15 nt, Chlamydophila pneumoniae CWL029
gauucuuuaaucuau

SEQ ID NO: 2535868 - RNA, 21 nt, Chlamydophila pneumoniae CWL029
gauucuuuaaucuaucugcaa

SEQ ID NO: 2535869 - RNA, 23 nt, Chlamydophila pneumoniae CWL029
gauugaaacuuuuuuucuucucu

SEQ ID NO: 2535870 - RNA, 18 nt, Chlamydophila pneumoniae CWL029
gauugaggauaaguucuu

SEQ ID NO: 2535871 - RNA, 21 nt, Chlamydophila pneumoniae CWL029
gauugauaaauuugcuuccaa

SEQ ID NO: 2535872 - RNA, 13 nt, Chlamydophila pneumoniae CWL029
gauugauaacaau

SEQ ID NO: 2535873 - RNA, 16 nt, Chlamydophila pneumoniae CWL029
gauugauccacagauc

SEQ ID NO: 2535874 - RNA, 21 nt, Chlamydophila pneumoniae CWL029
gauugcaguugcuguggcaua

SEQ ID NO: 2535875 - RNA, 13 nt, Chlamydophila pneumoniae CWL029
gauugccaggaga

SEQ ID NO: 2535876 - RNA, 13 nt, Chlamydophila pneumoniae CWL029
gauugcuaagcau

SEQ ID NO: 2535877 - RNA, 14 nt, Chlamydophila pneumoniae CWL029
gauuggaugagaau

SEQ ID NO: 2535878 - RNA, 20 nt, Chlamydophila pneumoniae CWL029
gauuggaugauagcuaugag

SEQ ID NO: 2535879 - RNA, 14 nt, Chlamydophila pneumoniae CWL029
gauugguaaggaga

SEQ ID NO: 2535880 - RNA, 15 nt, Chlamydophila pneumoniae CWL029
gauuguaaaaguagc

SEQ ID NO: 2535881 - RNA, 19 nt, Chlamydophila pneumoniae CWL029
gauuguagagacauagccu

SEQ ID NO: 2535882 - RNA, 17 nt, Chlamydophila pneumoniae CWL029
gauuguauagcuuacuu

SEQ ID NO: 2535883 - RNA, 20 nt, Chlamydophila pneumoniae CWL029
gauuuagaaucuuuucuaga

SEQ ID NO: 2535884 - RNA, 15 nt, Chlamydophila pneumoniae CWL029
gauuuauguuuucuc

SEQ ID NO: 2535885 - RNA, 23 nt, Chlamydophila pneumoniae CWL029
gauuuccaauccauucugagaaa

SEQ ID NO: 2535886 - RNA, 20 nt, Chlamydophila pneumoniae CWL029
gauuuccccuucagaggcua

SEQ ID NO: 2535887 - RNA, 23 nt, Chlamydophila pneumoniae CWL029
gauuucguauagcuggcaaugau

SEQ ID NO: 2535888 - RNA, 16 nt, Chlamydophila pneumoniae CWL029
gauuucuucuucagag

SEQ ID NO: 2535889 - RNA, 19 nt, Chlamydophila pneumoniae CWL029
gauuucuucuucagagcuc

SEQ ID NO: 2535890 - RNA, 14 nt, Chlamydophila pneumoniae CWL029
gauuucuuuuucag

SEQ ID NO: 2535891 - RNA, 18 nt, Chlamydophila pneumoniae CWL029
gauuuggaagauugaagg

SEQ ID NO: 2535892 - RNA, 19 nt, Chlamydophila pneumoniae CWL029
gauuuucgguuacuuuaau

SEQ ID NO: 2535893 - RNA, 17 nt, Chlamydophila pneumoniae CWL029
gauuuucuagaaacaac

SEQ ID NO: 2535894 - RNA, 11 nt, Chlamydophila pneumoniae CWL029
gauuuucucua

SEQ ID NO: 2535895 - RNA, 22 nt, Chlamydophila pneumoniae CWL029
gauuuuggagacacacuuucuu

SEQ ID NO: 2535896 - RNA, 11 nt, Chlamydophila pneumoniae CWL029
gauuuugugag

SEQ ID NO: 2535897 - RNA, 16 nt, Chlamydophila pneumoniae CWL029
gauuuuuagaauagaa

SEQ ID NO: 2535898 - RNA, 18 nt, Chlamydophila pneumoniae CWL029
gauuuuuagaauagaaga

SEQ ID NO: 2535899 - RNA, 14 nt, Chlamydophila pneumoniae CWL029
gauuuuucaagacc

SEQ ID NO: 2535900 - RNA, 21 nt, Chlamydophila pneumoniae CWL029
gauuuuugcuaagagcucuuu

SEQ ID NO: 2535901 - RNA, 19 nt, Chlamydophila pneumoniae CWL029
gauuuuuuugguugcuucu

SEQ ID NO: 2535902 - RNA, 17 nt, Chlamydophila pneumoniae CWL029
gcaaaaaguuucaaucu

SEQ ID NO: 2535903 - RNA, 17 nt, Chlamydophila pneumoniae CWL029
gcaaaagcaaggcugcc

SEQ ID NO: 2535904 - RNA, 21 nt, Chlamydophila pneumoniae CWL029
gcaaaaugcgaggaaaaagga

SEQ ID NO: 2535905 - RNA, 22 nt, Chlamydophila pneumoniae CWL029
gcaaaaugguuguuaggacgug

SEQ ID NO: 2535906 - RNA, 17 nt, Chlamydophila pneumoniae CWL029
gcaaacacaauuguaaa

SEQ ID NO: 2535907 - RNA, 14 nt, Chlamydophila pneumoniae CWL029
gcaaacagguauuu

SEQ ID NO: 2535908 - RNA, 12 nt, Chlamydophila pneumoniae CWL029
gcaaacgcaaug

SEQ ID NO: 2535909 - RNA, 21 nt, Chlamydophila pneumoniae CWL029
gcaaacgcaaugauuucucua

SEQ ID NO: 2535910 - RNA, 15 nt, Chlamydophila pneumoniae CWL029
gcaaacggaacuaaa

SEQ ID NO: 2535911 - RNA, 15 nt, Chlamydophila pneumoniae CWL029
gcaaacuccccaguu

SEQ ID NO: 2535912 - RNA, 21 nt, Chlamydophila pneumoniae CWL029
gcaaacuccccaguuuuccau

SEQ ID NO: 2535913 - RNA, 12 nt, Chlamydophila pneumoniae CWL029
gcaaagaaaauu

SEQ ID NO: 2535914 - RNA, 23 nt, Chlamydophila pneumoniae CWL029
gcaaagaacucaacuuuuuuacu

SEQ ID NO: 2535915 - RNA, 19 nt, Chlamydophila pneumoniae CWL029
gcaaagacauccaagccuc

SEQ ID NO: 2535916 - RNA, 15 nt, Chlamydophila pneumoniae CWL029
gcaaagcccccuccc

SEQ ID NO: 2535917 - RNA, 23 nt, Chlamydophila pneumoniae CWL029
gcaaagcugacaacaaaugugac

SEQ ID NO: 2535918 - RNA, 22 nt, Chlamydophila pneumoniae CWL029
gcaaaggaccacaauuccuaaa

SEQ ID NO: 2535919 - RNA, 18 nt, Chlamydophila pneumoniae CWL029
gcaaaguacuacaauaac

SEQ ID NO: 2535920 - RNA, 16 nt, Chlamydophila pneumoniae CWL029
gcaaaguaucaacguu

SEQ ID NO: 2535921 - RNA, 17 nt, Chlamydophila pneumoniae CWL029
gcaaaguuaaaccuuuu

SEQ ID NO: 2535922 - RNA, 17 nt, Chlamydophila pneumoniae CWL029
gcaaauaaaguccucca

SEQ ID NO: 2535923 - RNA, 21 nt, Chlamydophila pneumoniae CWL029
gcaaaucuuacauaaaccuuu

SEQ ID NO: 2535924 - RNA, 18 nt, Chlamydophila pneumoniae CWL029
gcaaauuucauuuagaca

SEQ ID NO: 2535925 - RNA, 15 nt, Chlamydophila pneumoniae CWL029
gcaacaaccaaaaga

SEQ ID NO: 2535926 - RNA, 15 nt, Chlamydophila pneumoniae CWL029
gcaacaaucuuucuu

SEQ ID NO: 2535927 - RNA, 16 nt, Chlamydophila pneumoniae CWL029
gcaacaaucuuucuuc

SEQ ID NO: 2535928 - RNA, 16 nt, Chlamydophila pneumoniae CWL029
gcaacagguaagacga

SEQ ID NO: 2535929 - RNA, 23 nt, Chlamydophila pneumoniae CWL029
gcaacauccauucuuaauauaaa

SEQ ID NO: 2535930 - RNA, 22 nt, Chlamydophila pneumoniae CWL029
gcaacaucucacagauaccauc

SEQ ID NO: 2535931 - RNA, 19 nt, Chlamydophila pneumoniae CWL029
gcaaccucugcauguugca

SEQ ID NO: 2535932 - RNA, 21 nt, Chlamydophila pneumoniae CWL029
gcaaccuguaaagaccaaaua

SEQ ID NO: 2535933 - RNA, 16 nt, Chlamydophila pneumoniae CWL029
gcaacgcgauuuucaa

SEQ ID NO: 2535934 - RNA, 13 nt, Chlamydophila pneumoniae CWL029
gcaacucuucagc

SEQ ID NO: 2535935 - RNA, 16 nt, Chlamydophila pneumoniae CWL029
gcaacucuuuaggucu

SEQ ID NO: 2535936 - RNA, 18 nt, Chlamydophila pneumoniae CWL029
gcaacucuuuaggucuug

SEQ ID NO: 2535937 - RNA, 21 nt, Chlamydophila pneumoniae CWL029
gcaacucuuuaggucuugucu

SEQ ID NO: 2535938 - RNA, 18 nt, Chlamydophila pneumoniae CWL029
gcaagaaguguauuuaaa

SEQ ID NO: 2535939 - RNA, 20 nt, Chlamydophila pneumoniae CWL029
gcaagagcucuugagaaagc

SEQ ID NO: 2535940 - RNA, 18 nt, Chlamydophila pneumoniae CWL029
gcaagaucuaacuucacc

SEQ ID NO: 2535941 - RNA, 18 nt, Chlamydophila pneumoniae CWL029
gcaagcacuuguuuuuuc

SEQ ID NO: 2535942 - RNA, 17 nt, Chlamydophila pneumoniae CWL029
gcaagcgcuagugcaag

SEQ ID NO: 2535943 - RNA, 19 nt, Chlamydophila pneumoniae CWL029
gcaagcuguggcgauuuua

SEQ ID NO: 2535944 - RNA, 19 nt, Chlamydophila pneumoniae CWL029
gcaagcuucuuguuuuugu

SEQ ID NO: 2535945 - RNA, 10 nt, Chlamydophila pneumoniae CWL029
gcaaggaaaa

SEQ ID NO: 2535946 - RNA, 21 nt, Chlamydophila pneumoniae CWL029
gcaaggaaaaaaaaucugcua

SEQ ID NO: 2535947 - RNA, 14 nt, Chlamydophila pneumoniae CWL029
gcaaggagcucccu

SEQ ID NO: 2535948 - RNA, 13 nt, Chlamydophila pneumoniae CWL029
gcaaggagcuuuu

SEQ ID NO: 2535949 - RNA, 15 nt, Chlamydophila pneumoniae CWL029
gcaagggcggagaau

SEQ ID NO: 2535950 - RNA, 17 nt, Chlamydophila pneumoniae CWL029
gcaaggggaguuuucuu

SEQ ID NO: 2535951 - RNA, 14 nt, Chlamydophila pneumoniae CWL029
gcaaguaaagaaau

SEQ ID NO: 2535952 - RNA, 22 nt, Chlamydophila pneumoniae CWL029
gcaaguaaucaugauaaaaauu

SEQ ID NO: 2535953 - RNA, 14 nt, Chlamydophila pneumoniae CWL029
gcaagucauaaaga

SEQ ID NO: 2535954 - RNA, 22 nt, Chlamydophila pneumoniae CWL029
gcaaguuguugauaauuacaga

SEQ ID NO: 2535955 - RNA, 21 nt, Chlamydophila pneumoniae CWL029
gcaauaggacucgaugaaacu

SEQ ID NO: 2535956 - RNA, 14 nt, Chlamydophila pneumoniae CWL029
gcaauauauccagg

SEQ ID NO: 2535957 - RNA, 17 nt, Chlamydophila pneumoniae CWL029
gcaauaucuauagaagg

SEQ ID NO: 2535958 - RNA, 17 nt, Chlamydophila pneumoniae CWL029
gcaauccaggaauagaa

SEQ ID NO: 2535959 - RNA, 23 nt, Chlamydophila pneumoniae CWL029
gcaauccauaguccuagcagaga

SEQ ID NO: 2535960 - RNA, 23 nt, Chlamydophila pneumoniae CWL029
gcaaucguguuuuccugagcuuu

SEQ ID NO: 2535961 - RNA, 23 nt, Chlamydophila pneumoniae CWL029
gcaaucugcagguaagggaugcu

SEQ ID NO: 2535962 - RNA, 18 nt, Chlamydophila pneumoniae CWL029
gcaaucuuugaagcucga

SEQ ID NO: 2535963 - RNA, 22 nt, Chlamydophila pneumoniae CWL029
gcaaucuuugaucgcuugugca

SEQ ID NO: 2535964 - RNA, 15 nt, Chlamydophila pneumoniae CWL029
gcaaugauauccuca

SEQ ID NO: 2535965 - RNA, 15 nt, Chlamydophila pneumoniae CWL029
gcaaugcuucuucag

SEQ ID NO: 2535966 - RNA, 16 nt, Chlamydophila pneumoniae CWL029
gcaauuccgaagaaga

SEQ ID NO: 2535967 - RNA, 20 nt, Chlamydophila pneumoniae CWL029
gcaauucgguagagcuagaa

SEQ ID NO: 2535968 - RNA, 18 nt, Chlamydophila pneumoniae CWL029
gcaauuguuaaaagaagg

SEQ ID NO: 2535969 - RNA, 19 nt, Chlamydophila pneumoniae CWL029
gcaauuucuccuaggucua

SEQ ID NO: 2535970 - RNA, 15 nt, Chlamydophila pneumoniae CWL029
gcaauuuucucaaua

SEQ ID NO: 2535971 - RNA, 12 nt, Chlamydophila pneumoniae CWL029
gcacaaaauaaa

SEQ ID NO: 2535972 - RNA, 21 nt, Chlamydophila pneumoniae CWL029
gcacaagaaccuguuuuucua

SEQ ID NO: 2535973 - RNA, 16 nt, Chlamydophila pneumoniae CWL029
gcacauucaagauucc

SEQ ID NO: 2535974 - RNA, 23 nt, Chlamydophila pneumoniae CWL029
gcaccaacacuuuuaaagauaag

SEQ ID NO: 2535975 - RNA, 18 nt, Chlamydophila pneumoniae CWL029
gcaccaauugcagucacu

SEQ ID NO: 2535976 - RNA, 13 nt, Chlamydophila pneumoniae CWL029
gcaccauaauaua

SEQ ID NO: 2535977 - RNA, 23 nt, Chlamydophila pneumoniae CWL029
gcacccaaacugaugccaagaaa

SEQ ID NO: 2535978 - RNA, 13 nt, Chlamydophila pneumoniae CWL029
gcaccgccugacc

SEQ ID NO: 2535979 - RNA, 18 nt, Chlamydophila pneumoniae CWL029
gcaccuuuaggaagcugu

SEQ ID NO: 2535980 - RNA, 15 nt, Chlamydophila pneumoniae CWL029
gcacgagagccucgg

SEQ ID NO: 2535981 - RNA, 14 nt, Chlamydophila pneumoniae CWL029
gcacgcaacaucuc

SEQ ID NO: 2535982 - RNA, 18 nt, Chlamydophila pneumoniae CWL029
gcacggauauucuuuagg

SEQ ID NO: 2535983 - RNA, 19 nt, Chlamydophila pneumoniae CWL029
gcacggauucuaaaagagc

SEQ ID NO: 2535984 - RNA, 14 nt, Chlamydophila pneumoniae CWL029
gcacgucugcaccu

SEQ ID NO: 2535985 - RNA, 15 nt, Chlamydophila pneumoniae CWL029
gcacuaaaagggaag

SEQ ID NO: 2535986 - RNA, 17 nt, Chlamydophila pneumoniae CWL029
gcacucucugcagggaa

SEQ ID NO: 2535987 - RNA, 14 nt, Chlamydophila pneumoniae CWL029
gcacugaugaaaaa

SEQ ID NO: 2535988 - RNA, 23 nt, Chlamydophila pneumoniae CWL029
gcacuuucuuuuuuaaucuagaa

SEQ ID NO: 2535989 - RNA, 14 nt, Chlamydophila pneumoniae CWL029
gcagaaacacugaa

SEQ ID NO: 2535990 - RNA, 19 nt, Chlamydophila pneumoniae CWL029
gcagaagguuccacagaga

SEQ ID NO: 2535991 - RNA, 17 nt, Chlamydophila pneumoniae CWL029
gcagaaguccuaucaaa

SEQ ID NO: 2535992 - RNA, 21 nt, Chlamydophila pneumoniae CWL029
gcagaaguccuaucaaagcaa

SEQ ID NO: 2535993 - RNA, 12 nt, Chlamydophila pneumoniae CWL029
gcagaaguuccu

SEQ ID NO: 2535994 - RNA, 15 nt, Chlamydophila pneumoniae CWL029
gcagaaguuccuuca

SEQ ID NO: 2535995 - RNA, 20 nt, Chlamydophila pneumoniae CWL029
gcagagaaauuaacagagcg

SEQ ID NO: 2535996 - RNA, 19 nt, Chlamydophila pneumoniae CWL029
gcagagccgucuacuuuug

SEQ ID NO: 2535997 - RNA, 14 nt, Chlamydophila pneumoniae CWL029
gcagaguccuucuu

SEQ ID NO: 2535998 - RNA, 18 nt, Chlamydophila pneumoniae CWL029
gcagaguccuucuuuucc

SEQ ID NO: 2535999 - RNA, 13 nt, Chlamydophila pneumoniae CWL029
gcagagucuauau

SEQ ID NO: 2536000 - RNA, 23 nt, Chlamydophila pneumoniae CWL029
gcagagucucaguugagaaccuu

SEQ ID NO: 2536001 - RNA, 19 nt, Chlamydophila pneumoniae CWL029
gcagauagacaaccuagaa

SEQ ID NO: 2536002 - RNA, 21 nt, Chlamydophila pneumoniae CWL029
gcagaucauaucggcagcagc

SEQ ID NO: 2536003 - RNA, 13 nt, Chlamydophila pneumoniae CWL029
gcagauccugcuu

SEQ ID NO: 2536004 - RNA, 13 nt, Chlamydophila pneumoniae CWL029
gcagaucuuuuau

SEQ ID NO: 2536005 - RNA, 13 nt, Chlamydophila pneumoniae CWL029
gcagcagccuugg

SEQ ID NO: 2536006 - RNA, 21 nt, Chlamydophila pneumoniae CWL029
gcagcauaaguuagccuggcu

SEQ ID NO: 2536007 - RNA, 21 nt, Chlamydophila pneumoniae CWL029
gcagccugcgacuacaagaua

SEQ ID NO: 2536008 - RNA, 22 nt, Chlamydophila pneumoniae CWL029
gcagcgugaauaucaucacuaa

SEQ ID NO: 2536009 - RNA, 18 nt, Chlamydophila pneumoniae CWL029
gcagcuagaggcaaacag

SEQ ID NO: 2536010 - RNA, 17 nt, Chlamydophila pneumoniae CWL029
gcagcucggauggacua

SEQ ID NO: 2536011 - RNA, 15 nt, Chlamydophila pneumoniae CWL029
gcaggaaaagcaaaa

SEQ ID NO: 2536012 - RNA, 22 nt, Chlamydophila pneumoniae CWL029
gcaggaagucaccuuacaucca

SEQ ID NO: 2536013 - RNA, 20 nt, Chlamydophila pneumoniae CWL029
gcaggcaucacuaaucucag

SEQ ID NO: 2536014 - RNA, 15 nt, Chlamydophila pneumoniae CWL029
gcaggccaggagacu

SEQ ID NO: 2536015 - RNA, 14 nt, Chlamydophila pneumoniae CWL029
gcagggaaaaugcg

SEQ ID NO: 2536016 - RNA, 15 nt, Chlamydophila pneumoniae CWL029
gcagggggccugcca

SEQ ID NO: 2536017 - RNA, 21 nt, Chlamydophila pneumoniae CWL029
gcaguaacugcaaagagaauu

SEQ ID NO: 2536018 - RNA, 19 nt, Chlamydophila pneumoniae CWL029
gcaguaauuccaaaauaaa

SEQ ID NO: 2536019 - RNA, 22 nt, Chlamydophila pneumoniae CWL029
gcagucguauucagguucugaa

SEQ ID NO: 2536020 - RNA, 20 nt, Chlamydophila pneumoniae CWL029
gcagucgugauauccaccuu

SEQ ID NO: 2536021 - RNA, 14 nt, Chlamydophila pneumoniae CWL029
gcagucucaggaaa

SEQ ID NO: 2536022 - RNA, 20 nt, Chlamydophila pneumoniae CWL029
gcaguggcuuauagagagaa

SEQ ID NO: 2536023 - RNA, 21 nt, Chlamydophila pneumoniae CWL029
gcaguggcuuauagagagaau

SEQ ID NO: 2536024 - RNA, 16 nt, Chlamydophila pneumoniae CWL029
gcaguuccgauaaaga

SEQ ID NO: 2536025 - RNA, 19 nt, Chlamydophila pneumoniae CWL029
gcauaaccuuugacaacac

SEQ ID NO: 2536026 - RNA, 21 nt, Chlamydophila pneumoniae CWL029
gcauaacugugcuccauagca

SEQ ID NO: 2536027 - RNA, 17 nt, Chlamydophila pneumoniae CWL029
gcauaacuuuaucauag

SEQ ID NO: 2536028 - RNA, 15 nt, Chlamydophila pneumoniae CWL029
gcauaaguuagccug

SEQ ID NO: 2536029 - RNA, 13 nt, Chlamydophila pneumoniae CWL029
gcauaauccugaa

SEQ ID NO: 2536030 - RNA, 15 nt, Chlamydophila pneumoniae CWL029
gcauaauccugaaug

SEQ ID NO: 2536031 - RNA, 21 nt, Chlamydophila pneumoniae CWL029
gcauaauccugaauggcucug

SEQ ID NO: 2536032 - RNA, 17 nt, Chlamydophila pneumoniae CWL029
gcauaaucucaccagaa

SEQ ID NO: 2536033 - RNA, 16 nt, Chlamydophila pneumoniae CWL029
gcauaaucuuuaacaa

SEQ ID NO: 2536034 - RNA, 18 nt, Chlamydophila pneumoniae CWL029
gcauacccuucuucuuca

SEQ ID NO: 2536035 - RNA, 15 nt, Chlamydophila pneumoniae CWL029
gcauagagcucuaaa

SEQ ID NO: 2536036 - RNA, 18 nt, Chlamydophila pneumoniae CWL029
gcauagagcucuaaaaaa

SEQ ID NO: 2536037 - RNA, 17 nt, Chlamydophila pneumoniae CWL029
gcauagcccgaaauuca

SEQ ID NO: 2536038 - RNA, 22 nt, Chlamydophila pneumoniae CWL029
gcauagccuuccauaucuagaa

SEQ ID NO: 2536039 - RNA, 18 nt, Chlamydophila pneumoniae CWL029
gcauagcgagaacaccau

SEQ ID NO: 2536040 - RNA, 21 nt, Chlamydophila pneumoniae CWL029
gcauagcgagaacaccauaaa

SEQ ID NO: 2536041 - RNA, 22 nt, Chlamydophila pneumoniae CWL029
gcauaguggcucaguguauugu

SEQ ID NO: 2536042 - RNA, 15 nt, Chlamydophila pneumoniae CWL029
gcauaguguuccaaa

SEQ ID NO: 2536043 - RNA, 20 nt, Chlamydophila pneumoniae CWL029
gcauaguguuccaaaacagg

SEQ ID NO: 2536044 - RNA, 14 nt, Chlamydophila pneumoniae CWL029
gcauauaaagacuc

SEQ ID NO: 2536045 - RNA, 23 nt, Chlamydophila pneumoniae CWL029
gcauauaaagacucucuuccaaa

SEQ ID NO: 2536046 - RNA, 15 nt, Chlamydophila pneumoniae CWL029
gcauaugcuccagaa

SEQ ID NO: 2536047 - RNA, 22 nt, Chlamydophila pneumoniae CWL029
gcauauucuaagcuuauuucug

SEQ ID NO: 2536048 - RNA, 18 nt, Chlamydophila pneumoniae CWL029
gcauauugccuucuucuu

SEQ ID NO: 2536049 - RNA, 16 nt, Chlamydophila pneumoniae CWL029
gcauauuuaaauauaa

SEQ ID NO: 2536050 - RNA, 16 nt, Chlamydophila pneumoniae CWL029
gcaucaagagauagag

SEQ ID NO: 2536051 - RNA, 16 nt, Chlamydophila pneumoniae CWL029
gcaucacgaaaaggag

SEQ ID NO: 2536052 - RNA, 17 nt, Chlamydophila pneumoniae CWL029
gcaucacgaaaaggaga

SEQ ID NO: 2536053 - RNA, 15 nt, Chlamydophila pneumoniae CWL029
gcaucagaaucguuc

SEQ ID NO: 2536054 - RNA, 13 nt, Chlamydophila pneumoniae CWL029
gcaucauugaaac

SEQ ID NO: 2536055 - RNA, 17 nt, Chlamydophila pneumoniae CWL029
gcaucgcuaucagcugg

SEQ ID NO: 2536056 - RNA, 13 nt, Chlamydophila pneumoniae CWL029
gcaucucucuuua

SEQ ID NO: 2536057 - RNA, 17 nt, Chlamydophila pneumoniae CWL029
gcaucuucgauuucuag

SEQ ID NO: 2536058 - RNA, 20 nt, Chlamydophila pneumoniae CWL029
gcaucuugagguauuccuac

SEQ ID NO: 2536059 - RNA, 21 nt, Chlamydophila pneumoniae CWL029
gcaucuuuggcacaauccuca

SEQ ID NO: 2536060 - RNA, 16 nt, Chlamydophila pneumoniae CWL029
gcaucuuuucaaaaga

SEQ ID NO: 2536061 - RNA, 21 nt, Chlamydophila pneumoniae CWL029
gcaugacgcuuuuccaaagca

SEQ ID NO: 2536062 - RNA, 16 nt, Chlamydophila pneumoniae CWL029
gcaugacuauuuucau

SEQ ID NO: 2536063 - RNA, 12 nt, Chlamydophila pneumoniae CWL029
gcaugaggagac

SEQ ID NO: 2536064 - RNA, 12 nt, Chlamydophila pneumoniae CWL029
gcaugcauagcu

SEQ ID NO: 2536065 - RNA, 14 nt, Chlamydophila pneumoniae CWL029
gcaugcauagcuga

SEQ ID NO: 2536066 - RNA, 22 nt, Chlamydophila pneumoniae CWL029
gcaugcaucuuaucaagagcuc

SEQ ID NO: 2536067 - RNA, 22 nt, Chlamydophila pneumoniae CWL029
gcauggagaauaaucucuuuca

SEQ ID NO: 2536068 - RNA, 16 nt, Chlamydophila pneumoniae CWL029
gcauggauccuucauc

SEQ ID NO: 2536069 - RNA, 23 nt, Chlamydophila pneumoniae CWL029
gcauggauccuucaucagcuucc

SEQ ID NO: 2536070 - RNA, 13 nt, Chlamydophila pneumoniae CWL029
gcauggucuccca

SEQ ID NO: 2536071 - RNA, 22 nt, Chlamydophila pneumoniae CWL029
gcauguauuguguucccucuuc

SEQ ID NO: 2536072 - RNA, 14 nt, Chlamydophila pneumoniae CWL029
gcauuaccuuaucg

SEQ ID NO: 2536073 - RNA, 22 nt, Chlamydophila pneumoniae CWL029
gcauuacgguuucugggaugca

SEQ ID NO: 2536074 - RNA, 16 nt, Chlamydophila pneumoniae CWL029
gcauucuguaauuuug

SEQ ID NO: 2536075 - RNA, 13 nt, Chlamydophila pneumoniae CWL029
gcauugcaaauaa

SEQ ID NO: 2536076 - RNA, 21 nt, Chlamydophila pneumoniae CWL029
gcauugcaaauaagccaguac

SEQ ID NO: 2536077 - RNA, 22 nt, Chlamydophila pneumoniae CWL029
gcauugcuugcgcagcuucugg

SEQ ID NO: 2536078 - RNA, 13 nt, Chlamydophila pneumoniae CWL029
gcauuggacaacg

SEQ ID NO: 2536079 - RNA, 21 nt, Chlamydophila pneumoniae CWL029
gcauuguuuguccuaggagag

SEQ ID NO: 2536080 - RNA, 19 nt, Chlamydophila pneumoniae CWL029
gcauuugccccuaacuggc

SEQ ID NO: 2536081 - RNA, 19 nt, Chlamydophila pneumoniae CWL029
gcauuuucucugagcagcu

SEQ ID NO: 2536082 - RNA, 22 nt, Chlamydophila pneumoniae CWL029
gccaaaaguuuugaggauuucu

SEQ ID NO: 2536083 - RNA, 17 nt, Chlamydophila pneumoniae CWL029
gccaaaauuuccuaccu

SEQ ID NO: 2536084 - RNA, 19 nt, Chlamydophila pneumoniae CWL029
gccaaaccaugaggcugcu

SEQ ID NO: 2536085 - RNA, 16 nt, Chlamydophila pneumoniae CWL029
gccaaacgaauuucuu

SEQ ID NO: 2536086 - RNA, 16 nt, Chlamydophila pneumoniae CWL029
gccaaagaacagcacu

SEQ ID NO: 2536087 - RNA, 17 nt, Chlamydophila pneumoniae CWL029
gccaaagaacagcacuc

SEQ ID NO: 2536088 - RNA, 15 nt, Chlamydophila pneumoniae CWL029
gccaaauaucucugg

SEQ ID NO: 2536089 - RNA, 12 nt, Chlamydophila pneumoniae CWL029
gccaacucucua

SEQ ID NO: 2536090 - RNA, 15 nt, Chlamydophila pneumoniae CWL029
gccaagaagauguag

SEQ ID NO: 2536091 - RNA, 15 nt, Chlamydophila pneumoniae CWL029
gccaagagagcuugu

SEQ ID NO: 2536092 - RNA, 21 nt, Chlamydophila pneumoniae CWL029
gccaauuuucaggcccaccag

SEQ ID NO: 2536093 - RNA, 12 nt, Chlamydophila pneumoniae CWL029
gccacagagaau

SEQ ID NO: 2536094 - RNA, 24 nt, Chlamydophila pneumoniae CWL029
gccacaucaaagcaauuucuccua

SEQ ID NO: 2536095 - RNA, 15 nt, Chlamydophila pneumoniae CWL029
gccacaugaaguccu

SEQ ID NO: 2536096 - RNA, 15 nt, Chlamydophila pneumoniae CWL029
gccaccaacaguccu

SEQ ID NO: 2536097 - RNA, 19 nt, Chlamydophila pneumoniae CWL029
gccacccccacuucuuuuu

SEQ ID NO: 2536098 - RNA, 18 nt, Chlamydophila pneumoniae CWL029
gccacccuuggcagagcc

SEQ ID NO: 2536099 - RNA, 23 nt, Chlamydophila pneumoniae CWL029
gccaccuuggcuucuaucuuuac

SEQ ID NO: 2536100 - RNA, 22 nt, Chlamydophila pneumoniae CWL029
gccagaauguacauagaggaga

SEQ ID NO: 2536101 - RNA, 17 nt, Chlamydophila pneumoniae CWL029
gccagagauucuucaca

SEQ ID NO: 2536102 - RNA, 16 nt, Chlamydophila pneumoniae CWL029
gccagcccaugucuuu

SEQ ID NO: 2536103 - RNA, 23 nt, Chlamydophila pneumoniae CWL029
gccaggagacuaaaagaauaaua

SEQ ID NO: 2536104 - RNA, 13 nt, Chlamydophila pneumoniae CWL029
gccauaacacuuu

SEQ ID NO: 2536105 - RNA, 13 nt, Chlamydophila pneumoniae CWL029
gccauaauaaagg

SEQ ID NO: 2536106 - RNA, 18 nt, Chlamydophila pneumoniae CWL029
gccaucuucuucuaggau

SEQ ID NO: 2536107 - RNA, 17 nt, Chlamydophila pneumoniae CWL029
gccaugucuaaaggagu

SEQ ID NO: 2536108 - RNA, 11 nt, Chlamydophila pneumoniae CWL029
gccauuagaau

SEQ ID NO: 2536109 - RNA, 20 nt, Chlamydophila pneumoniae CWL029
gccauuccauggauauggaa

SEQ ID NO: 2536110 - RNA, 16 nt, Chlamydophila pneumoniae CWL029
gccauuuucuaagaga

SEQ ID NO: 2536111 - RNA, 14 nt, Chlamydophila pneumoniae CWL029
gcccaaagcuaaaa

SEQ ID NO: 2536112 - RNA, 21 nt, Chlamydophila pneumoniae CWL029
gcccaaggaaaaacaaaccuc

SEQ ID NO: 2536113 - RNA, 23 nt, Chlamydophila pneumoniae CWL029
gcccaaggaaaaacaaaccuccu

SEQ ID NO: 2536114 - RNA, 16 nt, Chlamydophila pneumoniae CWL029
gcccagauucugaaga

SEQ ID NO: 2536115 - RNA, 17 nt, Chlamydophila pneumoniae CWL029
gcccccuugcaccccau

SEQ ID NO: 2536116 - RNA, 17 nt, Chlamydophila pneumoniae CWL029
gccccgaauuguauucg

SEQ ID NO: 2536117 - RNA, 22 nt, Chlamydophila pneumoniae CWL029
gccccuuaaagagaaucuccuc

SEQ ID NO: 2536118 - RNA, 22 nt, Chlamydophila pneumoniae CWL029
gccccuuccaauacuaaaacua

SEQ ID NO: 2536119 - RNA, 17 nt, Chlamydophila pneumoniae CWL029
gcccgaaauucauuaaa

SEQ ID NO: 2536120 - RNA, 15 nt, Chlamydophila pneumoniae CWL029
gcccuacgaauccaa

SEQ ID NO: 2536121 - RNA, 14 nt, Chlamydophila pneumoniae CWL029
gcccuauaguauaa

SEQ ID NO: 2536122 - RNA, 21 nt, Chlamydophila pneumoniae CWL029
gcccuauaguauaauagugag

SEQ ID NO: 2536123 - RNA, 12 nt, Chlamydophila pneumoniae CWL029
gcccucuucacu

SEQ ID NO: 2536124 - RNA, 14 nt, Chlamydophila pneumoniae CWL029
gcccuguucuaugc

SEQ ID NO: 2536125 - RNA, 14 nt, Chlamydophila pneumoniae CWL029
gcccuucaggacau

SEQ ID NO: 2536126 - RNA, 19 nt, Chlamydophila pneumoniae CWL029
gccgacucuacaucuucuu

SEQ ID NO: 2536127 - RNA, 14 nt, Chlamydophila pneumoniae CWL029
gccggcgguggaaa

SEQ ID NO: 2536128 - RNA, 17 nt, Chlamydophila pneumoniae CWL029
gccggcgguggaaaagg

SEQ ID NO: 2536129 - RNA, 14 nt, Chlamydophila pneumoniae CWL029
gccgugaagcagag

SEQ ID NO: 2536130 - RNA, 16 nt, Chlamydophila pneumoniae CWL029
gccgugcucuuauguu

SEQ ID NO: 2536131 - RNA, 19 nt, Chlamydophila pneumoniae CWL029
gccuaaagcuccgagaaac

SEQ ID NO: 2536132 - RNA, 22 nt, Chlamydophila pneumoniae CWL029
gccuaaagcuccgagaaacaac

SEQ ID NO: 2536133 - RNA, 14 nt, Chlamydophila pneumoniae CWL029
gccuaaucuuguag

SEQ ID NO: 2536134 - RNA, 12 nt, Chlamydophila pneumoniae CWL029
gccuacaauacu

SEQ ID NO: 2536135 - RNA, 13 nt, Chlamydophila pneumoniae CWL029
gccuaccaaaguu

SEQ ID NO: 2536136 - RNA, 14 nt, Chlamydophila pneumoniae CWL029
gccuagcuuucuug

SEQ ID NO: 2536137 - RNA, 18 nt, Chlamydophila pneumoniae CWL029
gccuauagaaauuagagu

SEQ ID NO: 2536138 - RNA, 17 nt, Chlamydophila pneumoniae CWL029
gccuccucaagauaaau

SEQ ID NO: 2536139 - RNA, 16 nt, Chlamydophila pneumoniae CWL029
gccucgagcagaaacu

SEQ ID NO: 2536140 - RNA, 16 nt, Chlamydophila pneumoniae CWL029
gccucuacccucugag

SEQ ID NO: 2536141 - RNA, 13 nt, Chlamydophila pneumoniae CWL029
gccucuccuugag

SEQ ID NO: 2536142 - RNA, 13 nt, Chlamydophila pneumoniae CWL029
gccugaaauccug

SEQ ID NO: 2536143 - RNA, 19 nt, Chlamydophila pneumoniae CWL029
gccugaaauccugggcaau

SEQ ID NO: 2536144 - RNA, 22 nt, Chlamydophila pneumoniae CWL029
gccugacgauaguacuuauccu

SEQ ID NO: 2536145 - RNA, 18 nt, Chlamydophila pneumoniae CWL029
gccugaugucuccauaca

SEQ ID NO: 2536146 - RNA, 21 nt, Chlamydophila pneumoniae CWL029
gccugccaauccaauggcuga

SEQ ID NO: 2536147 - RNA, 22 nt, Chlamydophila pneumoniae CWL029
gccuggaggcgguggcaugcca

SEQ ID NO: 2536148 - RNA, 15 nt, Chlamydophila pneumoniae CWL029
gccuggcuaaaggau

SEQ ID NO: 2536149 - RNA, 23 nt, Chlamydophila pneumoniae CWL029
gccuggggaucuuaggaaauuug

SEQ ID NO: 2536150 - RNA, 18 nt, Chlamydophila pneumoniae CWL029
gccuguaaagaaggaggu

SEQ ID NO: 2536151 - RNA, 20 nt, Chlamydophila pneumoniae CWL029
gccuguaauugauguuccuu

SEQ ID NO: 2536152 - RNA, 21 nt, Chlamydophila pneumoniae CWL029
gccugucuuaucuaaagaaau

SEQ ID NO: 2536153 - RNA, 15 nt, Chlamydophila pneumoniae CWL029
gccugugauaguaga

SEQ ID NO: 2536154 - RNA, 15 nt, Chlamydophila pneumoniae CWL029
gccuuacggccccug

SEQ ID NO: 2536155 - RNA, 17 nt, Chlamydophila pneumoniae CWL029
gccuuagcagcacccau

SEQ ID NO: 2536156 - RNA, 20 nt, Chlamydophila pneumoniae CWL029
gccuucagcaacuaaagcau

SEQ ID NO: 2536157 - RNA, 20 nt, Chlamydophila pneumoniae CWL029
gccuuccuuaacaacaucac

SEQ ID NO: 2536158 - RNA, 13 nt, Chlamydophila pneumoniae CWL029
gccuuuagggaaa

SEQ ID NO: 2536159 - RNA, 13 nt, Chlamydophila pneumoniae CWL029
gccuuuauauaaa

SEQ ID NO: 2536160 - RNA, 13 nt, Chlamydophila pneumoniae CWL029
gccuuuuccuaaa

SEQ ID NO: 2536161 - RNA, 17 nt, Chlamydophila pneumoniae CWL029
gccuuuuccuaaaucug

SEQ ID NO: 2536162 - RNA, 14 nt, Chlamydophila pneumoniae CWL029
gccuuuuucuugau

SEQ ID NO: 2536163 - RNA, 22 nt, Chlamydophila pneumoniae CWL029
gccuuuuucuugauuagagaau

SEQ ID NO: 2536164 - RNA, 13 nt, Chlamydophila pneumoniae CWL029
gcgaaccaaaguc

SEQ ID NO: 2536165 - RNA, 16 nt, Chlamydophila pneumoniae CWL029
gcgaagggaggagaac

SEQ ID NO: 2536166 - RNA, 18 nt, Chlamydophila pneumoniae CWL029
gcgaagggaggagaacuu

SEQ ID NO: 2536167 - RNA, 18 nt, Chlamydophila pneumoniae CWL029
gcgaauccagaauuuucu

SEQ ID NO: 2536168 - RNA, 14 nt, Chlamydophila pneumoniae CWL029
gcgacaagacaaug

SEQ ID NO: 2536169 - RNA, 16 nt, Chlamydophila pneumoniae CWL029
gcgacaugagaaaucu

SEQ ID NO: 2536170 - RNA, 17 nt, Chlamydophila pneumoniae CWL029
gcgacaugagaaaucuu

SEQ ID NO: 2536171 - RNA, 15 nt, Chlamydophila pneumoniae CWL029
gcgaccuaggagaaa

SEQ ID NO: 2536172 - RNA, 20 nt, Chlamydophila pneumoniae CWL029
gcgacuugccaaucuuccuu

SEQ ID NO: 2536173 - RNA, 23 nt, Chlamydophila pneumoniae CWL029
gcgagccauagaggaaugauccc

SEQ ID NO: 2536174 - RNA, 16 nt, Chlamydophila pneumoniae CWL029
gcgauacaauaaacaa

SEQ ID NO: 2536175 - RNA, 15 nt, Chlamydophila pneumoniae CWL029
gcgauaguaaacaga

SEQ ID NO: 2536176 - RNA, 23 nt, Chlamydophila pneumoniae CWL029
gcgauguuccuuuuuuuuuucuu

SEQ ID NO: 2536177 - RNA, 11 nt, Chlamydophila pneumoniae CWL029
gcgcaaagaac

SEQ ID NO: 2536178 - RNA, 22 nt, Chlamydophila pneumoniae CWL029
gcgcaaaucuuacauaaaccuu

SEQ ID NO: 2536179 - RNA, 17 nt, Chlamydophila pneumoniae CWL029
gcgcacaccagcucgag

SEQ ID NO: 2536180 - RNA, 11 nt, Chlamydophila pneumoniae CWL029
gcgcagcuucu

SEQ ID NO: 2536181 - RNA, 21 nt, Chlamydophila pneumoniae CWL029
gcgcagcuucuggagaaaaaa

SEQ ID NO: 2536182 - RNA, 12 nt, Chlamydophila pneumoniae CWL029
gcgcauuuuuuc

SEQ ID NO: 2536183 - RNA, 23 nt, Chlamydophila pneumoniae CWL029
gcgcccgaaucuuucaaaagaaa

SEQ ID NO: 2536184 - RNA, 14 nt, Chlamydophila pneumoniae CWL029
gcgcccgagcuucc

SEQ ID NO: 2536185 - RNA, 17 nt, Chlamydophila pneumoniae CWL029
gcgccgcauuacaggga

SEQ ID NO: 2536186 - RNA, 18 nt, Chlamydophila pneumoniae CWL029
gcgccuccaccugcagcg

SEQ ID NO: 2536187 - RNA, 13 nt, Chlamydophila pneumoniae CWL029
gcgcuacagugac

SEQ ID NO: 2536188 - RNA, 14 nt, Chlamydophila pneumoniae CWL029
gcgcuagcuccagc

SEQ ID NO: 2536189 - RNA, 15 nt, Chlamydophila pneumoniae CWL029
gcgcuauguuguucc

SEQ ID NO: 2536190 - RNA, 18 nt, Chlamydophila pneumoniae CWL029
gcgcucuaagagcccuug

SEQ ID NO: 2536191 - RNA, 14 nt, Chlamydophila pneumoniae CWL029
gcgcucuacaaaug

SEQ ID NO: 2536192 - RNA, 15 nt, Chlamydophila pneumoniae CWL029
gcgcuuccagcuucu

SEQ ID NO: 2536193 - RNA, 12 nt, Chlamydophila pneumoniae CWL029
gcggaacucauc

SEQ ID NO: 2536194 - RNA, 16 nt, Chlamydophila pneumoniae CWL029
gcggaagcaccgccug

SEQ ID NO: 2536195 - RNA, 20 nt, Chlamydophila pneumoniae CWL029
gcggaauacuucuccucgca

SEQ ID NO: 2536196 - RNA, 20 nt, Chlamydophila pneumoniae CWL029
gcggagaauaucaucuuccu

SEQ ID NO: 2536197 - RNA, 15 nt, Chlamydophila pneumoniae CWL029
gcggaucuucuucug

SEQ ID NO: 2536198 - RNA, 22 nt, Chlamydophila pneumoniae CWL029
gcggcaacaagagcgcauuuua

SEQ ID NO: 2536199 - RNA, 21 nt, Chlamydophila pneumoniae CWL029
gcgguagcgucuagcuagugu

SEQ ID NO: 2536200 - RNA, 23 nt, Chlamydophila pneumoniae CWL029
gcgguggaaaaggaggaggagca

SEQ ID NO: 2536201 - RNA, 21 nt, Chlamydophila pneumoniae CWL029
gcguacucuauuaaggauucc

SEQ ID NO: 2536202 - RNA, 23 nt, Chlamydophila pneumoniae CWL029
gcguacucuucuuuggaugcuaa

SEQ ID NO: 2536203 - RNA, 19 nt, Chlamydophila pneumoniae CWL029
gcgucaauaagcuugccag

SEQ ID NO: 2536204 - RNA, 14 nt, Chlamydophila pneumoniae CWL029
gcgucacauuuguu

SEQ ID NO: 2536205 - RNA, 17 nt, Chlamydophila pneumoniae CWL029
gcgucaugcauagaaua

SEQ ID NO: 2536206 - RNA, 17 nt, Chlamydophila pneumoniae CWL029
gcgucguaaucuuuuuu

SEQ ID NO: 2536207 - RNA, 17 nt, Chlamydophila pneumoniae CWL029
gcgucugcccuuucugc

SEQ ID NO: 2536208 - RNA, 18 nt, Chlamydophila pneumoniae CWL029
gcguucuugaaucuucaa

SEQ ID NO: 2536209 - RNA, 22 nt, Chlamydophila pneumoniae CWL029
gcguugauuccaaugacgggag

SEQ ID NO: 2536210 - RNA, 21 nt, Chlamydophila pneumoniae CWL029
gcguuucgacgagaaggaaga

SEQ ID NO: 2536211 - RNA, 13 nt, Chlamydophila pneumoniae CWL029
gcguuucuuucug

SEQ ID NO: 2536212 - RNA, 19 nt, Chlamydophila pneumoniae CWL029
gcuaaacuuuuuuucaaau

SEQ ID NO: 2536213 - RNA, 22 nt, Chlamydophila pneumoniae CWL029
gcuaaagcaggagcaucauuaa

SEQ ID NO: 2536214 - RNA, 17 nt, Chlamydophila pneumoniae CWL029
gcuaaaguagaauccuu

SEQ ID NO: 2536215 - RNA, 22 nt, Chlamydophila pneumoniae CWL029
gcuaaaguagaauccuucuccc

SEQ ID NO: 2536216 - RNA, 15 nt, Chlamydophila pneumoniae CWL029
gcuaaauuugucauc

SEQ ID NO: 2536217 - RNA, 22 nt, Chlamydophila pneumoniae CWL029
gcuaacagaaucugguuuaaua

SEQ ID NO: 2536218 - RNA, 15 nt, Chlamydophila pneumoniae CWL029
gcuaacgacauugaa

SEQ ID NO: 2536219 - RNA, 21 nt, Chlamydophila pneumoniae CWL029
gcuaacgcagcuuuagcuuuu

SEQ ID NO: 2536220 - RNA, 16 nt, Chlamydophila pneumoniae CWL029
gcuaagaucuuuagaa

SEQ ID NO: 2536221 - RNA, 12 nt, Chlamydophila pneumoniae CWL029
gcuaaggauucc

SEQ ID NO: 2536222 - RNA, 15 nt, Chlamydophila pneumoniae CWL029
gcuaaggauucccgg

SEQ ID NO: 2536223 - RNA, 15 nt, Chlamydophila pneumoniae CWL029
gcuaauaagauccaa

SEQ ID NO: 2536224 - RNA, 23 nt, Chlamydophila pneumoniae CWL029
gcuaauacaucaccacugcucca

SEQ ID NO: 2536225 - RNA, 18 nt, Chlamydophila pneumoniae CWL029
gcuaaucaauccaagaau

SEQ ID NO: 2536226 - RNA, 19 nt, Chlamydophila pneumoniae CWL029
gcuaauguugucucauggg

SEQ ID NO: 2536227 - RNA, 19 nt, Chlamydophila pneumoniae CWL029
gcuaauuuaaaugccuuaa

SEQ ID NO: 2536228 - RNA, 17 nt, Chlamydophila pneumoniae CWL029
gcuacaaggucuuuucc

SEQ ID NO: 2536229 - RNA, 19 nt, Chlamydophila pneumoniae CWL029
gcuacaaggucuuuuccug

SEQ ID NO: 2536230 - RNA, 15 nt, Chlamydophila pneumoniae CWL029
gcuacauaguuuuua

SEQ ID NO: 2536231 - RNA, 22 nt, Chlamydophila pneumoniae CWL029
gcuaccauuaaggaaucccaag

SEQ ID NO: 2536232 - RNA, 20 nt, Chlamydophila pneumoniae CWL029
gcuaccuuaguuuuuucuaa

SEQ ID NO: 2536233 - RNA, 16 nt, Chlamydophila pneumoniae CWL029
gcuacguacaauuaaa

SEQ ID NO: 2536234 - RNA, 19 nt, Chlamydophila pneumoniae CWL029
gcuacgugaucaaaauuau

SEQ ID NO: 2536235 - RNA, 17 nt, Chlamydophila pneumoniae CWL029
gcuacuucuucuuuucg

SEQ ID NO: 2536236 - RNA, 14 nt, Chlamydophila pneumoniae CWL029
gcuacuuuaagacc

SEQ ID NO: 2536237 - RNA, 16 nt, Chlamydophila pneumoniae CWL029
gcuagaucacaagaaa

SEQ ID NO: 2536238 - RNA, 15 nt, Chlamydophila pneumoniae CWL029
gcuagaugaagagug

SEQ ID NO: 2536239 - RNA, 16 nt, Chlamydophila pneumoniae CWL029
gcuagugcgaugggaa

SEQ ID NO: 2536240 - RNA, 18 nt, Chlamydophila pneumoniae CWL029
gcuauacaaccacuuccu

SEQ ID NO: 2536241 - RNA, 17 nt, Chlamydophila pneumoniae CWL029
gcuauaccuauauagag

SEQ ID NO: 2536242 - RNA, 19 nt, Chlamydophila pneumoniae CWL029
gcuauagauuuuggagaca

SEQ ID NO: 2536243 - RNA, 22 nt, Chlamydophila pneumoniae CWL029
gcuaucaacaucccccgggaag

SEQ ID NO: 2536244 - RNA, 20 nt, Chlamydophila pneumoniae CWL029
gcuaucagcuggguaagucc

SEQ ID NO: 2536245 - RNA, 22 nt, Chlamydophila pneumoniae CWL029
gcuaucagcuggguaaguccac

SEQ ID NO: 2536246 - RNA, 13 nt, Chlamydophila pneumoniae CWL029
gcuaucuccagaa

SEQ ID NO: 2536247 - RNA, 16 nt, Chlamydophila pneumoniae CWL029
gcuaugucuguuccca

SEQ ID NO: 2536248 - RNA, 13 nt, Chlamydophila pneumoniae CWL029
gcuauuccauaaa

SEQ ID NO: 2536249 - RNA, 14 nt, Chlamydophila pneumoniae CWL029
gcuauugaaaaauc

SEQ ID NO: 2536250 - RNA, 22 nt, Chlamydophila pneumoniae CWL029
gcuauuuuccucuauauuuuuu

SEQ ID NO: 2536251 - RNA, 13 nt, Chlamydophila pneumoniae CWL029
gcuauuuuuaaaa

SEQ ID NO: 2536252 - RNA, 19 nt, Chlamydophila pneumoniae CWL029
gcucaaaauuuccucgacu

SEQ ID NO: 2536253 - RNA, 18 nt, Chlamydophila pneumoniae CWL029
gcucaagagcaugcuuga

SEQ ID NO: 2536254 - RNA, 15 nt, Chlamydophila pneumoniae CWL029
gcucacucuuuaaaa

SEQ ID NO: 2536255 - RNA, 16 nt, Chlamydophila pneumoniae CWL029
gcucacuuacgaaucu

SEQ ID NO: 2536256 - RNA, 13 nt, Chlamydophila pneumoniae CWL029
gcucaggaaaacu

SEQ ID NO: 2536257 - RNA, 16 nt, Chlamydophila pneumoniae CWL029
gcucaguaaauauuuu

SEQ ID NO: 2536258 - RNA, 17 nt, Chlamydophila pneumoniae CWL029
gcucaguguauuguuug

SEQ ID NO: 2536259 - RNA, 17 nt, Chlamydophila pneumoniae CWL029
gcucaucggaucuuuuc

SEQ ID NO: 2536260 - RNA, 18 nt, Chlamydophila pneumoniae CWL029
gcucaucggaucuuuucu

SEQ ID NO: 2536261 - RNA, 19 nt, Chlamydophila pneumoniae CWL029
gcucaucggaucuuuucuu

SEQ ID NO: 2536262 - RNA, 20 nt, Chlamydophila pneumoniae CWL029
gcucaugaaauuucauucuc

SEQ ID NO: 2536263 - RNA, 21 nt, Chlamydophila pneumoniae CWL029
gcuccaaaaugggauccugca

SEQ ID NO: 2536264 - RNA, 19 nt, Chlamydophila pneumoniae CWL029
gcuccaaugggcagguuuc

SEQ ID NO: 2536265 - RNA, 17 nt, Chlamydophila pneumoniae CWL029
gcuccacggaaauauuc

SEQ ID NO: 2536266 - RNA, 18 nt, Chlamydophila pneumoniae CWL029
gcuccagaaacgcagcuu

SEQ ID NO: 2536267 - RNA, 21 nt, Chlamydophila pneumoniae CWL029
gcuccagaaacgcagcuuucc

SEQ ID NO: 2536268 - RNA, 23 nt, Chlamydophila pneumoniae CWL029
gcucccaacaagggaaagaaacu

SEQ ID NO: 2536269 - RNA, 21 nt, Chlamydophila pneumoniae CWL029
gcucccaugugcugaagacca

SEQ ID NO: 2536270 - RNA, 16 nt, Chlamydophila pneumoniae CWL029
gcucccguuccuuuag

SEQ ID NO: 2536271 - RNA, 23 nt, Chlamydophila pneumoniae CWL029
gcuccgacccgaccuaccugcua

SEQ ID NO: 2536272 - RNA, 13 nt, Chlamydophila pneumoniae CWL029
gcuccuaaagcau

SEQ ID NO: 2536273 - RNA, 14 nt, Chlamydophila pneumoniae CWL029
gcuccugaauaugc

SEQ ID NO: 2536274 - RNA, 12 nt, Chlamydophila pneumoniae CWL029
gcuccugcaaaa

SEQ ID NO: 2536275 - RNA, 17 nt, Chlamydophila pneumoniae CWL029
gcuccugcaaaaaacca

SEQ ID NO: 2536276 - RNA, 14 nt, Chlamydophila pneumoniae CWL029
gcucgcuaacuuau

SEQ ID NO: 2536277 - RNA, 16 nt, Chlamydophila pneumoniae CWL029
gcucggaaaucaggga

SEQ ID NO: 2536278 - RNA, 16 nt, Chlamydophila pneumoniae CWL029
gcucguaauccuucuu

SEQ ID NO: 2536279 - RNA, 19 nt, Chlamydophila pneumoniae CWL029
gcucgugcgacugcucuuu

SEQ ID NO: 2536280 - RNA, 18 nt, Chlamydophila pneumoniae CWL029
gcucuaaacucucuuccu

SEQ ID NO: 2536281 - RNA, 21 nt, Chlamydophila pneumoniae CWL029
gcucuaaacucucuuccuucu

SEQ ID NO: 2536282 - RNA, 18 nt, Chlamydophila pneumoniae CWL029
gcucuaagcugugcauuu

SEQ ID NO: 2536283 - RNA, 22 nt, Chlamydophila pneumoniae CWL029
gcucuaagcugugcauuuucuu

SEQ ID NO: 2536284 - RNA, 22 nt, Chlamydophila pneumoniae CWL029
gcucuacaagcucgguacgucu

SEQ ID NO: 2536285 - RNA, 18 nt, Chlamydophila pneumoniae CWL029
gcucuagauauucugauu

SEQ ID NO: 2536286 - RNA, 17 nt, Chlamydophila pneumoniae CWL029
gcucuagcuaacauaaa

SEQ ID NO: 2536287 - RNA, 15 nt, Chlamydophila pneumoniae CWL029
gcucuagucuuucaa

SEQ ID NO: 2536288 - RNA, 19 nt, Chlamydophila pneumoniae CWL029
gcucucaaggucacagcau

SEQ ID NO: 2536289 - RNA, 22 nt, Chlamydophila pneumoniae CWL029
gcucucaaggucacagcauuuu

SEQ ID NO: 2536290 - RNA, 14 nt, Chlamydophila pneumoniae CWL029
gcucuccaaaggga

SEQ ID NO: 2536291 - RNA, 12 nt, Chlamydophila pneumoniae CWL029
gcucuccauggc

SEQ ID NO: 2536292 - RNA, 21 nt, Chlamydophila pneumoniae CWL029
gcucuccuagacgaucuucag

SEQ ID NO: 2536293 - RNA, 16 nt, Chlamydophila pneumoniae CWL029
gcucuccugcaaaaag

SEQ ID NO: 2536294 - RNA, 12 nt, Chlamydophila pneumoniae CWL029
gcucuccuucag

SEQ ID NO: 2536295 - RNA, 14 nt, Chlamydophila pneumoniae CWL029
gcucucgacacuau

SEQ ID NO: 2536296 - RNA, 15 nt, Chlamydophila pneumoniae CWL029
gcucucgcuaagcaa

SEQ ID NO: 2536297 - RNA, 22 nt, Chlamydophila pneumoniae CWL029
gcucucgcuaagcaaagcggcu

SEQ ID NO: 2536298 - RNA, 15 nt, Chlamydophila pneumoniae CWL029
gcucucuccaugagc

SEQ ID NO: 2536299 - RNA, 12 nt, Chlamydophila pneumoniae CWL029
gcucuggagauu

SEQ ID NO: 2536300 - RNA, 19 nt, Chlamydophila pneumoniae CWL029
gcucuggauugaaagagcu

SEQ ID NO: 2536301 - RNA, 14 nt, Chlamydophila pneumoniae CWL029
gcucuuaauuucug

SEQ ID NO: 2536302 - RNA, 15 nt, Chlamydophila pneumoniae CWL029
gcucuuacuucuggu

SEQ ID NO: 2536303 - RNA, 19 nt, Chlamydophila pneumoniae CWL029
gcucuugagaaagcuucua

SEQ ID NO: 2536304 - RNA, 17 nt, Chlamydophila pneumoniae CWL029
gcucuuuaggauagagg

SEQ ID NO: 2536305 - RNA, 20 nt, Chlamydophila pneumoniae CWL029
gcucuuugggauaaaaaguu

SEQ ID NO: 2536306 - RNA, 16 nt, Chlamydophila pneumoniae CWL029
gcucuuuuaacuuaaa

SEQ ID NO: 2536307 - RNA, 22 nt, Chlamydophila pneumoniae CWL029
gcugaaaucaugccgagauuuu

SEQ ID NO: 2536308 - RNA, 16 nt, Chlamydophila pneumoniae CWL029
gcugaagauuuuuucu

SEQ ID NO: 2536309 - RNA, 17 nt, Chlamydophila pneumoniae CWL029
gcugaagauuuuuucuu

SEQ ID NO: 2536310 - RNA, 17 nt, Chlamydophila pneumoniae CWL029
gcugagacauauugaag

SEQ ID NO: 2536311 - RNA, 22 nt, Chlamydophila pneumoniae CWL029
gcugagacauauugaagauauu

SEQ ID NO: 2536312 - RNA, 17 nt, Chlamydophila pneumoniae CWL029
gcugagauggucgagaa

SEQ ID NO: 2536313 - RNA, 12 nt, Chlamydophila pneumoniae CWL029
gcugauaaaaua

SEQ ID NO: 2536314 - RNA, 19 nt, Chlamydophila pneumoniae CWL029
gcugauccagcuccauaag

SEQ ID NO: 2536315 - RNA, 16 nt, Chlamydophila pneumoniae CWL029
gcugauuucuuuuuca

SEQ ID NO: 2536316 - RNA, 22 nt, Chlamydophila pneumoniae CWL029
gcugauuucuuuuucagcuucu

SEQ ID NO: 2536317 - RNA, 19 nt, Chlamydophila pneumoniae CWL029
gcugcgucaauaagcuugc

SEQ ID NO: 2536318 - RNA, 15 nt, Chlamydophila pneumoniae CWL029
gcugcuagagcagcu

SEQ ID NO: 2536319 - RNA, 17 nt, Chlamydophila pneumoniae CWL029
gcugcucuuuuagaaug

SEQ ID NO: 2536320 - RNA, 16 nt, Chlamydophila pneumoniae CWL029
gcugcugaauauaguu

SEQ ID NO: 2536321 - RNA, 16 nt, Chlamydophila pneumoniae CWL029
gcugcugcuaaacagg

SEQ ID NO: 2536322 - RNA, 11 nt, Chlamydophila pneumoniae CWL029
gcugcuuugac

SEQ ID NO: 2536323 - RNA, 15 nt, Chlamydophila pneumoniae CWL029
gcuggaagacuugcu

SEQ ID NO: 2536324 - RNA, 13 nt, Chlamydophila pneumoniae CWL029
gcuggaucuucug

SEQ ID NO: 2536325 - RNA, 12 nt, Chlamydophila pneumoniae CWL029
gcuguacagaac

SEQ ID NO: 2536326 - RNA, 20 nt, Chlamydophila pneumoniae CWL029
gcuguacagaacaaugguuu

SEQ ID NO: 2536327 - RNA, 15 nt, Chlamydophila pneumoniae CWL029
gcuguacuugauauu

SEQ ID NO: 2536328 - RNA, 20 nt, Chlamydophila pneumoniae CWL029
gcuguagugauacuuuagaa

SEQ ID NO: 2536329 - RNA, 11 nt, Chlamydophila pneumoniae CWL029
gcuguauuuuc

SEQ ID NO: 2536330 - RNA, 16 nt, Chlamydophila pneumoniae CWL029
gcuguccagucuauag

SEQ ID NO: 2536331 - RNA, 20 nt, Chlamydophila pneumoniae CWL029
gcugucuagaacacucagag

SEQ ID NO: 2536332 - RNA, 13 nt, Chlamydophila pneumoniae CWL029
gcuguggugguga

SEQ ID NO: 2536333 - RNA, 18 nt, Chlamydophila pneumoniae CWL029
gcuguguuauggaaauca

SEQ ID NO: 2536334 - RNA, 18 nt, Chlamydophila pneumoniae CWL029
gcuguuuacuuuucucuu

SEQ ID NO: 2536335 - RNA, 22 nt, Chlamydophila pneumoniae CWL029
gcuguuucuucugaauagcucu

SEQ ID NO: 2536336 - RNA, 15 nt, Chlamydophila pneumoniae CWL029
gcuuacuuucuuuua

SEQ ID NO: 2536337 - RNA, 16 nt, Chlamydophila pneumoniae CWL029
gcuuacuuucuuuuag

SEQ ID NO: 2536338 - RNA, 23 nt, Chlamydophila pneumoniae CWL029
gcuuauuucuguaguucuugcca

SEQ ID NO: 2536339 - RNA, 15 nt, Chlamydophila pneumoniae CWL029
gcuucacaucuuucu

SEQ ID NO: 2536340 - RNA, 18 nt, Chlamydophila pneumoniae CWL029
gcuucaccauuaagauau

SEQ ID NO: 2536341 - RNA, 15 nt, Chlamydophila pneumoniae CWL029
gcuucaucaaaacau

SEQ ID NO: 2536342 - RNA, 18 nt, Chlamydophila pneumoniae CWL029
gcuucauuaucuucguaa

SEQ ID NO: 2536343 - RNA, 19 nt, Chlamydophila pneumoniae CWL029
gcuucauuccuacaucugu

SEQ ID NO: 2536344 - RNA, 22 nt, Chlamydophila pneumoniae CWL029
gcuuccauagcuuuagaagccc

SEQ ID NO: 2536345 - RNA, 18 nt, Chlamydophila pneumoniae CWL029
gcuuccaucguuagauuu

SEQ ID NO: 2536346 - RNA, 19 nt, Chlamydophila pneumoniae CWL029
gcuuccgugcgauuucccc

SEQ ID NO: 2536347 - RNA, 19 nt, Chlamydophila pneumoniae CWL029
gcuuccugcuccucuucuu

SEQ ID NO: 2536348 - RNA, 21 nt, Chlamydophila pneumoniae CWL029
gcuuccuuggucuuauugaag

SEQ ID NO: 2536349 - RNA, 16 nt, Chlamydophila pneumoniae CWL029
gcuucgcaaucuuuga

SEQ ID NO: 2536350 - RNA, 17 nt, Chlamydophila pneumoniae CWL029
gcuucgcaaucuuugau

SEQ ID NO: 2536351 - RNA, 17 nt, Chlamydophila pneumoniae CWL029
gcuucgggaucuaaaag

SEQ ID NO: 2536352 - RNA, 22 nt, Chlamydophila pneumoniae CWL029
gcuucuaagaaacuuccaaaac

SEQ ID NO: 2536353 - RNA, 20 nt, Chlamydophila pneumoniae CWL029
gcuucuaagaucuuuuguaa

SEQ ID NO: 2536354 - RNA, 16 nt, Chlamydophila pneumoniae CWL029
gcuucuauuuuagaau

SEQ ID NO: 2536355 - RNA, 17 nt, Chlamydophila pneumoniae CWL029
gcuucuccaaauaaagc

SEQ ID NO: 2536356 - RNA, 15 nt, Chlamydophila pneumoniae CWL029
gcuucuccaacuucc

SEQ ID NO: 2536357 - RNA, 20 nt, Chlamydophila pneumoniae CWL029
gcuucuggagaaaaaauauc

SEQ ID NO: 2536358 - RNA, 12 nt, Chlamydophila pneumoniae CWL029
gcuucuguaaag

SEQ ID NO: 2536359 - RNA, 22 nt, Chlamydophila pneumoniae CWL029
gcuucuucuauagaauccacua

SEQ ID NO: 2536360 - RNA, 15 nt, Chlamydophila pneumoniae CWL029
gcuucuuucaaagcc

SEQ ID NO: 2536361 - RNA, 15 nt, Chlamydophila pneumoniae CWL029
gcuucuuucuuacua

SEQ ID NO: 2536362 - RNA, 20 nt, Chlamydophila pneumoniae CWL029
gcuugauuuccugagagcgu

SEQ ID NO: 2536363 - RNA, 16 nt, Chlamydophila pneumoniae CWL029
gcuugccagcagaagu

SEQ ID NO: 2536364 - RNA, 15 nt, Chlamydophila pneumoniae CWL029
gcuugcgagcuucuu

SEQ ID NO: 2536365 - RNA, 13 nt, Chlamydophila pneumoniae CWL029
gcuugcgcagcuu

SEQ ID NO: 2536366 - RNA, 17 nt, Chlamydophila pneumoniae CWL029
gcuugucgcgacaagac

SEQ ID NO: 2536367 - RNA, 13 nt, Chlamydophila pneumoniae CWL029
gcuugucuaggag

SEQ ID NO: 2536368 - RNA, 17 nt, Chlamydophila pneumoniae CWL029
gcuuguugguuaaaaua

SEQ ID NO: 2536369 - RNA, 14 nt, Chlamydophila pneumoniae CWL029
gcuuuaaauuuuuu

SEQ ID NO: 2536370 - RNA, 21 nt, Chlamydophila pneumoniae CWL029
gcuuuaaauuuuuuaggaucu

SEQ ID NO: 2536371 - RNA, 15 nt, Chlamydophila pneumoniae CWL029
gcuuuaaguguuucu

SEQ ID NO: 2536372 - RNA, 16 nt, Chlamydophila pneumoniae CWL029
gcuuuagaaaagugcc

SEQ ID NO: 2536373 - RNA, 14 nt, Chlamydophila pneumoniae CWL029
gcuuuagaagcccg

SEQ ID NO: 2536374 - RNA, 19 nt, Chlamydophila pneumoniae CWL029
gcuuucagaaaagaaaagu

SEQ ID NO: 2536375 - RNA, 15 nt, Chlamydophila pneumoniae CWL029
gcuuuccuaaccauu

SEQ ID NO: 2536376 - RNA, 14 nt, Chlamydophila pneumoniae CWL029
gcuuuccuuuugau

SEQ ID NO: 2536377 - RNA, 15 nt, Chlamydophila pneumoniae CWL029
gcuuucuagcugcuc

SEQ ID NO: 2536378 - RNA, 16 nt, Chlamydophila pneumoniae CWL029
gcuuugauaauagucu

SEQ ID NO: 2536379 - RNA, 14 nt, Chlamydophila pneumoniae CWL029
gcuuugcaucccua

SEQ ID NO: 2536380 - RNA, 19 nt, Chlamydophila pneumoniae CWL029
gcuuugccgccucagcacc

SEQ ID NO: 2536381 - RNA, 15 nt, Chlamydophila pneumoniae CWL029
gcuuugcuuaaaaag

SEQ ID NO: 2536382 - RNA, 21 nt, Chlamydophila pneumoniae CWL029
gcuuuuaauguguucuuaucg

SEQ ID NO: 2536383 - RNA, 20 nt, Chlamydophila pneumoniae CWL029
gcuuuucauuuuuaggaucu

SEQ ID NO: 2536384 - RNA, 12 nt, Chlamydophila pneumoniae CWL029
gcuuuucuuuuu

SEQ ID NO: 2536385 - RNA, 14 nt, Chlamydophila pneumoniae CWL029
gcuuuucuuuuucu

SEQ ID NO: 2536386 - RNA, 18 nt, Chlamydophila pneumoniae CWL029
gcuuuugagauucaaaag

SEQ ID NO: 2536387 - RNA, 17 nt, Chlamydophila pneumoniae CWL029
gcuuuugugauaccucc

SEQ ID NO: 2536388 - RNA, 14 nt, Chlamydophila pneumoniae CWL029
gcuuuuguuguuuu

SEQ ID NO: 2536389 - RNA, 18 nt, Chlamydophila pneumoniae CWL029
gcuuuuguuuuguauuua

SEQ ID NO: 2536390 - RNA, 13 nt, Chlamydophila pneumoniae CWL029
gcuuuuugaauga

SEQ ID NO: 2536391 - RNA, 16 nt, Chlamydophila pneumoniae CWL029
gcuuuuugaaugaucc

SEQ ID NO: 2536392 - RNA, 10 nt, Chlamydophila pneumoniae CWL029
gcuuuuugcu

SEQ ID NO: 2536393 - RNA, 18 nt, Chlamydophila pneumoniae CWL029
ggaaaaacaaaccuccua

SEQ ID NO: 2536394 - RNA, 22 nt, Chlamydophila pneumoniae CWL029
ggaaaaccaugaguuuuucaga

SEQ ID NO: 2536395 - RNA, 23 nt, Chlamydophila pneumoniae CWL029
ggaaaagccucgaaauuuucaga

SEQ ID NO: 2536396 - RNA, 13 nt, Chlamydophila pneumoniae CWL029
ggaaaauaaucuu

SEQ ID NO: 2536397 - RNA, 17 nt, Chlamydophila pneumoniae CWL029
ggaaaauaaucuucaaa

SEQ ID NO: 2536398 - RNA, 22 nt, Chlamydophila pneumoniae CWL029
ggaaaauucaguauaagaugcu

SEQ ID NO: 2536399 - RNA, 17 nt, Chlamydophila pneumoniae CWL029
ggaaacauagaaucauu

SEQ ID NO: 2536400 - RNA, 22 nt, Chlamydophila pneumoniae CWL029
ggaaacuagauuucuacaaaca

SEQ ID NO: 2536401 - RNA, 23 nt, Chlamydophila pneumoniae CWL029
ggaaacuagauuucuacaaacag

SEQ ID NO: 2536402 - RNA, 19 nt, Chlamydophila pneumoniae CWL029
ggaaagacucaucuuugaa

SEQ ID NO: 2536403 - RNA, 17 nt, Chlamydophila pneumoniae CWL029
ggaaagccaagaagaug

SEQ ID NO: 2536404 - RNA, 14 nt, Chlamydophila pneumoniae CWL029
ggaaagcguuucga

SEQ ID NO: 2536405 - RNA, 15 nt, Chlamydophila pneumoniae CWL029
ggaaagcucuuucau

SEQ ID NO: 2536406 - RNA, 16 nt, Chlamydophila pneumoniae CWL029
ggaaaguucacaagca

SEQ ID NO: 2536407 - RNA, 23 nt, Chlamydophila pneumoniae CWL029
ggaaauuagguaguggccacaua

SEQ ID NO: 2536408 - RNA, 15 nt, Chlamydophila pneumoniae CWL029
ggaaauuauggaggg

SEQ ID NO: 2536409 - RNA, 14 nt, Chlamydophila pneumoniae CWL029
ggaacaaagcucuc

SEQ ID NO: 2536410 - RNA, 11 nt, Chlamydophila pneumoniae CWL029
ggaacaacugu

SEQ ID NO: 2536411 - RNA, 16 nt, Chlamydophila pneumoniae CWL029
ggaacaagucuucaau

SEQ ID NO: 2536412 - RNA, 14 nt, Chlamydophila pneumoniae CWL029
ggaacaguauaauc

SEQ ID NO: 2536413 - RNA, 20 nt, Chlamydophila pneumoniae CWL029
ggaacauaucgauaggauuc

SEQ ID NO: 2536414 - RNA, 18 nt, Chlamydophila pneumoniae CWL029
ggaacaugccaaauaucu

SEQ ID NO: 2536415 - RNA, 21 nt, Chlamydophila pneumoniae CWL029
ggaagaaaggauuggaugaga

SEQ ID NO: 2536416 - RNA, 17 nt, Chlamydophila pneumoniae CWL029
ggaagaaauuaacaaca

SEQ ID NO: 2536417 - RNA, 21 nt, Chlamydophila pneumoniae CWL029
ggaagaauuucauaagagaac

SEQ ID NO: 2536418 - RNA, 13 nt, Chlamydophila pneumoniae CWL029
ggaagacucucau

SEQ ID NO: 2536419 - RNA, 20 nt, Chlamydophila pneumoniae CWL029
ggaagaugaauaccagaagc

SEQ ID NO: 2536420 - RNA, 21 nt, Chlamydophila pneumoniae CWL029
ggaagaugaauaccagaagca

SEQ ID NO: 2536421 - RNA, 14 nt, Chlamydophila pneumoniae CWL029
ggaagcaaagaaaa

SEQ ID NO: 2536422 - RNA, 15 nt, Chlamydophila pneumoniae CWL029
ggaagccagucuuca

SEQ ID NO: 2536423 - RNA, 19 nt, Chlamydophila pneumoniae CWL029
ggaagcuguacuugauauu

SEQ ID NO: 2536424 - RNA, 23 nt, Chlamydophila pneumoniae CWL029
ggaagcuguacuugauauuguuc

SEQ ID NO: 2536425 - RNA, 16 nt, Chlamydophila pneumoniae CWL029
ggaagcuuaucaagaa

SEQ ID NO: 2536426 - RNA, 20 nt, Chlamydophila pneumoniae CWL029
ggaaguccauguacagaaaa

SEQ ID NO: 2536427 - RNA, 22 nt, Chlamydophila pneumoniae CWL029
ggaaguccauguacagaaaaua

SEQ ID NO: 2536428 - RNA, 10 nt, Chlamydophila pneumoniae CWL029
ggaaguguag

SEQ ID NO: 2536429 - RNA, 15 nt, Chlamydophila pneumoniae CWL029
ggaauacauuccuag

SEQ ID NO: 2536430 - RNA, 20 nt, Chlamydophila pneumoniae CWL029
ggaauacgaucugcuuugca

SEQ ID NO: 2536431 - RNA, 18 nt, Chlamydophila pneumoniae CWL029
ggaauaggcucuuuagca

SEQ ID NO: 2536432 - RNA, 22 nt, Chlamydophila pneumoniae CWL029
ggaauaucaggacaaugaagaa

SEQ ID NO: 2536433 - RNA, 20 nt, Chlamydophila pneumoniae CWL029
ggaauccccaauguuuuccu

SEQ ID NO: 2536434 - RNA, 15 nt, Chlamydophila pneumoniae CWL029
ggaaucccuuuuuaa

SEQ ID NO: 2536435 - RNA, 12 nt, Chlamydophila pneumoniae CWL029
ggaaucuaagaa

SEQ ID NO: 2536436 - RNA, 17 nt, Chlamydophila pneumoniae CWL029
ggaaucucgggagaaca

SEQ ID NO: 2536437 - RNA, 20 nt, Chlamydophila pneumoniae CWL029
ggaaucucgggagaacaugc

SEQ ID NO: 2536438 - RNA, 12 nt, Chlamydophila pneumoniae CWL029
ggaaugaucccu

SEQ ID NO: 2536439 - RNA, 18 nt, Chlamydophila pneumoniae CWL029
ggaaugcauuucaugaau

SEQ ID NO: 2536440 - RNA, 22 nt, Chlamydophila pneumoniae CWL029
ggaauuagagaaauuuuuaauu

SEQ ID NO: 2536441 - RNA, 22 nt, Chlamydophila pneumoniae CWL029
ggaauugcagcaaggagagugc

SEQ ID NO: 2536442 - RNA, 11 nt, Chlamydophila pneumoniae CWL029
ggaauuucucc

SEQ ID NO: 2536443 - RNA, 14 nt, Chlamydophila pneumoniae CWL029
ggacaaaucuccca

SEQ ID NO: 2536444 - RNA, 20 nt, Chlamydophila pneumoniae CWL029
ggacaacaacagcuuuaucu

SEQ ID NO: 2536445 - RNA, 18 nt, Chlamydophila pneumoniae CWL029
ggacaacagcaacacucg

SEQ ID NO: 2536446 - RNA, 14 nt, Chlamydophila pneumoniae CWL029
ggacaauauagaga

SEQ ID NO: 2536447 - RNA, 18 nt, Chlamydophila pneumoniae CWL029
ggacaaugcuaucuccag

SEQ ID NO: 2536448 - RNA, 18 nt, Chlamydophila pneumoniae CWL029
ggacaccagcuucccaag

SEQ ID NO: 2536449 - RNA, 12 nt, Chlamydophila pneumoniae CWL029
ggacagaaagau

SEQ ID NO: 2536450 - RNA, 19 nt, Chlamydophila pneumoniae CWL029
ggacagcacauagagugug

SEQ ID NO: 2536451 - RNA, 17 nt, Chlamydophila pneumoniae CWL029
ggaccacaauuccuaaa

SEQ ID NO: 2536452 - RNA, 22 nt, Chlamydophila pneumoniae CWL029
ggaccacaauuccuaaaacaag

SEQ ID NO: 2536453 - RNA, 18 nt, Chlamydophila pneumoniae CWL029
ggaccagaugcuaaagag

SEQ ID NO: 2536454 - RNA, 23 nt, Chlamydophila pneumoniae CWL029
ggaccuuauacccacaaagauca

SEQ ID NO: 2536455 - RNA, 18 nt, Chlamydophila pneumoniae CWL029
ggaccuuccuuaucuuca

SEQ ID NO: 2536456 - RNA, 21 nt, Chlamydophila pneumoniae CWL029
ggacgagaaccaaagcagugu

SEQ ID NO: 2536457 - RNA, 15 nt, Chlamydophila pneumoniae CWL029
ggacgcacauuuaga

SEQ ID NO: 2536458 - RNA, 14 nt, Chlamydophila pneumoniae CWL029
ggacuaaacaagaa

SEQ ID NO: 2536459 - RNA, 16 nt, Chlamydophila pneumoniae CWL029
ggacuaaacaagaaaa

SEQ ID NO: 2536460 - RNA, 20 nt, Chlamydophila pneumoniae CWL029
ggacuaaacaagaaaaagca

SEQ ID NO: 2536461 - RNA, 13 nt, Chlamydophila pneumoniae CWL029
ggacuacugaaac

SEQ ID NO: 2536462 - RNA, 22 nt, Chlamydophila pneumoniae CWL029
ggacuccaagaauagcaggaag

SEQ ID NO: 2536463 - RNA, 22 nt, Chlamydophila pneumoniae CWL029
ggacugacuucuaugauaucac

SEQ ID NO: 2536464 - RNA, 15 nt, Chlamydophila pneumoniae CWL029
ggacuucucaaagac

SEQ ID NO: 2536465 - RNA, 16 nt, Chlamydophila pneumoniae CWL029
ggacuucucaaagaca

SEQ ID NO: 2536466 - RNA, 21 nt, Chlamydophila pneumoniae CWL029
ggagaacaccucuucucuaua

SEQ ID NO: 2536467 - RNA, 10 nt, Chlamydophila pneumoniae CWL029
ggagaagccc

SEQ ID NO: 2536468 - RNA, 11 nt, Chlamydophila pneumoniae CWL029
ggagaagcccc

SEQ ID NO: 2536469 - RNA, 22 nt, Chlamydophila pneumoniae CWL029
ggagaagcuaagggaaauccac

SEQ ID NO: 2536470 - RNA, 15 nt, Chlamydophila pneumoniae CWL029
ggagaauagcaagca

SEQ ID NO: 2536471 - RNA, 13 nt, Chlamydophila pneumoniae CWL029
ggagaauugaaaa

SEQ ID NO: 2536472 - RNA, 20 nt, Chlamydophila pneumoniae CWL029
ggagacacacuuucuuuaaa

SEQ ID NO: 2536473 - RNA, 22 nt, Chlamydophila pneumoniae CWL029
ggagacacacuuucuuuaaaga

SEQ ID NO: 2536474 - RNA, 16 nt, Chlamydophila pneumoniae CWL029
ggagacucagagaaaa

SEQ ID NO: 2536475 - RNA, 18 nt, Chlamydophila pneumoniae CWL029
ggagacucagagaaaauc

SEQ ID NO: 2536476 - RNA, 24 nt, Chlamydophila pneumoniae CWL029
ggagacuugaucuacaaaaacuag

SEQ ID NO: 2536477 - RNA, 19 nt, Chlamydophila pneumoniae CWL029
ggagagcuucuucuguaaa

SEQ ID NO: 2536478 - RNA, 20 nt, Chlamydophila pneumoniae CWL029
ggagagcuugguuuucuccu

SEQ ID NO: 2536479 - RNA, 17 nt, Chlamydophila pneumoniae CWL029
ggagagcuuucgcuccu

SEQ ID NO: 2536480 - RNA, 13 nt, Chlamydophila pneumoniae CWL029
ggagagggaagga

SEQ ID NO: 2536481 - RNA, 11 nt, Chlamydophila pneumoniae CWL029
ggagagguaau

SEQ ID NO: 2536482 - RNA, 22 nt, Chlamydophila pneumoniae CWL029
ggagauaaagauguagaauaac

SEQ ID NO: 2536483 - RNA, 13 nt, Chlamydophila pneumoniae CWL029
ggagauuccuaaa

SEQ ID NO: 2536484 - RNA, 19 nt, Chlamydophila pneumoniae CWL029
ggagcauagacucuuccuu

SEQ ID NO: 2536485 - RNA, 23 nt, Chlamydophila pneumoniae CWL029
ggagcaucuuuucaaaagaaaag

SEQ ID NO: 2536486 - RNA, 13 nt, Chlamydophila pneumoniae CWL029
ggagcuaaagcug

SEQ ID NO: 2536487 - RNA, 17 nt, Chlamydophila pneumoniae CWL029
ggagcucuuucuuggau

SEQ ID NO: 2536488 - RNA, 12 nt, Chlamydophila pneumoniae CWL029
ggagcuucuaag

SEQ ID NO: 2536489 - RNA, 17 nt, Chlamydophila pneumoniae CWL029
ggagcuugucuaggagc

SEQ ID NO: 2536490 - RNA, 11 nt, Chlamydophila pneumoniae CWL029
ggagggaaaca

SEQ ID NO: 2536491 - RNA, 15 nt, Chlamydophila pneumoniae CWL029
ggagguccuuggcau

SEQ ID NO: 2536492 - RNA, 18 nt, Chlamydophila pneumoniae CWL029
ggaguucuugauucucuu

SEQ ID NO: 2536493 - RNA, 14 nt, Chlamydophila pneumoniae CWL029
ggaguuuuccuaaa

SEQ ID NO: 2536494 - RNA, 17 nt, Chlamydophila pneumoniae CWL029
ggauaaaaaguuuuugu

SEQ ID NO: 2536495 - RNA, 14 nt, Chlamydophila pneumoniae CWL029
ggauaaauggagga

SEQ ID NO: 2536496 - RNA, 15 nt, Chlamydophila pneumoniae CWL029
ggauaaguucuucca

SEQ ID NO: 2536497 - RNA, 20 nt, Chlamydophila pneumoniae CWL029
ggauaaugcucacuucuuug

SEQ ID NO: 2536498 - RNA, 13 nt, Chlamydophila pneumoniae CWL029
ggauaauuaaacu

SEQ ID NO: 2536499 - RNA, 18 nt, Chlamydophila pneumoniae CWL029
ggauagcauacgacagua

SEQ ID NO: 2536500 - RNA, 17 nt, Chlamydophila pneumoniae CWL029
ggauaggcaagauuaug

SEQ ID NO: 2536501 - RNA, 18 nt, Chlamydophila pneumoniae CWL029
ggauauacaauccagaau

SEQ ID NO: 2536502 - RNA, 24 nt, Chlamydophila pneumoniae CWL029
ggauaucugagcauaacuugaaga

SEQ ID NO: 2536503 - RNA, 22 nt, Chlamydophila pneumoniae CWL029
ggauaucuucuggguucuccac

SEQ ID NO: 2536504 - RNA, 17 nt, Chlamydophila pneumoniae CWL029
ggauauugauaaauccc

SEQ ID NO: 2536505 - RNA, 20 nt, Chlamydophila pneumoniae CWL029
ggauauugucaagaggcugu

SEQ ID NO: 2536506 - RNA, 17 nt, Chlamydophila pneumoniae CWL029
ggaucauguagcagagc

SEQ ID NO: 2536507 - RNA, 17 nt, Chlamydophila pneumoniae CWL029
ggaucauuaaaguccaa

SEQ ID NO: 2536508 - RNA, 14 nt, Chlamydophila pneumoniae CWL029
ggaucauugaguuc

SEQ ID NO: 2536509 - RNA, 20 nt, Chlamydophila pneumoniae CWL029
ggauccaucggcauuucucc

SEQ ID NO: 2536510 - RNA, 17 nt, Chlamydophila pneumoniae CWL029
ggauccuagaauaggaa

SEQ ID NO: 2536511 - RNA, 15 nt, Chlamydophila pneumoniae CWL029
ggaucuaaagcauca

SEQ ID NO: 2536512 - RNA, 18 nt, Chlamydophila pneumoniae CWL029
ggaucucucuuuccuuag

SEQ ID NO: 2536513 - RNA, 16 nt, Chlamydophila pneumoniae CWL029
ggaucuuaggauucuu

SEQ ID NO: 2536514 - RNA, 18 nt, Chlamydophila pneumoniae CWL029
ggaucuuauauaaaacuu

SEQ ID NO: 2536515 - RNA, 18 nt, Chlamydophila pneumoniae CWL029
ggaucuucagagagaaca

SEQ ID NO: 2536516 - RNA, 23 nt, Chlamydophila pneumoniae CWL029
ggaucuucuucuggcugagagaa

SEQ ID NO: 2536517 - RNA, 16 nt, Chlamydophila pneumoniae CWL029
ggaucuugauaaaaga

SEQ ID NO: 2536518 - RNA, 17 nt, Chlamydophila pneumoniae CWL029
ggaucuuuucuuucuaa

SEQ ID NO: 2536519 - RNA, 19 nt, Chlamydophila pneumoniae CWL029
ggaucuuuucuuucuaaga

SEQ ID NO: 2536520 - RNA, 19 nt, Chlamydophila pneumoniae CWL029
ggaugaagauaaaaucuuc

SEQ ID NO: 2536521 - RNA, 22 nt, Chlamydophila pneumoniae CWL029
ggaugaagauaaaaucuucauc

SEQ ID NO: 2536522 - RNA, 23 nt, Chlamydophila pneumoniae CWL029
ggaugcagaucauaucggcagca

SEQ ID NO: 2536523 - RNA, 18 nt, Chlamydophila pneumoniae CWL029
ggauggacuacugaaaca

SEQ ID NO: 2536524 - RNA, 11 nt, Chlamydophila pneumoniae CWL029
ggaugugaugu

SEQ ID NO: 2536525 - RNA, 13 nt, Chlamydophila pneumoniae CWL029
ggauguucaaagc

SEQ ID NO: 2536526 - RNA, 15 nt, Chlamydophila pneumoniae CWL029
ggauuaguaacuaaa

SEQ ID NO: 2536527 - RNA, 18 nt, Chlamydophila pneumoniae CWL029
ggauuaucccaaacuucu

SEQ ID NO: 2536528 - RNA, 15 nt, Chlamydophila pneumoniae CWL029
ggauucuaaaaagaa

SEQ ID NO: 2536529 - RNA, 20 nt, Chlamydophila pneumoniae CWL029
ggauucuaaaaagaaaagac

SEQ ID NO: 2536530 - RNA, 16 nt, Chlamydophila pneumoniae CWL029
ggauucugucuauaag

SEQ ID NO: 2536531 - RNA, 19 nt, Chlamydophila pneumoniae CWL029
ggauugcuucgggaucuaa

SEQ ID NO: 2536532 - RNA, 16 nt, Chlamydophila pneumoniae CWL029
ggauuucuucuucuaa

SEQ ID NO: 2536533 - RNA, 22 nt, Chlamydophila pneumoniae CWL029
ggcaacaagagcgcauuuuaca

SEQ ID NO: 2536534 - RNA, 13 nt, Chlamydophila pneumoniae CWL029
ggcaauagcuuug

SEQ ID NO: 2536535 - RNA, 15 nt, Chlamydophila pneumoniae CWL029
ggcaaucuaaaauca

SEQ ID NO: 2536536 - RNA, 13 nt, Chlamydophila pneumoniae CWL029
ggcaaugauaggg

SEQ ID NO: 2536537 - RNA, 17 nt, Chlamydophila pneumoniae CWL029
ggcaaugaucaaaaaug

SEQ ID NO: 2536538 - RNA, 22 nt, Chlamydophila pneumoniae CWL029
ggcacccaaacugaugccaaga

SEQ ID NO: 2536539 - RNA, 22 nt, Chlamydophila pneumoniae CWL029
ggcaccucaauaaaucuauucc

SEQ ID NO: 2536540 - RNA, 17 nt, Chlamydophila pneumoniae CWL029
ggcagguaguaggacaa

SEQ ID NO: 2536541 - RNA, 21 nt, Chlamydophila pneumoniae CWL029
ggcagugugggcaaugcuugu

SEQ ID NO: 2536542 - RNA, 17 nt, Chlamydophila pneumoniae CWL029
ggcauacaguagaaaca

SEQ ID NO: 2536543 - RNA, 15 nt, Chlamydophila pneumoniae CWL029
ggcauacucuuugca

SEQ ID NO: 2536544 - RNA, 14 nt, Chlamydophila pneumoniae CWL029
ggcaucuagagucu

SEQ ID NO: 2536545 - RNA, 12 nt, Chlamydophila pneumoniae CWL029
ggcaucuuuuac

SEQ ID NO: 2536546 - RNA, 14 nt, Chlamydophila pneumoniae CWL029
ggcauucaggagca

SEQ ID NO: 2536547 - RNA, 16 nt, Chlamydophila pneumoniae CWL029
ggcauuucuccacaug

SEQ ID NO: 2536548 - RNA, 21 nt, Chlamydophila pneumoniae CWL029
ggccaagagcuugucuuccac

SEQ ID NO: 2536549 - RNA, 17 nt, Chlamydophila pneumoniae CWL029
ggcccccuacagcagaa

SEQ ID NO: 2536550 - RNA, 14 nt, Chlamydophila pneumoniae CWL029
ggccccuggaauuu

SEQ ID NO: 2536551 - RNA, 18 nt, Chlamydophila pneumoniae CWL029
ggcccugacuuagagucu

SEQ ID NO: 2536552 - RNA, 18 nt, Chlamydophila pneumoniae CWL029
ggccuauagcaaagaaca

SEQ ID NO: 2536553 - RNA, 14 nt, Chlamydophila pneumoniae CWL029
ggccucaacacgcu

SEQ ID NO: 2536554 - RNA, 13 nt, Chlamydophila pneumoniae CWL029
ggccucuucccaa

SEQ ID NO: 2536555 - RNA, 18 nt, Chlamydophila pneumoniae CWL029
ggccugagaccauaaaau

SEQ ID NO: 2536556 - RNA, 19 nt, Chlamydophila pneumoniae CWL029
ggccuugccaguauugaua

SEQ ID NO: 2536557 - RNA, 18 nt, Chlamydophila pneumoniae CWL029
ggcuaaaggaucauuaaa

SEQ ID NO: 2536558 - RNA, 19 nt, Chlamydophila pneumoniae CWL029
ggcuaaauaaaccacgaau

SEQ ID NO: 2536559 - RNA, 14 nt, Chlamydophila pneumoniae CWL029
ggcuauagaauaca

SEQ ID NO: 2536560 - RNA, 11 nt, Chlamydophila pneumoniae CWL029
ggcucaaagaa

SEQ ID NO: 2536561 - RNA, 12 nt, Chlamydophila pneumoniae CWL029
ggcucaaagaaa

SEQ ID NO: 2536562 - RNA, 15 nt, Chlamydophila pneumoniae CWL029
ggcucuauaggggau

SEQ ID NO: 2536563 - RNA, 19 nt, Chlamydophila pneumoniae CWL029
ggcugagacauauugaaga

SEQ ID NO: 2536564 - RNA, 14 nt, Chlamydophila pneumoniae CWL029
ggcugagagaagca

SEQ ID NO: 2536565 - RNA, 24 nt, Chlamydophila pneumoniae CWL029
ggcugauucucccaauauccagaa

SEQ ID NO: 2536566 - RNA, 16 nt, Chlamydophila pneumoniae CWL029
ggcugucuugaccaau

SEQ ID NO: 2536567 - RNA, 13 nt, Chlamydophila pneumoniae CWL029
ggcuuaagucuug

SEQ ID NO: 2536568 - RNA, 22 nt, Chlamydophila pneumoniae CWL029
ggcuucagagauuuuaaagccu

SEQ ID NO: 2536569 - RNA, 18 nt, Chlamydophila pneumoniae CWL029
ggcuucauuccuacaucu

SEQ ID NO: 2536570 - RNA, 20 nt, Chlamydophila pneumoniae CWL029
ggcuuugccuuuagagacgc

SEQ ID NO: 2536571 - RNA, 11 nt, Chlamydophila pneumoniae CWL029
gggaaagaaac

SEQ ID NO: 2536572 - RNA, 13 nt, Chlamydophila pneumoniae CWL029
gggaaagaaacua

SEQ ID NO: 2536573 - RNA, 15 nt, Chlamydophila pneumoniae CWL029
gggaaaggucgggga

SEQ ID NO: 2536574 - RNA, 21 nt, Chlamydophila pneumoniae CWL029
gggaacaacugugguuuuaaa

SEQ ID NO: 2536575 - RNA, 13 nt, Chlamydophila pneumoniae CWL029
gggaacgcucucu

SEQ ID NO: 2536576 - RNA, 17 nt, Chlamydophila pneumoniae CWL029
gggaagacucucaucag

SEQ ID NO: 2536577 - RNA, 22 nt, Chlamydophila pneumoniae CWL029
gggaauuaaacuuucuucucua

SEQ ID NO: 2536578 - RNA, 18 nt, Chlamydophila pneumoniae CWL029
gggaauucuuuuccugca

SEQ ID NO: 2536579 - RNA, 14 nt, Chlamydophila pneumoniae CWL029
gggagagccauuuu

SEQ ID NO: 2536580 - RNA, 15 nt, Chlamydophila pneumoniae CWL029
gggagcuagaaaguc

SEQ ID NO: 2536581 - RNA, 10 nt, Chlamydophila pneumoniae CWL029
gggagcuucc

SEQ ID NO: 2536582 - RNA, 16 nt, Chlamydophila pneumoniae CWL029
gggaggaauuccucuc

SEQ ID NO: 2536583 - RNA, 21 nt, Chlamydophila pneumoniae CWL029
gggauaaaacuauaaaagcca

SEQ ID NO: 2536584 - RNA, 20 nt, Chlamydophila pneumoniae CWL029
gggauaaugcucacuucuuu

SEQ ID NO: 2536585 - RNA, 14 nt, Chlamydophila pneumoniae CWL029
gggaucacagucuu

SEQ ID NO: 2536586 - RNA, 16 nt, Chlamydophila pneumoniae CWL029
gggauccugcaaagcc

SEQ ID NO: 2536587 - RNA, 17 nt, Chlamydophila pneumoniae CWL029
gggaucuccuugagaga

SEQ ID NO: 2536588 - RNA, 20 nt, Chlamydophila pneumoniae CWL029
gggauuguucuuuacuacau

SEQ ID NO: 2536589 - RNA, 18 nt, Chlamydophila pneumoniae CWL029
gggcggacuauguuuaaa

SEQ ID NO: 2536590 - RNA, 13 nt, Chlamydophila pneumoniae CWL029
gggcuacaauacg

SEQ ID NO: 2536591 - RNA, 14 nt, Chlamydophila pneumoniae CWL029
ggggagucuuggau

SEQ ID NO: 2536592 - RNA, 15 nt, Chlamydophila pneumoniae CWL029
ggggauuaucccaaa

SEQ ID NO: 2536593 - RNA, 15 nt, Chlamydophila pneumoniae CWL029
ggggauugauaacaa

SEQ ID NO: 2536594 - RNA, 13 nt, Chlamydophila pneumoniae CWL029
ggggcuuuccuuc

SEQ ID NO: 2536595 - RNA, 18 nt, Chlamydophila pneumoniae CWL029
ggguaaggcgaaaucuuc

SEQ ID NO: 2536596 - RNA, 15 nt, Chlamydophila pneumoniae CWL029
gggucuacaacaguu

SEQ ID NO: 2536597 - RNA, 12 nt, Chlamydophila pneumoniae CWL029
ggguuucccugu

SEQ ID NO: 2536598 - RNA, 14 nt, Chlamydophila pneumoniae CWL029
gguaaagagcuucu

SEQ ID NO: 2536599 - RNA, 19 nt, Chlamydophila pneumoniae CWL029
gguaaagagcuucuucuaa

SEQ ID NO: 2536600 - RNA, 15 nt, Chlamydophila pneumoniae CWL029
gguaaauuuuuaaaa

SEQ ID NO: 2536601 - RNA, 12 nt, Chlamydophila pneumoniae CWL029
gguaaggaggaa

SEQ ID NO: 2536602 - RNA, 14 nt, Chlamydophila pneumoniae CWL029
gguaauacccucaa

SEQ ID NO: 2536603 - RNA, 15 nt, Chlamydophila pneumoniae CWL029
gguagagcuagaaug

SEQ ID NO: 2536604 - RNA, 19 nt, Chlamydophila pneumoniae CWL029
gguagauccuauaguaauu

SEQ ID NO: 2536605 - RNA, 18 nt, Chlamydophila pneumoniae CWL029
gguagcagaguuuuuccc

SEQ ID NO: 2536606 - RNA, 19 nt, Chlamydophila pneumoniae CWL029
gguagcagaguuuuucccu

SEQ ID NO: 2536607 - RNA, 21 nt, Chlamydophila pneumoniae CWL029
gguagcccugcaccaauugca

SEQ ID NO: 2536608 - RNA, 22 nt, Chlamydophila pneumoniae CWL029
gguagcgucucuucuuccucua

SEQ ID NO: 2536609 - RNA, 19 nt, Chlamydophila pneumoniae CWL029
gguagcuaaauuuagagaa

SEQ ID NO: 2536610 - RNA, 24 nt, Chlamydophila pneumoniae CWL029
gguaguuugccuucuuaucuucua

SEQ ID NO: 2536611 - RNA, 16 nt, Chlamydophila pneumoniae CWL029
gguauagaaacaccgu

SEQ ID NO: 2536612 - RNA, 23 nt, Chlamydophila pneumoniae CWL029
gguauccugcuccaaaaugggau

SEQ ID NO: 2536613 - RNA, 20 nt, Chlamydophila pneumoniae CWL029
gguaucuccuugauaaaacg

SEQ ID NO: 2536614 - RNA, 22 nt, Chlamydophila pneumoniae CWL029
gguauuaggaaguaguggacua

SEQ ID NO: 2536615 - RNA, 14 nt, Chlamydophila pneumoniae CWL029
gguauuucucucca

SEQ ID NO: 2536616 - RNA, 21 nt, Chlamydophila pneumoniae CWL029
ggucacuucaauuacaggagc

SEQ ID NO: 2536617 - RNA, 14 nt, Chlamydophila pneumoniae CWL029
gguccaaacccugg

SEQ ID NO: 2536618 - RNA, 16 nt, Chlamydophila pneumoniae CWL029
ggucgaucaagguguu

SEQ ID NO: 2536619 - RNA, 22 nt, Chlamydophila pneumoniae CWL029
ggucgauugagauugaggauaa

SEQ ID NO: 2536620 - RNA, 18 nt, Chlamydophila pneumoniae CWL029
ggucucccucacaagaag

SEQ ID NO: 2536621 - RNA, 14 nt, Chlamydophila pneumoniae CWL029
ggucuguauuuucu

SEQ ID NO: 2536622 - RNA, 19 nt, Chlamydophila pneumoniae CWL029
ggucuuuguucgcuccuaa

SEQ ID NO: 2536623 - RNA, 15 nt, Chlamydophila pneumoniae CWL029
ggugaacuaaaucuc

SEQ ID NO: 2536624 - RNA, 17 nt, Chlamydophila pneumoniae CWL029
ggugaagaauaauagca

SEQ ID NO: 2536625 - RNA, 14 nt, Chlamydophila pneumoniae CWL029
ggugcaucauuuuc

SEQ ID NO: 2536626 - RNA, 17 nt, Chlamydophila pneumoniae CWL029
gguguauaguauuuuua

SEQ ID NO: 2536627 - RNA, 13 nt, Chlamydophila pneumoniae CWL029
gguuaaaauagac

SEQ ID NO: 2536628 - RNA, 13 nt, Chlamydophila pneumoniae CWL029
gguuauagauacg

SEQ ID NO: 2536629 - RNA, 22 nt, Chlamydophila pneumoniae CWL029
gguuccacagagaccuucucuu

SEQ ID NO: 2536630 - RNA, 20 nt, Chlamydophila pneumoniae CWL029
gguuccucuuccuuuuugca

SEQ ID NO: 2536631 - RNA, 21 nt, Chlamydophila pneumoniae CWL029
gguucugaaauugucuucagu

SEQ ID NO: 2536632 - RNA, 22 nt, Chlamydophila pneumoniae CWL029
gguuguacuuuuacugaaauua

SEQ ID NO: 2536633 - RNA, 12 nt, Chlamydophila pneumoniae CWL029
gguuucuaaaua

SEQ ID NO: 2536634 - RNA, 11 nt, Chlamydophila pneumoniae CWL029
gguuucuaggu

SEQ ID NO: 2536635 - RNA, 16 nt, Chlamydophila pneumoniae CWL029
gguuucuuuuuuuuga

SEQ ID NO: 2536636 - RNA, 19 nt, Chlamydophila pneumoniae CWL029
gguuugcaugccuauuaag

SEQ ID NO: 2536637 - RNA, 16 nt, Chlamydophila pneumoniae CWL029
gguuuugaagcuccuc

SEQ ID NO: 2536638 - RNA, 13 nt, Chlamydophila pneumoniae CWL029
gguuuuuccaacu

SEQ ID NO: 2536639 - RNA, 18 nt, Chlamydophila pneumoniae CWL029
guaaaaaauacaggaauc

SEQ ID NO: 2536640 - RNA, 16 nt, Chlamydophila pneumoniae CWL029
guaaaaagccuaugau

SEQ ID NO: 2536641 - RNA, 12 nt, Chlamydophila pneumoniae CWL029
guaaaaauauag

SEQ ID NO: 2536642 - RNA, 14 nt, Chlamydophila pneumoniae CWL029
guaaaaauggcacu

SEQ ID NO: 2536643 - RNA, 15 nt, Chlamydophila pneumoniae CWL029
guaaaacacaaauag

SEQ ID NO: 2536644 - RNA, 21 nt, Chlamydophila pneumoniae CWL029
guaaaacacaaauagcaagag

SEQ ID NO: 2536645 - RNA, 16 nt, Chlamydophila pneumoniae CWL029
guaaaacuacaggaaa

SEQ ID NO: 2536646 - RNA, 20 nt, Chlamydophila pneumoniae CWL029
guaaaacugcgcuaucauca

SEQ ID NO: 2536647 - RNA, 17 nt, Chlamydophila pneumoniae CWL029
guaaacagcaaaguaau

SEQ ID NO: 2536648 - RNA, 15 nt, Chlamydophila pneumoniae CWL029
guaaagaaaagcaau

SEQ ID NO: 2536649 - RNA, 14 nt, Chlamydophila pneumoniae CWL029
guaaagagcuucuu

SEQ ID NO: 2536650 - RNA, 16 nt, Chlamydophila pneumoniae CWL029
guaaagagcuucuucu

SEQ ID NO: 2536651 - RNA, 17 nt, Chlamydophila pneumoniae CWL029
guaaagguuguaaggac

SEQ ID NO: 2536652 - RNA, 19 nt, Chlamydophila pneumoniae CWL029
guaaagguuguaaggacga

SEQ ID NO: 2536653 - RNA, 18 nt, Chlamydophila pneumoniae CWL029
guaaaguaggcacaucau

SEQ ID NO: 2536654 - RNA, 14 nt, Chlamydophila pneumoniae CWL029
guaaaguaugcaua

SEQ ID NO: 2536655 - RNA, 20 nt, Chlamydophila pneumoniae CWL029
guaaaguaugcauagccucg

SEQ ID NO: 2536656 - RNA, 13 nt, Chlamydophila pneumoniae CWL029
guaaauaauaacc

SEQ ID NO: 2536657 - RNA, 21 nt, Chlamydophila pneumoniae CWL029
guaaauacaaaacaaaagcca

SEQ ID NO: 2536658 - RNA, 17 nt, Chlamydophila pneumoniae CWL029
guaaauauuuuaccauu

SEQ ID NO: 2536659 - RNA, 21 nt, Chlamydophila pneumoniae CWL029
guaaaucauuggaaccauagg

SEQ ID NO: 2536660 - RNA, 17 nt, Chlamydophila pneumoniae CWL029
guaaaugaggcuccucc

SEQ ID NO: 2536661 - RNA, 17 nt, Chlamydophila pneumoniae CWL029
guaaauguuuugcgaua

SEQ ID NO: 2536662 - RNA, 16 nt, Chlamydophila pneumoniae CWL029
guaacauccauagaga

SEQ ID NO: 2536663 - RNA, 19 nt, Chlamydophila pneumoniae CWL029
guaacauugaccuaaagga

SEQ ID NO: 2536664 - RNA, 20 nt, Chlamydophila pneumoniae CWL029
guaacauugaccuaaaggaa

SEQ ID NO: 2536665 - RNA, 20 nt, Chlamydophila pneumoniae CWL029
guaacauuggagucuaaaaa

SEQ ID NO: 2536666 - RNA, 19 nt, Chlamydophila pneumoniae CWL029
guaaccaacaucaaagaau

SEQ ID NO: 2536667 - RNA, 14 nt, Chlamydophila pneumoniae CWL029
guaaccacaggauc

SEQ ID NO: 2536668 - RNA, 17 nt, Chlamydophila pneumoniae CWL029
guaacgcugcuaauguu

SEQ ID NO: 2536669 - RNA, 22 nt, Chlamydophila pneumoniae CWL029
guaagaacguauacgucccaca

SEQ ID NO: 2536670 - RNA, 17 nt, Chlamydophila pneumoniae CWL029
guaagaauccuugcuaa

SEQ ID NO: 2536671 - RNA, 15 nt, Chlamydophila pneumoniae CWL029
guaagacuaaaaaag

SEQ ID NO: 2536672 - RNA, 18 nt, Chlamydophila pneumoniae CWL029
guaagacuaaaaaagaga

SEQ ID NO: 2536673 - RNA, 20 nt, Chlamydophila pneumoniae CWL029
guaagacuaaaaaagagacc

SEQ ID NO: 2536674 - RNA, 15 nt, Chlamydophila pneumoniae CWL029
guaagagaauuauua

SEQ ID NO: 2536675 - RNA, 22 nt, Chlamydophila pneumoniae CWL029
guaagcagugugcugauuuuaa

SEQ ID NO: 2536676 - RNA, 18 nt, Chlamydophila pneumoniae CWL029
guaagcugcaaucucaaa

SEQ ID NO: 2536677 - RNA, 12 nt, Chlamydophila pneumoniae CWL029
guaagggaugcu

SEQ ID NO: 2536678 - RNA, 22 nt, Chlamydophila pneumoniae CWL029
guaauaacuauaauauaacugc

SEQ ID NO: 2536679 - RNA, 18 nt, Chlamydophila pneumoniae CWL029
guaauagguuucaauaga

SEQ ID NO: 2536680 - RNA, 21 nt, Chlamydophila pneumoniae CWL029
guaaucaugauaaaaauuuuc

SEQ ID NO: 2536681 - RNA, 18 nt, Chlamydophila pneumoniae CWL029
guaauccagauuguucaa

SEQ ID NO: 2536682 - RNA, 15 nt, Chlamydophila pneumoniae CWL029
guaauccuaauuccu

SEQ ID NO: 2536683 - RNA, 23 nt, Chlamydophila pneumoniae CWL029
guaauccuucuuucugcucuucu

SEQ ID NO: 2536684 - RNA, 15 nt, Chlamydophila pneumoniae CWL029
guaaucuaagaaucu

SEQ ID NO: 2536685 - RNA, 14 nt, Chlamydophila pneumoniae CWL029
guaaucuguauaug

SEQ ID NO: 2536686 - RNA, 19 nt, Chlamydophila pneumoniae CWL029
guaaucuuuuuuaaagcua

SEQ ID NO: 2536687 - RNA, 16 nt, Chlamydophila pneumoniae CWL029
guaaugagcuggaaga

SEQ ID NO: 2536688 - RNA, 15 nt, Chlamydophila pneumoniae CWL029
guaaugcuuagccau

SEQ ID NO: 2536689 - RNA, 19 nt, Chlamydophila pneumoniae CWL029
guaaugcuuagccauggca

SEQ ID NO: 2536690 - RNA, 22 nt, Chlamydophila pneumoniae CWL029
guaauuucuaaauagaaaacau

SEQ ID NO: 2536691 - RNA, 20 nt, Chlamydophila pneumoniae CWL029
guaauuucuagcuaauaaug

SEQ ID NO: 2536692 - RNA, 19 nt, Chlamydophila pneumoniae CWL029
guacaagcuucaucaaaac

SEQ ID NO: 2536693 - RNA, 23 nt, Chlamydophila pneumoniae CWL029
guacagaccguccuccccauaca

SEQ ID NO: 2536694 - RNA, 18 nt, Chlamydophila pneumoniae CWL029
guacaggaaguccaugua

SEQ ID NO: 2536695 - RNA, 23 nt, Chlamydophila pneumoniae CWL029
guacaguugcgcgcccucuucua

SEQ ID NO: 2536696 - RNA, 16 nt, Chlamydophila pneumoniae CWL029
guacaguuuuuuucua

SEQ ID NO: 2536697 - RNA, 12 nt, Chlamydophila pneumoniae CWL029
guaccaagaaaa

SEQ ID NO: 2536698 - RNA, 13 nt, Chlamydophila pneumoniae CWL029
guaccaagaaaau

SEQ ID NO: 2536699 - RNA, 14 nt, Chlamydophila pneumoniae CWL029
guaccaagaaaaua

SEQ ID NO: 2536700 - RNA, 20 nt, Chlamydophila pneumoniae CWL029
guaccguaaagaaaagcaau

SEQ ID NO: 2536701 - RNA, 23 nt, Chlamydophila pneumoniae CWL029
guaccguagcguacguuuucucu

SEQ ID NO: 2536702 - RNA, 13 nt, Chlamydophila pneumoniae CWL029
guaccuaggaucu

SEQ ID NO: 2536703 - RNA, 19 nt, Chlamydophila pneumoniae CWL029
guacgcaaguaaagaaauu

SEQ ID NO: 2536704 - RNA, 14 nt, Chlamydophila pneumoniae CWL029
guacggcuaaauaa

SEQ ID NO: 2536705 - RNA, 12 nt, Chlamydophila pneumoniae CWL029
guacgucuuuca

SEQ ID NO: 2536706 - RNA, 13 nt, Chlamydophila pneumoniae CWL029
guacguuuucucu

SEQ ID NO: 2536707 - RNA, 13 nt, Chlamydophila pneumoniae CWL029
guacuaagauacg

SEQ ID NO: 2536708 - RNA, 20 nt, Chlamydophila pneumoniae CWL029
guacuaucgguuuaaacaga

SEQ ID NO: 2536709 - RNA, 20 nt, Chlamydophila pneumoniae CWL029
guacucuucuuuuuaucaug

SEQ ID NO: 2536710 - RNA, 12 nt, Chlamydophila pneumoniae CWL029
guacuuuuugcc

SEQ ID NO: 2536711 - RNA, 19 nt, Chlamydophila pneumoniae CWL029
guagaaggggguucuaaga

SEQ ID NO: 2536712 - RNA, 20 nt, Chlamydophila pneumoniae CWL029
guagaaggggguucuaagaa

SEQ ID NO: 2536713 - RNA, 16 nt, Chlamydophila pneumoniae CWL029
guagaauaacgcaagg

SEQ ID NO: 2536714 - RNA, 16 nt, Chlamydophila pneumoniae CWL029
guagaauccuucuccc

SEQ ID NO: 2536715 - RNA, 22 nt, Chlamydophila pneumoniae CWL029
guagaauccuucucccucuaaa

SEQ ID NO: 2536716 - RNA, 18 nt, Chlamydophila pneumoniae CWL029
guagacaacaagucuucc

SEQ ID NO: 2536717 - RNA, 19 nt, Chlamydophila pneumoniae CWL029
guagacaauaccagauaaa

SEQ ID NO: 2536718 - RNA, 19 nt, Chlamydophila pneumoniae CWL029
guagagccucuaagaaaau

SEQ ID NO: 2536719 - RNA, 17 nt, Chlamydophila pneumoniae CWL029
guagaggacgugcuccc

SEQ ID NO: 2536720 - RNA, 20 nt, Chlamydophila pneumoniae CWL029
guagauagaaauucuguaga

SEQ ID NO: 2536721 - RNA, 20 nt, Chlamydophila pneumoniae CWL029
guagaucuucugaaaucaaa

SEQ ID NO: 2536722 - RNA, 16 nt, Chlamydophila pneumoniae CWL029
guagcagagccucacu

SEQ ID NO: 2536723 - RNA, 16 nt, Chlamydophila pneumoniae CWL029
guagcaucucucucca

SEQ ID NO: 2536724 - RNA, 24 nt, Chlamydophila pneumoniae CWL029
guagccuggaggcgguggcaugcc

SEQ ID NO: 2536725 - RNA, 18 nt, Chlamydophila pneumoniae CWL029
guagcgacguuugaucuu

SEQ ID NO: 2536726 - RNA, 19 nt, Chlamydophila pneumoniae CWL029
guagcgcuuccagcuucuc

SEQ ID NO: 2536727 - RNA, 22 nt, Chlamydophila pneumoniae CWL029
guagcuacggagagguuaugua

SEQ ID NO: 2536728 - RNA, 15 nt, Chlamydophila pneumoniae CWL029
guagcuauucucaaa

SEQ ID NO: 2536729 - RNA, 17 nt, Chlamydophila pneumoniae CWL029
guagcuauuuuugagga

SEQ ID NO: 2536730 - RNA, 21 nt, Chlamydophila pneumoniae CWL029
guagcucaauuggcagagcau

SEQ ID NO: 2536731 - RNA, 19 nt, Chlamydophila pneumoniae CWL029
guaggaacaugccaaauau

SEQ ID NO: 2536732 - RNA, 18 nt, Chlamydophila pneumoniae CWL029
guaggaccuacugggaaa

SEQ ID NO: 2536733 - RNA, 12 nt, Chlamydophila pneumoniae CWL029
guaggagcagcg

SEQ ID NO: 2536734 - RNA, 20 nt, Chlamydophila pneumoniae CWL029
guaggcacaucauuaucaua

SEQ ID NO: 2536735 - RNA, 21 nt, Chlamydophila pneumoniae CWL029
guaggcauacaguagaaacau

SEQ ID NO: 2536736 - RNA, 14 nt, Chlamydophila pneumoniae CWL029
guaggccuccuuca

SEQ ID NO: 2536737 - RNA, 14 nt, Chlamydophila pneumoniae CWL029
guagguuuuuccaa

SEQ ID NO: 2536738 - RNA, 18 nt, Chlamydophila pneumoniae CWL029
guagucaaaaauucuucg

SEQ ID NO: 2536739 - RNA, 15 nt, Chlamydophila pneumoniae CWL029
guagucaugauuuuu

SEQ ID NO: 2536740 - RNA, 18 nt, Chlamydophila pneumoniae CWL029
guagugagauacggagga

SEQ ID NO: 2536741 - RNA, 20 nt, Chlamydophila pneumoniae CWL029
guagugauacuuuagaaucc

SEQ ID NO: 2536742 - RNA, 16 nt, Chlamydophila pneumoniae CWL029
guagugcuaucauaac

SEQ ID NO: 2536743 - RNA, 13 nt, Chlamydophila pneumoniae CWL029
guaguucuugcca

SEQ ID NO: 2536744 - RNA, 17 nt, Chlamydophila pneumoniae CWL029
guaguuucuaaaacaga

SEQ ID NO: 2536745 - RNA, 19 nt, Chlamydophila pneumoniae CWL029
guaguuucuaaaacagaaa

SEQ ID NO: 2536746 - RNA, 20 nt, Chlamydophila pneumoniae CWL029
guauaacaucuaaaaaugca

SEQ ID NO: 2536747 - RNA, 19 nt, Chlamydophila pneumoniae CWL029
guauaauagugagcucccu

SEQ ID NO: 2536748 - RNA, 20 nt, Chlamydophila pneumoniae CWL029
guauaauuggcguaauaauu

SEQ ID NO: 2536749 - RNA, 22 nt, Chlamydophila pneumoniae CWL029
guauaauuggcguaauaauucc

SEQ ID NO: 2536750 - RNA, 15 nt, Chlamydophila pneumoniae CWL029
guauacauaucuccu

SEQ ID NO: 2536751 - RNA, 15 nt, Chlamydophila pneumoniae CWL029
guauacuaagacugu

SEQ ID NO: 2536752 - RNA, 13 nt, Chlamydophila pneumoniae CWL029
guauagaaacacc

SEQ ID NO: 2536753 - RNA, 21 nt, Chlamydophila pneumoniae CWL029
guauagacuccuuaacaaccg

SEQ ID NO: 2536754 - RNA, 22 nt, Chlamydophila pneumoniae CWL029
guauagacuccuuaacaaccgc

SEQ ID NO: 2536755 - RNA, 15 nt, Chlamydophila pneumoniae CWL029
guauagagaagauuu

SEQ ID NO: 2536756 - RNA, 19 nt, Chlamydophila pneumoniae CWL029
guauagagcgguucuuucu

SEQ ID NO: 2536757 - RNA, 14 nt, Chlamydophila pneumoniae CWL029
guauagauuuuccg

SEQ ID NO: 2536758 - RNA, 18 nt, Chlamydophila pneumoniae CWL029
guauagcuggcaaugaua

SEQ ID NO: 2536759 - RNA, 13 nt, Chlamydophila pneumoniae CWL029
guauaggcauuaa

SEQ ID NO: 2536760 - RNA, 14 nt, Chlamydophila pneumoniae CWL029
guauaguauuuuua

SEQ ID NO: 2536761 - RNA, 21 nt, Chlamydophila pneumoniae CWL029
guauauaaaagaggaagauga

SEQ ID NO: 2536762 - RNA, 23 nt, Chlamydophila pneumoniae CWL029
guauauaagauaauagagaagaa

SEQ ID NO: 2536763 - RNA, 21 nt, Chlamydophila pneumoniae CWL029
guauaucagcaaaaaacugca

SEQ ID NO: 2536764 - RNA, 19 nt, Chlamydophila pneumoniae CWL029
guaucaagaauaugggugu

SEQ ID NO: 2536765 - RNA, 23 nt, Chlamydophila pneumoniae CWL029
guaucaauaaugacucuagagua

SEQ ID NO: 2536766 - RNA, 20 nt, Chlamydophila pneumoniae CWL029
guaucagcaagcccuccagu

SEQ ID NO: 2536767 - RNA, 23 nt, Chlamydophila pneumoniae CWL029
guauccuucuacaaugauauaaa

SEQ ID NO: 2536768 - RNA, 17 nt, Chlamydophila pneumoniae CWL029
guaucuagcuuugucuc

SEQ ID NO: 2536769 - RNA, 14 nt, Chlamydophila pneumoniae CWL029
guaucuagggacuu

SEQ ID NO: 2536770 - RNA, 14 nt, Chlamydophila pneumoniae CWL029
guaucuccggaacg

SEQ ID NO: 2536771 - RNA, 15 nt, Chlamydophila pneumoniae CWL029
guaucucuuaaaaua

SEQ ID NO: 2536772 - RNA, 16 nt, Chlamydophila pneumoniae CWL029
guaucuguauccuucc

SEQ ID NO: 2536773 - RNA, 13 nt, Chlamydophila pneumoniae CWL029
guaucuucucuua

SEQ ID NO: 2536774 - RNA, 17 nt, Chlamydophila pneumoniae CWL029
guaugaggagauaaaga

SEQ ID NO: 2536775 - RNA, 19 nt, Chlamydophila pneumoniae CWL029
guauggaauucaaacuccu

SEQ ID NO: 2536776 - RNA, 21 nt, Chlamydophila pneumoniae CWL029
guauggauuucuccagcagcu

SEQ ID NO: 2536777 - RNA, 14 nt, Chlamydophila pneumoniae CWL029
guaugguccauaau

SEQ ID NO: 2536778 - RNA, 22 nt, Chlamydophila pneumoniae CWL029
guaugguccauaauuucuuuca

SEQ ID NO: 2536779 - RNA, 19 nt, Chlamydophila pneumoniae CWL029
guauucaacacggacacua

SEQ ID NO: 2536780 - RNA, 15 nt, Chlamydophila pneumoniae CWL029
guauuccuuggauuu

SEQ ID NO: 2536781 - RNA, 14 nt, Chlamydophila pneumoniae CWL029
guauucugaagcug

SEQ ID NO: 2536782 - RNA, 13 nt, Chlamydophila pneumoniae CWL029
guauucuguaaga

SEQ ID NO: 2536783 - RNA, 17 nt, Chlamydophila pneumoniae CWL029
guauucuguaagaaucc

SEQ ID NO: 2536784 - RNA, 17 nt, Chlamydophila pneumoniae CWL029
guauugcaaauuucauu

SEQ ID NO: 2536785 - RNA, 18 nt, Chlamydophila pneumoniae CWL029
guauuuaccuacagauau

SEQ ID NO: 2536786 - RNA, 13 nt, Chlamydophila pneumoniae CWL029
guauuuucuucaa

SEQ ID NO: 2536787 - RNA, 15 nt, Chlamydophila pneumoniae CWL029
guauuuuuaaauaca

SEQ ID NO: 2536788 - RNA, 16 nt, Chlamydophila pneumoniae CWL029
gucaaagguuuuaaaa

SEQ ID NO: 2536789 - RNA, 21 nt, Chlamydophila pneumoniae CWL029
gucaaauucauuaagaacauc

SEQ ID NO: 2536790 - RNA, 16 nt, Chlamydophila pneumoniae CWL029
gucaauaagcuugcca

SEQ ID NO: 2536791 - RNA, 21 nt, Chlamydophila pneumoniae CWL029
gucaauaagcuugccagcaga

SEQ ID NO: 2536792 - RNA, 16 nt, Chlamydophila pneumoniae CWL029
gucacagcauuuucuc

SEQ ID NO: 2536793 - RNA, 17 nt, Chlamydophila pneumoniae CWL029
gucacagcauuuucucu

SEQ ID NO: 2536794 - RNA, 12 nt, Chlamydophila pneumoniae CWL029
gucacguucuua

SEQ ID NO: 2536795 - RNA, 14 nt, Chlamydophila pneumoniae CWL029
gucacuacccugcc

SEQ ID NO: 2536796 - RNA, 11 nt, Chlamydophila pneumoniae CWL029
gucacuucaau

SEQ ID NO: 2536797 - RNA, 18 nt, Chlamydophila pneumoniae CWL029
gucaggaacccuggauga

SEQ ID NO: 2536798 - RNA, 15 nt, Chlamydophila pneumoniae CWL029
gucaggagguggugg

SEQ ID NO: 2536799 - RNA, 19 nt, Chlamydophila pneumoniae CWL029
gucaggaggugguggagcu

SEQ ID NO: 2536800 - RNA, 23 nt, Chlamydophila pneumoniae CWL029
gucauaaagaucgugaucaaaga

SEQ ID NO: 2536801 - RNA, 17 nt, Chlamydophila pneumoniae CWL029
gucauacuacucucauc

SEQ ID NO: 2536802 - RNA, 13 nt, Chlamydophila pneumoniae CWL029
gucauauuuaaaa

SEQ ID NO: 2536803 - RNA, 16 nt, Chlamydophila pneumoniae CWL029
gucauauuuaaaaggc

SEQ ID NO: 2536804 - RNA, 22 nt, Chlamydophila pneumoniae CWL029
gucaucccacgggucaggaggu

SEQ ID NO: 2536805 - RNA, 15 nt, Chlamydophila pneumoniae CWL029
gucaugauuuuucaa

SEQ ID NO: 2536806 - RNA, 16 nt, Chlamydophila pneumoniae CWL029
gucaugauuuuucaau

SEQ ID NO: 2536807 - RNA, 17 nt, Chlamydophila pneumoniae CWL029
gucaugcauagaauaaa

SEQ ID NO: 2536808 - RNA, 19 nt, Chlamydophila pneumoniae CWL029
gucauguauccgaaaucug

SEQ ID NO: 2536809 - RNA, 16 nt, Chlamydophila pneumoniae CWL029
gucauuaccugcuaaa

SEQ ID NO: 2536810 - RNA, 21 nt, Chlamydophila pneumoniae CWL029
gucauucugcaaggcaaugau

SEQ ID NO: 2536811 - RNA, 21 nt, Chlamydophila pneumoniae CWL029
gucauugccuugcugcauacu

SEQ ID NO: 2536812 - RNA, 12 nt, Chlamydophila pneumoniae CWL029
guccaaacccug

SEQ ID NO: 2536813 - RNA, 16 nt, Chlamydophila pneumoniae CWL029
guccagccugcaccag

SEQ ID NO: 2536814 - RNA, 18 nt, Chlamydophila pneumoniae CWL029
guccauaauuucuuucac

SEQ ID NO: 2536815 - RNA, 13 nt, Chlamydophila pneumoniae CWL029
guccauucugacc

SEQ ID NO: 2536816 - RNA, 21 nt, Chlamydophila pneumoniae CWL029
guccauuucauguaagaaugu

SEQ ID NO: 2536817 - RNA, 12 nt, Chlamydophila pneumoniae CWL029
gucccaaucaag

SEQ ID NO: 2536818 - RNA, 15 nt, Chlamydophila pneumoniae CWL029
gucccaaucaagaua

SEQ ID NO: 2536819 - RNA, 15 nt, Chlamydophila pneumoniae CWL029
gucccacaaaugaua

SEQ ID NO: 2536820 - RNA, 13 nt, Chlamydophila pneumoniae CWL029
gucccuuucagua

SEQ ID NO: 2536821 - RNA, 14 nt, Chlamydophila pneumoniae CWL029
guccgaagccuuca

SEQ ID NO: 2536822 - RNA, 19 nt, Chlamydophila pneumoniae CWL029
guccuccauggaaagaaac

SEQ ID NO: 2536823 - RNA, 20 nt, Chlamydophila pneumoniae CWL029
guccuccauggaaagaaaca

SEQ ID NO: 2536824 - RNA, 15 nt, Chlamydophila pneumoniae CWL029
guccucuaugguuuu

SEQ ID NO: 2536825 - RNA, 11 nt, Chlamydophila pneumoniae CWL029
guccucucccu

SEQ ID NO: 2536826 - RNA, 22 nt, Chlamydophila pneumoniae CWL029
guccugggguucucuaauggac

SEQ ID NO: 2536827 - RNA, 15 nt, Chlamydophila pneumoniae CWL029
guccuguuaagaugu

SEQ ID NO: 2536828 - RNA, 12 nt, Chlamydophila pneumoniae CWL029
guccuucuuccc

SEQ ID NO: 2536829 - RNA, 14 nt, Chlamydophila pneumoniae CWL029
gucgaaagaucaga

SEQ ID NO: 2536830 - RNA, 14 nt, Chlamydophila pneumoniae CWL029
gucgagaaccucca

SEQ ID NO: 2536831 - RNA, 16 nt, Chlamydophila pneumoniae CWL029
gucgagaaccuccacc

SEQ ID NO: 2536832 - RNA, 15 nt, Chlamydophila pneumoniae CWL029
gucgcaucaaugacu

SEQ ID NO: 2536833 - RNA, 16 nt, Chlamydophila pneumoniae CWL029
gucggagauuguuuca

SEQ ID NO: 2536834 - RNA, 13 nt, Chlamydophila pneumoniae CWL029
gucggaguuuuuu

SEQ ID NO: 2536835 - RNA, 14 nt, Chlamydophila pneumoniae CWL029
gucggcuuuagaaa

SEQ ID NO: 2536836 - RNA, 22 nt, Chlamydophila pneumoniae CWL029
gucggcuuuagaaaagugcccu

SEQ ID NO: 2536837 - RNA, 13 nt, Chlamydophila pneumoniae CWL029
gucgucuuuuaaa

SEQ ID NO: 2536838 - RNA, 19 nt, Chlamydophila pneumoniae CWL029
gucgucuuuuaaagagcgc

SEQ ID NO: 2536839 - RNA, 13 nt, Chlamydophila pneumoniae CWL029
gucuaaagaagau

SEQ ID NO: 2536840 - RNA, 12 nt, Chlamydophila pneumoniae CWL029
gucuaaucccca

SEQ ID NO: 2536841 - RNA, 21 nt, Chlamydophila pneumoniae CWL029
gucuacagaggaaucuauccu

SEQ ID NO: 2536842 - RNA, 22 nt, Chlamydophila pneumoniae CWL029
gucuacagaggaaucuauccuu

SEQ ID NO: 2536843 - RNA, 20 nt, Chlamydophila pneumoniae CWL029
gucuagaaaagacaucucug

SEQ ID NO: 2536844 - RNA, 20 nt, Chlamydophila pneumoniae CWL029
gucuauucucuucauuuucu

SEQ ID NO: 2536845 - RNA, 14 nt, Chlamydophila pneumoniae CWL029
gucuauuugaaaag

SEQ ID NO: 2536846 - RNA, 23 nt, Chlamydophila pneumoniae CWL029
gucucacucuuuucuagaaacug

SEQ ID NO: 2536847 - RNA, 16 nt, Chlamydophila pneumoniae CWL029
gucucaugaccuucag

SEQ ID NO: 2536848 - RNA, 20 nt, Chlamydophila pneumoniae CWL029
gucuccaaauguucucucca

SEQ ID NO: 2536849 - RNA, 17 nt, Chlamydophila pneumoniae CWL029
gucuccauaauucugca

SEQ ID NO: 2536850 - RNA, 13 nt, Chlamydophila pneumoniae CWL029
gucuccuugauuu

SEQ ID NO: 2536851 - RNA, 13 nt, Chlamydophila pneumoniae CWL029
gucucugaagacc

SEQ ID NO: 2536852 - RNA, 16 nt, Chlamydophila pneumoniae CWL029
gucucuuucagcucaa

SEQ ID NO: 2536853 - RNA, 11 nt, Chlamydophila pneumoniae CWL029
gucugaacauu

SEQ ID NO: 2536854 - RNA, 19 nt, Chlamydophila pneumoniae CWL029
gucugauguaggugauauu

SEQ ID NO: 2536855 - RNA, 23 nt, Chlamydophila pneumoniae CWL029
gucugcgauaggaucuucuauuu

SEQ ID NO: 2536856 - RNA, 14 nt, Chlamydophila pneumoniae CWL029
gucugcugaggaga

SEQ ID NO: 2536857 - RNA, 13 nt, Chlamydophila pneumoniae CWL029
gucuguaaggaca

SEQ ID NO: 2536858 - RNA, 13 nt, Chlamydophila pneumoniae CWL029
gucugugagaaau

SEQ ID NO: 2536859 - RNA, 17 nt, Chlamydophila pneumoniae CWL029
gucuguuaacucagaga

SEQ ID NO: 2536860 - RNA, 15 nt, Chlamydophila pneumoniae CWL029
gucuguuuuggaaag

SEQ ID NO: 2536861 - RNA, 15 nt, Chlamydophila pneumoniae CWL029
gucuuaaaauuccug

SEQ ID NO: 2536862 - RNA, 20 nt, Chlamydophila pneumoniae CWL029
gucuuagaauccaaagacuu

SEQ ID NO: 2536863 - RNA, 16 nt, Chlamydophila pneumoniae CWL029
gucuuagaauccucua

SEQ ID NO: 2536864 - RNA, 19 nt, Chlamydophila pneumoniae CWL029
gucuuauugaagucuucuu

SEQ ID NO: 2536865 - RNA, 16 nt, Chlamydophila pneumoniae CWL029
gucuuccacgaaggaa

SEQ ID NO: 2536866 - RNA, 22 nt, Chlamydophila pneumoniae CWL029
gucuuccauaacaguuuguucu

SEQ ID NO: 2536867 - RNA, 13 nt, Chlamydophila pneumoniae CWL029
gucuuccaucucu

SEQ ID NO: 2536868 - RNA, 17 nt, Chlamydophila pneumoniae CWL029
gucuucuuagaagagaa

SEQ ID NO: 2536869 - RNA, 19 nt, Chlamydophila pneumoniae CWL029
gucuugacguugcgaacag

SEQ ID NO: 2536870 - RNA, 15 nt, Chlamydophila pneumoniae CWL029
gucuugaguucuuuu

SEQ ID NO: 2536871 - RNA, 21 nt, Chlamydophila pneumoniae CWL029
gucuuuaauuaaaaguucagc

SEQ ID NO: 2536872 - RNA, 23 nt, Chlamydophila pneumoniae CWL029
gucuuuucuaagcaauauuucug

SEQ ID NO: 2536873 - RNA, 19 nt, Chlamydophila pneumoniae CWL029
gugaaaguacaggaguucc

SEQ ID NO: 2536874 - RNA, 13 nt, Chlamydophila pneumoniae CWL029
gugaaaucugcuc

SEQ ID NO: 2536875 - RNA, 19 nt, Chlamydophila pneumoniae CWL029
gugaagauaagaccagaaa

SEQ ID NO: 2536876 - RNA, 19 nt, Chlamydophila pneumoniae CWL029
gugaagccauuuucuaaga

SEQ ID NO: 2536877 - RNA, 19 nt, Chlamydophila pneumoniae CWL029
gugaagcugcuucuucaga

SEQ ID NO: 2536878 - RNA, 20 nt, Chlamydophila pneumoniae CWL029
gugaauaucaucacuaagau

SEQ ID NO: 2536879 - RNA, 18 nt, Chlamydophila pneumoniae CWL029
gugacgacaaaucacgac

SEQ ID NO: 2536880 - RNA, 14 nt, Chlamydophila pneumoniae CWL029
gugacuuuucuucu

SEQ ID NO: 2536881 - RNA, 14 nt, Chlamydophila pneumoniae CWL029
gugaguucuuccuu

SEQ ID NO: 2536882 - RNA, 14 nt, Chlamydophila pneumoniae CWL029
gugauacuuuagaa

SEQ ID NO: 2536883 - RNA, 16 nt, Chlamydophila pneumoniae CWL029
gugauauccaccuuac

SEQ ID NO: 2536884 - RNA, 12 nt, Chlamydophila pneumoniae CWL029
gugauugcugcu

SEQ ID NO: 2536885 - RNA, 23 nt, Chlamydophila pneumoniae CWL029
gugauugcugucagaacaagaag

SEQ ID NO: 2536886 - RNA, 19 nt, Chlamydophila pneumoniae CWL029
gugauuuagaaaucucacu

SEQ ID NO: 2536887 - RNA, 20 nt, Chlamydophila pneumoniae CWL029
gugauuucuuuauucccuuu

SEQ ID NO: 2536888 - RNA, 17 nt, Chlamydophila pneumoniae CWL029
gugcaaguucacacgua

SEQ ID NO: 2536889 - RNA, 17 nt, Chlamydophila pneumoniae CWL029
gugcaggagaacaauau

SEQ ID NO: 2536890 - RNA, 14 nt, Chlamydophila pneumoniae CWL029
gugcaucauuuuca

SEQ ID NO: 2536891 - RNA, 16 nt, Chlamydophila pneumoniae CWL029
gugcauuaucuaagaa

SEQ ID NO: 2536892 - RNA, 19 nt, Chlamydophila pneumoniae CWL029
gugcauuaucuaagaauau

SEQ ID NO: 2536893 - RNA, 14 nt, Chlamydophila pneumoniae CWL029
gugcauuuucuucu

SEQ ID NO: 2536894 - RNA, 19 nt, Chlamydophila pneumoniae CWL029
gugccacccuuggcagagc

SEQ ID NO: 2536895 - RNA, 19 nt, Chlamydophila pneumoniae CWL029
gugccugguaaaggauauu

SEQ ID NO: 2536896 - RNA, 13 nt, Chlamydophila pneumoniae CWL029
gugccuguaauug

SEQ ID NO: 2536897 - RNA, 18 nt, Chlamydophila pneumoniae CWL029
gugcgaaagcccaugaga

SEQ ID NO: 2536898 - RNA, 15 nt, Chlamydophila pneumoniae CWL029
gugcggcucucuuca

SEQ ID NO: 2536899 - RNA, 16 nt, Chlamydophila pneumoniae CWL029
gugcuaggcucucgac

SEQ ID NO: 2536900 - RNA, 20 nt, Chlamydophila pneumoniae CWL029
gugcuaggcucucgacacua

SEQ ID NO: 2536901 - RNA, 12 nt, Chlamydophila pneumoniae CWL029
gugcucucuaaa

SEQ ID NO: 2536902 - RNA, 15 nt, Chlamydophila pneumoniae CWL029
gugcucucuucuucu

SEQ ID NO: 2536903 - RNA, 13 nt, Chlamydophila pneumoniae CWL029
gugcucuguauug

SEQ ID NO: 2536904 - RNA, 21 nt, Chlamydophila pneumoniae CWL029
guggaaauugugaaaaaaaac

SEQ ID NO: 2536905 - RNA, 16 nt, Chlamydophila pneumoniae CWL029
guggacggggagagcc

SEQ ID NO: 2536906 - RNA, 20 nt, Chlamydophila pneumoniae CWL029
guggagcuugucuaggagcu

SEQ ID NO: 2536907 - RNA, 13 nt, Chlamydophila pneumoniae CWL029
guggagguuagua

SEQ ID NO: 2536908 - RNA, 15 nt, Chlamydophila pneumoniae CWL029
guggaguaucuagcu

SEQ ID NO: 2536909 - RNA, 22 nt, Chlamydophila pneumoniae CWL029
guggaucagaaaaaaugcguuu

SEQ ID NO: 2536910 - RNA, 20 nt, Chlamydophila pneumoniae CWL029
gugggaauguuguuuuugau

SEQ ID NO: 2536911 - RNA, 13 nt, Chlamydophila pneumoniae CWL029
guggucggcagaa

SEQ ID NO: 2536912 - RNA, 12 nt, Chlamydophila pneumoniae CWL029
guggucuagaga

SEQ ID NO: 2536913 - RNA, 22 nt, Chlamydophila pneumoniae CWL029
gugguuagagcagcagaaucau

SEQ ID NO: 2536914 - RNA, 16 nt, Chlamydophila pneumoniae CWL029
gugguuggauccaucg

SEQ ID NO: 2536915 - RNA, 23 nt, Chlamydophila pneumoniae CWL029
guguaucucuuaaaauauuaaau

SEQ ID NO: 2536916 - RNA, 16 nt, Chlamydophila pneumoniae CWL029
gugucauacgcagcac

SEQ ID NO: 2536917 - RNA, 13 nt, Chlamydophila pneumoniae CWL029
gugucuugcugau

SEQ ID NO: 2536918 - RNA, 16 nt, Chlamydophila pneumoniae CWL029
guguggguacaggggg

SEQ ID NO: 2536919 - RNA, 18 nt, Chlamydophila pneumoniae CWL029
gugugguaaaaauauagg

SEQ ID NO: 2536920 - RNA, 13 nt, Chlamydophila pneumoniae CWL029
guguugaauaaga

SEQ ID NO: 2536921 - RNA, 13 nt, Chlamydophila pneumoniae CWL029
guguuuccuuuuc

SEQ ID NO: 2536922 - RNA, 21 nt, Chlamydophila pneumoniae CWL029
guguuuccuuuucuccuucug

SEQ ID NO: 2536923 - RNA, 20 nt, Chlamydophila pneumoniae CWL029
guuaacaagauucucagcuu

SEQ ID NO: 2536924 - RNA, 19 nt, Chlamydophila pneumoniae CWL029
guuaacaaguaccaagaaa

SEQ ID NO: 2536925 - RNA, 21 nt, Chlamydophila pneumoniae CWL029
guuaacaaguaccaagaaaau

SEQ ID NO: 2536926 - RNA, 20 nt, Chlamydophila pneumoniae CWL029
guuaacgaauugcuuucccc

SEQ ID NO: 2536927 - RNA, 15 nt, Chlamydophila pneumoniae CWL029
guuaagcaauaucug

SEQ ID NO: 2536928 - RNA, 15 nt, Chlamydophila pneumoniae CWL029
guuaagcaccauaau

SEQ ID NO: 2536929 - RNA, 11 nt, Chlamydophila pneumoniae CWL029
guuaauaagaa

SEQ ID NO: 2536930 - RNA, 15 nt, Chlamydophila pneumoniae CWL029
guuaaucuaauuuua

SEQ ID NO: 2536931 - RNA, 17 nt, Chlamydophila pneumoniae CWL029
guuacaagcaauacuaa

SEQ ID NO: 2536932 - RNA, 17 nt, Chlamydophila pneumoniae CWL029
guuacagcguugcuaag

SEQ ID NO: 2536933 - RNA, 21 nt, Chlamydophila pneumoniae CWL029
guuacagcguugcuaagcaua

SEQ ID NO: 2536934 - RNA, 15 nt, Chlamydophila pneumoniae CWL029
guuaccaaaaacugg

SEQ ID NO: 2536935 - RNA, 23 nt, Chlamydophila pneumoniae CWL029
guuacgcucguagguaugagcuc

SEQ ID NO: 2536936 - RNA, 21 nt, Chlamydophila pneumoniae CWL029
guuacggaacucauuaagaag

SEQ ID NO: 2536937 - RNA, 16 nt, Chlamydophila pneumoniae CWL029
guuacgugagaacuca

SEQ ID NO: 2536938 - RNA, 15 nt, Chlamydophila pneumoniae CWL029
guuaggauauggugu

SEQ ID NO: 2536939 - RNA, 15 nt, Chlamydophila pneumoniae CWL029
guuauaaggauauca

SEQ ID NO: 2536940 - RNA, 15 nt, Chlamydophila pneumoniae CWL029
guuauauagacaaug

SEQ ID NO: 2536941 - RNA, 14 nt, Chlamydophila pneumoniae CWL029
guuauauuuuucug

SEQ ID NO: 2536942 - RNA, 19 nt, Chlamydophila pneumoniae CWL029
guuaugaagcuucuuuaau

SEQ ID NO: 2536943 - RNA, 21 nt, Chlamydophila pneumoniae CWL029
guuauuaaggaucccaucauc

SEQ ID NO: 2536944 - RNA, 19 nt, Chlamydophila pneumoniae CWL029
guuauuaauaaauuuaucu

SEQ ID NO: 2536945 - RNA, 15 nt, Chlamydophila pneumoniae CWL029
guuauuaucaaagug

SEQ ID NO: 2536946 - RNA, 13 nt, Chlamydophila pneumoniae CWL029
guuauugaguguu

SEQ ID NO: 2536947 - RNA, 23 nt, Chlamydophila pneumoniae CWL029
guucaccagaagcauugaggaca

SEQ ID NO: 2536948 - RNA, 15 nt, Chlamydophila pneumoniae CWL029
guucacuucaucgac

SEQ ID NO: 2536949 - RNA, 19 nt, Chlamydophila pneumoniae CWL029
guucacuucaucgacagua

SEQ ID NO: 2536950 - RNA, 13 nt, Chlamydophila pneumoniae CWL029
guucagcuagagc

SEQ ID NO: 2536951 - RNA, 14 nt, Chlamydophila pneumoniae CWL029
guucauaauccaag

SEQ ID NO: 2536952 - RNA, 16 nt, Chlamydophila pneumoniae CWL029
guucauaauccaagau

SEQ ID NO: 2536953 - RNA, 20 nt, Chlamydophila pneumoniae CWL029
guucauaauccaagauacca

SEQ ID NO: 2536954 - RNA, 15 nt, Chlamydophila pneumoniae CWL029
guuccaaaucucaau

SEQ ID NO: 2536955 - RNA, 23 nt, Chlamydophila pneumoniae CWL029
guuccacagagaccuucucuuca

SEQ ID NO: 2536956 - RNA, 15 nt, Chlamydophila pneumoniae CWL029
guuccacuugcucuu

SEQ ID NO: 2536957 - RNA, 15 nt, Chlamydophila pneumoniae CWL029
guuccauaucaaaga

SEQ ID NO: 2536958 - RNA, 13 nt, Chlamydophila pneumoniae CWL029
guuccauuuucag

SEQ ID NO: 2536959 - RNA, 17 nt, Chlamydophila pneumoniae CWL029
guucccuggaugaacuc

SEQ ID NO: 2536960 - RNA, 18 nt, Chlamydophila pneumoniae CWL029
guucccuggaugaacucc

SEQ ID NO: 2536961 - RNA, 21 nt, Chlamydophila pneumoniae CWL029
guuccgaauaggcauuacaca

SEQ ID NO: 2536962 - RNA, 20 nt, Chlamydophila pneumoniae CWL029
guuccugaaaagcauucugc

SEQ ID NO: 2536963 - RNA, 20 nt, Chlamydophila pneumoniae CWL029
guuccuguaguuugcagaga

SEQ ID NO: 2536964 - RNA, 13 nt, Chlamydophila pneumoniae CWL029
guucuaagaaauc

SEQ ID NO: 2536965 - RNA, 17 nt, Chlamydophila pneumoniae CWL029
guucuagcaaaucuaaa

SEQ ID NO: 2536966 - RNA, 21 nt, Chlamydophila pneumoniae CWL029
guucuaugccauaaauacagg

SEQ ID NO: 2536967 - RNA, 19 nt, Chlamydophila pneumoniae CWL029
guucucaaagaucaucuac

SEQ ID NO: 2536968 - RNA, 15 nt, Chlamydophila pneumoniae CWL029
guucucaauaauaga

SEQ ID NO: 2536969 - RNA, 18 nt, Chlamydophila pneumoniae CWL029
guucuccacaugcccaaa

SEQ ID NO: 2536970 - RNA, 17 nt, Chlamydophila pneumoniae CWL029
guucucccgugaacaaa

SEQ ID NO: 2536971 - RNA, 19 nt, Chlamydophila pneumoniae CWL029
guucucccgugaacaaaaa

SEQ ID NO: 2536972 - RNA, 20 nt, Chlamydophila pneumoniae CWL029
guucucccgugaacaaaaac

SEQ ID NO: 2536973 - RNA, 22 nt, Chlamydophila pneumoniae CWL029
guucuuaucgggggugccaaaa

SEQ ID NO: 2536974 - RNA, 12 nt, Chlamydophila pneumoniae CWL029
guucuucauucc

SEQ ID NO: 2536975 - RNA, 18 nt, Chlamydophila pneumoniae CWL029
guucuucuuuacucaagu

SEQ ID NO: 2536976 - RNA, 16 nt, Chlamydophila pneumoniae CWL029
guucuugaaguucuuc

SEQ ID NO: 2536977 - RNA, 14 nt, Chlamydophila pneumoniae CWL029
guucuuguaauaaa

SEQ ID NO: 2536978 - RNA, 15 nt, Chlamydophila pneumoniae CWL029
guucuuucaauaaca

SEQ ID NO: 2536979 - RNA, 17 nt, Chlamydophila pneumoniae CWL029
guucuuucaauaacaga

SEQ ID NO: 2536980 - RNA, 21 nt, Chlamydophila pneumoniae CWL029
guucuuucuagaaugaugcaa

SEQ ID NO: 2536981 - RNA, 10 nt, Chlamydophila pneumoniae CWL029
guucuuucug

SEQ ID NO: 2536982 - RNA, 17 nt, Chlamydophila pneumoniae CWL029
guucuuugaauuuccaa

SEQ ID NO: 2536983 - RNA, 17 nt, Chlamydophila pneumoniae CWL029
guucuuuuguuugucuu

SEQ ID NO: 2536984 - RNA, 12 nt, Chlamydophila pneumoniae CWL029
guucuuuuugca

SEQ ID NO: 2536985 - RNA, 19 nt, Chlamydophila pneumoniae CWL029
guugagaaccuucacaaga

SEQ ID NO: 2536986 - RNA, 17 nt, Chlamydophila pneumoniae CWL029
guugaggaauuggcagg

SEQ ID NO: 2536987 - RNA, 21 nt, Chlamydophila pneumoniae CWL029
guugauuucgugaacaaaauc

SEQ ID NO: 2536988 - RNA, 19 nt, Chlamydophila pneumoniae CWL029
guugcaacucucuuuaaac

SEQ ID NO: 2536989 - RNA, 14 nt, Chlamydophila pneumoniae CWL029
guugcaauucuuca

SEQ ID NO: 2536990 - RNA, 13 nt, Chlamydophila pneumoniae CWL029
guugcacuuuccg

SEQ ID NO: 2536991 - RNA, 23 nt, Chlamydophila pneumoniae CWL029
guugcaucgccuuaagcucuaag

SEQ ID NO: 2536992 - RNA, 22 nt, Chlamydophila pneumoniae CWL029
guugcaugcuugaaguucucaa

SEQ ID NO: 2536993 - RNA, 21 nt, Chlamydophila pneumoniae CWL029
guugcauuacgguuucuggga

SEQ ID NO: 2536994 - RNA, 15 nt, Chlamydophila pneumoniae CWL029
guugccaaucuuuca

SEQ ID NO: 2536995 - RNA, 19 nt, Chlamydophila pneumoniae CWL029
guugcgcaguggacgggga

SEQ ID NO: 2536996 - RNA, 22 nt, Chlamydophila pneumoniae CWL029
guugcuaagaucuuuagaauaa

SEQ ID NO: 2536997 - RNA, 17 nt, Chlamydophila pneumoniae CWL029
guugcuaagcgaaccaa

SEQ ID NO: 2536998 - RNA, 19 nt, Chlamydophila pneumoniae CWL029
guugcuucuaagaaacuuc

SEQ ID NO: 2536999 - RNA, 20 nt, Chlamydophila pneumoniae CWL029
guuggauccaucggcauuuc

SEQ ID NO: 2537000 - RNA, 16 nt, Chlamydophila pneumoniae CWL029
guugggcucauaaccc

SEQ ID NO: 2537001 - RNA, 21 nt, Chlamydophila pneumoniae CWL029
guuguagugaaugagcuucac

SEQ ID NO: 2537002 - RNA, 14 nt, Chlamydophila pneumoniae CWL029
guuguauccagcuc

SEQ ID NO: 2537003 - RNA, 16 nt, Chlamydophila pneumoniae CWL029
guuguauccagcucaa

SEQ ID NO: 2537004 - RNA, 15 nt, Chlamydophila pneumoniae CWL029
guuguccuuuauaau

SEQ ID NO: 2537005 - RNA, 18 nt, Chlamydophila pneumoniae CWL029
guuguugauaauuacaga

SEQ ID NO: 2537006 - RNA, 15 nt, Chlamydophila pneumoniae CWL029
guuguuggagcagaa

SEQ ID NO: 2537007 - RNA, 15 nt, Chlamydophila pneumoniae CWL029
guuguuuuugcugaa

SEQ ID NO: 2537008 - RNA, 22 nt, Chlamydophila pneumoniae CWL029
guuuacagaugcaugauccuau

SEQ ID NO: 2537009 - RNA, 17 nt, Chlamydophila pneumoniae CWL029
guuuaccugaaaaaaca

SEQ ID NO: 2537010 - RNA, 12 nt, Chlamydophila pneumoniae CWL029
guuuagaaaaag

SEQ ID NO: 2537011 - RNA, 16 nt, Chlamydophila pneumoniae CWL029
guuuagaaaaagaucu

SEQ ID NO: 2537012 - RNA, 21 nt, Chlamydophila pneumoniae CWL029
guuuagaaaaagaucuaaguc

SEQ ID NO: 2537013 - RNA, 22 nt, Chlamydophila pneumoniae CWL029
guuuagcauagagcucuaaaaa

SEQ ID NO: 2537014 - RNA, 22 nt, Chlamydophila pneumoniae CWL029
guuucaaacaauaguaaagcau

SEQ ID NO: 2537015 - RNA, 16 nt, Chlamydophila pneumoniae CWL029
guuucaaauaggaucu

SEQ ID NO: 2537016 - RNA, 21 nt, Chlamydophila pneumoniae CWL029
guuucaaauaggaucucucuu

SEQ ID NO: 2537017 - RNA, 14 nt, Chlamydophila pneumoniae CWL029
guuucaacauaaca

SEQ ID NO: 2537018 - RNA, 12 nt, Chlamydophila pneumoniae CWL029
guuucaaucucu

SEQ ID NO: 2537019 - RNA, 14 nt, Chlamydophila pneumoniae CWL029
guuucaaucucucc

SEQ ID NO: 2537020 - RNA, 15 nt, Chlamydophila pneumoniae CWL029
guuucaaucucuccu

SEQ ID NO: 2537021 - RNA, 17 nt, Chlamydophila pneumoniae CWL029
guuucaaucucuccuug

SEQ ID NO: 2537022 - RNA, 23 nt, Chlamydophila pneumoniae CWL029
guuucacaggcuacauaguuuuu

SEQ ID NO: 2537023 - RNA, 15 nt, Chlamydophila pneumoniae CWL029
guuucaggucagcaa

SEQ ID NO: 2537024 - RNA, 23 nt, Chlamydophila pneumoniae CWL029
guuucauuuaaagaguccgaagc

SEQ ID NO: 2537025 - RNA, 19 nt, Chlamydophila pneumoniae CWL029
guuuccaagacaacaccuc

SEQ ID NO: 2537026 - RNA, 21 nt, Chlamydophila pneumoniae CWL029
guuuccaagacaacaccuccc

SEQ ID NO: 2537027 - RNA, 22 nt, Chlamydophila pneumoniae CWL029
guuuccaagacaacaccuccca

SEQ ID NO: 2537028 - RNA, 22 nt, Chlamydophila pneumoniae CWL029
guuucccaccauauucucagga

SEQ ID NO: 2537029 - RNA, 14 nt, Chlamydophila pneumoniae CWL029
guuucccccauaaa

SEQ ID NO: 2537030 - RNA, 19 nt, Chlamydophila pneumoniae CWL029
guuuccgaucauuuuugcu

SEQ ID NO: 2537031 - RNA, 17 nt, Chlamydophila pneumoniae CWL029
guuuccuuuucuccuuc

SEQ ID NO: 2537032 - RNA, 17 nt, Chlamydophila pneumoniae CWL029
guuucgauaucacggcu

SEQ ID NO: 2537033 - RNA, 16 nt, Chlamydophila pneumoniae CWL029
guuucguaagagaauu

SEQ ID NO: 2537034 - RNA, 14 nt, Chlamydophila pneumoniae CWL029
guuucuaaaacaga

SEQ ID NO: 2537035 - RNA, 13 nt, Chlamydophila pneumoniae CWL029
guuucuaaauacu

SEQ ID NO: 2537036 - RNA, 21 nt, Chlamydophila pneumoniae CWL029
guuucuucugugcaucaguca

SEQ ID NO: 2537037 - RNA, 21 nt, Chlamydophila pneumoniae CWL029
guuucuuuugauugaaacuuu

SEQ ID NO: 2537038 - RNA, 22 nt, Chlamydophila pneumoniae CWL029
guuucuuuugauugaaacuuuu

SEQ ID NO: 2537039 - RNA, 15 nt, Chlamydophila pneumoniae CWL029
guuugagaaagacca

SEQ ID NO: 2537040 - RNA, 23 nt, Chlamydophila pneumoniae CWL029
guuuguaguaaggagagacugug

SEQ ID NO: 2537041 - RNA, 18 nt, Chlamydophila pneumoniae CWL029
guuuguaguguugaauaa

SEQ ID NO: 2537042 - RNA, 15 nt, Chlamydophila pneumoniae CWL029
guuugugggcauuua

SEQ ID NO: 2537043 - RNA, 16 nt, Chlamydophila pneumoniae CWL029
guuuguucuaaagcug

SEQ ID NO: 2537044 - RNA, 14 nt, Chlamydophila pneumoniae CWL029
guuuguuuucuauc

SEQ ID NO: 2537045 - RNA, 21 nt, Chlamydophila pneumoniae CWL029
guuuuaauagcuaaagugaug

SEQ ID NO: 2537046 - RNA, 22 nt, Chlamydophila pneumoniae CWL029
guuuuccccuuggaaaucagaa

SEQ ID NO: 2537047 - RNA, 17 nt, Chlamydophila pneumoniae CWL029
guuuucguaagagaauu

SEQ ID NO: 2537048 - RNA, 22 nt, Chlamydophila pneumoniae CWL029
guuuucuagaaaagauucuaaa

SEQ ID NO: 2537049 - RNA, 15 nt, Chlamydophila pneumoniae CWL029
guuuucuaugauccg

SEQ ID NO: 2537050 - RNA, 17 nt, Chlamydophila pneumoniae CWL029
guuuucucgaagaaaau

SEQ ID NO: 2537051 - RNA, 21 nt, Chlamydophila pneumoniae CWL029
guuuucuguugcacuuuccgu

SEQ ID NO: 2537052 - RNA, 23 nt, Chlamydophila pneumoniae CWL029
guuuucuucuuuaagauuuccuu

SEQ ID NO: 2537053 - RNA, 20 nt, Chlamydophila pneumoniae CWL029
guuuucuuuucugaagauuu

SEQ ID NO: 2537054 - RNA, 15 nt, Chlamydophila pneumoniae CWL029
guuuugaaaucaaaa

SEQ ID NO: 2537055 - RNA, 15 nt, Chlamydophila pneumoniae CWL029
guuuugcucucuaga

SEQ ID NO: 2537056 - RNA, 18 nt, Chlamydophila pneumoniae CWL029
guuuugcuguggaauuuu

SEQ ID NO: 2537057 - RNA, 19 nt, Chlamydophila pneumoniae CWL029
guuuuguggcuuuucuaaa

SEQ ID NO: 2537058 - RNA, 15 nt, Chlamydophila pneumoniae CWL029
guuuuguuucaucuu

SEQ ID NO: 2537059 - RNA, 16 nt, Chlamydophila pneumoniae CWL029
guuuuguuucaucuuc

SEQ ID NO: 2537060 - RNA, 15 nt, Chlamydophila pneumoniae CWL029
guuuuuaucccagau

SEQ ID NO: 2537061 - RNA, 19 nt, Chlamydophila pneumoniae CWL029
guuuuucaauuuggauuua

SEQ ID NO: 2537062 - RNA, 15 nt, Chlamydophila pneumoniae CWL029
guuuuucaguuguuu

SEQ ID NO: 2537063 - RNA, 20 nt, Chlamydophila pneumoniae CWL029
guuuuucgaaucguuuuugg

SEQ ID NO: 2537064 - RNA, 18 nt, Chlamydophila pneumoniae CWL029
guuuuucuccucuuucuu

SEQ ID NO: 2537065 - RNA, 12 nt, Chlamydophila pneumoniae CWL029
guuuuucuucca

SEQ ID NO: 2537066 - RNA, 17 nt, Chlamydophila pneumoniae CWL029
guuuuuugaaaacuuca

SEQ ID NO: 2537067 - RNA, 20 nt, Chlamydophila pneumoniae CWL029
guuuuuugaaaacuucaaaa

SEQ ID NO: 2537068 - RNA, 19 nt, Chlamydophila pneumoniae CWL029
uaaaaaaacccucaaagaa

SEQ ID NO: 2537069 - RNA, 13 nt, Chlamydophila pneumoniae CWL029
uaaaaaaguccua

SEQ ID NO: 2537070 - RNA, 16 nt, Chlamydophila pneumoniae CWL029
uaaaaaauuaucucca

SEQ ID NO: 2537071 - RNA, 23 nt, Chlamydophila pneumoniae CWL029
uaaaaaauuaucuccaaagauca

SEQ ID NO: 2537072 - RNA, 18 nt, Chlamydophila pneumoniae CWL029
uaaaaacccuaguucauu

SEQ ID NO: 2537073 - RNA, 22 nt, Chlamydophila pneumoniae CWL029
uaaaaacccuaguucauuagcu

SEQ ID NO: 2537074 - RNA, 16 nt, Chlamydophila pneumoniae CWL029
uaaaaacuauccuauu

SEQ ID NO: 2537075 - RNA, 15 nt, Chlamydophila pneumoniae CWL029
uaaaaacuucccauc

SEQ ID NO: 2537076 - RNA, 12 nt, Chlamydophila pneumoniae CWL029
uaaaaagaaaag

SEQ ID NO: 2537077 - RNA, 18 nt, Chlamydophila pneumoniae CWL029
uaaaaauagaaauaagca

SEQ ID NO: 2537078 - RNA, 20 nt, Chlamydophila pneumoniae CWL029
uaaaaauagaaauaagcauc

SEQ ID NO: 2537079 - RNA, 14 nt, Chlamydophila pneumoniae CWL029
uaaaaauauaucuu

SEQ ID NO: 2537080 - RNA, 22 nt, Chlamydophila pneumoniae CWL029
uaaaaauggcacuugagcacau

SEQ ID NO: 2537081 - RNA, 19 nt, Chlamydophila pneumoniae CWL029
uaaaaauuaaagugaaagc

SEQ ID NO: 2537082 - RNA, 13 nt, Chlamydophila pneumoniae CWL029
uaaaaauuuaaaa

SEQ ID NO: 2537083 - RNA, 19 nt, Chlamydophila pneumoniae CWL029
uaaaaauuucaugaggagc

SEQ ID NO: 2537084 - RNA, 21 nt, Chlamydophila pneumoniae CWL029
uaaaacaagaagaucaaagau

SEQ ID NO: 2537085 - RNA, 20 nt, Chlamydophila pneumoniae CWL029
uaaaacacaaauagcaagag

SEQ ID NO: 2537086 - RNA, 20 nt, Chlamydophila pneumoniae CWL029
uaaaacaucagcaacauaaa

SEQ ID NO: 2537087 - RNA, 20 nt, Chlamydophila pneumoniae CWL029
uaaaaccagcauaaucagua

SEQ ID NO: 2537088 - RNA, 13 nt, Chlamydophila pneumoniae CWL029
uaaaaccuagacu

SEQ ID NO: 2537089 - RNA, 20 nt, Chlamydophila pneumoniae CWL029
uaaaacgagcaggguaauuu

SEQ ID NO: 2537090 - RNA, 17 nt, Chlamydophila pneumoniae CWL029
uaaaacuacaggaaaac

SEQ ID NO: 2537091 - RNA, 13 nt, Chlamydophila pneumoniae CWL029
uaaaacuccacgc

SEQ ID NO: 2537092 - RNA, 17 nt, Chlamydophila pneumoniae CWL029
uaaaacuccacgccaaa

SEQ ID NO: 2537093 - RNA, 21 nt, Chlamydophila pneumoniae CWL029
uaaaacuccacgccaaaguac

SEQ ID NO: 2537094 - RNA, 20 nt, Chlamydophila pneumoniae CWL029
uaaaacugcgcuaucaucau

SEQ ID NO: 2537095 - RNA, 23 nt, Chlamydophila pneumoniae CWL029
uaaaacuucaguuguugcuuucu

SEQ ID NO: 2537096 - RNA, 12 nt, Chlamydophila pneumoniae CWL029
uaaaagaaagaa

SEQ ID NO: 2537097 - RNA, 21 nt, Chlamydophila pneumoniae CWL029
uaaaagaacauuaagaggaaa

SEQ ID NO: 2537098 - RNA, 22 nt, Chlamydophila pneumoniae CWL029
uaaaagaacgauaaaauugaaa

SEQ ID NO: 2537099 - RNA, 14 nt, Chlamydophila pneumoniae CWL029
uaaaagaauaauag

SEQ ID NO: 2537100 - RNA, 13 nt, Chlamydophila pneumoniae CWL029
uaaaagacugaaa

SEQ ID NO: 2537101 - RNA, 14 nt, Chlamydophila pneumoniae CWL029
uaaaagaggaagau

SEQ ID NO: 2537102 - RNA, 22 nt, Chlamydophila pneumoniae CWL029
uaaaagcauuuuugggaaaaga

SEQ ID NO: 2537103 - RNA, 23 nt, Chlamydophila pneumoniae CWL029
uaaaagcauuuuugggaaaagaa

SEQ ID NO: 2537104 - RNA, 19 nt, Chlamydophila pneumoniae CWL029
uaaaagguauuucucucca

SEQ ID NO: 2537105 - RNA, 16 nt, Chlamydophila pneumoniae CWL029
uaaaaguacgaccaac

SEQ ID NO: 2537106 - RNA, 15 nt, Chlamydophila pneumoniae CWL029
uaaaaguucagcaaa

SEQ ID NO: 2537107 - RNA, 16 nt, Chlamydophila pneumoniae CWL029
uaaaaguuuuuuauuu

SEQ ID NO: 2537108 - RNA, 21 nt, Chlamydophila pneumoniae CWL029
uaaaauaaccccuccaaaauc

SEQ ID NO: 2537109 - RNA, 12 nt, Chlamydophila pneumoniae CWL029
uaaaauaagaaa

SEQ ID NO: 2537110 - RNA, 14 nt, Chlamydophila pneumoniae CWL029
uaaaauaagaaauc

SEQ ID NO: 2537111 - RNA, 16 nt, Chlamydophila pneumoniae CWL029
uaaaauaauuuuauua

SEQ ID NO: 2537112 - RNA, 18 nt, Chlamydophila pneumoniae CWL029
uaaaauaucggauuuuac

SEQ ID NO: 2537113 - RNA, 23 nt, Chlamydophila pneumoniae CWL029
uaaaauaugcucgugcgacugcu

SEQ ID NO: 2537114 - RNA, 14 nt, Chlamydophila pneumoniae CWL029
uaaaaucaacaagu

SEQ ID NO: 2537115 - RNA, 18 nt, Chlamydophila pneumoniae CWL029
uaaaaucaagccacagag

SEQ ID NO: 2537116 - RNA, 18 nt, Chlamydophila pneumoniae CWL029
uaaaaucuccucucucaa

SEQ ID NO: 2537117 - RNA, 13 nt, Chlamydophila pneumoniae CWL029
uaaaaucuucauc

SEQ ID NO: 2537118 - RNA, 21 nt, Chlamydophila pneumoniae CWL029
uaaaaugcgcacggauucuaa

SEQ ID NO: 2537119 - RNA, 20 nt, Chlamydophila pneumoniae CWL029
uaaaaugcgguaauagguuu

SEQ ID NO: 2537120 - RNA, 18 nt, Chlamydophila pneumoniae CWL029
uaaaauucaaaucccuga

SEQ ID NO: 2537121 - RNA, 12 nt, Chlamydophila pneumoniae CWL029
uaaaauugaaau

SEQ ID NO: 2537122 - RNA, 22 nt, Chlamydophila pneumoniae CWL029
uaaaauuguuuguaucaaagaa

SEQ ID NO: 2537123 - RNA, 15 nt, Chlamydophila pneumoniae CWL029
uaaaauuuaaaaaaa

SEQ ID NO: 2537124 - RNA, 18 nt, Chlamydophila pneumoniae CWL029
uaaaauuuaaaaaaaucu

SEQ ID NO: 2537125 - RNA, 12 nt, Chlamydophila pneumoniae CWL029
uaaaauuucuag

SEQ ID NO: 2537126 - RNA, 14 nt, Chlamydophila pneumoniae CWL029
uaaaauuucuagga

SEQ ID NO: 2537127 - RNA, 15 nt, Chlamydophila pneumoniae CWL029
uaaaauuucuguagu

SEQ ID NO: 2537128 - RNA, 13 nt, Chlamydophila pneumoniae CWL029
uaaacaauaagag

SEQ ID NO: 2537129 - RNA, 14 nt, Chlamydophila pneumoniae CWL029
uaaacaauuucaau

SEQ ID NO: 2537130 - RNA, 16 nt, Chlamydophila pneumoniae CWL029
uaaacagaucuuuauc

SEQ ID NO: 2537131 - RNA, 19 nt, Chlamydophila pneumoniae CWL029
uaaacagaucuuuaucauu

SEQ ID NO: 2537132 - RNA, 15 nt, Chlamydophila pneumoniae CWL029
uaaacagcaaaguaa

SEQ ID NO: 2537133 - RNA, 12 nt, Chlamydophila pneumoniae CWL029
uaaacagcacag

SEQ ID NO: 2537134 - RNA, 22 nt, Chlamydophila pneumoniae CWL029
uaaacagcaguguuauuuggac

SEQ ID NO: 2537135 - RNA, 23 nt, Chlamydophila pneumoniae CWL029
uaaacagcgguugccuuucucuu

SEQ ID NO: 2537136 - RNA, 20 nt, Chlamydophila pneumoniae CWL029
uaaacauacaugcuaaucca

SEQ ID NO: 2537137 - RNA, 17 nt, Chlamydophila pneumoniae CWL029
uaaaccaucacuuccug

SEQ ID NO: 2537138 - RNA, 17 nt, Chlamydophila pneumoniae CWL029
uaaacccucagaacacg

SEQ ID NO: 2537139 - RNA, 22 nt, Chlamydophila pneumoniae CWL029
uaaacccuguccaacuaaaaca

SEQ ID NO: 2537140 - RNA, 16 nt, Chlamydophila pneumoniae CWL029
uaaacccuucaagcaa

SEQ ID NO: 2537141 - RNA, 23 nt, Chlamydophila pneumoniae CWL029
uaaaccuaccucugggaagacuc

SEQ ID NO: 2537142 - RNA, 16 nt, Chlamydophila pneumoniae CWL029
uaaacggacgcuagag

SEQ ID NO: 2537143 - RNA, 17 nt, Chlamydophila pneumoniae CWL029
uaaacggacgcuagaga

SEQ ID NO: 2537144 - RNA, 20 nt, Chlamydophila pneumoniae CWL029
uaaacuaaaaugguaaaccu

SEQ ID NO: 2537145 - RNA, 21 nt, Chlamydophila pneumoniae CWL029
uaaacuccauuguuguugcau

SEQ ID NO: 2537146 - RNA, 21 nt, Chlamydophila pneumoniae CWL029
uaaacucccuaaggagaaucc

SEQ ID NO: 2537147 - RNA, 12 nt, Chlamydophila pneumoniae CWL029
uaaacucuccaa

SEQ ID NO: 2537148 - RNA, 23 nt, Chlamydophila pneumoniae CWL029
uaaacucucuuccuucuccugua

SEQ ID NO: 2537149 - RNA, 17 nt, Chlamydophila pneumoniae CWL029
uaaacucuuguugucua

SEQ ID NO: 2537150 - RNA, 19 nt, Chlamydophila pneumoniae CWL029
uaaacugacguuuuucccu

SEQ ID NO: 2537151 - RNA, 17 nt, Chlamydophila pneumoniae CWL029
uaaacugcuacuuuaaa

SEQ ID NO: 2537152 - RNA, 22 nt, Chlamydophila pneumoniae CWL029
uaaacugggaagaccacgaaau

SEQ ID NO: 2537153 - RNA, 15 nt, Chlamydophila pneumoniae CWL029
uaaacuuucuucucu

SEQ ID NO: 2537154 - RNA, 21 nt, Chlamydophila pneumoniae CWL029
uaaacuuuguggggauuuuca

SEQ ID NO: 2537155 - RNA, 20 nt, Chlamydophila pneumoniae CWL029
uaaacuuuuuuucaaaucau

SEQ ID NO: 2537156 - RNA, 21 nt, Chlamydophila pneumoniae CWL029
uaaagaaggagguccuuggca

SEQ ID NO: 2537157 - RNA, 16 nt, Chlamydophila pneumoniae CWL029
uaaagaagguuucuag

SEQ ID NO: 2537158 - RNA, 21 nt, Chlamydophila pneumoniae CWL029
uaaagaagguuucuagguucu

SEQ ID NO: 2537159 - RNA, 19 nt, Chlamydophila pneumoniae CWL029
uaaagaaguuuacaaauaa

SEQ ID NO: 2537160 - RNA, 14 nt, Chlamydophila pneumoniae CWL029
uaaagaaucacucu

SEQ ID NO: 2537161 - RNA, 13 nt, Chlamydophila pneumoniae CWL029
uaaagaauucucc

SEQ ID NO: 2537162 - RNA, 17 nt, Chlamydophila pneumoniae CWL029
uaaagacccuucuuucc

SEQ ID NO: 2537163 - RNA, 18 nt, Chlamydophila pneumoniae CWL029
uaaagacccuucuuucca

SEQ ID NO: 2537164 - RNA, 18 nt, Chlamydophila pneumoniae CWL029
uaaagagaaucuccucau

SEQ ID NO: 2537165 - RNA, 13 nt, Chlamydophila pneumoniae CWL029
uaaagagcauccu

SEQ ID NO: 2537166 - RNA, 15 nt, Chlamydophila pneumoniae CWL029
uaaagagcauccugu

SEQ ID NO: 2537167 - RNA, 15 nt, Chlamydophila pneumoniae CWL029
uaaagaguagcccca

SEQ ID NO: 2537168 - RNA, 21 nt, Chlamydophila pneumoniae CWL029
uaaagagucuuccuagaccua

SEQ ID NO: 2537169 - RNA, 15 nt, Chlamydophila pneumoniae CWL029
uaaagauaaucugua

SEQ ID NO: 2537170 - RNA, 22 nt, Chlamydophila pneumoniae CWL029
uaaagauaaucuguaagaaaau

SEQ ID NO: 2537171 - RNA, 17 nt, Chlamydophila pneumoniae CWL029
uaaagauacuuaucuuu

SEQ ID NO: 2537172 - RNA, 19 nt, Chlamydophila pneumoniae CWL029
uaaagauacuuaucuuuaa

SEQ ID NO: 2537173 - RNA, 20 nt, Chlamydophila pneumoniae CWL029
uaaagauacuuaucuuuaaa

SEQ ID NO: 2537174 - RNA, 20 nt, Chlamydophila pneumoniae CWL029
uaaagaucgugaucaaagaa

SEQ ID NO: 2537175 - RNA, 23 nt, Chlamydophila pneumoniae CWL029
uaaagaucuuuuaugauguauaa

SEQ ID NO: 2537176 - RNA, 15 nt, Chlamydophila pneumoniae CWL029
uaaagauuggaauau

SEQ ID NO: 2537177 - RNA, 17 nt, Chlamydophila pneumoniae CWL029
uaaagcaaagauaaaga

SEQ ID NO: 2537178 - RNA, 20 nt, Chlamydophila pneumoniae CWL029
uaaagcaaagauaaagaagu

SEQ ID NO: 2537179 - RNA, 21 nt, Chlamydophila pneumoniae CWL029
uaaagcaaagauaaagaaguu

SEQ ID NO: 2537180 - RNA, 14 nt, Chlamydophila pneumoniae CWL029
uaaagcaaaugccu

SEQ ID NO: 2537181 - RNA, 17 nt, Chlamydophila pneumoniae CWL029
uaaagcauuggacaacg

SEQ ID NO: 2537182 - RNA, 19 nt, Chlamydophila pneumoniae CWL029
uaaagccacauucuucuga

SEQ ID NO: 2537183 - RNA, 23 nt, Chlamydophila pneumoniae CWL029
uaaagccccacccacuccagaaa

SEQ ID NO: 2537184 - RNA, 22 nt, Chlamydophila pneumoniae CWL029
uaaagccuccucaagauaaauc

SEQ ID NO: 2537185 - RNA, 15 nt, Chlamydophila pneumoniae CWL029
uaaagcuauuguuuu

SEQ ID NO: 2537186 - RNA, 14 nt, Chlamydophila pneumoniae CWL029
uaaagcuccgagaa

SEQ ID NO: 2537187 - RNA, 14 nt, Chlamydophila pneumoniae CWL029
uaaagcugcuuuuu

SEQ ID NO: 2537188 - RNA, 15 nt, Chlamydophila pneumoniae CWL029
uaaagcuugagaaaa

SEQ ID NO: 2537189 - RNA, 13 nt, Chlamydophila pneumoniae CWL029
uaaagcuuuuccg

SEQ ID NO: 2537190 - RNA, 21 nt, Chlamydophila pneumoniae CWL029
uaaaggaacugugccauaacg

SEQ ID NO: 2537191 - RNA, 18 nt, Chlamydophila pneumoniae CWL029
uaaaggcauaacugugcu

SEQ ID NO: 2537192 - RNA, 23 nt, Chlamydophila pneumoniae CWL029
uaaaggcauagauacaaacaucg

SEQ ID NO: 2537193 - RNA, 15 nt, Chlamydophila pneumoniae CWL029
uaaagguugcuaaga

SEQ ID NO: 2537194 - RNA, 16 nt, Chlamydophila pneumoniae CWL029
uaaagguuuuaaauuu

SEQ ID NO: 2537195 - RNA, 14 nt, Chlamydophila pneumoniae CWL029
uaaaguaaaaaaua

SEQ ID NO: 2537196 - RNA, 21 nt, Chlamydophila pneumoniae CWL029
uaaaguaauaucgguuucuuu

SEQ ID NO: 2537197 - RNA, 13 nt, Chlamydophila pneumoniae CWL029
uaaaguaggaauu

SEQ ID NO: 2537198 - RNA, 20 nt, Chlamydophila pneumoniae CWL029
uaaaguggcaaucuuuucuu

SEQ ID NO: 2537199 - RNA, 19 nt, Chlamydophila pneumoniae CWL029
uaaagugucauacgcagca

SEQ ID NO: 2537200 - RNA, 17 nt, Chlamydophila pneumoniae CWL029
uaaaguguguaaauguu

SEQ ID NO: 2537201 - RNA, 19 nt, Chlamydophila pneumoniae CWL029
uaaaguugaacugacacca

SEQ ID NO: 2537202 - RNA, 20 nt, Chlamydophila pneumoniae CWL029
uaaauaaaaccacuucucug

SEQ ID NO: 2537203 - RNA, 11 nt, Chlamydophila pneumoniae CWL029
uaaauaaaauc

SEQ ID NO: 2537204 - RNA, 22 nt, Chlamydophila pneumoniae CWL029
uaaauaccuagagcucugaaau

SEQ ID NO: 2537205 - RNA, 23 nt, Chlamydophila pneumoniae CWL029
uaaauacuuaggaauuuuucuag

SEQ ID NO: 2537206 - RNA, 18 nt, Chlamydophila pneumoniae CWL029
uaaauagaaaacauagag

SEQ ID NO: 2537207 - RNA, 23 nt, Chlamydophila pneumoniae CWL029
uaaauagaaaacauagagauucu

SEQ ID NO: 2537208 - RNA, 18 nt, Chlamydophila pneumoniae CWL029
uaaauagaaaucuuaguc

SEQ ID NO: 2537209 - RNA, 18 nt, Chlamydophila pneumoniae CWL029
uaaauagcaucccuucuu

SEQ ID NO: 2537210 - RNA, 14 nt, Chlamydophila pneumoniae CWL029
uaaauagcucaguu

SEQ ID NO: 2537211 - RNA, 15 nt, Chlamydophila pneumoniae CWL029
uaaauauaaauuuau

SEQ ID NO: 2537212 - RNA, 13 nt, Chlamydophila pneumoniae CWL029
uaaauauagaaaa

SEQ ID NO: 2537213 - RNA, 17 nt, Chlamydophila pneumoniae CWL029
uaaauauagaaaaucau

SEQ ID NO: 2537214 - RNA, 15 nt, Chlamydophila pneumoniae CWL029
uaaauaucuaauaaa

SEQ ID NO: 2537215 - RNA, 21 nt, Chlamydophila pneumoniae CWL029
uaaauaucuuaacgcuuagag

SEQ ID NO: 2537216 - RNA, 22 nt, Chlamydophila pneumoniae CWL029
uaaauaucuuaacgcuuagaga

SEQ ID NO: 2537217 - RNA, 20 nt, Chlamydophila pneumoniae CWL029
uaaauaugaauuagggcuuu

SEQ ID NO: 2537218 - RNA, 12 nt, Chlamydophila pneumoniae CWL029
uaaaucaaaauu

SEQ ID NO: 2537219 - RNA, 22 nt, Chlamydophila pneumoniae CWL029
uaaaucaaaauuuuuaguaauu

SEQ ID NO: 2537220 - RNA, 20 nt, Chlamydophila pneumoniae CWL029
uaaaucaacuacaucuccaa

SEQ ID NO: 2537221 - RNA, 14 nt, Chlamydophila pneumoniae CWL029
uaaauccaaaaaau

SEQ ID NO: 2537222 - RNA, 22 nt, Chlamydophila pneumoniae CWL029
uaaauccgcagagucuauaucu

SEQ ID NO: 2537223 - RNA, 17 nt, Chlamydophila pneumoniae CWL029
uaaaucuauacccaguu

SEQ ID NO: 2537224 - RNA, 14 nt, Chlamydophila pneumoniae CWL029
uaaaucuauaucca

SEQ ID NO: 2537225 - RNA, 14 nt, Chlamydophila pneumoniae CWL029
uaaaucuauucccc

SEQ ID NO: 2537226 - RNA, 16 nt, Chlamydophila pneumoniae CWL029
uaaaugccucuuucau

SEQ ID NO: 2537227 - RNA, 23 nt, Chlamydophila pneumoniae CWL029
uaaaugccucuuucauacuaaaa

SEQ ID NO: 2537228 - RNA, 21 nt, Chlamydophila pneumoniae CWL029
uaaauguugggaugaucucgu

SEQ ID NO: 2537229 - RNA, 19 nt, Chlamydophila pneumoniae CWL029
uaaauguuuucuaugaucc

SEQ ID NO: 2537230 - RNA, 21 nt, Chlamydophila pneumoniae CWL029
uaaauguuuugcgauaucuau

SEQ ID NO: 2537231 - RNA, 13 nt, Chlamydophila pneumoniae CWL029
uaaauuaaauauc

SEQ ID NO: 2537232 - RNA, 14 nt, Chlamydophila pneumoniae CWL029
uaaauuaaauaucu

SEQ ID NO: 2537233 - RNA, 13 nt, Chlamydophila pneumoniae CWL029
uaaauuaguaaau

SEQ ID NO: 2537234 - RNA, 14 nt, Chlamydophila pneumoniae CWL029
uaaauuaguaaaug

SEQ ID NO: 2537235 - RNA, 13 nt, Chlamydophila pneumoniae CWL029
uaaauucuggaau

SEQ ID NO: 2537236 - RNA, 23 nt, Chlamydophila pneumoniae CWL029
uaaauuguauggaauucaaacuc

SEQ ID NO: 2537237 - RNA, 16 nt, Chlamydophila pneumoniae CWL029
uaaauuucauuugaaa

SEQ ID NO: 2537238 - RNA, 12 nt, Chlamydophila pneumoniae CWL029
uaaauuugucau

SEQ ID NO: 2537239 - RNA, 21 nt, Chlamydophila pneumoniae CWL029
uaaauuugucaucacaucagu

SEQ ID NO: 2537240 - RNA, 20 nt, Chlamydophila pneumoniae CWL029
uaaauuuuguuuuuccauuu

SEQ ID NO: 2537241 - RNA, 20 nt, Chlamydophila pneumoniae CWL029
uaaauuuuuccuucaacaca

SEQ ID NO: 2537242 - RNA, 19 nt, Chlamydophila pneumoniae CWL029
uaacaaaauuucuuauaaa

SEQ ID NO: 2537243 - RNA, 14 nt, Chlamydophila pneumoniae CWL029
uaacaaaguuuaug

SEQ ID NO: 2537244 - RNA, 22 nt, Chlamydophila pneumoniae CWL029
uaacaacuagguuauuaucaaa

SEQ ID NO: 2537245 - RNA, 15 nt, Chlamydophila pneumoniae CWL029
uaacaagauucucag

SEQ ID NO: 2537246 - RNA, 18 nt, Chlamydophila pneumoniae CWL029
uaacaagggaagagaaaa

SEQ ID NO: 2537247 - RNA, 17 nt, Chlamydophila pneumoniae CWL029
uaacaaguaccaagaaa

SEQ ID NO: 2537248 - RNA, 15 nt, Chlamydophila pneumoniae CWL029
uaacaauauaugcua

SEQ ID NO: 2537249 - RNA, 20 nt, Chlamydophila pneumoniae CWL029
uaacaccaaaagaauacuca

SEQ ID NO: 2537250 - RNA, 15 nt, Chlamydophila pneumoniae CWL029
uaacacccucccuca

SEQ ID NO: 2537251 - RNA, 22 nt, Chlamydophila pneumoniae CWL029
uaacacuuccuacggcaagaau

SEQ ID NO: 2537252 - RNA, 13 nt, Chlamydophila pneumoniae CWL029
uaacacuucuuuc

SEQ ID NO: 2537253 - RNA, 15 nt, Chlamydophila pneumoniae CWL029
uaacacuucuuucuu

SEQ ID NO: 2537254 - RNA, 18 nt, Chlamydophila pneumoniae CWL029
uaacacuucuuucuugcu

SEQ ID NO: 2537255 - RNA, 13 nt, Chlamydophila pneumoniae CWL029
uaacauaaaguca

SEQ ID NO: 2537256 - RNA, 20 nt, Chlamydophila pneumoniae CWL029
uaacauaaagucaaacauca

SEQ ID NO: 2537257 - RNA, 13 nt, Chlamydophila pneumoniae CWL029
uaacauagauaag

SEQ ID NO: 2537258 - RNA, 17 nt, Chlamydophila pneumoniae CWL029
uaacaucaagaauuucu

SEQ ID NO: 2537259 - RNA, 17 nt, Chlamydophila pneumoniae CWL029
uaacauccauagagaac

SEQ ID NO: 2537260 - RNA, 14 nt, Chlamydophila pneumoniae CWL029
uaacaucuaaaaau

SEQ ID NO: 2537261 - RNA, 24 nt, Chlamydophila pneumoniae CWL029
uaacaugccaaaaguuuugaggau

SEQ ID NO: 2537262 - RNA, 20 nt, Chlamydophila pneumoniae CWL029
uaacaugcgcagaauaaaau

SEQ ID NO: 2537263 - RNA, 22 nt, Chlamydophila pneumoniae CWL029
uaacauuggagucuaaaaaaua

SEQ ID NO: 2537264 - RNA, 20 nt, Chlamydophila pneumoniae CWL029
uaacauuucguuuuuucuua

SEQ ID NO: 2537265 - RNA, 20 nt, Chlamydophila pneumoniae CWL029
uaaccaaaagaauuaagaag

SEQ ID NO: 2537266 - RNA, 23 nt, Chlamydophila pneumoniae CWL029
uaaccaaaagaauuaagaagaag

SEQ ID NO: 2537267 - RNA, 14 nt, Chlamydophila pneumoniae CWL029
uaaccaauaaacuu

SEQ ID NO: 2537268 - RNA, 20 nt, Chlamydophila pneumoniae CWL029
uaaccacagugauuuagaaa

SEQ ID NO: 2537269 - RNA, 13 nt, Chlamydophila pneumoniae CWL029
uaaccagaagacu

SEQ ID NO: 2537270 - RNA, 12 nt, Chlamydophila pneumoniae CWL029
uaaccagagagc

SEQ ID NO: 2537271 - RNA, 17 nt, Chlamydophila pneumoniae CWL029
uaaccccuccaaaauca

SEQ ID NO: 2537272 - RNA, 24 nt, Chlamydophila pneumoniae CWL029
uaacccgcuugcaucuuauggaag

SEQ ID NO: 2537273 - RNA, 21 nt, Chlamydophila pneumoniae CWL029
uaaccgucacuguuuuccaga

SEQ ID NO: 2537274 - RNA, 21 nt, Chlamydophila pneumoniae CWL029
uaaccguggcuuuguaaaaau

SEQ ID NO: 2537275 - RNA, 17 nt, Chlamydophila pneumoniae CWL029
uaaccuaaggcauggca

SEQ ID NO: 2537276 - RNA, 13 nt, Chlamydophila pneumoniae CWL029
uaaccucuuuucu

SEQ ID NO: 2537277 - RNA, 20 nt, Chlamydophila pneumoniae CWL029
uaaccuuugacaacaccaca

SEQ ID NO: 2537278 - RNA, 19 nt, Chlamydophila pneumoniae CWL029
uaacgaagugaggagaaua

SEQ ID NO: 2537279 - RNA, 20 nt, Chlamydophila pneumoniae CWL029
uaacgaagugaggagaauag

SEQ ID NO: 2537280 - RNA, 22 nt, Chlamydophila pneumoniae CWL029
uaacgaagugaggagaauagca

SEQ ID NO: 2537281 - RNA, 18 nt, Chlamydophila pneumoniae CWL029
uaacgaauugcuuucccc

SEQ ID NO: 2537282 - RNA, 22 nt, Chlamydophila pneumoniae CWL029
uaacgauuucuugaagaucucc

SEQ ID NO: 2537283 - RNA, 13 nt, Chlamydophila pneumoniae CWL029
uaacgcuuuucua

SEQ ID NO: 2537284 - RNA, 23 nt, Chlamydophila pneumoniae CWL029
uaacguacgcaaguaaagaaauu

SEQ ID NO: 2537285 - RNA, 16 nt, Chlamydophila pneumoniae CWL029
uaacguagucaaaaau

SEQ ID NO: 2537286 - RNA, 17 nt, Chlamydophila pneumoniae CWL029
uaacguagucaaaaauu

SEQ ID NO: 2537287 - RNA, 19 nt, Chlamydophila pneumoniae CWL029
uaacguuucaggucagcaa

SEQ ID NO: 2537288 - RNA, 21 nt, Chlamydophila pneumoniae CWL029
uaacguuucaggucagcaagg

SEQ ID NO: 2537289 - RNA, 20 nt, Chlamydophila pneumoniae CWL029
uaacguuucuucgcaaauau

SEQ ID NO: 2537290 - RNA, 14 nt, Chlamydophila pneumoniae CWL029
uaacuaagauaugu

SEQ ID NO: 2537291 - RNA, 13 nt, Chlamydophila pneumoniae CWL029
uaacuaguaacuu

SEQ ID NO: 2537292 - RNA, 22 nt, Chlamydophila pneumoniae CWL029
uaacuaucucuguuuuuugaaa

SEQ ID NO: 2537293 - RNA, 20 nt, Chlamydophila pneumoniae CWL029
uaacuauugggaaugcauuu

SEQ ID NO: 2537294 - RNA, 19 nt, Chlamydophila pneumoniae CWL029
uaacuccaggggauaaaac

SEQ ID NO: 2537295 - RNA, 22 nt, Chlamydophila pneumoniae CWL029
uaacuccaggggauaaaacuau

SEQ ID NO: 2537296 - RNA, 17 nt, Chlamydophila pneumoniae CWL029
uaacucggaaaaaauag

SEQ ID NO: 2537297 - RNA, 21 nt, Chlamydophila pneumoniae CWL029
uaacucggaaaaaauagaucc

SEQ ID NO: 2537298 - RNA, 17 nt, Chlamydophila pneumoniae CWL029
uaacucuagaucuucaa

SEQ ID NO: 2537299 - RNA, 21 nt, Chlamydophila pneumoniae CWL029
uaacucuagaucuucaauccc

SEQ ID NO: 2537300 - RNA, 20 nt, Chlamydophila pneumoniae CWL029
uaacucuuaagaauaaaaua

SEQ ID NO: 2537301 - RNA, 22 nt, Chlamydophila pneumoniae CWL029
uaacugaggcaaagauuuccaa

SEQ ID NO: 2537302 - RNA, 20 nt, Chlamydophila pneumoniae CWL029
uaacuggcaaucuaaaauca

SEQ ID NO: 2537303 - RNA, 22 nt, Chlamydophila pneumoniae CWL029
uaacuucuaaaagcaaguuguu

SEQ ID NO: 2537304 - RNA, 21 nt, Chlamydophila pneumoniae CWL029
uaacuugcauuuuuuggaaua

SEQ ID NO: 2537305 - RNA, 18 nt, Chlamydophila pneumoniae CWL029
uaacuuggugagcagcuu

SEQ ID NO: 2537306 - RNA, 22 nt, Chlamydophila pneumoniae CWL029
uaacuuggugagcagcuuuauc

SEQ ID NO: 2537307 - RNA, 15 nt, Chlamydophila pneumoniae CWL029
uaacuuuaucauaga

SEQ ID NO: 2537308 - RNA, 15 nt, Chlamydophila pneumoniae CWL029
uaagaaaucaguccu

SEQ ID NO: 2537309 - RNA, 16 nt, Chlamydophila pneumoniae CWL029
uaagaacaucuuccca

SEQ ID NO: 2537310 - RNA, 15 nt, Chlamydophila pneumoniae CWL029
uaagaacguauacgu

SEQ ID NO: 2537311 - RNA, 15 nt, Chlamydophila pneumoniae CWL029
uaagaacuuuaggga

SEQ ID NO: 2537312 - RNA, 19 nt, Chlamydophila pneumoniae CWL029
uaagaagcucacucuuuaa

SEQ ID NO: 2537313 - RNA, 20 nt, Chlamydophila pneumoniae CWL029
uaagaagguuuauuagaagu

SEQ ID NO: 2537314 - RNA, 15 nt, Chlamydophila pneumoniae CWL029
uaagaauaaaauagg

SEQ ID NO: 2537315 - RNA, 16 nt, Chlamydophila pneumoniae CWL029
uaagaaugagaacguc

SEQ ID NO: 2537316 - RNA, 19 nt, Chlamydophila pneumoniae CWL029
uaagacaauaaaauagccc

SEQ ID NO: 2537317 - RNA, 18 nt, Chlamydophila pneumoniae CWL029
uaagaccaaacuuucuuu

SEQ ID NO: 2537318 - RNA, 13 nt, Chlamydophila pneumoniae CWL029
uaagacuaaaaaa

SEQ ID NO: 2537319 - RNA, 15 nt, Chlamydophila pneumoniae CWL029
uaagacuaaaaaaga

SEQ ID NO: 2537320 - RNA, 16 nt, Chlamydophila pneumoniae CWL029
uaagacuguguuuuau

SEQ ID NO: 2537321 - RNA, 16 nt, Chlamydophila pneumoniae CWL029
uaagacuucuggaagc

SEQ ID NO: 2537322 - RNA, 21 nt, Chlamydophila pneumoniae CWL029
uaagagaauuauuauuaguua

SEQ ID NO: 2537323 - RNA, 23 nt, Chlamydophila pneumoniae CWL029
uaagagauuuuccauaggaacaa

SEQ ID NO: 2537324 - RNA, 12 nt, Chlamydophila pneumoniae CWL029
uaagagcuacaa

SEQ ID NO: 2537325 - RNA, 20 nt, Chlamydophila pneumoniae CWL029
uaagagcuacaaucccgagu

SEQ ID NO: 2537326 - RNA, 16 nt, Chlamydophila pneumoniae CWL029
uaagagguucucuuaa

SEQ ID NO: 2537327 - RNA, 17 nt, Chlamydophila pneumoniae CWL029
uaagagguucuugcuua

SEQ ID NO: 2537328 - RNA, 18 nt, Chlamydophila pneumoniae CWL029
uaagaguuccaagacaau

SEQ ID NO: 2537329 - RNA, 21 nt, Chlamydophila pneumoniae CWL029
uaagaguuuuacaucaaugau

SEQ ID NO: 2537330 - RNA, 20 nt, Chlamydophila pneumoniae CWL029
uaagauaaacagcacaggca

SEQ ID NO: 2537331 - RNA, 13 nt, Chlamydophila pneumoniae CWL029
uaagauaaacauu

SEQ ID NO: 2537332 - RNA, 17 nt, Chlamydophila pneumoniae CWL029
uaagauaauagagaaga

SEQ ID NO: 2537333 - RNA, 18 nt, Chlamydophila pneumoniae CWL029
uaagauaauagagaagaa

SEQ ID NO: 2537334 - RNA, 21 nt, Chlamydophila pneumoniae CWL029
uaagauaauagagaagaagca

SEQ ID NO: 2537335 - RNA, 15 nt, Chlamydophila pneumoniae CWL029
uaagauacuucucca

SEQ ID NO: 2537336 - RNA, 20 nt, Chlamydophila pneumoniae CWL029
uaagauagacucucacugag

SEQ ID NO: 2537337 - RNA, 20 nt, Chlamydophila pneumoniae CWL029
uaagauaucgaccuuaaaau

SEQ ID NO: 2537338 - RNA, 16 nt, Chlamydophila pneumoniae CWL029
uaagauccucuauaga

SEQ ID NO: 2537339 - RNA, 17 nt, Chlamydophila pneumoniae CWL029
uaagauccuuuaaagau

SEQ ID NO: 2537340 - RNA, 14 nt, Chlamydophila pneumoniae CWL029
uaagaucuuuagaa

SEQ ID NO: 2537341 - RNA, 23 nt, Chlamydophila pneumoniae CWL029
uaagaucuuuagaauaagagcua

SEQ ID NO: 2537342 - RNA, 18 nt, Chlamydophila pneumoniae CWL029
uaagauugccauguacau

SEQ ID NO: 2537343 - RNA, 13 nt, Chlamydophila pneumoniae CWL029
uaagauuuccuua

SEQ ID NO: 2537344 - RNA, 21 nt, Chlamydophila pneumoniae CWL029
uaagcaagagcuccgcuagag

SEQ ID NO: 2537345 - RNA, 20 nt, Chlamydophila pneumoniae CWL029
uaagcaagcaacugauguuu

SEQ ID NO: 2537346 - RNA, 14 nt, Chlamydophila pneumoniae CWL029
uaagcaauaucuau

SEQ ID NO: 2537347 - RNA, 22 nt, Chlamydophila pneumoniae CWL029
uaagcaauauuucuguucugcu

SEQ ID NO: 2537348 - RNA, 21 nt, Chlamydophila pneumoniae CWL029
uaagcauagcccgaaauucau

SEQ ID NO: 2537349 - RNA, 22 nt, Chlamydophila pneumoniae CWL029
uaagcauagcccgaaauucauu

SEQ ID NO: 2537350 - RNA, 20 nt, Chlamydophila pneumoniae CWL029
uaagcauauuuaaauauaaa

SEQ ID NO: 2537351 - RNA, 13 nt, Chlamydophila pneumoniae CWL029
uaagcaucuagaa

SEQ ID NO: 2537352 - RNA, 15 nt, Chlamydophila pneumoniae CWL029
uaagccaaauaccaa

SEQ ID NO: 2537353 - RNA, 15 nt, Chlamydophila pneumoniae CWL029
uaagccaguacuaaa

SEQ ID NO: 2537354 - RNA, 15 nt, Chlamydophila pneumoniae CWL029
uaagcgcucuucaau

SEQ ID NO: 2537355 - RNA, 20 nt, Chlamydophila pneumoniae CWL029
uaagcuaauaagauccaaaa

SEQ ID NO: 2537356 - RNA, 14 nt, Chlamydophila pneumoniae CWL029
uaagcuauaucuca

SEQ ID NO: 2537357 - RNA, 12 nt, Chlamydophila pneumoniae CWL029
uaagcucaaaau

SEQ ID NO: 2537358 - RNA, 21 nt, Chlamydophila pneumoniae CWL029
uaagcucaaaauuuccucgac

SEQ ID NO: 2537359 - RNA, 14 nt, Chlamydophila pneumoniae CWL029
uaagcucuaagucc

SEQ ID NO: 2537360 - RNA, 19 nt, Chlamydophila pneumoniae CWL029
uaagcucuuaauuucugcu

SEQ ID NO: 2537361 - RNA, 17 nt, Chlamydophila pneumoniae CWL029
uaagcugcaaucucaaa

SEQ ID NO: 2537362 - RNA, 19 nt, Chlamydophila pneumoniae CWL029
uaagcuggauucugucuau

SEQ ID NO: 2537363 - RNA, 17 nt, Chlamydophila pneumoniae CWL029
uaagcugugcauuuucu

SEQ ID NO: 2537364 - RNA, 15 nt, Chlamydophila pneumoniae CWL029
uaagcuuauuucugu

SEQ ID NO: 2537365 - RNA, 17 nt, Chlamydophila pneumoniae CWL029
uaagcuuuccucuccaa

SEQ ID NO: 2537366 - RNA, 20 nt, Chlamydophila pneumoniae CWL029
uaagcuuuuacccucgccaa

SEQ ID NO: 2537367 - RNA, 23 nt, Chlamydophila pneumoniae CWL029
uaagcuuuucuuccaaagacuga

SEQ ID NO: 2537368 - RNA, 14 nt, Chlamydophila pneumoniae CWL029
uaaggacaaaucuc

SEQ ID NO: 2537369 - RNA, 18 nt, Chlamydophila pneumoniae CWL029
uaaggacaaaucucccaa

SEQ ID NO: 2537370 - RNA, 19 nt, Chlamydophila pneumoniae CWL029
uaaggacaaaucucccaaa

SEQ ID NO: 2537371 - RNA, 16 nt, Chlamydophila pneumoniae CWL029
uaaggauguuguggau

SEQ ID NO: 2537372 - RNA, 17 nt, Chlamydophila pneumoniae CWL029
uaaggcuuccaaugcua

SEQ ID NO: 2537373 - RNA, 15 nt, Chlamydophila pneumoniae CWL029
uaaggcuuugccuuu

SEQ ID NO: 2537374 - RNA, 18 nt, Chlamydophila pneumoniae CWL029
uaaggcuuuucugcuccu

SEQ ID NO: 2537375 - RNA, 12 nt, Chlamydophila pneumoniae CWL029
uaagggcucuag

SEQ ID NO: 2537376 - RNA, 16 nt, Chlamydophila pneumoniae CWL029
uaagggcucuccuaaa

SEQ ID NO: 2537377 - RNA, 18 nt, Chlamydophila pneumoniae CWL029
uaaggugcuauuuuaaac

SEQ ID NO: 2537378 - RNA, 14 nt, Chlamydophila pneumoniae CWL029
uaagguuccaaaaa

SEQ ID NO: 2537379 - RNA, 19 nt, Chlamydophila pneumoniae CWL029
uaaguacacauugucucuu

SEQ ID NO: 2537380 - RNA, 22 nt, Chlamydophila pneumoniae CWL029
uaaguacacauugucucuuuua

SEQ ID NO: 2537381 - RNA, 23 nt, Chlamydophila pneumoniae CWL029
uaaguaggccuccuucauucaca

SEQ ID NO: 2537382 - RNA, 16 nt, Chlamydophila pneumoniae CWL029
uaaguccuucuuccca

SEQ ID NO: 2537383 - RNA, 19 nt, Chlamydophila pneumoniae CWL029
uaaguccuucuucccagcc

SEQ ID NO: 2537384 - RNA, 17 nt, Chlamydophila pneumoniae CWL029
uaagucgaauucauuaa

SEQ ID NO: 2537385 - RNA, 19 nt, Chlamydophila pneumoniae CWL029
uaagucuugaguucuuuug

SEQ ID NO: 2537386 - RNA, 18 nt, Chlamydophila pneumoniae CWL029
uaagugacuuuucuucuu

SEQ ID NO: 2537387 - RNA, 17 nt, Chlamydophila pneumoniae CWL029
uaagugauaaggaagaa

SEQ ID NO: 2537388 - RNA, 12 nt, Chlamydophila pneumoniae CWL029
uaagugcuuuua

SEQ ID NO: 2537389 - RNA, 18 nt, Chlamydophila pneumoniae CWL029
uaaguuacggaacucauu

SEQ ID NO: 2537390 - RNA, 17 nt, Chlamydophila pneumoniae CWL029
uaaguuacuuucugauu

SEQ ID NO: 2537391 - RNA, 21 nt, Chlamydophila pneumoniae CWL029
uaaguuagagacacagaagga

SEQ ID NO: 2537392 - RNA, 13 nt, Chlamydophila pneumoniae CWL029
uaaguucuuccaa

SEQ ID NO: 2537393 - RNA, 16 nt, Chlamydophila pneumoniae CWL029
uaaguuuguagcagca

SEQ ID NO: 2537394 - RNA, 13 nt, Chlamydophila pneumoniae CWL029
uaauaaaauuuaa

SEQ ID NO: 2537395 - RNA, 16 nt, Chlamydophila pneumoniae CWL029
uaauaaaauuuaaaaa

SEQ ID NO: 2537396 - RNA, 16 nt, Chlamydophila pneumoniae CWL029
uaauaagcaggaaaag

SEQ ID NO: 2537397 - RNA, 20 nt, Chlamydophila pneumoniae CWL029
uaauaagcauauuuaaauau

SEQ ID NO: 2537398 - RNA, 21 nt, Chlamydophila pneumoniae CWL029
uaauaagcauauuuaaauaua

SEQ ID NO: 2537399 - RNA, 22 nt, Chlamydophila pneumoniae CWL029
uaauaaugaagcagggaaaaug

SEQ ID NO: 2537400 - RNA, 14 nt, Chlamydophila pneumoniae CWL029
uaauacaaaaaaua

SEQ ID NO: 2537401 - RNA, 14 nt, Chlamydophila pneumoniae CWL029
uaauaccuuucuaa

SEQ ID NO: 2537402 - RNA, 18 nt, Chlamydophila pneumoniae CWL029
uaauacggacuucacaaa

SEQ ID NO: 2537403 - RNA, 14 nt, Chlamydophila pneumoniae CWL029
uaauacguuuuuag

SEQ ID NO: 2537404 - RNA, 12 nt, Chlamydophila pneumoniae CWL029
uaauagagaaga

SEQ ID NO: 2537405 - RNA, 14 nt, Chlamydophila pneumoniae CWL029
uaauagcaggaguu

SEQ ID NO: 2537406 - RNA, 17 nt, Chlamydophila pneumoniae CWL029
uaauagcgacaugagaa

SEQ ID NO: 2537407 - RNA, 16 nt, Chlamydophila pneumoniae CWL029
uaauagcuaaagugau

SEQ ID NO: 2537408 - RNA, 19 nt, Chlamydophila pneumoniae CWL029
uaauaggauaagaaauuaa

SEQ ID NO: 2537409 - RNA, 17 nt, Chlamydophila pneumoniae CWL029
uaauaucgguuccuaua

SEQ ID NO: 2537410 - RNA, 16 nt, Chlamydophila pneumoniae CWL029
uaauauuugagaagau

SEQ ID NO: 2537411 - RNA, 21 nt, Chlamydophila pneumoniae CWL029
uaaucagaagugaucuugaga

SEQ ID NO: 2537412 - RNA, 15 nt, Chlamydophila pneumoniae CWL029
uaaucagaggagccu

SEQ ID NO: 2537413 - RNA, 14 nt, Chlamydophila pneumoniae CWL029
uaaucauaaaaaaa

SEQ ID NO: 2537414 - RNA, 14 nt, Chlamydophila pneumoniae CWL029
uaaucauaucugcg

SEQ ID NO: 2537415 - RNA, 16 nt, Chlamydophila pneumoniae CWL029
uaaucaugauaaaaau

SEQ ID NO: 2537416 - RNA, 19 nt, Chlamydophila pneumoniae CWL029
uaaucaugauaaaaauuuu

SEQ ID NO: 2537417 - RNA, 22 nt, Chlamydophila pneumoniae CWL029
uaauccagcaacaaccaaaaga

SEQ ID NO: 2537418 - RNA, 16 nt, Chlamydophila pneumoniae CWL029
uaauccucgauacugu

SEQ ID NO: 2537419 - RNA, 18 nt, Chlamydophila pneumoniae CWL029
uaauccucgauacuguug

SEQ ID NO: 2537420 - RNA, 23 nt, Chlamydophila pneumoniae CWL029
uaauccugaauggcucugucacu

SEQ ID NO: 2537421 - RNA, 21 nt, Chlamydophila pneumoniae CWL029
uaauccuguugucacuaagau

SEQ ID NO: 2537422 - RNA, 22 nt, Chlamydophila pneumoniae CWL029
uaauccuguugucacuaagaua

SEQ ID NO: 2537423 - RNA, 14 nt, Chlamydophila pneumoniae CWL029
uaauccuucuuucu

SEQ ID NO: 2537424 - RNA, 20 nt, Chlamydophila pneumoniae CWL029
uaauccuuucacaaagaauu

SEQ ID NO: 2537425 - RNA, 18 nt, Chlamydophila pneumoniae CWL029
uaaucgagagaagaaauu

SEQ ID NO: 2537426 - RNA, 20 nt, Chlamydophila pneumoniae CWL029
uaaucgagagaagaaauucu

SEQ ID NO: 2537427 - RNA, 19 nt, Chlamydophila pneumoniae CWL029
uaaucuauaggauuugcau

SEQ ID NO: 2537428 - RNA, 22 nt, Chlamydophila pneumoniae CWL029
uaaucuccaaacauuuuuaagg

SEQ ID NO: 2537429 - RNA, 21 nt, Chlamydophila pneumoniae CWL029
uaaucucgcaguccuugagcu

SEQ ID NO: 2537430 - RNA, 12 nt, Chlamydophila pneumoniae CWL029
uaaucuguauau

SEQ ID NO: 2537431 - RNA, 21 nt, Chlamydophila pneumoniae CWL029
uaaucuugaucagcaaucaca

SEQ ID NO: 2537432 - RNA, 18 nt, Chlamydophila pneumoniae CWL029
uaaucuuuuuuaaagcua

SEQ ID NO: 2537433 - RNA, 13 nt, Chlamydophila pneumoniae CWL029
uaaugaacucagg

SEQ ID NO: 2537434 - RNA, 19 nt, Chlamydophila pneumoniae CWL029
uaaugacagcugagaaauu

SEQ ID NO: 2537435 - RNA, 20 nt, Chlamydophila pneumoniae CWL029
uaaugauacgugcagugaau

SEQ ID NO: 2537436 - RNA, 23 nt, Chlamydophila pneumoniae CWL029
uaaugcagauagcuuacagagaa

SEQ ID NO: 2537437 - RNA, 17 nt, Chlamydophila pneumoniae CWL029
uaaugccaauaugguag

SEQ ID NO: 2537438 - RNA, 23 nt, Chlamydophila pneumoniae CWL029
uaaugccgagaauacagagucug

SEQ ID NO: 2537439 - RNA, 22 nt, Chlamydophila pneumoniae CWL029
uaaugcuaucccacuaacaaga

SEQ ID NO: 2537440 - RNA, 14 nt, Chlamydophila pneumoniae CWL029
uaaugucuccaucg

SEQ ID NO: 2537441 - RNA, 12 nt, Chlamydophila pneumoniae CWL029
uaauuaaauaua

SEQ ID NO: 2537442 - RNA, 17 nt, Chlamydophila pneumoniae CWL029
uaauuaacguuucuucg

SEQ ID NO: 2537443 - RNA, 14 nt, Chlamydophila pneumoniae CWL029
uaauuacagaaucc

SEQ ID NO: 2537444 - RNA, 15 nt, Chlamydophila pneumoniae CWL029
uaauuauguagaucu

SEQ ID NO: 2537445 - RNA, 13 nt, Chlamydophila pneumoniae CWL029
uaauucaaaaaga

SEQ ID NO: 2537446 - RNA, 14 nt, Chlamydophila pneumoniae CWL029
uaauucagaaagac

SEQ ID NO: 2537447 - RNA, 22 nt, Chlamydophila pneumoniae CWL029
uaauucauauuuacgaaaacau

SEQ ID NO: 2537448 - RNA, 16 nt, Chlamydophila pneumoniae CWL029
uaauuccaucuggaau

SEQ ID NO: 2537449 - RNA, 14 nt, Chlamydophila pneumoniae CWL029
uaauuccuuggauu

SEQ ID NO: 2537450 - RNA, 16 nt, Chlamydophila pneumoniae CWL029
uaauugugcucucuaa

SEQ ID NO: 2537451 - RNA, 17 nt, Chlamydophila pneumoniae CWL029
uaauuucaggagcuccu

SEQ ID NO: 2537452 - RNA, 17 nt, Chlamydophila pneumoniae CWL029
uaauuuccuucuccaga

SEQ ID NO: 2537453 - RNA, 20 nt, Chlamydophila pneumoniae CWL029
uaauuucuaaauagaaaaca

SEQ ID NO: 2537454 - RNA, 22 nt, Chlamydophila pneumoniae CWL029
uaauuucuaaauagaaaacaua

SEQ ID NO: 2537455 - RNA, 17 nt, Chlamydophila pneumoniae CWL029
uaauuucuccgucaaga

SEQ ID NO: 2537456 - RNA, 19 nt, Chlamydophila pneumoniae CWL029
uaauuucuccgucaagaac

SEQ ID NO: 2537457 - RNA, 19 nt, Chlamydophila pneumoniae CWL029
uaauuuuagaacuucaaug

SEQ ID NO: 2537458 - RNA, 19 nt, Chlamydophila pneumoniae CWL029
uaauuuucccaauauccuc

SEQ ID NO: 2537459 - RNA, 15 nt, Chlamydophila pneumoniae CWL029
uaauuuucuguuaau

SEQ ID NO: 2537460 - RNA, 18 nt, Chlamydophila pneumoniae CWL029
uacaaaaaauaaaaucaa

SEQ ID NO: 2537461 - RNA, 16 nt, Chlamydophila pneumoniae CWL029
uacaaaacaaaagcca

SEQ ID NO: 2537462 - RNA, 12 nt, Chlamydophila pneumoniae CWL029
uacaaacaagaa

SEQ ID NO: 2537463 - RNA, 16 nt, Chlamydophila pneumoniae CWL029
uacaaacaagaagcgu

SEQ ID NO: 2537464 - RNA, 11 nt, Chlamydophila pneumoniae CWL029
uacaaacccau

SEQ ID NO: 2537465 - RNA, 18 nt, Chlamydophila pneumoniae CWL029
uacaaacccauauuugaa

SEQ ID NO: 2537466 - RNA, 24 nt, Chlamydophila pneumoniae CWL029
uacaaauggcaugaaagauaaugu

SEQ ID NO: 2537467 - RNA, 24 nt, Chlamydophila pneumoniae CWL029
uacaaauuaccuugagacaaagaa

SEQ ID NO: 2537468 - RNA, 12 nt, Chlamydophila pneumoniae CWL029
uacaacccuuua

SEQ ID NO: 2537469 - RNA, 20 nt, Chlamydophila pneumoniae CWL029
uacaagacaaaguuguuucu

SEQ ID NO: 2537470 - RNA, 11 nt, Chlamydophila pneumoniae CWL029
uacaagcaauu

SEQ ID NO: 2537471 - RNA, 20 nt, Chlamydophila pneumoniae CWL029
uacaagcuucaucaaaacau

SEQ ID NO: 2537472 - RNA, 15 nt, Chlamydophila pneumoniae CWL029
uacaagcuuccuugg

SEQ ID NO: 2537473 - RNA, 16 nt, Chlamydophila pneumoniae CWL029
uacaaggucuuuuccu

SEQ ID NO: 2537474 - RNA, 12 nt, Chlamydophila pneumoniae CWL029
uacaaguugaga

SEQ ID NO: 2537475 - RNA, 23 nt, Chlamydophila pneumoniae CWL029
uacaauaaccaggggcuuuccuu

SEQ ID NO: 2537476 - RNA, 17 nt, Chlamydophila pneumoniae CWL029
uacaaucccgaguccua

SEQ ID NO: 2537477 - RNA, 22 nt, Chlamydophila pneumoniae CWL029
uacaaucucuagggauaauuaa

SEQ ID NO: 2537478 - RNA, 23 nt, Chlamydophila pneumoniae CWL029
uacaaugaagucuucuuucccca

SEQ ID NO: 2537479 - RNA, 23 nt, Chlamydophila pneumoniae CWL029
uacaauuagagauucauaaaacu

SEQ ID NO: 2537480 - RNA, 14 nt, Chlamydophila pneumoniae CWL029
uacaauuuaaaucu

SEQ ID NO: 2537481 - RNA, 12 nt, Chlamydophila pneumoniae CWL029
uacaauuugcuc

SEQ ID NO: 2537482 - RNA, 18 nt, Chlamydophila pneumoniae CWL029
uacacauugucucuuuua

SEQ ID NO: 2537483 - RNA, 15 nt, Chlamydophila pneumoniae CWL029
uacaccauagaacug

SEQ ID NO: 2537484 - RNA, 18 nt, Chlamydophila pneumoniae CWL029
uacacuccaauaagacga

SEQ ID NO: 2537485 - RNA, 21 nt, Chlamydophila pneumoniae CWL029
uacacuuauguucuaugagau

SEQ ID NO: 2537486 - RNA, 15 nt, Chlamydophila pneumoniae CWL029
uacacuucuaauaca

SEQ ID NO: 2537487 - RNA, 22 nt, Chlamydophila pneumoniae CWL029
uacagaaaauaagaagcagcac

SEQ ID NO: 2537488 - RNA, 21 nt, Chlamydophila pneumoniae CWL029
uacagaaaggaccuccucaca

SEQ ID NO: 2537489 - RNA, 18 nt, Chlamydophila pneumoniae CWL029
uacagaaaggcuuuucuu

SEQ ID NO: 2537490 - RNA, 18 nt, Chlamydophila pneumoniae CWL029
uacagacaagcaaggaaa

SEQ ID NO: 2537491 - RNA, 22 nt, Chlamydophila pneumoniae CWL029
uacagagagaaacuuaguuuug

SEQ ID NO: 2537492 - RNA, 17 nt, Chlamydophila pneumoniae CWL029
uacagagggaauuucau

SEQ ID NO: 2537493 - RNA, 19 nt, Chlamydophila pneumoniae CWL029
uacagagggcuucauuccu

SEQ ID NO: 2537494 - RNA, 21 nt, Chlamydophila pneumoniae CWL029
uacagagucuguguagccgua

SEQ ID NO: 2537495 - RNA, 17 nt, Chlamydophila pneumoniae CWL029
uacagauaucaaagcau

SEQ ID NO: 2537496 - RNA, 21 nt, Chlamydophila pneumoniae CWL029
uacagaucaggauucuaaaaa

SEQ ID NO: 2537497 - RNA, 23 nt, Chlamydophila pneumoniae CWL029
uacagaucaggauucuaaaaaga

SEQ ID NO: 2537498 - RNA, 15 nt, Chlamydophila pneumoniae CWL029
uacagaucugcauaa

SEQ ID NO: 2537499 - RNA, 19 nt, Chlamydophila pneumoniae CWL029
uacagauguaaaugcuccu

SEQ ID NO: 2537500 - RNA, 13 nt, Chlamydophila pneumoniae CWL029
uacagauguuuuc

SEQ ID NO: 2537501 - RNA, 19 nt, Chlamydophila pneumoniae CWL029
uacagauucaccaagaaca

SEQ ID NO: 2537502 - RNA, 15 nt, Chlamydophila pneumoniae CWL029
uacagcauaaaaauu

SEQ ID NO: 2537503 - RNA, 23 nt, Chlamydophila pneumoniae CWL029
uacagcgcuuucgggaauaauag

SEQ ID NO: 2537504 - RNA, 20 nt, Chlamydophila pneumoniae CWL029
uacagcguugcuaagcauag

SEQ ID NO: 2537505 - RNA, 14 nt, Chlamydophila pneumoniae CWL029
uacaggaauucuca

SEQ ID NO: 2537506 - RNA, 14 nt, Chlamydophila pneumoniae CWL029
uacaggcaaggaga

SEQ ID NO: 2537507 - RNA, 17 nt, Chlamydophila pneumoniae CWL029
uacaguaguaaauaaua

SEQ ID NO: 2537508 - RNA, 17 nt, Chlamydophila pneumoniae CWL029
uacagugacauccggau

SEQ ID NO: 2537509 - RNA, 18 nt, Chlamydophila pneumoniae CWL029
uacaguuuuuuucuaaau

SEQ ID NO: 2537510 - RNA, 12 nt, Chlamydophila pneumoniae CWL029
uacauaaaauga

SEQ ID NO: 2537511 - RNA, 13 nt, Chlamydophila pneumoniae CWL029
uacauagaggaga

SEQ ID NO: 2537512 - RNA, 22 nt, Chlamydophila pneumoniae CWL029
uacauagggaaaguucaguaaa

SEQ ID NO: 2537513 - RNA, 21 nt, Chlamydophila pneumoniae CWL029
uacauaguuuuuauuuuuaaa

SEQ ID NO: 2537514 - RNA, 14 nt, Chlamydophila pneumoniae CWL029
uacaucaaaaugcu

SEQ ID NO: 2537515 - RNA, 14 nt, Chlamydophila pneumoniae CWL029
uacaucagacugaa

SEQ ID NO: 2537516 - RNA, 15 nt, Chlamydophila pneumoniae CWL029
uacaucagacugaag

SEQ ID NO: 2537517 - RNA, 16 nt, Chlamydophila pneumoniae CWL029
uacaucagacugaaga

SEQ ID NO: 2537518 - RNA, 19 nt, Chlamydophila pneumoniae CWL029
uacaucaucagaagcuccu

SEQ ID NO: 2537519 - RNA, 13 nt, Chlamydophila pneumoniae CWL029
uacauccucacua

SEQ ID NO: 2537520 - RNA, 13 nt, Chlamydophila pneumoniae CWL029
uacaucuaacucu

SEQ ID NO: 2537521 - RNA, 17 nt, Chlamydophila pneumoniae CWL029
uacaucuccaagccaug

SEQ ID NO: 2537522 - RNA, 15 nt, Chlamydophila pneumoniae CWL029
uacaucuuaagagca

SEQ ID NO: 2537523 - RNA, 17 nt, Chlamydophila pneumoniae CWL029
uacaucuuaagagcaaa

SEQ ID NO: 2537524 - RNA, 19 nt, Chlamydophila pneumoniae CWL029
uacaucuucuuggcuuucc

SEQ ID NO: 2537525 - RNA, 15 nt, Chlamydophila pneumoniae CWL029
uacaugcucaagaag

SEQ ID NO: 2537526 - RNA, 13 nt, Chlamydophila pneumoniae CWL029
uacauguaaacaa

SEQ ID NO: 2537527 - RNA, 15 nt, Chlamydophila pneumoniae CWL029
uacauucgcaagaau

SEQ ID NO: 2537528 - RNA, 22 nt, Chlamydophila pneumoniae CWL029
uacauuugauucauaaagagga

SEQ ID NO: 2537529 - RNA, 20 nt, Chlamydophila pneumoniae CWL029
uacauuugcuauuuucccuu

SEQ ID NO: 2537530 - RNA, 13 nt, Chlamydophila pneumoniae CWL029
uaccaaaauacca

SEQ ID NO: 2537531 - RNA, 14 nt, Chlamydophila pneumoniae CWL029
uaccaacugagcua

SEQ ID NO: 2537532 - RNA, 20 nt, Chlamydophila pneumoniae CWL029
uaccaagacaauggaaauag

SEQ ID NO: 2537533 - RNA, 21 nt, Chlamydophila pneumoniae CWL029
uaccaagaugaagaaacuugu

SEQ ID NO: 2537534 - RNA, 14 nt, Chlamydophila pneumoniae CWL029
uaccaauaugcucu

SEQ ID NO: 2537535 - RNA, 14 nt, Chlamydophila pneumoniae CWL029
uaccaccuaaaaug

SEQ ID NO: 2537536 - RNA, 16 nt, Chlamydophila pneumoniae CWL029
uaccaccuaaaaugca

SEQ ID NO: 2537537 - RNA, 17 nt, Chlamydophila pneumoniae CWL029
uaccaucgucuccaaaa

SEQ ID NO: 2537538 - RNA, 16 nt, Chlamydophila pneumoniae CWL029
uacccaaagaggggag

SEQ ID NO: 2537539 - RNA, 17 nt, Chlamydophila pneumoniae CWL029
uacccaucuagaaacau

SEQ ID NO: 2537540 - RNA, 22 nt, Chlamydophila pneumoniae CWL029
uacccucggagacucagagaaa

SEQ ID NO: 2537541 - RNA, 19 nt, Chlamydophila pneumoniae CWL029
uacccuucagaauucucaa

SEQ ID NO: 2537542 - RNA, 19 nt, Chlamydophila pneumoniae CWL029
uacccuuccggggugcgac

SEQ ID NO: 2537543 - RNA, 14 nt, Chlamydophila pneumoniae CWL029
uacccuucuucuuc

SEQ ID NO: 2537544 - RNA, 17 nt, Chlamydophila pneumoniae CWL029
uaccgacaagcaucauu

SEQ ID NO: 2537545 - RNA, 16 nt, Chlamydophila pneumoniae CWL029
uaccgaccgaaucucu

SEQ ID NO: 2537546 - RNA, 14 nt, Chlamydophila pneumoniae CWL029
uaccgcuguuuuau

SEQ ID NO: 2537547 - RNA, 14 nt, Chlamydophila pneumoniae CWL029
uaccguuuccuccu

SEQ ID NO: 2537548 - RNA, 15 nt, Chlamydophila pneumoniae CWL029
uaccguuuccuccuc

SEQ ID NO: 2537549 - RNA, 19 nt, Chlamydophila pneumoniae CWL029
uaccuagggucuucucgag

SEQ ID NO: 2537550 - RNA, 22 nt, Chlamydophila pneumoniae CWL029
uaccuaguagagguugagugaa

SEQ ID NO: 2537551 - RNA, 18 nt, Chlamydophila pneumoniae CWL029
uaccuauugugcuuuucu

SEQ ID NO: 2537552 - RNA, 21 nt, Chlamydophila pneumoniae CWL029
uaccuauugugcuuuucucuu

SEQ ID NO: 2537553 - RNA, 21 nt, Chlamydophila pneumoniae CWL029
uaccucaucucuggaauacau

SEQ ID NO: 2537554 - RNA, 19 nt, Chlamydophila pneumoniae CWL029
uaccugcauucauaaaaau

SEQ ID NO: 2537555 - RNA, 15 nt, Chlamydophila pneumoniae CWL029
uaccugcuaaacuuu

SEQ ID NO: 2537556 - RNA, 20 nt, Chlamydophila pneumoniae CWL029
uaccuuaguuuuuucuaagg

SEQ ID NO: 2537557 - RNA, 14 nt, Chlamydophila pneumoniae CWL029
uaccuuaucgccaa

SEQ ID NO: 2537558 - RNA, 15 nt, Chlamydophila pneumoniae CWL029
uaccuuguuuuccug

SEQ ID NO: 2537559 - RNA, 15 nt, Chlamydophila pneumoniae CWL029
uaccuuucuaagaau

SEQ ID NO: 2537560 - RNA, 17 nt, Chlamydophila pneumoniae CWL029
uacgaaaacaucuguau

SEQ ID NO: 2537561 - RNA, 15 nt, Chlamydophila pneumoniae CWL029
uacgaacuaaaggaa

SEQ ID NO: 2537562 - RNA, 14 nt, Chlamydophila pneumoniae CWL029
uacgaauaaguuuu

SEQ ID NO: 2537563 - RNA, 19 nt, Chlamydophila pneumoniae CWL029
uacgaauccaaaaaagagc

SEQ ID NO: 2537564 - RNA, 13 nt, Chlamydophila pneumoniae CWL029
uacgacagaagua

SEQ ID NO: 2537565 - RNA, 19 nt, Chlamydophila pneumoniae CWL029
uacgaccaacuccucaaaa

SEQ ID NO: 2537566 - RNA, 18 nt, Chlamydophila pneumoniae CWL029
uacgacgaaguuagcuaa

SEQ ID NO: 2537567 - RNA, 18 nt, Chlamydophila pneumoniae CWL029
uacgagaucagauguaaa

SEQ ID NO: 2537568 - RNA, 20 nt, Chlamydophila pneumoniae CWL029
uacgauagccaucauaaaac

SEQ ID NO: 2537569 - RNA, 14 nt, Chlamydophila pneumoniae CWL029
uacgauccaucuca

SEQ ID NO: 2537570 - RNA, 17 nt, Chlamydophila pneumoniae CWL029
uacgaucugcuuugcau

SEQ ID NO: 2537571 - RNA, 13 nt, Chlamydophila pneumoniae CWL029
uacgauguuuucu

SEQ ID NO: 2537572 - RNA, 14 nt, Chlamydophila pneumoniae CWL029
uacgauguuuucuu

SEQ ID NO: 2537573 - RNA, 16 nt, Chlamydophila pneumoniae CWL029
uacgcaaguaaagaaa

SEQ ID NO: 2537574 - RNA, 20 nt, Chlamydophila pneumoniae CWL029
uacgcaaguaaagaaauucu

SEQ ID NO: 2537575 - RNA, 19 nt, Chlamydophila pneumoniae CWL029
uacgccgugccuauagaaa

SEQ ID NO: 2537576 - RNA, 23 nt, Chlamydophila pneumoniae CWL029
uacggaaaauacagccagcagaa

SEQ ID NO: 2537577 - RNA, 17 nt, Chlamydophila pneumoniae CWL029
uacggacaacaacagcu

SEQ ID NO: 2537578 - RNA, 18 nt, Chlamydophila pneumoniae CWL029
uacggauacguugguuca

SEQ ID NO: 2537579 - RNA, 20 nt, Chlamydophila pneumoniae CWL029
uacggaugggcacucuucca

SEQ ID NO: 2537580 - RNA, 21 nt, Chlamydophila pneumoniae CWL029
uacggaugggcacucuuccac

SEQ ID NO: 2537581 - RNA, 18 nt, Chlamydophila pneumoniae CWL029
uacggguaaccugaaagc

SEQ ID NO: 2537582 - RNA, 14 nt, Chlamydophila pneumoniae CWL029
uacgguuucuggga

SEQ ID NO: 2537583 - RNA, 18 nt, Chlamydophila pneumoniae CWL029
uacguaccguauccucua

SEQ ID NO: 2537584 - RNA, 22 nt, Chlamydophila pneumoniae CWL029
uacguccugaugccuuuuucuu

SEQ ID NO: 2537585 - RNA, 13 nt, Chlamydophila pneumoniae CWL029
uacguggcuucca

SEQ ID NO: 2537586 - RNA, 22 nt, Chlamydophila pneumoniae CWL029
uacguugguucaaauccagcca

SEQ ID NO: 2537587 - RNA, 12 nt, Chlamydophila pneumoniae CWL029
uacguuuucucu

SEQ ID NO: 2537588 - RNA, 14 nt, Chlamydophila pneumoniae CWL029
uacguuuuucccuu

SEQ ID NO: 2537589 - RNA, 23 nt, Chlamydophila pneumoniae CWL029
uacguuuuucccuuuaaaaguac

SEQ ID NO: 2537590 - RNA, 15 nt, Chlamydophila pneumoniae CWL029
uacguuuuuuuccuu

SEQ ID NO: 2537591 - RNA, 17 nt, Chlamydophila pneumoniae CWL029
uacuaaaaucucauuuc

SEQ ID NO: 2537592 - RNA, 16 nt, Chlamydophila pneumoniae CWL029
uacuaaaggugaaagu

SEQ ID NO: 2537593 - RNA, 20 nt, Chlamydophila pneumoniae CWL029
uacuaaaggugaaaguacag

SEQ ID NO: 2537594 - RNA, 15 nt, Chlamydophila pneumoniae CWL029
uacuacucucaucaa

SEQ ID NO: 2537595 - RNA, 12 nt, Chlamydophila pneumoniae CWL029
uacuaucgguuu

SEQ ID NO: 2537596 - RNA, 13 nt, Chlamydophila pneumoniae CWL029
uacucauauuuug

SEQ ID NO: 2537597 - RNA, 15 nt, Chlamydophila pneumoniae CWL029
uacuccauuggcaua

SEQ ID NO: 2537598 - RNA, 16 nt, Chlamydophila pneumoniae CWL029
uacuccgagcauuuua

SEQ ID NO: 2537599 - RNA, 19 nt, Chlamydophila pneumoniae CWL029
uacucgucaaauucauuaa

SEQ ID NO: 2537600 - RNA, 23 nt, Chlamydophila pneumoniae CWL029
uacucuacaguaguaaauaauaa

SEQ ID NO: 2537601 - RNA, 13 nt, Chlamydophila pneumoniae CWL029
uacucucugcuuc

SEQ ID NO: 2537602 - RNA, 16 nt, Chlamydophila pneumoniae CWL029
uacucuugcuugcuag

SEQ ID NO: 2537603 - RNA, 14 nt, Chlamydophila pneumoniae CWL029
uacucuuuaaaaau

SEQ ID NO: 2537604 - RNA, 17 nt, Chlamydophila pneumoniae CWL029
uacugaaaccuucucuc

SEQ ID NO: 2537605 - RNA, 19 nt, Chlamydophila pneumoniae CWL029
uacugaaucccguuaaaaa

SEQ ID NO: 2537606 - RNA, 19 nt, Chlamydophila pneumoniae CWL029
uacugagcuucuauuucua

SEQ ID NO: 2537607 - RNA, 18 nt, Chlamydophila pneumoniae CWL029
uacugaggaaaucgcauu

SEQ ID NO: 2537608 - RNA, 22 nt, Chlamydophila pneumoniae CWL029
uacugaggaaaucgcauuacaa

SEQ ID NO: 2537609 - RNA, 17 nt, Chlamydophila pneumoniae CWL029
uacugccagcgaucaca

SEQ ID NO: 2537610 - RNA, 19 nt, Chlamydophila pneumoniae CWL029
uacugcugcuaagccaaau

SEQ ID NO: 2537611 - RNA, 23 nt, Chlamydophila pneumoniae CWL029
uacuggagagguaaccagagagc

SEQ ID NO: 2537612 - RNA, 16 nt, Chlamydophila pneumoniae CWL029
uacuguagaguuuucu

SEQ ID NO: 2537613 - RNA, 22 nt, Chlamydophila pneumoniae CWL029
uacuguuaacaaguaccaagaa

SEQ ID NO: 2537614 - RNA, 13 nt, Chlamydophila pneumoniae CWL029
uacuguuuuucuu

SEQ ID NO: 2537615 - RNA, 14 nt, Chlamydophila pneumoniae CWL029
uacuuacaagaaca

SEQ ID NO: 2537616 - RNA, 20 nt, Chlamydophila pneumoniae CWL029
uacuuacaagaacaaggcuc

SEQ ID NO: 2537617 - RNA, 23 nt, Chlamydophila pneumoniae CWL029
uacuuacuaaaggugaaaguaca

SEQ ID NO: 2537618 - RNA, 18 nt, Chlamydophila pneumoniae CWL029
uacuuaggaauuuuucua

SEQ ID NO: 2537619 - RNA, 13 nt, Chlamydophila pneumoniae CWL029
uacuuauuguucu

SEQ ID NO: 2537620 - RNA, 19 nt, Chlamydophila pneumoniae CWL029
uacuucaagaaaaaccccu

SEQ ID NO: 2537621 - RNA, 20 nt, Chlamydophila pneumoniae CWL029
uacuucacguugcaauggcu

SEQ ID NO: 2537622 - RNA, 19 nt, Chlamydophila pneumoniae CWL029
uacuucacucuuucuguag

SEQ ID NO: 2537623 - RNA, 24 nt, Chlamydophila pneumoniae CWL029
uacuucuccacagcuucuucguaa

SEQ ID NO: 2537624 - RNA, 21 nt, Chlamydophila pneumoniae CWL029
uacuucuccucgcaauccagg

SEQ ID NO: 2537625 - RNA, 12 nt, Chlamydophila pneumoniae CWL029
uacuucuccuga

SEQ ID NO: 2537626 - RNA, 16 nt, Chlamydophila pneumoniae CWL029
uacuugggagaugcua

SEQ ID NO: 2537627 - RNA, 16 nt, Chlamydophila pneumoniae CWL029
uacuuuaaucaagccu

SEQ ID NO: 2537628 - RNA, 23 nt, Chlamydophila pneumoniae CWL029
uacuuuaggaggggggauucugu

SEQ ID NO: 2537629 - RNA, 22 nt, Chlamydophila pneumoniae CWL029
uacuuucugauugagaauaaaa

SEQ ID NO: 2537630 - RNA, 14 nt, Chlamydophila pneumoniae CWL029
uagaaaaagaucua

SEQ ID NO: 2537631 - RNA, 18 nt, Chlamydophila pneumoniae CWL029
uagaaaacgccaacugua

SEQ ID NO: 2537632 - RNA, 15 nt, Chlamydophila pneumoniae CWL029
uagaaaagacaucuc

SEQ ID NO: 2537633 - RNA, 18 nt, Chlamydophila pneumoniae CWL029
uagaaaagauaaaacauu

SEQ ID NO: 2537634 - RNA, 21 nt, Chlamydophila pneumoniae CWL029
uagaaaagauucuaaaucaac

SEQ ID NO: 2537635 - RNA, 20 nt, Chlamydophila pneumoniae CWL029
uagaaaaucauucaaauaua

SEQ ID NO: 2537636 - RNA, 18 nt, Chlamydophila pneumoniae CWL029
uagaaacaacugaaaaac

SEQ ID NO: 2537637 - RNA, 19 nt, Chlamydophila pneumoniae CWL029
uagaaacauuuaagucauu

SEQ ID NO: 2537638 - RNA, 18 nt, Chlamydophila pneumoniae CWL029
uagaaaccaugaugcaau

SEQ ID NO: 2537639 - RNA, 14 nt, Chlamydophila pneumoniae CWL029
uagaaacugcuccu

SEQ ID NO: 2537640 - RNA, 20 nt, Chlamydophila pneumoniae CWL029
uagaaagacauccuucuuua

SEQ ID NO: 2537641 - RNA, 12 nt, Chlamydophila pneumoniae CWL029
uagaaagaccau

SEQ ID NO: 2537642 - RNA, 13 nt, Chlamydophila pneumoniae CWL029
uagaaaggaaucc

SEQ ID NO: 2537643 - RNA, 20 nt, Chlamydophila pneumoniae CWL029
uagaaauaagcaucuagaau

SEQ ID NO: 2537644 - RNA, 15 nt, Chlamydophila pneumoniae CWL029
uagaaauauacucuu

SEQ ID NO: 2537645 - RNA, 16 nt, Chlamydophila pneumoniae CWL029
uagaaauauacucuug

SEQ ID NO: 2537646 - RNA, 21 nt, Chlamydophila pneumoniae CWL029
uagaaauauacucuugcuugc

SEQ ID NO: 2537647 - RNA, 23 nt, Chlamydophila pneumoniae CWL029
uagaaauauacucuugcuugcua

SEQ ID NO: 2537648 - RNA, 13 nt, Chlamydophila pneumoniae CWL029
uagaaaucucacu

SEQ ID NO: 2537649 - RNA, 14 nt, Chlamydophila pneumoniae CWL029
uagaaauuccaauu

SEQ ID NO: 2537650 - RNA, 15 nt, Chlamydophila pneumoniae CWL029
uagaacacucagaga

SEQ ID NO: 2537651 - RNA, 16 nt, Chlamydophila pneumoniae CWL029
uagaacacucagagau

SEQ ID NO: 2537652 - RNA, 23 nt, Chlamydophila pneumoniae CWL029
uagaacugcgaaggguuguugcc

SEQ ID NO: 2537653 - RNA, 15 nt, Chlamydophila pneumoniae CWL029
uagaacuugggaugc

SEQ ID NO: 2537654 - RNA, 19 nt, Chlamydophila pneumoniae CWL029
uagaacuugggaugcuacu

SEQ ID NO: 2537655 - RNA, 12 nt, Chlamydophila pneumoniae CWL029
uagaagacauuc

SEQ ID NO: 2537656 - RNA, 18 nt, Chlamydophila pneumoniae CWL029
uagaagccaccaucuguu

SEQ ID NO: 2537657 - RNA, 14 nt, Chlamydophila pneumoniae CWL029
uagaagcccgcagu

SEQ ID NO: 2537658 - RNA, 12 nt, Chlamydophila pneumoniae CWL029
uagaagcugcug

SEQ ID NO: 2537659 - RNA, 15 nt, Chlamydophila pneumoniae CWL029
uagaagcugcugcua

SEQ ID NO: 2537660 - RNA, 18 nt, Chlamydophila pneumoniae CWL029
uagaaggggguucuaaga

SEQ ID NO: 2537661 - RNA, 14 nt, Chlamydophila pneumoniae CWL029
uagaauaaagauuu

SEQ ID NO: 2537662 - RNA, 16 nt, Chlamydophila pneumoniae CWL029
uagaauacacagcuau

SEQ ID NO: 2537663 - RNA, 15 nt, Chlamydophila pneumoniae CWL029
uagaaucacauaaaa

SEQ ID NO: 2537664 - RNA, 23 nt, Chlamydophila pneumoniae CWL029
uagaaucagagggacuccuguga

SEQ ID NO: 2537665 - RNA, 15 nt, Chlamydophila pneumoniae CWL029
uagaauccaaagacu

SEQ ID NO: 2537666 - RNA, 22 nt, Chlamydophila pneumoniae CWL029
uagaauccucggaagauaaauc

SEQ ID NO: 2537667 - RNA, 16 nt, Chlamydophila pneumoniae CWL029
uagaauccugaucugu

SEQ ID NO: 2537668 - RNA, 14 nt, Chlamydophila pneumoniae CWL029
uagaauccuucucc

SEQ ID NO: 2537669 - RNA, 21 nt, Chlamydophila pneumoniae CWL029
uagaaucucugcccccuguuu

SEQ ID NO: 2537670 - RNA, 16 nt, Chlamydophila pneumoniae CWL029
uagaaucucugugcca

SEQ ID NO: 2537671 - RNA, 13 nt, Chlamydophila pneumoniae CWL029
uagaaugaugcaa

SEQ ID NO: 2537672 - RNA, 15 nt, Chlamydophila pneumoniae CWL029
uagaaugaugcaagc

SEQ ID NO: 2537673 - RNA, 12 nt, Chlamydophila pneumoniae CWL029
uagaauuuucuu

SEQ ID NO: 2537674 - RNA, 21 nt, Chlamydophila pneumoniae CWL029
uagacaacaagucuucccucu

SEQ ID NO: 2537675 - RNA, 16 nt, Chlamydophila pneumoniae CWL029
uagacaagagagagcu

SEQ ID NO: 2537676 - RNA, 19 nt, Chlamydophila pneumoniae CWL029
uagacaauaccagauaaag

SEQ ID NO: 2537677 - RNA, 23 nt, Chlamydophila pneumoniae CWL029
uagacacgaccacuacuuaaagc

SEQ ID NO: 2537678 - RNA, 19 nt, Chlamydophila pneumoniae CWL029
uagaccaauaaauccaaaa

SEQ ID NO: 2537679 - RNA, 20 nt, Chlamydophila pneumoniae CWL029
uagaccccccauuccaaagc

SEQ ID NO: 2537680 - RNA, 22 nt, Chlamydophila pneumoniae CWL029
uagaccggaucccguaaaagaa

SEQ ID NO: 2537681 - RNA, 17 nt, Chlamydophila pneumoniae CWL029
uagacgaggagaagucg

SEQ ID NO: 2537682 - RNA, 18 nt, Chlamydophila pneumoniae CWL029
uagacgugcucucuucuu

SEQ ID NO: 2537683 - RNA, 23 nt, Chlamydophila pneumoniae CWL029
uagagaaagagugccaagagcau

SEQ ID NO: 2537684 - RNA, 12 nt, Chlamydophila pneumoniae CWL029
uagagaaauuuu

SEQ ID NO: 2537685 - RNA, 22 nt, Chlamydophila pneumoniae CWL029
uagagaaauuuuuaauuuuucu

SEQ ID NO: 2537686 - RNA, 16 nt, Chlamydophila pneumoniae CWL029
uagagaagauuucuau

SEQ ID NO: 2537687 - RNA, 20 nt, Chlamydophila pneumoniae CWL029
uagagacagccuguuuucuu

SEQ ID NO: 2537688 - RNA, 13 nt, Chlamydophila pneumoniae CWL029
uagagacaucgua

SEQ ID NO: 2537689 - RNA, 14 nt, Chlamydophila pneumoniae CWL029
uagagacaucguau

SEQ ID NO: 2537690 - RNA, 19 nt, Chlamydophila pneumoniae CWL029
uagagagaaggaauuaaaa

SEQ ID NO: 2537691 - RNA, 16 nt, Chlamydophila pneumoniae CWL029
uagagagaaugacuuu

SEQ ID NO: 2537692 - RNA, 13 nt, Chlamydophila pneumoniae CWL029
uagagagaaugcc

SEQ ID NO: 2537693 - RNA, 23 nt, Chlamydophila pneumoniae CWL029
uagagagagucggcuuuagaaaa

SEQ ID NO: 2537694 - RNA, 15 nt, Chlamydophila pneumoniae CWL029
uagagagccuuuccu

SEQ ID NO: 2537695 - RNA, 17 nt, Chlamydophila pneumoniae CWL029
uagagagcgcagagucu

SEQ ID NO: 2537696 - RNA, 16 nt, Chlamydophila pneumoniae CWL029
uagagauaucaucaaa

SEQ ID NO: 2537697 - RNA, 17 nt, Chlamydophila pneumoniae CWL029
uagagauccaaugacaa

SEQ ID NO: 2537698 - RNA, 18 nt, Chlamydophila pneumoniae CWL029
uagagauuguaauuuccu

SEQ ID NO: 2537699 - RNA, 19 nt, Chlamydophila pneumoniae CWL029
uagagauuuuucuaggaau

SEQ ID NO: 2537700 - RNA, 23 nt, Chlamydophila pneumoniae CWL029
uagagauuuuucuaggaaucuuu

SEQ ID NO: 2537701 - RNA, 19 nt, Chlamydophila pneumoniae CWL029
uagagcaagauucuucaga

SEQ ID NO: 2537702 - RNA, 18 nt, Chlamydophila pneumoniae CWL029
uagagcacauagaaacag

SEQ ID NO: 2537703 - RNA, 19 nt, Chlamydophila pneumoniae CWL029
uagagcacauagaaacagu

SEQ ID NO: 2537704 - RNA, 17 nt, Chlamydophila pneumoniae CWL029
uagagccucuaagaaaa

SEQ ID NO: 2537705 - RNA, 17 nt, Chlamydophila pneumoniae CWL029
uagagcgaauguagcca

SEQ ID NO: 2537706 - RNA, 21 nt, Chlamydophila pneumoniae CWL029
uagagcgcccgaaucuuucaa

SEQ ID NO: 2537707 - RNA, 12 nt, Chlamydophila pneumoniae CWL029
uagagcuagaau

SEQ ID NO: 2537708 - RNA, 19 nt, Chlamydophila pneumoniae CWL029
uagagcuucaaguuucuuu

SEQ ID NO: 2537709 - RNA, 15 nt, Chlamydophila pneumoniae CWL029
uagagcuucuuuauc

SEQ ID NO: 2537710 - RNA, 23 nt, Chlamydophila pneumoniae CWL029
uagaggacucccucaaaauuuaa

SEQ ID NO: 2537711 - RNA, 23 nt, Chlamydophila pneumoniae CWL029
uagaggagacucuaguuuuucuu

SEQ ID NO: 2537712 - RNA, 14 nt, Chlamydophila pneumoniae CWL029
uagaggaucuucaa

SEQ ID NO: 2537713 - RNA, 20 nt, Chlamydophila pneumoniae CWL029
uagaguacacagcacaagaa

SEQ ID NO: 2537714 - RNA, 20 nt, Chlamydophila pneumoniae CWL029
uagaguccaagguucuggga

SEQ ID NO: 2537715 - RNA, 15 nt, Chlamydophila pneumoniae CWL029
uagaguccacaguca

SEQ ID NO: 2537716 - RNA, 16 nt, Chlamydophila pneumoniae CWL029
uagagucgauaaaaac

SEQ ID NO: 2537717 - RNA, 14 nt, Chlamydophila pneumoniae CWL029
uagagucucuuuca

SEQ ID NO: 2537718 - RNA, 22 nt, Chlamydophila pneumoniae CWL029
uagagucuucgacaaggaagcc

SEQ ID NO: 2537719 - RNA, 16 nt, Chlamydophila pneumoniae CWL029
uagagugacucaucag

SEQ ID NO: 2537720 - RNA, 16 nt, Chlamydophila pneumoniae CWL029
uagagugucuuccuug

SEQ ID NO: 2537721 - RNA, 16 nt, Chlamydophila pneumoniae CWL029
uagaguugcuuuaugg

SEQ ID NO: 2537722 - RNA, 14 nt, Chlamydophila pneumoniae CWL029
uagauaagaucucu

SEQ ID NO: 2537723 - RNA, 13 nt, Chlamydophila pneumoniae CWL029
uagauaugccuca

SEQ ID NO: 2537724 - RNA, 13 nt, Chlamydophila pneumoniae CWL029
uagaucacaagaa

SEQ ID NO: 2537725 - RNA, 17 nt, Chlamydophila pneumoniae CWL029
uagaucacaagaaagaa

SEQ ID NO: 2537726 - RNA, 13 nt, Chlamydophila pneumoniae CWL029
uagaucacaucaa

SEQ ID NO: 2537727 - RNA, 21 nt, Chlamydophila pneumoniae CWL029
uagauccccuucauucuuucg

SEQ ID NO: 2537728 - RNA, 19 nt, Chlamydophila pneumoniae CWL029
uagauccuauaguaauuuc

SEQ ID NO: 2537729 - RNA, 15 nt, Chlamydophila pneumoniae CWL029
uagaucuucugaaau

SEQ ID NO: 2537730 - RNA, 18 nt, Chlamydophila pneumoniae CWL029
uagaucuucugaaaucaa

SEQ ID NO: 2537731 - RNA, 14 nt, Chlamydophila pneumoniae CWL029
uagaucuugaaaag

SEQ ID NO: 2537732 - RNA, 13 nt, Chlamydophila pneumoniae CWL029
uagaugucaguau

SEQ ID NO: 2537733 - RNA, 14 nt, Chlamydophila pneumoniae CWL029
uagauuaggaagau

SEQ ID NO: 2537734 - RNA, 15 nt, Chlamydophila pneumoniae CWL029
uagauuccccaaacu

SEQ ID NO: 2537735 - RNA, 21 nt, Chlamydophila pneumoniae CWL029
uagauucguuauccucgucuu

SEQ ID NO: 2537736 - RNA, 14 nt, Chlamydophila pneumoniae CWL029
uagauuguuaguga

SEQ ID NO: 2537737 - RNA, 17 nt, Chlamydophila pneumoniae CWL029
uagauuguuagugagau

SEQ ID NO: 2537738 - RNA, 17 nt, Chlamydophila pneumoniae CWL029
uagauuuguuagagcuu

SEQ ID NO: 2537739 - RNA, 13 nt, Chlamydophila pneumoniae CWL029
uagauuuuuacuu

SEQ ID NO: 2537740 - RNA, 19 nt, Chlamydophila pneumoniae CWL029
uagauuuuuacuugcccaa

SEQ ID NO: 2537741 - RNA, 18 nt, Chlamydophila pneumoniae CWL029
uagauuuuucuuuuagag

SEQ ID NO: 2537742 - RNA, 24 nt, Chlamydophila pneumoniae CWL029
uagauuuuucuuuuagagaaaucu

SEQ ID NO: 2537743 - RNA, 17 nt, Chlamydophila pneumoniae CWL029
uagcaaacggaacuaaa

SEQ ID NO: 2537744 - RNA, 20 nt, Chlamydophila pneumoniae CWL029
uagcaaacggaacuaaagag

SEQ ID NO: 2537745 - RNA, 14 nt, Chlamydophila pneumoniae CWL029
uagcaaagacaucu

SEQ ID NO: 2537746 - RNA, 16 nt, Chlamydophila pneumoniae CWL029
uagcaagcgcuagugc

SEQ ID NO: 2537747 - RNA, 17 nt, Chlamydophila pneumoniae CWL029
uagcaagcgcuagugca

SEQ ID NO: 2537748 - RNA, 18 nt, Chlamydophila pneumoniae CWL029
uagcaauucgguagagcu

SEQ ID NO: 2537749 - RNA, 22 nt, Chlamydophila pneumoniae CWL029
uagcaauucgguagagcuagaa

SEQ ID NO: 2537750 - RNA, 22 nt, Chlamydophila pneumoniae CWL029
uagcagaaguccuaucaaagca

SEQ ID NO: 2537751 - RNA, 13 nt, Chlamydophila pneumoniae CWL029
uagcagagccuca

SEQ ID NO: 2537752 - RNA, 21 nt, Chlamydophila pneumoniae CWL029
uagcagcccgcacaucaugcu

SEQ ID NO: 2537753 - RNA, 16 nt, Chlamydophila pneumoniae CWL029
uagcaggaguuuucaa

SEQ ID NO: 2537754 - RNA, 22 nt, Chlamydophila pneumoniae CWL029
uagcagggggccugccaugaau

SEQ ID NO: 2537755 - RNA, 20 nt, Chlamydophila pneumoniae CWL029
uagcaguauagagaagauuu

SEQ ID NO: 2537756 - RNA, 18 nt, Chlamydophila pneumoniae CWL029
uagcauagagcucuaaaa

SEQ ID NO: 2537757 - RNA, 16 nt, Chlamydophila pneumoniae CWL029
uagcauaggcuaagac

SEQ ID NO: 2537758 - RNA, 14 nt, Chlamydophila pneumoniae CWL029
uagcaucaucuccu

SEQ ID NO: 2537759 - RNA, 21 nt, Chlamydophila pneumoniae CWL029
uagcaucaucuccugaagcca

SEQ ID NO: 2537760 - RNA, 20 nt, Chlamydophila pneumoniae CWL029
uagcaucccuucuucuuuua

SEQ ID NO: 2537761 - RNA, 14 nt, Chlamydophila pneumoniae CWL029
uagcaucucucucc

SEQ ID NO: 2537762 - RNA, 19 nt, Chlamydophila pneumoniae CWL029
uagcauguucgauuuucuc

SEQ ID NO: 2537763 - RNA, 14 nt, Chlamydophila pneumoniae CWL029
uagcauugcuugcg

SEQ ID NO: 2537764 - RNA, 15 nt, Chlamydophila pneumoniae CWL029
uagcauuucuuucuc

SEQ ID NO: 2537765 - RNA, 17 nt, Chlamydophila pneumoniae CWL029
uagcauuucuuucucuu

SEQ ID NO: 2537766 - RNA, 19 nt, Chlamydophila pneumoniae CWL029
uagcauuucuuucucuucg

SEQ ID NO: 2537767 - RNA, 13 nt, Chlamydophila pneumoniae CWL029
uagccaaagacuc

SEQ ID NO: 2537768 - RNA, 20 nt, Chlamydophila pneumoniae CWL029
uagccaauauagaagcugcu

SEQ ID NO: 2537769 - RNA, 23 nt, Chlamydophila pneumoniae CWL029
uagccaauauagaagcugcugcu

SEQ ID NO: 2537770 - RNA, 18 nt, Chlamydophila pneumoniae CWL029
uagccaucauagcaaacg

SEQ ID NO: 2537771 - RNA, 23 nt, Chlamydophila pneumoniae CWL029
uagccauggcaucuaagccagag

SEQ ID NO: 2537772 - RNA, 19 nt, Chlamydophila pneumoniae CWL029
uagccauuagaaucucugc

SEQ ID NO: 2537773 - RNA, 13 nt, Chlamydophila pneumoniae CWL029
uagccccauagag

SEQ ID NO: 2537774 - RNA, 18 nt, Chlamydophila pneumoniae CWL029
uagcccgaaauucauuaa

SEQ ID NO: 2537775 - RNA, 23 nt, Chlamydophila pneumoniae CWL029
uagcccuagaguaaagaguagcc

SEQ ID NO: 2537776 - RNA, 19 nt, Chlamydophila pneumoniae CWL029
uagccgacaugcuuuccuu

SEQ ID NO: 2537777 - RNA, 22 nt, Chlamydophila pneumoniae CWL029
uagccguaggguagccauccac

SEQ ID NO: 2537778 - RNA, 14 nt, Chlamydophila pneumoniae CWL029
uagccuuucuuuuu

SEQ ID NO: 2537779 - RNA, 14 nt, Chlamydophila pneumoniae CWL029
uagcgaaagucaaa

SEQ ID NO: 2537780 - RNA, 14 nt, Chlamydophila pneumoniae CWL029
uagcgacaugagaa

SEQ ID NO: 2537781 - RNA, 17 nt, Chlamydophila pneumoniae CWL029
uagcgacaugagaaauc

SEQ ID NO: 2537782 - RNA, 23 nt, Chlamydophila pneumoniae CWL029
uagcgaucucucuuccugcugcu

SEQ ID NO: 2537783 - RNA, 16 nt, Chlamydophila pneumoniae CWL029
uagcgcggucacuuca

SEQ ID NO: 2537784 - RNA, 20 nt, Chlamydophila pneumoniae CWL029
uagcgcuuccagcuucuccc

SEQ ID NO: 2537785 - RNA, 14 nt, Chlamydophila pneumoniae CWL029
uagcgucucuucuu

SEQ ID NO: 2537786 - RNA, 20 nt, Chlamydophila pneumoniae CWL029
uagcuaaaccuucagauccg

SEQ ID NO: 2537787 - RNA, 13 nt, Chlamydophila pneumoniae CWL029
uagcuaagagcau

SEQ ID NO: 2537788 - RNA, 15 nt, Chlamydophila pneumoniae CWL029
uagcuacaagucccc

SEQ ID NO: 2537789 - RNA, 22 nt, Chlamydophila pneumoniae CWL029
uagcuacggagagguuauguac

SEQ ID NO: 2537790 - RNA, 22 nt, Chlamydophila pneumoniae CWL029
uagcuagcguuuguaucacccg

SEQ ID NO: 2537791 - RNA, 17 nt, Chlamydophila pneumoniae CWL029
uagcuaugaguugcuug

SEQ ID NO: 2537792 - RNA, 15 nt, Chlamydophila pneumoniae CWL029
uagcuauucucaaau

SEQ ID NO: 2537793 - RNA, 16 nt, Chlamydophila pneumoniae CWL029
uagcuauuuuugagga

SEQ ID NO: 2537794 - RNA, 18 nt, Chlamydophila pneumoniae CWL029
uagcucaaaucucauucc

SEQ ID NO: 2537795 - RNA, 22 nt, Chlamydophila pneumoniae CWL029
uagcucagcucuaauucuucua

SEQ ID NO: 2537796 - RNA, 16 nt, Chlamydophila pneumoniae CWL029
uagcucaggaaaacuu

SEQ ID NO: 2537797 - RNA, 19 nt, Chlamydophila pneumoniae CWL029
uagcucaggaaaacuuaau

SEQ ID NO: 2537798 - RNA, 18 nt, Chlamydophila pneumoniae CWL029
uagcucauuaucaagaaa

SEQ ID NO: 2537799 - RNA, 20 nt, Chlamydophila pneumoniae CWL029
uagcucauuaucaagaaauu

SEQ ID NO: 2537800 - RNA, 16 nt, Chlamydophila pneumoniae CWL029
uagcucccguuccuuu

SEQ ID NO: 2537801 - RNA, 19 nt, Chlamydophila pneumoniae CWL029
uagcucguuauauuuuucu

SEQ ID NO: 2537802 - RNA, 13 nt, Chlamydophila pneumoniae CWL029
uagcucuggagau

SEQ ID NO: 2537803 - RNA, 22 nt, Chlamydophila pneumoniae CWL029
uagcucuugcgaacuauccuaa

SEQ ID NO: 2537804 - RNA, 18 nt, Chlamydophila pneumoniae CWL029
uagcugcucuuuuagaau

SEQ ID NO: 2537805 - RNA, 18 nt, Chlamydophila pneumoniae CWL029
uagcuuacagagaaauuu

SEQ ID NO: 2537806 - RNA, 15 nt, Chlamydophila pneumoniae CWL029
uagcuuacuuucuuu

SEQ ID NO: 2537807 - RNA, 17 nt, Chlamydophila pneumoniae CWL029
uagcuuacuuucuuuua

SEQ ID NO: 2537808 - RNA, 18 nt, Chlamydophila pneumoniae CWL029
uagcuuuuaguuucccac

SEQ ID NO: 2537809 - RNA, 16 nt, Chlamydophila pneumoniae CWL029
uagcuuuuuuuaugau

SEQ ID NO: 2537810 - RNA, 22 nt, Chlamydophila pneumoniae CWL029
uaggaaaagcauagucgucuuu

SEQ ID NO: 2537811 - RNA, 15 nt, Chlamydophila pneumoniae CWL029
uaggaacaaagccaa

SEQ ID NO: 2537812 - RNA, 16 nt, Chlamydophila pneumoniae CWL029
uaggaacaaagcucuc

SEQ ID NO: 2537813 - RNA, 18 nt, Chlamydophila pneumoniae CWL029
uaggaacuugaauaccaa

SEQ ID NO: 2537814 - RNA, 14 nt, Chlamydophila pneumoniae CWL029
uaggaagaugaaua

SEQ ID NO: 2537815 - RNA, 18 nt, Chlamydophila pneumoniae CWL029
uaggaagcucuucuacuu

SEQ ID NO: 2537816 - RNA, 13 nt, Chlamydophila pneumoniae CWL029
uaggaaucuuuua

SEQ ID NO: 2537817 - RNA, 18 nt, Chlamydophila pneumoniae CWL029
uaggaaugauaaugcagg

SEQ ID NO: 2537818 - RNA, 17 nt, Chlamydophila pneumoniae CWL029
uaggaauugcuguucca

SEQ ID NO: 2537819 - RNA, 18 nt, Chlamydophila pneumoniae CWL029
uaggacagcacauagagu

SEQ ID NO: 2537820 - RNA, 22 nt, Chlamydophila pneumoniae CWL029
uaggaccuacugggaaaucuaa

SEQ ID NO: 2537821 - RNA, 16 nt, Chlamydophila pneumoniae CWL029
uaggagcauagacucu

SEQ ID NO: 2537822 - RNA, 21 nt, Chlamydophila pneumoniae CWL029
uaggauagaggccuuuuagag

SEQ ID NO: 2537823 - RNA, 13 nt, Chlamydophila pneumoniae CWL029
uaggauaucauau

SEQ ID NO: 2537824 - RNA, 14 nt, Chlamydophila pneumoniae CWL029
uaggauccaggagu

SEQ ID NO: 2537825 - RNA, 12 nt, Chlamydophila pneumoniae CWL029
uaggauucggac

SEQ ID NO: 2537826 - RNA, 12 nt, Chlamydophila pneumoniae CWL029
uaggauuugcau

SEQ ID NO: 2537827 - RNA, 22 nt, Chlamydophila pneumoniae CWL029
uaggcauacaguagaaacaugg

SEQ ID NO: 2537828 - RNA, 19 nt, Chlamydophila pneumoniae CWL029
uaggcgaugcaaauuccag

SEQ ID NO: 2537829 - RNA, 19 nt, Chlamydophila pneumoniae CWL029
uaggcucuuuagcaaacau

SEQ ID NO: 2537830 - RNA, 17 nt, Chlamydophila pneumoniae CWL029
uaggcuuaauaaacauc

SEQ ID NO: 2537831 - RNA, 22 nt, Chlamydophila pneumoniae CWL029
uagggaaagcaucuuucaucaa

SEQ ID NO: 2537832 - RNA, 15 nt, Chlamydophila pneumoniae CWL029
uagggaauuucggac

SEQ ID NO: 2537833 - RNA, 21 nt, Chlamydophila pneumoniae CWL029
uagggaauuuuuucuguuccu

SEQ ID NO: 2537834 - RNA, 18 nt, Chlamydophila pneumoniae CWL029
uagggagaucuuauagac

SEQ ID NO: 2537835 - RNA, 23 nt, Chlamydophila pneumoniae CWL029
uagggagugaggaaucauaacca

SEQ ID NO: 2537836 - RNA, 18 nt, Chlamydophila pneumoniae CWL029
uagggcaggcggaaagga

SEQ ID NO: 2537837 - RNA, 21 nt, Chlamydophila pneumoniae CWL029
uagggcaggcggaaaggaagg

SEQ ID NO: 2537838 - RNA, 16 nt, Chlamydophila pneumoniae CWL029
uagggcauucuguaau

SEQ ID NO: 2537839 - RNA, 23 nt, Chlamydophila pneumoniae CWL029
uaggggaauuaaacuuucuucuc

SEQ ID NO: 2537840 - RNA, 14 nt, Chlamydophila pneumoniae CWL029
uagggguuucccug

SEQ ID NO: 2537841 - RNA, 15 nt, Chlamydophila pneumoniae CWL029
uaggguaaagaaaua

SEQ ID NO: 2537842 - RNA, 16 nt, Chlamydophila pneumoniae CWL029
uaggguagccauccac

SEQ ID NO: 2537843 - RNA, 21 nt, Chlamydophila pneumoniae CWL029
uaggguuugcaugccuauuaa

SEQ ID NO: 2537844 - RNA, 24 nt, Chlamydophila pneumoniae CWL029
uagguaaggaaacgauuucuucuu

SEQ ID NO: 2537845 - RNA, 14 nt, Chlamydophila pneumoniae CWL029
uagguagagaaucc

SEQ ID NO: 2537846 - RNA, 18 nt, Chlamydophila pneumoniae CWL029
uagguagguuguuguuga

SEQ ID NO: 2537847 - RNA, 12 nt, Chlamydophila pneumoniae CWL029
uaggucuugucu

SEQ ID NO: 2537848 - RNA, 21 nt, Chlamydophila pneumoniae CWL029
uaggucuugucuauucucuuc

SEQ ID NO: 2537849 - RNA, 20 nt, Chlamydophila pneumoniae CWL029
uaggugaaauauugaucuuu

SEQ ID NO: 2537850 - RNA, 16 nt, Chlamydophila pneumoniae CWL029
uaggugacccacgcau

SEQ ID NO: 2537851 - RNA, 12 nt, Chlamydophila pneumoniae CWL029
uagguucuuuuc

SEQ ID NO: 2537852 - RNA, 23 nt, Chlamydophila pneumoniae CWL029
uagguucuuuucggaucagaaug

SEQ ID NO: 2537853 - RNA, 18 nt, Chlamydophila pneumoniae CWL029
uagguuguuguugaggaa

SEQ ID NO: 2537854 - RNA, 16 nt, Chlamydophila pneumoniae CWL029
uagguuucaauagaag

SEQ ID NO: 2537855 - RNA, 12 nt, Chlamydophila pneumoniae CWL029
uaguaaagaauc

SEQ ID NO: 2537856 - RNA, 21 nt, Chlamydophila pneumoniae CWL029
uaguaaagccacauucuucug

SEQ ID NO: 2537857 - RNA, 14 nt, Chlamydophila pneumoniae CWL029
uaguaacuaaauuc

SEQ ID NO: 2537858 - RNA, 22 nt, Chlamydophila pneumoniae CWL029
uaguaucgagcucuuuaagaac

SEQ ID NO: 2537859 - RNA, 23 nt, Chlamydophila pneumoniae CWL029
uaguauggcauucuuuuucuauu

SEQ ID NO: 2537860 - RNA, 13 nt, Chlamydophila pneumoniae CWL029
uaguauuuuuaaa

SEQ ID NO: 2537861 - RNA, 16 nt, Chlamydophila pneumoniae CWL029
uaguauuuuuaaauac

SEQ ID NO: 2537862 - RNA, 20 nt, Chlamydophila pneumoniae CWL029
uaguauuuuuaaauacagau

SEQ ID NO: 2537863 - RNA, 15 nt, Chlamydophila pneumoniae CWL029
uagucaaaaauucuu

SEQ ID NO: 2537864 - RNA, 16 nt, Chlamydophila pneumoniae CWL029
uagucaauguauucuc

SEQ ID NO: 2537865 - RNA, 23 nt, Chlamydophila pneumoniae CWL029
uagucaugauuuuucaaucaaua

SEQ ID NO: 2537866 - RNA, 15 nt, Chlamydophila pneumoniae CWL029
uaguccuuauuucaa

SEQ ID NO: 2537867 - RNA, 18 nt, Chlamydophila pneumoniae CWL029
uagucuggcauaagucac

SEQ ID NO: 2537868 - RNA, 14 nt, Chlamydophila pneumoniae CWL029
uagucuucuuagaa

SEQ ID NO: 2537869 - RNA, 21 nt, Chlamydophila pneumoniae CWL029
uagucuucuuagaaagacuag

SEQ ID NO: 2537870 - RNA, 15 nt, Chlamydophila pneumoniae CWL029
uagucuuucaaccuc

SEQ ID NO: 2537871 - RNA, 15 nt, Chlamydophila pneumoniae CWL029
uagucuuucuaagaa

SEQ ID NO: 2537872 - RNA, 22 nt, Chlamydophila pneumoniae CWL029
uagugaacacucucuaccauca

SEQ ID NO: 2537873 - RNA, 21 nt, Chlamydophila pneumoniae CWL029
uagugaacuuuuguacacaga

SEQ ID NO: 2537874 - RNA, 21 nt, Chlamydophila pneumoniae CWL029
uagugaagcugcuucuucaga

SEQ ID NO: 2537875 - RNA, 21 nt, Chlamydophila pneumoniae CWL029
uagugaaugagcuucacaucu

SEQ ID NO: 2537876 - RNA, 16 nt, Chlamydophila pneumoniae CWL029
uagugagauagucuug

SEQ ID NO: 2537877 - RNA, 19 nt, Chlamydophila pneumoniae CWL029
uagugauacuuuagaaucc

SEQ ID NO: 2537878 - RNA, 17 nt, Chlamydophila pneumoniae CWL029
uaguggucaucucguug

SEQ ID NO: 2537879 - RNA, 21 nt, Chlamydophila pneumoniae CWL029
uagugucaucggcuucuccaa

SEQ ID NO: 2537880 - RNA, 21 nt, Chlamydophila pneumoniae CWL029
uaguguucgagcaucucaaga

SEQ ID NO: 2537881 - RNA, 22 nt, Chlamydophila pneumoniae CWL029
uaguguuucuuuaucuaaccaa

SEQ ID NO: 2537882 - RNA, 15 nt, Chlamydophila pneumoniae CWL029
uaguuagcauugcuu

SEQ ID NO: 2537883 - RNA, 20 nt, Chlamydophila pneumoniae CWL029
uaguucaucauauuuuucuu

SEQ ID NO: 2537884 - RNA, 12 nt, Chlamydophila pneumoniae CWL029
uaguucauuagc

SEQ ID NO: 2537885 - RNA, 21 nt, Chlamydophila pneumoniae CWL029
uaguucauuagcuaaaucaaa

SEQ ID NO: 2537886 - RNA, 17 nt, Chlamydophila pneumoniae CWL029
uaguucguucaucuguc

SEQ ID NO: 2537887 - RNA, 22 nt, Chlamydophila pneumoniae CWL029
uaguucguucaucugucauuaa

SEQ ID NO: 2537888 - RNA, 23 nt, Chlamydophila pneumoniae CWL029
uaguucucuaagacuguguuuua

SEQ ID NO: 2537889 - RNA, 11 nt, Chlamydophila pneumoniae CWL029
uaguucuucuu

SEQ ID NO: 2537890 - RNA, 15 nt, Chlamydophila pneumoniae CWL029
uaguucuucuuuacu

SEQ ID NO: 2537891 - RNA, 18 nt, Chlamydophila pneumoniae CWL029
uaguugcaugacuauuuu

SEQ ID NO: 2537892 - RNA, 21 nt, Chlamydophila pneumoniae CWL029
uaguugcaugacuauuuucau

SEQ ID NO: 2537893 - RNA, 12 nt, Chlamydophila pneumoniae CWL029
uaguuguaauuu

SEQ ID NO: 2537894 - RNA, 16 nt, Chlamydophila pneumoniae CWL029
uaguuguccuuuauaa

SEQ ID NO: 2537895 - RNA, 18 nt, Chlamydophila pneumoniae CWL029
uaguugugagacuuucug

SEQ ID NO: 2537896 - RNA, 22 nt, Chlamydophila pneumoniae CWL029
uaguuugccuucuuaucuucua

SEQ ID NO: 2537897 - RNA, 11 nt, Chlamydophila pneumoniae CWL029
uaguuuucaua

SEQ ID NO: 2537898 - RNA, 17 nt, Chlamydophila pneumoniae CWL029
uaguuuuuauuuuuaaa

SEQ ID NO: 2537899 - RNA, 18 nt, Chlamydophila pneumoniae CWL029
uaguuuuuauuuuuaaau

SEQ ID NO: 2537900 - RNA, 20 nt, Chlamydophila pneumoniae CWL029
uaguuuuuauuuuuaaauaa

SEQ ID NO: 2537901 - RNA, 21 nt, Chlamydophila pneumoniae CWL029
uaguuuuugcuguuucuucug

SEQ ID NO: 2537902 - RNA, 22 nt, Chlamydophila pneumoniae CWL029
uauaaaaaagggaugaagauaa

SEQ ID NO: 2537903 - RNA, 21 nt, Chlamydophila pneumoniae CWL029
uauaaacuucaaugaagaaaa

SEQ ID NO: 2537904 - RNA, 23 nt, Chlamydophila pneumoniae CWL029
uauaaagauaaucuguaagaaaa

SEQ ID NO: 2537905 - RNA, 16 nt, Chlamydophila pneumoniae CWL029
uauaaagcaaaugccu

SEQ ID NO: 2537906 - RNA, 19 nt, Chlamydophila pneumoniae CWL029
uauaaaugcuguagauugu

SEQ ID NO: 2537907 - RNA, 21 nt, Chlamydophila pneumoniae CWL029
uauaaauucaagacuauagaa

SEQ ID NO: 2537908 - RNA, 15 nt, Chlamydophila pneumoniae CWL029
uauaacaacauugca

SEQ ID NO: 2537909 - RNA, 20 nt, Chlamydophila pneumoniae CWL029
uauaacuacaaaauccacau

SEQ ID NO: 2537910 - RNA, 11 nt, Chlamydophila pneumoniae CWL029
uauaacucucu

SEQ ID NO: 2537911 - RNA, 17 nt, Chlamydophila pneumoniae CWL029
uauaacucucuagagga

SEQ ID NO: 2537912 - RNA, 16 nt, Chlamydophila pneumoniae CWL029
uauaagagcaagguaa

SEQ ID NO: 2537913 - RNA, 17 nt, Chlamydophila pneumoniae CWL029
uauaaggauaucaugca

SEQ ID NO: 2537914 - RNA, 17 nt, Chlamydophila pneumoniae CWL029
uauaagugacuuuucuu

SEQ ID NO: 2537915 - RNA, 19 nt, Chlamydophila pneumoniae CWL029
uauaagugacuuuucuucu

SEQ ID NO: 2537916 - RNA, 18 nt, Chlamydophila pneumoniae CWL029
uauaauugacguagacga

SEQ ID NO: 2537917 - RNA, 16 nt, Chlamydophila pneumoniae CWL029
uauacaagcgaaagca

SEQ ID NO: 2537918 - RNA, 17 nt, Chlamydophila pneumoniae CWL029
uauacagaaaagaaugu

SEQ ID NO: 2537919 - RNA, 21 nt, Chlamydophila pneumoniae CWL029
uauacaguuggcguuuucuag

SEQ ID NO: 2537920 - RNA, 16 nt, Chlamydophila pneumoniae CWL029
uauacaucccauucaa

SEQ ID NO: 2537921 - RNA, 17 nt, Chlamydophila pneumoniae CWL029
uauaccacuacugagcu

SEQ ID NO: 2537922 - RNA, 15 nt, Chlamydophila pneumoniae CWL029
uauacgguaaugcca

SEQ ID NO: 2537923 - RNA, 14 nt, Chlamydophila pneumoniae CWL029
uauacuaagacugu

SEQ ID NO: 2537924 - RNA, 23 nt, Chlamydophila pneumoniae CWL029
uauacuaagacugucuaugaucc

SEQ ID NO: 2537925 - RNA, 19 nt, Chlamydophila pneumoniae CWL029
uauagacuuguauucuuga

SEQ ID NO: 2537926 - RNA, 16 nt, Chlamydophila pneumoniae CWL029
uauagagaagauuucu

SEQ ID NO: 2537927 - RNA, 18 nt, Chlamydophila pneumoniae CWL029
uauagagaauacauugcu

SEQ ID NO: 2537928 - RNA, 22 nt, Chlamydophila pneumoniae CWL029
uauagauacguaguccuuauuu

SEQ ID NO: 2537929 - RNA, 17 nt, Chlamydophila pneumoniae CWL029
uauagauaugccucagg

SEQ ID NO: 2537930 - RNA, 21 nt, Chlamydophila pneumoniae CWL029
uauagauuuaagagucuugca

SEQ ID NO: 2537931 - RNA, 16 nt, Chlamydophila pneumoniae CWL029
uauagauuuugugagg

SEQ ID NO: 2537932 - RNA, 14 nt, Chlamydophila pneumoniae CWL029
uauagcauuauucc

SEQ ID NO: 2537933 - RNA, 18 nt, Chlamydophila pneumoniae CWL029
uauagcauuauucccuaa

SEQ ID NO: 2537934 - RNA, 16 nt, Chlamydophila pneumoniae CWL029
uauagcguacaggaag

SEQ ID NO: 2537935 - RNA, 23 nt, Chlamydophila pneumoniae CWL029
uauagcuccuuggcuauggaaag

SEQ ID NO: 2537936 - RNA, 12 nt, Chlamydophila pneumoniae CWL029
uauaggaaacug

SEQ ID NO: 2537937 - RNA, 22 nt, Chlamydophila pneumoniae CWL029
uauaggaauaacaccaaaagaa

SEQ ID NO: 2537938 - RNA, 13 nt, Chlamydophila pneumoniae CWL029
uauaggauuugca

SEQ ID NO: 2537939 - RNA, 20 nt, Chlamydophila pneumoniae CWL029
uauagguuaagccaaucccu

SEQ ID NO: 2537940 - RNA, 14 nt, Chlamydophila pneumoniae CWL029
uauaguagaagaaa

SEQ ID NO: 2537941 - RNA, 13 nt, Chlamydophila pneumoniae CWL029
uauaguauuuuua

SEQ ID NO: 2537942 - RNA, 14 nt, Chlamydophila pneumoniae CWL029
uauaguauuuuuaa

SEQ ID NO: 2537943 - RNA, 16 nt, Chlamydophila pneumoniae CWL029
uauaguauuuuuaaau

SEQ ID NO: 2537944 - RNA, 18 nt, Chlamydophila pneumoniae CWL029
uauaguauuuuuaaauac

SEQ ID NO: 2537945 - RNA, 18 nt, Chlamydophila pneumoniae CWL029
uauaguuuucaaaaaucg

SEQ ID NO: 2537946 - RNA, 11 nt, Chlamydophila pneumoniae CWL029
uauauaaaggu

SEQ ID NO: 2537947 - RNA, 15 nt, Chlamydophila pneumoniae CWL029
uauauauaagaucuu

SEQ ID NO: 2537948 - RNA, 18 nt, Chlamydophila pneumoniae CWL029
uauaucagcaaaaaacug

SEQ ID NO: 2537949 - RNA, 21 nt, Chlamydophila pneumoniae CWL029
uauaucagcaaaaaacugcaa

SEQ ID NO: 2537950 - RNA, 17 nt, Chlamydophila pneumoniae CWL029
uauaucauuaagaagau

SEQ ID NO: 2537951 - RNA, 14 nt, Chlamydophila pneumoniae CWL029
uauauccugaguga

SEQ ID NO: 2537952 - RNA, 19 nt, Chlamydophila pneumoniae CWL029
uauaucgcguguaaaagcu

SEQ ID NO: 2537953 - RNA, 16 nt, Chlamydophila pneumoniae CWL029
uauauuuuuuacauaa

SEQ ID NO: 2537954 - RNA, 14 nt, Chlamydophila pneumoniae CWL029
uauauuuuuuccca

SEQ ID NO: 2537955 - RNA, 15 nt, Chlamydophila pneumoniae CWL029
uaucaaaagguuuua

SEQ ID NO: 2537956 - RNA, 19 nt, Chlamydophila pneumoniae CWL029
uaucaaagacucaugaaau

SEQ ID NO: 2537957 - RNA, 15 nt, Chlamydophila pneumoniae CWL029
uaucaaagcauugca

SEQ ID NO: 2537958 - RNA, 23 nt, Chlamydophila pneumoniae CWL029
uaucaaagcauugcaaauaagcc

SEQ ID NO: 2537959 - RNA, 18 nt, Chlamydophila pneumoniae CWL029
uaucagauccaugaacag

SEQ ID NO: 2537960 - RNA, 15 nt, Chlamydophila pneumoniae CWL029
uaucagcaaaaaacu

SEQ ID NO: 2537961 - RNA, 20 nt, Chlamydophila pneumoniae CWL029
uaucagggagcggaauuucu

SEQ ID NO: 2537962 - RNA, 22 nt, Chlamydophila pneumoniae CWL029
uaucagggagcggaauuucuca

SEQ ID NO: 2537963 - RNA, 19 nt, Chlamydophila pneumoniae CWL029
uaucaguauggcguuuuuu

SEQ ID NO: 2537964 - RNA, 22 nt, Chlamydophila pneumoniae CWL029
uaucaucaaugguuaaaaccca

SEQ ID NO: 2537965 - RNA, 20 nt, Chlamydophila pneumoniae CWL029
uaucaugcaauacuuuucuc

SEQ ID NO: 2537966 - RNA, 21 nt, Chlamydophila pneumoniae CWL029
uaucaugcaauacuuuucucc

SEQ ID NO: 2537967 - RNA, 16 nt, Chlamydophila pneumoniae CWL029
uaucauggacaagcaa

SEQ ID NO: 2537968 - RNA, 23 nt, Chlamydophila pneumoniae CWL029
uaucauuauacuucguuaugaag

SEQ ID NO: 2537969 - RNA, 23 nt, Chlamydophila pneumoniae CWL029
uauccaaagccggcccacucaaa

SEQ ID NO: 2537970 - RNA, 14 nt, Chlamydophila pneumoniae CWL029
uauccaaugagaga

SEQ ID NO: 2537971 - RNA, 18 nt, Chlamydophila pneumoniae CWL029
uauccaccaagacugaau

SEQ ID NO: 2537972 - RNA, 16 nt, Chlamydophila pneumoniae CWL029
uauccagaaagauucu

SEQ ID NO: 2537973 - RNA, 21 nt, Chlamydophila pneumoniae CWL029
uauccagaaagauucugccca

SEQ ID NO: 2537974 - RNA, 22 nt, Chlamydophila pneumoniae CWL029
uauccagaaauacguccagccu

SEQ ID NO: 2537975 - RNA, 19 nt, Chlamydophila pneumoniae CWL029
uauccaugacuuuuguugc

SEQ ID NO: 2537976 - RNA, 22 nt, Chlamydophila pneumoniae CWL029
uauccauggaauggcuacuuua

SEQ ID NO: 2537977 - RNA, 12 nt, Chlamydophila pneumoniae CWL029
uaucccacagaa

SEQ ID NO: 2537978 - RNA, 17 nt, Chlamydophila pneumoniae CWL029
uaucccagauaaagaca

SEQ ID NO: 2537979 - RNA, 21 nt, Chlamydophila pneumoniae CWL029
uauccgacucuguuuccuugu

SEQ ID NO: 2537980 - RNA, 17 nt, Chlamydophila pneumoniae CWL029
uauccguauggauuucu

SEQ ID NO: 2537981 - RNA, 18 nt, Chlamydophila pneumoniae CWL029
uauccugaacaucuccag

SEQ ID NO: 2537982 - RNA, 14 nt, Chlamydophila pneumoniae CWL029
uauccugcuccaaa

SEQ ID NO: 2537983 - RNA, 17 nt, Chlamydophila pneumoniae CWL029
uauccuguuucaacaua

SEQ ID NO: 2537984 - RNA, 14 nt, Chlamydophila pneumoniae CWL029
uauccuuccuuauu

SEQ ID NO: 2537985 - RNA, 22 nt, Chlamydophila pneumoniae CWL029
uauccuugaaauugcucuugcu

SEQ ID NO: 2537986 - RNA, 19 nt, Chlamydophila pneumoniae CWL029
uauccuugauuuuaaaaug

SEQ ID NO: 2537987 - RNA, 18 nt, Chlamydophila pneumoniae CWL029
uaucgacuguacaaaugc

SEQ ID NO: 2537988 - RNA, 14 nt, Chlamydophila pneumoniae CWL029
uaucgaguucuuuu

SEQ ID NO: 2537989 - RNA, 17 nt, Chlamydophila pneumoniae CWL029
uaucgauaacgauuucu

SEQ ID NO: 2537990 - RNA, 23 nt, Chlamydophila pneumoniae CWL029
uaucgccuuccuuaacaacauca

SEQ ID NO: 2537991 - RNA, 20 nt, Chlamydophila pneumoniae CWL029
uaucggaccuacguuuucuc

SEQ ID NO: 2537992 - RNA, 21 nt, Chlamydophila pneumoniae CWL029
uaucggaccuacguuuucucu

SEQ ID NO: 2537993 - RNA, 19 nt, Chlamydophila pneumoniae CWL029
uaucgggggugccaaaaaa

SEQ ID NO: 2537994 - RNA, 12 nt, Chlamydophila pneumoniae CWL029
uaucgugacucu

SEQ ID NO: 2537995 - RNA, 14 nt, Chlamydophila pneumoniae CWL029
uaucguuucaguuu

SEQ ID NO: 2537996 - RNA, 14 nt, Chlamydophila pneumoniae CWL029
uaucuaaagaaaug

SEQ ID NO: 2537997 - RNA, 15 nt, Chlamydophila pneumoniae CWL029
uaucuaaagaaaugu

SEQ ID NO: 2537998 - RNA, 17 nt, Chlamydophila pneumoniae CWL029
uaucuacacaguagccu

SEQ ID NO: 2537999 - RNA, 23 nt, Chlamydophila pneumoniae CWL029
uaucuacacaguagccuucuucu

SEQ ID NO: 2538000 - RNA, 15 nt, Chlamydophila pneumoniae CWL029
uaucuacagcuauag

SEQ ID NO: 2538001 - RNA, 17 nt, Chlamydophila pneumoniae CWL029
uaucuacagcuauagaa

SEQ ID NO: 2538002 - RNA, 19 nt, Chlamydophila pneumoniae CWL029
uaucuagggacuucucaaa

SEQ ID NO: 2538003 - RNA, 16 nt, Chlamydophila pneumoniae CWL029
uaucuauagaaggcau

SEQ ID NO: 2538004 - RNA, 15 nt, Chlamydophila pneumoniae CWL029
uaucuauuaagccgc

SEQ ID NO: 2538005 - RNA, 20 nt, Chlamydophila pneumoniae CWL029
uaucucuggcauaauccuga

SEQ ID NO: 2538006 - RNA, 14 nt, Chlamydophila pneumoniae CWL029
uaucucuguuuuuu

SEQ ID NO: 2538007 - RNA, 21 nt, Chlamydophila pneumoniae CWL029
uaucucuguuuuuugaaaacu

SEQ ID NO: 2538008 - RNA, 14 nt, Chlamydophila pneumoniae CWL029
uaucucuuaaaaua

SEQ ID NO: 2538009 - RNA, 16 nt, Chlamydophila pneumoniae CWL029
uaucugcacuuucuuu

SEQ ID NO: 2538010 - RNA, 14 nt, Chlamydophila pneumoniae CWL029
uaucugccauagga

SEQ ID NO: 2538011 - RNA, 16 nt, Chlamydophila pneumoniae CWL029
uaucugcgacaaaaau

SEQ ID NO: 2538012 - RNA, 16 nt, Chlamydophila pneumoniae CWL029
uaucugcguuucuuuc

SEQ ID NO: 2538013 - RNA, 15 nt, Chlamydophila pneumoniae CWL029
uaucugcucccuccu

SEQ ID NO: 2538014 - RNA, 14 nt, Chlamydophila pneumoniae CWL029
uaucuguuaaaaac

SEQ ID NO: 2538015 - RNA, 19 nt, Chlamydophila pneumoniae CWL029
uaucuguuaaaaacaagau

SEQ ID NO: 2538016 - RNA, 13 nt, Chlamydophila pneumoniae CWL029
uaucuuagggaau

SEQ ID NO: 2538017 - RNA, 17 nt, Chlamydophila pneumoniae CWL029
uaucuucaaaaguaauc

SEQ ID NO: 2538018 - RNA, 20 nt, Chlamydophila pneumoniae CWL029
uaucuucaaaaguaaucacu

SEQ ID NO: 2538019 - RNA, 22 nt, Chlamydophila pneumoniae CWL029
uaucuucagaaugcccuuuagg

SEQ ID NO: 2538020 - RNA, 16 nt, Chlamydophila pneumoniae CWL029
uaucuucguaauaacu

SEQ ID NO: 2538021 - RNA, 13 nt, Chlamydophila pneumoniae CWL029
uaucuucuaaaac

SEQ ID NO: 2538022 - RNA, 21 nt, Chlamydophila pneumoniae CWL029
uaucuuguuucguaagagaau

SEQ ID NO: 2538023 - RNA, 14 nt, Chlamydophila pneumoniae CWL029
uaucuuuaagauuu

SEQ ID NO: 2538024 - RNA, 20 nt, Chlamydophila pneumoniae CWL029
uaucuuuaagauuuuuagaa

SEQ ID NO: 2538025 - RNA, 19 nt, Chlamydophila pneumoniae CWL029
uaucuuuacuaacaaaauu

SEQ ID NO: 2538026 - RNA, 22 nt, Chlamydophila pneumoniae CWL029
uaucuuuacuaacaaaauuucu

SEQ ID NO: 2538027 - RNA, 22 nt, Chlamydophila pneumoniae CWL029
uaucuuuauuuaaauaaaacca

SEQ ID NO: 2538028 - RNA, 14 nt, Chlamydophila pneumoniae CWL029
uaucuuugguaugc

SEQ ID NO: 2538029 - RNA, 19 nt, Chlamydophila pneumoniae CWL029
uaugaacgauuucuuuuag

SEQ ID NO: 2538030 - RNA, 18 nt, Chlamydophila pneumoniae CWL029
uaugaacugccugagaaa

SEQ ID NO: 2538031 - RNA, 16 nt, Chlamydophila pneumoniae CWL029
uaugaaugauuuccau

SEQ ID NO: 2538032 - RNA, 17 nt, Chlamydophila pneumoniae CWL029
uaugaaugauuuccaua

SEQ ID NO: 2538033 - RNA, 21 nt, Chlamydophila pneumoniae CWL029
uaugaaugauuuccauagagu

SEQ ID NO: 2538034 - RNA, 19 nt, Chlamydophila pneumoniae CWL029
uaugaauuagggcuuuuac

SEQ ID NO: 2538035 - RNA, 19 nt, Chlamydophila pneumoniae CWL029
uaugacacagcuaaucaau

SEQ ID NO: 2538036 - RNA, 21 nt, Chlamydophila pneumoniae CWL029
uaugacacagcuaaucaaucc

SEQ ID NO: 2538037 - RNA, 15 nt, Chlamydophila pneumoniae CWL029
uaugacuucuugucc

SEQ ID NO: 2538038 - RNA, 20 nt, Chlamydophila pneumoniae CWL029
uaugacuucuuguccuguua

SEQ ID NO: 2538039 - RNA, 16 nt, Chlamydophila pneumoniae CWL029
uaugagcuccaaaaua

SEQ ID NO: 2538040 - RNA, 17 nt, Chlamydophila pneumoniae CWL029
uaugaggagauaaagau

SEQ ID NO: 2538041 - RNA, 17 nt, Chlamydophila pneumoniae CWL029
uaugauccgaaaacucu

SEQ ID NO: 2538042 - RNA, 21 nt, Chlamydophila pneumoniae CWL029
uaugauccgaaaacucuuaga

SEQ ID NO: 2538043 - RNA, 21 nt, Chlamydophila pneumoniae CWL029
uaugaucucuucaugaaaaaa

SEQ ID NO: 2538044 - RNA, 15 nt, Chlamydophila pneumoniae CWL029
uaugaugccucauug

SEQ ID NO: 2538045 - RNA, 17 nt, Chlamydophila pneumoniae CWL029
uaugaugccucauugcc

SEQ ID NO: 2538046 - RNA, 15 nt, Chlamydophila pneumoniae CWL029
uaugauguauaaagu

SEQ ID NO: 2538047 - RNA, 22 nt, Chlamydophila pneumoniae CWL029
uaugcaaaacaacauucguuag

SEQ ID NO: 2538048 - RNA, 16 nt, Chlamydophila pneumoniae CWL029
uaugcacaaaauaaaa

SEQ ID NO: 2538049 - RNA, 23 nt, Chlamydophila pneumoniae CWL029
uaugcacgcuuucgucuaaaaua

SEQ ID NO: 2538050 - RNA, 13 nt, Chlamydophila pneumoniae CWL029
uaugcccaaggaa

SEQ ID NO: 2538051 - RNA, 14 nt, Chlamydophila pneumoniae CWL029
uaugcccaaggaaa

SEQ ID NO: 2538052 - RNA, 15 nt, Chlamydophila pneumoniae CWL029
uaugcccaaggaaaa

SEQ ID NO: 2538053 - RNA, 23 nt, Chlamydophila pneumoniae CWL029
uaugcuauagcuggaucuucuga

SEQ ID NO: 2538054 - RNA, 20 nt, Chlamydophila pneumoniae CWL029
uaugcucauuaauaauaucu

SEQ ID NO: 2538055 - RNA, 19 nt, Chlamydophila pneumoniae CWL029
uaugcuguugcuccaagag

SEQ ID NO: 2538056 - RNA, 15 nt, Chlamydophila pneumoniae CWL029
uauggaagauaaaca

SEQ ID NO: 2538057 - RNA, 19 nt, Chlamydophila pneumoniae CWL029
uauggcagccuggaaagcu

SEQ ID NO: 2538058 - RNA, 20 nt, Chlamydophila pneumoniae CWL029
uaugggaggaauuccucuca

SEQ ID NO: 2538059 - RNA, 20 nt, Chlamydophila pneumoniae CWL029
uauggucucccucacaagaa

SEQ ID NO: 2538060 - RNA, 19 nt, Chlamydophila pneumoniae CWL029
uauguauaacaucuaaaaa

SEQ ID NO: 2538061 - RNA, 15 nt, Chlamydophila pneumoniae CWL029
uauguccguauuuuu

SEQ ID NO: 2538062 - RNA, 18 nt, Chlamydophila pneumoniae CWL029
uaugugaugucgcgaaag

SEQ ID NO: 2538063 - RNA, 14 nt, Chlamydophila pneumoniae CWL029
uauguuaaaaauac

SEQ ID NO: 2538064 - RNA, 13 nt, Chlamydophila pneumoniae CWL029
uauuaaaaauagc

SEQ ID NO: 2538065 - RNA, 20 nt, Chlamydophila pneumoniae CWL029
uauuaaaaauagcuuacuuu

SEQ ID NO: 2538066 - RNA, 15 nt, Chlamydophila pneumoniae CWL029
uauuaaaaucucuag

SEQ ID NO: 2538067 - RNA, 13 nt, Chlamydophila pneumoniae CWL029
uauuaaagaaucu

SEQ ID NO: 2538068 - RNA, 14 nt, Chlamydophila pneumoniae CWL029
uauuaagaauggau

SEQ ID NO: 2538069 - RNA, 17 nt, Chlamydophila pneumoniae CWL029
uauuaaggauuccuuga

SEQ ID NO: 2538070 - RNA, 22 nt, Chlamydophila pneumoniae CWL029
uauuaagggaagaucuugguua

SEQ ID NO: 2538071 - RNA, 18 nt, Chlamydophila pneumoniae CWL029
uauuaauaaauuuaucug

SEQ ID NO: 2538072 - RNA, 14 nt, Chlamydophila pneumoniae CWL029
uauuaaucuuauug

SEQ ID NO: 2538073 - RNA, 18 nt, Chlamydophila pneumoniae CWL029
uauuacagauuucuucuu

SEQ ID NO: 2538074 - RNA, 19 nt, Chlamydophila pneumoniae CWL029
uauuaggcuuuuuucuauu

SEQ ID NO: 2538075 - RNA, 17 nt, Chlamydophila pneumoniae CWL029
uauuaguuuugaaauca

SEQ ID NO: 2538076 - RNA, 15 nt, Chlamydophila pneumoniae CWL029
uauuauaaauagaaa

SEQ ID NO: 2538077 - RNA, 17 nt, Chlamydophila pneumoniae CWL029
uauuauaaauagaaauc

SEQ ID NO: 2538078 - RNA, 13 nt, Chlamydophila pneumoniae CWL029
uauuaucuuguuu

SEQ ID NO: 2538079 - RNA, 13 nt, Chlamydophila pneumoniae CWL029
uauuauugaauaa

SEQ ID NO: 2538080 - RNA, 22 nt, Chlamydophila pneumoniae CWL029
uauuccauaaaaauguaauuuu

SEQ ID NO: 2538081 - RNA, 14 nt, Chlamydophila pneumoniae CWL029
uauuccaucacagu

SEQ ID NO: 2538082 - RNA, 17 nt, Chlamydophila pneumoniae CWL029
uauuccaucacaguuaa

SEQ ID NO: 2538083 - RNA, 15 nt, Chlamydophila pneumoniae CWL029
uauuccuauaacaac

SEQ ID NO: 2538084 - RNA, 19 nt, Chlamydophila pneumoniae CWL029
uauuccucuuaggagagcu

SEQ ID NO: 2538085 - RNA, 17 nt, Chlamydophila pneumoniae CWL029
uauucucgaaaaauuug

SEQ ID NO: 2538086 - RNA, 18 nt, Chlamydophila pneumoniae CWL029
uauucucuucauuuucuu

SEQ ID NO: 2538087 - RNA, 16 nt, Chlamydophila pneumoniae CWL029
uauucugaaauuucug

SEQ ID NO: 2538088 - RNA, 15 nt, Chlamydophila pneumoniae CWL029
uauucugaagcugca

SEQ ID NO: 2538089 - RNA, 17 nt, Chlamydophila pneumoniae CWL029
uauucuguggaauauca

SEQ ID NO: 2538090 - RNA, 17 nt, Chlamydophila pneumoniae CWL029
uauucuuaaugcgaugc

SEQ ID NO: 2538091 - RNA, 13 nt, Chlamydophila pneumoniae CWL029
uauucuuggaaua

SEQ ID NO: 2538092 - RNA, 18 nt, Chlamydophila pneumoniae CWL029
uauugaaaaaucccuguu

SEQ ID NO: 2538093 - RNA, 16 nt, Chlamydophila pneumoniae CWL029
uauugaagucuucuug

SEQ ID NO: 2538094 - RNA, 18 nt, Chlamydophila pneumoniae CWL029
uauugacuagcucucuug

SEQ ID NO: 2538095 - RNA, 13 nt, Chlamydophila pneumoniae CWL029
uauugcaaagcau

SEQ ID NO: 2538096 - RNA, 13 nt, Chlamydophila pneumoniae CWL029
uauugcagaaucu

SEQ ID NO: 2538097 - RNA, 15 nt, Chlamydophila pneumoniae CWL029
uauugccuucuucuu

SEQ ID NO: 2538098 - RNA, 20 nt, Chlamydophila pneumoniae CWL029
uauugcgaacuuuugggccc

SEQ ID NO: 2538099 - RNA, 16 nt, Chlamydophila pneumoniae CWL029
uauugguguaucucuu

SEQ ID NO: 2538100 - RNA, 22 nt, Chlamydophila pneumoniae CWL029
uauuguguucccucuucuucca

SEQ ID NO: 2538101 - RNA, 23 nt, Chlamydophila pneumoniae CWL029
uauuguguucccucuucuuccaa

SEQ ID NO: 2538102 - RNA, 13 nt, Chlamydophila pneumoniae CWL029
uauuuaaauauaa

SEQ ID NO: 2538103 - RNA, 15 nt, Chlamydophila pneumoniae CWL029
uauuuaaauauaaau

SEQ ID NO: 2538104 - RNA, 18 nt, Chlamydophila pneumoniae CWL029
uauuuaagggaaauguca

SEQ ID NO: 2538105 - RNA, 12 nt, Chlamydophila pneumoniae CWL029
uauuuaauccaa

SEQ ID NO: 2538106 - RNA, 18 nt, Chlamydophila pneumoniae CWL029
uauuuagagagaaacauc

SEQ ID NO: 2538107 - RNA, 17 nt, Chlamydophila pneumoniae CWL029
uauuuagcauuucucua

SEQ ID NO: 2538108 - RNA, 18 nt, Chlamydophila pneumoniae CWL029
uauuuauuuuauuaguuu

SEQ ID NO: 2538109 - RNA, 14 nt, Chlamydophila pneumoniae CWL029
uauuucuauuauuu

SEQ ID NO: 2538110 - RNA, 15 nt, Chlamydophila pneumoniae CWL029
uauuucucuaucauc

SEQ ID NO: 2538111 - RNA, 12 nt, Chlamydophila pneumoniae CWL029
uauuucuuaauu

SEQ ID NO: 2538112 - RNA, 22 nt, Chlamydophila pneumoniae CWL029
uauuugcaacaaucuuucuucu

SEQ ID NO: 2538113 - RNA, 23 nt, Chlamydophila pneumoniae CWL029
uauuugcaacaaucuuucuucua

SEQ ID NO: 2538114 - RNA, 20 nt, Chlamydophila pneumoniae CWL029
uauuugcagaagcauuguau

SEQ ID NO: 2538115 - RNA, 15 nt, Chlamydophila pneumoniae CWL029
uauuugccaaaauaa

SEQ ID NO: 2538116 - RNA, 19 nt, Chlamydophila pneumoniae CWL029
uauuuugcaaaugaaaaga

SEQ ID NO: 2538117 - RNA, 15 nt, Chlamydophila pneumoniae CWL029
uauuuugucuuuuua

SEQ ID NO: 2538118 - RNA, 12 nt, Chlamydophila pneumoniae CWL029
uauuuuuaaaga

SEQ ID NO: 2538119 - RNA, 13 nt, Chlamydophila pneumoniae CWL029
uauuuuuaaauaa

SEQ ID NO: 2538120 - RNA, 23 nt, Chlamydophila pneumoniae CWL029
uauuuuuccauggcuauuuuuaa

SEQ ID NO: 2538121 - RNA, 21 nt, Chlamydophila pneumoniae CWL029
ucaaaaaaaacgccauacuga

SEQ ID NO: 2538122 - RNA, 13 nt, Chlamydophila pneumoniae CWL029
ucaaaaaaaagac

SEQ ID NO: 2538123 - RNA, 14 nt, Chlamydophila pneumoniae CWL029
ucaaaaagagagcc

SEQ ID NO: 2538124 - RNA, 12 nt, Chlamydophila pneumoniae CWL029
ucaaaagaaaag

SEQ ID NO: 2538125 - RNA, 18 nt, Chlamydophila pneumoniae CWL029
ucaaaagaaaucaaacau

SEQ ID NO: 2538126 - RNA, 11 nt, Chlamydophila pneumoniae CWL029
ucaaaagaaga

SEQ ID NO: 2538127 - RNA, 12 nt, Chlamydophila pneumoniae CWL029
ucaaaagacuua

SEQ ID NO: 2538128 - RNA, 17 nt, Chlamydophila pneumoniae CWL029
ucaaaagguuuuauaaa

SEQ ID NO: 2538129 - RNA, 18 nt, Chlamydophila pneumoniae CWL029
ucaaaauaucauucacua

SEQ ID NO: 2538130 - RNA, 22 nt, Chlamydophila pneumoniae CWL029
ucaaaaucaaaguauauauuuu

SEQ ID NO: 2538131 - RNA, 14 nt, Chlamydophila pneumoniae CWL029
ucaaaaucacauuu

SEQ ID NO: 2538132 - RNA, 15 nt, Chlamydophila pneumoniae CWL029
ucaaaaucacauuuu

SEQ ID NO: 2538133 - RNA, 14 nt, Chlamydophila pneumoniae CWL029
ucaaaaugcugcuu

SEQ ID NO: 2538134 - RNA, 12 nt, Chlamydophila pneumoniae CWL029
ucaaaauuuaaa

SEQ ID NO: 2538135 - RNA, 14 nt, Chlamydophila pneumoniae CWL029
ucaaaauuuaaaua

SEQ ID NO: 2538136 - RNA, 17 nt, Chlamydophila pneumoniae CWL029
ucaaacaucacucagga

SEQ ID NO: 2538137 - RNA, 11 nt, Chlamydophila pneumoniae CWL029
ucaaacauuac

SEQ ID NO: 2538138 - RNA, 21 nt, Chlamydophila pneumoniae CWL029
ucaaaccacggauuuucucua

SEQ ID NO: 2538139 - RNA, 23 nt, Chlamydophila pneumoniae CWL029
ucaaaccacggauuuucucuaca

SEQ ID NO: 2538140 - RNA, 17 nt, Chlamydophila pneumoniae CWL029
ucaaacuccuuuuaaaa

SEQ ID NO: 2538141 - RNA, 21 nt, Chlamydophila pneumoniae CWL029
ucaaacugauuaguuuguuuu

SEQ ID NO: 2538142 - RNA, 11 nt, Chlamydophila pneumoniae CWL029
ucaaagaacaa

SEQ ID NO: 2538143 - RNA, 19 nt, Chlamydophila pneumoniae CWL029
ucaaagaacaauaaaaggc

SEQ ID NO: 2538144 - RNA, 14 nt, Chlamydophila pneumoniae CWL029
ucaaagaagacacu

SEQ ID NO: 2538145 - RNA, 19 nt, Chlamydophila pneumoniae CWL029
ucaaagacaggcucaugaa

SEQ ID NO: 2538146 - RNA, 15 nt, Chlamydophila pneumoniae CWL029
ucaaagacucaugaa

SEQ ID NO: 2538147 - RNA, 18 nt, Chlamydophila pneumoniae CWL029
ucaaagacucaugaaaua

SEQ ID NO: 2538148 - RNA, 12 nt, Chlamydophila pneumoniae CWL029
ucaaagauauaa

SEQ ID NO: 2538149 - RNA, 22 nt, Chlamydophila pneumoniae CWL029
ucaaagauauagauucaugaaa

SEQ ID NO: 2538150 - RNA, 18 nt, Chlamydophila pneumoniae CWL029
ucaaagcaaaagucauaa

SEQ ID NO: 2538151 - RNA, 12 nt, Chlamydophila pneumoniae CWL029
ucaaagcaaaga

SEQ ID NO: 2538152 - RNA, 15 nt, Chlamydophila pneumoniae CWL029
ucaaagcauugcaaa

SEQ ID NO: 2538153 - RNA, 17 nt, Chlamydophila pneumoniae CWL029
ucaaaggauccauaacc

SEQ ID NO: 2538154 - RNA, 21 nt, Chlamydophila pneumoniae CWL029
ucaaaggcaacgcgauuuuca

SEQ ID NO: 2538155 - RNA, 23 nt, Chlamydophila pneumoniae CWL029
ucaaaggcaacgcgauuuucaac

SEQ ID NO: 2538156 - RNA, 22 nt, Chlamydophila pneumoniae CWL029
ucaaagucaaauacuucuccug

SEQ ID NO: 2538157 - RNA, 18 nt, Chlamydophila pneumoniae CWL029
ucaaauacuucuccugaa

SEQ ID NO: 2538158 - RNA, 19 nt, Chlamydophila pneumoniae CWL029
ucaaauacuucuccugaac

SEQ ID NO: 2538159 - RNA, 20 nt, Chlamydophila pneumoniae CWL029
ucaaauaggaucucucuuuc

SEQ ID NO: 2538160 - RNA, 22 nt, Chlamydophila pneumoniae CWL029
ucaaauauaugaguuuacuaac

SEQ ID NO: 2538161 - RNA, 17 nt, Chlamydophila pneumoniae CWL029
ucaaauucaaaauagaa

SEQ ID NO: 2538162 - RNA, 18 nt, Chlamydophila pneumoniae CWL029
ucaaauuccuucucagaa

SEQ ID NO: 2538163 - RNA, 19 nt, Chlamydophila pneumoniae CWL029
ucaaauuccuucucagaaa

SEQ ID NO: 2538164 - RNA, 23 nt, Chlamydophila pneumoniae CWL029
ucaaauuggaauucgcauuuuug

SEQ ID NO: 2538165 - RNA, 16 nt, Chlamydophila pneumoniae CWL029
ucaaauuucaauaaga

SEQ ID NO: 2538166 - RNA, 17 nt, Chlamydophila pneumoniae CWL029
ucaaauuugcucuccug

SEQ ID NO: 2538167 - RNA, 22 nt, Chlamydophila pneumoniae CWL029
ucaacaaguucuuggaaaaaag

SEQ ID NO: 2538168 - RNA, 23 nt, Chlamydophila pneumoniae CWL029
ucaacaaguucuuggaaaaaagg

SEQ ID NO: 2538169 - RNA, 21 nt, Chlamydophila pneumoniae CWL029
ucaacacccggcuuuuccaga

SEQ ID NO: 2538170 - RNA, 19 nt, Chlamydophila pneumoniae CWL029
ucaacaccucaauacggac

SEQ ID NO: 2538171 - RNA, 16 nt, Chlamydophila pneumoniae CWL029
ucaacauguuaauaag

SEQ ID NO: 2538172 - RNA, 21 nt, Chlamydophila pneumoniae CWL029
ucaacauucuucugucuguau

SEQ ID NO: 2538173 - RNA, 23 nt, Chlamydophila pneumoniae CWL029
ucaacauuuugccuuuagggaaa

SEQ ID NO: 2538174 - RNA, 16 nt, Chlamydophila pneumoniae CWL029
ucaacguuuguaguaa

SEQ ID NO: 2538175 - RNA, 21 nt, Chlamydophila pneumoniae CWL029
ucaacguuuguaguaaggaga

SEQ ID NO: 2538176 - RNA, 13 nt, Chlamydophila pneumoniae CWL029
ucaacuacaucuc

SEQ ID NO: 2538177 - RNA, 15 nt, Chlamydophila pneumoniae CWL029
ucaacuacaucucca

SEQ ID NO: 2538178 - RNA, 21 nt, Chlamydophila pneumoniae CWL029
ucaacugguauagacuccuua

SEQ ID NO: 2538179 - RNA, 14 nt, Chlamydophila pneumoniae CWL029
ucaacuuuguuaau

SEQ ID NO: 2538180 - RNA, 15 nt, Chlamydophila pneumoniae CWL029
ucaagaaaaaccccu

SEQ ID NO: 2538181 - RNA, 20 nt, Chlamydophila pneumoniae CWL029
ucaagaaaugcccugucacu

SEQ ID NO: 2538182 - RNA, 14 nt, Chlamydophila pneumoniae CWL029
ucaagaaauucuuc

SEQ ID NO: 2538183 - RNA, 22 nt, Chlamydophila pneumoniae CWL029
ucaagaauuucuucuuuccaua

SEQ ID NO: 2538184 - RNA, 22 nt, Chlamydophila pneumoniae CWL029
ucaagaccuaagcucauaagaa

SEQ ID NO: 2538185 - RNA, 20 nt, Chlamydophila pneumoniae CWL029
ucaagacgacacucaaaucu

SEQ ID NO: 2538186 - RNA, 15 nt, Chlamydophila pneumoniae CWL029
ucaagacuauagaaa

SEQ ID NO: 2538187 - RNA, 21 nt, Chlamydophila pneumoniae CWL029
ucaagagauagagauaaguca

SEQ ID NO: 2538188 - RNA, 15 nt, Chlamydophila pneumoniae CWL029
ucaagauaaauccca

SEQ ID NO: 2538189 - RNA, 13 nt, Chlamydophila pneumoniae CWL029
ucaagaucuucau

SEQ ID NO: 2538190 - RNA, 18 nt, Chlamydophila pneumoniae CWL029
ucaagaucuucaucacaa

SEQ ID NO: 2538191 - RNA, 17 nt, Chlamydophila pneumoniae CWL029
ucaagcaaaucuccguu

SEQ ID NO: 2538192 - RNA, 19 nt, Chlamydophila pneumoniae CWL029
ucaagcuauagauuuugga

SEQ ID NO: 2538193 - RNA, 15 nt, Chlamydophila pneumoniae CWL029
ucaaggaacauuuga

SEQ ID NO: 2538194 - RNA, 14 nt, Chlamydophila pneumoniae CWL029
ucaaggaguuuuaa

SEQ ID NO: 2538195 - RNA, 19 nt, Chlamydophila pneumoniae CWL029
ucaaggaucuuauauaaaa

SEQ ID NO: 2538196 - RNA, 20 nt, Chlamydophila pneumoniae CWL029
ucaaggccuauagauuuugu

SEQ ID NO: 2538197 - RNA, 15 nt, Chlamydophila pneumoniae CWL029
ucaagguacuuuaua

SEQ ID NO: 2538198 - RNA, 14 nt, Chlamydophila pneumoniae CWL029
ucaaguaagaaguc

SEQ ID NO: 2538199 - RNA, 16 nt, Chlamydophila pneumoniae CWL029
ucaaguuucuuuugca

SEQ ID NO: 2538200 - RNA, 23 nt, Chlamydophila pneumoniae CWL029
ucaauaaucggccgaguuucucc

SEQ ID NO: 2538201 - RNA, 13 nt, Chlamydophila pneumoniae CWL029
ucaauaauuucaa

SEQ ID NO: 2538202 - RNA, 16 nt, Chlamydophila pneumoniae CWL029
ucaauagaagcuuguu

SEQ ID NO: 2538203 - RNA, 19 nt, Chlamydophila pneumoniae CWL029
ucaauaucuugaauucuca

SEQ ID NO: 2538204 - RNA, 14 nt, Chlamydophila pneumoniae CWL029
ucaaucaauaaaau

SEQ ID NO: 2538205 - RNA, 19 nt, Chlamydophila pneumoniae CWL029
ucaauccaagaauagccau

SEQ ID NO: 2538206 - RNA, 13 nt, Chlamydophila pneumoniae CWL029
ucaaucucuccuu

SEQ ID NO: 2538207 - RNA, 18 nt, Chlamydophila pneumoniae CWL029
ucaaucucuuugacaucu

SEQ ID NO: 2538208 - RNA, 13 nt, Chlamydophila pneumoniae CWL029
ucaaugaaagcug

SEQ ID NO: 2538209 - RNA, 19 nt, Chlamydophila pneumoniae CWL029
ucaaugaagaaaaaucuac

SEQ ID NO: 2538210 - RNA, 15 nt, Chlamydophila pneumoniae CWL029
ucaaugacuguaucu

SEQ ID NO: 2538211 - RNA, 17 nt, Chlamydophila pneumoniae CWL029
ucaauggcgauaaaugc

SEQ ID NO: 2538212 - RNA, 22 nt, Chlamydophila pneumoniae CWL029
ucaauuccuuucuccagcauuu

SEQ ID NO: 2538213 - RNA, 13 nt, Chlamydophila pneumoniae CWL029
ucaauucuguuau

SEQ ID NO: 2538214 - RNA, 14 nt, Chlamydophila pneumoniae CWL029
ucaauugaaucaga

SEQ ID NO: 2538215 - RNA, 13 nt, Chlamydophila pneumoniae CWL029
ucaauuucuucau

SEQ ID NO: 2538216 - RNA, 19 nt, Chlamydophila pneumoniae CWL029
ucaauuucuucaucaauac

SEQ ID NO: 2538217 - RNA, 22 nt, Chlamydophila pneumoniae CWL029
ucaauuugcguugcauguccau

SEQ ID NO: 2538218 - RNA, 16 nt, Chlamydophila pneumoniae CWL029
ucacaaacaacagaaa

SEQ ID NO: 2538219 - RNA, 19 nt, Chlamydophila pneumoniae CWL029
ucacaaacaacagaaaugu

SEQ ID NO: 2538220 - RNA, 20 nt, Chlamydophila pneumoniae CWL029
ucacaaagaaccauagauuu

SEQ ID NO: 2538221 - RNA, 12 nt, Chlamydophila pneumoniae CWL029
ucacaaagaauu

SEQ ID NO: 2538222 - RNA, 19 nt, Chlamydophila pneumoniae CWL029
ucacaaagaauucagagaa

SEQ ID NO: 2538223 - RNA, 14 nt, Chlamydophila pneumoniae CWL029
ucacaagaaagaau

SEQ ID NO: 2538224 - RNA, 22 nt, Chlamydophila pneumoniae CWL029
ucacaagcugguagacuucuug

SEQ ID NO: 2538225 - RNA, 16 nt, Chlamydophila pneumoniae CWL029
ucacaaguccugcguu

SEQ ID NO: 2538226 - RNA, 19 nt, Chlamydophila pneumoniae CWL029
ucacaauaccaucucuuuc

SEQ ID NO: 2538227 - RNA, 17 nt, Chlamydophila pneumoniae CWL029
ucacaauauaaaugcua

SEQ ID NO: 2538228 - RNA, 17 nt, Chlamydophila pneumoniae CWL029
ucacaaucuaaauaaga

SEQ ID NO: 2538229 - RNA, 14 nt, Chlamydophila pneumoniae CWL029
ucacaaugaucuuu

SEQ ID NO: 2538230 - RNA, 22 nt, Chlamydophila pneumoniae CWL029
ucacacgaauaauuaaaucgua

SEQ ID NO: 2538231 - RNA, 19 nt, Chlamydophila pneumoniae CWL029
ucacacguaagaaaggaug

SEQ ID NO: 2538232 - RNA, 23 nt, Chlamydophila pneumoniae CWL029
ucacagagucugggauguucaaa

SEQ ID NO: 2538233 - RNA, 16 nt, Chlamydophila pneumoniae CWL029
ucacagauaccaucac

SEQ ID NO: 2538234 - RNA, 15 nt, Chlamydophila pneumoniae CWL029
ucacagauguaaucu

SEQ ID NO: 2538235 - RNA, 15 nt, Chlamydophila pneumoniae CWL029
ucacagcaaucugca

SEQ ID NO: 2538236 - RNA, 16 nt, Chlamydophila pneumoniae CWL029
ucacagcaaucugcag

SEQ ID NO: 2538237 - RNA, 18 nt, Chlamydophila pneumoniae CWL029
ucacagcaugcacggcuu

SEQ ID NO: 2538238 - RNA, 22 nt, Chlamydophila pneumoniae CWL029
ucacagcauuuucucugagcag

SEQ ID NO: 2538239 - RNA, 14 nt, Chlamydophila pneumoniae CWL029
ucacagucuuaaau

SEQ ID NO: 2538240 - RNA, 19 nt, Chlamydophila pneumoniae CWL029
ucacaguuaagacgcagaa

SEQ ID NO: 2538241 - RNA, 20 nt, Chlamydophila pneumoniae CWL029
ucacauaguuuaauaaaucu

SEQ ID NO: 2538242 - RNA, 13 nt, Chlamydophila pneumoniae CWL029
ucacaucaagaua

SEQ ID NO: 2538243 - RNA, 19 nt, Chlamydophila pneumoniae CWL029
ucacaucaguuaacugugu

SEQ ID NO: 2538244 - RNA, 20 nt, Chlamydophila pneumoniae CWL029
ucacaucaguuaacugugua

SEQ ID NO: 2538245 - RNA, 14 nt, Chlamydophila pneumoniae CWL029
ucacaucaguucca

SEQ ID NO: 2538246 - RNA, 15 nt, Chlamydophila pneumoniae CWL029
ucacauccuguaguu

SEQ ID NO: 2538247 - RNA, 15 nt, Chlamydophila pneumoniae CWL029
ucacaucuccuuuca

SEQ ID NO: 2538248 - RNA, 14 nt, Chlamydophila pneumoniae CWL029
ucacaucuuucucu

SEQ ID NO: 2538249 - RNA, 15 nt, Chlamydophila pneumoniae CWL029
ucacaucuuucucua

SEQ ID NO: 2538250 - RNA, 13 nt, Chlamydophila pneumoniae CWL029
ucaccaacuccuc

SEQ ID NO: 2538251 - RNA, 18 nt, Chlamydophila pneumoniae CWL029
ucaccacaaaccucuaaa

SEQ ID NO: 2538252 - RNA, 22 nt, Chlamydophila pneumoniae CWL029
ucaccacgaacuucagcaagaa

SEQ ID NO: 2538253 - RNA, 20 nt, Chlamydophila pneumoniae CWL029
ucaccagaagcaacuaaacu

SEQ ID NO: 2538254 - RNA, 15 nt, Chlamydophila pneumoniae CWL029
ucaccagaagcauug

SEQ ID NO: 2538255 - RNA, 20 nt, Chlamydophila pneumoniae CWL029
ucaccauauaauagauauac

SEQ ID NO: 2538256 - RNA, 18 nt, Chlamydophila pneumoniae CWL029
ucaccauccaaagcuauu

SEQ ID NO: 2538257 - RNA, 13 nt, Chlamydophila pneumoniae CWL029
ucaccauuaaauu

SEQ ID NO: 2538258 - RNA, 14 nt, Chlamydophila pneumoniae CWL029
ucaccauuaagaua

SEQ ID NO: 2538259 - RNA, 20 nt, Chlamydophila pneumoniae CWL029
ucaccauuaagauaucugcu

SEQ ID NO: 2538260 - RNA, 21 nt, Chlamydophila pneumoniae CWL029
ucaccauuaagauaucugcuc

SEQ ID NO: 2538261 - RNA, 22 nt, Chlamydophila pneumoniae CWL029
ucaccgcgcauagcaacuacag

SEQ ID NO: 2538262 - RNA, 15 nt, Chlamydophila pneumoniae CWL029
ucaccuacaucagac

SEQ ID NO: 2538263 - RNA, 18 nt, Chlamydophila pneumoniae CWL029
ucaccuacaucagacuga

SEQ ID NO: 2538264 - RNA, 14 nt, Chlamydophila pneumoniae CWL029
ucaccugagcuaua

SEQ ID NO: 2538265 - RNA, 15 nt, Chlamydophila pneumoniae CWL029
ucaccuuagagugac

SEQ ID NO: 2538266 - RNA, 20 nt, Chlamydophila pneumoniae CWL029
ucaccuugaaguuuuuucuc

SEQ ID NO: 2538267 - RNA, 13 nt, Chlamydophila pneumoniae CWL029
ucacgaaaaggag

SEQ ID NO: 2538268 - RNA, 17 nt, Chlamydophila pneumoniae CWL029
ucacgaaaaggagaaua

SEQ ID NO: 2538269 - RNA, 20 nt, Chlamydophila pneumoniae CWL029
ucacgagucccuucuuucaa

SEQ ID NO: 2538270 - RNA, 14 nt, Chlamydophila pneumoniae CWL029
ucacgauuucggga

SEQ ID NO: 2538271 - RNA, 21 nt, Chlamydophila pneumoniae CWL029
ucacguauagguugaauaaau

SEQ ID NO: 2538272 - RNA, 16 nt, Chlamydophila pneumoniae CWL029
ucacguccacaagcuu

SEQ ID NO: 2538273 - RNA, 13 nt, Chlamydophila pneumoniae CWL029
ucacuaucaugga

SEQ ID NO: 2538274 - RNA, 16 nt, Chlamydophila pneumoniae CWL029
ucacucaaacccucuc

SEQ ID NO: 2538275 - RNA, 16 nt, Chlamydophila pneumoniae CWL029
ucacucuagaaaauau

SEQ ID NO: 2538276 - RNA, 17 nt, Chlamydophila pneumoniae CWL029
ucacucuagaaaauauu

SEQ ID NO: 2538277 - RNA, 23 nt, Chlamydophila pneumoniae CWL029
ucacucuagaaaauauuccugga

SEQ ID NO: 2538278 - RNA, 13 nt, Chlamydophila pneumoniae CWL029
ucacucuaugaga

SEQ ID NO: 2538279 - RNA, 23 nt, Chlamydophila pneumoniae CWL029
ucacugucggaaguuucagagcc

SEQ ID NO: 2538280 - RNA, 16 nt, Chlamydophila pneumoniae CWL029
ucacuuauaagcugcu

SEQ ID NO: 2538281 - RNA, 14 nt, Chlamydophila pneumoniae CWL029
ucacuucaauuaca

SEQ ID NO: 2538282 - RNA, 20 nt, Chlamydophila pneumoniae CWL029
ucacuucgacacgaacuuug

SEQ ID NO: 2538283 - RNA, 15 nt, Chlamydophila pneumoniae CWL029
ucagaaaauguaaaa

SEQ ID NO: 2538284 - RNA, 23 nt, Chlamydophila pneumoniae CWL029
ucagaaaauguaaaaaauuauuu

SEQ ID NO: 2538285 - RNA, 16 nt, Chlamydophila pneumoniae CWL029
ucagaaacaugaaguu

SEQ ID NO: 2538286 - RNA, 22 nt, Chlamydophila pneumoniae CWL029
ucagaaaugaagccaaaaggca

SEQ ID NO: 2538287 - RNA, 21 nt, Chlamydophila pneumoniae CWL029
ucagaacaacgcugcuucucu

SEQ ID NO: 2538288 - RNA, 15 nt, Chlamydophila pneumoniae CWL029
ucagaagcuccugag

SEQ ID NO: 2538289 - RNA, 23 nt, Chlamydophila pneumoniae CWL029
ucagaaggaucugauagaacagg

SEQ ID NO: 2538290 - RNA, 21 nt, Chlamydophila pneumoniae CWL029
ucagaagugaucuugagaaaa

SEQ ID NO: 2538291 - RNA, 16 nt, Chlamydophila pneumoniae CWL029
ucagaaucuuugugau

SEQ ID NO: 2538292 - RNA, 19 nt, Chlamydophila pneumoniae CWL029
ucagaaugcccuuuaggga

SEQ ID NO: 2538293 - RNA, 20 nt, Chlamydophila pneumoniae CWL029
ucagaauuuuaucagaaacu

SEQ ID NO: 2538294 - RNA, 19 nt, Chlamydophila pneumoniae CWL029
ucagacgugcucucuacuu

SEQ ID NO: 2538295 - RNA, 13 nt, Chlamydophila pneumoniae CWL029
ucagagagaacag

SEQ ID NO: 2538296 - RNA, 18 nt, Chlamydophila pneumoniae CWL029
ucagagauugccaggaga

SEQ ID NO: 2538297 - RNA, 19 nt, Chlamydophila pneumoniae CWL029
ucagagauugccaggagag

SEQ ID NO: 2538298 - RNA, 17 nt, Chlamydophila pneumoniae CWL029
ucagagauuuuaaagcc

SEQ ID NO: 2538299 - RNA, 18 nt, Chlamydophila pneumoniae CWL029
ucagaggaaucuaagaac

SEQ ID NO: 2538300 - RNA, 17 nt, Chlamydophila pneumoniae CWL029
ucagaggagccuccaua

SEQ ID NO: 2538301 - RNA, 19 nt, Chlamydophila pneumoniae CWL029
ucagaguugucaaguaagu

SEQ ID NO: 2538302 - RNA, 21 nt, Chlamydophila pneumoniae CWL029
ucagauaaguuacuuucugau

SEQ ID NO: 2538303 - RNA, 14 nt, Chlamydophila pneumoniae CWL029
ucagauuuuuuaac

SEQ ID NO: 2538304 - RNA, 20 nt, Chlamydophila pneumoniae CWL029
ucagcaaagacauccaagcc

SEQ ID NO: 2538305 - RNA, 13 nt, Chlamydophila pneumoniae CWL029
ucagcaacauaaa

SEQ ID NO: 2538306 - RNA, 21 nt, Chlamydophila pneumoniae CWL029
ucagcaacaucguuaauauaa

SEQ ID NO: 2538307 - RNA, 13 nt, Chlamydophila pneumoniae CWL029
ucagcaagaaaau

SEQ ID NO: 2538308 - RNA, 18 nt, Chlamydophila pneumoniae CWL029
ucagcaagaaaauaggug

SEQ ID NO: 2538309 - RNA, 19 nt, Chlamydophila pneumoniae CWL029
ucagcaagaucuaacuuca

SEQ ID NO: 2538310 - RNA, 15 nt, Chlamydophila pneumoniae CWL029
ucagcacccaccauu

SEQ ID NO: 2538311 - RNA, 19 nt, Chlamydophila pneumoniae CWL029
ucagcagcugucaauccaa

SEQ ID NO: 2538312 - RNA, 18 nt, Chlamydophila pneumoniae CWL029
ucagcagcuucuauugcu

SEQ ID NO: 2538313 - RNA, 21 nt, Chlamydophila pneumoniae CWL029
ucagcagcuucuauugcugua

SEQ ID NO: 2538314 - RNA, 18 nt, Chlamydophila pneumoniae CWL029
ucagcauagagagaagga

SEQ ID NO: 2538315 - RNA, 12 nt, Chlamydophila pneumoniae CWL029
ucagcauuuuau

SEQ ID NO: 2538316 - RNA, 16 nt, Chlamydophila pneumoniae CWL029
ucagcccacuguuuug

SEQ ID NO: 2538317 - RNA, 20 nt, Chlamydophila pneumoniae CWL029
ucagcccacuguuuugcuuc

SEQ ID NO: 2538318 - RNA, 21 nt, Chlamydophila pneumoniae CWL029
ucagcccugccucacagcuaa

SEQ ID NO: 2538319 - RNA, 21 nt, Chlamydophila pneumoniae CWL029
ucagcuaauuuaaaugccuua

SEQ ID NO: 2538320 - RNA, 19 nt, Chlamydophila pneumoniae CWL029
ucagcuagagcacauagaa

SEQ ID NO: 2538321 - RNA, 21 nt, Chlamydophila pneumoniae CWL029
ucagcucccaugugcugaaga

SEQ ID NO: 2538322 - RNA, 23 nt, Chlamydophila pneumoniae CWL029
ucagcucuaauucuucuacagaa

SEQ ID NO: 2538323 - RNA, 14 nt, Chlamydophila pneumoniae CWL029
ucagcuguccuccg

SEQ ID NO: 2538324 - RNA, 15 nt, Chlamydophila pneumoniae CWL029
ucagcuuaucuauag

SEQ ID NO: 2538325 - RNA, 15 nt, Chlamydophila pneumoniae CWL029
ucagcuucuacagca

SEQ ID NO: 2538326 - RNA, 14 nt, Chlamydophila pneumoniae CWL029
ucagcuucuugaug

SEQ ID NO: 2538327 - RNA, 16 nt, Chlamydophila pneumoniae CWL029
ucagcuuguuuuugca

SEQ ID NO: 2538328 - RNA, 16 nt, Chlamydophila pneumoniae CWL029
ucagcuuuaacaugcc

SEQ ID NO: 2538329 - RNA, 19 nt, Chlamydophila pneumoniae CWL029
ucagcuuugcuuaaaaagu

SEQ ID NO: 2538330 - RNA, 18 nt, Chlamydophila pneumoniae CWL029
ucaggaaaacuuaauaag

SEQ ID NO: 2538331 - RNA, 20 nt, Chlamydophila pneumoniae CWL029
ucaggaaaacuuaauaagcg

SEQ ID NO: 2538332 - RNA, 19 nt, Chlamydophila pneumoniae CWL029
ucaggaaagguaguuuucu

SEQ ID NO: 2538333 - RNA, 21 nt, Chlamydophila pneumoniae CWL029
ucaggaagaaaggauuggaug

SEQ ID NO: 2538334 - RNA, 17 nt, Chlamydophila pneumoniae CWL029
ucaggacccuuuuccuc

SEQ ID NO: 2538335 - RNA, 22 nt, Chlamydophila pneumoniae CWL029
ucaggaccuaagggcucuccua

SEQ ID NO: 2538336 - RNA, 17 nt, Chlamydophila pneumoniae CWL029
ucaggagauacaagcaa

SEQ ID NO: 2538337 - RNA, 23 nt, Chlamydophila pneumoniae CWL029
ucaggauacucugaacaggaaua

SEQ ID NO: 2538338 - RNA, 18 nt, Chlamydophila pneumoniae CWL029
ucaggauuacggaaaaua

SEQ ID NO: 2538339 - RNA, 17 nt, Chlamydophila pneumoniae CWL029
ucaggauuaguaacuaa

SEQ ID NO: 2538340 - RNA, 13 nt, Chlamydophila pneumoniae CWL029
ucaggauuuucca

SEQ ID NO: 2538341 - RNA, 23 nt, Chlamydophila pneumoniae CWL029
ucaggcauucuucauuguagagg

SEQ ID NO: 2538342 - RNA, 21 nt, Chlamydophila pneumoniae CWL029
ucagggagcggaauuucucau

SEQ ID NO: 2538343 - RNA, 19 nt, Chlamydophila pneumoniae CWL029
ucagggggaaagccaagaa

SEQ ID NO: 2538344 - RNA, 18 nt, Chlamydophila pneumoniae CWL029
ucaggucugcugaggaga

SEQ ID NO: 2538345 - RNA, 20 nt, Chlamydophila pneumoniae CWL029
ucaguaaacccucagaacac

SEQ ID NO: 2538346 - RNA, 21 nt, Chlamydophila pneumoniae CWL029
ucaguaaacccucagaacacg

SEQ ID NO: 2538347 - RNA, 14 nt, Chlamydophila pneumoniae CWL029
ucaguaaauauuuu

SEQ ID NO: 2538348 - RNA, 15 nt, Chlamydophila pneumoniae CWL029
ucagucuuccuuuau

SEQ ID NO: 2538349 - RNA, 16 nt, Chlamydophila pneumoniae CWL029
ucagucuuccuuuaua

SEQ ID NO: 2538350 - RNA, 19 nt, Chlamydophila pneumoniae CWL029
ucagugucuugaagagauu

SEQ ID NO: 2538351 - RNA, 20 nt, Chlamydophila pneumoniae CWL029
ucaguuccucauccucauca

SEQ ID NO: 2538352 - RNA, 19 nt, Chlamydophila pneumoniae CWL029
ucaguuuuuucuucugaca

SEQ ID NO: 2538353 - RNA, 10 nt, Chlamydophila pneumoniae CWL029
ucauaaacaa

SEQ ID NO: 2538354 - RNA, 15 nt, Chlamydophila pneumoniae CWL029
ucauaaacagcagug

SEQ ID NO: 2538355 - RNA, 14 nt, Chlamydophila pneumoniae CWL029
ucauaaagaggaau

SEQ ID NO: 2538356 - RNA, 19 nt, Chlamydophila pneumoniae CWL029
ucauaaaguauauugacaa

SEQ ID NO: 2538357 - RNA, 20 nt, Chlamydophila pneumoniae CWL029
ucauaaauacgugcuugaau

SEQ ID NO: 2538358 - RNA, 14 nt, Chlamydophila pneumoniae CWL029
ucauaaauaggcuc

SEQ ID NO: 2538359 - RNA, 15 nt, Chlamydophila pneumoniae CWL029
ucauaaccaaaagaa

SEQ ID NO: 2538360 - RNA, 16 nt, Chlamydophila pneumoniae CWL029
ucauaaccaaguaaau

SEQ ID NO: 2538361 - RNA, 15 nt, Chlamydophila pneumoniae CWL029
ucauaaccuaaggca

SEQ ID NO: 2538362 - RNA, 15 nt, Chlamydophila pneumoniae CWL029
ucauaaccugggcaa

SEQ ID NO: 2538363 - RNA, 13 nt, Chlamydophila pneumoniae CWL029
ucauaagaaauuc

SEQ ID NO: 2538364 - RNA, 17 nt, Chlamydophila pneumoniae CWL029
ucauaagaguagacaag

SEQ ID NO: 2538365 - RNA, 17 nt, Chlamydophila pneumoniae CWL029
ucauaagauagagcgac

SEQ ID NO: 2538366 - RNA, 13 nt, Chlamydophila pneumoniae CWL029
ucauaagauuucc

SEQ ID NO: 2538367 - RNA, 17 nt, Chlamydophila pneumoniae CWL029
ucauaagcucuauuucu

SEQ ID NO: 2538368 - RNA, 23 nt, Chlamydophila pneumoniae CWL029
ucauagcauguucgauuuucucu

SEQ ID NO: 2538369 - RNA, 23 nt, Chlamydophila pneumoniae CWL029
ucauaggaaacgcccuucuuagu

SEQ ID NO: 2538370 - RNA, 19 nt, Chlamydophila pneumoniae CWL029
ucauauaaaacgaucccua

SEQ ID NO: 2538371 - RNA, 19 nt, Chlamydophila pneumoniae CWL029
ucauauaaaguuuccaagu

SEQ ID NO: 2538372 - RNA, 20 nt, Chlamydophila pneumoniae CWL029
ucauaugaaugacugcagau

SEQ ID NO: 2538373 - RNA, 12 nt, Chlamydophila pneumoniae CWL029
ucauauuuaaaa

SEQ ID NO: 2538374 - RNA, 15 nt, Chlamydophila pneumoniae CWL029
ucauauuuauuuaaa

SEQ ID NO: 2538375 - RNA, 19 nt, Chlamydophila pneumoniae CWL029
ucauauuuuucuugaaggu

SEQ ID NO: 2538376 - RNA, 20 nt, Chlamydophila pneumoniae CWL029
ucauauuuuucuugaagguu

SEQ ID NO: 2538377 - RNA, 17 nt, Chlamydophila pneumoniae CWL029
ucauauuuuuguccugc

SEQ ID NO: 2538378 - RNA, 14 nt, Chlamydophila pneumoniae CWL029
ucaucaaaaagauc

SEQ ID NO: 2538379 - RNA, 12 nt, Chlamydophila pneumoniae CWL029
ucaucaaagcaa

SEQ ID NO: 2538380 - RNA, 15 nt, Chlamydophila pneumoniae CWL029
ucaucaaagcaaaga

SEQ ID NO: 2538381 - RNA, 17 nt, Chlamydophila pneumoniae CWL029
ucaucaaugguuaaaac

SEQ ID NO: 2538382 - RNA, 18 nt, Chlamydophila pneumoniae CWL029
ucaucacaauuuuaaaau

SEQ ID NO: 2538383 - RNA, 16 nt, Chlamydophila pneumoniae CWL029
ucaucacaucaguuaa

SEQ ID NO: 2538384 - RNA, 22 nt, Chlamydophila pneumoniae CWL029
ucaucaccauccaaagcuauuu

SEQ ID NO: 2538385 - RNA, 13 nt, Chlamydophila pneumoniae CWL029
ucaucagaagcuc

SEQ ID NO: 2538386 - RNA, 23 nt, Chlamydophila pneumoniae CWL029
ucaucagaaguggccuugccagu

SEQ ID NO: 2538387 - RNA, 14 nt, Chlamydophila pneumoniae CWL029
ucaucagaggccac

SEQ ID NO: 2538388 - RNA, 15 nt, Chlamydophila pneumoniae CWL029
ucaucagcaaaacuc

SEQ ID NO: 2538389 - RNA, 21 nt, Chlamydophila pneumoniae CWL029
ucaucagcuucccaauuguau

SEQ ID NO: 2538390 - RNA, 19 nt, Chlamydophila pneumoniae CWL029
ucaucauaaauaggcucua

SEQ ID NO: 2538391 - RNA, 17 nt, Chlamydophila pneumoniae CWL029
ucaucccacgggucagg

SEQ ID NO: 2538392 - RNA, 14 nt, Chlamydophila pneumoniae CWL029
ucauccccucagaa

SEQ ID NO: 2538393 - RNA, 15 nt, Chlamydophila pneumoniae CWL029
ucauccccucagaaa

SEQ ID NO: 2538394 - RNA, 18 nt, Chlamydophila pneumoniae CWL029
ucauccccucagaaagga

SEQ ID NO: 2538395 - RNA, 23 nt, Chlamydophila pneumoniae CWL029
ucauccccucagaaaggagaucc

SEQ ID NO: 2538396 - RNA, 15 nt, Chlamydophila pneumoniae CWL029
ucauccgaagacuca

SEQ ID NO: 2538397 - RNA, 12 nt, Chlamydophila pneumoniae CWL029
ucauccucauca

SEQ ID NO: 2538398 - RNA, 14 nt, Chlamydophila pneumoniae CWL029
ucauccucaucauc

SEQ ID NO: 2538399 - RNA, 18 nt, Chlamydophila pneumoniae CWL029
ucauccucaucaucagaa

SEQ ID NO: 2538400 - RNA, 23 nt, Chlamydophila pneumoniae CWL029
ucauccuuuagcuguuucucugu

SEQ ID NO: 2538401 - RNA, 16 nt, Chlamydophila pneumoniae CWL029
ucaucgcaaucaaaga

SEQ ID NO: 2538402 - RNA, 23 nt, Chlamydophila pneumoniae CWL029
ucaucggcuucuccaacuuccau

SEQ ID NO: 2538403 - RNA, 23 nt, Chlamydophila pneumoniae CWL029
ucaucgucgcgacugaagucagu

SEQ ID NO: 2538404 - RNA, 18 nt, Chlamydophila pneumoniae CWL029
ucaucucgcaguccaaag

SEQ ID NO: 2538405 - RNA, 23 nt, Chlamydophila pneumoniae CWL029
ucaucucguugggcucauaaccc

SEQ ID NO: 2538406 - RNA, 21 nt, Chlamydophila pneumoniae CWL029
ucaucugucauuaaaaauuua

SEQ ID NO: 2538407 - RNA, 14 nt, Chlamydophila pneumoniae CWL029
ucaucuuccucuuu

SEQ ID NO: 2538408 - RNA, 20 nt, Chlamydophila pneumoniae CWL029
ucaucuuguacgaaaaucua

SEQ ID NO: 2538409 - RNA, 21 nt, Chlamydophila pneumoniae CWL029
ucaucuuguacgaaaaucuac

SEQ ID NO: 2538410 - RNA, 11 nt, Chlamydophila pneumoniae CWL029
ucaugaaagug

SEQ ID NO: 2538411 - RNA, 15 nt, Chlamydophila pneumoniae CWL029
ucaugaagaauuacc

SEQ ID NO: 2538412 - RNA, 16 nt, Chlamydophila pneumoniae CWL029
ucaugagaauuuucau

SEQ ID NO: 2538413 - RNA, 23 nt, Chlamydophila pneumoniae CWL029
ucaugagccgauguugcagaaug

SEQ ID NO: 2538414 - RNA, 22 nt, Chlamydophila pneumoniae CWL029
ucaugauaaaaauuuucaggaa

SEQ ID NO: 2538415 - RNA, 21 nt, Chlamydophila pneumoniae CWL029
ucaugcggacuuuauucucuu

SEQ ID NO: 2538416 - RNA, 16 nt, Chlamydophila pneumoniae CWL029
ucauguagcagagccu

SEQ ID NO: 2538417 - RNA, 16 nt, Chlamydophila pneumoniae CWL029
ucauuaagaacaucuu

SEQ ID NO: 2538418 - RNA, 13 nt, Chlamydophila pneumoniae CWL029
ucauuaagaagau

SEQ ID NO: 2538419 - RNA, 12 nt, Chlamydophila pneumoniae CWL029
ucauuaagaucc

SEQ ID NO: 2538420 - RNA, 22 nt, Chlamydophila pneumoniae CWL029
ucauuaagauccuuuaaagauu

SEQ ID NO: 2538421 - RNA, 18 nt, Chlamydophila pneumoniae CWL029
ucauuaauaauaucuaac

SEQ ID NO: 2538422 - RNA, 12 nt, Chlamydophila pneumoniae CWL029
ucauuaccugcu

SEQ ID NO: 2538423 - RNA, 14 nt, Chlamydophila pneumoniae CWL029
ucauuaccugcuaa

SEQ ID NO: 2538424 - RNA, 20 nt, Chlamydophila pneumoniae CWL029
ucauuagcccuacgaaucca

SEQ ID NO: 2538425 - RNA, 15 nt, Chlamydophila pneumoniae CWL029
ucauuaucaagaaau

SEQ ID NO: 2538426 - RNA, 17 nt, Chlamydophila pneumoniae CWL029
ucauuaucacagaugua

SEQ ID NO: 2538427 - RNA, 21 nt, Chlamydophila pneumoniae CWL029
ucauucaaauauaugaguuua

SEQ ID NO: 2538428 - RNA, 14 nt, Chlamydophila pneumoniae CWL029
ucauuccagcaucu

SEQ ID NO: 2538429 - RNA, 15 nt, Chlamydophila pneumoniae CWL029
ucauuccaggauucu

SEQ ID NO: 2538430 - RNA, 16 nt, Chlamydophila pneumoniae CWL029
ucauucccuuuuucca

SEQ ID NO: 2538431 - RNA, 22 nt, Chlamydophila pneumoniae CWL029
ucauugcuauugaaaaaucccu

SEQ ID NO: 2538432 - RNA, 15 nt, Chlamydophila pneumoniae CWL029
ucauuuuaguuuuca

SEQ ID NO: 2538433 - RNA, 12 nt, Chlamydophila pneumoniae CWL029
ucauuuuuuaau

SEQ ID NO: 2538434 - RNA, 15 nt, Chlamydophila pneumoniae CWL029
ucauuuuuuaauaaa

SEQ ID NO: 2538435 - RNA, 14 nt, Chlamydophila pneumoniae CWL029
uccaaaaaagagcc

SEQ ID NO: 2538436 - RNA, 15 nt, Chlamydophila pneumoniae CWL029
uccaaaaacuucuaa

SEQ ID NO: 2538437 - RNA, 12 nt, Chlamydophila pneumoniae CWL029
uccaaaacucaa

SEQ ID NO: 2538438 - RNA, 15 nt, Chlamydophila pneumoniae CWL029
uccaaaagaccaaaa

SEQ ID NO: 2538439 - RNA, 17 nt, Chlamydophila pneumoniae CWL029
uccaaaagaccaaaaau

SEQ ID NO: 2538440 - RNA, 17 nt, Chlamydophila pneumoniae CWL029
uccaaaauaaaaggagc

SEQ ID NO: 2538441 - RNA, 22 nt, Chlamydophila pneumoniae CWL029
uccaaaauaaucucgcaguccu

SEQ ID NO: 2538442 - RNA, 16 nt, Chlamydophila pneumoniae CWL029
uccaaacccugggcuc

SEQ ID NO: 2538443 - RNA, 20 nt, Chlamydophila pneumoniae CWL029
uccaaacguggucauuagcc

SEQ ID NO: 2538444 - RNA, 17 nt, Chlamydophila pneumoniae CWL029
uccaaagaucaucuuca

SEQ ID NO: 2538445 - RNA, 18 nt, Chlamydophila pneumoniae CWL029
uccaaagccugaaaaaua

SEQ ID NO: 2538446 - RNA, 17 nt, Chlamydophila pneumoniae CWL029
uccaaagcuauuucucu

SEQ ID NO: 2538447 - RNA, 20 nt, Chlamydophila pneumoniae CWL029
uccaaaggaaaauaaucuuc

SEQ ID NO: 2538448 - RNA, 21 nt, Chlamydophila pneumoniae CWL029
uccaaaggaaaauaaucuuca

SEQ ID NO: 2538449 - RNA, 12 nt, Chlamydophila pneumoniae CWL029
uccaaauaaagc

SEQ ID NO: 2538450 - RNA, 22 nt, Chlamydophila pneumoniae CWL029
uccaaauagagugaccauagca

SEQ ID NO: 2538451 - RNA, 14 nt, Chlamydophila pneumoniae CWL029
uccaaauguucucu

SEQ ID NO: 2538452 - RNA, 13 nt, Chlamydophila pneumoniae CWL029
uccaacaucagcu

SEQ ID NO: 2538453 - RNA, 17 nt, Chlamydophila pneumoniae CWL029
uccaacuuccauaugag

SEQ ID NO: 2538454 - RNA, 16 nt, Chlamydophila pneumoniae CWL029
uccaacuuuugaagau

SEQ ID NO: 2538455 - RNA, 22 nt, Chlamydophila pneumoniae CWL029
uccaacuuuugaagauccugag

SEQ ID NO: 2538456 - RNA, 21 nt, Chlamydophila pneumoniae CWL029
uccaagaagucaucgcgagag

SEQ ID NO: 2538457 - RNA, 18 nt, Chlamydophila pneumoniae CWL029
uccaagaauagccauaau

SEQ ID NO: 2538458 - RNA, 20 nt, Chlamydophila pneumoniae CWL029
uccaagacaacaccucccac

SEQ ID NO: 2538459 - RNA, 19 nt, Chlamydophila pneumoniae CWL029
uccaagacaauaaaaaaga

SEQ ID NO: 2538460 - RNA, 20 nt, Chlamydophila pneumoniae CWL029
uccaagacaauaaaaaagag

SEQ ID NO: 2538461 - RNA, 21 nt, Chlamydophila pneumoniae CWL029
uccaagacaauaaaaaagaga

SEQ ID NO: 2538462 - RNA, 15 nt, Chlamydophila pneumoniae CWL029
uccaagaguucucuu

SEQ ID NO: 2538463 - RNA, 12 nt, Chlamydophila pneumoniae CWL029
uccaagaucucc

SEQ ID NO: 2538464 - RNA, 22 nt, Chlamydophila pneumoniae CWL029
uccaagaucuccgccuacaaua

SEQ ID NO: 2538465 - RNA, 22 nt, Chlamydophila pneumoniae CWL029
uccaagugaucagaaaugaagc

SEQ ID NO: 2538466 - RNA, 23 nt, Chlamydophila pneumoniae CWL029
uccaagugaucagaaaugaagcc

SEQ ID NO: 2538467 - RNA, 13 nt, Chlamydophila pneumoniae CWL029
uccaauacuaaaa

SEQ ID NO: 2538468 - RNA, 20 nt, Chlamydophila pneumoniae CWL029
uccaauagccaaagacucuu

SEQ ID NO: 2538469 - RNA, 17 nt, Chlamydophila pneumoniae CWL029
uccaauaggccagaaug

SEQ ID NO: 2538470 - RNA, 23 nt, Chlamydophila pneumoniae CWL029
uccaauaggccagaauguacaua

SEQ ID NO: 2538471 - RNA, 13 nt, Chlamydophila pneumoniae CWL029
uccaaucugcuga

SEQ ID NO: 2538472 - RNA, 16 nt, Chlamydophila pneumoniae CWL029
uccaaucugcugaagg

SEQ ID NO: 2538473 - RNA, 17 nt, Chlamydophila pneumoniae CWL029
uccaaugagagagagac

SEQ ID NO: 2538474 - RNA, 16 nt, Chlamydophila pneumoniae CWL029
uccaaugcaugaaucu

SEQ ID NO: 2538475 - RNA, 17 nt, Chlamydophila pneumoniae CWL029
uccaauuguaaaucauu

SEQ ID NO: 2538476 - RNA, 14 nt, Chlamydophila pneumoniae CWL029
uccaauuuucuuca

SEQ ID NO: 2538477 - RNA, 19 nt, Chlamydophila pneumoniae CWL029
uccaauuuuugcauagaca

SEQ ID NO: 2538478 - RNA, 14 nt, Chlamydophila pneumoniae CWL029
uccacaagccuccc

SEQ ID NO: 2538479 - RNA, 17 nt, Chlamydophila pneumoniae CWL029
uccacaagcuuuucgca

SEQ ID NO: 2538480 - RNA, 19 nt, Chlamydophila pneumoniae CWL029
uccacagagaccuucucuu

SEQ ID NO: 2538481 - RNA, 20 nt, Chlamydophila pneumoniae CWL029
uccacagagaccuucucuuc

SEQ ID NO: 2538482 - RNA, 17 nt, Chlamydophila pneumoniae CWL029
uccacaucuugagcuuc

SEQ ID NO: 2538483 - RNA, 13 nt, Chlamydophila pneumoniae CWL029
uccacaugcccaa

SEQ ID NO: 2538484 - RNA, 13 nt, Chlamydophila pneumoniae CWL029
uccaccaagacug

SEQ ID NO: 2538485 - RNA, 20 nt, Chlamydophila pneumoniae CWL029
uccaccaggagcuccuccuu

SEQ ID NO: 2538486 - RNA, 23 nt, Chlamydophila pneumoniae CWL029
uccaccaggagcuccuccuugaa

SEQ ID NO: 2538487 - RNA, 22 nt, Chlamydophila pneumoniae CWL029
uccaccgcucacacgaauaauu

SEQ ID NO: 2538488 - RNA, 14 nt, Chlamydophila pneumoniae CWL029
uccacgaaggaauc

SEQ ID NO: 2538489 - RNA, 22 nt, Chlamydophila pneumoniae CWL029
uccacgaccugcaaacucccca

SEQ ID NO: 2538490 - RNA, 17 nt, Chlamydophila pneumoniae CWL029
uccacgagauucugcuu

SEQ ID NO: 2538491 - RNA, 21 nt, Chlamydophila pneumoniae CWL029
uccacgaguucgcggaucuuc

SEQ ID NO: 2538492 - RNA, 23 nt, Chlamydophila pneumoniae CWL029
uccacgaguucgcggaucuucuu

SEQ ID NO: 2538493 - RNA, 15 nt, Chlamydophila pneumoniae CWL029
uccacggaaauauuc

SEQ ID NO: 2538494 - RNA, 15 nt, Chlamydophila pneumoniae CWL029
uccacugcuuuaggc

SEQ ID NO: 2538495 - RNA, 19 nt, Chlamydophila pneumoniae CWL029
uccacuguucuucuucagu

SEQ ID NO: 2538496 - RNA, 17 nt, Chlamydophila pneumoniae CWL029
uccagaaaaagaacaua

SEQ ID NO: 2538497 - RNA, 15 nt, Chlamydophila pneumoniae CWL029
uccagaaacgcagcu

SEQ ID NO: 2538498 - RNA, 19 nt, Chlamydophila pneumoniae CWL029
uccagaaaguauuccucuu

SEQ ID NO: 2538499 - RNA, 13 nt, Chlamydophila pneumoniae CWL029
uccagaagcaaga

SEQ ID NO: 2538500 - RNA, 18 nt, Chlamydophila pneumoniae CWL029
uccagaucaaugccuugc

SEQ ID NO: 2538501 - RNA, 16 nt, Chlamydophila pneumoniae CWL029
uccagauuguucaaaa

SEQ ID NO: 2538502 - RNA, 16 nt, Chlamydophila pneumoniae CWL029
uccagcaacaaccaaa

SEQ ID NO: 2538503 - RNA, 23 nt, Chlamydophila pneumoniae CWL029
uccagcaccuuuaggaagcugua

SEQ ID NO: 2538504 - RNA, 13 nt, Chlamydophila pneumoniae CWL029
uccagcagcaaau

SEQ ID NO: 2538505 - RNA, 21 nt, Chlamydophila pneumoniae CWL029
uccagccugcaccagacccuc

SEQ ID NO: 2538506 - RNA, 13 nt, Chlamydophila pneumoniae CWL029
uccagcuccauaa

SEQ ID NO: 2538507 - RNA, 20 nt, Chlamydophila pneumoniae CWL029
uccagcugagcuaucuucaa

SEQ ID NO: 2538508 - RNA, 15 nt, Chlamydophila pneumoniae CWL029
uccagcuucucccau

SEQ ID NO: 2538509 - RNA, 15 nt, Chlamydophila pneumoniae CWL029
uccaggaauagaaag

SEQ ID NO: 2538510 - RNA, 17 nt, Chlamydophila pneumoniae CWL029
uccaggacguaaaaaga

SEQ ID NO: 2538511 - RNA, 16 nt, Chlamydophila pneumoniae CWL029
uccagggacagaaguc

SEQ ID NO: 2538512 - RNA, 22 nt, Chlamydophila pneumoniae CWL029
uccaggguagcgcuuuuuuaaa

SEQ ID NO: 2538513 - RNA, 23 nt, Chlamydophila pneumoniae CWL029
uccagguagcagaguuuuucccu

SEQ ID NO: 2538514 - RNA, 18 nt, Chlamydophila pneumoniae CWL029
uccaguagaucuucugaa

SEQ ID NO: 2538515 - RNA, 19 nt, Chlamydophila pneumoniae CWL029
uccaguagaucuucugaaa

SEQ ID NO: 2538516 - RNA, 22 nt, Chlamydophila pneumoniae CWL029
uccaguagaucuucugaaauca

SEQ ID NO: 2538517 - RNA, 16 nt, Chlamydophila pneumoniae CWL029
uccaguaucuucucuu

SEQ ID NO: 2538518 - RNA, 17 nt, Chlamydophila pneumoniae CWL029
uccaguaucuucucuua

SEQ ID NO: 2538519 - RNA, 19 nt, Chlamydophila pneumoniae CWL029
uccagucuggcuuaggagg

SEQ ID NO: 2538520 - RNA, 20 nt, Chlamydophila pneumoniae CWL029
uccaguuuguugaucucuaa

SEQ ID NO: 2538521 - RNA, 20 nt, Chlamydophila pneumoniae CWL029
uccauaaaaauguaauuuuu

SEQ ID NO: 2538522 - RNA, 18 nt, Chlamydophila pneumoniae CWL029
uccauaacaguuuguucu

SEQ ID NO: 2538523 - RNA, 19 nt, Chlamydophila pneumoniae CWL029
uccauaagcuuuucuucca

SEQ ID NO: 2538524 - RNA, 16 nt, Chlamydophila pneumoniae CWL029
uccauaauuucuuuca

SEQ ID NO: 2538525 - RNA, 18 nt, Chlamydophila pneumoniae CWL029
uccauacccaaauuucuu

SEQ ID NO: 2538526 - RNA, 21 nt, Chlamydophila pneumoniae CWL029
uccauagccaaggagcuauag

SEQ ID NO: 2538527 - RNA, 21 nt, Chlamydophila pneumoniae CWL029
uccauagcuaaguaacagucc

SEQ ID NO: 2538528 - RNA, 20 nt, Chlamydophila pneumoniae CWL029
uccauagcuuuagaagcccg

SEQ ID NO: 2538529 - RNA, 13 nt, Chlamydophila pneumoniae CWL029
uccauaggaacaa

SEQ ID NO: 2538530 - RNA, 22 nt, Chlamydophila pneumoniae CWL029
uccauaugggacuucaagccaa

SEQ ID NO: 2538531 - RNA, 23 nt, Chlamydophila pneumoniae CWL029
uccaucacgaggagcuuuuaccu

SEQ ID NO: 2538532 - RNA, 21 nt, Chlamydophila pneumoniae CWL029
uccaucggaauuugccugaaa

SEQ ID NO: 2538533 - RNA, 16 nt, Chlamydophila pneumoniae CWL029
uccaucggcauuucuc

SEQ ID NO: 2538534 - RNA, 13 nt, Chlamydophila pneumoniae CWL029
uccaucucuuuaa

SEQ ID NO: 2538535 - RNA, 23 nt, Chlamydophila pneumoniae CWL029
uccaugacuuuuguugcaauucc

SEQ ID NO: 2538536 - RNA, 18 nt, Chlamydophila pneumoniae CWL029
uccaugcuaauaauuccu

SEQ ID NO: 2538537 - RNA, 15 nt, Chlamydophila pneumoniae CWL029
uccauggcuauuuuu

SEQ ID NO: 2538538 - RNA, 19 nt, Chlamydophila pneumoniae CWL029
uccauggcuauuuuuaaaa

SEQ ID NO: 2538539 - RNA, 14 nt, Chlamydophila pneumoniae CWL029
uccauguacagaaa

SEQ ID NO: 2538540 - RNA, 16 nt, Chlamydophila pneumoniae CWL029
uccauguacaguuugu

SEQ ID NO: 2538541 - RNA, 22 nt, Chlamydophila pneumoniae CWL029
uccauguacaguuuguaaaaag

SEQ ID NO: 2538542 - RNA, 21 nt, Chlamydophila pneumoniae CWL029
uccauuagggcauucuguaau

SEQ ID NO: 2538543 - RNA, 15 nt, Chlamydophila pneumoniae CWL029
uccauuauacuuuuu

SEQ ID NO: 2538544 - RNA, 22 nt, Chlamydophila pneumoniae CWL029
uccauucagauggucagucucg

SEQ ID NO: 2538545 - RNA, 17 nt, Chlamydophila pneumoniae CWL029
uccauucugagaaagaa

SEQ ID NO: 2538546 - RNA, 18 nt, Chlamydophila pneumoniae CWL029
uccauucugagaaagaag

SEQ ID NO: 2538547 - RNA, 12 nt, Chlamydophila pneumoniae CWL029
uccauucuuaau

SEQ ID NO: 2538548 - RNA, 20 nt, Chlamydophila pneumoniae CWL029
uccauucuuaauauaaaaga

SEQ ID NO: 2538549 - RNA, 22 nt, Chlamydophila pneumoniae CWL029
uccauucuuaauauaaaagaag

SEQ ID NO: 2538550 - RNA, 21 nt, Chlamydophila pneumoniae CWL029
uccauuggaauccuuuggaag

SEQ ID NO: 2538551 - RNA, 16 nt, Chlamydophila pneumoniae CWL029
uccauuggcauagagc

SEQ ID NO: 2538552 - RNA, 16 nt, Chlamydophila pneumoniae CWL029
uccauuucuaggaauu

SEQ ID NO: 2538553 - RNA, 13 nt, Chlamydophila pneumoniae CWL029
ucccaaacuucuu

SEQ ID NO: 2538554 - RNA, 17 nt, Chlamydophila pneumoniae CWL029
ucccaaacuucuucucg

SEQ ID NO: 2538555 - RNA, 16 nt, Chlamydophila pneumoniae CWL029
ucccaagcugaaagaa

SEQ ID NO: 2538556 - RNA, 15 nt, Chlamydophila pneumoniae CWL029
ucccaagucugcuug

SEQ ID NO: 2538557 - RNA, 11 nt, Chlamydophila pneumoniae CWL029
ucccacagaaa

SEQ ID NO: 2538558 - RNA, 20 nt, Chlamydophila pneumoniae CWL029
ucccaccauauucucaggaa

SEQ ID NO: 2538559 - RNA, 20 nt, Chlamydophila pneumoniae CWL029
ucccacggugccuaggcuaa

SEQ ID NO: 2538560 - RNA, 22 nt, Chlamydophila pneumoniae CWL029
ucccacuggacuucguuuugau

SEQ ID NO: 2538561 - RNA, 18 nt, Chlamydophila pneumoniae CWL029
ucccagaagaaauuagag

SEQ ID NO: 2538562 - RNA, 20 nt, Chlamydophila pneumoniae CWL029
ucccagaaggggaauaauau

SEQ ID NO: 2538563 - RNA, 18 nt, Chlamydophila pneumoniae CWL029
ucccagauuuuuuugguu

SEQ ID NO: 2538564 - RNA, 18 nt, Chlamydophila pneumoniae CWL029
ucccaucuuguucuaaaa

SEQ ID NO: 2538565 - RNA, 17 nt, Chlamydophila pneumoniae CWL029
ucccaugugcugaagac

SEQ ID NO: 2538566 - RNA, 21 nt, Chlamydophila pneumoniae CWL029
ucccaugugcugaagaccaug

SEQ ID NO: 2538567 - RNA, 13 nt, Chlamydophila pneumoniae CWL029
uccccaagcucuc

SEQ ID NO: 2538568 - RNA, 16 nt, Chlamydophila pneumoniae CWL029
uccccagggagaucua

SEQ ID NO: 2538569 - RNA, 14 nt, Chlamydophila pneumoniae CWL029
uccccauucacaaa

SEQ ID NO: 2538570 - RNA, 18 nt, Chlamydophila pneumoniae CWL029
uccccauucacaaaucuu

SEQ ID NO: 2538571 - RNA, 23 nt, Chlamydophila pneumoniae CWL029
ucccccugaaugcaacagaguca

SEQ ID NO: 2538572 - RNA, 15 nt, Chlamydophila pneumoniae CWL029
uccccuccagucugg

SEQ ID NO: 2538573 - RNA, 19 nt, Chlamydophila pneumoniae CWL029
uccccucugauuauuucua

SEQ ID NO: 2538574 - RNA, 21 nt, Chlamydophila pneumoniae CWL029
uccccucugauuauuucuaaa

SEQ ID NO: 2538575 - RNA, 23 nt, Chlamydophila pneumoniae CWL029
uccccucugauuauuucuaaaaa

SEQ ID NO: 2538576 - RNA, 16 nt, Chlamydophila pneumoniae CWL029
uccccugcaucucugc

SEQ ID NO: 2538577 - RNA, 18 nt, Chlamydophila pneumoniae CWL029
uccccuuggaaaucagaa

SEQ ID NO: 2538578 - RNA, 22 nt, Chlamydophila pneumoniae CWL029
ucccgaacgcuagggaaaccau

SEQ ID NO: 2538579 - RNA, 13 nt, Chlamydophila pneumoniae CWL029
ucccgacaagcuu

SEQ ID NO: 2538580 - RNA, 17 nt, Chlamydophila pneumoniae CWL029
ucccgacauuuaacauc

SEQ ID NO: 2538581 - RNA, 21 nt, Chlamydophila pneumoniae CWL029
ucccgagggaugaugcccuga

SEQ ID NO: 2538582 - RNA, 17 nt, Chlamydophila pneumoniae CWL029
ucccgaguccuaaaauu

SEQ ID NO: 2538583 - RNA, 22 nt, Chlamydophila pneumoniae CWL029
ucccgcaaaguuaaaccuuuuu

SEQ ID NO: 2538584 - RNA, 18 nt, Chlamydophila pneumoniae CWL029
ucccgugagcaugcucac

SEQ ID NO: 2538585 - RNA, 13 nt, Chlamydophila pneumoniae CWL029
ucccguuccuuua

SEQ ID NO: 2538586 - RNA, 20 nt, Chlamydophila pneumoniae CWL029
ucccuaagaguuccaagaca

SEQ ID NO: 2538587 - RNA, 17 nt, Chlamydophila pneumoniae CWL029
ucccuaagguagagucc

SEQ ID NO: 2538588 - RNA, 16 nt, Chlamydophila pneumoniae CWL029
ucccuagcauacaucg

SEQ ID NO: 2538589 - RNA, 20 nt, Chlamydophila pneumoniae CWL029
ucccuauaaagcaaaugccu

SEQ ID NO: 2538590 - RNA, 22 nt, Chlamydophila pneumoniae CWL029
ucccuauaaagcaaaugccugu

SEQ ID NO: 2538591 - RNA, 15 nt, Chlamydophila pneumoniae CWL029
ucccucaaaauuuaa

SEQ ID NO: 2538592 - RNA, 18 nt, Chlamydophila pneumoniae CWL029
ucccucaaaauuuaaaua

SEQ ID NO: 2538593 - RNA, 18 nt, Chlamydophila pneumoniae CWL029
ucccuccgcaguuguaca

SEQ ID NO: 2538594 - RNA, 15 nt, Chlamydophila pneumoniae CWL029
ucccucgcuaaagua

SEQ ID NO: 2538595 - RNA, 14 nt, Chlamydophila pneumoniae CWL029
ucccucuucuucca

SEQ ID NO: 2538596 - RNA, 16 nt, Chlamydophila pneumoniae CWL029
ucccucuucuuccaau

SEQ ID NO: 2538597 - RNA, 15 nt, Chlamydophila pneumoniae CWL029
ucccugguacuuaug

SEQ ID NO: 2538598 - RNA, 19 nt, Chlamydophila pneumoniae CWL029
ucccuuagaaauucuaaga

SEQ ID NO: 2538599 - RNA, 23 nt, Chlamydophila pneumoniae CWL029
uccgacucuguuuccuugugucu

SEQ ID NO: 2538600 - RNA, 12 nt, Chlamydophila pneumoniae CWL029
uccgauauacuu

SEQ ID NO: 2538601 - RNA, 23 nt, Chlamydophila pneumoniae CWL029
uccgaucauuuuugcuagaucug

SEQ ID NO: 2538602 - RNA, 17 nt, Chlamydophila pneumoniae CWL029
uccgcaggucgcaucaa

SEQ ID NO: 2538603 - RNA, 15 nt, Chlamydophila pneumoniae CWL029
uccgcaguuguacaa

SEQ ID NO: 2538604 - RNA, 14 nt, Chlamydophila pneumoniae CWL029
uccggaacgcagag

SEQ ID NO: 2538605 - RNA, 18 nt, Chlamydophila pneumoniae CWL029
uccggaacgcagaguuuu

SEQ ID NO: 2538606 - RNA, 17 nt, Chlamydophila pneumoniae CWL029
uccggaaggaguucuuu

SEQ ID NO: 2538607 - RNA, 20 nt, Chlamydophila pneumoniae CWL029
uccggauucuuuauccccag

SEQ ID NO: 2538608 - RNA, 18 nt, Chlamydophila pneumoniae CWL029
uccguaaggacuguagug

SEQ ID NO: 2538609 - RNA, 19 nt, Chlamydophila pneumoniae CWL029
uccguagguguuaaguuca

SEQ ID NO: 2538610 - RNA, 13 nt, Chlamydophila pneumoniae CWL029
uccguauaaguau

SEQ ID NO: 2538611 - RNA, 14 nt, Chlamydophila pneumoniae CWL029
uccguauuuuuuac

SEQ ID NO: 2538612 - RNA, 16 nt, Chlamydophila pneumoniae CWL029
uccgucaagaacaaga

SEQ ID NO: 2538613 - RNA, 20 nt, Chlamydophila pneumoniae CWL029
uccgucaagaacaagagcuu

SEQ ID NO: 2538614 - RNA, 16 nt, Chlamydophila pneumoniae CWL029
uccgucauauuuaaaa

SEQ ID NO: 2538615 - RNA, 23 nt, Chlamydophila pneumoniae CWL029
uccgugagauacuuuaaagacuu

SEQ ID NO: 2538616 - RNA, 18 nt, Chlamydophila pneumoniae CWL029
uccguucgagagguuccc

SEQ ID NO: 2538617 - RNA, 19 nt, Chlamydophila pneumoniae CWL029
uccuaaaaaggguuccucu

SEQ ID NO: 2538618 - RNA, 15 nt, Chlamydophila pneumoniae CWL029
uccuaaaauuucuag

SEQ ID NO: 2538619 - RNA, 17 nt, Chlamydophila pneumoniae CWL029
uccuaaaauuucuagga

SEQ ID NO: 2538620 - RNA, 14 nt, Chlamydophila pneumoniae CWL029
uccuaaaucugcuu

SEQ ID NO: 2538621 - RNA, 15 nt, Chlamydophila pneumoniae CWL029
uccuaacaaaaggau

SEQ ID NO: 2538622 - RNA, 18 nt, Chlamydophila pneumoniae CWL029
uccuaagagauuuuccau

SEQ ID NO: 2538623 - RNA, 19 nt, Chlamydophila pneumoniae CWL029
uccuaagagauuuuccaua

SEQ ID NO: 2538624 - RNA, 18 nt, Chlamydophila pneumoniae CWL029
uccuacgagcgcuuucuu

SEQ ID NO: 2538625 - RNA, 13 nt, Chlamydophila pneumoniae CWL029
uccuacggcaaga

SEQ ID NO: 2538626 - RNA, 19 nt, Chlamydophila pneumoniae CWL029
uccuagaagcgcuuuaugu

SEQ ID NO: 2538627 - RNA, 21 nt, Chlamydophila pneumoniae CWL029
uccuagagucgaguuucuagu

SEQ ID NO: 2538628 - RNA, 17 nt, Chlamydophila pneumoniae CWL029
uccuagcagagaaauua

SEQ ID NO: 2538629 - RNA, 16 nt, Chlamydophila pneumoniae CWL029
uccuagggagugagga

SEQ ID NO: 2538630 - RNA, 19 nt, Chlamydophila pneumoniae CWL029
uccuagguucuuuucggau

SEQ ID NO: 2538631 - RNA, 19 nt, Chlamydophila pneumoniae CWL029
uccuauaaaaaccuuaucg

SEQ ID NO: 2538632 - RNA, 15 nt, Chlamydophila pneumoniae CWL029
uccuaucaaagcaaa

SEQ ID NO: 2538633 - RNA, 22 nt, Chlamydophila pneumoniae CWL029
uccuauugguguaucucuuaaa

SEQ ID NO: 2538634 - RNA, 19 nt, Chlamydophila pneumoniae CWL029
uccuauuuuagcauaaucu

SEQ ID NO: 2538635 - RNA, 14 nt, Chlamydophila pneumoniae CWL029
uccuauuuuuuaag

SEQ ID NO: 2538636 - RNA, 14 nt, Chlamydophila pneumoniae CWL029
uccucaaaagauau

SEQ ID NO: 2538637 - RNA, 22 nt, Chlamydophila pneumoniae CWL029
uccucaaagaguuuuuuagagg

SEQ ID NO: 2538638 - RNA, 23 nt, Chlamydophila pneumoniae CWL029
uccucaaagccgaggauucgcua

SEQ ID NO: 2538639 - RNA, 21 nt, Chlamydophila pneumoniae CWL029
uccucaagaauaugaacugcc

SEQ ID NO: 2538640 - RNA, 17 nt, Chlamydophila pneumoniae CWL029
uccucaagauaaauccc

SEQ ID NO: 2538641 - RNA, 20 nt, Chlamydophila pneumoniae CWL029
uccucaagauaaaucccacu

SEQ ID NO: 2538642 - RNA, 13 nt, Chlamydophila pneumoniae CWL029
uccucaauuuguu

SEQ ID NO: 2538643 - RNA, 13 nt, Chlamydophila pneumoniae CWL029
uccucacuauuaa

SEQ ID NO: 2538644 - RNA, 14 nt, Chlamydophila pneumoniae CWL029
uccucaucaucaga

SEQ ID NO: 2538645 - RNA, 14 nt, Chlamydophila pneumoniae CWL029
uccuccaaaagacc

SEQ ID NO: 2538646 - RNA, 12 nt, Chlamydophila pneumoniae CWL029
uccuccaaaauu

SEQ ID NO: 2538647 - RNA, 20 nt, Chlamydophila pneumoniae CWL029
uccuccaaugagcucuauuu

SEQ ID NO: 2538648 - RNA, 22 nt, Chlamydophila pneumoniae CWL029
uccuccauggaaagaaacaaau

SEQ ID NO: 2538649 - RNA, 16 nt, Chlamydophila pneumoniae CWL029
uccuccauguacaguu

SEQ ID NO: 2538650 - RNA, 15 nt, Chlamydophila pneumoniae CWL029
uccuccccauacaua

SEQ ID NO: 2538651 - RNA, 20 nt, Chlamydophila pneumoniae CWL029
uccucgagaacguagcagag

SEQ ID NO: 2538652 - RNA, 14 nt, Chlamydophila pneumoniae CWL029
uccucgauacuguu

SEQ ID NO: 2538653 - RNA, 17 nt, Chlamydophila pneumoniae CWL029
uccucgauacuguugau

SEQ ID NO: 2538654 - RNA, 23 nt, Chlamydophila pneumoniae CWL029
uccucgcucagcuaauuuaaaug

SEQ ID NO: 2538655 - RNA, 14 nt, Chlamydophila pneumoniae CWL029
uccucggaagauaa

SEQ ID NO: 2538656 - RNA, 17 nt, Chlamydophila pneumoniae CWL029
uccucgucuaaagaaga

SEQ ID NO: 2538657 - RNA, 14 nt, Chlamydophila pneumoniae CWL029
uccucgucuucaau

SEQ ID NO: 2538658 - RNA, 21 nt, Chlamydophila pneumoniae CWL029
uccucuaaggacaaaucuccc

SEQ ID NO: 2538659 - RNA, 16 nt, Chlamydophila pneumoniae CWL029
uccucucaugaaauuu

SEQ ID NO: 2538660 - RNA, 22 nt, Chlamydophila pneumoniae CWL029
uccucucaugaaauuuucuaag

SEQ ID NO: 2538661 - RNA, 22 nt, Chlamydophila pneumoniae CWL029
uccucuccaaaacaaucuaaag

SEQ ID NO: 2538662 - RNA, 16 nt, Chlamydophila pneumoniae CWL029
uccucuccuaaugccg

SEQ ID NO: 2538663 - RNA, 16 nt, Chlamydophila pneumoniae CWL029
uccucucgauucucgu

SEQ ID NO: 2538664 - RNA, 14 nt, Chlamydophila pneumoniae CWL029
uccucucuuuauau

SEQ ID NO: 2538665 - RNA, 15 nt, Chlamydophila pneumoniae CWL029
uccucuucaauuucu

SEQ ID NO: 2538666 - RNA, 14 nt, Chlamydophila pneumoniae CWL029
uccucuuccuuuuu

SEQ ID NO: 2538667 - RNA, 17 nt, Chlamydophila pneumoniae CWL029
uccucuuucuuaggaaa

SEQ ID NO: 2538668 - RNA, 13 nt, Chlamydophila pneumoniae CWL029
uccugaaaguaca

SEQ ID NO: 2538669 - RNA, 18 nt, Chlamydophila pneumoniae CWL029
uccugaacaucuccagca

SEQ ID NO: 2538670 - RNA, 19 nt, Chlamydophila pneumoniae CWL029
uccugaacggcucuuucua

SEQ ID NO: 2538671 - RNA, 13 nt, Chlamydophila pneumoniae CWL029
uccugaagaugag

SEQ ID NO: 2538672 - RNA, 19 nt, Chlamydophila pneumoniae CWL029
uccugaagggacaaguacg

SEQ ID NO: 2538673 - RNA, 19 nt, Chlamydophila pneumoniae CWL029
uccugaauaugcuuuucaa

SEQ ID NO: 2538674 - RNA, 19 nt, Chlamydophila pneumoniae CWL029
uccugaaucagcuuaucua

SEQ ID NO: 2538675 - RNA, 12 nt, Chlamydophila pneumoniae CWL029
uccugaccagug

SEQ ID NO: 2538676 - RNA, 23 nt, Chlamydophila pneumoniae CWL029
uccugacgcauagcacuaugaau

SEQ ID NO: 2538677 - RNA, 17 nt, Chlamydophila pneumoniae CWL029
uccugacuauaaaaugc

SEQ ID NO: 2538678 - RNA, 11 nt, Chlamydophila pneumoniae CWL029
uccugagacca

SEQ ID NO: 2538679 - RNA, 11 nt, Chlamydophila pneumoniae CWL029
uccugagagcg

SEQ ID NO: 2538680 - RNA, 21 nt, Chlamydophila pneumoniae CWL029
uccugagagcguuguggaagu

SEQ ID NO: 2538681 - RNA, 19 nt, Chlamydophila pneumoniae CWL029
uccugagguugggcagaag

SEQ ID NO: 2538682 - RNA, 17 nt, Chlamydophila pneumoniae CWL029
uccugaugccuuuuucu

SEQ ID NO: 2538683 - RNA, 19 nt, Chlamydophila pneumoniae CWL029
uccugcaagcauuguuugu

SEQ ID NO: 2538684 - RNA, 13 nt, Chlamydophila pneumoniae CWL029
uccugcagcagcc

SEQ ID NO: 2538685 - RNA, 17 nt, Chlamydophila pneumoniae CWL029
uccugcaguauuauaaa

SEQ ID NO: 2538686 - RNA, 11 nt, Chlamydophila pneumoniae CWL029
uccugcugcuu

SEQ ID NO: 2538687 - RNA, 19 nt, Chlamydophila pneumoniae CWL029
uccugcuucuauagagaca

SEQ ID NO: 2538688 - RNA, 17 nt, Chlamydophila pneumoniae CWL029
uccuggaacaguauaau

SEQ ID NO: 2538689 - RNA, 22 nt, Chlamydophila pneumoniae CWL029
uccuggaagaauuucauaagag

SEQ ID NO: 2538690 - RNA, 16 nt, Chlamydophila pneumoniae CWL029
uccuggagcaugagag

SEQ ID NO: 2538691 - RNA, 16 nt, Chlamydophila pneumoniae CWL029
uccugggguucucuaa

SEQ ID NO: 2538692 - RNA, 20 nt, Chlamydophila pneumoniae CWL029
uccuguacaucgguguugca

SEQ ID NO: 2538693 - RNA, 16 nt, Chlamydophila pneumoniae CWL029
uccuguaguuuuacuu

SEQ ID NO: 2538694 - RNA, 16 nt, Chlamydophila pneumoniae CWL029
uccuuaacaacaucac

SEQ ID NO: 2538695 - RNA, 15 nt, Chlamydophila pneumoniae CWL029
uccuuaaccuccuca

SEQ ID NO: 2538696 - RNA, 22 nt, Chlamydophila pneumoniae CWL029
uccuuaaugguagcuuaagaau

SEQ ID NO: 2538697 - RNA, 19 nt, Chlamydophila pneumoniae CWL029
uccuuaccuauauagcccu

SEQ ID NO: 2538698 - RNA, 18 nt, Chlamydophila pneumoniae CWL029
uccuuacggauacguugg

SEQ ID NO: 2538699 - RNA, 22 nt, Chlamydophila pneumoniae CWL029
uccuuagcauuaggaaaguacc

SEQ ID NO: 2538700 - RNA, 20 nt, Chlamydophila pneumoniae CWL029
uccuuaggggcguugagcaa

SEQ ID NO: 2538701 - RNA, 15 nt, Chlamydophila pneumoniae CWL029
uccuuaucuugcugc

SEQ ID NO: 2538702 - RNA, 17 nt, Chlamydophila pneumoniae CWL029
uccuuauuucaaagaag

SEQ ID NO: 2538703 - RNA, 14 nt, Chlamydophila pneumoniae CWL029
uccuucaaagauau

SEQ ID NO: 2538704 - RNA, 13 nt, Chlamydophila pneumoniae CWL029
uccuucaggauuu

SEQ ID NO: 2538705 - RNA, 19 nt, Chlamydophila pneumoniae CWL029
uccuucaggauuuuccauu

SEQ ID NO: 2538706 - RNA, 21 nt, Chlamydophila pneumoniae CWL029
uccuucauacguuuuuuuccu

SEQ ID NO: 2538707 - RNA, 17 nt, Chlamydophila pneumoniae CWL029
uccuucauucacagcag

SEQ ID NO: 2538708 - RNA, 18 nt, Chlamydophila pneumoniae CWL029
uccuucauucacagcagu

SEQ ID NO: 2538709 - RNA, 17 nt, Chlamydophila pneumoniae CWL029
uccuuccuuaagggaag

SEQ ID NO: 2538710 - RNA, 17 nt, Chlamydophila pneumoniae CWL029
uccuucgaagcggagca

SEQ ID NO: 2538711 - RNA, 14 nt, Chlamydophila pneumoniae CWL029
uccuucgaccuauu

SEQ ID NO: 2538712 - RNA, 24 nt, Chlamydophila pneumoniae CWL029
uccuucgaccuauuugcaacaauc

SEQ ID NO: 2538713 - RNA, 22 nt, Chlamydophila pneumoniae CWL029
uccuucuacaaugauauaaaag

SEQ ID NO: 2538714 - RNA, 20 nt, Chlamydophila pneumoniae CWL029
uccuucuacagauugaugcu

SEQ ID NO: 2538715 - RNA, 20 nt, Chlamydophila pneumoniae CWL029
uccuucugcaaucagugcug

SEQ ID NO: 2538716 - RNA, 20 nt, Chlamydophila pneumoniae CWL029
uccuucuggagugacaccaa

SEQ ID NO: 2538717 - RNA, 13 nt, Chlamydophila pneumoniae CWL029
uccuucuguuuuc

SEQ ID NO: 2538718 - RNA, 15 nt, Chlamydophila pneumoniae CWL029
uccuucuguuuucac

SEQ ID NO: 2538719 - RNA, 12 nt, Chlamydophila pneumoniae CWL029
uccuucuucuuc

SEQ ID NO: 2538720 - RNA, 14 nt, Chlamydophila pneumoniae CWL029
uccuucuucuucaa

SEQ ID NO: 2538721 - RNA, 13 nt, Chlamydophila pneumoniae CWL029
uccuugaaaauca

SEQ ID NO: 2538722 - RNA, 20 nt, Chlamydophila pneumoniae CWL029
uccuugaacuaacugagcaa

SEQ ID NO: 2538723 - RNA, 17 nt, Chlamydophila pneumoniae CWL029
uccuugagggcuaucca

SEQ ID NO: 2538724 - RNA, 20 nt, Chlamydophila pneumoniae CWL029
uccuugagggcuauccacaa

SEQ ID NO: 2538725 - RNA, 14 nt, Chlamydophila pneumoniae CWL029
uccuugauuuggga

SEQ ID NO: 2538726 - RNA, 19 nt, Chlamydophila pneumoniae CWL029
uccuugcaaaacagcauca

SEQ ID NO: 2538727 - RNA, 17 nt, Chlamydophila pneumoniae CWL029
uccuugcagcccugcau

SEQ ID NO: 2538728 - RNA, 17 nt, Chlamydophila pneumoniae CWL029
uccuuggauuucuucuu

SEQ ID NO: 2538729 - RNA, 15 nt, Chlamydophila pneumoniae CWL029
uccuugggucuuuuu

SEQ ID NO: 2538730 - RNA, 12 nt, Chlamydophila pneumoniae CWL029
uccuuguagaac

SEQ ID NO: 2538731 - RNA, 17 nt, Chlamydophila pneumoniae CWL029
uccuuguagaacuucuc

SEQ ID NO: 2538732 - RNA, 20 nt, Chlamydophila pneumoniae CWL029
uccuuguagaacuucucaag

SEQ ID NO: 2538733 - RNA, 14 nt, Chlamydophila pneumoniae CWL029
uccuuuaaauaaaa

SEQ ID NO: 2538734 - RNA, 16 nt, Chlamydophila pneumoniae CWL029
uccuuuaaauaaaauc

SEQ ID NO: 2538735 - RNA, 21 nt, Chlamydophila pneumoniae CWL029
uccuuuagccuggucucauga

SEQ ID NO: 2538736 - RNA, 15 nt, Chlamydophila pneumoniae CWL029
uccuuucuccagcau

SEQ ID NO: 2538737 - RNA, 20 nt, Chlamydophila pneumoniae CWL029
uccuuucuuuugcuuuuccc

SEQ ID NO: 2538738 - RNA, 22 nt, Chlamydophila pneumoniae CWL029
uccuuucuuuugcuuuucccac

SEQ ID NO: 2538739 - RNA, 19 nt, Chlamydophila pneumoniae CWL029
uccuuugagucuuuuucag

SEQ ID NO: 2538740 - RNA, 22 nt, Chlamydophila pneumoniae CWL029
uccuuugagucuuuuucagaaa

SEQ ID NO: 2538741 - RNA, 17 nt, Chlamydophila pneumoniae CWL029
uccuuuguauucagugu

SEQ ID NO: 2538742 - RNA, 12 nt, Chlamydophila pneumoniae CWL029
uccuuuuaaaau

SEQ ID NO: 2538743 - RNA, 14 nt, Chlamydophila pneumoniae CWL029
ucgaaaaacgguaa

SEQ ID NO: 2538744 - RNA, 16 nt, Chlamydophila pneumoniae CWL029
ucgaaacacucaugaa

SEQ ID NO: 2538745 - RNA, 22 nt, Chlamydophila pneumoniae CWL029
ucgaaacacucaugaaagugcu

SEQ ID NO: 2538746 - RNA, 18 nt, Chlamydophila pneumoniae CWL029
ucgaaaccacagcaaaga

SEQ ID NO: 2538747 - RNA, 17 nt, Chlamydophila pneumoniae CWL029
ucgaaacucuuugagga

SEQ ID NO: 2538748 - RNA, 19 nt, Chlamydophila pneumoniae CWL029
ucgaaacucuuugaggaua

SEQ ID NO: 2538749 - RNA, 17 nt, Chlamydophila pneumoniae CWL029
ucgaaauccuaaaaagg

SEQ ID NO: 2538750 - RNA, 12 nt, Chlamydophila pneumoniae CWL029
ucgaaauuuuca

SEQ ID NO: 2538751 - RNA, 21 nt, Chlamydophila pneumoniae CWL029
ucgaacagagaugcaaauccu

SEQ ID NO: 2538752 - RNA, 23 nt, Chlamydophila pneumoniae CWL029
ucgaagaaaauaaagaucuucau

SEQ ID NO: 2538753 - RNA, 19 nt, Chlamydophila pneumoniae CWL029
ucgaagaacuuagcaauga

SEQ ID NO: 2538754 - RNA, 19 nt, Chlamydophila pneumoniae CWL029
ucgaagagcccucuucacu

SEQ ID NO: 2538755 - RNA, 16 nt, Chlamydophila pneumoniae CWL029
ucgaagauucaaagaa

SEQ ID NO: 2538756 - RNA, 20 nt, Chlamydophila pneumoniae CWL029
ucgaagauucaaagaagucg

SEQ ID NO: 2538757 - RNA, 16 nt, Chlamydophila pneumoniae CWL029
ucgaagcuugcugauu

SEQ ID NO: 2538758 - RNA, 22 nt, Chlamydophila pneumoniae CWL029
ucgaaguugauuguagagacau

SEQ ID NO: 2538759 - RNA, 18 nt, Chlamydophila pneumoniae CWL029
ucgaauagcucuggagau

SEQ ID NO: 2538760 - RNA, 19 nt, Chlamydophila pneumoniae CWL029
ucgaaucuuuauuucugau

SEQ ID NO: 2538761 - RNA, 19 nt, Chlamydophila pneumoniae CWL029
ucgaaugcugcacaguuca

SEQ ID NO: 2538762 - RNA, 20 nt, Chlamydophila pneumoniae CWL029
ucgaaugguuccugaagcag

SEQ ID NO: 2538763 - RNA, 12 nt, Chlamydophila pneumoniae CWL029
ucgaauuccucc

SEQ ID NO: 2538764 - RNA, 22 nt, Chlamydophila pneumoniae CWL029
ucgaauuguguguuuucauaaa

SEQ ID NO: 2538765 - RNA, 17 nt, Chlamydophila pneumoniae CWL029
ucgacaacaacauaaag

SEQ ID NO: 2538766 - RNA, 20 nt, Chlamydophila pneumoniae CWL029
ucgacaacaacauaaagaag

SEQ ID NO: 2538767 - RNA, 16 nt, Chlamydophila pneumoniae CWL029
ucgacaaccaaaacag

SEQ ID NO: 2538768 - RNA, 12 nt, Chlamydophila pneumoniae CWL029
ucgacagcagca

SEQ ID NO: 2538769 - RNA, 13 nt, Chlamydophila pneumoniae CWL029
ucgacagcagcau

SEQ ID NO: 2538770 - RNA, 20 nt, Chlamydophila pneumoniae CWL029
ucgacaugcaggccaacucu

SEQ ID NO: 2538771 - RNA, 16 nt, Chlamydophila pneumoniae CWL029
ucgaccuauuugcaac

SEQ ID NO: 2538772 - RNA, 21 nt, Chlamydophila pneumoniae CWL029
ucgacuauaagagguucucuu

SEQ ID NO: 2538773 - RNA, 12 nt, Chlamydophila pneumoniae CWL029
ucgacucuucca

SEQ ID NO: 2538774 - RNA, 21 nt, Chlamydophila pneumoniae CWL029
ucgacuuccuucaaucguaau

SEQ ID NO: 2538775 - RNA, 21 nt, Chlamydophila pneumoniae CWL029
ucgacuuuuuuaagagugucu

SEQ ID NO: 2538776 - RNA, 20 nt, Chlamydophila pneumoniae CWL029
ucgagaacguagcagaggca

SEQ ID NO: 2538777 - RNA, 19 nt, Chlamydophila pneumoniae CWL029
ucgagagaagaaauucuga

SEQ ID NO: 2538778 - RNA, 21 nt, Chlamydophila pneumoniae CWL029
ucgagcagaaacuccaaaaua

SEQ ID NO: 2538779 - RNA, 20 nt, Chlamydophila pneumoniae CWL029
ucgaguaccgaccgaaucuc

SEQ ID NO: 2538780 - RNA, 16 nt, Chlamydophila pneumoniae CWL029
ucgaguucuuuuugca

SEQ ID NO: 2538781 - RNA, 17 nt, Chlamydophila pneumoniae CWL029
ucgauaacacuucuuuc

SEQ ID NO: 2538782 - RNA, 12 nt, Chlamydophila pneumoniae CWL029
ucgauaagaacu

SEQ ID NO: 2538783 - RNA, 13 nt, Chlamydophila pneumoniae CWL029
ucgauaauuuuca

SEQ ID NO: 2538784 - RNA, 15 nt, Chlamydophila pneumoniae CWL029
ucgauaucucuaccg

SEQ ID NO: 2538785 - RNA, 22 nt, Chlamydophila pneumoniae CWL029
ucgaucucugugguuccuggau

SEQ ID NO: 2538786 - RNA, 15 nt, Chlamydophila pneumoniae CWL029
ucgaugagggaaaug

SEQ ID NO: 2538787 - RNA, 16 nt, Chlamydophila pneumoniae CWL029
ucgaugcuauuuuucc

SEQ ID NO: 2538788 - RNA, 14 nt, Chlamydophila pneumoniae CWL029
ucgauuauuucuug

SEQ ID NO: 2538789 - RNA, 18 nt, Chlamydophila pneumoniae CWL029
ucgauugagauugaggau

SEQ ID NO: 2538790 - RNA, 15 nt, Chlamydophila pneumoniae CWL029
ucgauuggaagcaaa

SEQ ID NO: 2538791 - RNA, 22 nt, Chlamydophila pneumoniae CWL029
ucgauuguaacuucguuagaaa

SEQ ID NO: 2538792 - RNA, 23 nt, Chlamydophila pneumoniae CWL029
ucgcaaauauaguuuucauaauc

SEQ ID NO: 2538793 - RNA, 23 nt, Chlamydophila pneumoniae CWL029
ucgcaaauuuuucgagaauauac

SEQ ID NO: 2538794 - RNA, 19 nt, Chlamydophila pneumoniae CWL029
ucgcacacuccauuucagc

SEQ ID NO: 2538795 - RNA, 20 nt, Chlamydophila pneumoniae CWL029
ucgcacuacagcuucauuau

SEQ ID NO: 2538796 - RNA, 19 nt, Chlamydophila pneumoniae CWL029
ucgcagcaggauaaccauc

SEQ ID NO: 2538797 - RNA, 14 nt, Chlamydophila pneumoniae CWL029
ucgcaguaaugcca

SEQ ID NO: 2538798 - RNA, 17 nt, Chlamydophila pneumoniae CWL029
ucgcaguccaaagacuu

SEQ ID NO: 2538799 - RNA, 18 nt, Chlamydophila pneumoniae CWL029
ucgcaguccaaagacuuu

SEQ ID NO: 2538800 - RNA, 22 nt, Chlamydophila pneumoniae CWL029
ucgcauuacaaauggcaugaaa

SEQ ID NO: 2538801 - RNA, 11 nt, Chlamydophila pneumoniae CWL029
ucgccaaacca

SEQ ID NO: 2538802 - RNA, 21 nt, Chlamydophila pneumoniae CWL029
ucgccaaaccaugaggcugcu

SEQ ID NO: 2538803 - RNA, 22 nt, Chlamydophila pneumoniae CWL029
ucgccaaacgaauuucuuguuc

SEQ ID NO: 2538804 - RNA, 16 nt, Chlamydophila pneumoniae CWL029
ucgccguuaaagacuu

SEQ ID NO: 2538805 - RNA, 20 nt, Chlamydophila pneumoniae CWL029
ucgccuuggguuugucucca

SEQ ID NO: 2538806 - RNA, 23 nt, Chlamydophila pneumoniae CWL029
ucgccuuggguuugucuccaaau

SEQ ID NO: 2538807 - RNA, 15 nt, Chlamydophila pneumoniae CWL029
ucgcgacaagacaau

SEQ ID NO: 2538808 - RNA, 21 nt, Chlamydophila pneumoniae CWL029
ucgcuaacgcagcuuuagcuu

SEQ ID NO: 2538809 - RNA, 14 nt, Chlamydophila pneumoniae CWL029
ucgcuaagcaaagc

SEQ ID NO: 2538810 - RNA, 12 nt, Chlamydophila pneumoniae CWL029
ucgcuaccauau

SEQ ID NO: 2538811 - RNA, 14 nt, Chlamydophila pneumoniae CWL029
ucgcuagaucacaa

SEQ ID NO: 2538812 - RNA, 23 nt, Chlamydophila pneumoniae CWL029
ucgcucagcuaauuuaaaugccu

SEQ ID NO: 2538813 - RNA, 19 nt, Chlamydophila pneumoniae CWL029
ucgcuccuaauggaaacau

SEQ ID NO: 2538814 - RNA, 13 nt, Chlamydophila pneumoniae CWL029
ucgcucuccucuc

SEQ ID NO: 2538815 - RNA, 14 nt, Chlamydophila pneumoniae CWL029
ucgcugauaaaaua

SEQ ID NO: 2538816 - RNA, 15 nt, Chlamydophila pneumoniae CWL029
ucgcuuaacaaacuu

SEQ ID NO: 2538817 - RNA, 14 nt, Chlamydophila pneumoniae CWL029
ucgcuugugcaugc

SEQ ID NO: 2538818 - RNA, 20 nt, Chlamydophila pneumoniae CWL029
ucgcuugugcaugcaucuua

SEQ ID NO: 2538819 - RNA, 14 nt, Chlamydophila pneumoniae CWL029
ucgcuuuugcuaga

SEQ ID NO: 2538820 - RNA, 22 nt, Chlamydophila pneumoniae CWL029
ucggaaaucagggauauacaau

SEQ ID NO: 2538821 - RNA, 19 nt, Chlamydophila pneumoniae CWL029
ucggacgauauuuagagag

SEQ ID NO: 2538822 - RNA, 15 nt, Chlamydophila pneumoniae CWL029
ucggagauuguuuca

SEQ ID NO: 2538823 - RNA, 16 nt, Chlamydophila pneumoniae CWL029
ucggagguucgaaucc

SEQ ID NO: 2538824 - RNA, 16 nt, Chlamydophila pneumoniae CWL029
ucggaguguuggggag

SEQ ID NO: 2538825 - RNA, 13 nt, Chlamydophila pneumoniae CWL029
ucggaucuguaau

SEQ ID NO: 2538826 - RNA, 21 nt, Chlamydophila pneumoniae CWL029
ucggaucuuuucuuucuaaga

SEQ ID NO: 2538827 - RNA, 14 nt, Chlamydophila pneumoniae CWL029
ucggcaauuguuaa

SEQ ID NO: 2538828 - RNA, 21 nt, Chlamydophila pneumoniae CWL029
ucggcaauuguuaaaagaagg

SEQ ID NO: 2538829 - RNA, 15 nt, Chlamydophila pneumoniae CWL029
ucggcuaaagaaaag

SEQ ID NO: 2538830 - RNA, 22 nt, Chlamydophila pneumoniae CWL029
ucgggaauaauaggauaagaaa

SEQ ID NO: 2538831 - RNA, 16 nt, Chlamydophila pneumoniae CWL029
ucggggagaacaccuc

SEQ ID NO: 2538832 - RNA, 16 nt, Chlamydophila pneumoniae CWL029
ucggggauugcaaaau

SEQ ID NO: 2538833 - RNA, 21 nt, Chlamydophila pneumoniae CWL029
ucgguaaccugugaaaauuuu

SEQ ID NO: 2538834 - RNA, 14 nt, Chlamydophila pneumoniae CWL029
ucgguagagcuaga

SEQ ID NO: 2538835 - RNA, 12 nt, Chlamydophila pneumoniae CWL029
ucggucuuuucu

SEQ ID NO: 2538836 - RNA, 22 nt, Chlamydophila pneumoniae CWL029
ucgguuaagaggugauacauag

SEQ ID NO: 2538837 - RNA, 19 nt, Chlamydophila pneumoniae CWL029
ucgguuauuuuuccagaaa

SEQ ID NO: 2538838 - RNA, 18 nt, Chlamydophila pneumoniae CWL029
ucgguucggucucuucuc

SEQ ID NO: 2538839 - RNA, 21 nt, Chlamydophila pneumoniae CWL029
ucguaaccacagugauuuaga

SEQ ID NO: 2538840 - RNA, 21 nt, Chlamydophila pneumoniae CWL029
ucguaacuuccuuuuucugcu

SEQ ID NO: 2538841 - RNA, 15 nt, Chlamydophila pneumoniae CWL029
ucguaauaacuauaa

SEQ ID NO: 2538842 - RNA, 17 nt, Chlamydophila pneumoniae CWL029
ucguaaucuuuuuuaaa

SEQ ID NO: 2538843 - RNA, 19 nt, Chlamydophila pneumoniae CWL029
ucguaauugcugaaaauga

SEQ ID NO: 2538844 - RNA, 17 nt, Chlamydophila pneumoniae CWL029
ucguacguggaaaguag

SEQ ID NO: 2538845 - RNA, 18 nt, Chlamydophila pneumoniae CWL029
ucguagacaacaagucuu

SEQ ID NO: 2538846 - RNA, 17 nt, Chlamydophila pneumoniae CWL029
ucguagcaggcaucacu

SEQ ID NO: 2538847 - RNA, 20 nt, Chlamydophila pneumoniae CWL029
ucguagcaggcaucacuaau

SEQ ID NO: 2538848 - RNA, 14 nt, Chlamydophila pneumoniae CWL029
ucguagcuaaauug

SEQ ID NO: 2538849 - RNA, 22 nt, Chlamydophila pneumoniae CWL029
ucguagcucaggaaaacuuaau

SEQ ID NO: 2538850 - RNA, 15 nt, Chlamydophila pneumoniae CWL029
ucguaucuuuuugca

SEQ ID NO: 2538851 - RNA, 11 nt, Chlamydophila pneumoniae CWL029
ucgucaaauuc

SEQ ID NO: 2538852 - RNA, 20 nt, Chlamydophila pneumoniae CWL029
ucgucaagcucugagaaaga

SEQ ID NO: 2538853 - RNA, 21 nt, Chlamydophila pneumoniae CWL029
ucguccugacacaacucuuaa

SEQ ID NO: 2538854 - RNA, 16 nt, Chlamydophila pneumoniae CWL029
ucgucuaaagaagauu

SEQ ID NO: 2538855 - RNA, 18 nt, Chlamydophila pneumoniae CWL029
ucgucuuagaauccucua

SEQ ID NO: 2538856 - RNA, 20 nt, Chlamydophila pneumoniae CWL029
ucgucuuagaauccucuauc

SEQ ID NO: 2538857 - RNA, 14 nt, Chlamydophila pneumoniae CWL029
ucgucuuuuaaaga

SEQ ID NO: 2538858 - RNA, 15 nt, Chlamydophila pneumoniae CWL029
ucgucuuuuaaagag

SEQ ID NO: 2538859 - RNA, 13 nt, Chlamydophila pneumoniae CWL029
ucgugcaggagaa

SEQ ID NO: 2538860 - RNA, 19 nt, Chlamydophila pneumoniae CWL029
ucgugcaggagaacaauau

SEQ ID NO: 2538861 - RNA, 20 nt, Chlamydophila pneumoniae CWL029
ucguuagaaaccaugaugca

SEQ ID NO: 2538862 - RNA, 14 nt, Chlamydophila pneumoniae CWL029
ucguuagagaagag

SEQ ID NO: 2538863 - RNA, 13 nt, Chlamydophila pneumoniae CWL029
ucguuauccucgu

SEQ ID NO: 2538864 - RNA, 19 nt, Chlamydophila pneumoniae CWL029
ucguuaugaagcuucuuua

SEQ ID NO: 2538865 - RNA, 13 nt, Chlamydophila pneumoniae CWL029
ucguucaucuguc

SEQ ID NO: 2538866 - RNA, 22 nt, Chlamydophila pneumoniae CWL029
ucguugccaaucuuucauuccc

SEQ ID NO: 2538867 - RNA, 13 nt, Chlamydophila pneumoniae CWL029
ucguuuauaacau

SEQ ID NO: 2538868 - RNA, 16 nt, Chlamydophila pneumoniae CWL029
ucguuuccgaucauuu

SEQ ID NO: 2538869 - RNA, 21 nt, Chlamydophila pneumoniae CWL029
ucguuuccgaucauuuuugcu

SEQ ID NO: 2538870 - RNA, 17 nt, Chlamydophila pneumoniae CWL029
ucguuucucuggcaaug

SEQ ID NO: 2538871 - RNA, 20 nt, Chlamydophila pneumoniae CWL029
ucguuuuugauaguagacau

SEQ ID NO: 2538872 - RNA, 19 nt, Chlamydophila pneumoniae CWL029
ucguuuuuucuuaucugcu

SEQ ID NO: 2538873 - RNA, 14 nt, Chlamydophila pneumoniae CWL029
ucuaaaaacucuuc

SEQ ID NO: 2538874 - RNA, 18 nt, Chlamydophila pneumoniae CWL029
ucuaaaaaugcacuuuga

SEQ ID NO: 2538875 - RNA, 21 nt, Chlamydophila pneumoniae CWL029
ucuaaaacaccugcccauuuu

SEQ ID NO: 2538876 - RNA, 19 nt, Chlamydophila pneumoniae CWL029
ucuaaaacaucagcaacau

SEQ ID NO: 2538877 - RNA, 19 nt, Chlamydophila pneumoniae CWL029
ucuaaaagcacuuaaaaaa

SEQ ID NO: 2538878 - RNA, 16 nt, Chlamydophila pneumoniae CWL029
ucuaaaaugaaauacu

SEQ ID NO: 2538879 - RNA, 12 nt, Chlamydophila pneumoniae CWL029
ucuaaagaaaug

SEQ ID NO: 2538880 - RNA, 13 nt, Chlamydophila pneumoniae CWL029
ucuaaagaaaugu

SEQ ID NO: 2538881 - RNA, 15 nt, Chlamydophila pneumoniae CWL029
ucuaaagcagaaucc

SEQ ID NO: 2538882 - RNA, 17 nt, Chlamydophila pneumoniae CWL029
ucuaaagguuuuaaauu

SEQ ID NO: 2538883 - RNA, 22 nt, Chlamydophila pneumoniae CWL029
ucuaaagguuuuaaauuuagag

SEQ ID NO: 2538884 - RNA, 16 nt, Chlamydophila pneumoniae CWL029
ucuaaauagaaaacau

SEQ ID NO: 2538885 - RNA, 18 nt, Chlamydophila pneumoniae CWL029
ucuaaauggaugaucucc

SEQ ID NO: 2538886 - RNA, 23 nt, Chlamydophila pneumoniae CWL029
ucuaaccaaccuuguugaaaggc

SEQ ID NO: 2538887 - RNA, 21 nt, Chlamydophila pneumoniae CWL029
ucuaacucuaaucugauucaa

SEQ ID NO: 2538888 - RNA, 15 nt, Chlamydophila pneumoniae CWL029
ucuaagaaaaugaau

SEQ ID NO: 2538889 - RNA, 21 nt, Chlamydophila pneumoniae CWL029
ucuaagaaaggcacuccaaaa

SEQ ID NO: 2538890 - RNA, 21 nt, Chlamydophila pneumoniae CWL029
ucuaagcagccucuucucuac

SEQ ID NO: 2538891 - RNA, 17 nt, Chlamydophila pneumoniae CWL029
ucuaagcgcucuucaau

SEQ ID NO: 2538892 - RNA, 23 nt, Chlamydophila pneumoniae CWL029
ucuaagcugugcauuuucuucuu

SEQ ID NO: 2538893 - RNA, 19 nt, Chlamydophila pneumoniae CWL029
ucuaaggcauuggaaaucu

SEQ ID NO: 2538894 - RNA, 16 nt, Chlamydophila pneumoniae CWL029
ucuaaguccaacauca

SEQ ID NO: 2538895 - RNA, 15 nt, Chlamydophila pneumoniae CWL029
ucuaaucaauucgcu

SEQ ID NO: 2538896 - RNA, 21 nt, Chlamydophila pneumoniae CWL029
ucuaaucaauucgcucagaaa

SEQ ID NO: 2538897 - RNA, 15 nt, Chlamydophila pneumoniae CWL029
ucuaaucuucuuaau

SEQ ID NO: 2538898 - RNA, 12 nt, Chlamydophila pneumoniae CWL029
ucuaauuucagg

SEQ ID NO: 2538899 - RNA, 20 nt, Chlamydophila pneumoniae CWL029
ucuaauuucaggagcuccug

SEQ ID NO: 2538900 - RNA, 18 nt, Chlamydophila pneumoniae CWL029
ucuacaaaaacuagaaua

SEQ ID NO: 2538901 - RNA, 12 nt, Chlamydophila pneumoniae CWL029
ucuacaaaugcg

SEQ ID NO: 2538902 - RNA, 20 nt, Chlamydophila pneumoniae CWL029
ucuacacacaugacaaauaa

SEQ ID NO: 2538903 - RNA, 18 nt, Chlamydophila pneumoniae CWL029
ucuacaccauagaacugc

SEQ ID NO: 2538904 - RNA, 22 nt, Chlamydophila pneumoniae CWL029
ucuacagauaggguaagauugc

SEQ ID NO: 2538905 - RNA, 16 nt, Chlamydophila pneumoniae CWL029
ucuacagcuauagaag

SEQ ID NO: 2538906 - RNA, 20 nt, Chlamydophila pneumoniae CWL029
ucuacaggauauugcggaaa

SEQ ID NO: 2538907 - RNA, 17 nt, Chlamydophila pneumoniae CWL029
ucuacaguaguaaauaa

SEQ ID NO: 2538908 - RNA, 18 nt, Chlamydophila pneumoniae CWL029
ucuacaucuucuuggcuu

SEQ ID NO: 2538909 - RNA, 14 nt, Chlamydophila pneumoniae CWL029
ucuacaugcucaag

SEQ ID NO: 2538910 - RNA, 15 nt, Chlamydophila pneumoniae CWL029
ucuacaugcucaaga

SEQ ID NO: 2538911 - RNA, 18 nt, Chlamydophila pneumoniae CWL029
ucuacaugcucaagaaga

SEQ ID NO: 2538912 - RNA, 15 nt, Chlamydophila pneumoniae CWL029
ucuaccaacugagcu

SEQ ID NO: 2538913 - RNA, 20 nt, Chlamydophila pneumoniae CWL029
ucuaccgaacagagcgucua

SEQ ID NO: 2538914 - RNA, 14 nt, Chlamydophila pneumoniae CWL029
ucuaccuguagcua

SEQ ID NO: 2538915 - RNA, 16 nt, Chlamydophila pneumoniae CWL029
ucuacgauguuuucuu

SEQ ID NO: 2538916 - RNA, 23 nt, Chlamydophila pneumoniae CWL029
ucuacgauguuuucuuauccuug

SEQ ID NO: 2538917 - RNA, 17 nt, Chlamydophila pneumoniae CWL029
ucuacgcggagaaugcu

SEQ ID NO: 2538918 - RNA, 18 nt, Chlamydophila pneumoniae CWL029
ucuacgcuauucuuaagc

SEQ ID NO: 2538919 - RNA, 22 nt, Chlamydophila pneumoniae CWL029
ucuacuaggcgcauaugcucca

SEQ ID NO: 2538920 - RNA, 24 nt, Chlamydophila pneumoniae CWL029
ucuacuaggcgcauaugcuccaga

SEQ ID NO: 2538921 - RNA, 16 nt, Chlamydophila pneumoniae CWL029
ucuacucuuuaaaaau

SEQ ID NO: 2538922 - RNA, 21 nt, Chlamydophila pneumoniae CWL029
ucuacugaaaccuucucucuu

SEQ ID NO: 2538923 - RNA, 22 nt, Chlamydophila pneumoniae CWL029
ucuacugaaaccuucucucuua

SEQ ID NO: 2538924 - RNA, 13 nt, Chlamydophila pneumoniae CWL029
ucuagaaaauauu

SEQ ID NO: 2538925 - RNA, 14 nt, Chlamydophila pneumoniae CWL029
ucuagaaaaucucu

SEQ ID NO: 2538926 - RNA, 16 nt, Chlamydophila pneumoniae CWL029
ucuagaaaaucucuaa

SEQ ID NO: 2538927 - RNA, 23 nt, Chlamydophila pneumoniae CWL029
ucuagaaaaugaagagcuuccau

SEQ ID NO: 2538928 - RNA, 17 nt, Chlamydophila pneumoniae CWL029
ucuagaaagauuuauuu

SEQ ID NO: 2538929 - RNA, 13 nt, Chlamydophila pneumoniae CWL029
ucuagaacacuca

SEQ ID NO: 2538930 - RNA, 16 nt, Chlamydophila pneumoniae CWL029
ucuagacaacaaauug

SEQ ID NO: 2538931 - RNA, 16 nt, Chlamydophila pneumoniae CWL029
ucuagagauuuuucua

SEQ ID NO: 2538932 - RNA, 17 nt, Chlamydophila pneumoniae CWL029
ucuagaguugcuuuaug

SEQ ID NO: 2538933 - RNA, 13 nt, Chlamydophila pneumoniae CWL029
ucuagaucuucaa

SEQ ID NO: 2538934 - RNA, 23 nt, Chlamydophila pneumoniae CWL029
ucuagcauaguguuccaaaacag

SEQ ID NO: 2538935 - RNA, 22 nt, Chlamydophila pneumoniae CWL029
ucuagccaauauagaagcugcu

SEQ ID NO: 2538936 - RNA, 16 nt, Chlamydophila pneumoniae CWL029
ucuagcucaaaucuca

SEQ ID NO: 2538937 - RNA, 15 nt, Chlamydophila pneumoniae CWL029
ucuagcuuccucacg

SEQ ID NO: 2538938 - RNA, 15 nt, Chlamydophila pneumoniae CWL029
ucuaggccuaaagaa

SEQ ID NO: 2538939 - RNA, 18 nt, Chlamydophila pneumoniae CWL029
ucuagggacguuguaucc

SEQ ID NO: 2538940 - RNA, 15 nt, Chlamydophila pneumoniae CWL029
ucuagguuuucucuu

SEQ ID NO: 2538941 - RNA, 18 nt, Chlamydophila pneumoniae CWL029
ucuagguuuucucuuccu

SEQ ID NO: 2538942 - RNA, 15 nt, Chlamydophila pneumoniae CWL029
ucuauaaauguaggg

SEQ ID NO: 2538943 - RNA, 15 nt, Chlamydophila pneumoniae CWL029
ucuauaacuacaaaa

SEQ ID NO: 2538944 - RNA, 13 nt, Chlamydophila pneumoniae CWL029
ucuauaauaaccu

SEQ ID NO: 2538945 - RNA, 22 nt, Chlamydophila pneumoniae CWL029
ucuauacagacaagcaaggaaa

SEQ ID NO: 2538946 - RNA, 23 nt, Chlamydophila pneumoniae CWL029
ucuauacagacaagcaaggaaaa

SEQ ID NO: 2538947 - RNA, 21 nt, Chlamydophila pneumoniae CWL029
ucuauacgcuuaacaugaaaa

SEQ ID NO: 2538948 - RNA, 12 nt, Chlamydophila pneumoniae CWL029
ucuauagaguag

SEQ ID NO: 2538949 - RNA, 16 nt, Chlamydophila pneumoniae CWL029
ucuauagaguagcuca

SEQ ID NO: 2538950 - RNA, 13 nt, Chlamydophila pneumoniae CWL029
ucuauauauccug

SEQ ID NO: 2538951 - RNA, 15 nt, Chlamydophila pneumoniae CWL029
ucuauauauccugag

SEQ ID NO: 2538952 - RNA, 18 nt, Chlamydophila pneumoniae CWL029
ucuauauccacaaucucu

SEQ ID NO: 2538953 - RNA, 14 nt, Chlamydophila pneumoniae CWL029
ucuauaucuacagc

SEQ ID NO: 2538954 - RNA, 19 nt, Chlamydophila pneumoniae CWL029
ucuauauuuuuucccacaa

SEQ ID NO: 2538955 - RNA, 19 nt, Chlamydophila pneumoniae CWL029
ucuaucagggcuacgguaa

SEQ ID NO: 2538956 - RNA, 14 nt, Chlamydophila pneumoniae CWL029
ucuauccaucaucg

SEQ ID NO: 2538957 - RNA, 14 nt, Chlamydophila pneumoniae CWL029
ucuaucuaaucaau

SEQ ID NO: 2538958 - RNA, 18 nt, Chlamydophila pneumoniae CWL029
ucuaucuacacacaugac

SEQ ID NO: 2538959 - RNA, 19 nt, Chlamydophila pneumoniae CWL029
ucuaucuuuacuaacaaaa

SEQ ID NO: 2538960 - RNA, 22 nt, Chlamydophila pneumoniae CWL029
ucuaugagaguaaguuuuuaau

SEQ ID NO: 2538961 - RNA, 22 nt, Chlamydophila pneumoniae CWL029
ucuaugauaucaccagguccuu

SEQ ID NO: 2538962 - RNA, 22 nt, Chlamydophila pneumoniae CWL029
ucuauggucucccucacaagaa

SEQ ID NO: 2538963 - RNA, 16 nt, Chlamydophila pneumoniae CWL029
ucuauguuuugacaua

SEQ ID NO: 2538964 - RNA, 19 nt, Chlamydophila pneumoniae CWL029
ucuauuaaggauuccuuga

SEQ ID NO: 2538965 - RNA, 18 nt, Chlamydophila pneumoniae CWL029
ucuauucgcugucuagaa

SEQ ID NO: 2538966 - RNA, 20 nt, Chlamydophila pneumoniae CWL029
ucuauucucuucauuuucuu

SEQ ID NO: 2538967 - RNA, 13 nt, Chlamydophila pneumoniae CWL029
ucuauuucauaua

SEQ ID NO: 2538968 - RNA, 20 nt, Chlamydophila pneumoniae CWL029
ucuauuucauauaaaguuuc

SEQ ID NO: 2538969 - RNA, 15 nt, Chlamydophila pneumoniae CWL029
ucuauuugaaaagaa

SEQ ID NO: 2538970 - RNA, 13 nt, Chlamydophila pneumoniae CWL029
ucuauuuucagga

SEQ ID NO: 2538971 - RNA, 20 nt, Chlamydophila pneumoniae CWL029
ucucaaagacaugagggcau

SEQ ID NO: 2538972 - RNA, 16 nt, Chlamydophila pneumoniae CWL029
ucucaacgcaauagga

SEQ ID NO: 2538973 - RNA, 17 nt, Chlamydophila pneumoniae CWL029
ucucaaguaagaagucu

SEQ ID NO: 2538974 - RNA, 13 nt, Chlamydophila pneumoniae CWL029
ucucaauaauaga

SEQ ID NO: 2538975 - RNA, 16 nt, Chlamydophila pneumoniae CWL029
ucucacaagcauccua

SEQ ID NO: 2538976 - RNA, 18 nt, Chlamydophila pneumoniae CWL029
ucucaccagaagcaacua

SEQ ID NO: 2538977 - RNA, 13 nt, Chlamydophila pneumoniae CWL029
ucucagaaagccu

SEQ ID NO: 2538978 - RNA, 21 nt, Chlamydophila pneumoniae CWL029
ucucagaaagccuuugcucac

SEQ ID NO: 2538979 - RNA, 19 nt, Chlamydophila pneumoniae CWL029
ucucagauaaaaagaagua

SEQ ID NO: 2538980 - RNA, 17 nt, Chlamydophila pneumoniae CWL029
ucucagcuucaucagaa

SEQ ID NO: 2538981 - RNA, 17 nt, Chlamydophila pneumoniae CWL029
ucucaguaggagcagcg

SEQ ID NO: 2538982 - RNA, 18 nt, Chlamydophila pneumoniae CWL029
ucucagugaacucuucaa

SEQ ID NO: 2538983 - RNA, 15 nt, Chlamydophila pneumoniae CWL029
ucucaguuaaagagc

SEQ ID NO: 2538984 - RNA, 14 nt, Chlamydophila pneumoniae CWL029
ucucauaaguauag

SEQ ID NO: 2538985 - RNA, 15 nt, Chlamydophila pneumoniae CWL029
ucucauaguuucuau

SEQ ID NO: 2538986 - RNA, 20 nt, Chlamydophila pneumoniae CWL029
ucucaugaaauuuucuaaga

SEQ ID NO: 2538987 - RNA, 20 nt, Chlamydophila pneumoniae CWL029
ucucauggauuacugaagau

SEQ ID NO: 2538988 - RNA, 19 nt, Chlamydophila pneumoniae CWL029
ucucauuccagcaucuucu

SEQ ID NO: 2538989 - RNA, 22 nt, Chlamydophila pneumoniae CWL029
ucucauuucguagacgcucuaa

SEQ ID NO: 2538990 - RNA, 15 nt, Chlamydophila pneumoniae CWL029
ucuccaaaagcucua

SEQ ID NO: 2538991 - RNA, 16 nt, Chlamydophila pneumoniae CWL029
ucuccaaaagcucuac

SEQ ID NO: 2538992 - RNA, 14 nt, Chlamydophila pneumoniae CWL029
ucuccaaagauaca

SEQ ID NO: 2538993 - RNA, 17 nt, Chlamydophila pneumoniae CWL029
ucuccaagauaauuaug

SEQ ID NO: 2538994 - RNA, 19 nt, Chlamydophila pneumoniae CWL029
ucuccagaaauuuuuacaa

SEQ ID NO: 2538995 - RNA, 18 nt, Chlamydophila pneumoniae CWL029
ucuccaguaucuucucuu

SEQ ID NO: 2538996 - RNA, 21 nt, Chlamydophila pneumoniae CWL029
ucuccauccucagucucucua

SEQ ID NO: 2538997 - RNA, 18 nt, Chlamydophila pneumoniae CWL029
ucucccgugagcaugcuc

SEQ ID NO: 2538998 - RNA, 19 nt, Chlamydophila pneumoniae CWL029
ucucccgugagcaugcuca

SEQ ID NO: 2538999 - RNA, 16 nt, Chlamydophila pneumoniae CWL029
ucucccuguauuaaag

SEQ ID NO: 2539000 - RNA, 17 nt, Chlamydophila pneumoniae CWL029
ucuccggaacgcagagu

SEQ ID NO: 2539001 - RNA, 19 nt, Chlamydophila pneumoniae CWL029
ucuccggaggucccucuaa

SEQ ID NO: 2539002 - RNA, 17 nt, Chlamydophila pneumoniae CWL029
ucuccgucauauuuaaa

SEQ ID NO: 2539003 - RNA, 12 nt, Chlamydophila pneumoniae CWL029
ucuccguccccc

SEQ ID NO: 2539004 - RNA, 22 nt, Chlamydophila pneumoniae CWL029
ucuccgucccccggcucuguug

SEQ ID NO: 2539005 - RNA, 19 nt, Chlamydophila pneumoniae CWL029
ucuccguuaccaaaaacug

SEQ ID NO: 2539006 - RNA, 18 nt, Chlamydophila pneumoniae CWL029
ucuccuaaaccaucacuu

SEQ ID NO: 2539007 - RNA, 21 nt, Chlamydophila pneumoniae CWL029
ucuccuaggucuaauccccaa

SEQ ID NO: 2539008 - RNA, 13 nt, Chlamydophila pneumoniae CWL029
ucuccucaucaga

SEQ ID NO: 2539009 - RNA, 19 nt, Chlamydophila pneumoniae CWL029
ucuccugaaccgcaaaaag

SEQ ID NO: 2539010 - RNA, 21 nt, Chlamydophila pneumoniae CWL029
ucuccuggagagcgaaauaga

SEQ ID NO: 2539011 - RNA, 14 nt, Chlamydophila pneumoniae CWL029
ucuccuuaccaaua

SEQ ID NO: 2539012 - RNA, 19 nt, Chlamydophila pneumoniae CWL029
ucuccuucuggaugcccug

SEQ ID NO: 2539013 - RNA, 15 nt, Chlamydophila pneumoniae CWL029
ucuccuugauuuggg

SEQ ID NO: 2539014 - RNA, 14 nt, Chlamydophila pneumoniae CWL029
ucuccuuuaaauaa

SEQ ID NO: 2539015 - RNA, 22 nt, Chlamydophila pneumoniae CWL029
ucucgaaaaauuugcgaagucc

SEQ ID NO: 2539016 - RNA, 19 nt, Chlamydophila pneumoniae CWL029
ucucgaacucugaaguaca

SEQ ID NO: 2539017 - RNA, 13 nt, Chlamydophila pneumoniae CWL029
ucucgaagaaaau

SEQ ID NO: 2539018 - RNA, 14 nt, Chlamydophila pneumoniae CWL029
ucucgaagaaaaua

SEQ ID NO: 2539019 - RNA, 22 nt, Chlamydophila pneumoniae CWL029
ucucgaagaaaauaaagaucuu

SEQ ID NO: 2539020 - RNA, 12 nt, Chlamydophila pneumoniae CWL029
ucucgaagcuug

SEQ ID NO: 2539021 - RNA, 20 nt, Chlamydophila pneumoniae CWL029
ucucgaauagaaaagguauu

SEQ ID NO: 2539022 - RNA, 15 nt, Chlamydophila pneumoniae CWL029
ucucgacacuaugug

SEQ ID NO: 2539023 - RNA, 17 nt, Chlamydophila pneumoniae CWL029
ucucgacacuauguguu

SEQ ID NO: 2539024 - RNA, 17 nt, Chlamydophila pneumoniae CWL029
ucucguacguggaaagu

SEQ ID NO: 2539025 - RNA, 19 nt, Chlamydophila pneumoniae CWL029
ucucgucauuaccugcuaa

SEQ ID NO: 2539026 - RNA, 20 nt, Chlamydophila pneumoniae CWL029
ucucuaagaaucuauagaac

SEQ ID NO: 2539027 - RNA, 22 nt, Chlamydophila pneumoniae CWL029
ucucuaccgaacagagcgucua

SEQ ID NO: 2539028 - RNA, 21 nt, Chlamydophila pneumoniae CWL029
ucucuagccaauauagaagcu

SEQ ID NO: 2539029 - RNA, 21 nt, Chlamydophila pneumoniae CWL029
ucucuagcuguuaauucccgu

SEQ ID NO: 2539030 - RNA, 15 nt, Chlamydophila pneumoniae CWL029
ucucuaggaacucuu

SEQ ID NO: 2539031 - RNA, 16 nt, Chlamydophila pneumoniae CWL029
ucucuagggaaaggag

SEQ ID NO: 2539032 - RNA, 17 nt, Chlamydophila pneumoniae CWL029
ucucuaguucuagaaag

SEQ ID NO: 2539033 - RNA, 22 nt, Chlamydophila pneumoniae CWL029
ucucuaguucuagaaaggcauu

SEQ ID NO: 2539034 - RNA, 13 nt, Chlamydophila pneumoniae CWL029
ucucuaguuuuua

SEQ ID NO: 2539035 - RNA, 20 nt, Chlamydophila pneumoniae CWL029
ucucuaugaacgauuucuuu

SEQ ID NO: 2539036 - RNA, 22 nt, Chlamydophila pneumoniae CWL029
ucucuaugaacgauuucuuuua

SEQ ID NO: 2539037 - RNA, 18 nt, Chlamydophila pneumoniae CWL029
ucucuaugcacaaaauaa

SEQ ID NO: 2539038 - RNA, 16 nt, Chlamydophila pneumoniae CWL029
ucucuaugcgcucuaa

SEQ ID NO: 2539039 - RNA, 19 nt, Chlamydophila pneumoniae CWL029
ucucuaugcgcucuaagag

SEQ ID NO: 2539040 - RNA, 14 nt, Chlamydophila pneumoniae CWL029
ucucucaauaagau

SEQ ID NO: 2539041 - RNA, 22 nt, Chlamydophila pneumoniae CWL029
ucucuccguccaguucuucauu

SEQ ID NO: 2539042 - RNA, 19 nt, Chlamydophila pneumoniae CWL029
ucucucgcauauucuuuug

SEQ ID NO: 2539043 - RNA, 13 nt, Chlamydophila pneumoniae CWL029
ucucucuuuaaaa

SEQ ID NO: 2539044 - RNA, 13 nt, Chlamydophila pneumoniae CWL029
ucucucuuuccuu

SEQ ID NO: 2539045 - RNA, 19 nt, Chlamydophila pneumoniae CWL029
ucucugaagcuaaaaaauu

SEQ ID NO: 2539046 - RNA, 18 nt, Chlamydophila pneumoniae CWL029
ucucugcaacgcaguuua

SEQ ID NO: 2539047 - RNA, 19 nt, Chlamydophila pneumoniae CWL029
ucucugcccccuguuugaa

SEQ ID NO: 2539048 - RNA, 18 nt, Chlamydophila pneumoniae CWL029
ucucuguauaguuuucaa

SEQ ID NO: 2539049 - RNA, 18 nt, Chlamydophila pneumoniae CWL029
ucucuuaaaauauuaaau

SEQ ID NO: 2539050 - RNA, 17 nt, Chlamydophila pneumoniae CWL029
ucucuucacucuuuuau

SEQ ID NO: 2539051 - RNA, 22 nt, Chlamydophila pneumoniae CWL029
ucucuucccuuguuaugaaaau

SEQ ID NO: 2539052 - RNA, 14 nt, Chlamydophila pneumoniae CWL029
ucucuuccuucucc

SEQ ID NO: 2539053 - RNA, 17 nt, Chlamydophila pneumoniae CWL029
ucucuuccuucuccugu

SEQ ID NO: 2539054 - RNA, 22 nt, Chlamydophila pneumoniae CWL029
ucucuuccuucuccuguaaagc

SEQ ID NO: 2539055 - RNA, 22 nt, Chlamydophila pneumoniae CWL029
ucucuucgcuggcauguuuaau

SEQ ID NO: 2539056 - RNA, 15 nt, Chlamydophila pneumoniae CWL029
ucucuucucuguugg

SEQ ID NO: 2539057 - RNA, 13 nt, Chlamydophila pneumoniae CWL029
ucucuucuucuca

SEQ ID NO: 2539058 - RNA, 14 nt, Chlamydophila pneumoniae CWL029
ucucuugauuccuu

SEQ ID NO: 2539059 - RNA, 22 nt, Chlamydophila pneumoniae CWL029
ucucuugauuccuuaagucguc

SEQ ID NO: 2539060 - RNA, 19 nt, Chlamydophila pneumoniae CWL029
ucucuuuaaaaauauaucu

SEQ ID NO: 2539061 - RNA, 19 nt, Chlamydophila pneumoniae CWL029
ucucuuuaacuucuaaaag

SEQ ID NO: 2539062 - RNA, 13 nt, Chlamydophila pneumoniae CWL029
ucucuuucacaaa

SEQ ID NO: 2539063 - RNA, 15 nt, Chlamydophila pneumoniae CWL029
ucucuuuuggaagac

SEQ ID NO: 2539064 - RNA, 13 nt, Chlamydophila pneumoniae CWL029
ucugaaacaaugc

SEQ ID NO: 2539065 - RNA, 20 nt, Chlamydophila pneumoniae CWL029
ucugaaacaaugcaucccug

SEQ ID NO: 2539066 - RNA, 13 nt, Chlamydophila pneumoniae CWL029
ucugaaacauaag

SEQ ID NO: 2539067 - RNA, 17 nt, Chlamydophila pneumoniae CWL029
ucugaaaucaaaaaaaa

SEQ ID NO: 2539068 - RNA, 20 nt, Chlamydophila pneumoniae CWL029
ucugaagaccccucuugcuu

SEQ ID NO: 2539069 - RNA, 16 nt, Chlamydophila pneumoniae CWL029
ucugaagcuaaaaaau

SEQ ID NO: 2539070 - RNA, 23 nt, Chlamydophila pneumoniae CWL029
ucugaaggauuugcucuguagua

SEQ ID NO: 2539071 - RNA, 22 nt, Chlamydophila pneumoniae CWL029
ucugaauagcucuuuucaugau

SEQ ID NO: 2539072 - RNA, 19 nt, Chlamydophila pneumoniae CWL029
ucugaaucucauaaguaua

SEQ ID NO: 2539073 - RNA, 15 nt, Chlamydophila pneumoniae CWL029
ucugacaaguguguu

SEQ ID NO: 2539074 - RNA, 22 nt, Chlamydophila pneumoniae CWL029
ucugacauuccuuaauuacucg

SEQ ID NO: 2539075 - RNA, 19 nt, Chlamydophila pneumoniae CWL029
ucugacgucuccaacaguc

SEQ ID NO: 2539076 - RNA, 21 nt, Chlamydophila pneumoniae CWL029
ucugagcauaacuugaagaag

SEQ ID NO: 2539077 - RNA, 14 nt, Chlamydophila pneumoniae CWL029
ucugagcuugccua

SEQ ID NO: 2539078 - RNA, 16 nt, Chlamydophila pneumoniae CWL029
ucugaguuagcuuuug

SEQ ID NO: 2539079 - RNA, 19 nt, Chlamydophila pneumoniae CWL029
ucugauaaucagaggagcc

SEQ ID NO: 2539080 - RNA, 17 nt, Chlamydophila pneumoniae CWL029
ucugauagaacaggauu

SEQ ID NO: 2539081 - RNA, 15 nt, Chlamydophila pneumoniae CWL029
ucugaucccucaaaa

SEQ ID NO: 2539082 - RNA, 15 nt, Chlamydophila pneumoniae CWL029
ucugaucguacagga

SEQ ID NO: 2539083 - RNA, 15 nt, Chlamydophila pneumoniae CWL029
ucugaugcaccauaa

SEQ ID NO: 2539084 - RNA, 20 nt, Chlamydophila pneumoniae CWL029
ucugauuauuucuaaaaaau

SEQ ID NO: 2539085 - RNA, 18 nt, Chlamydophila pneumoniae CWL029
ucugauugagaauaaaac

SEQ ID NO: 2539086 - RNA, 19 nt, Chlamydophila pneumoniae CWL029
ucugcaaucugaaugccug

SEQ ID NO: 2539087 - RNA, 19 nt, Chlamydophila pneumoniae CWL029
ucugcaauuccgaagaaga

SEQ ID NO: 2539088 - RNA, 23 nt, Chlamydophila pneumoniae CWL029
ucugcaauuccgaagaagaaagg

SEQ ID NO: 2539089 - RNA, 15 nt, Chlamydophila pneumoniae CWL029
ucugcacggauauuc

SEQ ID NO: 2539090 - RNA, 20 nt, Chlamydophila pneumoniae CWL029
ucugcagguaagggaugcuc

SEQ ID NO: 2539091 - RNA, 21 nt, Chlamydophila pneumoniae CWL029
ucugcauauaaagacucucuu

SEQ ID NO: 2539092 - RNA, 19 nt, Chlamydophila pneumoniae CWL029
ucugccauaggauccagga

SEQ ID NO: 2539093 - RNA, 13 nt, Chlamydophila pneumoniae CWL029
ucugcccaaagcu

SEQ ID NO: 2539094 - RNA, 21 nt, Chlamydophila pneumoniae CWL029
ucugcccgucuuagaauccaa

SEQ ID NO: 2539095 - RNA, 16 nt, Chlamydophila pneumoniae CWL029
ucugcccuuucugcaa

SEQ ID NO: 2539096 - RNA, 17 nt, Chlamydophila pneumoniae CWL029
ucugccuaccaaaguuu

SEQ ID NO: 2539097 - RNA, 20 nt, Chlamydophila pneumoniae CWL029
ucugcgauugccggcuauga

SEQ ID NO: 2539098 - RNA, 22 nt, Chlamydophila pneumoniae CWL029
ucugcgcagcguauaauuggcg

SEQ ID NO: 2539099 - RNA, 22 nt, Chlamydophila pneumoniae CWL029
ucugcgucuuuaauuaaaaguu

SEQ ID NO: 2539100 - RNA, 15 nt, Chlamydophila pneumoniae CWL029
ucugcguuucuuucu

SEQ ID NO: 2539101 - RNA, 16 nt, Chlamydophila pneumoniae CWL029
ucugcguuucuuucug

SEQ ID NO: 2539102 - RNA, 22 nt, Chlamydophila pneumoniae CWL029
ucugcuccugaauaugcuuuuc

SEQ ID NO: 2539103 - RNA, 15 nt, Chlamydophila pneumoniae CWL029
ucugcugaagggaca

SEQ ID NO: 2539104 - RNA, 16 nt, Chlamydophila pneumoniae CWL029
ucugcugaggagagua

SEQ ID NO: 2539105 - RNA, 19 nt, Chlamydophila pneumoniae CWL029
ucugcuggaguagcucaau

SEQ ID NO: 2539106 - RNA, 22 nt, Chlamydophila pneumoniae CWL029
ucugcuucuguaaagauucuau

SEQ ID NO: 2539107 - RNA, 21 nt, Chlamydophila pneumoniae CWL029
ucuggagaaaaaauaucuccg

SEQ ID NO: 2539108 - RNA, 20 nt, Chlamydophila pneumoniae CWL029
ucuggauacguuuuucccuu

SEQ ID NO: 2539109 - RNA, 23 nt, Chlamydophila pneumoniae CWL029
ucuggaugagaggauuugaaccu

SEQ ID NO: 2539110 - RNA, 13 nt, Chlamydophila pneumoniae CWL029
ucuggauguagag

SEQ ID NO: 2539111 - RNA, 23 nt, Chlamydophila pneumoniae CWL029
ucugggaagacucucaucagcaa

SEQ ID NO: 2539112 - RNA, 21 nt, Chlamydophila pneumoniae CWL029
ucugggugcgucguaaucuuu

SEQ ID NO: 2539113 - RNA, 14 nt, Chlamydophila pneumoniae CWL029
ucuggguucuccac

SEQ ID NO: 2539114 - RNA, 17 nt, Chlamydophila pneumoniae CWL029
ucugguauagaaacacc

SEQ ID NO: 2539115 - RNA, 18 nt, Chlamydophila pneumoniae CWL029
ucugguuaagcaccauaa

SEQ ID NO: 2539116 - RNA, 23 nt, Chlamydophila pneumoniae CWL029
ucugguuuuucgauuuggaagau

SEQ ID NO: 2539117 - RNA, 19 nt, Chlamydophila pneumoniae CWL029
ucuguaaagugaaauugaa

SEQ ID NO: 2539118 - RNA, 18 nt, Chlamydophila pneumoniae CWL029
ucuguaauauucaacaug

SEQ ID NO: 2539119 - RNA, 17 nt, Chlamydophila pneumoniae CWL029
ucuguaauuuuuuucaa

SEQ ID NO: 2539120 - RNA, 17 nt, Chlamydophila pneumoniae CWL029
ucuguagauuuucccua

SEQ ID NO: 2539121 - RNA, 15 nt, Chlamydophila pneumoniae CWL029
ucuguagguuuuucc

SEQ ID NO: 2539122 - RNA, 23 nt, Chlamydophila pneumoniae CWL029
ucuguagguuuuuccaacuucaa

SEQ ID NO: 2539123 - RNA, 15 nt, Chlamydophila pneumoniae CWL029
ucuguaguaaagcca

SEQ ID NO: 2539124 - RNA, 22 nt, Chlamydophila pneumoniae CWL029
ucuguaguuuguucacuuggua

SEQ ID NO: 2539125 - RNA, 13 nt, Chlamydophila pneumoniae CWL029
ucuguauaguuuu

SEQ ID NO: 2539126 - RNA, 17 nt, Chlamydophila pneumoniae CWL029
ucuguaucgauaguuuu

SEQ ID NO: 2539127 - RNA, 16 nt, Chlamydophila pneumoniae CWL029
ucugucuguauuuccg

SEQ ID NO: 2539128 - RNA, 13 nt, Chlamydophila pneumoniae CWL029
ucugugagaaaua

SEQ ID NO: 2539129 - RNA, 15 nt, Chlamydophila pneumoniae CWL029
ucugugaguacccag

SEQ ID NO: 2539130 - RNA, 12 nt, Chlamydophila pneumoniae CWL029
ucuguguagccg

SEQ ID NO: 2539131 - RNA, 20 nt, Chlamydophila pneumoniae CWL029
ucugugugacgacaaaucac

SEQ ID NO: 2539132 - RNA, 21 nt, Chlamydophila pneumoniae CWL029
ucuguuggucucuauuuagac

SEQ ID NO: 2539133 - RNA, 14 nt, Chlamydophila pneumoniae CWL029
ucuguuuuggaaag

SEQ ID NO: 2539134 - RNA, 15 nt, Chlamydophila pneumoniae CWL029
ucuguuuuuugaaaa

SEQ ID NO: 2539135 - RNA, 13 nt, Chlamydophila pneumoniae CWL029
ucuuaaaaacuac

SEQ ID NO: 2539136 - RNA, 12 nt, Chlamydophila pneumoniae CWL029
ucuuaaaacaug

SEQ ID NO: 2539137 - RNA, 12 nt, Chlamydophila pneumoniae CWL029
ucuuaaaacugc

SEQ ID NO: 2539138 - RNA, 22 nt, Chlamydophila pneumoniae CWL029
ucuuaaaauauuaaauucaaaa

SEQ ID NO: 2539139 - RNA, 15 nt, Chlamydophila pneumoniae CWL029
ucuuaaaauuccuga

SEQ ID NO: 2539140 - RNA, 18 nt, Chlamydophila pneumoniae CWL029
ucuuaacaauauaugcua

SEQ ID NO: 2539141 - RNA, 17 nt, Chlamydophila pneumoniae CWL029
ucuuaacgcuuagagaa

SEQ ID NO: 2539142 - RNA, 17 nt, Chlamydophila pneumoniae CWL029
ucuuaagaauaaaauag

SEQ ID NO: 2539143 - RNA, 15 nt, Chlamydophila pneumoniae CWL029
ucuuaagagcaaaca

SEQ ID NO: 2539144 - RNA, 13 nt, Chlamydophila pneumoniae CWL029
ucuuaauauaaaa

SEQ ID NO: 2539145 - RNA, 18 nt, Chlamydophila pneumoniae CWL029
ucuuaauauaaaagaaga

SEQ ID NO: 2539146 - RNA, 23 nt, Chlamydophila pneumoniae CWL029
ucuuaauauaaaagaagacgcuc

SEQ ID NO: 2539147 - RNA, 14 nt, Chlamydophila pneumoniae CWL029
ucuuaauuaaaaac

SEQ ID NO: 2539148 - RNA, 22 nt, Chlamydophila pneumoniae CWL029
ucuuacuaaagaaagagucuca

SEQ ID NO: 2539149 - RNA, 18 nt, Chlamydophila pneumoniae CWL029
ucuuagaagagaaaguag

SEQ ID NO: 2539150 - RNA, 14 nt, Chlamydophila pneumoniae CWL029
ucuuagaauccaaa

SEQ ID NO: 2539151 - RNA, 21 nt, Chlamydophila pneumoniae CWL029
ucuuagccccuccaacaaaca

SEQ ID NO: 2539152 - RNA, 12 nt, Chlamydophila pneumoniae CWL029
ucuuagccuagg

SEQ ID NO: 2539153 - RNA, 21 nt, Chlamydophila pneumoniae CWL029
ucuuaguaaagaaucacucuc

SEQ ID NO: 2539154 - RNA, 23 nt, Chlamydophila pneumoniae CWL029
ucuuauaaaaaagggaugaagau

SEQ ID NO: 2539155 - RNA, 18 nt, Chlamydophila pneumoniae CWL029
ucuuauagacagguacau

SEQ ID NO: 2539156 - RNA, 17 nt, Chlamydophila pneumoniae CWL029
ucuuauagggaauuuuu

SEQ ID NO: 2539157 - RNA, 13 nt, Chlamydophila pneumoniae CWL029
ucuuauauaaaac

SEQ ID NO: 2539158 - RNA, 13 nt, Chlamydophila pneumoniae CWL029
ucuuaucugcuau

SEQ ID NO: 2539159 - RNA, 14 nt, Chlamydophila pneumoniae CWL029
ucuuaucuggagau

SEQ ID NO: 2539160 - RNA, 15 nt, Chlamydophila pneumoniae CWL029
ucuuaucuggagaug

SEQ ID NO: 2539161 - RNA, 15 nt, Chlamydophila pneumoniae CWL029
ucuuaucuucuaaaa

SEQ ID NO: 2539162 - RNA, 17 nt, Chlamydophila pneumoniae CWL029
ucuuaugaccaagaaca

SEQ ID NO: 2539163 - RNA, 17 nt, Chlamydophila pneumoniae CWL029
ucuuauucacuggaaug

SEQ ID NO: 2539164 - RNA, 14 nt, Chlamydophila pneumoniae CWL029
ucuucaaaagaccg

SEQ ID NO: 2539165 - RNA, 18 nt, Chlamydophila pneumoniae CWL029
ucuucaaaaguaaucacu

SEQ ID NO: 2539166 - RNA, 21 nt, Chlamydophila pneumoniae CWL029
ucuucaaagcuacuaaucacc

SEQ ID NO: 2539167 - RNA, 23 nt, Chlamydophila pneumoniae CWL029
ucuucaaagcuacuaaucaccuu

SEQ ID NO: 2539168 - RNA, 22 nt, Chlamydophila pneumoniae CWL029
ucuucaaagucaaauacuucuc

SEQ ID NO: 2539169 - RNA, 19 nt, Chlamydophila pneumoniae CWL029
ucuucacgacauacaucaa

SEQ ID NO: 2539170 - RNA, 17 nt, Chlamydophila pneumoniae CWL029
ucuucagaaugcccuuu

SEQ ID NO: 2539171 - RNA, 19 nt, Chlamydophila pneumoniae CWL029
ucuucagaguugucaagua

SEQ ID NO: 2539172 - RNA, 13 nt, Chlamydophila pneumoniae CWL029
ucuucagcccacu

SEQ ID NO: 2539173 - RNA, 23 nt, Chlamydophila pneumoniae CWL029
ucuucagcuuuaacaugccaaaa

SEQ ID NO: 2539174 - RNA, 22 nt, Chlamydophila pneumoniae CWL029
ucuucaucaauacgaucuuuug

SEQ ID NO: 2539175 - RNA, 15 nt, Chlamydophila pneumoniae CWL029
ucuucaucacaaaau

SEQ ID NO: 2539176 - RNA, 16 nt, Chlamydophila pneumoniae CWL029
ucuucauccgaagacu

SEQ ID NO: 2539177 - RNA, 22 nt, Chlamydophila pneumoniae CWL029
ucuucaugcugcuuugacgacu

SEQ ID NO: 2539178 - RNA, 22 nt, Chlamydophila pneumoniae CWL029
ucuucauugcaaaaaugaaaga

SEQ ID NO: 2539179 - RNA, 20 nt, Chlamydophila pneumoniae CWL029
ucuucauuuucuuuuaagag

SEQ ID NO: 2539180 - RNA, 17 nt, Chlamydophila pneumoniae CWL029
ucuuccaaagacugagc

SEQ ID NO: 2539181 - RNA, 18 nt, Chlamydophila pneumoniae CWL029
ucuuccaaagacugagcu

SEQ ID NO: 2539182 - RNA, 14 nt, Chlamydophila pneumoniae CWL029
ucuuccaacuucug

SEQ ID NO: 2539183 - RNA, 16 nt, Chlamydophila pneumoniae CWL029
ucuuccacaauguuua

SEQ ID NO: 2539184 - RNA, 19 nt, Chlamydophila pneumoniae CWL029
ucuuccaucucuuuaaaug

SEQ ID NO: 2539185 - RNA, 17 nt, Chlamydophila pneumoniae CWL029
ucuucccagguaaacaa

SEQ ID NO: 2539186 - RNA, 14 nt, Chlamydophila pneumoniae CWL029
ucuucccccagacc

SEQ ID NO: 2539187 - RNA, 17 nt, Chlamydophila pneumoniae CWL029
ucuuccuucuucuucaa

SEQ ID NO: 2539188 - RNA, 17 nt, Chlamydophila pneumoniae CWL029
ucuucgauuguaacuuc

SEQ ID NO: 2539189 - RNA, 18 nt, Chlamydophila pneumoniae CWL029
ucuucgauuguaacuucg

SEQ ID NO: 2539190 - RNA, 22 nt, Chlamydophila pneumoniae CWL029
ucuucgauuucuaguuguccuu

SEQ ID NO: 2539191 - RNA, 13 nt, Chlamydophila pneumoniae CWL029
ucuucgcaaauau

SEQ ID NO: 2539192 - RNA, 22 nt, Chlamydophila pneumoniae CWL029
ucuucgcaaauauaguuuucau

SEQ ID NO: 2539193 - RNA, 23 nt, Chlamydophila pneumoniae CWL029
ucuucgcuggcauguuuaauauc

SEQ ID NO: 2539194 - RNA, 16 nt, Chlamydophila pneumoniae CWL029
ucuucggaucuguaau

SEQ ID NO: 2539195 - RNA, 15 nt, Chlamydophila pneumoniae CWL029
ucuucguuuauaaca

SEQ ID NO: 2539196 - RNA, 18 nt, Chlamydophila pneumoniae CWL029
ucuucguuuauaacauca

SEQ ID NO: 2539197 - RNA, 13 nt, Chlamydophila pneumoniae CWL029
ucuucuaaaacac

SEQ ID NO: 2539198 - RNA, 18 nt, Chlamydophila pneumoniae CWL029
ucuucuaaaaccacagaa

SEQ ID NO: 2539199 - RNA, 16 nt, Chlamydophila pneumoniae CWL029
ucuucuaaaacuucag

SEQ ID NO: 2539200 - RNA, 20 nt, Chlamydophila pneumoniae CWL029
ucuucuaaaacuucaguugu

SEQ ID NO: 2539201 - RNA, 15 nt, Chlamydophila pneumoniae CWL029
ucuucuacagaauag

SEQ ID NO: 2539202 - RNA, 13 nt, Chlamydophila pneumoniae CWL029
ucuucuaccugua

SEQ ID NO: 2539203 - RNA, 19 nt, Chlamydophila pneumoniae CWL029
ucuucuacuuuaagaagca

SEQ ID NO: 2539204 - RNA, 23 nt, Chlamydophila pneumoniae CWL029
ucuucuagcucauuaucaagaaa

SEQ ID NO: 2539205 - RNA, 21 nt, Chlamydophila pneumoniae CWL029
ucuucucgaacaggagagaga

SEQ ID NO: 2539206 - RNA, 11 nt, Chlamydophila pneumoniae CWL029
ucuucugaaau

SEQ ID NO: 2539207 - RNA, 19 nt, Chlamydophila pneumoniae CWL029
ucuucugauugaaguucag

SEQ ID NO: 2539208 - RNA, 22 nt, Chlamydophila pneumoniae CWL029
ucuucuggauacguuuuucccu

SEQ ID NO: 2539209 - RNA, 19 nt, Chlamydophila pneumoniae CWL029
ucuucuggguucuccacau

SEQ ID NO: 2539210 - RNA, 16 nt, Chlamydophila pneumoniae CWL029
ucuucuguaggaacaa

SEQ ID NO: 2539211 - RNA, 15 nt, Chlamydophila pneumoniae CWL029
ucuucuguuuucucu

SEQ ID NO: 2539212 - RNA, 16 nt, Chlamydophila pneumoniae CWL029
ucuucuuagaaacaca

SEQ ID NO: 2539213 - RNA, 18 nt, Chlamydophila pneumoniae CWL029
ucuucuuagccaaaauuu

SEQ ID NO: 2539214 - RNA, 15 nt, Chlamydophila pneumoniae CWL029
ucuucuucaaaguca

SEQ ID NO: 2539215 - RNA, 17 nt, Chlamydophila pneumoniae CWL029
ucuucuucaucuucuaa

SEQ ID NO: 2539216 - RNA, 14 nt, Chlamydophila pneumoniae CWL029
ucuucuucuggcug

SEQ ID NO: 2539217 - RNA, 14 nt, Chlamydophila pneumoniae CWL029
ucuucuugauuaag

SEQ ID NO: 2539218 - RNA, 15 nt, Chlamydophila pneumoniae CWL029
ucuucuugauuaaga

SEQ ID NO: 2539219 - RNA, 15 nt, Chlamydophila pneumoniae CWL029
ucuucuugcaaucuu

SEQ ID NO: 2539220 - RNA, 19 nt, Chlamydophila pneumoniae CWL029
ucuucuuggcuuucccccu

SEQ ID NO: 2539221 - RNA, 15 nt, Chlamydophila pneumoniae CWL029
ucuucuuguucuucu

SEQ ID NO: 2539222 - RNA, 20 nt, Chlamydophila pneumoniae CWL029
ucuucuuuaagauuuccuua

SEQ ID NO: 2539223 - RNA, 15 nt, Chlamydophila pneumoniae CWL029
ucuucuuuccauaga

SEQ ID NO: 2539224 - RNA, 18 nt, Chlamydophila pneumoniae CWL029
ucuucuuugccaaugaga

SEQ ID NO: 2539225 - RNA, 18 nt, Chlamydophila pneumoniae CWL029
ucuucuuuggaugcuaau

SEQ ID NO: 2539226 - RNA, 13 nt, Chlamydophila pneumoniae CWL029
ucuucuuuucguu

SEQ ID NO: 2539227 - RNA, 11 nt, Chlamydophila pneumoniae CWL029
ucuugaaaaaa

SEQ ID NO: 2539228 - RNA, 15 nt, Chlamydophila pneumoniae CWL029
ucuugaaaaaauucu

SEQ ID NO: 2539229 - RNA, 13 nt, Chlamydophila pneumoniae CWL029
ucuugaagagauu

SEQ ID NO: 2539230 - RNA, 20 nt, Chlamydophila pneumoniae CWL029
ucuugaagagauugauuucu

SEQ ID NO: 2539231 - RNA, 19 nt, Chlamydophila pneumoniae CWL029
ucuugaaguucuucaagau

SEQ ID NO: 2539232 - RNA, 14 nt, Chlamydophila pneumoniae CWL029
ucuugacggcagga

SEQ ID NO: 2539233 - RNA, 19 nt, Chlamydophila pneumoniae CWL029
ucuugacggcaggacucuu

SEQ ID NO: 2539234 - RNA, 17 nt, Chlamydophila pneumoniae CWL029
ucuugacuuguuucucc

SEQ ID NO: 2539235 - RNA, 16 nt, Chlamydophila pneumoniae CWL029
ucuugagcauccaaaa

SEQ ID NO: 2539236 - RNA, 19 nt, Chlamydophila pneumoniae CWL029
ucuugagccacuuuuaauu

SEQ ID NO: 2539237 - RNA, 21 nt, Chlamydophila pneumoniae CWL029
ucuugagcgacgacaaggaca

SEQ ID NO: 2539238 - RNA, 18 nt, Chlamydophila pneumoniae CWL029
ucuugauagcuaagagca

SEQ ID NO: 2539239 - RNA, 15 nt, Chlamydophila pneumoniae CWL029
ucuugauccaucugc

SEQ ID NO: 2539240 - RNA, 15 nt, Chlamydophila pneumoniae CWL029
ucuugauuagagaau

SEQ ID NO: 2539241 - RNA, 15 nt, Chlamydophila pneumoniae CWL029
ucuugauucucuucc

SEQ ID NO: 2539242 - RNA, 22 nt, Chlamydophila pneumoniae CWL029
ucuugcucuagucuuucaaccu

SEQ ID NO: 2539243 - RNA, 13 nt, Chlamydophila pneumoniae CWL029
ucuugcucugaca

SEQ ID NO: 2539244 - RNA, 23 nt, Chlamydophila pneumoniae CWL029
ucuugcugcccaaauugagaaau

SEQ ID NO: 2539245 - RNA, 16 nt, Chlamydophila pneumoniae CWL029
ucuugcuuauugucuu

SEQ ID NO: 2539246 - RNA, 14 nt, Chlamydophila pneumoniae CWL029
ucuugcuuuuccgu

SEQ ID NO: 2539247 - RNA, 18 nt, Chlamydophila pneumoniae CWL029
ucuugguguauaguauuu

SEQ ID NO: 2539248 - RNA, 17 nt, Chlamydophila pneumoniae CWL029
ucuuguacauccuuguc

SEQ ID NO: 2539249 - RNA, 22 nt, Chlamydophila pneumoniae CWL029
ucuuguauugcuacuguccauc

SEQ ID NO: 2539250 - RNA, 15 nt, Chlamydophila pneumoniae CWL029
ucuuguuaaaguaaa

SEQ ID NO: 2539251 - RNA, 15 nt, Chlamydophila pneumoniae CWL029
ucuuguuccaauaga

SEQ ID NO: 2539252 - RNA, 14 nt, Chlamydophila pneumoniae CWL029
ucuuguucuaaaau

SEQ ID NO: 2539253 - RNA, 15 nt, Chlamydophila pneumoniae CWL029
ucuuguucuaaaaug

SEQ ID NO: 2539254 - RNA, 20 nt, Chlamydophila pneumoniae CWL029
ucuuuaaaaacccaacuccc

SEQ ID NO: 2539255 - RNA, 13 nt, Chlamydophila pneumoniae CWL029
ucuuuaaaaauag

SEQ ID NO: 2539256 - RNA, 16 nt, Chlamydophila pneumoniae CWL029
ucuuuaaaaucuucug

SEQ ID NO: 2539257 - RNA, 19 nt, Chlamydophila pneumoniae CWL029
ucuuuaagauuuuuagaau

SEQ ID NO: 2539258 - RNA, 19 nt, Chlamydophila pneumoniae CWL029
ucuuuaagguugcuuuucu

SEQ ID NO: 2539259 - RNA, 21 nt, Chlamydophila pneumoniae CWL029
ucuuuaauccaguuuuuuaaa

SEQ ID NO: 2539260 - RNA, 15 nt, Chlamydophila pneumoniae CWL029
ucuuuaauuccaacu

SEQ ID NO: 2539261 - RNA, 15 nt, Chlamydophila pneumoniae CWL029
ucuuuagaauaagag

SEQ ID NO: 2539262 - RNA, 20 nt, Chlamydophila pneumoniae CWL029
ucuuuagagucugcagcaga

SEQ ID NO: 2539263 - RNA, 14 nt, Chlamydophila pneumoniae CWL029
ucuuuagcaaacau

SEQ ID NO: 2539264 - RNA, 17 nt, Chlamydophila pneumoniae CWL029
ucuuuagcaaacauuuu

SEQ ID NO: 2539265 - RNA, 13 nt, Chlamydophila pneumoniae CWL029
ucuuuaggagcau

SEQ ID NO: 2539266 - RNA, 18 nt, Chlamydophila pneumoniae CWL029
ucuuuaggguaaagaaau

SEQ ID NO: 2539267 - RNA, 14 nt, Chlamydophila pneumoniae CWL029
ucuuuaugagagag

SEQ ID NO: 2539268 - RNA, 14 nt, Chlamydophila pneumoniae CWL029
ucuuuauuuaaaua

SEQ ID NO: 2539269 - RNA, 15 nt, Chlamydophila pneumoniae CWL029
ucuuuauuuaaauaa

SEQ ID NO: 2539270 - RNA, 22 nt, Chlamydophila pneumoniae CWL029
ucuuucaaccuccgcucuaagc

SEQ ID NO: 2539271 - RNA, 16 nt, Chlamydophila pneumoniae CWL029
ucuuucaauaacagag

SEQ ID NO: 2539272 - RNA, 14 nt, Chlamydophila pneumoniae CWL029
ucuuucaauagcuu

SEQ ID NO: 2539273 - RNA, 23 nt, Chlamydophila pneumoniae CWL029
ucuuucacauacauucuauucua

SEQ ID NO: 2539274 - RNA, 18 nt, Chlamydophila pneumoniae CWL029
ucuuucacaucuuuagaa

SEQ ID NO: 2539275 - RNA, 21 nt, Chlamydophila pneumoniae CWL029
ucuuucacaucuuuagaauca

SEQ ID NO: 2539276 - RNA, 20 nt, Chlamydophila pneumoniae CWL029
ucuuucaccaacuccucuaa

SEQ ID NO: 2539277 - RNA, 14 nt, Chlamydophila pneumoniae CWL029
ucuuucagaaagaa

SEQ ID NO: 2539278 - RNA, 12 nt, Chlamydophila pneumoniae CWL029
ucuuucauaaga

SEQ ID NO: 2539279 - RNA, 19 nt, Chlamydophila pneumoniae CWL029
ucuuucauaagauagagcg

SEQ ID NO: 2539280 - RNA, 14 nt, Chlamydophila pneumoniae CWL029
ucuuucauaagauu

SEQ ID NO: 2539281 - RNA, 17 nt, Chlamydophila pneumoniae CWL029
ucuuucauaagauugcc

SEQ ID NO: 2539282 - RNA, 14 nt, Chlamydophila pneumoniae CWL029
ucuuucauacuaaa

SEQ ID NO: 2539283 - RNA, 14 nt, Chlamydophila pneumoniae CWL029
ucuuucauucccuu

SEQ ID NO: 2539284 - RNA, 20 nt, Chlamydophila pneumoniae CWL029
ucuuuccucucaugaaauuu

SEQ ID NO: 2539285 - RNA, 20 nt, Chlamydophila pneumoniae CWL029
ucuuuccuuagcauuaggaa

SEQ ID NO: 2539286 - RNA, 13 nt, Chlamydophila pneumoniae CWL029
ucuuucuaaaaca

SEQ ID NO: 2539287 - RNA, 16 nt, Chlamydophila pneumoniae CWL029
ucuuucuaagaagacu

SEQ ID NO: 2539288 - RNA, 15 nt, Chlamydophila pneumoniae CWL029
ucuuucuaagauauc

SEQ ID NO: 2539289 - RNA, 19 nt, Chlamydophila pneumoniae CWL029
ucuuucuagaaugaugcaa

SEQ ID NO: 2539290 - RNA, 16 nt, Chlamydophila pneumoniae CWL029
ucuuucuauagcuccu

SEQ ID NO: 2539291 - RNA, 12 nt, Chlamydophila pneumoniae CWL029
ucuuucucuaaa

SEQ ID NO: 2539292 - RNA, 15 nt, Chlamydophila pneumoniae CWL029
ucuuucucuaaaaua

SEQ ID NO: 2539293 - RNA, 17 nt, Chlamydophila pneumoniae CWL029
ucuuucugauuuaaaag

SEQ ID NO: 2539294 - RNA, 15 nt, Chlamydophila pneumoniae CWL029
ucuuucuucuagagc

SEQ ID NO: 2539295 - RNA, 19 nt, Chlamydophila pneumoniae CWL029
ucuuugaacaacuccuuaa

SEQ ID NO: 2539296 - RNA, 21 nt, Chlamydophila pneumoniae CWL029
ucuuugacaucuaauuuuaaa

SEQ ID NO: 2539297 - RNA, 18 nt, Chlamydophila pneumoniae CWL029
ucuuugagaucuugaaug

SEQ ID NO: 2539298 - RNA, 20 nt, Chlamydophila pneumoniae CWL029
ucuuugaggauacgaauaag

SEQ ID NO: 2539299 - RNA, 16 nt, Chlamydophila pneumoniae CWL029
ucuuuggcacaauccu

SEQ ID NO: 2539300 - RNA, 20 nt, Chlamydophila pneumoniae CWL029
ucuuuggcacaauccucacu

SEQ ID NO: 2539301 - RNA, 15 nt, Chlamydophila pneumoniae CWL029
ucuuuguucgcuccu

SEQ ID NO: 2539302 - RNA, 16 nt, Chlamydophila pneumoniae CWL029
ucuuuuaacuuaaaga

SEQ ID NO: 2539303 - RNA, 18 nt, Chlamydophila pneumoniae CWL029
ucuuuuaugauguauaaa

SEQ ID NO: 2539304 - RNA, 21 nt, Chlamydophila pneumoniae CWL029
ucuuuuaugauguauaaaguu

SEQ ID NO: 2539305 - RNA, 19 nt, Chlamydophila pneumoniae CWL029
ucuuuucuaagcaauauuu

SEQ ID NO: 2539306 - RNA, 17 nt, Chlamydophila pneumoniae CWL029
ucuuuucuacaugcuca

SEQ ID NO: 2539307 - RNA, 23 nt, Chlamydophila pneumoniae CWL029
ucuuuucuagaaacugcuccuga

SEQ ID NO: 2539308 - RNA, 17 nt, Chlamydophila pneumoniae CWL029
ucuuuucugaagauuuu

SEQ ID NO: 2539309 - RNA, 16 nt, Chlamydophila pneumoniae CWL029
ucuuuucuuuuuagaa

SEQ ID NO: 2539310 - RNA, 16 nt, Chlamydophila pneumoniae CWL029
ucuuuugauaacuuug

SEQ ID NO: 2539311 - RNA, 23 nt, Chlamydophila pneumoniae CWL029
ucuuuugguugugucaacccuuu

SEQ ID NO: 2539312 - RNA, 18 nt, Chlamydophila pneumoniae CWL029
ucuuuuguaaucuaagaa

SEQ ID NO: 2539313 - RNA, 17 nt, Chlamydophila pneumoniae CWL029
ucuuuuguuuuagcucu

SEQ ID NO: 2539314 - RNA, 20 nt, Chlamydophila pneumoniae CWL029
ucuuuuuauugauaaugauu

SEQ ID NO: 2539315 - RNA, 16 nt, Chlamydophila pneumoniae CWL029
ucuuuuucagcuucua

SEQ ID NO: 2539316 - RNA, 21 nt, Chlamydophila pneumoniae CWL029
ucuuuuucuagggaucccaaa

SEQ ID NO: 2539317 - RNA, 23 nt, Chlamydophila pneumoniae CWL029
ucuuuuucuauuaaaaauagcuu

SEQ ID NO: 2539318 - RNA, 19 nt, Chlamydophila pneumoniae CWL029
ugaaaaaagaauaaaaaua

SEQ ID NO: 2539319 - RNA, 18 nt, Chlamydophila pneumoniae CWL029
ugaaaaggauugcacuca

SEQ ID NO: 2539320 - RNA, 18 nt, Chlamydophila pneumoniae CWL029
ugaaaaucaagaagagaa

SEQ ID NO: 2539321 - RNA, 21 nt, Chlamydophila pneumoniae CWL029
ugaaaaucgcaccuugaccuc

SEQ ID NO: 2539322 - RNA, 19 nt, Chlamydophila pneumoniae CWL029
ugaaaauucgaauucucag

SEQ ID NO: 2539323 - RNA, 22 nt, Chlamydophila pneumoniae CWL029
ugaaaauucgaauucucagaaa

SEQ ID NO: 2539324 - RNA, 14 nt, Chlamydophila pneumoniae CWL029
ugaaaauuuuccca

SEQ ID NO: 2539325 - RNA, 18 nt, Chlamydophila pneumoniae CWL029
ugaaaccuucucucuuaa

SEQ ID NO: 2539326 - RNA, 17 nt, Chlamydophila pneumoniae CWL029
ugaaacuuuaggauuca

SEQ ID NO: 2539327 - RNA, 21 nt, Chlamydophila pneumoniae CWL029
ugaaacuuuuuuucuucucua

SEQ ID NO: 2539328 - RNA, 19 nt, Chlamydophila pneumoniae CWL029
ugaaagaaugccauucuua

SEQ ID NO: 2539329 - RNA, 22 nt, Chlamydophila pneumoniae CWL029
ugaaagauguguuuuaacaacu

SEQ ID NO: 2539330 - RNA, 21 nt, Chlamydophila pneumoniae CWL029
ugaaagauuauucuagaguug

SEQ ID NO: 2539331 - RNA, 14 nt, Chlamydophila pneumoniae CWL029
ugaaagcuucuucu

SEQ ID NO: 2539332 - RNA, 16 nt, Chlamydophila pneumoniae CWL029
ugaaaguacagaaagg

SEQ ID NO: 2539333 - RNA, 17 nt, Chlamydophila pneumoniae CWL029
ugaaaguacaggcucca

SEQ ID NO: 2539334 - RNA, 18 nt, Chlamydophila pneumoniae CWL029
ugaaagucagcaagucau

SEQ ID NO: 2539335 - RNA, 20 nt, Chlamydophila pneumoniae CWL029
ugaaauacuccacuuuuuuc

SEQ ID NO: 2539336 - RNA, 17 nt, Chlamydophila pneumoniae CWL029
ugaaauaguguuucuuu

SEQ ID NO: 2539337 - RNA, 16 nt, Chlamydophila pneumoniae CWL029
ugaaauaugagaucga

SEQ ID NO: 2539338 - RNA, 14 nt, Chlamydophila pneumoniae CWL029
ugaaaucaaaaaaa

SEQ ID NO: 2539339 - RNA, 17 nt, Chlamydophila pneumoniae CWL029
ugaaaucaaaaaaaacg

SEQ ID NO: 2539340 - RNA, 12 nt, Chlamydophila pneumoniae CWL029
ugaaaucaugga

SEQ ID NO: 2539341 - RNA, 16 nt, Chlamydophila pneumoniae CWL029
ugaaaucguaucuuuu

SEQ ID NO: 2539342 - RNA, 14 nt, Chlamydophila pneumoniae CWL029
ugaaaucuuuagaa

SEQ ID NO: 2539343 - RNA, 23 nt, Chlamydophila pneumoniae CWL029
ugaaauugaauggucucgaaauc

SEQ ID NO: 2539344 - RNA, 19 nt, Chlamydophila pneumoniae CWL029
ugaaauuucauucucacag

SEQ ID NO: 2539345 - RNA, 14 nt, Chlamydophila pneumoniae CWL029
ugaaauuucugaaa

SEQ ID NO: 2539346 - RNA, 20 nt, Chlamydophila pneumoniae CWL029
ugaaauuucugaaacaaugc

SEQ ID NO: 2539347 - RNA, 21 nt, Chlamydophila pneumoniae CWL029
ugaaauuucugaaacaaugca

SEQ ID NO: 2539348 - RNA, 12 nt, Chlamydophila pneumoniae CWL029
ugaaauuuucua

SEQ ID NO: 2539349 - RNA, 14 nt, Chlamydophila pneumoniae CWL029
ugaacaaaaacugc

SEQ ID NO: 2539350 - RNA, 13 nt, Chlamydophila pneumoniae CWL029
ugaacauaauucg

SEQ ID NO: 2539351 - RNA, 20 nt, Chlamydophila pneumoniae CWL029
ugaacaucgguuuccaagac

SEQ ID NO: 2539352 - RNA, 20 nt, Chlamydophila pneumoniae CWL029
ugaaccuccgcccccuugca

SEQ ID NO: 2539353 - RNA, 13 nt, Chlamydophila pneumoniae CWL029
ugaacggcucuuu

SEQ ID NO: 2539354 - RNA, 22 nt, Chlamydophila pneumoniae CWL029
ugaacggcucuuucuaaaacau

SEQ ID NO: 2539355 - RNA, 21 nt, Chlamydophila pneumoniae CWL029
ugaacguagcuacaaaauuau

SEQ ID NO: 2539356 - RNA, 15 nt, Chlamydophila pneumoniae CWL029
ugaacuaacugagca

SEQ ID NO: 2539357 - RNA, 18 nt, Chlamydophila pneumoniae CWL029
ugaacuuuuguacacaga

SEQ ID NO: 2539358 - RNA, 22 nt, Chlamydophila pneumoniae CWL029
ugaagaacaaaaaaucaaucuu

SEQ ID NO: 2539359 - RNA, 18 nt, Chlamydophila pneumoniae CWL029
ugaagaaguacaagugaa

SEQ ID NO: 2539360 - RNA, 19 nt, Chlamydophila pneumoniae CWL029
ugaagaaguacaagugaag

SEQ ID NO: 2539361 - RNA, 15 nt, Chlamydophila pneumoniae CWL029
ugaagagcauuuaaa

SEQ ID NO: 2539362 - RNA, 17 nt, Chlamydophila pneumoniae CWL029
ugaagagucaaacuuau

SEQ ID NO: 2539363 - RNA, 18 nt, Chlamydophila pneumoniae CWL029
ugaagagugguuccugaa

SEQ ID NO: 2539364 - RNA, 17 nt, Chlamydophila pneumoniae CWL029
ugaagaucuccgaagac

SEQ ID NO: 2539365 - RNA, 18 nt, Chlamydophila pneumoniae CWL029
ugaagauggcaaggaaaa

SEQ ID NO: 2539366 - RNA, 17 nt, Chlamydophila pneumoniae CWL029
ugaagcagcuucugcag

SEQ ID NO: 2539367 - RNA, 18 nt, Chlamydophila pneumoniae CWL029
ugaagcagggaaaaugcg

SEQ ID NO: 2539368 - RNA, 19 nt, Chlamydophila pneumoniae CWL029
ugaagcagggaaaaugcga

SEQ ID NO: 2539369 - RNA, 13 nt, Chlamydophila pneumoniae CWL029
ugaaggaucauac

SEQ ID NO: 2539370 - RNA, 16 nt, Chlamydophila pneumoniae CWL029
ugaaguacauuaucac

SEQ ID NO: 2539371 - RNA, 21 nt, Chlamydophila pneumoniae CWL029
ugaaguacauuaucacagcaa

SEQ ID NO: 2539372 - RNA, 18 nt, Chlamydophila pneumoniae CWL029
ugaaguccagacuuuccu

SEQ ID NO: 2539373 - RNA, 23 nt, Chlamydophila pneumoniae CWL029
ugaagucguuuagauuuuucuuu

SEQ ID NO: 2539374 - RNA, 16 nt, Chlamydophila pneumoniae CWL029
ugaaguuugucguaau

SEQ ID NO: 2539375 - RNA, 22 nt, Chlamydophila pneumoniae CWL029
ugaaguuuuuucucucuuuauc

SEQ ID NO: 2539376 - RNA, 12 nt, Chlamydophila pneumoniae CWL029
ugaauaagauuu

SEQ ID NO: 2539377 - RNA, 12 nt, Chlamydophila pneumoniae CWL029
ugaauaagcuuu

SEQ ID NO: 2539378 - RNA, 20 nt, Chlamydophila pneumoniae CWL029
ugaauaagcuuuccucucca

SEQ ID NO: 2539379 - RNA, 14 nt, Chlamydophila pneumoniae CWL029
ugaauaccaaaauu

SEQ ID NO: 2539380 - RNA, 16 nt, Chlamydophila pneumoniae CWL029
ugaauaccguuucagg

SEQ ID NO: 2539381 - RNA, 17 nt, Chlamydophila pneumoniae CWL029
ugaauaccguuucagga

SEQ ID NO: 2539382 - RNA, 19 nt, Chlamydophila pneumoniae CWL029
ugaauaccguuucaggaaa

SEQ ID NO: 2539383 - RNA, 20 nt, Chlamydophila pneumoniae CWL029
ugaauagcucuuuucaugau

SEQ ID NO: 2539384 - RNA, 17 nt, Chlamydophila pneumoniae CWL029
ugaauaguagaguugac

SEQ ID NO: 2539385 - RNA, 19 nt, Chlamydophila pneumoniae CWL029
ugaauaguagaguugacaa

SEQ ID NO: 2539386 - RNA, 23 nt, Chlamydophila pneumoniae CWL029
ugaauaguugugagacuuucuga

SEQ ID NO: 2539387 - RNA, 18 nt, Chlamydophila pneumoniae CWL029
ugaauauaguuuaaaugu

SEQ ID NO: 2539388 - RNA, 17 nt, Chlamydophila pneumoniae CWL029
ugaauaucaucacuaag

SEQ ID NO: 2539389 - RNA, 20 nt, Chlamydophila pneumoniae CWL029
ugaauaugauuuccacuugu

SEQ ID NO: 2539390 - RNA, 13 nt, Chlamydophila pneumoniae CWL029
ugaaucagcuuau

SEQ ID NO: 2539391 - RNA, 13 nt, Chlamydophila pneumoniae CWL029
ugaaucauagaga

SEQ ID NO: 2539392 - RNA, 14 nt, Chlamydophila pneumoniae CWL029
ugaaucccaucaaa

SEQ ID NO: 2539393 - RNA, 13 nt, Chlamydophila pneumoniae CWL029
ugaauccuucuau

SEQ ID NO: 2539394 - RNA, 13 nt, Chlamydophila pneumoniae CWL029
ugaaucucuucug

SEQ ID NO: 2539395 - RNA, 21 nt, Chlamydophila pneumoniae CWL029
ugaaucucuucuguaggaaca

SEQ ID NO: 2539396 - RNA, 13 nt, Chlamydophila pneumoniae CWL029
ugaaucuucaaga

SEQ ID NO: 2539397 - RNA, 19 nt, Chlamydophila pneumoniae CWL029
ugaaugagcuucacaucuu

SEQ ID NO: 2539398 - RNA, 10 nt, Chlamydophila pneumoniae CWL029
ugaaugaucc

SEQ ID NO: 2539399 - RNA, 13 nt, Chlamydophila pneumoniae CWL029
ugaaugauuucca

SEQ ID NO: 2539400 - RNA, 14 nt, Chlamydophila pneumoniae CWL029
ugaaugauuuccau

SEQ ID NO: 2539401 - RNA, 19 nt, Chlamydophila pneumoniae CWL029
ugaaugcagcacggaacaa

SEQ ID NO: 2539402 - RNA, 19 nt, Chlamydophila pneumoniae CWL029
ugaauuagggcuuuuacuc

SEQ ID NO: 2539403 - RNA, 12 nt, Chlamydophila pneumoniae CWL029
ugaauuaguuuc

SEQ ID NO: 2539404 - RNA, 14 nt, Chlamydophila pneumoniae CWL029
ugaauuuaugggug

SEQ ID NO: 2539405 - RNA, 16 nt, Chlamydophila pneumoniae CWL029
ugacaaauaaacugac

SEQ ID NO: 2539406 - RNA, 16 nt, Chlamydophila pneumoniae CWL029
ugacaaauaaguccug

SEQ ID NO: 2539407 - RNA, 22 nt, Chlamydophila pneumoniae CWL029
ugacaaauaaguccuguuugaa

SEQ ID NO: 2539408 - RNA, 13 nt, Chlamydophila pneumoniae CWL029
ugacaaauagaaa

SEQ ID NO: 2539409 - RNA, 17 nt, Chlamydophila pneumoniae CWL029
ugacaaauagaaaggaa

SEQ ID NO: 2539410 - RNA, 17 nt, Chlamydophila pneumoniae CWL029
ugacaaguguguuucaa

SEQ ID NO: 2539411 - RNA, 16 nt, Chlamydophila pneumoniae CWL029
ugacaauccgcauauu

SEQ ID NO: 2539412 - RNA, 18 nt, Chlamydophila pneumoniae CWL029
ugacaaucgcuguaaauu

SEQ ID NO: 2539413 - RNA, 21 nt, Chlamydophila pneumoniae CWL029
ugacacaacucuuaaaucgcu

SEQ ID NO: 2539414 - RNA, 12 nt, Chlamydophila pneumoniae CWL029
ugacacagagaa

SEQ ID NO: 2539415 - RNA, 15 nt, Chlamydophila pneumoniae CWL029
ugacacggcguagag

SEQ ID NO: 2539416 - RNA, 17 nt, Chlamydophila pneumoniae CWL029
ugacacucagcucccau

SEQ ID NO: 2539417 - RNA, 22 nt, Chlamydophila pneumoniae CWL029
ugacacucagcucccaugugcu

SEQ ID NO: 2539418 - RNA, 21 nt, Chlamydophila pneumoniae CWL029
ugacagcuccauuuaaaugga

SEQ ID NO: 2539419 - RNA, 15 nt, Chlamydophila pneumoniae CWL029
ugacagcugagaaau

SEQ ID NO: 2539420 - RNA, 22 nt, Chlamydophila pneumoniae CWL029
ugacagggaaagaacagcagaa

SEQ ID NO: 2539421 - RNA, 13 nt, Chlamydophila pneumoniae CWL029
ugacaucuccaag

SEQ ID NO: 2539422 - RNA, 21 nt, Chlamydophila pneumoniae CWL029
ugacaucuccaagauaauuau

SEQ ID NO: 2539423 - RNA, 23 nt, Chlamydophila pneumoniae CWL029
ugaccaaacuuggucauuauagu

SEQ ID NO: 2539424 - RNA, 13 nt, Chlamydophila pneumoniae CWL029
ugaccaguggcag

SEQ ID NO: 2539425 - RNA, 20 nt, Chlamydophila pneumoniae CWL029
ugaccaucaaugagaucugc

SEQ ID NO: 2539426 - RNA, 22 nt, Chlamydophila pneumoniae CWL029
ugacccagagaauguucccaaa

SEQ ID NO: 2539427 - RNA, 13 nt, Chlamydophila pneumoniae CWL029
ugaccuucucaag

SEQ ID NO: 2539428 - RNA, 21 nt, Chlamydophila pneumoniae CWL029
ugacgcaagagacaagaaaau

SEQ ID NO: 2539429 - RNA, 22 nt, Chlamydophila pneumoniae CWL029
ugacgcgcuucuucaagaaaug

SEQ ID NO: 2539430 - RNA, 17 nt, Chlamydophila pneumoniae CWL029
ugacgcuuuuccaaagc

SEQ ID NO: 2539431 - RNA, 18 nt, Chlamydophila pneumoniae CWL029
ugacgcuuuuccaaagca

SEQ ID NO: 2539432 - RNA, 15 nt, Chlamydophila pneumoniae CWL029
ugacggcaggacucu

SEQ ID NO: 2539433 - RNA, 14 nt, Chlamydophila pneumoniae CWL029
ugacguaaugcaga

SEQ ID NO: 2539434 - RNA, 12 nt, Chlamydophila pneumoniae CWL029
ugacgugcauug

SEQ ID NO: 2539435 - RNA, 21 nt, Chlamydophila pneumoniae CWL029
ugacgugcauugaauccuucu

SEQ ID NO: 2539436 - RNA, 16 nt, Chlamydophila pneumoniae CWL029
ugacucuaauucagaa

SEQ ID NO: 2539437 - RNA, 17 nt, Chlamydophila pneumoniae CWL029
ugacucuaauucagaaa

SEQ ID NO: 2539438 - RNA, 14 nt, Chlamydophila pneumoniae CWL029
ugacucuagaguac

SEQ ID NO: 2539439 - RNA, 18 nt, Chlamydophila pneumoniae CWL029
ugacucuagccaccaaca

SEQ ID NO: 2539440 - RNA, 17 nt, Chlamydophila pneumoniae CWL029
ugacucuuauugcagaa

SEQ ID NO: 2539441 - RNA, 19 nt, Chlamydophila pneumoniae CWL029
ugacucuuuuaagacaaua

SEQ ID NO: 2539442 - RNA, 11 nt, Chlamydophila pneumoniae CWL029
ugacugaaacu

SEQ ID NO: 2539443 - RNA, 23 nt, Chlamydophila pneumoniae CWL029
ugacugcagagaaauucaugccu

SEQ ID NO: 2539444 - RNA, 23 nt, Chlamydophila pneumoniae CWL029
ugacuggcgacuugccaaucuuc

SEQ ID NO: 2539445 - RNA, 15 nt, Chlamydophila pneumoniae CWL029
ugacuuccuccaaaa

SEQ ID NO: 2539446 - RNA, 15 nt, Chlamydophila pneumoniae CWL029
ugacuuuucuucuuc

SEQ ID NO: 2539447 - RNA, 20 nt, Chlamydophila pneumoniae CWL029
ugacuuuuguugcaauucca

SEQ ID NO: 2539448 - RNA, 16 nt, Chlamydophila pneumoniae CWL029
ugagaaaagguaacau

SEQ ID NO: 2539449 - RNA, 22 nt, Chlamydophila pneumoniae CWL029
ugagaaaaguugccuaaagaga

SEQ ID NO: 2539450 - RNA, 15 nt, Chlamydophila pneumoniae CWL029
ugagaaaaucugcag

SEQ ID NO: 2539451 - RNA, 20 nt, Chlamydophila pneumoniae CWL029
ugagaaaaucugcagcagau

SEQ ID NO: 2539452 - RNA, 18 nt, Chlamydophila pneumoniae CWL029
ugagaaaucuuuugauua

SEQ ID NO: 2539453 - RNA, 19 nt, Chlamydophila pneumoniae CWL029
ugagaacucagcgcaucac

SEQ ID NO: 2539454 - RNA, 16 nt, Chlamydophila pneumoniae CWL029
ugagaauaaaacuuuc

SEQ ID NO: 2539455 - RNA, 21 nt, Chlamydophila pneumoniae CWL029
ugagaauaaaacuuucuuuuu

SEQ ID NO: 2539456 - RNA, 20 nt, Chlamydophila pneumoniae CWL029
ugagaauauggccuagcuuu

SEQ ID NO: 2539457 - RNA, 15 nt, Chlamydophila pneumoniae CWL029
ugagaccauaaaauc

SEQ ID NO: 2539458 - RNA, 19 nt, Chlamydophila pneumoniae CWL029
ugagagauuuuuucauacu

SEQ ID NO: 2539459 - RNA, 19 nt, Chlamydophila pneumoniae CWL029
ugagagcguuguggaagua

SEQ ID NO: 2539460 - RNA, 22 nt, Chlamydophila pneumoniae CWL029
ugagauaaucgcacuucuauuu

SEQ ID NO: 2539461 - RNA, 17 nt, Chlamydophila pneumoniae CWL029
ugagauacggaggauua

SEQ ID NO: 2539462 - RNA, 19 nt, Chlamydophila pneumoniae CWL029
ugagauacuuuaaagacuu

SEQ ID NO: 2539463 - RNA, 23 nt, Chlamydophila pneumoniae CWL029
ugagaucaucucccaaauagcua

SEQ ID NO: 2539464 - RNA, 15 nt, Chlamydophila pneumoniae CWL029
ugagauggucgagaa

SEQ ID NO: 2539465 - RNA, 22 nt, Chlamydophila pneumoniae CWL029
ugagauggucgagaaccuccac

SEQ ID NO: 2539466 - RNA, 13 nt, Chlamydophila pneumoniae CWL029
ugagauucaaaag

SEQ ID NO: 2539467 - RNA, 14 nt, Chlamydophila pneumoniae CWL029
ugagauugaggaua

SEQ ID NO: 2539468 - RNA, 22 nt, Chlamydophila pneumoniae CWL029
ugagcaacaagcugcugagcag

SEQ ID NO: 2539469 - RNA, 23 nt, Chlamydophila pneumoniae CWL029
ugagccaacagguucacuucauc

SEQ ID NO: 2539470 - RNA, 17 nt, Chlamydophila pneumoniae CWL029
ugagccccuugcaaaag

SEQ ID NO: 2539471 - RNA, 16 nt, Chlamydophila pneumoniae CWL029
ugagcgacgacaagga

SEQ ID NO: 2539472 - RNA, 18 nt, Chlamydophila pneumoniae CWL029
ugagcgucguguuuucac

SEQ ID NO: 2539473 - RNA, 14 nt, Chlamydophila pneumoniae CWL029
ugagcuaagucucc

SEQ ID NO: 2539474 - RNA, 12 nt, Chlamydophila pneumoniae CWL029
ugagcuacaaga

SEQ ID NO: 2539475 - RNA, 13 nt, Chlamydophila pneumoniae CWL029
ugagcucucuagc

SEQ ID NO: 2539476 - RNA, 21 nt, Chlamydophila pneumoniae CWL029
ugagcugcugguccuaaaaaa

SEQ ID NO: 2539477 - RNA, 19 nt, Chlamydophila pneumoniae CWL029
ugagcuucacaucuuucuc

SEQ ID NO: 2539478 - RNA, 20 nt, Chlamydophila pneumoniae CWL029
ugagcuucacaucuuucucu

SEQ ID NO: 2539479 - RNA, 22 nt, Chlamydophila pneumoniae CWL029
ugagcuuugguuucguacaguu

SEQ ID NO: 2539480 - RNA, 14 nt, Chlamydophila pneumoniae CWL029
ugaggaaaauuccc

SEQ ID NO: 2539481 - RNA, 13 nt, Chlamydophila pneumoniae CWL029
ugaggaaaggagg

SEQ ID NO: 2539482 - RNA, 15 nt, Chlamydophila pneumoniae CWL029
ugaggaaaggagggc

SEQ ID NO: 2539483 - RNA, 20 nt, Chlamydophila pneumoniae CWL029
ugaggaacgcacgccaagag

SEQ ID NO: 2539484 - RNA, 22 nt, Chlamydophila pneumoniae CWL029
ugaggaacgcacgccaagagag

SEQ ID NO: 2539485 - RNA, 18 nt, Chlamydophila pneumoniae CWL029
ugaggaaucauaaccaaa

SEQ ID NO: 2539486 - RNA, 22 nt, Chlamydophila pneumoniae CWL029
ugaggaaucauaaccaaaagaa

SEQ ID NO: 2539487 - RNA, 16 nt, Chlamydophila pneumoniae CWL029
ugaggaccuuccuuau

SEQ ID NO: 2539488 - RNA, 17 nt, Chlamydophila pneumoniae CWL029
ugagggucggauuuaga

SEQ ID NO: 2539489 - RNA, 10 nt, Chlamydophila pneumoniae CWL029
ugagucgaca

SEQ ID NO: 2539490 - RNA, 15 nt, Chlamydophila pneumoniae CWL029
ugagucgacaugcag

SEQ ID NO: 2539491 - RNA, 21 nt, Chlamydophila pneumoniae CWL029
ugagucgcgaccgaaaguccc

SEQ ID NO: 2539492 - RNA, 16 nt, Chlamydophila pneumoniae CWL029
ugagucugaacauucu

SEQ ID NO: 2539493 - RNA, 18 nt, Chlamydophila pneumoniae CWL029
ugaguggguucacuccug

SEQ ID NO: 2539494 - RNA, 14 nt, Chlamydophila pneumoniae CWL029
ugaguucuuccuuc

SEQ ID NO: 2539495 - RNA, 21 nt, Chlamydophila pneumoniae CWL029
ugaguucuuccuucuucuuca

SEQ ID NO: 2539496 - RNA, 23 nt, Chlamydophila pneumoniae CWL029
ugaguucuuccuucuucuucaaa

SEQ ID NO: 2539497 - RNA, 21 nt, Chlamydophila pneumoniae CWL029
ugaguucuuuuguuugucuuc

SEQ ID NO: 2539498 - RNA, 13 nt, Chlamydophila pneumoniae CWL029
ugcagaucauauc

SEQ ID NO: 2539499 - RNA, 16 nt, Chlamydophila pneumoniae CWL029
ugcagcagaugaaacu

SEQ ID NO: 2539500 - RNA, 19 nt, Chlamydophila pneumoniae CWL029
ugcagcgaucaaaggcugc

SEQ ID NO: 2539501 - RNA, 19 nt, Chlamydophila pneumoniae CWL029
ugcagcguuucuagggacg

SEQ ID NO: 2539502 - RNA, 19 nt, Chlamydophila pneumoniae CWL029
ugcagcuaacgaagccuca

SEQ ID NO: 2539503 - RNA, 16 nt, Chlamydophila pneumoniae CWL029
ugcaggagaacaauau

SEQ ID NO: 2539504 - RNA, 16 nt, Chlamydophila pneumoniae CWL029
ugcaguugaugagaaa

SEQ ID NO: 2539505 - RNA, 18 nt, Chlamydophila pneumoniae CWL029
ugcaguugaugagaaaaa

SEQ ID NO: 2539506 - RNA, 13 nt, Chlamydophila pneumoniae CWL029
ugcauaaucucac

SEQ ID NO: 2539507 - RNA, 22 nt, Chlamydophila pneumoniae CWL029
ugcauacguuaacaaggauuau

SEQ ID NO: 2539508 - RNA, 16 nt, Chlamydophila pneumoniae CWL029
ugcauagaauaaagau

SEQ ID NO: 2539509 - RNA, 20 nt, Chlamydophila pneumoniae CWL029
ugcauaguauggcauucuuu

SEQ ID NO: 2539510 - RNA, 24 nt, Chlamydophila pneumoniae CWL029
ugcaucccaccgacaagaugguga

SEQ ID NO: 2539511 - RNA, 18 nt, Chlamydophila pneumoniae CWL029
ugcaucccuggauuucuu

SEQ ID NO: 2539512 - RNA, 20 nt, Chlamydophila pneumoniae CWL029
ugcaucccuggauuucuucu

SEQ ID NO: 2539513 - RNA, 17 nt, Chlamydophila pneumoniae CWL029
ugcaucucuuaaaacau

SEQ ID NO: 2539514 - RNA, 19 nt, Chlamydophila pneumoniae CWL029
ugcaucuuaucaagagcuc

SEQ ID NO: 2539515 - RNA, 17 nt, Chlamydophila pneumoniae CWL029
ugcaucuuauggaagag

SEQ ID NO: 2539516 - RNA, 18 nt, Chlamydophila pneumoniae CWL029
ugcaucuuauggaagaga

SEQ ID NO: 2539517 - RNA, 17 nt, Chlamydophila pneumoniae CWL029
ugcaugaauauagguua

SEQ ID NO: 2539518 - RNA, 21 nt, Chlamydophila pneumoniae CWL029
ugcaugccuggccaucaucac

SEQ ID NO: 2539519 - RNA, 20 nt, Chlamydophila pneumoniae CWL029
ugcauuaagauaaacauuaa

SEQ ID NO: 2539520 - RNA, 22 nt, Chlamydophila pneumoniae CWL029
ugcauuaucuaagaauauggac

SEQ ID NO: 2539521 - RNA, 19 nt, Chlamydophila pneumoniae CWL029
ugcauuucaugaauuguca

SEQ ID NO: 2539522 - RNA, 15 nt, Chlamydophila pneumoniae CWL029
ugcauuuucuucuug

SEQ ID NO: 2539523 - RNA, 16 nt, Chlamydophila pneumoniae CWL029
ugcauuuucuucuugc

SEQ ID NO: 2539524 - RNA, 13 nt, Chlamydophila pneumoniae CWL029
ugccaagagcauc

SEQ ID NO: 2539525 - RNA, 16 nt, Chlamydophila pneumoniae CWL029
ugccagagauucuuca

SEQ ID NO: 2539526 - RNA, 18 nt, Chlamydophila pneumoniae CWL029
ugccagagauucuucaca

SEQ ID NO: 2539527 - RNA, 13 nt, Chlamydophila pneumoniae CWL029
ugccagcagaagu

SEQ ID NO: 2539528 - RNA, 13 nt, Chlamydophila pneumoniae CWL029
ugccagcuugccc

SEQ ID NO: 2539529 - RNA, 19 nt, Chlamydophila pneumoniae CWL029
ugccaggagagcuaacagc

SEQ ID NO: 2539530 - RNA, 16 nt, Chlamydophila pneumoniae CWL029
ugccaggcuuaaauau

SEQ ID NO: 2539531 - RNA, 14 nt, Chlamydophila pneumoniae CWL029
ugccauaaauacag

SEQ ID NO: 2539532 - RNA, 20 nt, Chlamydophila pneumoniae CWL029
ugccaugcccacagaccaaa

SEQ ID NO: 2539533 - RNA, 19 nt, Chlamydophila pneumoniae CWL029
ugccauucuuaucugcugg

SEQ ID NO: 2539534 - RNA, 16 nt, Chlamydophila pneumoniae CWL029
ugcccaaggaaaaaca

SEQ ID NO: 2539535 - RNA, 19 nt, Chlamydophila pneumoniae CWL029
ugcccacacccuuuaaguu

SEQ ID NO: 2539536 - RNA, 16 nt, Chlamydophila pneumoniae CWL029
ugcccacuucuaccaa

SEQ ID NO: 2539537 - RNA, 21 nt, Chlamydophila pneumoniae CWL029
ugcccauugaccugcuuuuuu

SEQ ID NO: 2539538 - RNA, 17 nt, Chlamydophila pneumoniae CWL029
ugcccauuuuuggaaaa

SEQ ID NO: 2539539 - RNA, 19 nt, Chlamydophila pneumoniae CWL029
ugcccuggauagcauacga

SEQ ID NO: 2539540 - RNA, 22 nt, Chlamydophila pneumoniae CWL029
ugcccuucguaacgcuuuucua

SEQ ID NO: 2539541 - RNA, 15 nt, Chlamydophila pneumoniae CWL029
ugccgagaauacaga

SEQ ID NO: 2539542 - RNA, 23 nt, Chlamydophila pneumoniae CWL029
ugccgugcucuuauguuaaaaau

SEQ ID NO: 2539543 - RNA, 18 nt, Chlamydophila pneumoniae CWL029
ugccucuuucauacuaaa

SEQ ID NO: 2539544 - RNA, 17 nt, Chlamydophila pneumoniae CWL029
ugccugaaaauucgaau

SEQ ID NO: 2539545 - RNA, 16 nt, Chlamydophila pneumoniae CWL029
ugccugaaauccuggg

SEQ ID NO: 2539546 - RNA, 17 nt, Chlamydophila pneumoniae CWL029
ugccugaagauggcaag

SEQ ID NO: 2539547 - RNA, 14 nt, Chlamydophila pneumoniae CWL029
ugccuguuuuauug

SEQ ID NO: 2539548 - RNA, 12 nt, Chlamydophila pneumoniae CWL029
ugccuucuuauc

SEQ ID NO: 2539549 - RNA, 12 nt, Chlamydophila pneumoniae CWL029
ugccuucuucaa

SEQ ID NO: 2539550 - RNA, 13 nt, Chlamydophila pneumoniae CWL029
ugccuucuucuug

SEQ ID NO: 2539551 - RNA, 15 nt, Chlamydophila pneumoniae CWL029
ugccuuugaucagga

SEQ ID NO: 2539552 - RNA, 21 nt, Chlamydophila pneumoniae CWL029
ugccuuuuucuugauuagaga

SEQ ID NO: 2539553 - RNA, 14 nt, Chlamydophila pneumoniae CWL029
ugccuuuuuuucua

SEQ ID NO: 2539554 - RNA, 16 nt, Chlamydophila pneumoniae CWL029
ugcgaacaguuccuau

SEQ ID NO: 2539555 - RNA, 18 nt, Chlamydophila pneumoniae CWL029
ugcgaacaguuccuauuu

SEQ ID NO: 2539556 - RNA, 22 nt, Chlamydophila pneumoniae CWL029
ugcgaacgaagacuuguucuuc

SEQ ID NO: 2539557 - RNA, 20 nt, Chlamydophila pneumoniae CWL029
ugcgaauccugaggaugcua

SEQ ID NO: 2539558 - RNA, 19 nt, Chlamydophila pneumoniae CWL029
ugcgaaugucguuaaaaac

SEQ ID NO: 2539559 - RNA, 15 nt, Chlamydophila pneumoniae CWL029
ugcgacaaaaaugcc

SEQ ID NO: 2539560 - RNA, 17 nt, Chlamydophila pneumoniae CWL029
ugcgacugcucuuucau

SEQ ID NO: 2539561 - RNA, 22 nt, Chlamydophila pneumoniae CWL029
ugcgaggaaaaaggaggauguu

SEQ ID NO: 2539562 - RNA, 19 nt, Chlamydophila pneumoniae CWL029
ugcgauaucuauaaaugua

SEQ ID NO: 2539563 - RNA, 23 nt, Chlamydophila pneumoniae CWL029
ugcgauuuccccuucagaggcua

SEQ ID NO: 2539564 - RNA, 20 nt, Chlamydophila pneumoniae CWL029
ugcgcacggauucuaaaaga

SEQ ID NO: 2539565 - RNA, 22 nt, Chlamydophila pneumoniae CWL029
ugcgcagcuucuggagaaaaaa

SEQ ID NO: 2539566 - RNA, 23 nt, Chlamydophila pneumoniae CWL029
ugcgcagcuucuggagaaaaaau

SEQ ID NO: 2539567 - RNA, 16 nt, Chlamydophila pneumoniae CWL029
ugcgcccgagcuucca

SEQ ID NO: 2539568 - RNA, 18 nt, Chlamydophila pneumoniae CWL029
ugcgcuacacccaggaaa

SEQ ID NO: 2539569 - RNA, 16 nt, Chlamydophila pneumoniae CWL029
ugcgcucggauuucau

SEQ ID NO: 2539570 - RNA, 20 nt, Chlamydophila pneumoniae CWL029
ugcggaccuuaagaugaggu

SEQ ID NO: 2539571 - RNA, 23 nt, Chlamydophila pneumoniae CWL029
ugcggaugugccgugacuccaga

SEQ ID NO: 2539572 - RNA, 15 nt, Chlamydophila pneumoniae CWL029
ugcggauuugcauua

SEQ ID NO: 2539573 - RNA, 21 nt, Chlamydophila pneumoniae CWL029
ugcggcaaguaucucaucacg

SEQ ID NO: 2539574 - RNA, 15 nt, Chlamydophila pneumoniae CWL029
ugcggcuaauuucaa

SEQ ID NO: 2539575 - RNA, 18 nt, Chlamydophila pneumoniae CWL029
ugcguuugagcuaagucu

SEQ ID NO: 2539576 - RNA, 13 nt, Chlamydophila pneumoniae CWL029
ugcuaaacaaugc

SEQ ID NO: 2539577 - RNA, 23 nt, Chlamydophila pneumoniae CWL029
ugcuaaacuuuuuuucaaaucau

SEQ ID NO: 2539578 - RNA, 17 nt, Chlamydophila pneumoniae CWL029
ugcuaagagcucuuucc

SEQ ID NO: 2539579 - RNA, 17 nt, Chlamydophila pneumoniae CWL029
ugcuaagaucuuuagaa

SEQ ID NO: 2539580 - RNA, 17 nt, Chlamydophila pneumoniae CWL029
ugcuaagccaaauacca

SEQ ID NO: 2539581 - RNA, 15 nt, Chlamydophila pneumoniae CWL029
ugcuacaaacucuuc

SEQ ID NO: 2539582 - RNA, 17 nt, Chlamydophila pneumoniae CWL029
ugcuacaaacucuucca

SEQ ID NO: 2539583 - RNA, 13 nt, Chlamydophila pneumoniae CWL029
ugcuacagcuucu

SEQ ID NO: 2539584 - RNA, 17 nt, Chlamydophila pneumoniae CWL029
ugcuacagcuucuuuuc

SEQ ID NO: 2539585 - RNA, 19 nt, Chlamydophila pneumoniae CWL029
ugcuacuguccauccaaau

SEQ ID NO: 2539586 - RNA, 21 nt, Chlamydophila pneumoniae CWL029
ugcuagaucuggagagggaag

SEQ ID NO: 2539587 - RNA, 12 nt, Chlamydophila pneumoniae CWL029
ugcuauacagaa

SEQ ID NO: 2539588 - RNA, 21 nt, Chlamydophila pneumoniae CWL029
ugcuaucauaacguauuucac

SEQ ID NO: 2539589 - RNA, 14 nt, Chlamydophila pneumoniae CWL029
ugcuauuuacugaa

SEQ ID NO: 2539590 - RNA, 13 nt, Chlamydophila pneumoniae CWL029
ugcuauuuuaaac

SEQ ID NO: 2539591 - RNA, 15 nt, Chlamydophila pneumoniae CWL029
ugcuauuuuccucua

SEQ ID NO: 2539592 - RNA, 20 nt, Chlamydophila pneumoniae CWL029
ugcucaauacagauaucaaa

SEQ ID NO: 2539593 - RNA, 23 nt, Chlamydophila pneumoniae CWL029
ugcucaauacagauaucaaagca

SEQ ID NO: 2539594 - RNA, 17 nt, Chlamydophila pneumoniae CWL029
ugcucacuguuuuucgu

SEQ ID NO: 2539595 - RNA, 18 nt, Chlamydophila pneumoniae CWL029
uggauacguuuuucccuu

SEQ ID NO: 2539596 - RNA, 22 nt, Chlamydophila pneumoniae CWL029
uggauacguuuuucccuuuaaa

SEQ ID NO: 2539597 - RNA, 16 nt, Chlamydophila pneumoniae CWL029
uggauagaagcaugaa

SEQ ID NO: 2539598 - RNA, 18 nt, Chlamydophila pneumoniae CWL029
uggauaucguagacaaca

SEQ ID NO: 2539599 - RNA, 18 nt, Chlamydophila pneumoniae CWL029
uggaucacguaagcuuua

SEQ ID NO: 2539600 - RNA, 12 nt, Chlamydophila pneumoniae CWL029
uggaucagaaaa

SEQ ID NO: 2539601 - RNA, 20 nt, Chlamydophila pneumoniae CWL029
uggaucagaaaaaaugcguu

SEQ ID NO: 2539602 - RNA, 21 nt, Chlamydophila pneumoniae CWL029
uggauccuucaucagcuuccc

SEQ ID NO: 2539603 - RNA, 12 nt, Chlamydophila pneumoniae CWL029
uggaucuugaua

SEQ ID NO: 2539604 - RNA, 17 nt, Chlamydophila pneumoniae CWL029
uggauguagaggaucua

SEQ ID NO: 2539605 - RNA, 18 nt, Chlamydophila pneumoniae CWL029
uggauucgcacguaggca

SEQ ID NO: 2539606 - RNA, 17 nt, Chlamydophila pneumoniae CWL029
uggauugucgaugaggg

SEQ ID NO: 2539607 - RNA, 13 nt, Chlamydophila pneumoniae CWL029
uggauuucuucug

SEQ ID NO: 2539608 - RNA, 17 nt, Chlamydophila pneumoniae CWL029
uggcaaucuuuucuugu

SEQ ID NO: 2539609 - RNA, 15 nt, Chlamydophila pneumoniae CWL029
uggcaaugauauccu

SEQ ID NO: 2539610 - RNA, 13 nt, Chlamydophila pneumoniae CWL029
uggcacaauccuc

SEQ ID NO: 2539611 - RNA, 23 nt, Chlamydophila pneumoniae CWL029
uggcagcaaauccuuuauguaua

SEQ ID NO: 2539612 - RNA, 20 nt, Chlamydophila pneumoniae CWL029
uggcagcuuggaugggaauc

SEQ ID NO: 2539613 - RNA, 16 nt, Chlamydophila pneumoniae CWL029
uggcauaauccugaau

SEQ ID NO: 2539614 - RNA, 14 nt, Chlamydophila pneumoniae CWL029
uggcauagagccua

SEQ ID NO: 2539615 - RNA, 14 nt, Chlamydophila pneumoniae CWL029
uggcauagcgaaag

SEQ ID NO: 2539616 - RNA, 14 nt, Chlamydophila pneumoniae CWL029
uggcauagcgagaa

SEQ ID NO: 2539617 - RNA, 14 nt, Chlamydophila pneumoniae CWL029
uggcaucuaagcca

SEQ ID NO: 2539618 - RNA, 18 nt, Chlamydophila pneumoniae CWL029
uggcauucuuuuucuauu

SEQ ID NO: 2539619 - RNA, 17 nt, Chlamydophila pneumoniae CWL029
uggccuagcuuucuugg

SEQ ID NO: 2539620 - RNA, 18 nt, Chlamydophila pneumoniae CWL029
uggcgaauccuagagaac

SEQ ID NO: 2539621 - RNA, 12 nt, Chlamydophila pneumoniae CWL029
uggcgauaaaug

SEQ ID NO: 2539622 - RNA, 13 nt, Chlamydophila pneumoniae CWL029
uggcguaauaauu

SEQ ID NO: 2539623 - RNA, 20 nt, Chlamydophila pneumoniae CWL029
uggcgucugcccuuucugca

SEQ ID NO: 2539624 - RNA, 21 nt, Chlamydophila pneumoniae CWL029
uggcguuuucuagaaaagauu

SEQ ID NO: 2539625 - RNA, 15 nt, Chlamydophila pneumoniae CWL029
uggcuauuuuuaaaa

SEQ ID NO: 2539626 - RNA, 17 nt, Chlamydophila pneumoniae CWL029
uggcucuagaaauauac

SEQ ID NO: 2539627 - RNA, 15 nt, Chlamydophila pneumoniae CWL029
uggcugagagaagca

SEQ ID NO: 2539628 - RNA, 16 nt, Chlamydophila pneumoniae CWL029
uggcugagagauaggg

SEQ ID NO: 2539629 - RNA, 17 nt, Chlamydophila pneumoniae CWL029
uggcuggaaagccaagc

SEQ ID NO: 2539630 - RNA, 23 nt, Chlamydophila pneumoniae CWL029
uggcuuuuuuugucccaacuaga

SEQ ID NO: 2539631 - RNA, 14 nt, Chlamydophila pneumoniae CWL029
ugggaaaagaaaag

SEQ ID NO: 2539632 - RNA, 20 nt, Chlamydophila pneumoniae CWL029
ugggaaaagaaaagaaagaa

SEQ ID NO: 2539633 - RNA, 12 nt, Chlamydophila pneumoniae CWL029
ugggaagacucu

SEQ ID NO: 2539634 - RNA, 18 nt, Chlamydophila pneumoniae CWL029
ugggaaggucuuuucgca

SEQ ID NO: 2539635 - RNA, 17 nt, Chlamydophila pneumoniae CWL029
ugggaauucuuuuccug

SEQ ID NO: 2539636 - RNA, 21 nt, Chlamydophila pneumoniae CWL029
ugggaauuguucuugaaguuc

SEQ ID NO: 2539637 - RNA, 20 nt, Chlamydophila pneumoniae CWL029
ugggaauuugauuuuucaaa

SEQ ID NO: 2539638 - RNA, 16 nt, Chlamydophila pneumoniae CWL029
ugggagcuuccuccaa

SEQ ID NO: 2539639 - RNA, 20 nt, Chlamydophila pneumoniae CWL029
ugggauauuggagacuaggg

SEQ ID NO: 2539640 - RNA, 16 nt, Chlamydophila pneumoniae CWL029
ugggaucggucuuuuc

SEQ ID NO: 2539641 - RNA, 15 nt, Chlamydophila pneumoniae CWL029
ugggaugaucucuga

SEQ ID NO: 2539642 - RNA, 22 nt, Chlamydophila pneumoniae CWL029
ugggcaaugaucaaaaaugaua

SEQ ID NO: 2539643 - RNA, 21 nt, Chlamydophila pneumoniae CWL029
ugggcauuuaacaacaugcgc

SEQ ID NO: 2539644 - RNA, 15 nt, Chlamydophila pneumoniae CWL029
ugggcgucuucuucg

SEQ ID NO: 2539645 - RNA, 19 nt, Chlamydophila pneumoniae CWL029
ugggcuaggguuucuacag

SEQ ID NO: 2539646 - RNA, 14 nt, Chlamydophila pneumoniae CWL029
ugggcucacucuaa

SEQ ID NO: 2539647 - RNA, 15 nt, Chlamydophila pneumoniae CWL029
uggggaaauuaaauu

SEQ ID NO: 2539648 - RNA, 20 nt, Chlamydophila pneumoniae CWL029
uggggauuaucccaaacuuc

SEQ ID NO: 2539649 - RNA, 20 nt, Chlamydophila pneumoniae CWL029
uggggcaguagguaagaagc

SEQ ID NO: 2539650 - RNA, 19 nt, Chlamydophila pneumoniae CWL029
uggggcauaagaacucuau

SEQ ID NO: 2539651 - RNA, 17 nt, Chlamydophila pneumoniae CWL029
uggggcuuccagaaaca

SEQ ID NO: 2539652 - RNA, 13 nt, Chlamydophila pneumoniae CWL029
uggguaaguccac

SEQ ID NO: 2539653 - RNA, 15 nt, Chlamydophila pneumoniae CWL029
uggguaaguccacaa

SEQ ID NO: 2539654 - RNA, 15 nt, Chlamydophila pneumoniae CWL029
uggguucacuccuga

SEQ ID NO: 2539655 - RNA, 17 nt, Chlamydophila pneumoniae CWL029
uggguucacuccugaag

SEQ ID NO: 2539656 - RNA, 12 nt, Chlamydophila pneumoniae CWL029
uggguucuccac

SEQ ID NO: 2539657 - RNA, 13 nt, Chlamydophila pneumoniae CWL029
uggguuugucucc

SEQ ID NO: 2539658 - RNA, 13 nt, Chlamydophila pneumoniae CWL029
ugguaaaaauaua

SEQ ID NO: 2539659 - RNA, 19 nt, Chlamydophila pneumoniae CWL029
ugguaacacgagugccuuc

SEQ ID NO: 2539660 - RNA, 14 nt, Chlamydophila pneumoniae CWL029
ugguaauuuuucag

SEQ ID NO: 2539661 - RNA, 16 nt, Chlamydophila pneumoniae CWL029
ugguaucugauugcua

SEQ ID NO: 2539662 - RNA, 12 nt, Chlamydophila pneumoniae CWL029
uggucagucucg

SEQ ID NO: 2539663 - RNA, 20 nt, Chlamydophila pneumoniae CWL029
ugguccaucgagaaaugcuc

SEQ ID NO: 2539664 - RNA, 17 nt, Chlamydophila pneumoniae CWL029
uggucggaguuuuuuuc

SEQ ID NO: 2539665 - RNA, 16 nt, Chlamydophila pneumoniae CWL029
uggucuagagauuuuu

SEQ ID NO: 2539666 - RNA, 14 nt, Chlamydophila pneumoniae CWL029
uggucuguauuuuc

SEQ ID NO: 2539667 - RNA, 17 nt, Chlamydophila pneumoniae CWL029
uggugaagaauaauagc

SEQ ID NO: 2539668 - RNA, 21 nt, Chlamydophila pneumoniae CWL029
uggugacucuagccaccaaca

SEQ ID NO: 2539669 - RNA, 22 nt, Chlamydophila pneumoniae CWL029
ugguguucuucagcccacuguu

SEQ ID NO: 2539670 - RNA, 23 nt, Chlamydophila pneumoniae CWL029
ugguuaaaacccauguuucuucc

SEQ ID NO: 2539671 - RNA, 13 nt, Chlamydophila pneumoniae CWL029
ugguuaaaauaga

SEQ ID NO: 2539672 - RNA, 16 nt, Chlamydophila pneumoniae CWL029
ugguuccugaaaagca

SEQ ID NO: 2539673 - RNA, 21 nt, Chlamydophila pneumoniae CWL029
ugguuuuugcaaccacacagg

SEQ ID NO: 2539674 - RNA, 19 nt, Chlamydophila pneumoniae CWL029
uguaaaaaauuauuuggau

SEQ ID NO: 2539675 - RNA, 20 nt, Chlamydophila pneumoniae CWL029
uguaaaaacuguguuuucua

SEQ ID NO: 2539676 - RNA, 11 nt, Chlamydophila pneumoniae CWL029
uguaaaaguua

SEQ ID NO: 2539677 - RNA, 16 nt, Chlamydophila pneumoniae CWL029
uguaaauacaaaacaa

SEQ ID NO: 2539678 - RNA, 23 nt, Chlamydophila pneumoniae CWL029
uguaaaugaggcuccuccuuuga

SEQ ID NO: 2539679 - RNA, 15 nt, Chlamydophila pneumoniae CWL029
uguaaauuuuuccuu

SEQ ID NO: 2539680 - RNA, 21 nt, Chlamydophila pneumoniae CWL029
uguaacauugaccuaaaggaa

SEQ ID NO: 2539681 - RNA, 20 nt, Chlamydophila pneumoniae CWL029
uguaacgggagcguuuuuug

SEQ ID NO: 2539682 - RNA, 22 nt, Chlamydophila pneumoniae CWL029
uguaacucuuaagaauaaaaua

SEQ ID NO: 2539683 - RNA, 21 nt, Chlamydophila pneumoniae CWL029
uguaagaaaaugaggacacaa

SEQ ID NO: 2539684 - RNA, 19 nt, Chlamydophila pneumoniae CWL029
uguaagaaggcagagaacu

SEQ ID NO: 2539685 - RNA, 18 nt, Chlamydophila pneumoniae CWL029
uguaagacuaaaaaagag

SEQ ID NO: 2539686 - RNA, 14 nt, Chlamydophila pneumoniae CWL029
uguaaguuacggaa

SEQ ID NO: 2539687 - RNA, 19 nt, Chlamydophila pneumoniae CWL029
uguaaguuacggaacucau

SEQ ID NO: 2539688 - RNA, 13 nt, Chlamydophila pneumoniae CWL029
uguaauaaaagaa

SEQ ID NO: 2539689 - RNA, 21 nt, Chlamydophila pneumoniae CWL029
uguaauauucaacauguuaau

SEQ ID NO: 2539690 - RNA, 20 nt, Chlamydophila pneumoniae CWL029
uguaaucauaaaaaaagcua

SEQ ID NO: 2539691 - RNA, 22 nt, Chlamydophila pneumoniae CWL029
uguaaucccagauuuuuuuggu

SEQ ID NO: 2539692 - RNA, 16 nt, Chlamydophila pneumoniae CWL029
uguaauuuuuuucaaa

SEQ ID NO: 2539693 - RNA, 14 nt, Chlamydophila pneumoniae CWL029
uguuaaucuaauuu

SEQ ID NO: 2539694 - RNA, 18 nt, Chlamydophila pneumoniae CWL029
uguuagaccagggagacc

SEQ ID NO: 2539695 - RNA, 22 nt, Chlamydophila pneumoniae CWL029
uguuagcaucgcuuaacaaacu

SEQ ID NO: 2539696 - RNA, 20 nt, Chlamydophila pneumoniae CWL029
uguuagugagaucaaaaaua

SEQ ID NO: 2539697 - RNA, 20 nt, Chlamydophila pneumoniae CWL029
uguuauaagugacuuuucuu

SEQ ID NO: 2539698 - RNA, 17 nt, Chlamydophila pneumoniae CWL029
uguuaugaguuuuuaau

SEQ ID NO: 2539699 - RNA, 14 nt, Chlamydophila pneumoniae CWL029
uguucaaaaauaga

SEQ ID NO: 2539700 - RNA, 12 nt, Chlamydophila pneumoniae CWL029
uguucaaagauu

SEQ ID NO: 2539701 - RNA, 13 nt, Chlamydophila pneumoniae CWL029
uguucagcuagag

SEQ ID NO: 2539702 - RNA, 13 nt, Chlamydophila pneumoniae CWL029
uguucauaaucag

SEQ ID NO: 2539703 - RNA, 16 nt, Chlamydophila pneumoniae CWL029
uguuccauaauuuuag

SEQ ID NO: 2539704 - RNA, 17 nt, Chlamydophila pneumoniae CWL029
uguucuaaagcugcuuc

SEQ ID NO: 2539705 - RNA, 15 nt, Chlamydophila pneumoniae CWL029
uguucucgcaaugcu

SEQ ID NO: 2539706 - RNA, 21 nt, Chlamydophila pneumoniae CWL029
uguucugcacguggcuuuugu

SEQ ID NO: 2539707 - RNA, 13 nt, Chlamydophila pneumoniae CWL029
uguucuuccaacu

SEQ ID NO: 2539708 - RNA, 14 nt, Chlamydophila pneumoniae CWL029
uguugaauaagauu

SEQ ID NO: 2539709 - RNA, 16 nt, Chlamydophila pneumoniae CWL029
uguugauaauuacaga

SEQ ID NO: 2539710 - RNA, 19 nt, Chlamydophila pneumoniae CWL029
uguugauccuucuuauggu

SEQ ID NO: 2539711 - RNA, 18 nt, Chlamydophila pneumoniae CWL029
uguugaucucuaaaugga

SEQ ID NO: 2539712 - RNA, 20 nt, Chlamydophila pneumoniae CWL029
uguugcccuacaauuuccuu

SEQ ID NO: 2539713 - RNA, 19 nt, Chlamydophila pneumoniae CWL029
uguugcggauuugcauuac

SEQ ID NO: 2539714 - RNA, 20 nt, Chlamydophila pneumoniae CWL029
uguuggaauugcauuaagau

SEQ ID NO: 2539715 - RNA, 12 nt, Chlamydophila pneumoniae CWL029
uguuggguugug

SEQ ID NO: 2539716 - RNA, 22 nt, Chlamydophila pneumoniae CWL029
uguuguaacgggagcguuuuuu

SEQ ID NO: 2539717 - RNA, 13 nt, Chlamydophila pneumoniae CWL029
uguuguaauaaaa

SEQ ID NO: 2539718 - RNA, 16 nt, Chlamydophila pneumoniae CWL029
uguuguaauaaaauca

SEQ ID NO: 2539719 - RNA, 17 nt, Chlamydophila pneumoniae CWL029
uguuguauggcagccug

SEQ ID NO: 2539720 - RNA, 16 nt, Chlamydophila pneumoniae CWL029
uguugucagcuuugcu

SEQ ID NO: 2539721 - RNA, 14 nt, Chlamydophila pneumoniae CWL029
uguuuaaguccuuc

SEQ ID NO: 2539722 - RNA, 19 nt, Chlamydophila pneumoniae CWL029
uguuuaaguccuucuuccc

SEQ ID NO: 2539723 - RNA, 18 nt, Chlamydophila pneumoniae CWL029
uguuuagaaaaagaucua

SEQ ID NO: 2539724 - RNA, 17 nt, Chlamydophila pneumoniae CWL029
uguuuaucgacucuucc

SEQ ID NO: 2539725 - RNA, 15 nt, Chlamydophila pneumoniae CWL029
uguuuaugaaaaucu

SEQ ID NO: 2539726 - RNA, 12 nt, Chlamydophila pneumoniae CWL029
uguuuauuuagc

SEQ ID NO: 2539727 - RNA, 15 nt, Chlamydophila pneumoniae CWL029
uguuuauuuagcauu

SEQ ID NO: 2539728 - RNA, 16 nt, Chlamydophila pneumoniae CWL029
uguuucaacaccucaa

SEQ ID NO: 2539729 - RNA, 22 nt, Chlamydophila pneumoniae CWL029
uguuucaacauaacaugagaaa

SEQ ID NO: 2539730 - RNA, 15 nt, Chlamydophila pneumoniae CWL029
uguuucgaaaguugg

SEQ ID NO: 2539731 - RNA, 24 nt, Chlamydophila pneumoniae CWL029
uguuucuagaaaaucucuaagaau

SEQ ID NO: 2539732 - RNA, 14 nt, Chlamydophila pneumoniae CWL029
uguuucuccuauug

SEQ ID NO: 2539733 - RNA, 14 nt, Chlamydophila pneumoniae CWL029
uguuucuucugaau

SEQ ID NO: 2539734 - RNA, 19 nt, Chlamydophila pneumoniae CWL029
uguuucuucugaauagcuc

SEQ ID NO: 2539735 - RNA, 12 nt, Chlamydophila pneumoniae CWL029
uguuucuuguag

SEQ ID NO: 2539736 - RNA, 17 nt, Chlamydophila pneumoniae CWL029
uguuucuuguagcuccc

SEQ ID NO: 2539737 - RNA, 18 nt, Chlamydophila pneumoniae CWL029
uguuucuuugacuuucau

SEQ ID NO: 2539738 - RNA, 22 nt, Chlamydophila pneumoniae CWL029
uguuucuuugacuuucauauga

SEQ ID NO: 2539739 - RNA, 16 nt, Chlamydophila pneumoniae CWL029
uguuugcaugcggcuc

SEQ ID NO: 2539740 - RNA, 18 nt, Chlamydophila pneumoniae CWL029
uguuugcaugcggcuccu

SEQ ID NO: 2539741 - RNA, 15 nt, Chlamydophila pneumoniae CWL029
uguuugcuauacaga

SEQ ID NO: 2539742 - RNA, 18 nt, Chlamydophila pneumoniae CWL029
uguuuuagauggaucuau

SEQ ID NO: 2539743 - RNA, 12 nt, Chlamydophila pneumoniae CWL029
uguuuuauagau

SEQ ID NO: 2539744 - RNA, 12 nt, Chlamydophila pneumoniae CWL029
uguuuuccagaa

SEQ ID NO: 2539745 - RNA, 13 nt, Chlamydophila pneumoniae CWL029
uguuuucuaucag

SEQ ID NO: 2539746 - RNA, 15 nt, Chlamydophila pneumoniae CWL029
uguuuucuucuaccu

SEQ ID NO: 2539747 - RNA, 21 nt, Chlamydophila pneumoniae CWL029
uguuuugcuucuauuuuagaa

SEQ ID NO: 2539748 - RNA, 13 nt, Chlamydophila pneumoniae CWL029
uguuuuucaauuu

SEQ ID NO: 2539749 - RNA, 13 nt, Chlamydophila pneumoniae CWL029
uguuuuucuucca

SEQ ID NO: 2539750 - RNA, 16 nt, Chlamydophila pneumoniae CWL029
uguuuuugcugaagau

SEQ ID NO: 2539751 - RNA, 14 nt, Chlamydophila pneumoniae CWL029
uguuuuuucuucug

SEQ ID NO: 2539752 - RNA, 13 nt, Chlamydophila pneumoniae CWL029
uguuuuuugagau

SEQ ID NO: 2539753 - RNA, 13 nt, Chlamydophila pneumoniae CWL029
uuaaaaaacuucc

SEQ ID NO: 2539754 - RNA, 22 nt, Chlamydophila pneumoniae CWL029
uuaaaaaacuuccuaacuaucu

SEQ ID NO: 2539755 - RNA, 16 nt, Chlamydophila pneumoniae CWL029
uuaaaaagucugaauc

SEQ ID NO: 2539756 - RNA, 19 nt, Chlamydophila pneumoniae CWL029
uuaaaaauauaucuucaga

SEQ ID NO: 2539757 - RNA, 19 nt, Chlamydophila pneumoniae CWL029
uuaaaacccauguuucuuc

SEQ ID NO: 2539758 - RNA, 18 nt, Chlamydophila pneumoniae CWL029
uuaaaaguuccaaaucuc

SEQ ID NO: 2539759 - RNA, 14 nt, Chlamydophila pneumoniae CWL029
uuaaaauagacauu

SEQ ID NO: 2539760 - RNA, 18 nt, Chlamydophila pneumoniae CWL029
uuaaaauuucugggcuaa

SEQ ID NO: 2539761 - RNA, 16 nt, Chlamydophila pneumoniae CWL029
uuaaacccuucaagca

SEQ ID NO: 2539762 - RNA, 15 nt, Chlamydophila pneumoniae CWL029
uuaaacuaagaauac

SEQ ID NO: 2539763 - RNA, 23 nt, Chlamydophila pneumoniae CWL029
uuaaacuuacagccaccuuggcu

SEQ ID NO: 2539764 - RNA, 23 nt, Chlamydophila pneumoniae CWL029
uuaaacuuucuucucuaggaaga

SEQ ID NO: 2539765 - RNA, 17 nt, Chlamydophila pneumoniae CWL029
uuaaagauuuucauaac

SEQ ID NO: 2539766 - RNA, 15 nt, Chlamydophila pneumoniae CWL029
uuaaagguaaaacua

SEQ ID NO: 2539767 - RNA, 15 nt, Chlamydophila pneumoniae CWL029
uuaaaguaaaaaaua

SEQ ID NO: 2539768 - RNA, 19 nt, Chlamydophila pneumoniae CWL029
uuaaaguaaaaaauacagg

SEQ ID NO: 2539769 - RNA, 17 nt, Chlamydophila pneumoniae CWL029
uuaaaguccaagaucaa

SEQ ID NO: 2539770 - RNA, 12 nt, Chlamydophila pneumoniae CWL029
uuaaauacagau

SEQ ID NO: 2539771 - RNA, 14 nt, Chlamydophila pneumoniae CWL029
uuaaauauagaaaa

SEQ ID NO: 2539772 - RNA, 15 nt, Chlamydophila pneumoniae CWL029
uuaaauauagaaaau

SEQ ID NO: 2539773 - RNA, 16 nt, Chlamydophila pneumoniae CWL029
uuaaauauauaaagaa

SEQ ID NO: 2539774 - RNA, 17 nt, Chlamydophila pneumoniae CWL029
uuaaauaucuaauaaaa

SEQ ID NO: 2539775 - RNA, 16 nt, Chlamydophila pneumoniae CWL029
uuaaauguauugcaaa

SEQ ID NO: 2539776 - RNA, 17 nt, Chlamydophila pneumoniae CWL029
uuaaauuaucagagaca

SEQ ID NO: 2539777 - RNA, 18 nt, Chlamydophila pneumoniae CWL029
uuaaauuuuguuuuucca

SEQ ID NO: 2539778 - RNA, 23 nt, Chlamydophila pneumoniae CWL029
uuaacaacuagguuauuaucaaa

SEQ ID NO: 2539779 - RNA, 17 nt, Chlamydophila pneumoniae CWL029
uuaacaaguaccaagaa

SEQ ID NO: 2539780 - RNA, 18 nt, Chlamydophila pneumoniae CWL029
uuaacaaguaccaagaaa

SEQ ID NO: 2539781 - RNA, 19 nt, Chlamydophila pneumoniae CWL029
uuaacaaguaccaagaaaa

SEQ ID NO: 2539782 - RNA, 19 nt, Chlamydophila pneumoniae CWL029
uuaaccgagcuuuuugcuu

SEQ ID NO: 2539783 - RNA, 14 nt, Chlamydophila pneumoniae CWL029
uuaaccucuuuucu

SEQ ID NO: 2539784 - RNA, 21 nt, Chlamydophila pneumoniae CWL029
uuaacuguguaugaaucacau

SEQ ID NO: 2539785 - RNA, 16 nt, Chlamydophila pneumoniae CWL029
uuaacuucuaaaagca

SEQ ID NO: 2539786 - RNA, 13 nt, Chlamydophila pneumoniae CWL029
uuaagaacaucuu

SEQ ID NO: 2539787 - RNA, 19 nt, Chlamydophila pneumoniae CWL029
uuaagaagauucuuuaauc

SEQ ID NO: 2539788 - RNA, 19 nt, Chlamydophila pneumoniae CWL029
uuaagaccaaacuuucuuu

SEQ ID NO: 2539789 - RNA, 14 nt, Chlamydophila pneumoniae CWL029
uuaagaggaaagca

SEQ ID NO: 2539790 - RNA, 18 nt, Chlamydophila pneumoniae CWL029
uuaagauaaacagcacag

SEQ ID NO: 2539791 - RNA, 17 nt, Chlamydophila pneumoniae CWL029
uuauccaccaagacuga

SEQ ID NO: 2539792 - RNA, 21 nt, Chlamydophila pneumoniae CWL029
uuauccaccaagacugaauau

SEQ ID NO: 2539793 - RNA, 18 nt, Chlamydophila pneumoniae CWL029
uuaucccagauaaagaca

SEQ ID NO: 2539794 - RNA, 19 nt, Chlamydophila pneumoniae CWL029
uuaucgugacucuuaucug

SEQ ID NO: 2539795 - RNA, 13 nt, Chlamydophila pneumoniae CWL029
uuaucuaaagaaa

SEQ ID NO: 2539796 - RNA, 16 nt, Chlamydophila pneumoniae CWL029
uuaucuaagacuucug

SEQ ID NO: 2539797 - RNA, 14 nt, Chlamydophila pneumoniae CWL029
uuaucuagcucuuc

SEQ ID NO: 2539798 - RNA, 22 nt, Chlamydophila pneumoniae CWL029
uuaucucaaugcgauaaccacu

SEQ ID NO: 2539799 - RNA, 22 nt, Chlamydophila pneumoniae CWL029
uuaucucccaagacgagaacau

SEQ ID NO: 2539800 - RNA, 17 nt, Chlamydophila pneumoniae CWL029
uuaucuggagaugcgcu

SEQ ID NO: 2539801 - RNA, 18 nt, Chlamydophila pneumoniae CWL029
uuaucuuagggaaucucu

SEQ ID NO: 2539802 - RNA, 18 nt, Chlamydophila pneumoniae CWL029
uuaucuucuaaaacuuca

SEQ ID NO: 2539803 - RNA, 21 nt, Chlamydophila pneumoniae CWL029
uuaugacaaacucuauuuuca

SEQ ID NO: 2539804 - RNA, 15 nt, Chlamydophila pneumoniae CWL029
uuaugaguuuuuaau

SEQ ID NO: 2539805 - RNA, 20 nt, Chlamydophila pneumoniae CWL029
uuauggaugcuaaauuuguc

SEQ ID NO: 2539806 - RNA, 21 nt, Chlamydophila pneumoniae CWL029
uuauguagauugauccagccc

SEQ ID NO: 2539807 - RNA, 11 nt, Chlamydophila pneumoniae CWL029
uuauuaaaauc

SEQ ID NO: 2539808 - RNA, 15 nt, Chlamydophila pneumoniae CWL029
uuauuaucaaaguga

SEQ ID NO: 2539809 - RNA, 19 nt, Chlamydophila pneumoniae CWL029
uuauuaucaaagugaacga

SEQ ID NO: 2539810 - RNA, 19 nt, Chlamydophila pneumoniae CWL029
uuauuauguagaucauaaa

SEQ ID NO: 2539811 - RNA, 13 nt, Chlamydophila pneumoniae CWL029
uuauuauuaguua

SEQ ID NO: 2539812 - RNA, 14 nt, Chlamydophila pneumoniae CWL029
uuauuauugaauaa

SEQ ID NO: 2539813 - RNA, 21 nt, Chlamydophila pneumoniae CWL029
uuauucccuaagguagagucc

SEQ ID NO: 2539814 - RNA, 12 nt, Chlamydophila pneumoniae CWL029
uuauucuuaaug

SEQ ID NO: 2539815 - RNA, 17 nt, Chlamydophila pneumoniae CWL029
uuauugauaaugauucc

SEQ ID NO: 2539816 - RNA, 12 nt, Chlamydophila pneumoniae CWL029
uuauuuaaaauu

SEQ ID NO: 2539817 - RNA, 22 nt, Chlamydophila pneumoniae CWL029
uuauuuguuucuuccauacagg

SEQ ID NO: 2539818 - RNA, 13 nt, Chlamydophila pneumoniae CWL029
uuauuuuaaaguc

SEQ ID NO: 2539819 - RNA, 15 nt, Chlamydophila pneumoniae CWL029
uuauuuuaaagucac

SEQ ID NO: 2539820 - RNA, 18 nt, Chlamydophila pneumoniae CWL029
uuauuuuaaagucacuuu

SEQ ID NO: 2539821 - RNA, 22 nt, Chlamydophila pneumoniae CWL029
uuauuuuaggaggaguauagca

SEQ ID NO: 2539822 - RNA, 13 nt, Chlamydophila pneumoniae CWL029
uuauuuucuggug

SEQ ID NO: 2539823 - RNA, 14 nt, Chlamydophila pneumoniae CWL029
uuauuuuuaaauaa

SEQ ID NO: 2539824 - RNA, 15 nt, Chlamydophila pneumoniae CWL029
uucaaaaagagagcc

SEQ ID NO: 2539825 - RNA, 13 nt, Chlamydophila pneumoniae CWL029
uucaaaagaaaag

SEQ ID NO: 2539826 - RNA, 15 nt, Chlamydophila pneumoniae CWL029
uucaaaagaaaucaa

SEQ ID NO: 2539827 - RNA, 16 nt, Chlamydophila pneumoniae CWL029
uucaaaagaccgccuu

SEQ ID NO: 2539828 - RNA, 15 nt, Chlamydophila pneumoniae CWL029
uucaaaauagaagcc

SEQ ID NO: 2539829 - RNA, 17 nt, Chlamydophila pneumoniae CWL029
uucaaaauagaagccac

SEQ ID NO: 2539830 - RNA, 18 nt, Chlamydophila pneumoniae CWL029
uucaaacuccuuuuaaaa

SEQ ID NO: 2539831 - RNA, 20 nt, Chlamydophila pneumoniae CWL029
uucaaacugauuaguuuguu

SEQ ID NO: 2539832 - RNA, 22 nt, Chlamydophila pneumoniae CWL029
uucaaagaagacacuguugcau

SEQ ID NO: 2539833 - RNA, 13 nt, Chlamydophila pneumoniae CWL029
uucaaagaagucg

SEQ ID NO: 2539834 - RNA, 12 nt, Chlamydophila pneumoniae CWL029
uucaaagauaua

SEQ ID NO: 2539835 - RNA, 22 nt, Chlamydophila pneumoniae CWL029
uucaaagauauagauucaugaa

SEQ ID NO: 2539836 - RNA, 12 nt, Chlamydophila pneumoniae CWL029
uucaaagccauu

SEQ ID NO: 2539837 - RNA, 14 nt, Chlamydophila pneumoniae CWL029
uucaaagucaaaua

SEQ ID NO: 2539838 - RNA, 19 nt, Chlamydophila pneumoniae CWL029
uucaaaucaucaaaaagau

SEQ ID NO: 2539839 - RNA, 20 nt, Chlamydophila pneumoniae CWL029
uucaacaaaggcuccaaacg

SEQ ID NO: 2539840 - RNA, 16 nt, Chlamydophila pneumoniae CWL029
uucaaccaaacgucag

SEQ ID NO: 2539841 - RNA, 21 nt, Chlamydophila pneumoniae CWL029
uucaacuuuguuaauagaaga

SEQ ID NO: 2539842 - RNA, 11 nt, Chlamydophila pneumoniae CWL029
uucaagaaaaa

SEQ ID NO: 2539843 - RNA, 17 nt, Chlamydophila pneumoniae CWL029
uucaagaugauccgcau

SEQ ID NO: 2539844 - RNA, 21 nt, Chlamydophila pneumoniae CWL029
uucaagauugugcucaauaca

SEQ ID NO: 2539845 - RNA, 20 nt, Chlamydophila pneumoniae CWL029
uucaaggaacauuugagcaa

SEQ ID NO: 2539846 - RNA, 21 nt, Chlamydophila pneumoniae CWL029
uucaagguacugcucaaugac

SEQ ID NO: 2539847 - RNA, 19 nt, Chlamydophila pneumoniae CWL029
uucaagucgagaaacaaaa

SEQ ID NO: 2539848 - RNA, 13 nt, Chlamydophila pneumoniae CWL029
uucaagucuguaa

SEQ ID NO: 2539849 - RNA, 14 nt, Chlamydophila pneumoniae CWL029
uucaagucuguaag

SEQ ID NO: 2539850 - RNA, 20 nt, Chlamydophila pneumoniae CWL029
uucaauaaccagaagacucc

SEQ ID NO: 2539851 - RNA, 21 nt, Chlamydophila pneumoniae CWL029
uucaauaauuucaaagaugca

SEQ ID NO: 2539852 - RNA, 21 nt, Chlamydophila pneumoniae CWL029
uucaauacgcuagcucuuaaa

SEQ ID NO: 2539853 - RNA, 23 nt, Chlamydophila pneumoniae CWL029
uucaauccccugcaucucugcau

SEQ ID NO: 2539854 - RNA, 13 nt, Chlamydophila pneumoniae CWL029
uucaaucucuccu

SEQ ID NO: 2539855 - RNA, 23 nt, Chlamydophila pneumoniae CWL029
uucaaucucuccuugacaaauaa

SEQ ID NO: 2539856 - RNA, 15 nt, Chlamydophila pneumoniae CWL029
uucaaugaagaaaaa

SEQ ID NO: 2539857 - RNA, 20 nt, Chlamydophila pneumoniae CWL029
uucaaugacuucuggaucuu

SEQ ID NO: 2539858 - RNA, 21 nt, Chlamydophila pneumoniae CWL029
uucaaugauuucuuuagcuuu

SEQ ID NO: 2539859 - RNA, 14 nt, Chlamydophila pneumoniae CWL029
uucaauguaauugc

SEQ ID NO: 2539860 - RNA, 22 nt, Chlamydophila pneumoniae CWL029
uucaauuacaggagcuagaaga

SEQ ID NO: 2539861 - RNA, 17 nt, Chlamydophila pneumoniae CWL029
uucaauugagacaaaaa

SEQ ID NO: 2539862 - RNA, 17 nt, Chlamydophila pneumoniae CWL029
uucaauuuggauuuaug

SEQ ID NO: 2539863 - RNA, 23 nt, Chlamydophila pneumoniae CWL029
uucacaaaucuuccccuaaaaau

SEQ ID NO: 2539864 - RNA, 17 nt, Chlamydophila pneumoniae CWL029
uucacauaguuuaauaa

SEQ ID NO: 2539865 - RNA, 22 nt, Chlamydophila pneumoniae CWL029
uucaccacaaaccucuaaaaac

SEQ ID NO: 2539866 - RNA, 16 nt, Chlamydophila pneumoniae CWL029
uucaccauuaagauau

SEQ ID NO: 2539867 - RNA, 22 nt, Chlamydophila pneumoniae CWL029
uucacccucauuaagaggaguc

SEQ ID NO: 2539868 - RNA, 23 nt, Chlamydophila pneumoniae CWL029
uucacgacauacaucaaaaugcu

SEQ ID NO: 2539869 - RNA, 17 nt, Chlamydophila pneumoniae CWL029
uucacguauagguugaa

SEQ ID NO: 2539870 - RNA, 19 nt, Chlamydophila pneumoniae CWL029
uucacuugguagcgucucu

SEQ ID NO: 2539871 - RNA, 23 nt, Chlamydophila pneumoniae CWL029
uucagaaagacgaucuugagcca

SEQ ID NO: 2539872 - RNA, 13 nt, Chlamydophila pneumoniae CWL029
uucagaauucuca

SEQ ID NO: 2539873 - RNA, 17 nt, Chlamydophila pneumoniae CWL029
uucagaggcuagaaaau

SEQ ID NO: 2539874 - RNA, 19 nt, Chlamydophila pneumoniae CWL029
uucagaguggucauugccu

SEQ ID NO: 2539875 - RNA, 15 nt, Chlamydophila pneumoniae CWL029
uucagaugauuuuau

SEQ ID NO: 2539876 - RNA, 23 nt, Chlamydophila pneumoniae CWL029
uucagcaagucgguaauaccuuu

SEQ ID NO: 2539877 - RNA, 19 nt, Chlamydophila pneumoniae CWL029
uucagcagguucuugaauc

SEQ ID NO: 2539878 - RNA, 14 nt, Chlamydophila pneumoniae CWL029
uucagccugucuau

SEQ ID NO: 2539879 - RNA, 21 nt, Chlamydophila pneumoniae CWL029
uucaggacgcacauuuagaag

SEQ ID NO: 2539880 - RNA, 23 nt, Chlamydophila pneumoniae CWL029
uucaggagaccagggaucuucau

SEQ ID NO: 2539881 - RNA, 16 nt, Chlamydophila pneumoniae CWL029
uucaggauuuuccauu

SEQ ID NO: 2539882 - RNA, 13 nt, Chlamydophila pneumoniae CWL029
uucagguucugaa

SEQ ID NO: 2539883 - RNA, 13 nt, Chlamydophila pneumoniae CWL029
uucaguuccucau

SEQ ID NO: 2539884 - RNA, 20 nt, Chlamydophila pneumoniae CWL029
uucaguuuuaucggcaauug

SEQ ID NO: 2539885 - RNA, 13 nt, Chlamydophila pneumoniae CWL029
uucauaaaacugu

SEQ ID NO: 2539886 - RNA, 17 nt, Chlamydophila pneumoniae CWL029
uucauaaagaggaauga

SEQ ID NO: 2539887 - RNA, 13 nt, Chlamydophila pneumoniae CWL029
uucauaaauucag

SEQ ID NO: 2539888 - RNA, 17 nt, Chlamydophila pneumoniae CWL029
uucgaaaaacgguaaau

SEQ ID NO: 2539889 - RNA, 20 nt, Chlamydophila pneumoniae CWL029
uucgaaucguuuuuggaaaa

SEQ ID NO: 2539890 - RNA, 22 nt, Chlamydophila pneumoniae CWL029
uucgacaacaacauaaagaagg

SEQ ID NO: 2539891 - RNA, 21 nt, Chlamydophila pneumoniae CWL029
uucgacgagaaggaagaagaa

SEQ ID NO: 2539892 - RNA, 19 nt, Chlamydophila pneumoniae CWL029
uucgacuauaagagguucu

SEQ ID NO: 2539893 - RNA, 13 nt, Chlamydophila pneumoniae CWL029
uucgacucuccac

SEQ ID NO: 2539894 - RNA, 22 nt, Chlamydophila pneumoniae CWL029
uucgauaucucuaccgaacaga

SEQ ID NO: 2539895 - RNA, 19 nt, Chlamydophila pneumoniae CWL029
uucgaugcuauuuuuccau

SEQ ID NO: 2539896 - RNA, 18 nt, Chlamydophila pneumoniae CWL029
uucgauguuaaggcuucc

SEQ ID NO: 2539897 - RNA, 21 nt, Chlamydophila pneumoniae CWL029
uucgauguuaaggcuuccaau

SEQ ID NO: 2539898 - RNA, 15 nt, Chlamydophila pneumoniae CWL029
uucgcaaauuuuucg

SEQ ID NO: 2539899 - RNA, 17 nt, Chlamydophila pneumoniae CWL029
uucgcacuaauuuccuu

SEQ ID NO: 2539900 - RNA, 15 nt, Chlamydophila pneumoniae CWL029
uucgcacuacagcuu

SEQ ID NO: 2539901 - RNA, 17 nt, Chlamydophila pneumoniae CWL029
uucgcggaucuucuucu

SEQ ID NO: 2539902 - RNA, 17 nt, Chlamydophila pneumoniae CWL029
uucgcuacauaaaauga

SEQ ID NO: 2539903 - RNA, 18 nt, Chlamydophila pneumoniae CWL029
uucgcugucuagaacacu

SEQ ID NO: 2539904 - RNA, 19 nt, Chlamydophila pneumoniae CWL029
uucggaguuggaucaagga

SEQ ID NO: 2539905 - RNA, 20 nt, Chlamydophila pneumoniae CWL029
uucguaacgcuuuucuaaua

SEQ ID NO: 2539906 - RNA, 22 nt, Chlamydophila pneumoniae CWL029
uucguacaguuuuuuucuaaau

SEQ ID NO: 2539907 - RNA, 22 nt, Chlamydophila pneumoniae CWL029
uucguagacgcucuaaacucuc

SEQ ID NO: 2539908 - RNA, 15 nt, Chlamydophila pneumoniae CWL029
uucgucgucauccca

SEQ ID NO: 2539909 - RNA, 22 nt, Chlamydophila pneumoniae CWL029
uucgugaacaaaaucgaacaga

SEQ ID NO: 2539910 - RNA, 18 nt, Chlamydophila pneumoniae CWL029
uucguggaacuuucuggg

SEQ ID NO: 2539911 - RNA, 13 nt, Chlamydophila pneumoniae CWL029
uucguuacuagga

SEQ ID NO: 2539912 - RNA, 22 nt, Chlamydophila pneumoniae CWL029
uucguuuccgaucauuuuugcu

SEQ ID NO: 2539913 - RNA, 13 nt, Chlamydophila pneumoniae CWL029
uucguuucgcuuu

SEQ ID NO: 2539914 - RNA, 15 nt, Chlamydophila pneumoniae CWL029
uucuaaaaacucuuc

SEQ ID NO: 2539915 - RNA, 16 nt, Chlamydophila pneumoniae CWL029
uucuaaaacagaaauu

SEQ ID NO: 2539916 - RNA, 22 nt, Chlamydophila pneumoniae CWL029
uucuaaaacagaaauugcuucu

SEQ ID NO: 2539917 - RNA, 16 nt, Chlamydophila pneumoniae CWL029
uucuaaaacuucaguu

SEQ ID NO: 2539918 - RNA, 14 nt, Chlamydophila pneumoniae CWL029
uucuaaaagagcaa

SEQ ID NO: 2539919 - RNA, 12 nt, Chlamydophila pneumoniae CWL029
uucuaaacaauu

SEQ ID NO: 2539920 - RNA, 13 nt, Chlamydophila pneumoniae CWL029
uucuaaagauuuu

SEQ ID NO: 2539921 - RNA, 17 nt, Chlamydophila pneumoniae CWL029
uucuaaauagaaaacau

SEQ ID NO: 2539922 - RNA, 22 nt, Chlamydophila pneumoniae CWL029
uucuaacgcuuuuucaaacugu

SEQ ID NO: 2539923 - RNA, 20 nt, Chlamydophila pneumoniae CWL029
uucuaacuguacacuuucaa

SEQ ID NO: 2539924 - RNA, 12 nt, Chlamydophila pneumoniae CWL029
uucuaagauucc

SEQ ID NO: 2539925 - RNA, 14 nt, Chlamydophila pneumoniae CWL029
uucuaagcaauauu

SEQ ID NO: 2539926 - RNA, 18 nt, Chlamydophila pneumoniae CWL029
uucuaagcuuauuucugu

SEQ ID NO: 2539927 - RNA, 24 nt, Chlamydophila pneumoniae CWL029
uucuaagcuuauuucuguaguucu

SEQ ID NO: 2539928 - RNA, 20 nt, Chlamydophila pneumoniae CWL029
uucuaaggugcuauuuuaaa

SEQ ID NO: 2539929 - RNA, 12 nt, Chlamydophila pneumoniae CWL029
uucuaauacacc

SEQ ID NO: 2539930 - RNA, 15 nt, Chlamydophila pneumoniae CWL029
uucuacaaacaggua

SEQ ID NO: 2539931 - RNA, 23 nt, Chlamydophila pneumoniae CWL029
uucuacaaugauauaaaagcuga

SEQ ID NO: 2539932 - RNA, 16 nt, Chlamydophila pneumoniae CWL029
uucuacacgacgagga

SEQ ID NO: 2539933 - RNA, 22 nt, Chlamydophila pneumoniae CWL029
uucuacacuguuguaauaaaau

SEQ ID NO: 2539934 - RNA, 18 nt, Chlamydophila pneumoniae CWL029
uucuacauagauccccuu

SEQ ID NO: 2539935 - RNA, 21 nt, Chlamydophila pneumoniae CWL029
uucuacaucccaagggccaga

SEQ ID NO: 2539936 - RNA, 20 nt, Chlamydophila pneumoniae CWL029
uucuacauuugcuauuuucc

SEQ ID NO: 2539937 - RNA, 21 nt, Chlamydophila pneumoniae CWL029
uucuacauuugcuauuuuccc

SEQ ID NO: 2539938 - RNA, 13 nt, Chlamydophila pneumoniae CWL029
uucuaccaauucu

SEQ ID NO: 2539939 - RNA, 19 nt, Chlamydophila pneumoniae CWL029
uucuaccuguagcuacaga

SEQ ID NO: 2539940 - RNA, 18 nt, Chlamydophila pneumoniae CWL029
uucuagaaaagauucuaa

SEQ ID NO: 2539941 - RNA, 21 nt, Chlamydophila pneumoniae CWL029
uucuagagcuucaaguuucuu

SEQ ID NO: 2539942 - RNA, 18 nt, Chlamydophila pneumoniae CWL029
uucuagaguucauuuuag

SEQ ID NO: 2539943 - RNA, 16 nt, Chlamydophila pneumoniae CWL029
uucuagcaaaucuaaa

SEQ ID NO: 2539944 - RNA, 20 nt, Chlamydophila pneumoniae CWL029
uucuagcauaguguuccaaa

SEQ ID NO: 2539945 - RNA, 16 nt, Chlamydophila pneumoniae CWL029
uucuagcuaauaauga

SEQ ID NO: 2539946 - RNA, 21 nt, Chlamydophila pneumoniae CWL029
uucuagcuaauaaugaagcag

SEQ ID NO: 2539947 - RNA, 15 nt, Chlamydophila pneumoniae CWL029
uucuagcucauuauc

SEQ ID NO: 2539948 - RNA, 16 nt, Chlamydophila pneumoniae CWL029
uucuaggaaucuuuua

SEQ ID NO: 2539949 - RNA, 16 nt, Chlamydophila pneumoniae CWL029
uucuaggaauugcugu

SEQ ID NO: 2539950 - RNA, 18 nt, Chlamydophila pneumoniae CWL029
uucuaggauuuagacuaa

SEQ ID NO: 2539951 - RNA, 20 nt, Chlamydophila pneumoniae CWL029
uucuagggaucccaaaaaau

SEQ ID NO: 2539952 - RNA, 23 nt, Chlamydophila pneumoniae CWL029
uucuagggaucccaaaaaaugcc

SEQ ID NO: 2539953 - RNA, 20 nt, Chlamydophila pneumoniae CWL029
uucuaggggagguaaaauaa

SEQ ID NO: 2539954 - RNA, 17 nt, Chlamydophila pneumoniae CWL029
uucuauacgaacacaga

SEQ ID NO: 2539955 - RNA, 21 nt, Chlamydophila pneumoniae CWL029
uucuauacgcuuaacaugaaa

SEQ ID NO: 2539956 - RNA, 14 nt, Chlamydophila pneumoniae CWL029
uucuauagcaagac

SEQ ID NO: 2539957 - RNA, 19 nt, Chlamydophila pneumoniae CWL029
uucuauaucauuaagaaga

SEQ ID NO: 2539958 - RNA, 17 nt, Chlamydophila pneumoniae CWL029
uucuaucuuacugaaga

SEQ ID NO: 2539959 - RNA, 22 nt, Chlamydophila pneumoniae CWL029
uucuaugauaucaccagguccu

SEQ ID NO: 2539960 - RNA, 20 nt, Chlamydophila pneumoniae CWL029
uucuaugccauaaauacagg

SEQ ID NO: 2539961 - RNA, 13 nt, Chlamydophila pneumoniae CWL029
uucuauguguucu

SEQ ID NO: 2539962 - RNA, 17 nt, Chlamydophila pneumoniae CWL029
uucuauguguucucgaa

SEQ ID NO: 2539963 - RNA, 15 nt, Chlamydophila pneumoniae CWL029
uucuauuaaaaauag

SEQ ID NO: 2539964 - RNA, 13 nt, Chlamydophila pneumoniae CWL029
uucuauuucauau

SEQ ID NO: 2539965 - RNA, 20 nt, Chlamydophila pneumoniae CWL029
uucuauuucgucgucauccc

SEQ ID NO: 2539966 - RNA, 14 nt, Chlamydophila pneumoniae CWL029
uucucaaagaucau

SEQ ID NO: 2539967 - RNA, 14 nt, Chlamydophila pneumoniae CWL029
uucucaagaucuuc

SEQ ID NO: 2539968 - RNA, 12 nt, Chlamydophila pneumoniae CWL029
uucucagaaaga

SEQ ID NO: 2539969 - RNA, 15 nt, Chlamydophila pneumoniae CWL029
uucucagaaagauau

SEQ ID NO: 2539970 - RNA, 14 nt, Chlamydophila pneumoniae CWL029
uucucauagcuucc

SEQ ID NO: 2539971 - RNA, 17 nt, Chlamydophila pneumoniae CWL029
uucucauagcuuccugu

SEQ ID NO: 2539972 - RNA, 19 nt, Chlamydophila pneumoniae CWL029
uucucauagcuuccuguag

SEQ ID NO: 2539973 - RNA, 19 nt, Chlamydophila pneumoniae CWL029
uucucauccagacaagaca

SEQ ID NO: 2539974 - RNA, 13 nt, Chlamydophila pneumoniae CWL029
uucuccaaauaaa

SEQ ID NO: 2539975 - RNA, 14 nt, Chlamydophila pneumoniae CWL029
uucuccacaugccc

SEQ ID NO: 2539976 - RNA, 17 nt, Chlamydophila pneumoniae CWL029
uucuccagcuucuuucu

SEQ ID NO: 2539977 - RNA, 21 nt, Chlamydophila pneumoniae CWL029
uucuccaguaucuucucuuau

SEQ ID NO: 2539978 - RNA, 22 nt, Chlamydophila pneumoniae CWL029
uucucccgcaaaguuaaaccuu

SEQ ID NO: 2539979 - RNA, 20 nt, Chlamydophila pneumoniae CWL029
uucucccgcuaauuaccauu

SEQ ID NO: 2539980 - RNA, 18 nt, Chlamydophila pneumoniae CWL029
uucucccgugaacaaaaa

SEQ ID NO: 2539981 - RNA, 21 nt, Chlamydophila pneumoniae CWL029
uucuccucgcaauccaggaau

SEQ ID NO: 2539982 - RNA, 23 nt, Chlamydophila pneumoniae CWL029
uucuccugaaccgcaaaaagcuu

SEQ ID NO: 2539983 - RNA, 12 nt, Chlamydophila pneumoniae CWL029
uucucgaaaaau

SEQ ID NO: 2539984 - RNA, 13 nt, Chlamydophila pneumoniae CWL029
uucucgaaaaauu

SEQ ID NO: 2539985 - RNA, 23 nt, Chlamydophila pneumoniae CWL029
uugaauucauccagauuagaaaa

SEQ ID NO: 2539986 - RNA, 13 nt, Chlamydophila pneumoniae CWL029
uugaauucucaag

SEQ ID NO: 2539987 - RNA, 13 nt, Chlamydophila pneumoniae CWL029
uugaauuuccaaa

SEQ ID NO: 2539988 - RNA, 14 nt, Chlamydophila pneumoniae CWL029
uugacaucuguagu

SEQ ID NO: 2539989 - RNA, 16 nt, Chlamydophila pneumoniae CWL029
uugacuagcucucuug

SEQ ID NO: 2539990 - RNA, 12 nt, Chlamydophila pneumoniae CWL029
uugacugaaacu

SEQ ID NO: 2539991 - RNA, 14 nt, Chlamydophila pneumoniae CWL029
uugagaaagaccac

SEQ ID NO: 2539992 - RNA, 16 nt, Chlamydophila pneumoniae CWL029
uugagaaagaccaccu

SEQ ID NO: 2539993 - RNA, 17 nt, Chlamydophila pneumoniae CWL029
uugagaaagaccaccuu

SEQ ID NO: 2539994 - RNA, 19 nt, Chlamydophila pneumoniae CWL029
uugagaaauauaacucucu

SEQ ID NO: 2539995 - RNA, 18 nt, Chlamydophila pneumoniae CWL029
uugagaauaaaacuuucu

SEQ ID NO: 2539996 - RNA, 14 nt, Chlamydophila pneumoniae CWL029
uugagacaaagaau

SEQ ID NO: 2539997 - RNA, 21 nt, Chlamydophila pneumoniae CWL029
uugagauaaucgcacuucuau

SEQ ID NO: 2539998 - RNA, 14 nt, Chlamydophila pneumoniae CWL029
uugagcacauuguu

SEQ ID NO: 2539999 - RNA, 13 nt, Chlamydophila pneumoniae CWL029
uugagcaguaaug

SEQ ID NO: 2540000 - RNA, 19 nt, Chlamydophila pneumoniae CWL029
uugagcuaacgacauugaa

SEQ ID NO: 2540001 - RNA, 19 nt, Chlamydophila pneumoniae CWL029
uugaggcaagucucaaagg

SEQ ID NO: 2540002 - RNA, 17 nt, Chlamydophila pneumoniae CWL029
uugaggguucaauuccu

SEQ ID NO: 2540003 - RNA, 16 nt, Chlamydophila pneumoniae CWL029
uugagucuuuuucaga

SEQ ID NO: 2540004 - RNA, 16 nt, Chlamydophila pneumoniae CWL029
uugaguugguuuugua

SEQ ID NO: 2540005 - RNA, 15 nt, Chlamydophila pneumoniae CWL029
uugauaacaguagcg

SEQ ID NO: 2540006 - RNA, 23 nt, Chlamydophila pneumoniae CWL029
uugauaacuuugcaugaggagac

SEQ ID NO: 2540007 - RNA, 14 nt, Chlamydophila pneumoniae CWL029
uugauaauagucuu

SEQ ID NO: 2540008 - RNA, 17 nt, Chlamydophila pneumoniae CWL029
uugauagcuaagagcau

SEQ ID NO: 2540009 - RNA, 21 nt, Chlamydophila pneumoniae CWL029
uugauaguguucgagcaucuc

SEQ ID NO: 2540010 - RNA, 14 nt, Chlamydophila pneumoniae CWL029
uugauauuguucuu

SEQ ID NO: 2540011 - RNA, 14 nt, Chlamydophila pneumoniae CWL029
uugauccagccccc

SEQ ID NO: 2540012 - RNA, 18 nt, Chlamydophila pneumoniae CWL029
uugauccuuuccaagaag

SEQ ID NO: 2540013 - RNA, 17 nt, Chlamydophila pneumoniae CWL029
uugaucuacaaaaacua

SEQ ID NO: 2540014 - RNA, 12 nt, Chlamydophila pneumoniae CWL029
uugaugagaaaa

SEQ ID NO: 2540015 - RNA, 13 nt, Chlamydophila pneumoniae CWL029
uugaugagaaaaa

SEQ ID NO: 2540016 - RNA, 19 nt, Chlamydophila pneumoniae CWL029
uugaugagaaaaagaaucu

SEQ ID NO: 2540017 - RNA, 21 nt, Chlamydophila pneumoniae CWL029
uugaugagaaaaagaaucucu

SEQ ID NO: 2540018 - RNA, 23 nt, Chlamydophila pneumoniae CWL029
uugauuaggaacaagucggcagg

SEQ ID NO: 2540019 - RNA, 12 nt, Chlamydophila pneumoniae CWL029
uugauucauaaa

SEQ ID NO: 2540020 - RNA, 15 nt, Chlamydophila pneumoniae CWL029
uugauuccaaugacg

SEQ ID NO: 2540021 - RNA, 15 nt, Chlamydophila pneumoniae CWL029
uugauugaaacuuuu

SEQ ID NO: 2540022 - RNA, 20 nt, Chlamydophila pneumoniae CWL029
uugauugcgaacaguuccua

SEQ ID NO: 2540023 - RNA, 21 nt, Chlamydophila pneumoniae CWL029
uugauuggaucuugauaaaag

SEQ ID NO: 2540024 - RNA, 16 nt, Chlamydophila pneumoniae CWL029
uugauuuagaaucuuu

SEQ ID NO: 2540025 - RNA, 19 nt, Chlamydophila pneumoniae CWL029
uugauuuccaacaccagga

SEQ ID NO: 2540026 - RNA, 12 nt, Chlamydophila pneumoniae CWL029
uugauuuuaaaa

SEQ ID NO: 2540027 - RNA, 15 nt, Chlamydophila pneumoniae CWL029
uugauuuuaaaauga

SEQ ID NO: 2540028 - RNA, 21 nt, Chlamydophila pneumoniae CWL029
uugauuuugcagugauaaacc

SEQ ID NO: 2540029 - RNA, 12 nt, Chlamydophila pneumoniae CWL029
uugauuuuucaa

SEQ ID NO: 2540030 - RNA, 17 nt, Chlamydophila pneumoniae CWL029
uugcaaaaaugaaagaa

SEQ ID NO: 2540031 - RNA, 13 nt, Chlamydophila pneumoniae CWL029
uugcaaaugaaaa

SEQ ID NO: 2540032 - RNA, 22 nt, Chlamydophila pneumoniae CWL029
uugcaacaaaaggcccaacucu

SEQ ID NO: 2540033 - RNA, 21 nt, Chlamydophila pneumoniae CWL029
uugcaauaccaauugggcuag

SEQ ID NO: 2540034 - RNA, 21 nt, Chlamydophila pneumoniae CWL029
uugcaauucuucaugcugcuu

SEQ ID NO: 2540035 - RNA, 14 nt, Chlamydophila pneumoniae CWL029
uugcaauugccaua

SEQ ID NO: 2540036 - RNA, 15 nt, Chlamydophila pneumoniae CWL029
uugcaauuuucuaaa

SEQ ID NO: 2540037 - RNA, 18 nt, Chlamydophila pneumoniae CWL029
uugcaccccaugcaagug

SEQ ID NO: 2540038 - RNA, 14 nt, Chlamydophila pneumoniae CWL029
uugcagaagcauug

SEQ ID NO: 2540039 - RNA, 20 nt, Chlamydophila pneumoniae CWL029
uugcagaagcauuguauucc

SEQ ID NO: 2540040 - RNA, 22 nt, Chlamydophila pneumoniae CWL029
uugcagaguuggaucauucuuu

SEQ ID NO: 2540041 - RNA, 18 nt, Chlamydophila pneumoniae CWL029
uugcagauugaaucccau

SEQ ID NO: 2540042 - RNA, 18 nt, Chlamydophila pneumoniae CWL029
uugcaguggcuuauagag

SEQ ID NO: 2540043 - RNA, 18 nt, Chlamydophila pneumoniae CWL029
uugcauagcggcaacaag

SEQ ID NO: 2540044 - RNA, 18 nt, Chlamydophila pneumoniae CWL029
uugcaucuuauggaagag

SEQ ID NO: 2540045 - RNA, 16 nt, Chlamydophila pneumoniae CWL029
uugcauggauccuuca

SEQ ID NO: 2540046 - RNA, 21 nt, Chlamydophila pneumoniae CWL029
uugcauuaaaucguacuucac

SEQ ID NO: 2540047 - RNA, 15 nt, Chlamydophila pneumoniae CWL029
uugccaaucuuucau

SEQ ID NO: 2540048 - RNA, 22 nt, Chlamydophila pneumoniae CWL029
uugccaggaaacguucuuucaa

SEQ ID NO: 2540049 - RNA, 14 nt, Chlamydophila pneumoniae CWL029
uugccauaauaaag

SEQ ID NO: 2540050 - RNA, 18 nt, Chlamydophila pneumoniae CWL029
uugcccauugaccugcuu

SEQ ID NO: 2540051 - RNA, 18 nt, Chlamydophila pneumoniae CWL029
uugccgugaguugcaauu

SEQ ID NO: 2540052 - RNA, 19 nt, Chlamydophila pneumoniae CWL029
uugccuggggaucuuagga

SEQ ID NO: 2540053 - RNA, 14 nt, Chlamydophila pneumoniae CWL029
uugccuucuuaucu

SEQ ID NO: 2540054 - RNA, 14 nt, Chlamydophila pneumoniae CWL029
uugcgacauaacca

SEQ ID NO: 2540055 - RNA, 23 nt, Chlamydophila pneumoniae CWL029
uugcgauaucuauaaauguaggg

SEQ ID NO: 2540056 - RNA, 15 nt, Chlamydophila pneumoniae CWL029
uugcgccagcaaaga

SEQ ID NO: 2540057 - RNA, 20 nt, Chlamydophila pneumoniae CWL029
uugcuaagagcucuuucccu

SEQ ID NO: 2540058 - RNA, 14 nt, Chlamydophila pneumoniae CWL029
uugcuacagcuucu

SEQ ID NO: 2540059 - RNA, 22 nt, Chlamydophila pneumoniae CWL029
uugcuacagcuucuuuuccagc

SEQ ID NO: 2540060 - RNA, 18 nt, Chlamydophila pneumoniae CWL029
uugcuagaucuggagagg

SEQ ID NO: 2540061 - RNA, 14 nt, Chlamydophila pneumoniae CWL029
uugcuauacagaaa

SEQ ID NO: 2540062 - RNA, 20 nt, Chlamydophila pneumoniae CWL029
uugcuauugaaaaaucccug

SEQ ID NO: 2540063 - RNA, 23 nt, Chlamydophila pneumoniae CWL029
uugcuccuccaaaagaccaaaaa

SEQ ID NO: 2540064 - RNA, 23 nt, Chlamydophila pneumoniae CWL029
uugcucuaccaacugagcuauuu

SEQ ID NO: 2540065 - RNA, 17 nt, Chlamydophila pneumoniae CWL029
uugcucuagucuuucaa

SEQ ID NO: 2540066 - RNA, 13 nt, Chlamydophila pneumoniae CWL029
uugcucuuuagga

SEQ ID NO: 2540067 - RNA, 14 nt, Chlamydophila pneumoniae CWL029
uugcugaaaaugau

SEQ ID NO: 2540068 - RNA, 15 nt, Chlamydophila pneumoniae CWL029
uugcugaaaaugauu

SEQ ID NO: 2540069 - RNA, 12 nt, Chlamydophila pneumoniae CWL029
uugcugaagauu

SEQ ID NO: 2540070 - RNA, 14 nt, Chlamydophila pneumoniae CWL029
uugcugaagauuuu

SEQ ID NO: 2540071 - RNA, 15 nt, Chlamydophila pneumoniae CWL029
uugcugaagauuuuu

SEQ ID NO: 2540072 - RNA, 13 nt, Chlamydophila pneumoniae CWL029
uugcugauuucuu

SEQ ID NO: 2540073 - RNA, 19 nt, Chlamydophila pneumoniae CWL029
uugcugauuucuuuuucag

SEQ ID NO: 2540074 - RNA, 18 nt, Chlamydophila pneumoniae CWL029
uugcugcggccacauuaa

SEQ ID NO: 2540075 - RNA, 16 nt, Chlamydophila pneumoniae CWL029
uugcugcucuccaaag

SEQ ID NO: 2540076 - RNA, 19 nt, Chlamydophila pneumoniae CWL029
uugcuguggaauuuuccug

SEQ ID NO: 2540077 - RNA, 19 nt, Chlamydophila pneumoniae CWL029
uugcuuaaaaagucugaau

SEQ ID NO: 2540078 - RNA, 12 nt, Chlamydophila pneumoniae CWL029
uugcuuccaacg

SEQ ID NO: 2540079 - RNA, 20 nt, Chlamydophila pneumoniae CWL029
uugcuucuaagaaacuucca

SEQ ID NO: 2540080 - RNA, 16 nt, Chlamydophila pneumoniae CWL029
uugcuugaaguuuguc

SEQ ID NO: 2540081 - RNA, 11 nt, Chlamydophila pneumoniae CWL029
uugcuuucuag

SEQ ID NO: 2540082 - RNA, 14 nt, Chlamydophila pneumoniae CWL029
uugcuuuucauuuu

SEQ ID NO: 2540083 - RNA, 13 nt, Chlamydophila pneumoniae CWL029
uuuaauuuuucua

SEQ ID NO: 2540084 - RNA, 18 nt, Chlamydophila pneumoniae CWL029
uuuaauuuuucuaagaaa

SEQ ID NO: 2540085 - RNA, 22 nt, Chlamydophila pneumoniae CWL029
uuuacaaucucugcgagaaucg

SEQ ID NO: 2540086 - RNA, 17 nt, Chlamydophila pneumoniae CWL029
uuuaccagaaaugggca

SEQ ID NO: 2540087 - RNA, 16 nt, Chlamydophila pneumoniae CWL029
uuuaccuuguuuuccu

SEQ ID NO: 2540088 - RNA, 22 nt, Chlamydophila pneumoniae CWL029
uuuacgaaaacaucuguauauu

SEQ ID NO: 2540089 - RNA, 15 nt, Chlamydophila pneumoniae CWL029
uuuacgaugagguug

SEQ ID NO: 2540090 - RNA, 16 nt, Chlamydophila pneumoniae CWL029
uuuagaaaaagaucua

SEQ ID NO: 2540091 - RNA, 19 nt, Chlamydophila pneumoniae CWL029
uuuagaaauuccaauuuuu

SEQ ID NO: 2540092 - RNA, 13 nt, Chlamydophila pneumoniae CWL029
uuuagaacuucaa

SEQ ID NO: 2540093 - RNA, 21 nt, Chlamydophila pneumoniae CWL029
uuuagaagguguuuuggcugc

SEQ ID NO: 2540094 - RNA, 20 nt, Chlamydophila pneumoniae CWL029
uuuagaaucuuuucuagaaa

SEQ ID NO: 2540095 - RNA, 16 nt, Chlamydophila pneumoniae CWL029
uuuagaauuuguccuu

SEQ ID NO: 2540096 - RNA, 13 nt, Chlamydophila pneumoniae CWL029
uuuagacaagaca

SEQ ID NO: 2540097 - RNA, 19 nt, Chlamydophila pneumoniae CWL029
uuuagacgaggagaagucg

SEQ ID NO: 2540098 - RNA, 13 nt, Chlamydophila pneumoniae CWL029
uuuagagaaaucu

SEQ ID NO: 2540099 - RNA, 21 nt, Chlamydophila pneumoniae CWL029
uuuagcaaucucuuucacaaa

SEQ ID NO: 2540100 - RNA, 15 nt, Chlamydophila pneumoniae CWL029
uuuagccuggucuca

SEQ ID NO: 2540101 - RNA, 16 nt, Chlamydophila pneumoniae CWL029
uuuagcgcuacaguga

SEQ ID NO: 2540102 - RNA, 13 nt, Chlamydophila pneumoniae CWL029
uuuaggaagcugu

SEQ ID NO: 2540103 - RNA, 19 nt, Chlamydophila pneumoniae CWL029
uuuaguggaaauugugaaa

SEQ ID NO: 2540104 - RNA, 15 nt, Chlamydophila pneumoniae CWL029
uuuaguucaccacua

SEQ ID NO: 2540105 - RNA, 21 nt, Chlamydophila pneumoniae CWL029
uuuauaaagaucgggucuaca

SEQ ID NO: 2540106 - RNA, 18 nt, Chlamydophila pneumoniae CWL029
uuuauaacaucaagaauu

SEQ ID NO: 2540107 - RNA, 18 nt, Chlamydophila pneumoniae CWL029
uuuauagcggaguguuuu

SEQ ID NO: 2540108 - RNA, 14 nt, Chlamydophila pneumoniae CWL029
uuuaucauugcuau

SEQ ID NO: 2540109 - RNA, 20 nt, Chlamydophila pneumoniae CWL029
uuuaucauugcuauugaaaa

SEQ ID NO: 2540110 - RNA, 13 nt, Chlamydophila pneumoniae CWL029
uuuauccaccaag

SEQ ID NO: 2540111 - RNA, 16 nt, Chlamydophila pneumoniae CWL029
uuuaucccagauaaag

SEQ ID NO: 2540112 - RNA, 22 nt, Chlamydophila pneumoniae CWL029
uuuaucccagauaaagacaucu

SEQ ID NO: 2540113 - RNA, 19 nt, Chlamydophila pneumoniae CWL029
uuuaucugcgacaaaaaug

SEQ ID NO: 2540114 - RNA, 22 nt, Chlamydophila pneumoniae CWL029
uuuaugaucucuucaugaaaaa

SEQ ID NO: 2540115 - RNA, 14 nt, Chlamydophila pneumoniae CWL029
uuuaugauguauaa

SEQ ID NO: 2540116 - RNA, 12 nt, Chlamydophila pneumoniae CWL029
uuuauuaaaauc

SEQ ID NO: 2540117 - RNA, 16 nt, Chlamydophila pneumoniae CWL029
uuuauuagaaguaucu

SEQ ID NO: 2540118 - RNA, 21 nt, Chlamydophila pneumoniae CWL029
uuuauuuaaauaaaaccacuu

SEQ ID NO: 2540119 - RNA, 19 nt, Chlamydophila pneumoniae CWL029
uuuauuuugaugcuucuuu

SEQ ID NO: 2540120 - RNA, 16 nt, Chlamydophila pneumoniae CWL029
uuucaaagaagacacu

SEQ ID NO: 2540121 - RNA, 17 nt, Chlamydophila pneumoniae CWL029
uuucaaaggagaaagaa

SEQ ID NO: 2540122 - RNA, 22 nt, Chlamydophila pneumoniae CWL029
uuucaaaggcaacgcgauuuuc

SEQ ID NO: 2540123 - RNA, 20 nt, Chlamydophila pneumoniae CWL029
uuucaacauaacaugagaaa

SEQ ID NO: 2540124 - RNA, 16 nt, Chlamydophila pneumoniae CWL029
uuucaagaacuccuuu

SEQ ID NO: 2540125 - RNA, 20 nt, Chlamydophila pneumoniae CWL029
uuucaagcuuucguuuucua

SEQ ID NO: 2540126 - RNA, 21 nt, Chlamydophila pneumoniae CWL029
uuucaauaaccagaagacucc

SEQ ID NO: 2540127 - RNA, 12 nt, Chlamydophila pneumoniae CWL029
uuucaauagcuu

SEQ ID NO: 2540128 - RNA, 18 nt, Chlamydophila pneumoniae CWL029
uuucaauagcuuccaagg

SEQ ID NO: 2540129 - RNA, 15 nt, Chlamydophila pneumoniae CWL029
uuucaaucucuccuu

SEQ ID NO: 2540130 - RNA, 16 nt, Chlamydophila pneumoniae CWL029
uuucaaucucuccuug

SEQ ID NO: 2540131 - RNA, 18 nt, Chlamydophila pneumoniae CWL029
uuucacauacauucuauu

SEQ ID NO: 2540132 - RNA, 19 nt, Chlamydophila pneumoniae CWL029
uuucacauaguuuaauaaa

SEQ ID NO: 2540133 - RNA, 17 nt, Chlamydophila pneumoniae CWL029
uuucaccaacuccucua

SEQ ID NO: 2540134 - RNA, 14 nt, Chlamydophila pneumoniae CWL029
uuucagaaaagaaa

SEQ ID NO: 2540135 - RNA, 20 nt, Chlamydophila pneumoniae CWL029
uuucagauaaguuacuuucu

SEQ ID NO: 2540136 - RNA, 12 nt, Chlamydophila pneumoniae CWL029
uuucagauuuuu

SEQ ID NO: 2540137 - RNA, 14 nt, Chlamydophila pneumoniae CWL029
uuucagauuuuuua

SEQ ID NO: 2540138 - RNA, 19 nt, Chlamydophila pneumoniae CWL029
uuucaggaaacucaaucuc

SEQ ID NO: 2540139 - RNA, 22 nt, Chlamydophila pneumoniae CWL029
uuucaggaaacucaaucucuuu

SEQ ID NO: 2540140 - RNA, 19 nt, Chlamydophila pneumoniae CWL029
uuucaguuguuucuagaaa

SEQ ID NO: 2540141 - RNA, 21 nt, Chlamydophila pneumoniae CWL029
uuucaguuuuaucggcaauug

SEQ ID NO: 2540142 - RNA, 14 nt, Chlamydophila pneumoniae CWL029
uuucauaaacaauu

SEQ ID NO: 2540143 - RNA, 16 nt, Chlamydophila pneumoniae CWL029
uuucauaaacaauuca

SEQ ID NO: 2540144 - RNA, 13 nt, Chlamydophila pneumoniae CWL029
uuucauaagagaa

SEQ ID NO: 2540145 - RNA, 16 nt, Chlamydophila pneumoniae CWL029
uuucauacuuauccuu

SEQ ID NO: 2540146 - RNA, 21 nt, Chlamydophila pneumoniae CWL029
uuucauauaaaguuuccaagu

SEQ ID NO: 2540147 - RNA, 18 nt, Chlamydophila pneumoniae CWL029
uuucauguaagaauguag

SEQ ID NO: 2540148 - RNA, 13 nt, Chlamydophila pneumoniae CWL029
uuucauucccuuu

SEQ ID NO: 2540149 - RNA, 23 nt, Chlamydophila pneumoniae CWL029
uuucauucccuuuuuccauaccc

SEQ ID NO: 2540150 - RNA, 17 nt, Chlamydophila pneumoniae CWL029
uuucauuugaaauauga

SEQ ID NO: 2540151 - RNA, 20 nt, Chlamydophila pneumoniae CWL029
uuucauuuuuaggaucuuug

SEQ ID NO: 2540152 - RNA, 17 nt, Chlamydophila pneumoniae CWL029
uuuccaaagaucgaucu

SEQ ID NO: 2540153 - RNA, 14 nt, Chlamydophila pneumoniae CWL029
uuuccaagaaguca

SEQ ID NO: 2540154 - RNA, 22 nt, Chlamydophila pneumoniae CWL029
uuuccauacccaaauuucuucu

SEQ ID NO: 2540155 - RNA, 23 nt, Chlamydophila pneumoniae CWL029
uuuccauacccaaauuucuucug

SEQ ID NO: 2540156 - RNA, 11 nt, Chlamydophila pneumoniae CWL029
uuuccauccac

SEQ ID NO: 2540157 - RNA, 19 nt, Chlamydophila pneumoniae CWL029
uuuccccuuggaaaucaga

SEQ ID NO: 2540158 - RNA, 22 nt, Chlamydophila pneumoniae CWL029
uuucccgcucuuuauuaacucc

SEQ ID NO: 2540159 - RNA, 21 nt, Chlamydophila pneumoniae CWL029
uuucccuaagcaaaaacuuuc

SEQ ID NO: 2540160 - RNA, 16 nt, Chlamydophila pneumoniae CWL029
uuucccuccaccagaa

SEQ ID NO: 2540161 - RNA, 16 nt, Chlamydophila pneumoniae CWL029
uuucccucguugcuua

SEQ ID NO: 2540162 - RNA, 15 nt, Chlamydophila pneumoniae CWL029
uuucccuucuaagga

SEQ ID NO: 2540163 - RNA, 21 nt, Chlamydophila pneumoniae CWL029
uuuccggggagaacuucaaca

SEQ ID NO: 2540164 - RNA, 23 nt, Chlamydophila pneumoniae CWL029
uuuccguaaguaaccaauacagc

SEQ ID NO: 2540165 - RNA, 12 nt, Chlamydophila pneumoniae CWL029
uuuccuaaaaua

SEQ ID NO: 2540166 - RNA, 18 nt, Chlamydophila pneumoniae CWL029
uuuccuaccuauauuuuu

SEQ ID NO: 2540167 - RNA, 22 nt, Chlamydophila pneumoniae CWL029
uuuccucuaucagggagcggaa

SEQ ID NO: 2540168 - RNA, 16 nt, Chlamydophila pneumoniae CWL029
uuuccucucaugaaau

SEQ ID NO: 2540169 - RNA, 18 nt, Chlamydophila pneumoniae CWL029
uuuccuggucuccagaag

SEQ ID NO: 2540170 - RNA, 23 nt, Chlamydophila pneumoniae CWL029
uuuccuucuuuuaaaaacucuuu

SEQ ID NO: 2540171 - RNA, 17 nt, Chlamydophila pneumoniae CWL029
uuuccuugguaucccaa

SEQ ID NO: 2540172 - RNA, 17 nt, Chlamydophila pneumoniae CWL029
uuuccuuuucuccuucu

SEQ ID NO: 2540173 - RNA, 18 nt, Chlamydophila pneumoniae CWL029
uuuccuuuucuccuucug

SEQ ID NO: 2540174 - RNA, 19 nt, Chlamydophila pneumoniae CWL029
uuuccuuuucuccuucugg

SEQ ID NO: 2540175 - RNA, 18 nt, Chlamydophila pneumoniae CWL029
uuucgaugcuauuuuucc

SEQ ID NO: 2540176 - RNA, 15 nt, Chlamydophila pneumoniae CWL029
uuucguaaccacagu

SEQ ID NO: 2540177 - RNA, 22 nt, Chlamydophila pneumoniae CWL029
uuucgucaaagguuuuaaaaug

SEQ ID NO: 2540178 - RNA, 15 nt, Chlamydophila pneumoniae CWL029
uuucgugaacaaaau

SEQ ID NO: 2540179 - RNA, 20 nt, Chlamydophila pneumoniae CWL029
uuucuaaauagaaaacauag

SEQ ID NO: 2540180 - RNA, 16 nt, Chlamydophila pneumoniae CWL029
uuuuacguucuuucuu

SEQ ID NO: 2540181 - RNA, 13 nt, Chlamydophila pneumoniae CWL029
uuuuacuaucucc

SEQ ID NO: 2540182 - RNA, 14 nt, Chlamydophila pneumoniae CWL029
uuuuacuaucuccu

SEQ ID NO: 2540183 - RNA, 12 nt, Chlamydophila pneumoniae CWL029
uuuuacucccug

SEQ ID NO: 2540184 - RNA, 16 nt, Chlamydophila pneumoniae CWL029
uuuuacugaaauuaag

SEQ ID NO: 2540185 - RNA, 20 nt, Chlamydophila pneumoniae CWL029
uuuuagaaauguuuuuaaac

SEQ ID NO: 2540186 - RNA, 15 nt, Chlamydophila pneumoniae CWL029
uuuuagagccuuuuc

SEQ ID NO: 2540187 - RNA, 20 nt, Chlamydophila pneumoniae CWL029
uuuuaggaguugguugcagu

SEQ ID NO: 2540188 - RNA, 16 nt, Chlamydophila pneumoniae CWL029
uuuuauaggaauaaca

SEQ ID NO: 2540189 - RNA, 17 nt, Chlamydophila pneumoniae CWL029
uuuuaugauuacaucua

SEQ ID NO: 2540190 - RNA, 15 nt, Chlamydophila pneumoniae CWL029
uuuuauuuaaaauuu

SEQ ID NO: 2540191 - RNA, 20 nt, Chlamydophila pneumoniae CWL029
uuuuauuuauuaucuuguuu

SEQ ID NO: 2540192 - RNA, 23 nt, Chlamydophila pneumoniae CWL029
uuuucaaauauugcgaacuuuug

SEQ ID NO: 2540193 - RNA, 17 nt, Chlamydophila pneumoniae CWL029
uuuucaaaucaucaaaa

SEQ ID NO: 2540194 - RNA, 12 nt, Chlamydophila pneumoniae CWL029
uuuucaaauucu

SEQ ID NO: 2540195 - RNA, 21 nt, Chlamydophila pneumoniae CWL029
uuuucaauagcaguaucuaga

SEQ ID NO: 2540196 - RNA, 16 nt, Chlamydophila pneumoniae CWL029
uuuucacgagcucaca

SEQ ID NO: 2540197 - RNA, 22 nt, Chlamydophila pneumoniae CWL029
uuuucagaaagcgaagagcuca

SEQ ID NO: 2540198 - RNA, 22 nt, Chlamydophila pneumoniae CWL029
uuuucagccugucuauaaaaua

SEQ ID NO: 2540199 - RNA, 15 nt, Chlamydophila pneumoniae CWL029
uuuucaggaacuuua

SEQ ID NO: 2540200 - RNA, 13 nt, Chlamydophila pneumoniae CWL029
uuuucaguucgug

SEQ ID NO: 2540201 - RNA, 20 nt, Chlamydophila pneumoniae CWL029
uuuuccauacccaaauuucu

SEQ ID NO: 2540202 - RNA, 23 nt, Chlamydophila pneumoniae CWL029
uuuuccauacccaaauuucuucu

SEQ ID NO: 2540203 - RNA, 21 nt, Chlamydophila pneumoniae CWL029
uuuuccccuuggaaaucagaa

SEQ ID NO: 2540204 - RNA, 13 nt, Chlamydophila pneumoniae CWL029
uuuuccucuauau

SEQ ID NO: 2540205 - RNA, 20 nt, Chlamydophila pneumoniae CWL029
uuuucgcuaacuuauccuca

SEQ ID NO: 2540206 - RNA, 14 nt, Chlamydophila pneumoniae CWL029
uuuucuaagagauc

SEQ ID NO: 2540207 - RNA, 15 nt, Chlamydophila pneumoniae CWL029
uuuucuaagagaucu

SEQ ID NO: 2540208 - RNA, 16 nt, Chlamydophila pneumoniae CWL029
uuuucuaagagaucua

SEQ ID NO: 2540209 - RNA, 18 nt, Chlamydophila pneumoniae CWL029
uuuucuagaaaagauucu

SEQ ID NO: 2540210 - RNA, 21 nt, Chlamydophila pneumoniae CWL029
uuuucuagaaaagauucuaaa

SEQ ID NO: 2540211 - RNA, 22 nt, Chlamydophila pneumoniae CWL029
uuuucuagaaaagauucuaaau

SEQ ID NO: 2540212 - RNA, 23 nt, Chlamydophila pneumoniae CWL029
uuuucuagaaacugcuccugaag

SEQ ID NO: 2540213 - RNA, 22 nt, Chlamydophila pneumoniae CWL029
uuuucuagcauaguguuccaaa

SEQ ID NO: 2540214 - RNA, 13 nt, Chlamydophila pneumoniae CWL029
uuuucuaugaucc

SEQ ID NO: 2540215 - RNA, 20 nt, Chlamydophila pneumoniae CWL029
uuuucucaauaguguaacau

SEQ ID NO: 2540216 - RNA, 14 nt, Chlamydophila pneumoniae CWL029
uuuucuccuucucc

SEQ ID NO: 2540217 - RNA, 21 nt, Chlamydophila pneumoniae CWL029
uuuucucgaagaaaauaaaga

SEQ ID NO: 2540218 - RNA, 14 nt, Chlamydophila pneumoniae CWL029
uuuucucugagcag

SEQ ID NO: 2540219 - RNA, 12 nt, Chlamydophila pneumoniae CWL029
uuuucugcuccu

SEQ ID NO: 2540220 - RNA, 22 nt, Chlamydophila pneumoniae CWL029
uuuucuuauagggaauuuuuuc

SEQ ID NO: 2540221 - RNA, 16 nt, Chlamydophila pneumoniae CWL029
uuuucuuaucaugaaa

SEQ ID NO: 2540222 - RNA, 13 nt, Chlamydophila pneumoniae CWL029
uuuucuuccaaag

SEQ ID NO: 2540223 - RNA, 17 nt, Chlamydophila pneumoniae CWL029
uuuucuuccacacaacu

SEQ ID NO: 2540224 - RNA, 22 nt, Chlamydophila pneumoniae CWL029
uuuucuucuuuaagauuuccuu

SEQ ID NO: 2540225 - RNA, 17 nt, Chlamydophila pneumoniae CWL029
uuuucuugauuagagaa

SEQ ID NO: 2540226 - RNA, 22 nt, Chlamydophila pneumoniae CWL029
uuuucuuguaagacuaaaaaag

SEQ ID NO: 2540227 - RNA, 19 nt, Chlamydophila pneumoniae CWL029
uuuucuuucuaagauaucu

SEQ ID NO: 2540228 - RNA, 20 nt, Chlamydophila pneumoniae CWL029
uuuugaaaauugcauuuaaa

SEQ ID NO: 2540229 - RNA, 13 nt, Chlamydophila pneumoniae CWL029
uuuugaaaauuuu

SEQ ID NO: 2540230 - RNA, 13 nt, Chlamydophila pneumoniae CWL029
uuuugaagugcuu

SEQ ID NO: 2540231 - RNA, 14 nt, Chlamydophila pneumoniae CWL029
uuuugaagugcuuu

SEQ ID NO: 2540232 - RNA, 20 nt, Chlamydophila pneumoniae CWL029
uuuugaauuaaaaguuccaa

SEQ ID NO: 2540233 - RNA, 14 nt, Chlamydophila pneumoniae CWL029
uuuugagauucaaa

SEQ ID NO: 2540234 - RNA, 23 nt, Chlamydophila pneumoniae CWL029
uuuugaggaacuucagcuuugcu

SEQ ID NO: 2540235 - RNA, 19 nt, Chlamydophila pneumoniae CWL029
uuuugauucccuccuuccu

SEQ ID NO: 2540236 - RNA, 21 nt, Chlamydophila pneumoniae CWL029
uuuugauucccuccuuccuua

SEQ ID NO: 2540237 - RNA, 15 nt, Chlamydophila pneumoniae CWL029
uuuugauuuugcagu

SEQ ID NO: 2540238 - RNA, 20 nt, Chlamydophila pneumoniae CWL029
uuuugcaaaucuucgaauuu

SEQ ID NO: 2540239 - RNA, 22 nt, Chlamydophila pneumoniae CWL029
uuuugccacaacucauccuaaa

SEQ ID NO: 2540240 - RNA, 22 nt, Chlamydophila pneumoniae CWL029
uuuugccaguucuugaaacucu

SEQ ID NO: 2540241 - RNA, 17 nt, Chlamydophila pneumoniae CWL029
uuuugcuaaacaaugca

SEQ ID NO: 2540242 - RNA, 12 nt, Chlamydophila pneumoniae CWL029
uuuugcucucua

SEQ ID NO: 2540243 - RNA, 13 nt, Chlamydophila pneumoniae CWL029
uuuugcugaagau

SEQ ID NO: 2540244 - RNA, 17 nt, Chlamydophila pneumoniae CWL029
uuuugcugaagauuuuu

SEQ ID NO: 2540245 - RNA, 15 nt, Chlamydophila pneumoniae CWL029
uuuugcuuuucccuu

SEQ ID NO: 2540246 - RNA, 20 nt, Chlamydophila pneumoniae CWL029
uuuugguugugucaacccuu

SEQ ID NO: 2540247 - RNA, 20 nt, Chlamydophila pneumoniae CWL029
uuuugguuuuagaaauguuu

SEQ ID NO: 2540248 - RNA, 19 nt, Chlamydophila pneumoniae CWL029
uuuuguaaucuaagaaucu

SEQ ID NO: 2540249 - RNA, 14 nt, Chlamydophila pneumoniae CWL029
uuuuguaggaacau

SEQ ID NO: 2540250 - RNA, 22 nt, Chlamydophila pneumoniae CWL029
uuuugucgcaauaacaaacgcc

SEQ ID NO: 2540251 - RNA, 19 nt, Chlamydophila pneumoniae CWL029
uuuugugaauuuuauuuau

SEQ ID NO: 2540252 - RNA, 18 nt, Chlamydophila pneumoniae CWL029
uuuuguggcuuuucuaaa

SEQ ID NO: 2540253 - RNA, 17 nt, Chlamydophila pneumoniae CWL029
uuuuguuaaauucccaa

SEQ ID NO: 2540254 - RNA, 12 nt, Chlamydophila pneumoniae CWL029
uuuuuaaaacuc

SEQ ID NO: 2540255 - RNA, 12 nt, Chlamydophila pneumoniae CWL029
uuuuuaaauaca

SEQ ID NO: 2540256 - RNA, 17 nt, Chlamydophila pneumoniae CWL029
uuuuuaaccucuuuucu

SEQ ID NO: 2540257 - RNA, 12 nt, Chlamydophila pneumoniae CWL029
uuuuuacaugua

SEQ ID NO: 2540258 - RNA, 19 nt, Chlamydophila pneumoniae CWL029
uuuuuaggacgcuauccua

SEQ ID NO: 2540259 - RNA, 13 nt, Chlamydophila pneumoniae CWL029
uuuuuauuuaaaa

SEQ ID NO: 2540260 - RNA, 23 nt, Chlamydophila pneumoniae CWL029
uuuuucaaucaauaaaaugucca

SEQ ID NO: 2540261 - RNA, 16 nt, Chlamydophila pneumoniae CWL029
uuuuucaauccuuccu

SEQ ID NO: 2540262 - RNA, 15 nt, Chlamydophila pneumoniae CWL029
uuuuuccaacuucaa

SEQ ID NO: 2540263 - RNA, 17 nt, Chlamydophila pneumoniae CWL029
uuuuuccaacuucaacu

SEQ ID NO: 2540264 - RNA, 14 nt, Chlamydophila pneumoniae CWL029
uuuuucccucgcua

SEQ ID NO: 2540265 - RNA, 16 nt, Chlamydophila pneumoniae CWL029
uuuuucccucgcuaaa

SEQ ID NO: 2540266 - RNA, 18 nt, Chlamydophila pneumoniae CWL029
uuuuucccuuuaaaagua

SEQ ID NO: 2540267 - RNA, 18 nt, Chlamydophila pneumoniae CWL029
uuuuucuauaauaaccuc

SEQ ID NO: 2540268 - RNA, 22 nt, Chlamydophila pneumoniae CWL029
uuuuucugcuucuccaaauaaa

SEQ ID NO: 2540269 - RNA, 13 nt, Chlamydophila pneumoniae CWL029
uuuuucuuaguau

SEQ ID NO: 2540270 - RNA, 14 nt, Chlamydophila pneumoniae CWL029
uuuuugaaaacuuc

SEQ ID NO: 2540271 - RNA, 13 nt, Chlamydophila pneumoniae CWL029
uuuuugaaaauuu

SEQ ID NO: 2540272 - RNA, 20 nt, Chlamydophila pneumoniae CWL029
uuuuugaauaugauuuccac

SEQ ID NO: 2540273 - RNA, 12 nt, Chlamydophila pneumoniae CWL029
uuuuuuaaaaau

SEQ ID NO: 2540274 - RNA, 12 nt, Chlamydophila pneumoniae CWL029
uuuuuuaaagug

SEQ ID NO: 2540275 - RNA, 12 nt, Chlamydophila pneumoniae CWL029
uuuuuuaaccuc

SEQ ID NO: 2540276 - RNA, 11 nt, Chlamydophila pneumoniae CWL029
uuuuuuaauuc

SEQ ID NO: 2540277 - RNA, 12 nt, Chlamydophila pneumoniae CWL029
uuuuuucuaaau

SEQ ID NO: 2540278 - RNA, 16 nt, Chlamydophila pneumoniae J138
uucacgauaucuacca

SEQ ID NO: 2540279 - RNA, 17 nt, Chlamydophila pneumoniae J138
uucacguauagguugaa

SEQ ID NO: 2540280 - RNA, 13 nt, Chlamydophila pneumoniae J138
uucacuccugaag

SEQ ID NO: 2540281 - RNA, 19 nt, Chlamydophila pneumoniae J138
uucacuugguagcgucucu

SEQ ID NO: 2540282 - RNA, 23 nt, Chlamydophila pneumoniae J138
uucacuugguagcgucucuucuu

SEQ ID NO: 2540283 - RNA, 23 nt, Chlamydophila pneumoniae J138
uucagaaagacgaucuugagcca

SEQ ID NO: 2540284 - RNA, 16 nt, Chlamydophila pneumoniae J138
uucagaaggaucugau

SEQ ID NO: 2540285 - RNA, 15 nt, Chlamydophila pneumoniae J138
uucagaauucucaag

SEQ ID NO: 2540286 - RNA, 19 nt, Chlamydophila pneumoniae J138
uucagaguggucauugccu

SEQ ID NO: 2540287 - RNA, 16 nt, Chlamydophila pneumoniae J138
uucagaguugauuguc

SEQ ID NO: 2540288 - RNA, 21 nt, Chlamydophila pneumoniae J138
uucagaguugauugucucaac

SEQ ID NO: 2540289 - RNA, 20 nt, Chlamydophila pneumoniae J138
uucagaugauuuuaucugcg

SEQ ID NO: 2540290 - RNA, 17 nt, Chlamydophila pneumoniae J138
uucagauggucagucuc

SEQ ID NO: 2540291 - RNA, 18 nt, Chlamydophila pneumoniae J138
uucagcaaacggagagca

SEQ ID NO: 2540292 - RNA, 15 nt, Chlamydophila pneumoniae J138
uucagcaagaaaaua

SEQ ID NO: 2540293 - RNA, 21 nt, Chlamydophila pneumoniae J138
uucagcaaggaaguuauaauu

SEQ ID NO: 2540294 - RNA, 23 nt, Chlamydophila pneumoniae J138
uucagcaagucgguaauaccuuu

SEQ ID NO: 2540295 - RNA, 12 nt, Chlamydophila pneumoniae J138
uucagcacuuuu

SEQ ID NO: 2540296 - RNA, 13 nt, Chlamydophila pneumoniae J138
uucagcuuugcuu

SEQ ID NO: 2540297 - RNA, 17 nt, Chlamydophila pneumoniae J138
uucaggacaugccuuag

SEQ ID NO: 2540298 - RNA, 18 nt, Chlamydophila pneumoniae J138
uucaggacccuuuuccuc

SEQ ID NO: 2540299 - RNA, 23 nt, Chlamydophila pneumoniae J138
uucaggagaccagggaucuucau

SEQ ID NO: 2540300 - RNA, 15 nt, Chlamydophila pneumoniae J138
uucaggauuuuccau

SEQ ID NO: 2540301 - RNA, 16 nt, Chlamydophila pneumoniae J138
uucaggauuuuccauu

SEQ ID NO: 2540302 - RNA, 13 nt, Chlamydophila pneumoniae J138
uucagguucugaa

SEQ ID NO: 2540303 - RNA, 21 nt, Chlamydophila pneumoniae J138
uucaguauugcaagccgcaaa

SEQ ID NO: 2540304 - RNA, 13 nt, Chlamydophila pneumoniae J138
uucaguuccucau

SEQ ID NO: 2540305 - RNA, 13 nt, Chlamydophila pneumoniae J138
uucauaaaacugu

SEQ ID NO: 2540306 - RNA, 21 nt, Chlamydophila pneumoniae J138
uucauaacuugagccaacagg

SEQ ID NO: 2540307 - RNA, 13 nt, Chlamydophila pneumoniae J138
uucauaagauugc

SEQ ID NO: 2540308 - RNA, 13 nt, Chlamydophila pneumoniae J138
uucauacguuuuu

SEQ ID NO: 2540309 - RNA, 20 nt, Chlamydophila pneumoniae J138
uucauacuaaaaucuuucaa

SEQ ID NO: 2540310 - RNA, 16 nt, Chlamydophila pneumoniae J138
uucauauaaaguuucc

SEQ ID NO: 2540311 - RNA, 16 nt, Chlamydophila pneumoniae J138
uucauauuuacgaaaa

SEQ ID NO: 2540312 - RNA, 21 nt, Chlamydophila pneumoniae J138
uucaucacaaaauucaugcaa

SEQ ID NO: 2540313 - RNA, 17 nt, Chlamydophila pneumoniae J138
uucaucaggagaacggu

SEQ ID NO: 2540314 - RNA, 20 nt, Chlamydophila pneumoniae J138
uucuaaaaagaaaagaccuc

SEQ ID NO: 2540315 - RNA, 15 nt, Chlamydophila pneumoniae J138
uucuaaaacuucagu

SEQ ID NO: 2540316 - RNA, 16 nt, Chlamydophila pneumoniae J138
uucuaaaacuucaguu

SEQ ID NO: 2540317 - RNA, 14 nt, Chlamydophila pneumoniae J138
uucuaaaagagcaa

SEQ ID NO: 2540318 - RNA, 13 nt, Chlamydophila pneumoniae J138
uucuaaagauuuu

SEQ ID NO: 2540319 - RNA, 17 nt, Chlamydophila pneumoniae J138
uucuaaauagaaaacau

SEQ ID NO: 2540320 - RNA, 22 nt, Chlamydophila pneumoniae J138
uucuaacgcuuuuucaaacugu

SEQ ID NO: 2540321 - RNA, 20 nt, Chlamydophila pneumoniae J138
uucuaacuguacacuuucaa

SEQ ID NO: 2540322 - RNA, 12 nt, Chlamydophila pneumoniae J138
uucuaagauucc

SEQ ID NO: 2540323 - RNA, 13 nt, Chlamydophila pneumoniae J138
uucuaagauuccu

SEQ ID NO: 2540324 - RNA, 23 nt, Chlamydophila pneumoniae J138
uucuaagauuccuaacuucugaa

SEQ ID NO: 2540325 - RNA, 14 nt, Chlamydophila pneumoniae J138
uucuaagcaauauu

SEQ ID NO: 2540326 - RNA, 19 nt, Chlamydophila pneumoniae J138
uucuaagcaauauuucugu

SEQ ID NO: 2540327 - RNA, 24 nt, Chlamydophila pneumoniae J138
uucuaagcuuauuucuguaguucu

SEQ ID NO: 2540328 - RNA, 23 nt, Chlamydophila pneumoniae J138
uucuacaaugauauaaaagcuga

SEQ ID NO: 2540329 - RNA, 16 nt, Chlamydophila pneumoniae J138
uucuacacgacgagga

SEQ ID NO: 2540330 - RNA, 21 nt, Chlamydophila pneumoniae J138
uucuacaucccaagggccaga

SEQ ID NO: 2540331 - RNA, 19 nt, Chlamydophila pneumoniae J138
uucuaccuguagcuacaga

SEQ ID NO: 2540332 - RNA, 22 nt, Chlamydophila pneumoniae J138
uucuacugaaaccuucucucuu

SEQ ID NO: 2540333 - RNA, 16 nt, Chlamydophila pneumoniae J138
uucuagaaaagauucu

SEQ ID NO: 2540334 - RNA, 21 nt, Chlamydophila pneumoniae J138
uucuagaaacugcuccugaag

SEQ ID NO: 2540335 - RNA, 20 nt, Chlamydophila pneumoniae J138
uucuagcauaguguuccaaa

SEQ ID NO: 2540336 - RNA, 21 nt, Chlamydophila pneumoniae J138
uucuagcuaauaaugaagcag

SEQ ID NO: 2540337 - RNA, 15 nt, Chlamydophila pneumoniae J138
uucuagcucauuauc

SEQ ID NO: 2540338 - RNA, 21 nt, Chlamydophila pneumoniae J138
uucuagcucauuaucaagaaa

SEQ ID NO: 2540339 - RNA, 18 nt, Chlamydophila pneumoniae J138
uucuaggauuuagacuaa

SEQ ID NO: 2540340 - RNA, 20 nt, Chlamydophila pneumoniae J138
uucuagggaucccaaaaaau

SEQ ID NO: 2540341 - RNA, 20 nt, Chlamydophila pneumoniae J138
uucuaggggagguaaaauaa

SEQ ID NO: 2540342 - RNA, 21 nt, Chlamydophila pneumoniae J138
uucuauacgcuuaacaugaaa

SEQ ID NO: 2540343 - RNA, 14 nt, Chlamydophila pneumoniae J138
uucuauagcaagac

SEQ ID NO: 2540344 - RNA, 16 nt, Chlamydophila pneumoniae J138
uucuauagcaagacga

SEQ ID NO: 2540345 - RNA, 19 nt, Chlamydophila pneumoniae J138
uucuauaucauuaagaaga

SEQ ID NO: 2540346 - RNA, 13 nt, Chlamydophila pneumoniae J138
uucuauguguucu

SEQ ID NO: 2540347 - RNA, 17 nt, Chlamydophila pneumoniae J138
uucuauguguucucgaa

SEQ ID NO: 2540348 - RNA, 12 nt, Chlamydophila pneumoniae J138
uucuauuaaaaa

SEQ ID NO: 2540349 - RNA, 22 nt, Chlamydophila pneumoniae J138
uucuauucgcugucuagaacac

SEQ ID NO: 2540350 - RNA, 20 nt, Chlamydophila pneumoniae J138
uucuauuucgucgucauccc

SEQ ID NO: 2540351 - RNA, 14 nt, Chlamydophila pneumoniae J138
uucuauuuuagaau

SEQ ID NO: 2540352 - RNA, 14 nt, Chlamydophila pneumoniae J138
uucucaaagaucau

SEQ ID NO: 2540353 - RNA, 14 nt, Chlamydophila pneumoniae J138
uucucaagaucuuc

SEQ ID NO: 2540354 - RNA, 12 nt, Chlamydophila pneumoniae J138
uucucagaaaga

SEQ ID NO: 2540355 - RNA, 15 nt, Chlamydophila pneumoniae J138
uucucagaaagauau

SEQ ID NO: 2540356 - RNA, 20 nt, Chlamydophila pneumoniae J138
uucuccaaccucgagauccu

SEQ ID NO: 2540357 - RNA, 14 nt, Chlamydophila pneumoniae J138
uucuccacaugccc

SEQ ID NO: 2540358 - RNA, 19 nt, Chlamydophila pneumoniae J138
uucuccacaugcccaaaca

SEQ ID NO: 2540359 - RNA, 17 nt, Chlamydophila pneumoniae J138
uucuccagcuucuuucu

SEQ ID NO: 2540360 - RNA, 15 nt, Chlamydophila pneumoniae J138
uucucccauagcaau

SEQ ID NO: 2540361 - RNA, 16 nt, Chlamydophila pneumoniae J138
uucucccauagcaaug

SEQ ID NO: 2540362 - RNA, 20 nt, Chlamydophila pneumoniae J138
uucucccgcuaauuaccauu

SEQ ID NO: 2540363 - RNA, 18 nt, Chlamydophila pneumoniae J138
uucuccggaguauccucc

SEQ ID NO: 2540364 - RNA, 20 nt, Chlamydophila pneumoniae J138
uucuccucgcaauccaggaa

SEQ ID NO: 2540365 - RNA, 21 nt, Chlamydophila pneumoniae J138
uucuccucgcaauccaggaau

SEQ ID NO: 2540366 - RNA, 14 nt, Chlamydophila pneumoniae J138
uucuccucuuucuu

SEQ ID NO: 2540367 - RNA, 15 nt, Chlamydophila pneumoniae J138
uucuccucuuucuua

SEQ ID NO: 2540368 - RNA, 23 nt, Chlamydophila pneumoniae J138
uucuccugaaccgcaaaaagcuu

SEQ ID NO: 2540369 - RNA, 13 nt, Chlamydophila pneumoniae J138
uucucgaaaaauu

SEQ ID NO: 2540370 - RNA, 16 nt, Chlamydophila pneumoniae J138
uucucgaagcuugcug

SEQ ID NO: 2540371 - RNA, 12 nt, Chlamydophila pneumoniae J138
uucucuaaaaua

SEQ ID NO: 2540372 - RNA, 18 nt, Chlamydophila pneumoniae J138
uucucuaagcagccucuu

SEQ ID NO: 2540373 - RNA, 19 nt, Chlamydophila pneumoniae J138
uucucuaggaacucuuuaa

SEQ ID NO: 2540374 - RNA, 15 nt, Chlamydophila pneumoniae J138
uucucuaucuuuauu

SEQ ID NO: 2540375 - RNA, 21 nt, Chlamydophila pneumoniae J138
uucucuaucuuuauuuaaaua

SEQ ID NO: 2540376 - RNA, 22 nt, Chlamydophila pneumoniae J138
uucucuccacaggaaugaaacc

SEQ ID NO: 2540377 - RNA, 14 nt, Chlamydophila pneumoniae J138
uucucucucugcag

SEQ ID NO: 2540378 - RNA, 21 nt, Chlamydophila pneumoniae J138
uucucugaacuugauuuguuu

SEQ ID NO: 2540379 - RNA, 13 nt, Chlamydophila pneumoniae J138
gagaccuucucuu

SEQ ID NO: 2540380 - RNA, 13 nt, Chlamydophila pneumoniae J138
gagacguuguugc

SEQ ID NO: 2540381 - RNA, 17 nt, Chlamydophila pneumoniae J138
gagacucagagaaaauc

SEQ ID NO: 2540382 - RNA, 16 nt, Chlamydophila pneumoniae J138
gagacucuaguuuuuc

SEQ ID NO: 2540383 - RNA, 22 nt, Chlamydophila pneumoniae J138
gagacuguguuuuuaggaguug

SEQ ID NO: 2540384 - RNA, 13 nt, Chlamydophila pneumoniae J138
gagacuuccucuu

SEQ ID NO: 2540385 - RNA, 15 nt, Chlamydophila pneumoniae J138
gagacuuccucuuca

SEQ ID NO: 2540386 - RNA, 19 nt, Chlamydophila pneumoniae J138
gagacuugaucuacaaaaa

SEQ ID NO: 2540387 - RNA, 13 nt, Chlamydophila pneumoniae J138
gagagaagaaauu

SEQ ID NO: 2540388 - RNA, 18 nt, Chlamydophila pneumoniae J138
gagagaaggaauuaaaau

SEQ ID NO: 2540389 - RNA, 13 nt, Chlamydophila pneumoniae J138
gagagagacccgu

SEQ ID NO: 2540390 - RNA, 13 nt, Chlamydophila pneumoniae J138
gagagagcuggac

SEQ ID NO: 2540391 - RNA, 21 nt, Chlamydophila pneumoniae J138
gagagagcuggacuucugguu

SEQ ID NO: 2540392 - RNA, 19 nt, Chlamydophila pneumoniae J138
gagagcuugguuuucuccu

SEQ ID NO: 2540393 - RNA, 21 nt, Chlamydophila pneumoniae J138
gagagcuuucgcuccuaagcu

SEQ ID NO: 2540394 - RNA, 20 nt, Chlamydophila pneumoniae J138
gagagcuuuuagguagagaa

SEQ ID NO: 2540395 - RNA, 22 nt, Chlamydophila pneumoniae J138
gagaggaaaucccgagauauga

SEQ ID NO: 2540396 - RNA, 17 nt, Chlamydophila pneumoniae J138
gagaggagagaauccuu

SEQ ID NO: 2540397 - RNA, 15 nt, Chlamydophila pneumoniae J138
gagagguaggcagug

SEQ ID NO: 2540398 - RNA, 18 nt, Chlamydophila pneumoniae J138
gagaguagugaacacucu

SEQ ID NO: 2540399 - RNA, 19 nt, Chlamydophila pneumoniae J138
gagauacguuccagccugu

SEQ ID NO: 2540400 - RNA, 21 nt, Chlamydophila pneumoniae J138
gagauaucaucaaaagauaug

SEQ ID NO: 2540401 - RNA, 18 nt, Chlamydophila pneumoniae J138
gagauauugugaggggau

SEQ ID NO: 2540402 - RNA, 15 nt, Chlamydophila pneumoniae J138
gagaucacagggaca

SEQ ID NO: 2540403 - RNA, 15 nt, Chlamydophila pneumoniae J138
gagaucauuagcauc

SEQ ID NO: 2540404 - RNA, 17 nt, Chlamydophila pneumoniae J138
gagauccuccuggaaga

SEQ ID NO: 2540405 - RNA, 19 nt, Chlamydophila pneumoniae J138
gagaucuuauagacaggua

SEQ ID NO: 2540406 - RNA, 20 nt, Chlamydophila pneumoniae J138
gagaugcaaauccuguagaa

SEQ ID NO: 2540407 - RNA, 21 nt, Chlamydophila pneumoniae J138
gagaugccauaagcaagcaac

SEQ ID NO: 2540408 - RNA, 17 nt, Chlamydophila pneumoniae J138
gagaugcuucuaaacaa

SEQ ID NO: 2540409 - RNA, 17 nt, Chlamydophila pneumoniae J138
gagauuaccgaagagcc

SEQ ID NO: 2540410 - RNA, 15 nt, Chlamydophila pneumoniae J138
gagauucauaaaacu

SEQ ID NO: 2540411 - RNA, 22 nt, Chlamydophila pneumoniae J138
gagauuccuaaaccuaaaaugg

SEQ ID NO: 2540412 - RNA, 15 nt, Chlamydophila pneumoniae J138
gagauucgaaagaac

SEQ ID NO: 2540413 - RNA, 16 nt, Chlamydophila pneumoniae J138
gagauucuugaggacc

SEQ ID NO: 2540414 - RNA, 12 nt, Chlamydophila pneumoniae J138
gagauuuuccau

SEQ ID NO: 2540415 - RNA, 12 nt, Chlamydophila pneumoniae J138
gagauuuuucua

SEQ ID NO: 2540416 - RNA, 11 nt, Chlamydophila pneumoniae J138
gagcaaacauc

SEQ ID NO: 2540417 - RNA, 17 nt, Chlamydophila pneumoniae J138
gagcaauuaagaaacua

SEQ ID NO: 2540418 - RNA, 15 nt, Chlamydophila pneumoniae J138
gagcacaaggagaga

SEQ ID NO: 2540419 - RNA, 22 nt, Chlamydophila pneumoniae J138
gagcacuuuuaauauuugagaa

SEQ ID NO: 2540420 - RNA, 18 nt, Chlamydophila pneumoniae J138
gagcagaaacuccaaaau

SEQ ID NO: 2540421 - RNA, 16 nt, Chlamydophila pneumoniae J138
gagcauagacucuucc

SEQ ID NO: 2540422 - RNA, 21 nt, Chlamydophila pneumoniae J138
gagcauccuguagccacuaag

SEQ ID NO: 2540423 - RNA, 22 nt, Chlamydophila pneumoniae J138
gagcaucuuuucaaaagaaaag

SEQ ID NO: 2540424 - RNA, 21 nt, Chlamydophila pneumoniae J138
gagccaacagguucacuucau

SEQ ID NO: 2540425 - RNA, 18 nt, Chlamydophila pneumoniae J138
gagccuagagaguucuug

SEQ ID NO: 2540426 - RNA, 14 nt, Chlamydophila pneumoniae J138
gagccuccauaaug

SEQ ID NO: 2540427 - RNA, 13 nt, Chlamydophila pneumoniae J138
gagcgccuccacc

SEQ ID NO: 2540428 - RNA, 12 nt, Chlamydophila pneumoniae J138
gagcuaccagaa

SEQ ID NO: 2540429 - RNA, 16 nt, Chlamydophila pneumoniae J138
gagcuagaaugucuug

SEQ ID NO: 2540430 - RNA, 23 nt, Chlamydophila pneumoniae J138
gagcuaugaugagaacguccuca

SEQ ID NO: 2540431 - RNA, 19 nt, Chlamydophila pneumoniae J138
gagcuccgcuagaggaucu

SEQ ID NO: 2540432 - RNA, 17 nt, Chlamydophila pneumoniae J138
gagcucgcaaaagcugu

SEQ ID NO: 2540433 - RNA, 20 nt, Chlamydophila pneumoniae J138
gagcucguaauccuucuuuc

SEQ ID NO: 2540434 - RNA, 23 nt, Chlamydophila pneumoniae J138
gagcucuaaaaaagauaaagcua

SEQ ID NO: 2540435 - RNA, 18 nt, Chlamydophila pneumoniae J138
gagcucucgacgaacaug

SEQ ID NO: 2540436 - RNA, 14 nt, Chlamydophila pneumoniae J138
gagcugaucuucua

SEQ ID NO: 2540437 - RNA, 22 nt, Chlamydophila pneumoniae J138
gagcugcugguccuaaaaaaag

SEQ ID NO: 2540438 - RNA, 17 nt, Chlamydophila pneumoniae J138
gagcuucaaguuucuuu

SEQ ID NO: 2540439 - RNA, 18 nt, Chlamydophila pneumoniae J138
gagcuucacaucuuucuc

SEQ ID NO: 2540440 - RNA, 22 nt, Chlamydophila pneumoniae J138
gagcuuccauuggaauccuuug

SEQ ID NO: 2540441 - RNA, 16 nt, Chlamydophila pneumoniae J138
gagcuucuaagaucuu

SEQ ID NO: 2540442 - RNA, 13 nt, Chlamydophila pneumoniae J138
gagcuugucuucc

SEQ ID NO: 2540443 - RNA, 14 nt, Chlamydophila pneumoniae J138
gagcuugucuucca

SEQ ID NO: 2540444 - RNA, 15 nt, Chlamydophila pneumoniae J138
gagcuuuuacaaacc

SEQ ID NO: 2540445 - RNA, 20 nt, Chlamydophila pneumoniae J138
gagcuuuuagguagagaauc

SEQ ID NO: 2540446 - RNA, 15 nt, Chlamydophila pneumoniae J138
gagcuuuuaguaggu

SEQ ID NO: 2540447 - RNA, 15 nt, Chlamydophila pneumoniae J138
gaggaacgcacgcca

SEQ ID NO: 2540448 - RNA, 20 nt, Chlamydophila pneumoniae J138
gaggaacguuacgucuuagg

SEQ ID NO: 2540449 - RNA, 12 nt, Chlamydophila pneumoniae J138
gaggaaugaaga

SEQ ID NO: 2540450 - RNA, 13 nt, Chlamydophila pneumoniae J138
gaggaaugaagag

SEQ ID NO: 2540451 - RNA, 14 nt, Chlamydophila pneumoniae J138
gaggaauucuggaa

SEQ ID NO: 2540452 - RNA, 23 nt, Chlamydophila pneumoniae J138
gaggaccgaaaaaccuucuccaa

SEQ ID NO: 2540453 - RNA, 14 nt, Chlamydophila pneumoniae J138
gaggacgaaucaau

SEQ ID NO: 2540454 - RNA, 15 nt, Chlamydophila pneumoniae J138
gaggacgcagagaug

SEQ ID NO: 2540455 - RNA, 15 nt, Chlamydophila pneumoniae J138
gaggagaagucgaaa

SEQ ID NO: 2540456 - RNA, 20 nt, Chlamydophila pneumoniae J138
gaggagaauagcaagcacuu

SEQ ID NO: 2540457 - RNA, 23 nt, Chlamydophila pneumoniae J138
gaggagcuauuaaauuaucagag

SEQ ID NO: 2540458 - RNA, 18 nt, Chlamydophila pneumoniae J138
gaggagcucccucuagag

SEQ ID NO: 2540459 - RNA, 15 nt, Chlamydophila pneumoniae J138
gaggagggaaacacc

SEQ ID NO: 2540460 - RNA, 19 nt, Chlamydophila pneumoniae J138
gaggauaaaugaguggguu

SEQ ID NO: 2540461 - RNA, 16 nt, Chlamydophila pneumoniae J138
gaggauugacaaucgc

SEQ ID NO: 2540462 - RNA, 15 nt, Chlamydophila pneumoniae J138
gaggcaagucucaaa

SEQ ID NO: 2540463 - RNA, 13 nt, Chlamydophila pneumoniae J138
gaggcccgaagca

SEQ ID NO: 2540464 - RNA, 21 nt, Chlamydophila pneumoniae J138
gaggcuagaaaaucauacgcc

SEQ ID NO: 2540465 - RNA, 16 nt, Chlamydophila pneumoniae J138
gaggcuguccuugcag

SEQ ID NO: 2540466 - RNA, 22 nt, Chlamydophila pneumoniae J138
gaggcuucugagcuugccuacc

SEQ ID NO: 2540467 - RNA, 11 nt, Chlamydophila pneumoniae J138
gagggauuugu

SEQ ID NO: 2540468 - RNA, 23 nt, Chlamydophila pneumoniae J138
gagggguaaaccaauugagcucu

SEQ ID NO: 2540469 - RNA, 13 nt, Chlamydophila pneumoniae J138
gagggucucagca

SEQ ID NO: 2540470 - RNA, 16 nt, Chlamydophila pneumoniae J138
gaggguuccaagagcu

SEQ ID NO: 2540471 - RNA, 17 nt, Chlamydophila pneumoniae J138
gagguaaccagagagcu

SEQ ID NO: 2540472 - RNA, 23 nt, Chlamydophila pneumoniae J138
gagguccuuggcauucaggagca

SEQ ID NO: 2540473 - RNA, 18 nt, Chlamydophila pneumoniae J138
gaggucuuugaguagcca

SEQ ID NO: 2540474 - RNA, 20 nt, Chlamydophila pneumoniae J138
gaggucuuuucuuuuuagaa

SEQ ID NO: 2540475 - RNA, 15 nt, Chlamydophila pneumoniae J138
gagguuagaagggag

SEQ ID NO: 2540476 - RNA, 13 nt, Chlamydophila pneumoniae J138
gagguuauguacu

SEQ ID NO: 2540477 - RNA, 16 nt, Chlamydophila pneumoniae J138
gagguucgcagaacuu

SEQ ID NO: 2540478 - RNA, 22 nt, Chlamydophila pneumoniae J138
gagguucgcagaacuucuccaa

SEQ ID NO: 2540479 - RNA, 17 nt, Chlamydophila pneumoniae J138
gaguaaggaacaaugua

SEQ ID NO: 2540480 - RNA, 16 nt, Chlamydophila pneumoniae J138
agucauaagcucuauu

SEQ ID NO: 2540481 - RNA, 23 nt, Chlamydophila pneumoniae J138
agucauguccguucgagagguuc

SEQ ID NO: 2540482 - RNA, 13 nt, Chlamydophila pneumoniae J138
aguccaagaucaa

SEQ ID NO: 2540483 - RNA, 16 nt, Chlamydophila pneumoniae J138
aguccaagaucaaacg

SEQ ID NO: 2540484 - RNA, 10 nt, Chlamydophila pneumoniae J138
aguccacauc

SEQ ID NO: 2540485 - RNA, 16 nt, Chlamydophila pneumoniae J138
aguccagacuuuccuc

SEQ ID NO: 2540486 - RNA, 15 nt, Chlamydophila pneumoniae J138
aguccaguuuguuga

SEQ ID NO: 2540487 - RNA, 16 nt, Chlamydophila pneumoniae J138
agucccccuaagggcu

SEQ ID NO: 2540488 - RNA, 23 nt, Chlamydophila pneumoniae J138
agucccccuaagggcucuagaua

SEQ ID NO: 2540489 - RNA, 18 nt, Chlamydophila pneumoniae J138
agucccuugucaacaaaa

SEQ ID NO: 2540490 - RNA, 15 nt, Chlamydophila pneumoniae J138
aguccucuaugguuu

SEQ ID NO: 2540491 - RNA, 19 nt, Chlamydophila pneumoniae J138
aguccugcaggcuucacca

SEQ ID NO: 2540492 - RNA, 18 nt, Chlamydophila pneumoniae J138
aguccuguauauucugaa

SEQ ID NO: 2540493 - RNA, 19 nt, Chlamydophila pneumoniae J138
aguccuucuugcaaagaua

SEQ ID NO: 2540494 - RNA, 23 nt, Chlamydophila pneumoniae J138
aguccuuuaccaucgucuccaaa

SEQ ID NO: 2540495 - RNA, 13 nt, Chlamydophila pneumoniae J138
agucgagaaacaa

SEQ ID NO: 2540496 - RNA, 21 nt, Chlamydophila pneumoniae J138
agucgagaaacaaaaucuuuu

SEQ ID NO: 2540497 - RNA, 15 nt, Chlamydophila pneumoniae J138
agucgcuagaucaca

SEQ ID NO: 2540498 - RNA, 19 nt, Chlamydophila pneumoniae J138
agucgggaccauaaagaau

SEQ ID NO: 2540499 - RNA, 19 nt, Chlamydophila pneumoniae J138
agucgugagaagcaucuuc

SEQ ID NO: 2540500 - RNA, 14 nt, Chlamydophila pneumoniae J138
agucgugcaggaga

SEQ ID NO: 2540501 - RNA, 21 nt, Chlamydophila pneumoniae J138
agucguuuucucgaauagaaa

SEQ ID NO: 2540502 - RNA, 23 nt, Chlamydophila pneumoniae J138
agucuauagccucuucuacacca

SEQ ID NO: 2540503 - RNA, 17 nt, Chlamydophila pneumoniae J138
agucuauuugaaaagaa

SEQ ID NO: 2540504 - RNA, 22 nt, Chlamydophila pneumoniae J138
agucuauuugaaaagaaagaau

SEQ ID NO: 2540505 - RNA, 20 nt, Chlamydophila pneumoniae J138
agucucacucuuuucuagaa

SEQ ID NO: 2540506 - RNA, 16 nt, Chlamydophila pneumoniae J138
agucucaguugagaac

SEQ ID NO: 2540507 - RNA, 23 nt, Chlamydophila pneumoniae J138
agucucauggauuacugaagauc

SEQ ID NO: 2540508 - RNA, 18 nt, Chlamydophila pneumoniae J138
agucuccuggaacaguau

SEQ ID NO: 2540509 - RNA, 23 nt, Chlamydophila pneumoniae J138
agucucgguuuccugaagaugag

SEQ ID NO: 2540510 - RNA, 15 nt, Chlamydophila pneumoniae J138
agucucucuaaggga

SEQ ID NO: 2540511 - RNA, 14 nt, Chlamydophila pneumoniae J138
agucucucuaucua

SEQ ID NO: 2540512 - RNA, 17 nt, Chlamydophila pneumoniae J138
agucugaacauucuuaa

SEQ ID NO: 2540513 - RNA, 17 nt, Chlamydophila pneumoniae J138
agucugcagcagaugaa

SEQ ID NO: 2540514 - RNA, 15 nt, Chlamydophila pneumoniae J138
agucuggcauaaguc

SEQ ID NO: 2540515 - RNA, 18 nt, Chlamydophila pneumoniae J138
agucugguuuuucuccug

SEQ ID NO: 2540516 - RNA, 18 nt, Chlamydophila pneumoniae J138
agucugugagaaauaggu

SEQ ID NO: 2540517 - RNA, 18 nt, Chlamydophila pneumoniae J138
agucuguuuuggaaagaa

SEQ ID NO: 2540518 - RNA, 16 nt, Chlamydophila pneumoniae J138
agucuucccucuccuu

SEQ ID NO: 2540519 - RNA, 17 nt, Chlamydophila pneumoniae J138
agucuucccucuccuug

SEQ ID NO: 2540520 - RNA, 19 nt, Chlamydophila pneumoniae J138
agucuucuuagaaagacua

SEQ ID NO: 2540521 - RNA, 17 nt, Chlamydophila pneumoniae J138
agucuugaguucuuuug

SEQ ID NO: 2540522 - RNA, 15 nt, Chlamydophila pneumoniae J138
agucuugcgccagca

SEQ ID NO: 2540523 - RNA, 20 nt, Chlamydophila pneumoniae J138
agucuugcgccagcaaagau

SEQ ID NO: 2540524 - RNA, 17 nt, Chlamydophila pneumoniae J138
agucuuucuaagaagac

SEQ ID NO: 2540525 - RNA, 14 nt, Chlamydophila pneumoniae J138
agucuuuuucagaa

SEQ ID NO: 2540526 - RNA, 22 nt, Chlamydophila pneumoniae J138
agugaacuuuuguacacagaga

SEQ ID NO: 2540527 - RNA, 16 nt, Chlamydophila pneumoniae J138
agugaagacaaguaaa

SEQ ID NO: 2540528 - RNA, 23 nt, Chlamydophila pneumoniae J138
agugaagacaaguaaacagcaaa

SEQ ID NO: 2540529 - RNA, 20 nt, Chlamydophila pneumoniae J138
agugaagcugcuucuucaga

SEQ ID NO: 2540530 - RNA, 17 nt, Chlamydophila pneumoniae J138
agugaaugagcuucaca

SEQ ID NO: 2540531 - RNA, 22 nt, Chlamydophila pneumoniae J138
agugaaugagcuucacaucuuu

SEQ ID NO: 2540532 - RNA, 16 nt, Chlamydophila pneumoniae J138
agugacaccaacaaca

SEQ ID NO: 2540533 - RNA, 17 nt, Chlamydophila pneumoniae J138
agugacaccaacaacaa

SEQ ID NO: 2540534 - RNA, 16 nt, Chlamydophila pneumoniae J138
agugacuuccuccaaa

SEQ ID NO: 2540535 - RNA, 14 nt, Chlamydophila pneumoniae J138
agugacuuuucuuc

SEQ ID NO: 2540536 - RNA, 14 nt, Chlamydophila pneumoniae J138
agugagaucaaaaa

SEQ ID NO: 2540537 - RNA, 21 nt, Chlamydophila pneumoniae J138
agugaggccuccauuucuagg

SEQ ID NO: 2540538 - RNA, 15 nt, Chlamydophila pneumoniae J138
agugauaaggaagaa

SEQ ID NO: 2540539 - RNA, 14 nt, Chlamydophila pneumoniae J138
agugauggggauua

SEQ ID NO: 2540540 - RNA, 14 nt, Chlamydophila pneumoniae J138
agugauuccuguca

SEQ ID NO: 2540541 - RNA, 18 nt, Chlamydophila pneumoniae J138
agugccaagagcaucaca

SEQ ID NO: 2540542 - RNA, 15 nt, Chlamydophila pneumoniae J138
agugcucaguaaaua

SEQ ID NO: 2540543 - RNA, 13 nt, Chlamydophila pneumoniae J138
agugcugccauga

SEQ ID NO: 2540544 - RNA, 15 nt, Chlamydophila pneumoniae J138
agugcuuucaggagu

SEQ ID NO: 2540545 - RNA, 20 nt, Chlamydophila pneumoniae J138
aguggaaauugugaaaaaaa

SEQ ID NO: 2540546 - RNA, 17 nt, Chlamydophila pneumoniae J138
aguggacggggagagcc

SEQ ID NO: 2540547 - RNA, 19 nt, Chlamydophila pneumoniae J138
aguggacuauagaugccau

SEQ ID NO: 2540548 - RNA, 18 nt, Chlamydophila pneumoniae J138
aguggcuuauagagagaa

SEQ ID NO: 2540549 - RNA, 19 nt, Chlamydophila pneumoniae J138
aguggcuuauagagagaau

SEQ ID NO: 2540550 - RNA, 23 nt, Chlamydophila pneumoniae J138
aguguaacauugaccuaaaggaa

SEQ ID NO: 2540551 - RNA, 15 nt, Chlamydophila pneumoniae J138
aguguauaacguaga

SEQ ID NO: 2540552 - RNA, 18 nt, Chlamydophila pneumoniae J138
aguguauaucagcaaaaa

SEQ ID NO: 2540553 - RNA, 16 nt, Chlamydophila pneumoniae J138
agugucauacgcagca

SEQ ID NO: 2540554 - RNA, 17 nt, Chlamydophila pneumoniae J138
agugucauacgcagcac

SEQ ID NO: 2540555 - RNA, 19 nt, Chlamydophila pneumoniae J138
agugucaucggcuucucca

SEQ ID NO: 2540556 - RNA, 20 nt, Chlamydophila pneumoniae J138
agugucaucggcuucuccaa

SEQ ID NO: 2540557 - RNA, 21 nt, Chlamydophila pneumoniae J138
agugucaucggcuucuccaac

SEQ ID NO: 2540558 - RNA, 15 nt, Chlamydophila pneumoniae J138
agugucuaagauaua

SEQ ID NO: 2540559 - RNA, 21 nt, Chlamydophila pneumoniae J138
agugugguuuaccuuguuuuc

SEQ ID NO: 2540560 - RNA, 11 nt, Chlamydophila pneumoniae J138
aguguguuuca

SEQ ID NO: 2540561 - RNA, 15 nt, Chlamydophila pneumoniae J138
aguguguuucaaaca

SEQ ID NO: 2540562 - RNA, 16 nt, Chlamydophila pneumoniae J138
aguguguuucaaacaa

SEQ ID NO: 2540563 - RNA, 18 nt, Chlamydophila pneumoniae J138
aguguucgagcaucucaa

SEQ ID NO: 2540564 - RNA, 22 nt, Chlamydophila pneumoniae J138
aguguuguuggagcagaaacuc

SEQ ID NO: 2540565 - RNA, 16 nt, Chlamydophila pneumoniae J138
aguguuucuuuaucua

SEQ ID NO: 2540566 - RNA, 16 nt, Chlamydophila pneumoniae J138
aguuaaagagcauccu

SEQ ID NO: 2540567 - RNA, 19 nt, Chlamydophila pneumoniae J138
aguuaacuguguaugaauc

SEQ ID NO: 2540568 - RNA, 19 nt, Chlamydophila pneumoniae J138
aguuacgcgaccucuguag

SEQ ID NO: 2540569 - RNA, 16 nt, Chlamydophila pneumoniae J138
aguuagaagagucauu

SEQ ID NO: 2540570 - RNA, 18 nt, Chlamydophila pneumoniae J138
aguuagagacacagaagg

SEQ ID NO: 2540571 - RNA, 20 nt, Chlamydophila pneumoniae J138
aguuagauguaaucauaaaa

SEQ ID NO: 2540572 - RNA, 23 nt, Chlamydophila pneumoniae J138
aguuaggaucccugauuccuugg

SEQ ID NO: 2540573 - RNA, 13 nt, Chlamydophila pneumoniae J138
aguuaucaaaagg

SEQ ID NO: 2540574 - RNA, 14 nt, Chlamydophila pneumoniae J138
aguucaauuucuau

SEQ ID NO: 2540575 - RNA, 13 nt, Chlamydophila pneumoniae J138
aguucacaagcag

SEQ ID NO: 2540576 - RNA, 22 nt, Chlamydophila pneumoniae J138
aguucacaagugcauuaucuaa

SEQ ID NO: 2540577 - RNA, 17 nt, Chlamydophila pneumoniae J138
aguucauaaccugggca

SEQ ID NO: 2540578 - RNA, 16 nt, Chlamydophila pneumoniae J138
aguucaucuagaugau

SEQ ID NO: 2540579 - RNA, 15 nt, Chlamydophila pneumoniae J138
aguucaugggguuuc

SEQ ID NO: 2540580 - RNA, 20 nt, Chlamydophila pneumoniae J138
aguucaugggguuucuuuuu

SEQ ID NO: 2540581 - RNA, 12 nt, Chlamydophila pneumoniae J138
auagccaaagac

SEQ ID NO: 2540582 - RNA, 15 nt, Chlamydophila pneumoniae J138
auagccaaagacucu

SEQ ID NO: 2540583 - RNA, 16 nt, Chlamydophila pneumoniae J138
auagccaaagacucuu

SEQ ID NO: 2540584 - RNA, 19 nt, Chlamydophila pneumoniae J138
auagccauaauuagaacag

SEQ ID NO: 2540585 - RNA, 17 nt, Chlamydophila pneumoniae J138
auagccaucauagcaaa

SEQ ID NO: 2540586 - RNA, 18 nt, Chlamydophila pneumoniae J138
auagccaucauagcaaac

SEQ ID NO: 2540587 - RNA, 22 nt, Chlamydophila pneumoniae J138
auagccauuagaaucucugccc

SEQ ID NO: 2540588 - RNA, 20 nt, Chlamydophila pneumoniae J138
auagccgacaugcuuuccuu

SEQ ID NO: 2540589 - RNA, 21 nt, Chlamydophila pneumoniae J138
auagccgacaugcuuuccuuc

SEQ ID NO: 2540590 - RNA, 16 nt, Chlamydophila pneumoniae J138
auagccgagaucuuug

SEQ ID NO: 2540591 - RNA, 18 nt, Chlamydophila pneumoniae J138
auagccuccauuuagaca

SEQ ID NO: 2540592 - RNA, 19 nt, Chlamydophila pneumoniae J138
auagcgaaagucaaagggc

SEQ ID NO: 2540593 - RNA, 19 nt, Chlamydophila pneumoniae J138
auagcgacaugagaaaucu

SEQ ID NO: 2540594 - RNA, 13 nt, Chlamydophila pneumoniae J138
auagcgagaacac

SEQ ID NO: 2540595 - RNA, 20 nt, Chlamydophila pneumoniae J138
auagcggucacugugauuuu

SEQ ID NO: 2540596 - RNA, 17 nt, Chlamydophila pneumoniae J138
auagcuaugaguugcuu

SEQ ID NO: 2540597 - RNA, 12 nt, Chlamydophila pneumoniae J138
auagcuccuugg

SEQ ID NO: 2540598 - RNA, 20 nt, Chlamydophila pneumoniae J138
auagcucguuauauuuuucu

SEQ ID NO: 2540599 - RNA, 14 nt, Chlamydophila pneumoniae J138
auagcucuuuucau

SEQ ID NO: 2540600 - RNA, 19 nt, Chlamydophila pneumoniae J138
auagcugaggcaucuauug

SEQ ID NO: 2540601 - RNA, 17 nt, Chlamydophila pneumoniae J138
auagcuggaucuucuga

SEQ ID NO: 2540602 - RNA, 21 nt, Chlamydophila pneumoniae J138
auagcuggcaaugauauccuc

SEQ ID NO: 2540603 - RNA, 23 nt, Chlamydophila pneumoniae J138
auagcuggcaaugauauccucaa

SEQ ID NO: 2540604 - RNA, 21 nt, Chlamydophila pneumoniae J138
auagcuggggauuaguagcua

SEQ ID NO: 2540605 - RNA, 15 nt, Chlamydophila pneumoniae J138
auagcuuccuguagu

SEQ ID NO: 2540606 - RNA, 21 nt, Chlamydophila pneumoniae J138
auagcuucugacucuguugca

SEQ ID NO: 2540607 - RNA, 14 nt, Chlamydophila pneumoniae J138
auagcuuugaagag

SEQ ID NO: 2540608 - RNA, 13 nt, Chlamydophila pneumoniae J138
auaggaagcucuu

SEQ ID NO: 2540609 - RNA, 16 nt, Chlamydophila pneumoniae J138
auaggaauuagagaaa

SEQ ID NO: 2540610 - RNA, 23 nt, Chlamydophila pneumoniae J138
auaggaauugcagcaaggagagu

SEQ ID NO: 2540611 - RNA, 13 nt, Chlamydophila pneumoniae J138
auaggauaagaaa

SEQ ID NO: 2540612 - RNA, 15 nt, Chlamydophila pneumoniae J138
auaggauaagaaauu

SEQ ID NO: 2540613 - RNA, 16 nt, Chlamydophila pneumoniae J138
auaggauccaggaguu

SEQ ID NO: 2540614 - RNA, 14 nt, Chlamydophila pneumoniae J138
auaggaucugcaug

SEQ ID NO: 2540615 - RNA, 15 nt, Chlamydophila pneumoniae J138
auaggcaaguguuuu

SEQ ID NO: 2540616 - RNA, 13 nt, Chlamydophila pneumoniae J138
auaggcauuacac

SEQ ID NO: 2540617 - RNA, 19 nt, Chlamydophila pneumoniae J138
auaggcauuacacaacucu

SEQ ID NO: 2540618 - RNA, 20 nt, Chlamydophila pneumoniae J138
auaggcauuacacaacucuu

SEQ ID NO: 2540619 - RNA, 20 nt, Chlamydophila pneumoniae J138
auaggccaagagcuugucuu

SEQ ID NO: 2540620 - RNA, 20 nt, Chlamydophila pneumoniae J138
auaggcucuuuagcaaacau

SEQ ID NO: 2540621 - RNA, 22 nt, Chlamydophila pneumoniae J138
auaggcucuuuagcaaacauuu

SEQ ID NO: 2540622 - RNA, 12 nt, Chlamydophila pneumoniae J138
auagggaauuuc

SEQ ID NO: 2540623 - RNA, 20 nt, Chlamydophila pneumoniae J138
auagggaucuccuugagaga

SEQ ID NO: 2540624 - RNA, 19 nt, Chlamydophila pneumoniae J138
auagggcaggcggaaagga

SEQ ID NO: 2540625 - RNA, 22 nt, Chlamydophila pneumoniae J138
auagggcaggcggaaaggaagg

SEQ ID NO: 2540626 - RNA, 13 nt, Chlamydophila pneumoniae J138
auagguagaggca

SEQ ID NO: 2540627 - RNA, 18 nt, Chlamydophila pneumoniae J138
auaguaaacagaagugcu

SEQ ID NO: 2540628 - RNA, 13 nt, Chlamydophila pneumoniae J138
auaguagaacugc

SEQ ID NO: 2540629 - RNA, 21 nt, Chlamydophila pneumoniae J138
auaguagcgaauccagaauuu

SEQ ID NO: 2540630 - RNA, 22 nt, Chlamydophila pneumoniae J138
auaguauaauagugagcucccu

SEQ ID NO: 2540631 - RNA, 13 nt, Chlamydophila pneumoniae J138
auaguauuuuuaa

SEQ ID NO: 2540632 - RNA, 14 nt, Chlamydophila pneumoniae J138
auaguauuuuuaaa

SEQ ID NO: 2540633 - RNA, 15 nt, Chlamydophila pneumoniae J138
auaguauuuuuaaau

SEQ ID NO: 2540634 - RNA, 16 nt, Chlamydophila pneumoniae J138
auaguauuuuuaaaua

SEQ ID NO: 2540635 - RNA, 23 nt, Chlamydophila pneumoniae J138
auaguguauaucagcaaaaaacu

SEQ ID NO: 2540636 - RNA, 15 nt, Chlamydophila pneumoniae J138
auaguguuccaaaac

SEQ ID NO: 2540637 - RNA, 23 nt, Chlamydophila pneumoniae J138
auaguguucgagcaucucaagag

SEQ ID NO: 2540638 - RNA, 16 nt, Chlamydophila pneumoniae J138
auaguuaaauuuccaa

SEQ ID NO: 2540639 - RNA, 18 nt, Chlamydophila pneumoniae J138
auaguugcaugacuauuu

SEQ ID NO: 2540640 - RNA, 21 nt, Chlamydophila pneumoniae J138
auaguugcaugacuauuuuca

SEQ ID NO: 2540641 - RNA, 16 nt, Chlamydophila pneumoniae J138
auaguuuuuauuuuua

SEQ ID NO: 2540642 - RNA, 20 nt, Chlamydophila pneumoniae J138
auaguuuuuauuuuuaaaua

SEQ ID NO: 2540643 - RNA, 17 nt, Chlamydophila pneumoniae J138
auauaaagacucucuuc

SEQ ID NO: 2540644 - RNA, 15 nt, Chlamydophila pneumoniae J138
auauaaagaucuuuu

SEQ ID NO: 2540645 - RNA, 19 nt, Chlamydophila pneumoniae J138
auauaaaugcuauuuuccu

SEQ ID NO: 2540646 - RNA, 20 nt, Chlamydophila pneumoniae J138
auauaagauaauagagaaga

SEQ ID NO: 2540647 - RNA, 21 nt, Chlamydophila pneumoniae J138
auauaauaguggcuauacccu

SEQ ID NO: 2540648 - RNA, 15 nt, Chlamydophila pneumoniae J138
auauaaucguuuuuu

SEQ ID NO: 2540649 - RNA, 15 nt, Chlamydophila pneumoniae J138
auauaccacuacuga

SEQ ID NO: 2540650 - RNA, 18 nt, Chlamydophila pneumoniae J138
auauacuuauaccacccc

SEQ ID NO: 2540651 - RNA, 20 nt, Chlamydophila pneumoniae J138
auauagagagcgcagagucu

SEQ ID NO: 2540652 - RNA, 12 nt, Chlamydophila pneumoniae J138
auauagagaucu

SEQ ID NO: 2540653 - RNA, 16 nt, Chlamydophila pneumoniae J138
auauagcguacaggaa

SEQ ID NO: 2540654 - RNA, 19 nt, Chlamydophila pneumoniae J138
auauaggcgugugaaaucu

SEQ ID NO: 2540655 - RNA, 19 nt, Chlamydophila pneumoniae J138
auauagggagacuuugcca

SEQ ID NO: 2540656 - RNA, 16 nt, Chlamydophila pneumoniae J138
auaucaaagaucugaa

SEQ ID NO: 2540657 - RNA, 16 nt, Chlamydophila pneumoniae J138
auaucaaagcauugca

SEQ ID NO: 2540658 - RNA, 16 nt, Chlamydophila pneumoniae J138
cugaagggacagucuc

SEQ ID NO: 2540659 - RNA, 20 nt, Chlamydophila pneumoniae J138
cugaagucagugcuucuugg

SEQ ID NO: 2540660 - RNA, 16 nt, Chlamydophila pneumoniae J138
cugaauagcucuuuuc

SEQ ID NO: 2540661 - RNA, 22 nt, Chlamydophila pneumoniae J138
cugaauagcucuuuucaugaua

SEQ ID NO: 2540662 - RNA, 23 nt, Chlamydophila pneumoniae J138
cugaauagcucuuuucaugauaa

SEQ ID NO: 2540663 - RNA, 18 nt, Chlamydophila pneumoniae J138
cugaauaugcuuuucaaa

SEQ ID NO: 2540664 - RNA, 23 nt, Chlamydophila pneumoniae J138
cugaauaugcuuuucaaauauug

SEQ ID NO: 2540665 - RNA, 18 nt, Chlamydophila pneumoniae J138
cugaaucccguuaaaaaa

SEQ ID NO: 2540666 - RNA, 17 nt, Chlamydophila pneumoniae J138
cugacaaauagaaagga

SEQ ID NO: 2540667 - RNA, 15 nt, Chlamydophila pneumoniae J138
cugacacagagcuuc

SEQ ID NO: 2540668 - RNA, 18 nt, Chlamydophila pneumoniae J138
cugacacucagcucccau

SEQ ID NO: 2540669 - RNA, 15 nt, Chlamydophila pneumoniae J138
cugacacuccucaga

SEQ ID NO: 2540670 - RNA, 18 nt, Chlamydophila pneumoniae J138
cugaccaucaaugagauc

SEQ ID NO: 2540671 - RNA, 16 nt, Chlamydophila pneumoniae J138
cugacgugcauugaau

SEQ ID NO: 2540672 - RNA, 15 nt, Chlamydophila pneumoniae J138
cugacuauaaaaugc

SEQ ID NO: 2540673 - RNA, 20 nt, Chlamydophila pneumoniae J138
cugacucuuauugcagaauc

SEQ ID NO: 2540674 - RNA, 19 nt, Chlamydophila pneumoniae J138
cugacuugcaagcuucuug

SEQ ID NO: 2540675 - RNA, 15 nt, Chlamydophila pneumoniae J138
cugagaaguuaagac

SEQ ID NO: 2540676 - RNA, 17 nt, Chlamydophila pneumoniae J138
cugagaauacaacccuu

SEQ ID NO: 2540677 - RNA, 18 nt, Chlamydophila pneumoniae J138
cugagaauacaacccuuu

SEQ ID NO: 2540678 - RNA, 21 nt, Chlamydophila pneumoniae J138
cugagaauacaacccuuuaua

SEQ ID NO: 2540679 - RNA, 23 nt, Chlamydophila pneumoniae J138
cugagaauacaacccuuuauacu

SEQ ID NO: 2540680 - RNA, 16 nt, Chlamydophila pneumoniae J138
cugagaccauaaaauc

SEQ ID NO: 2540681 - RNA, 19 nt, Chlamydophila pneumoniae J138
cugagaccauaaaaucaac

SEQ ID NO: 2540682 - RNA, 18 nt, Chlamydophila pneumoniae J138
cugagagaagcagaaucu

SEQ ID NO: 2540683 - RNA, 17 nt, Chlamydophila pneumoniae J138
cugagagauuuuuucau

SEQ ID NO: 2540684 - RNA, 16 nt, Chlamydophila pneumoniae J138
cugagcaacuucuucg

SEQ ID NO: 2540685 - RNA, 23 nt, Chlamydophila pneumoniae J138
cugagcaacuucuucguuagaga

SEQ ID NO: 2540686 - RNA, 13 nt, Chlamydophila pneumoniae J138
cugagcagcuucg

SEQ ID NO: 2540687 - RNA, 18 nt, Chlamydophila pneumoniae J138
cugagccugugauaguag

SEQ ID NO: 2540688 - RNA, 14 nt, Chlamydophila pneumoniae J138
cugagcuaucuuca

SEQ ID NO: 2540689 - RNA, 16 nt, Chlamydophila pneumoniae J138
cugagcuaucuucaag

SEQ ID NO: 2540690 - RNA, 17 nt, Chlamydophila pneumoniae J138
cugagcuucuauuucua

SEQ ID NO: 2540691 - RNA, 17 nt, Chlamydophila pneumoniae J138
cugaggacgcagagaug

SEQ ID NO: 2540692 - RNA, 22 nt, Chlamydophila pneumoniae J138
cugaggcuauagaauacacagc

SEQ ID NO: 2540693 - RNA, 16 nt, Chlamydophila pneumoniae J138
cugagguuauuuaauc

SEQ ID NO: 2540694 - RNA, 14 nt, Chlamydophila pneumoniae J138
cugagguugggcag

SEQ ID NO: 2540695 - RNA, 21 nt, Chlamydophila pneumoniae J138
cugaguauuuugcaaaugaaa

SEQ ID NO: 2540696 - RNA, 21 nt, Chlamydophila pneumoniae J138
cugagucauaagcucuauuuc

SEQ ID NO: 2540697 - RNA, 16 nt, Chlamydophila pneumoniae J138
cugagugauguuugac

SEQ ID NO: 2540698 - RNA, 17 nt, Chlamydophila pneumoniae J138
cugauaaaauaaacucu

SEQ ID NO: 2540699 - RNA, 20 nt, Chlamydophila pneumoniae J138
cugauaaucagaggagccuc

SEQ ID NO: 2540700 - RNA, 19 nt, Chlamydophila pneumoniae J138
cugauacgcagcuagaggc

SEQ ID NO: 2540701 - RNA, 14 nt, Chlamydophila pneumoniae J138
cugauccagcucca

SEQ ID NO: 2540702 - RNA, 17 nt, Chlamydophila pneumoniae J138
cugauccagcuccauaa

SEQ ID NO: 2540703 - RNA, 16 nt, Chlamydophila pneumoniae J138
cugaugaaaaagcuga

SEQ ID NO: 2540704 - RNA, 14 nt, Chlamydophila pneumoniae J138
cugaugaccucauc

SEQ ID NO: 2540705 - RNA, 17 nt, Chlamydophila pneumoniae J138
cugaugaccucaucucg

SEQ ID NO: 2540706 - RNA, 14 nt, Chlamydophila pneumoniae J138
cugaugccaagaaa

SEQ ID NO: 2540707 - RNA, 22 nt, Chlamydophila pneumoniae J138
cugaugccaagaaauauacugc

SEQ ID NO: 2540708 - RNA, 22 nt, Chlamydophila pneumoniae J138
cugaugcugaggacgcagagau

SEQ ID NO: 2540709 - RNA, 21 nt, Chlamydophila pneumoniae J138
cugauguaggugauauuuucu

SEQ ID NO: 2540710 - RNA, 23 nt, Chlamydophila pneumoniae J138
cugauguaggugauauuuucuug

SEQ ID NO: 2540711 - RNA, 17 nt, Chlamydophila pneumoniae J138
cugaugucuccauacag

SEQ ID NO: 2540712 - RNA, 20 nt, Chlamydophila pneumoniae J138
cugauuaguucucuaagacu

SEQ ID NO: 2540713 - RNA, 13 nt, Chlamydophila pneumoniae J138
cugauucucccaa

SEQ ID NO: 2540714 - RNA, 19 nt, Chlamydophila pneumoniae J138
cugauucucccaauaucca

SEQ ID NO: 2540715 - RNA, 16 nt, Chlamydophila pneumoniae J138
cugauuucuuuuucag

SEQ ID NO: 2540716 - RNA, 20 nt, Chlamydophila pneumoniae J138
cuguagggaaagacucaucu

SEQ ID NO: 2540717 - RNA, 21 nt, Chlamydophila pneumoniae J138
cuguagguuuuuccaacuuca

SEQ ID NO: 2540718 - RNA, 19 nt, Chlamydophila pneumoniae J138
cuguaguuagcauugcuug

SEQ ID NO: 2540719 - RNA, 18 nt, Chlamydophila pneumoniae J138
cuguauagaaacuguuaa

SEQ ID NO: 2540720 - RNA, 16 nt, Chlamydophila pneumoniae J138
cuguaucgacuguaca

SEQ ID NO: 2540721 - RNA, 21 nt, Chlamydophila pneumoniae J138
cuguaucgauaacgauuucuu

SEQ ID NO: 2540722 - RNA, 23 nt, Chlamydophila pneumoniae J138
cuguauuuuauagcguugauucc

SEQ ID NO: 2540723 - RNA, 19 nt, Chlamydophila pneumoniae J138
cugucaauccaacaaagau

SEQ ID NO: 2540724 - RNA, 15 nt, Chlamydophila pneumoniae J138
cugucacuaucuucu

SEQ ID NO: 2540725 - RNA, 15 nt, Chlamydophila pneumoniae J138
cugucagaacaagaa

SEQ ID NO: 2540726 - RNA, 17 nt, Chlamydophila pneumoniae J138
cugucagaacaagaagu

SEQ ID NO: 2540727 - RNA, 20 nt, Chlamydophila pneumoniae J138
cugucauguauccgaaaucu

SEQ ID NO: 2540728 - RNA, 14 nt, Chlamydophila pneumoniae J138
cugucauuaaaaau

SEQ ID NO: 2540729 - RNA, 21 nt, Chlamydophila pneumoniae J138
cugucauuaaaaauuuaaaag

SEQ ID NO: 2540730 - RNA, 23 nt, Chlamydophila pneumoniae J138
cugucauuaaaaauuuaaaagau

SEQ ID NO: 2540731 - RNA, 20 nt, Chlamydophila pneumoniae J138
cuguccaacuaaaacagccu

SEQ ID NO: 2540732 - RNA, 14 nt, Chlamydophila pneumoniae J138
cuguccauccaaau

SEQ ID NO: 2540733 - RNA, 15 nt, Chlamydophila pneumoniae J138
cuguccauccaaaua

SEQ ID NO: 2540734 - RNA, 15 nt, Chlamydophila pneumoniae J138
cuguccuccgagaaa

SEQ ID NO: 2540735 - RNA, 18 nt, Chlamydophila pneumoniae J138
cugucuagaacacucaga

SEQ ID NO: 2540736 - RNA, 16 nt, Chlamydophila pneumoniae J138
cugugaaaauuuucuu

SEQ ID NO: 2540737 - RNA, 16 nt, Chlamydophila pneumoniae J138
cugugaggaaaauucc

SEQ ID NO: 2540738 - RNA, 13 nt, Chlamydophila pneumoniae J138
cugugauaguaga

SEQ ID NO: 2540739 - RNA, 15 nt, Chlamydophila pneumoniae J138
cugugcaucagucag

SEQ ID NO: 2540740 - RNA, 23 nt, Chlamydophila pneumoniae J138
cugugcaucagucagacucacau

SEQ ID NO: 2540741 - RNA, 14 nt, Chlamydophila pneumoniae J138
cugugcauuuucuu

SEQ ID NO: 2540742 - RNA, 20 nt, Chlamydophila pneumoniae J138
cugugcauuuucuucuugca

SEQ ID NO: 2540743 - RNA, 16 nt, Chlamydophila pneumoniae J138
cugugcuccauagcau

SEQ ID NO: 2540744 - RNA, 14 nt, Chlamydophila pneumoniae J138
cuguggcaauagcg

SEQ ID NO: 2540745 - RNA, 22 nt, Chlamydophila pneumoniae J138
cuguggcauacucuuugcagug

SEQ ID NO: 2540746 - RNA, 21 nt, Chlamydophila pneumoniae J138
cuguguaaaaguuagguagau

SEQ ID NO: 2540747 - RNA, 13 nt, Chlamydophila pneumoniae J138
cuguguaugaauc

SEQ ID NO: 2540748 - RNA, 23 nt, Chlamydophila pneumoniae J138
cuguguuuuauccaccaagacug

SEQ ID NO: 2540749 - RNA, 14 nt, Chlamydophila pneumoniae J138
cuguguuuucuagu

SEQ ID NO: 2540750 - RNA, 13 nt, Chlamydophila pneumoniae J138
cuguuaacucaga

SEQ ID NO: 2540751 - RNA, 17 nt, Chlamydophila pneumoniae J138
cuguucauaauccaaga

SEQ ID NO: 2540752 - RNA, 18 nt, Chlamydophila pneumoniae J138
cuguuccugaguacuuug

SEQ ID NO: 2540753 - RNA, 20 nt, Chlamydophila pneumoniae J138
cuguuguaauaaaagaaaga

SEQ ID NO: 2540754 - RNA, 21 nt, Chlamydophila pneumoniae J138
cuguuguacuaucacagccau

SEQ ID NO: 2540755 - RNA, 23 nt, Chlamydophila pneumoniae J138
cuguuguacuaucacagccaucg

SEQ ID NO: 2540756 - RNA, 23 nt, Chlamydophila pneumoniae J138
cuguuucaacauaacaugagaaa

SEQ ID NO: 2540757 - RNA, 18 nt, Chlamydophila pneumoniae J138
cuguuuucacauggccaa

SEQ ID NO: 2540758 - RNA, 15 nt, Chlamydophila pneumoniae J138
cuguuuucuuuucug

SEQ ID NO: 2540759 - RNA, 14 nt, Chlamydophila pneumoniae J138
cuguuuuggaaaga

SEQ ID NO: 2540760 - RNA, 21 nt, Chlamydophila pneumoniae J138
cuguuuuggaaagaagagaau

SEQ ID NO: 2540761 - RNA, 21 nt, Chlamydophila pneumoniae J138
cuguuuuucuuccacacaacu

SEQ ID NO: 2540762 - RNA, 15 nt, Chlamydophila pneumoniae J138
cuguuuuuugaaaac

SEQ ID NO: 2540763 - RNA, 15 nt, Chlamydophila pneumoniae J138
cuuaaaauucuguaa

SEQ ID NO: 2540764 - RNA, 20 nt, Chlamydophila pneumoniae J138
cuuaaagagaaucuccucau

SEQ ID NO: 2540765 - RNA, 12 nt, Chlamydophila pneumoniae J138
cuuaaagaguuu

SEQ ID NO: 2540766 - RNA, 23 nt, Chlamydophila pneumoniae J138
cuuaaagguaaagcuucuuucuc

SEQ ID NO: 2540767 - RNA, 12 nt, Chlamydophila pneumoniae J138
cuuaaauccuaa

SEQ ID NO: 2540768 - RNA, 20 nt, Chlamydophila pneumoniae J138
cuuaacaacaucacuuauau

SEQ ID NO: 2540769 - RNA, 20 nt, Chlamydophila pneumoniae J138
cuuaacaaccgccuuuauau

SEQ ID NO: 2540770 - RNA, 18 nt, Chlamydophila pneumoniae J138
cuuaaccuccucaagaau

SEQ ID NO: 2540771 - RNA, 16 nt, Chlamydophila pneumoniae J138
cuuaacgcuuagagaa

SEQ ID NO: 2540772 - RNA, 16 nt, Chlamydophila pneumoniae J138
cuuaacuggcaaucua

SEQ ID NO: 2540773 - RNA, 21 nt, Chlamydophila pneumoniae J138
cuuaacuggcaaucuaaaauc

SEQ ID NO: 2540774 - RNA, 22 nt, Chlamydophila pneumoniae J138
cuuaacuggcaaucuaaaauca

SEQ ID NO: 2540775 - RNA, 22 nt, Chlamydophila pneumoniae J138
cuuaacuuuaggcccugacuua

SEQ ID NO: 2540776 - RNA, 20 nt, Chlamydophila pneumoniae J138
cuuaagaauaaaauaggaaa

SEQ ID NO: 2540777 - RNA, 22 nt, Chlamydophila pneumoniae J138
cuuaagaguuuuacaucaauga

SEQ ID NO: 2540778 - RNA, 15 nt, Chlamydophila pneumoniae J138
cuuaagauacuucuc

SEQ ID NO: 2540779 - RNA, 15 nt, Chlamydophila pneumoniae J138
cuuaaggaaauguag

SEQ ID NO: 2540780 - RNA, 13 nt, Chlamydophila pneumoniae J138
cuuaauaaacauc

SEQ ID NO: 2540781 - RNA, 21 nt, Chlamydophila pneumoniae J138
cuuaauagauucguuauccuc

SEQ ID NO: 2540782 - RNA, 22 nt, Chlamydophila pneumoniae J138
cuuaauagggccauuagcaauc

SEQ ID NO: 2540783 - RNA, 16 nt, Chlamydophila pneumoniae J138
cuuaauauaaaagaag

SEQ ID NO: 2540784 - RNA, 18 nt, Chlamydophila pneumoniae J138
cuuaauauaaaagaagac

SEQ ID NO: 2540785 - RNA, 20 nt, Chlamydophila pneumoniae J138
cuuaaugagaguuucuaaug

SEQ ID NO: 2540786 - RNA, 13 nt, Chlamydophila pneumoniae J138
cuuaauuuccuuc

SEQ ID NO: 2540787 - RNA, 17 nt, Chlamydophila pneumoniae J138
cuuaauuuccuucucca

SEQ ID NO: 2540788 - RNA, 18 nt, Chlamydophila pneumoniae J138
cuuacaagcuuccuuggu

SEQ ID NO: 2540789 - RNA, 14 nt, Chlamydophila pneumoniae J138
cuuacagagaaauu

SEQ ID NO: 2540790 - RNA, 19 nt, Chlamydophila pneumoniae J138
cuuacauuggcuuguaccg

SEQ ID NO: 2540791 - RNA, 19 nt, Chlamydophila pneumoniae J138
cuuacggccccuggaauuu

SEQ ID NO: 2540792 - RNA, 22 nt, Chlamydophila pneumoniae J138
cuuacggccccuggaauuucuc

SEQ ID NO: 2540793 - RNA, 17 nt, Chlamydophila pneumoniae J138
cuuacguaaacuauacu

SEQ ID NO: 2540794 - RNA, 16 nt, Chlamydophila pneumoniae J138
cuuacuaaagaaagag

SEQ ID NO: 2540795 - RNA, 15 nt, Chlamydophila pneumoniae J138
cuuacuaaaggugaa

SEQ ID NO: 2540796 - RNA, 21 nt, Chlamydophila pneumoniae J138
cuuacuaaaggugaaaguaca

SEQ ID NO: 2540797 - RNA, 22 nt, Chlamydophila pneumoniae J138
cuuacugaagaaguaagcgauu

SEQ ID NO: 2540798 - RNA, 14 nt, Chlamydophila pneumoniae J138
cuuagaauccaaag

SEQ ID NO: 2540799 - RNA, 18 nt, Chlamydophila pneumoniae J138
cuuagaauccaaagacuu

SEQ ID NO: 2540800 - RNA, 22 nt, Chlamydophila pneumoniae J138
cuuagaaucuaagauccugaga

SEQ ID NO: 2540801 - RNA, 12 nt, Chlamydophila pneumoniae J138
cuuagagaauug

SEQ ID NO: 2540802 - RNA, 17 nt, Chlamydophila pneumoniae J138
cuuagcaaugaaggcca

SEQ ID NO: 2540803 - RNA, 13 nt, Chlamydophila pneumoniae J138
cuuagccccucca

SEQ ID NO: 2540804 - RNA, 21 nt, Chlamydophila pneumoniae J138
cuuagccccuccaacaaacaa

SEQ ID NO: 2540805 - RNA, 15 nt, Chlamydophila pneumoniae J138
cuuaggaaagagucu

SEQ ID NO: 2540806 - RNA, 15 nt, Chlamydophila pneumoniae J138
cuuaggaauuuuucu

SEQ ID NO: 2540807 - RNA, 18 nt, Chlamydophila pneumoniae J138
cuuaggaauuuuucuagu

SEQ ID NO: 2540808 - RNA, 16 nt, Chlamydophila pneumoniae J138
cuuaggauucuuauca

SEQ ID NO: 2540809 - RNA, 19 nt, Chlamydophila pneumoniae J138
cuuagggccguauucccag

SEQ ID NO: 2540810 - RNA, 15 nt, Chlamydophila pneumoniae J138
cuuaggguucucaaa

SEQ ID NO: 2540811 - RNA, 16 nt, Chlamydophila pneumoniae J138
cuuaggguucucaaag

SEQ ID NO: 2540812 - RNA, 16 nt, Chlamydophila pneumoniae J138
cuuaguaucgagcucu

SEQ ID NO: 2540813 - RNA, 21 nt, Chlamydophila pneumoniae J138
cuuaguccgguuucuucuacc

SEQ ID NO: 2540814 - RNA, 23 nt, Chlamydophila pneumoniae J138
cuuaguccgguuucuucuaccaa

SEQ ID NO: 2540815 - RNA, 20 nt, Chlamydophila pneumoniae J138
cuuauaaacuucaaugaaga

SEQ ID NO: 2540816 - RNA, 19 nt, Chlamydophila pneumoniae J138
cuuauacacuccaauaaga

SEQ ID NO: 2540817 - RNA, 17 nt, Chlamydophila pneumoniae J138
cuuauacccacaaagau

SEQ ID NO: 2540818 - RNA, 20 nt, Chlamydophila pneumoniae J138
cuuauacccacaaagaucac

SEQ ID NO: 2540819 - RNA, 19 nt, Chlamydophila pneumoniae J138
cuuauagggaauuuuuucu

SEQ ID NO: 2540820 - RNA, 20 nt, Chlamydophila pneumoniae J138
cuuauagggaauuuuuucug

SEQ ID NO: 2540821 - RNA, 16 nt, Chlamydophila pneumoniae J138
cuuaucccauaaaugu

SEQ ID NO: 2540822 - RNA, 21 nt, Chlamydophila pneumoniae J138
cuuauccgucagccuuagcag

SEQ ID NO: 2540823 - RNA, 14 nt, Chlamydophila pneumoniae J138
cuuauccucagggg

SEQ ID NO: 2540824 - RNA, 15 nt, Chlamydophila pneumoniae J138
cuuauccugaacauc

SEQ ID NO: 2540825 - RNA, 20 nt, Chlamydophila pneumoniae J138
cuuauccugaacaucuccag

SEQ ID NO: 2540826 - RNA, 13 nt, Chlamydophila pneumoniae J138
cuuauccuuuuca

SEQ ID NO: 2540827 - RNA, 23 nt, Chlamydophila pneumoniae J138
cuuaucgggggugccaaaaaauu

SEQ ID NO: 2540828 - RNA, 16 nt, Chlamydophila pneumoniae J138
cuuaucuaaagaaaug

SEQ ID NO: 2540829 - RNA, 21 nt, Chlamydophila pneumoniae J138
cuuaucuaggucgauauccca

SEQ ID NO: 2540830 - RNA, 19 nt, Chlamydophila pneumoniae J138
cuuaucuauagcauuguuu

SEQ ID NO: 2540831 - RNA, 12 nt, Chlamydophila pneumoniae J138
cuuaucucuuuc

SEQ ID NO: 2540832 - RNA, 14 nt, Chlamydophila pneumoniae J138
cuuaucuuuaaauu

SEQ ID NO: 2540833 - RNA, 20 nt, Chlamydophila pneumoniae J138
cuuaucuuuaaauucgccaa

SEQ ID NO: 2540834 - RNA, 14 nt, Chlamydophila pneumoniae J138
cuuaugcucauuaa

SEQ ID NO: 2540835 - RNA, 16 nt, Chlamydophila pneumoniae J138
cuuauguuaaaaauac

SEQ ID NO: 2540836 - RNA, 19 nt, Chlamydophila pneumoniae J138
cuuauuauugaauaagcuu

SEQ ID NO: 2540837 - RNA, 17 nt, Chlamydophila pneumoniae J138
cuuauugaagucuucuu

SEQ ID NO: 2540838 - RNA, 18 nt, Chlamydophila pneumoniae J138
cuuauugaagucuucuug

SEQ ID NO: 2540839 - RNA, 14 nt, Chlamydophila pneumoniae J138
cuucaaaaaacaac

SEQ ID NO: 2540840 - RNA, 12 nt, Chlamydophila pneumoniae J138
cuucaaaaagcu

SEQ ID NO: 2540841 - RNA, 20 nt, Chlamydophila pneumoniae J138
cuucaaaggcaaccucugca

SEQ ID NO: 2540842 - RNA, 13 nt, Chlamydophila pneumoniae J138
cuucaaaugaaau

SEQ ID NO: 2540843 - RNA, 19 nt, Chlamydophila pneumoniae J138
cuucaagagcuuuuacaaa

SEQ ID NO: 2540844 - RNA, 23 nt, Chlamydophila pneumoniae J138
cuucaaggcaucuucuuugccaa

SEQ ID NO: 2540845 - RNA, 15 nt, Chlamydophila pneumoniae J138
cuucaagguacuuua

SEQ ID NO: 2540846 - RNA, 16 nt, Chlamydophila pneumoniae J138
cuucaagguacuuuau

SEQ ID NO: 2540847 - RNA, 21 nt, Chlamydophila pneumoniae J138
cuucaagucgagaaacaaaau

SEQ ID NO: 2540848 - RNA, 18 nt, Chlamydophila pneumoniae J138
cuucaauccccugcaucu

SEQ ID NO: 2540849 - RNA, 23 nt, Chlamydophila pneumoniae J138
cuucaaugaagaaaaaucuacau

SEQ ID NO: 2540850 - RNA, 18 nt, Chlamydophila pneumoniae J138
cuucaaugacuucuggau

SEQ ID NO: 2540851 - RNA, 20 nt, Chlamydophila pneumoniae J138
cuucaaugauguguugauuu

SEQ ID NO: 2540852 - RNA, 14 nt, Chlamydophila pneumoniae J138
cuucacaagaaaac

SEQ ID NO: 2540853 - RNA, 16 nt, Chlamydophila pneumoniae J138
cuucacaaucuaaaua

SEQ ID NO: 2540854 - RNA, 17 nt, Chlamydophila pneumoniae J138
cuucacaucuuucucua

SEQ ID NO: 2540855 - RNA, 18 nt, Chlamydophila pneumoniae J138
cuucacgacauacaucaa

SEQ ID NO: 2540856 - RNA, 19 nt, Chlamydophila pneumoniae J138
cuucacucguugccaaucu

SEQ ID NO: 2540857 - RNA, 14 nt, Chlamydophila pneumoniae J138
cuucacucuuucug

SEQ ID NO: 2540858 - RNA, 22 nt, Chlamydophila pneumoniae J138
cuucacucuuuuauuuuaggaa

SEQ ID NO: 2540859 - RNA, 22 nt, Chlamydophila pneumoniae J138
uuucuagaaaacgccaacugua

SEQ ID NO: 2540860 - RNA, 18 nt, Chlamydophila pneumoniae J138
uuucuaggaaucuuuuag

SEQ ID NO: 2540861 - RNA, 16 nt, Chlamydophila pneumoniae J138
uuucuaggaauugcug

SEQ ID NO: 2540862 - RNA, 23 nt, Chlamydophila pneumoniae J138
uuucuaguucguucaucugucau

SEQ ID NO: 2540863 - RNA, 22 nt, Chlamydophila pneumoniae J138
uuucuauuucgucgucauccca

SEQ ID NO: 2540864 - RNA, 12 nt, Chlamydophila pneumoniae J138
uuucuauuuuca

SEQ ID NO: 2540865 - RNA, 21 nt, Chlamydophila pneumoniae J138
uuuuccaaaaacgauucgaaa

SEQ ID NO: 2540866 - RNA, 15 nt, Chlamydophila pneumoniae J138
uuuuccaaauuccuu

SEQ ID NO: 2540867 - RNA, 20 nt, Chlamydophila pneumoniae J138
uuuuccauacccaaauuucu

SEQ ID NO: 2540868 - RNA, 23 nt, Chlamydophila pneumoniae J138
uuuuccauacccaaauuucuucu

SEQ ID NO: 2540869 - RNA, 16 nt, Chlamydophila pneumoniae J138
uuuucccacagcuugc

SEQ ID NO: 2540870 - RNA, 21 nt, Chlamydophila pneumoniae J138
uuuuccccuuggaaaucagaa

SEQ ID NO: 2540871 - RNA, 13 nt, Chlamydophila pneumoniae J138
uuuuccucuauau

SEQ ID NO: 2540872 - RNA, 18 nt, Chlamydophila pneumoniae J138
uuuucgaaucguuuuugg

SEQ ID NO: 2540873 - RNA, 15 nt, Chlamydophila pneumoniae J138
uuuucgacgcuguug

SEQ ID NO: 2540874 - RNA, 20 nt, Chlamydophila pneumoniae J138
uuuucgcuaacuuauccuca

SEQ ID NO: 2540875 - RNA, 12 nt, Chlamydophila pneumoniae J138
uuuucuaaaaug

SEQ ID NO: 2540876 - RNA, 15 nt, Chlamydophila pneumoniae J138
uuuucuaagagaucu

SEQ ID NO: 2540877 - RNA, 22 nt, Chlamydophila pneumoniae J138
uuuucuaagauuccuaacuucu

SEQ ID NO: 2540878 - RNA, 11 nt, Chlamydophila pneumoniae J138
uuuucuagaaa

SEQ ID NO: 2540879 - RNA, 18 nt, Chlamydophila pneumoniae J138
uuuucuagaaaagauucu

SEQ ID NO: 2540880 - RNA, 21 nt, Chlamydophila pneumoniae J138
uuuucuagaaaagauucuaaa

SEQ ID NO: 2540881 - RNA, 22 nt, Chlamydophila pneumoniae J138
uuuucuagcauaguguuccaaa

SEQ ID NO: 2540882 - RNA, 22 nt, Chlamydophila pneumoniae J138
uuuucuagucgugccaaugugc

SEQ ID NO: 2540883 - RNA, 22 nt, Chlamydophila pneumoniae J138
uuuucuauaucauuaagaagau

SEQ ID NO: 2540884 - RNA, 13 nt, Chlamydophila pneumoniae J138
uuuucuaugaucc

SEQ ID NO: 2540885 - RNA, 20 nt, Chlamydophila pneumoniae J138
uuuucucaauaguguaacau

SEQ ID NO: 2540886 - RNA, 17 nt, Chlamydophila pneumoniae J138
uuuucucauagcuuccu

SEQ ID NO: 2540887 - RNA, 16 nt, Chlamydophila pneumoniae J138
uuuucucgaagaaaau

SEQ ID NO: 2540888 - RNA, 16 nt, Chlamydophila pneumoniae J138
uuuucucgaauagaaa

SEQ ID NO: 2540889 - RNA, 13 nt, Chlamydophila pneumoniae J138
uuuucucugagca

SEQ ID NO: 2540890 - RNA, 12 nt, Chlamydophila pneumoniae J138
uuuucugaagau

SEQ ID NO: 2540891 - RNA, 16 nt, Chlamydophila pneumoniae J138
uuuucuuaucaugaaa

SEQ ID NO: 2540892 - RNA, 16 nt, Chlamydophila pneumoniae J138
uuuucuucaacauaca

SEQ ID NO: 2540893 - RNA, 12 nt, Chlamydophila pneumoniae J138
uuuucuuccaaa

SEQ ID NO: 2540894 - RNA, 16 nt, Chlamydophila pneumoniae J138
uuuucuuccaaagacu

SEQ ID NO: 2540895 - RNA, 21 nt, Chlamydophila pneumoniae J138
uuuucuucugacauuccuuaa

SEQ ID NO: 2540896 - RNA, 20 nt, Chlamydophila pneumoniae J138
uuuucuucuucggaucugua

SEQ ID NO: 2540897 - RNA, 17 nt, Chlamydophila pneumoniae J138
uuuucuugauuagagaa

SEQ ID NO: 2540898 - RNA, 18 nt, Chlamydophila pneumoniae J138
uuuucuugauuagagaau

SEQ ID NO: 2540899 - RNA, 22 nt, Chlamydophila pneumoniae J138
uuuucuuguaagacuaaaaaag

SEQ ID NO: 2540900 - RNA, 19 nt, Chlamydophila pneumoniae J138
uuuucuuucuaagauaucu

SEQ ID NO: 2540901 - RNA, 22 nt, Chlamydophila pneumoniae J138
uuuucuuuucugaagauuuuuu

SEQ ID NO: 2540902 - RNA, 14 nt, Chlamydophila pneumoniae J138
uuuucuuuuuagaa

SEQ ID NO: 2540903 - RNA, 20 nt, Chlamydophila pneumoniae J138
uuuugaaaauugcauuuaaa

SEQ ID NO: 2540904 - RNA, 13 nt, Chlamydophila pneumoniae J138
uuuugaaaauuuu

SEQ ID NO: 2540905 - RNA, 13 nt, Chlamydophila pneumoniae J138
uuuugaagugcuu

SEQ ID NO: 2540906 - RNA, 15 nt, Chlamydophila pneumoniae J138
uuuugagauucaaaa

SEQ ID NO: 2540907 - RNA, 13 nt, Chlamydophila pneumoniae J138
uuuugauaccucu

SEQ ID NO: 2540908 - RNA, 21 nt, Chlamydophila pneumoniae J138
uuuugauuaggcuucagagau

SEQ ID NO: 2540909 - RNA, 15 nt, Chlamydophila pneumoniae J138
uuuugauuuugcagu

SEQ ID NO: 2540910 - RNA, 20 nt, Chlamydophila pneumoniae J138
uuuugcagugauaaaccaag

SEQ ID NO: 2540911 - RNA, 22 nt, Chlamydophila pneumoniae J138
uuuugccacaacucauccuaaa

SEQ ID NO: 2540912 - RNA, 22 nt, Chlamydophila pneumoniae J138
uuuugccaguucuugaaacucu

SEQ ID NO: 2540913 - RNA, 18 nt, Chlamydophila pneumoniae J138
uuuugccgugcucuuaug

SEQ ID NO: 2540914 - RNA, 14 nt, Chlamydophila pneumoniae J138
uuuugcgauuucag

SEQ ID NO: 2540915 - RNA, 17 nt, Chlamydophila pneumoniae J138
uuuugcuaaacaaugca

SEQ ID NO: 2540916 - RNA, 21 nt, Chlamydophila pneumoniae J138
uuuugcuaagagcucuuuccc

SEQ ID NO: 2540917 - RNA, 16 nt, Chlamydophila pneumoniae J138
uuuugcugaagauuuu

SEQ ID NO: 2540918 - RNA, 17 nt, Chlamydophila pneumoniae J138
uuuugcugaagauuuuu

SEQ ID NO: 2540919 - RNA, 15 nt, Chlamydophila pneumoniae J138
uuuugguucuuggag

SEQ ID NO: 2540920 - RNA, 19 nt, Chlamydophila pneumoniae J138
uuuuguaaucuaagaaucu

SEQ ID NO: 2540921 - RNA, 16 nt, Chlamydophila pneumoniae J138
uuuugucgcaauaaca

SEQ ID NO: 2540922 - RNA, 17 nt, Chlamydophila pneumoniae J138
uuuuguucccuacuucc

SEQ ID NO: 2540923 - RNA, 12 nt, Chlamydophila pneumoniae J138
uuuuuaaauaca

SEQ ID NO: 2540924 - RNA, 21 nt, Chlamydophila pneumoniae J138
uuuuuaaccgagcuuuuugcu

SEQ ID NO: 2540925 - RNA, 17 nt, Chlamydophila pneumoniae J138
uuuuuaaccucuuuucu

SEQ ID NO: 2540926 - RNA, 12 nt, Chlamydophila pneumoniae J138
uuuuuacaugua

SEQ ID NO: 2540927 - RNA, 21 nt, Chlamydophila pneumoniae J138
uuuuuagaagguguuuuggcu

SEQ ID NO: 2540928 - RNA, 14 nt, Chlamydophila pneumoniae J138
uuuuuaucuccuga

SEQ ID NO: 2540929 - RNA, 23 nt, Chlamydophila pneumoniae J138
uuuuucaaucaauaaaaugucca

SEQ ID NO: 2540930 - RNA, 16 nt, Chlamydophila pneumoniae J138
uuuuucaauccuuccu

SEQ ID NO: 2540931 - RNA, 17 nt, Chlamydophila pneumoniae J138
uuuuuccaacuucaacu

SEQ ID NO: 2540932 - RNA, 14 nt, Chlamydophila pneumoniae J138
uuuuucccucgcua

SEQ ID NO: 2540933 - RNA, 18 nt, Chlamydophila pneumoniae J138
uuuuucccuuuaaaagua

SEQ ID NO: 2540934 - RNA, 19 nt, Chlamydophila pneumoniae J138
uuuuucccuuuaaaaguac

SEQ ID NO: 2540935 - RNA, 12 nt, Chlamydophila pneumoniae J138
uuuuucuaguuc

SEQ ID NO: 2540936 - RNA, 10 nt, Chlamydophila pneumoniae J138
uuuuucucuu

SEQ ID NO: 2540937 - RNA, 22 nt, Chlamydophila pneumoniae J138
uuuuucugcuucuccaaauaaa

SEQ ID NO: 2540938 - RNA, 22 nt, Chlamydophila pneumoniae J138
uuuuucuguuccugaguacuuu

SEQ ID NO: 2540939 - RNA, 13 nt, Chlamydophila pneumoniae J138
uuuuucuuaguau

SEQ ID NO: 2540940 - RNA, 20 nt, Chlamydophila pneumoniae J138
uuuuucuugaaaaauccuga

SEQ ID NO: 2540941 - RNA, 20 nt, Chlamydophila pneumoniae J138
uuuuugaauaugauuuccac

SEQ ID NO: 2540942 - RNA, 12 nt, Chlamydophila pneumoniae J138
uuuuugaaugau

SEQ ID NO: 2540943 - RNA, 23 nt, Chlamydophila pneumoniae J138
uuuuugcuaagagcucuuucccu

SEQ ID NO: 2540944 - RNA, 17 nt, Chlamydophila pneumoniae J138
uuuuuggaaauccguaa

SEQ ID NO: 2540945 - RNA, 18 nt, Chlamydophila pneumoniae J138
uuuuuguucauccagaag

SEQ ID NO: 2540946 - RNA, 12 nt, Chlamydophila pneumoniae J138
uuuuuuaaagug

SEQ ID NO: 2540947 - RNA, 11 nt, Chlamydophila pneumoniae J138
uuuuuuaauuc

SEQ ID NO: 2540948 - RNA, 16 nt, Chlamydophila pneumoniae J138
uuaacuucuaaaagca

SEQ ID NO: 2540949 - RNA, 11 nt, Chlamydophila pneumoniae J138
uuaagaagaag

SEQ ID NO: 2540950 - RNA, 15 nt, Chlamydophila pneumoniae J138
uuaagaagaagcuga

SEQ ID NO: 2540951 - RNA, 19 nt, Chlamydophila pneumoniae J138
uuaagaagauucuuuaauc

SEQ ID NO: 2540952 - RNA, 17 nt, Chlamydophila pneumoniae J138
uuaagacaauauaagca

SEQ ID NO: 2540953 - RNA, 19 nt, Chlamydophila pneumoniae J138
uuaagaccaaacuuucuuu

SEQ ID NO: 2540954 - RNA, 16 nt, Chlamydophila pneumoniae J138
uuaagauaaacagcac

SEQ ID NO: 2540955 - RNA, 18 nt, Chlamydophila pneumoniae J138
uuaagauaaacagcacag

SEQ ID NO: 2540956 - RNA, 15 nt, Chlamydophila pneumoniae J138
uuaagauagacucuc

SEQ ID NO: 2540957 - RNA, 21 nt, Chlamydophila pneumoniae J138
uuaagauagacucucacugag

SEQ ID NO: 2540958 - RNA, 19 nt, Chlamydophila pneumoniae J138
uuaagauaucgaccuuaaa

SEQ ID NO: 2540959 - RNA, 14 nt, Chlamydophila pneumoniae J138
uuaaggaaacagug

SEQ ID NO: 2540960 - RNA, 23 nt, Chlamydophila pneumoniae J138
uuaaggaaacagugguaugcuuu

SEQ ID NO: 2540961 - RNA, 14 nt, Chlamydophila pneumoniae J138
uuaagucacacuuu

SEQ ID NO: 2540962 - RNA, 20 nt, Chlamydophila pneumoniae J138
uuaagugauggggauuaucc

SEQ ID NO: 2540963 - RNA, 15 nt, Chlamydophila pneumoniae J138
uuaauaaaucuauau

SEQ ID NO: 2540964 - RNA, 18 nt, Chlamydophila pneumoniae J138
uuaauaaauuuaucugcu

SEQ ID NO: 2540965 - RNA, 20 nt, Chlamydophila pneumoniae J138
uuaauaagaaccucuaauuu

SEQ ID NO: 2540966 - RNA, 18 nt, Chlamydophila pneumoniae J138
uuaauacaaaaaauaaaa

SEQ ID NO: 2540967 - RNA, 22 nt, Chlamydophila pneumoniae J138
uuaauacaaaaaauaaaaucaa

SEQ ID NO: 2540968 - RNA, 15 nt, Chlamydophila pneumoniae J138
uuaauacuuugccaa

SEQ ID NO: 2540969 - RNA, 14 nt, Chlamydophila pneumoniae J138
uuaaucaagccuaa

SEQ ID NO: 2540970 - RNA, 17 nt, Chlamydophila pneumoniae J138
uuaauccaaaaacuucu

SEQ ID NO: 2540971 - RNA, 13 nt, Chlamydophila pneumoniae J138
uuaauccuugagg

SEQ ID NO: 2540972 - RNA, 22 nt, Chlamydophila pneumoniae J138
uuaauccuugagggcuauccac

SEQ ID NO: 2540973 - RNA, 16 nt, Chlamydophila pneumoniae J138
uuaauccuuucacaaa

SEQ ID NO: 2540974 - RNA, 13 nt, Chlamydophila pneumoniae J138
uuaauguuuggcc

SEQ ID NO: 2540975 - RNA, 12 nt, Chlamydophila pneumoniae J138
uuaauucucuga

SEQ ID NO: 2540976 - RNA, 12 nt, Chlamydophila pneumoniae J138
uuaauuuuucua

SEQ ID NO: 2540977 - RNA, 22 nt, Chlamydophila pneumoniae J138
uuaauuuuugcuaaacaaugca

SEQ ID NO: 2540978 - RNA, 15 nt, Chlamydophila pneumoniae J138
uuacaaauaaaauga

SEQ ID NO: 2540979 - RNA, 17 nt, Chlamydophila pneumoniae J138
uuacaaauaaaaugauu

SEQ ID NO: 2540980 - RNA, 22 nt, Chlamydophila pneumoniae J138
uuacaaauggcaugaaagauaa

SEQ ID NO: 2540981 - RNA, 14 nt, Chlamydophila pneumoniae J138
uuacaauugaaaau

SEQ ID NO: 2540982 - RNA, 15 nt, Chlamydophila pneumoniae J138
uuacacaacucuuuc

SEQ ID NO: 2540983 - RNA, 13 nt, Chlamydophila pneumoniae J138
uuacagaaaggcu

SEQ ID NO: 2540984 - RNA, 20 nt, Chlamydophila pneumoniae J138
uuacagaugcaugauccuau

SEQ ID NO: 2540985 - RNA, 18 nt, Chlamydophila pneumoniae J138
uuacagccuauugcaggg

SEQ ID NO: 2540986 - RNA, 17 nt, Chlamydophila pneumoniae J138
uuacauaacacuuuguu

SEQ ID NO: 2540987 - RNA, 13 nt, Chlamydophila pneumoniae J138
uuacaucaaugau

SEQ ID NO: 2540988 - RNA, 16 nt, Chlamydophila pneumoniae J138
uuacauguaaacaaaa

SEQ ID NO: 2540989 - RNA, 14 nt, Chlamydophila pneumoniae J138
uuaccaaaaacugg

SEQ ID NO: 2540990 - RNA, 21 nt, Chlamydophila pneumoniae J138
uuaccaucgucuccaaaaauu

SEQ ID NO: 2540991 - RNA, 23 nt, Chlamydophila pneumoniae J138
auacagcuguuuacuuuucucuu

SEQ ID NO: 2540992 - RNA, 21 nt, Chlamydophila pneumoniae J138
auacaggccugaugucuccau

SEQ ID NO: 2540993 - RNA, 22 nt, Chlamydophila pneumoniae J138
auacaggcuccucugcuaagca

SEQ ID NO: 2540994 - RNA, 14 nt, Chlamydophila pneumoniae J138
auacaguagaaaca

SEQ ID NO: 2540995 - RNA, 15 nt, Chlamydophila pneumoniae J138
auacaguagaaacau

SEQ ID NO: 2540996 - RNA, 19 nt, Chlamydophila pneumoniae J138
auacaguuggcguuuucua

SEQ ID NO: 2540997 - RNA, 22 nt, Chlamydophila pneumoniae J138
auacaguuggcguuuucuagaa

SEQ ID NO: 2540998 - RNA, 13 nt, Chlamydophila pneumoniae J138
auacauagggaaa

SEQ ID NO: 2540999 - RNA, 19 nt, Chlamydophila pneumoniae J138
auacaucaccacugcucca

SEQ ID NO: 2541000 - RNA, 23 nt, Chlamydophila pneumoniae J138
auacaucaccacugcuccaauuu

SEQ ID NO: 2541001 - RNA, 22 nt, Chlamydophila pneumoniae J138
auacaucccauucaauaauuuc

SEQ ID NO: 2541002 - RNA, 18 nt, Chlamydophila pneumoniae J138
auacauccucacuagaga

SEQ ID NO: 2541003 - RNA, 17 nt, Chlamydophila pneumoniae J138
auacaucguauccaaau

SEQ ID NO: 2541004 - RNA, 22 nt, Chlamydophila pneumoniae J138
auacaucuuaagagcaaacauc

SEQ ID NO: 2541005 - RNA, 12 nt, Chlamydophila pneumoniae J138
auacauuccuag

SEQ ID NO: 2541006 - RNA, 14 nt, Chlamydophila pneumoniae J138
auacauucuauucu

SEQ ID NO: 2541007 - RNA, 14 nt, Chlamydophila pneumoniae J138
auaccaaaauacca

SEQ ID NO: 2541008 - RNA, 15 nt, Chlamydophila pneumoniae J138
auaccaaaauaccau

SEQ ID NO: 2541009 - RNA, 13 nt, Chlamydophila pneumoniae J138
auaccaaaauuau

SEQ ID NO: 2541010 - RNA, 15 nt, Chlamydophila pneumoniae J138
auaccaaggcugcug

SEQ ID NO: 2541011 - RNA, 17 nt, Chlamydophila pneumoniae J138
auaccacuacugagcuu

SEQ ID NO: 2541012 - RNA, 21 nt, Chlamydophila pneumoniae J138
auaccagauaaagcaaagaua

SEQ ID NO: 2541013 - RNA, 13 nt, Chlamydophila pneumoniae J138
auaccaucaaggu

SEQ ID NO: 2541014 - RNA, 16 nt, Chlamydophila pneumoniae J138
auacccacaaagauca

SEQ ID NO: 2541015 - RNA, 15 nt, Chlamydophila pneumoniae J138
auacccaucuagaaa

SEQ ID NO: 2541016 - RNA, 22 nt, Chlamydophila pneumoniae J138
auacccucggagacucagagaa

SEQ ID NO: 2541017 - RNA, 13 nt, Chlamydophila pneumoniae J138
auacccuucuucu

SEQ ID NO: 2541018 - RNA, 15 nt, Chlamydophila pneumoniae J138
auaccgcuguuuuau

SEQ ID NO: 2541019 - RNA, 12 nt, Chlamydophila pneumoniae J138
auaccuacuaaa

SEQ ID NO: 2541020 - RNA, 14 nt, Chlamydophila pneumoniae J138
auaccuccuccaau

SEQ ID NO: 2541021 - RNA, 18 nt, Chlamydophila pneumoniae J138
auaccuccuccaaucugc

SEQ ID NO: 2541022 - RNA, 15 nt, Chlamydophila pneumoniae J138
auacgaacacagaua

SEQ ID NO: 2541023 - RNA, 13 nt, Chlamydophila pneumoniae J138
auacgcagcacgc

SEQ ID NO: 2541024 - RNA, 22 nt, Chlamydophila pneumoniae J138
auacgccgggccacuucaucuu

SEQ ID NO: 2541025 - RNA, 18 nt, Chlamydophila pneumoniae J138
auacgcuagcucuuaaau

SEQ ID NO: 2541026 - RNA, 19 nt, Chlamydophila pneumoniae J138
auacgcuuacaaauaacua

SEQ ID NO: 2541027 - RNA, 21 nt, Chlamydophila pneumoniae J138
auacggacuucacaaagaacc

SEQ ID NO: 2541028 - RNA, 20 nt, Chlamydophila pneumoniae J138
auacguaauccagauuguuc

SEQ ID NO: 2541029 - RNA, 16 nt, Chlamydophila pneumoniae J138
auacgucccacaaaau

SEQ ID NO: 2541030 - RNA, 15 nt, Chlamydophila pneumoniae J138
auacgucguuacagc

SEQ ID NO: 2541031 - RNA, 13 nt, Chlamydophila pneumoniae J138
auacguuuuuccc

SEQ ID NO: 2541032 - RNA, 16 nt, Chlamydophila pneumoniae J138
auacguuuuuuuccuu

SEQ ID NO: 2541033 - RNA, 22 nt, Chlamydophila pneumoniae J138
auacguuuuuuuccuuucuuuu

SEQ ID NO: 2541034 - RNA, 19 nt, Chlamydophila pneumoniae J138
auacuaagaagcucacucu

SEQ ID NO: 2541035 - RNA, 15 nt, Chlamydophila pneumoniae J138
auacuacucucauca

SEQ ID NO: 2541036 - RNA, 20 nt, Chlamydophila pneumoniae J138
auacuacuuacaagaacaag

SEQ ID NO: 2541037 - RNA, 15 nt, Chlamydophila pneumoniae J138
auacucauauuuugu

SEQ ID NO: 2541038 - RNA, 15 nt, Chlamydophila pneumoniae J138
auacuccacuuuuuu

SEQ ID NO: 2541039 - RNA, 18 nt, Chlamydophila pneumoniae J138
auacuccacuuuuuuccc

SEQ ID NO: 2541040 - RNA, 22 nt, Chlamydophila pneumoniae J138
auacuccacuuuuuucccucca

SEQ ID NO: 2541041 - RNA, 16 nt, Chlamydophila pneumoniae J138
auacucgucaaauuca

SEQ ID NO: 2541042 - RNA, 15 nt, Chlamydophila pneumoniae J138
auacucuauuaagga

SEQ ID NO: 2541043 - RNA, 18 nt, Chlamydophila pneumoniae J138
auacugcugcuaagccaa

SEQ ID NO: 2541044 - RNA, 16 nt, Chlamydophila pneumoniae J138
auacuguuaacaagua

SEQ ID NO: 2541045 - RNA, 17 nt, Chlamydophila pneumoniae J138
auacuguuuuucuucca

SEQ ID NO: 2541046 - RNA, 23 nt, Chlamydophila pneumoniae J138
auacuuaauccuguagggaaaga

SEQ ID NO: 2541047 - RNA, 18 nt, Chlamydophila pneumoniae J138
auacuuaggaauuuuucu

SEQ ID NO: 2541048 - RNA, 16 nt, Chlamydophila pneumoniae J138
auacuuauauuggcuu

SEQ ID NO: 2541049 - RNA, 15 nt, Chlamydophila pneumoniae J138
auacuucaggacgca

SEQ ID NO: 2541050 - RNA, 13 nt, Chlamydophila pneumoniae J138
auacuucuccuga

SEQ ID NO: 2541051 - RNA, 14 nt, Chlamydophila pneumoniae J138
auacuucuccugaa

SEQ ID NO: 2541052 - RNA, 20 nt, Chlamydophila pneumoniae J138
auacuucuuccacgagauuc

SEQ ID NO: 2541053 - RNA, 19 nt, Chlamydophila pneumoniae J138
auagaaaagguauuaggaa

SEQ ID NO: 2541054 - RNA, 13 nt, Chlamydophila pneumoniae J138
auagaaaguacag

SEQ ID NO: 2541055 - RNA, 18 nt, Chlamydophila pneumoniae J138
auagaaaguacagauuuc

SEQ ID NO: 2541056 - RNA, 20 nt, Chlamydophila pneumoniae J138
auagaaauaagcaucuagaa

SEQ ID NO: 2541057 - RNA, 14 nt, Chlamydophila pneumoniae J138
auagaaaugagaga

SEQ ID NO: 2541058 - RNA, 14 nt, Chlamydophila pneumoniae J138
auagaaauucugua

SEQ ID NO: 2541059 - RNA, 16 nt, Chlamydophila pneumoniae J138
auagaaauucuguaga

SEQ ID NO: 2541060 - RNA, 22 nt, Chlamydophila pneumoniae J138
auagaaauucuguagauacuau

SEQ ID NO: 2541061 - RNA, 20 nt, Chlamydophila pneumoniae J138
auagaacgaauuucaacagc

SEQ ID NO: 2541062 - RNA, 18 nt, Chlamydophila pneumoniae J138
auagaacucuccucgagg

SEQ ID NO: 2541063 - RNA, 15 nt, Chlamydophila pneumoniae J138
auagaagaucauuaa

SEQ ID NO: 2541064 - RNA, 15 nt, Chlamydophila pneumoniae J138
auagaagcugcugcu

SEQ ID NO: 2541065 - RNA, 15 nt, Chlamydophila pneumoniae J138
auagaauacacagcu

SEQ ID NO: 2541066 - RNA, 14 nt, Chlamydophila pneumoniae J138
auagaauagaaugu

SEQ ID NO: 2541067 - RNA, 15 nt, Chlamydophila pneumoniae J138
auagacacuugcuua

SEQ ID NO: 2541068 - RNA, 20 nt, Chlamydophila pneumoniae J138
auagacacuugcuuaaggaa

SEQ ID NO: 2541069 - RNA, 21 nt, Chlamydophila pneumoniae J138
auagacacuugcuuaaggaaa

SEQ ID NO: 2541070 - RNA, 17 nt, Chlamydophila pneumoniae J138
auagaccccccauucca

SEQ ID NO: 2541071 - RNA, 23 nt, Chlamydophila pneumoniae J138
auagaccggaucccguaaaagaa

SEQ ID NO: 2541072 - RNA, 15 nt, Chlamydophila pneumoniae J138
auagacuccuuaaca

SEQ ID NO: 2541073 - RNA, 15 nt, Chlamydophila pneumoniae J138
auagacucucacuga

SEQ ID NO: 2541074 - RNA, 13 nt, Chlamydophila pneumoniae J138
auagacucuuccu

SEQ ID NO: 2541075 - RNA, 20 nt, Chlamydophila pneumoniae J138
auagagaacuccauucagau

SEQ ID NO: 2541076 - RNA, 11 nt, Chlamydophila pneumoniae J138
auagagaagau

SEQ ID NO: 2541077 - RNA, 17 nt, Chlamydophila pneumoniae J138
auagagagaaugacuuu

SEQ ID NO: 2541078 - RNA, 18 nt, Chlamydophila pneumoniae J138
auagagagcgcagagucu

SEQ ID NO: 2541079 - RNA, 21 nt, Chlamydophila pneumoniae J138
auagagagcgccuaaacccac

SEQ ID NO: 2541080 - RNA, 14 nt, Chlamydophila pneumoniae J138
auagagauucuaca

SEQ ID NO: 2541081 - RNA, 17 nt, Chlamydophila pneumoniae J138
auagagccuagagaguu

SEQ ID NO: 2541082 - RNA, 20 nt, Chlamydophila pneumoniae J138
auagagccuagagaguucuu

SEQ ID NO: 2541083 - RNA, 23 nt, Chlamydophila pneumoniae J138
auagagccuccuccuucugcaau

SEQ ID NO: 2541084 - RNA, 14 nt, Chlamydophila pneumoniae J138
auagagcgguucuu

SEQ ID NO: 2541085 - RNA, 18 nt, Chlamydophila pneumoniae J138
auagagcgguucuuucua

SEQ ID NO: 2541086 - RNA, 21 nt, Chlamydophila pneumoniae J138
auagagcgguucuuucuagaa

SEQ ID NO: 2541087 - RNA, 13 nt, Chlamydophila pneumoniae J138
auagagcucuaaa

SEQ ID NO: 2541088 - RNA, 14 nt, Chlamydophila pneumoniae J138
auagagcucuaaaa

SEQ ID NO: 2541089 - RNA, 16 nt, Chlamydophila pneumoniae J138
auagagcugccaaugu

SEQ ID NO: 2541090 - RNA, 18 nt, Chlamydophila pneumoniae J138
auagagcuucuuuaucua

SEQ ID NO: 2541091 - RNA, 21 nt, Chlamydophila pneumoniae J138
auagagcuucuuuaucuagcu

SEQ ID NO: 2541092 - RNA, 17 nt, Chlamydophila pneumoniae J138
ccgugacuccagaaggu

SEQ ID NO: 2541093 - RNA, 23 nt, Chlamydophila pneumoniae J138
ccguuucaggaaacucaaucucu

SEQ ID NO: 2541094 - RNA, 14 nt, Chlamydophila pneumoniae J138
ccguuuccuccucu

SEQ ID NO: 2541095 - RNA, 13 nt, Chlamydophila pneumoniae J138
ccuaaaacaagaa

SEQ ID NO: 2541096 - RNA, 21 nt, Chlamydophila pneumoniae J138
ccuaaagaauuuguaacucuu

SEQ ID NO: 2541097 - RNA, 16 nt, Chlamydophila pneumoniae J138
ccuaaauuaaauaucu

SEQ ID NO: 2541098 - RNA, 16 nt, Chlamydophila pneumoniae J138
ccuaaauucauaacac

SEQ ID NO: 2541099 - RNA, 17 nt, Chlamydophila pneumoniae J138
ccuaaauucauaacacc

SEQ ID NO: 2541100 - RNA, 15 nt, Chlamydophila pneumoniae J138
ccuaacggcuugccu

SEQ ID NO: 2541101 - RNA, 16 nt, Chlamydophila pneumoniae J138
ccuaacuaucucuguu

SEQ ID NO: 2541102 - RNA, 23 nt, Chlamydophila pneumoniae J138
ccuaacuaucucuguuuuuugaa

SEQ ID NO: 2541103 - RNA, 15 nt, Chlamydophila pneumoniae J138
ccuaagagauuuucc

SEQ ID NO: 2541104 - RNA, 18 nt, Chlamydophila pneumoniae J138
ccuaagagauuuuccaua

SEQ ID NO: 2541105 - RNA, 15 nt, Chlamydophila pneumoniae J138
ccuaagggcucuccu

SEQ ID NO: 2541106 - RNA, 20 nt, Chlamydophila pneumoniae J138
ccuaagguuuccaugagaau

SEQ ID NO: 2541107 - RNA, 23 nt, Chlamydophila pneumoniae J138
ccuaagguuuccaugagaauaug

SEQ ID NO: 2541108 - RNA, 17 nt, Chlamydophila pneumoniae J138
ccuaagucguuaacauc

SEQ ID NO: 2541109 - RNA, 13 nt, Chlamydophila pneumoniae J138
ccuaauaaagaag

SEQ ID NO: 2541110 - RNA, 19 nt, Chlamydophila pneumoniae J138
ccuaauucucgagcagcug

SEQ ID NO: 2541111 - RNA, 21 nt, Chlamydophila pneumoniae J138
ccuacaccaucuuuaaaaggc

SEQ ID NO: 2541112 - RNA, 23 nt, Chlamydophila pneumoniae J138
ccuacacugguagcuaaauuuag

SEQ ID NO: 2541113 - RNA, 23 nt, Chlamydophila pneumoniae J138
ccuacagaucaggauucuaaaaa

SEQ ID NO: 2541114 - RNA, 21 nt, Chlamydophila pneumoniae J138
ccuacaggcaggccacuuccu

SEQ ID NO: 2541115 - RNA, 17 nt, Chlamydophila pneumoniae J138
ccuacauggaucccugu

SEQ ID NO: 2541116 - RNA, 20 nt, Chlamydophila pneumoniae J138
ccuaccaaaguuuguagcau

SEQ ID NO: 2541117 - RNA, 14 nt, Chlamydophila pneumoniae J138
ccuacccaauuugu

SEQ ID NO: 2541118 - RNA, 22 nt, Chlamydophila pneumoniae J138
ccuacgacaugccuaaauagcu

SEQ ID NO: 2541119 - RNA, 15 nt, Chlamydophila pneumoniae J138
ccuacguuuucucua

SEQ ID NO: 2541120 - RNA, 16 nt, Chlamydophila pneumoniae J138
ccuacugggaaaucua

SEQ ID NO: 2541121 - RNA, 14 nt, Chlamydophila pneumoniae J138
ccuagaauaggaau

SEQ ID NO: 2541122 - RNA, 15 nt, Chlamydophila pneumoniae J138
ccuagagaguucuug

SEQ ID NO: 2541123 - RNA, 21 nt, Chlamydophila pneumoniae J138
ccuagagaguucuuguaauaa

SEQ ID NO: 2541124 - RNA, 17 nt, Chlamydophila pneumoniae J138
ccuagauagcaaaucaa

SEQ ID NO: 2541125 - RNA, 14 nt, Chlamydophila pneumoniae J138
ccuagggucuucuc

SEQ ID NO: 2541126 - RNA, 13 nt, Chlamydophila pneumoniae J138
ccuagguucuuuu

SEQ ID NO: 2541127 - RNA, 20 nt, Chlamydophila pneumoniae J138
ccuaguguuagaugaagagu

SEQ ID NO: 2541128 - RNA, 21 nt, Chlamydophila pneumoniae J138
ccuaguucauuagcuaaauca

SEQ ID NO: 2541129 - RNA, 23 nt, Chlamydophila pneumoniae J138
ccuaguucauuagcuaaaucaaa

SEQ ID NO: 2541130 - RNA, 21 nt, Chlamydophila pneumoniae J138
ccuauaaagcaaaugccugua

SEQ ID NO: 2541131 - RNA, 16 nt, Chlamydophila pneumoniae J138
ccuauaguauaauagu

SEQ ID NO: 2541132 - RNA, 21 nt, Chlamydophila pneumoniae J138
ccuauaguauaauagugagcu

SEQ ID NO: 2541133 - RNA, 22 nt, Chlamydophila pneumoniae J138
ccuauaucgccguuaaagacuu

SEQ ID NO: 2541134 - RNA, 13 nt, Chlamydophila pneumoniae J138
ccuaucaaagcaa

SEQ ID NO: 2541135 - RNA, 16 nt, Chlamydophila pneumoniae J138
ccuaucaaagcaaaag

SEQ ID NO: 2541136 - RNA, 20 nt, Chlamydophila pneumoniae J138
ccuaugacggauccuagaau

SEQ ID NO: 2541137 - RNA, 10 nt, Chlamydophila pneumoniae J138
ccuauuuaag

SEQ ID NO: 2541138 - RNA, 22 nt, Chlamydophila pneumoniae J138
ccuauuugcaacaaucuuucuu

SEQ ID NO: 2541139 - RNA, 23 nt, Chlamydophila pneumoniae J138
ccuauuuucuuaugaccaagaac

SEQ ID NO: 2541140 - RNA, 22 nt, Chlamydophila pneumoniae J138
ccucaaagccgaggauucgcua

SEQ ID NO: 2541141 - RNA, 18 nt, Chlamydophila pneumoniae J138
ccucaagauaaaucccac

SEQ ID NO: 2541142 - RNA, 13 nt, Chlamydophila pneumoniae J138
ccucacaagaagc

SEQ ID NO: 2541143 - RNA, 20 nt, Chlamydophila pneumoniae J138
ccucacagaauuguuuuguu

SEQ ID NO: 2541144 - RNA, 17 nt, Chlamydophila pneumoniae J138
ccucacauguuucacuu

SEQ ID NO: 2541145 - RNA, 21 nt, Chlamydophila pneumoniae J138
ccucagaauccauuuugccca

SEQ ID NO: 2541146 - RNA, 13 nt, Chlamydophila pneumoniae J138
ccucagucucucu

SEQ ID NO: 2541147 - RNA, 14 nt, Chlamydophila pneumoniae J138
ccucaucagaagcc

SEQ ID NO: 2541148 - RNA, 21 nt, Chlamydophila pneumoniae J138
ccucaucagaagccaccaaaa

SEQ ID NO: 2541149 - RNA, 23 nt, Chlamydophila pneumoniae J138
ccucaucagaagccaccaaaaau

SEQ ID NO: 2541150 - RNA, 13 nt, Chlamydophila pneumoniae J138
ccucaucaucaga

SEQ ID NO: 2541151 - RNA, 17 nt, Chlamydophila pneumoniae J138
ccucauccccucagaaa

SEQ ID NO: 2541152 - RNA, 19 nt, Chlamydophila pneumoniae J138
ccucauccccucagaaagg

SEQ ID NO: 2541153 - RNA, 17 nt, Chlamydophila pneumoniae J138
ccucauccucaucauca

SEQ ID NO: 2541154 - RNA, 16 nt, Chlamydophila pneumoniae J138
ccucauucaaggcgcc

SEQ ID NO: 2541155 - RNA, 22 nt, Chlamydophila pneumoniae J138
ccuccaaaagaccaaaaauaaa

SEQ ID NO: 2541156 - RNA, 17 nt, Chlamydophila pneumoniae J138
ccuccaacaaacaauuc

SEQ ID NO: 2541157 - RNA, 15 nt, Chlamydophila pneumoniae J138
ccuccaccagaagca

SEQ ID NO: 2541158 - RNA, 15 nt, Chlamydophila pneumoniae J138
ccuccaccaggagcu

SEQ ID NO: 2541159 - RNA, 17 nt, Chlamydophila pneumoniae J138
ccuccauaaugcugaga

SEQ ID NO: 2541160 - RNA, 21 nt, Chlamydophila pneumoniae J138
ccuccgaggagggaaacaccg

SEQ ID NO: 2541161 - RNA, 21 nt, Chlamydophila pneumoniae J138
ccuccgauugcuaaucccuuc

SEQ ID NO: 2541162 - RNA, 11 nt, Chlamydophila pneumoniae J138
ccuccucuucu

SEQ ID NO: 2541163 - RNA, 20 nt, Chlamydophila pneumoniae J138
ccuccucuucuauucugaua

SEQ ID NO: 2541164 - RNA, 16 nt, Chlamydophila pneumoniae J138
ccuccucuucuucauc

SEQ ID NO: 2541165 - RNA, 22 nt, Chlamydophila pneumoniae J138
ccucgcaauccaggaauagaaa

SEQ ID NO: 2541166 - RNA, 13 nt, Chlamydophila pneumoniae J138
ccucgccaaacca

SEQ ID NO: 2541167 - RNA, 15 nt, Chlamydophila pneumoniae J138
ccucgccgcugcccu

SEQ ID NO: 2541168 - RNA, 16 nt, Chlamydophila pneumoniae J138
ccucgccgcugcccua

SEQ ID NO: 2541169 - RNA, 21 nt, Chlamydophila pneumoniae J138
ccucgguuauuuuuccagaaa

SEQ ID NO: 2541170 - RNA, 16 nt, Chlamydophila pneumoniae J138
ccucgucaccugagcu

SEQ ID NO: 2541171 - RNA, 15 nt, Chlamydophila pneumoniae J138
ccucuaaaaacccua

SEQ ID NO: 2541172 - RNA, 22 nt, Chlamydophila pneumoniae J138
ccucuaaacauaaagacccuuc

SEQ ID NO: 2541173 - RNA, 22 nt, Chlamydophila pneumoniae J138
ccucuaaggacaaaucucccaa

SEQ ID NO: 2541174 - RNA, 20 nt, Chlamydophila pneumoniae J138
ccucuacgcuauucuuaagc

SEQ ID NO: 2541175 - RNA, 15 nt, Chlamydophila pneumoniae J138
ccucuagaagacaca

SEQ ID NO: 2541176 - RNA, 17 nt, Chlamydophila pneumoniae J138
ccucuagaagacacagg

SEQ ID NO: 2541177 - RNA, 18 nt, Chlamydophila pneumoniae J138
ccucucacauuugcagac

SEQ ID NO: 2541178 - RNA, 23 nt, Chlamydophila pneumoniae J138
ccucucaugaaauuuucuaagag

SEQ ID NO: 2541179 - RNA, 14 nt, Chlamydophila pneumoniae J138
ccucucccuuggga

SEQ ID NO: 2541180 - RNA, 15 nt, Chlamydophila pneumoniae J138
ccucuccuugaaaau

SEQ ID NO: 2541181 - RNA, 20 nt, Chlamydophila pneumoniae J138
ccucucucaagucuauuuga

SEQ ID NO: 2541182 - RNA, 19 nt, Chlamydophila pneumoniae J138
ccucugauuauuucuaaaa

SEQ ID NO: 2541183 - RNA, 20 nt, Chlamydophila pneumoniae J138
ccucugcauauaaagacucu

SEQ ID NO: 2541184 - RNA, 16 nt, Chlamydophila pneumoniae J138
ccucugggaagacucu

SEQ ID NO: 2541185 - RNA, 22 nt, Chlamydophila pneumoniae J138
ccucugggaagacucucaucag

SEQ ID NO: 2541186 - RNA, 18 nt, Chlamydophila pneumoniae J138
ccucuguagguuuuucca

SEQ ID NO: 2541187 - RNA, 20 nt, Chlamydophila pneumoniae J138
ccucuugaggaccuuccuua

SEQ ID NO: 2541188 - RNA, 19 nt, Chlamydophila pneumoniae J138
ccucuuuuauauaccacua

SEQ ID NO: 2541189 - RNA, 13 nt, Chlamydophila pneumoniae J138
ccugaaaguacag

SEQ ID NO: 2541190 - RNA, 23 nt, Chlamydophila pneumoniae J138
ccugaaaguacagaaaggaccuc

SEQ ID NO: 2541191 - RNA, 13 nt, Chlamydophila pneumoniae J138
cucaugaagaauu

SEQ ID NO: 2541192 - RNA, 21 nt, Chlamydophila pneumoniae J138
cucaugaagaauuaccgcgag

SEQ ID NO: 2541193 - RNA, 15 nt, Chlamydophila pneumoniae J138
cucauggauuacuga

SEQ ID NO: 2541194 - RNA, 19 nt, Chlamydophila pneumoniae J138
cucauuaagaggagucccc

SEQ ID NO: 2541195 - RNA, 18 nt, Chlamydophila pneumoniae J138
cucauuccagcaucuucu

SEQ ID NO: 2541196 - RNA, 22 nt, Chlamydophila pneumoniae J138
cucauugcggcaccaaagaugc

SEQ ID NO: 2541197 - RNA, 18 nt, Chlamydophila pneumoniae J138
cuccaaaagcucuacaag

SEQ ID NO: 2541198 - RNA, 14 nt, Chlamydophila pneumoniae J138
cuccaaaauaaucu

SEQ ID NO: 2541199 - RNA, 23 nt, Chlamydophila pneumoniae J138
cuccaaaauaaucucgcaguccu

SEQ ID NO: 2541200 - RNA, 20 nt, Chlamydophila pneumoniae J138
cuccaaacauuuuuaaggaa

SEQ ID NO: 2541201 - RNA, 23 nt, Chlamydophila pneumoniae J138
cuccaacaccgaaggcacuggca

SEQ ID NO: 2541202 - RNA, 13 nt, Chlamydophila pneumoniae J138
cuccaacagucug

SEQ ID NO: 2541203 - RNA, 19 nt, Chlamydophila pneumoniae J138
cuccaacuaaaccuucaau

SEQ ID NO: 2541204 - RNA, 20 nt, Chlamydophila pneumoniae J138
cuccaacuuccauaugaggu

SEQ ID NO: 2541205 - RNA, 19 nt, Chlamydophila pneumoniae J138
cuccaagaauagcaggaag

SEQ ID NO: 2541206 - RNA, 23 nt, Chlamydophila pneumoniae J138
cuccaagaauagcaggaaggaau

SEQ ID NO: 2541207 - RNA, 18 nt, Chlamydophila pneumoniae J138
cuccaagucagccaagac

SEQ ID NO: 2541208 - RNA, 19 nt, Chlamydophila pneumoniae J138
cuccacaggaaugaaaccu

SEQ ID NO: 2541209 - RNA, 18 nt, Chlamydophila pneumoniae J138
cuccacaugcccaaacau

SEQ ID NO: 2541210 - RNA, 12 nt, Chlamydophila pneumoniae J138
cuccaccagaag

SEQ ID NO: 2541211 - RNA, 21 nt, Chlamydophila pneumoniae J138
cuccaccaggagcuccuccuu

SEQ ID NO: 2541212 - RNA, 22 nt, Chlamydophila pneumoniae J138
cuccaccaggagcuccuccuug

SEQ ID NO: 2541213 - RNA, 17 nt, Chlamydophila pneumoniae J138
cuccagaaacgcagcuu

SEQ ID NO: 2541214 - RNA, 18 nt, Chlamydophila pneumoniae J138
cuccagaaacgcagcuuu

SEQ ID NO: 2541215 - RNA, 18 nt, Chlamydophila pneumoniae J138
cuccagaaaguauuccuc

SEQ ID NO: 2541216 - RNA, 16 nt, Chlamydophila pneumoniae J138
cuccagaaauuuuuac

SEQ ID NO: 2541217 - RNA, 22 nt, Chlamydophila pneumoniae J138
cuccagaaauuuuuacaaucuc

SEQ ID NO: 2541218 - RNA, 16 nt, Chlamydophila pneumoniae J138
cuccagaagcaagaau

SEQ ID NO: 2541219 - RNA, 13 nt, Chlamydophila pneumoniae J138
cuccagcauaagg

SEQ ID NO: 2541220 - RNA, 15 nt, Chlamydophila pneumoniae J138
cuccagcauaaggau

SEQ ID NO: 2541221 - RNA, 17 nt, Chlamydophila pneumoniae J138
cuccaggggauaaaacu

SEQ ID NO: 2541222 - RNA, 22 nt, Chlamydophila pneumoniae J138
cuccaggguguuugcauaguau

SEQ ID NO: 2541223 - RNA, 15 nt, Chlamydophila pneumoniae J138
cuccauaagcuuuuc

SEQ ID NO: 2541224 - RNA, 17 nt, Chlamydophila pneumoniae J138
cuccauuggcauagagc

SEQ ID NO: 2541225 - RNA, 18 nt, Chlamydophila pneumoniae J138
cuccauuuagaaugaccg

SEQ ID NO: 2541226 - RNA, 14 nt, Chlamydophila pneumoniae J138
cuccauuucuagga

SEQ ID NO: 2541227 - RNA, 21 nt, Chlamydophila pneumoniae J138
cuccauuucuaggaauugcug

SEQ ID NO: 2541228 - RNA, 18 nt, Chlamydophila pneumoniae J138
cucccaaauuggagguca

SEQ ID NO: 2541229 - RNA, 16 nt, Chlamydophila pneumoniae J138
cucccaagacgagaac

SEQ ID NO: 2541230 - RNA, 17 nt, Chlamydophila pneumoniae J138
cucccaauauccagaaa

SEQ ID NO: 2541231 - RNA, 16 nt, Chlamydophila pneumoniae J138
cucccaccaaggggcg

SEQ ID NO: 2541232 - RNA, 17 nt, Chlamydophila pneumoniae J138
cucccauagcaaugccu

SEQ ID NO: 2541233 - RNA, 19 nt, Chlamydophila pneumoniae J138
cucccauguaguaaauucc

SEQ ID NO: 2541234 - RNA, 14 nt, Chlamydophila pneumoniae J138
cucccauuucugga

SEQ ID NO: 2541235 - RNA, 22 nt, Chlamydophila pneumoniae J138
cucccauuucuggagaaugccc

SEQ ID NO: 2541236 - RNA, 13 nt, Chlamydophila pneumoniae J138
cuccccauacaua

SEQ ID NO: 2541237 - RNA, 20 nt, Chlamydophila pneumoniae J138
cucccguuccuuuagccugg

SEQ ID NO: 2541238 - RNA, 20 nt, Chlamydophila pneumoniae J138
cucccuagguuuuaucuuua

SEQ ID NO: 2541239 - RNA, 17 nt, Chlamydophila pneumoniae J138
cucccuaugccaguucc

SEQ ID NO: 2541240 - RNA, 21 nt, Chlamydophila pneumoniae J138
cucccuggucuguauuuucuu

SEQ ID NO: 2541241 - RNA, 12 nt, Chlamydophila pneumoniae J138
cuccgaagacua

SEQ ID NO: 2541242 - RNA, 15 nt, Chlamydophila pneumoniae J138
cuccgaagacuacca

SEQ ID NO: 2541243 - RNA, 13 nt, Chlamydophila pneumoniae J138
cuccgaggaggga

SEQ ID NO: 2541244 - RNA, 23 nt, Chlamydophila pneumoniae J138
cuccgcuuuuacgaaugagauca

SEQ ID NO: 2541245 - RNA, 20 nt, Chlamydophila pneumoniae J138
cuccguccaguucuucauuc

SEQ ID NO: 2541246 - RNA, 18 nt, Chlamydophila pneumoniae J138
cuccgucuccuaucagag

SEQ ID NO: 2541247 - RNA, 19 nt, Chlamydophila pneumoniae J138
cuccguggcggauaaucaa

SEQ ID NO: 2541248 - RNA, 21 nt, Chlamydophila pneumoniae J138
cuccuaaaccaucacuuccug

SEQ ID NO: 2541249 - RNA, 23 nt, Chlamydophila pneumoniae J138
cuccuaaggaaaccacguccauu

SEQ ID NO: 2541250 - RNA, 14 nt, Chlamydophila pneumoniae J138
cuccuagacagccu

SEQ ID NO: 2541251 - RNA, 12 nt, Chlamydophila pneumoniae J138
cuccuaggggaa

SEQ ID NO: 2541252 - RNA, 22 nt, Chlamydophila pneumoniae J138
cuccuauuccggagcccucggu

SEQ ID NO: 2541253 - RNA, 12 nt, Chlamydophila pneumoniae J138
cuccucaaaaga

SEQ ID NO: 2541254 - RNA, 13 nt, Chlamydophila pneumoniae J138
cuccucaaaagau

SEQ ID NO: 2541255 - RNA, 19 nt, Chlamydophila pneumoniae J138
cuccucagaauccauuuug

SEQ ID NO: 2541256 - RNA, 23 nt, Chlamydophila pneumoniae J138
cuccucagaauccauuuugccca

SEQ ID NO: 2541257 - RNA, 17 nt, Chlamydophila pneumoniae J138
cuccuccaaucugcuga

SEQ ID NO: 2541258 - RNA, 18 nt, Chlamydophila pneumoniae J138
cuccuccaaugagcucua

SEQ ID NO: 2541259 - RNA, 16 nt, Chlamydophila pneumoniae J138
cuccuccuucugcaau

SEQ ID NO: 2541260 - RNA, 23 nt, Chlamydophila pneumoniae J138
cuccucguuaauaagaaccucua

SEQ ID NO: 2541261 - RNA, 17 nt, Chlamydophila pneumoniae J138
cuccucuaacuucauua

SEQ ID NO: 2541262 - RNA, 17 nt, Chlamydophila pneumoniae J138
cuccucucucaauaaga

SEQ ID NO: 2541263 - RNA, 12 nt, Chlamydophila pneumoniae J138
cuccucugcuaa

SEQ ID NO: 2541264 - RNA, 15 nt, Chlamydophila pneumoniae J138
cuccucugcuaagca

SEQ ID NO: 2541265 - RNA, 23 nt, Chlamydophila pneumoniae J138
cuccugaagccaugacaaagggu

SEQ ID NO: 2541266 - RNA, 12 nt, Chlamydophila pneumoniae J138
cuccugaagcug

SEQ ID NO: 2541267 - RNA, 21 nt, Chlamydophila pneumoniae J138
cuccugaagcugagaauacaa

SEQ ID NO: 2541268 - RNA, 20 nt, Chlamydophila pneumoniae J138
cuccugaagggacaaguacg

SEQ ID NO: 2541269 - RNA, 23 nt, Chlamydophila pneumoniae J138
cuccugacucuuuuaagacaaua

SEQ ID NO: 2541270 - RNA, 16 nt, Chlamydophila pneumoniae J138
cuccugcaaaaaacca

SEQ ID NO: 2541271 - RNA, 22 nt, Chlamydophila pneumoniae J138
cuccuggaagaauuucauaaga

SEQ ID NO: 2541272 - RNA, 19 nt, Chlamydophila pneumoniae J138
cuccuucauucacagcagu

SEQ ID NO: 2541273 - RNA, 20 nt, Chlamydophila pneumoniae J138
cuccuugacuaaauccacca

SEQ ID NO: 2541274 - RNA, 13 nt, Chlamydophila pneumoniae J138
cuccuuuaaauaa

SEQ ID NO: 2541275 - RNA, 19 nt, Chlamydophila pneumoniae J138
cuccuuuuaaaauuuugau

SEQ ID NO: 2541276 - RNA, 23 nt, Chlamydophila pneumoniae J138
cuccuuuuuaggacgcuauccua

SEQ ID NO: 2541277 - RNA, 19 nt, Chlamydophila pneumoniae J138
cucgaaacucuuugaggau

SEQ ID NO: 2541278 - RNA, 12 nt, Chlamydophila pneumoniae J138
cucgaaauccua

SEQ ID NO: 2541279 - RNA, 18 nt, Chlamydophila pneumoniae J138
cucgaaccacuguccaug

SEQ ID NO: 2541280 - RNA, 19 nt, Chlamydophila pneumoniae J138
cucgaacucugaaguacac

SEQ ID NO: 2541281 - RNA, 12 nt, Chlamydophila pneumoniae J138
cucgaagaaaau

SEQ ID NO: 2541282 - RNA, 18 nt, Chlamydophila pneumoniae J138
cucgaagcuugcugauuu

SEQ ID NO: 2541283 - RNA, 23 nt, Chlamydophila pneumoniae J138
cucgaauuguguguuuucauaaa

SEQ ID NO: 2541284 - RNA, 18 nt, Chlamydophila pneumoniae J138
cucgacacuauguguuuc

SEQ ID NO: 2541285 - RNA, 20 nt, Chlamydophila pneumoniae J138
cucgacguauuugccaaaau

SEQ ID NO: 2541286 - RNA, 21 nt, Chlamydophila pneumoniae J138
cucgagcagaaacuccaaaau

SEQ ID NO: 2541287 - RNA, 14 nt, Chlamydophila pneumoniae J138
cucgauuauuucuu

SEQ ID NO: 2541288 - RNA, 17 nt, Chlamydophila pneumoniae J138
cucgauuugaucuugcu

SEQ ID NO: 2541289 - RNA, 22 nt, Chlamydophila pneumoniae J138
cucgcuaaaguagaauccuucu

SEQ ID NO: 2541290 - RNA, 16 nt, Chlamydophila pneumoniae J138
cucgcuauuccauaaa

SEQ ID NO: 2541291 - RNA, 18 nt, Chlamydophila pneumoniae J138
cucgcuguuucaacaccu

SEQ ID NO: 2541292 - RNA, 22 nt, Chlamydophila pneumoniae J138
cucggaaaucagggauauacaa

SEQ ID NO: 2541293 - RNA, 14 nt, Chlamydophila pneumoniae J138
cucggacagaaaga

SEQ ID NO: 2541294 - RNA, 22 nt, Chlamydophila pneumoniae J138
cucggauggacuacugaaacac

SEQ ID NO: 2541295 - RNA, 19 nt, Chlamydophila pneumoniae J138
cucgguuauuuuuccagaa

SEQ ID NO: 2541296 - RNA, 16 nt, Chlamydophila pneumoniae J138
cucguacguggaaagu

SEQ ID NO: 2541297 - RNA, 20 nt, Chlamydophila pneumoniae J138
cucguagcuauuuuugagga

SEQ ID NO: 2541298 - RNA, 23 nt, Chlamydophila pneumoniae J138
cucgugcaaggccuaaucuugua

SEQ ID NO: 2541299 - RNA, 14 nt, Chlamydophila pneumoniae J138
cucuaaaaaagaua

SEQ ID NO: 2541300 - RNA, 21 nt, Chlamydophila pneumoniae J138
cucuaaacauaaagacccuuc

SEQ ID NO: 2541301 - RNA, 18 nt, Chlamydophila pneumoniae J138
cucuaaacucucuuccuu

SEQ ID NO: 2541302 - RNA, 14 nt, Chlamydophila pneumoniae J138
cucuaacuucauua

SEQ ID NO: 2541303 - RNA, 17 nt, Chlamydophila pneumoniae J138
cucuaagcgaaacauua

SEQ ID NO: 2541304 - RNA, 19 nt, Chlamydophila pneumoniae J138
cucuaagcugugcauuuuc

SEQ ID NO: 2541305 - RNA, 21 nt, Chlamydophila pneumoniae J138
cucuaagcugugcauuuucuu

SEQ ID NO: 2541306 - RNA, 21 nt, Chlamydophila pneumoniae J138
cucuaaggacaaaucucccaa

SEQ ID NO: 2541307 - RNA, 18 nt, Chlamydophila pneumoniae J138
cucuaauucuucuacaga

SEQ ID NO: 2541308 - RNA, 16 nt, Chlamydophila pneumoniae J138
cucuacaggagaagcg

SEQ ID NO: 2541309 - RNA, 24 nt, Chlamydophila pneumoniae J138
cucuacaguaguaaauaauaaccu

SEQ ID NO: 2541310 - RNA, 13 nt, Chlamydophila pneumoniae J138
cucuaccaacuga

SEQ ID NO: 2541311 - RNA, 16 nt, Chlamydophila pneumoniae J138
cucuaccaacugagcu

SEQ ID NO: 2541312 - RNA, 15 nt, Chlamydophila pneumoniae J138
cucuaccaucaugaa

SEQ ID NO: 2541313 - RNA, 20 nt, Chlamydophila pneumoniae J138
cucuacuaaaaucucauuuc

SEQ ID NO: 2541314 - RNA, 14 nt, Chlamydophila pneumoniae J138
cucuacucuacagu

SEQ ID NO: 2541315 - RNA, 22 nt, Chlamydophila pneumoniae J138
cucuagaggagcgaugacuugg

SEQ ID NO: 2541316 - RNA, 20 nt, Chlamydophila pneumoniae J138
cucuagcaccuaauaaagaa

SEQ ID NO: 2541317 - RNA, 21 nt, Chlamydophila pneumoniae J138
cucuaggaacucuuuaaaagg

SEQ ID NO: 2541318 - RNA, 13 nt, Chlamydophila pneumoniae J138
cucuauagcauua

SEQ ID NO: 2541319 - RNA, 19 nt, Chlamydophila pneumoniae J138
cucuauauuuuuucccaca

SEQ ID NO: 2541320 - RNA, 23 nt, Chlamydophila pneumoniae J138
cucuaucagggcuacgguaaaau

SEQ ID NO: 2541321 - RNA, 21 nt, Chlamydophila pneumoniae J138
cucuaugguuuucauugcagu

SEQ ID NO: 2541322 - RNA, 16 nt, Chlamydophila pneumoniae J138
cucucaagucuauuug

SEQ ID NO: 2541323 - RNA, 13 nt, Chlamydophila pneumoniae J138
cucucaauaagau

SEQ ID NO: 2541324 - RNA, 14 nt, Chlamydophila pneumoniae J138
cucucacugagugu

SEQ ID NO: 2541325 - RNA, 19 nt, Chlamydophila pneumoniae J138
cucucaguuaaagagcauc

SEQ ID NO: 2541326 - RNA, 22 nt, Chlamydophila pneumoniae J138
cucucaucaaagcaaagagcaa

SEQ ID NO: 2541327 - RNA, 11 nt, Chlamydophila pneumoniae J138
cucuccaaaag

SEQ ID NO: 2541328 - RNA, 13 nt, Chlamydophila pneumoniae J138
cucuccaaaagcu

SEQ ID NO: 2541329 - RNA, 13 nt, Chlamydophila pneumoniae J138
cucuccacagggu

SEQ ID NO: 2541330 - RNA, 21 nt, Chlamydophila pneumoniae J138
cucuccacagggucuaguuca

SEQ ID NO: 2541331 - RNA, 23 nt, Chlamydophila pneumoniae J138
cucuccacagggucuaguucaau

SEQ ID NO: 2541332 - RNA, 18 nt, Chlamydophila pneumoniae J138
cucuccagaagucgcagu

SEQ ID NO: 2541333 - RNA, 16 nt, Chlamydophila pneumoniae J138
cucuccagcuugauca

SEQ ID NO: 2541334 - RNA, 12 nt, Chlamydophila pneumoniae J138
cucuccauggcu

SEQ ID NO: 2541335 - RNA, 19 nt, Chlamydophila pneumoniae J138
cucuccgauaugggcuuug

SEQ ID NO: 2541336 - RNA, 20 nt, Chlamydophila pneumoniae J138
cucuccgucauauuuaaaag

SEQ ID NO: 2541337 - RNA, 14 nt, Chlamydophila pneumoniae J138
cucuccuaaaccau

SEQ ID NO: 2541338 - RNA, 23 nt, Chlamydophila pneumoniae J138
cucuccuaaugccgagaauacag

SEQ ID NO: 2541339 - RNA, 15 nt, Chlamydophila pneumoniae J138
cucuccugcaaaaag

SEQ ID NO: 2541340 - RNA, 16 nt, Chlamydophila pneumoniae J138
cucuccugcaaaaagu

SEQ ID NO: 2541341 - RNA, 24 nt, Chlamydophila pneumoniae J138
cucuccuugacaaauaaguccugu

SEQ ID NO: 2541342 - RNA, 12 nt, Chlamydophila pneumoniae J138
cucucucugcag

SEQ ID NO: 2541343 - RNA, 16 nt, Chlamydophila pneumoniae J138
cucucugccuaccaaa

SEQ ID NO: 2541344 - RNA, 19 nt, Chlamydophila pneumoniae J138
cucucuguagcacuucuca

SEQ ID NO: 2541345 - RNA, 21 nt, Chlamydophila pneumoniae J138
cucucuguagcacuucucagc

SEQ ID NO: 2541346 - RNA, 13 nt, Chlamydophila pneumoniae J138
cucucuuccaaaa

SEQ ID NO: 2541347 - RNA, 14 nt, Chlamydophila pneumoniae J138
cucucuuccaaaag

SEQ ID NO: 2541348 - RNA, 13 nt, Chlamydophila pneumoniae J138
cucucuuccuucu

SEQ ID NO: 2541349 - RNA, 14 nt, Chlamydophila pneumoniae J138
cucucuuccuucuc

SEQ ID NO: 2541350 - RNA, 15 nt, Chlamydophila pneumoniae J138
cucucuuuaaaaaua

SEQ ID NO: 2541351 - RNA, 17 nt, Chlamydophila pneumoniae J138
cucucuuuaaaaauaua

SEQ ID NO: 2541352 - RNA, 23 nt, Chlamydophila pneumoniae J138
cucucuuuaaaaauauaucuuca

SEQ ID NO: 2541353 - RNA, 15 nt, Chlamydophila pneumoniae J138
cucucuuuaucuuua

SEQ ID NO: 2541354 - RNA, 13 nt, Chlamydophila pneumoniae J138
cucugaacaggaa

SEQ ID NO: 2541355 - RNA, 20 nt, Chlamydophila pneumoniae J138
cucugaagaccccucuugcu

SEQ ID NO: 2541356 - RNA, 12 nt, Chlamydophila pneumoniae J138
cucugaaggauu

SEQ ID NO: 2541357 - RNA, 22 nt, Chlamydophila pneumoniae J138
cucugaccaucaaugagaucug

SEQ ID NO: 2541358 - RNA, 15 nt, Chlamydophila pneumoniae J138
cucugagcagcuucg

SEQ ID NO: 2541359 - RNA, 12 nt, Chlamydophila pneumoniae J138
cucugcagggaa

SEQ ID NO: 2541360 - RNA, 14 nt, Chlamydophila pneumoniae J138
cucugcagggaauc

SEQ ID NO: 2541361 - RNA, 16 nt, Chlamydophila pneumoniae J138
cucugcauauugcucu

SEQ ID NO: 2541362 - RNA, 20 nt, Chlamydophila pneumoniae J138
cucugccaugucuaaaggag

SEQ ID NO: 2541363 - RNA, 21 nt, Chlamydophila pneumoniae J138
cucugccaugucuaaaggagu

SEQ ID NO: 2541364 - RNA, 15 nt, Chlamydophila pneumoniae J138
cucugccuaccaaag

SEQ ID NO: 2541365 - RNA, 23 nt, Chlamydophila pneumoniae J138
cucugccuaccaaaguuuguagc

SEQ ID NO: 2541366 - RNA, 21 nt, Chlamydophila pneumoniae J138
cucugggaagacucucaucag

SEQ ID NO: 2541367 - RNA, 19 nt, Chlamydophila pneumoniae J138
cucugguauagaaacaccg

SEQ ID NO: 2541368 - RNA, 20 nt, Chlamydophila pneumoniae J138
cucugguauagaaacaccgu

SEQ ID NO: 2541369 - RNA, 23 nt, Chlamydophila pneumoniae J138
cucuguagguuuuuccaacuuca

SEQ ID NO: 2541370 - RNA, 11 nt, Chlamydophila pneumoniae J138
cucuguaguaa

SEQ ID NO: 2541371 - RNA, 18 nt, Chlamydophila pneumoniae J138
cucuguaguaaagccaca

SEQ ID NO: 2541372 - RNA, 16 nt, Chlamydophila pneumoniae J138
cucugugguuccugga

SEQ ID NO: 2541373 - RNA, 17 nt, Chlamydophila pneumoniae J138
cucugugguuccuggau

SEQ ID NO: 2541374 - RNA, 23 nt, Chlamydophila pneumoniae J138
cucugugguuccuggauuuagga

SEQ ID NO: 2541375 - RNA, 23 nt, Chlamydophila pneumoniae J138
cucugugguuuuuauucuuaaug

SEQ ID NO: 2541376 - RNA, 20 nt, Chlamydophila pneumoniae J138
cucuguguuuugaggaacuu

SEQ ID NO: 2541377 - RNA, 14 nt, Chlamydophila pneumoniae J138
cucuguuuccuugu

SEQ ID NO: 2541378 - RNA, 23 nt, Chlamydophila pneumoniae J138
cucuuaaaugugaaaucguaucu

SEQ ID NO: 2541379 - RNA, 14 nt, Chlamydophila pneumoniae J138
cucuuaagaauaaa

SEQ ID NO: 2541380 - RNA, 14 nt, Chlamydophila pneumoniae J138
cucuuaauuaaaaa

SEQ ID NO: 2541381 - RNA, 23 nt, Chlamydophila pneumoniae J138
cucuuaucgugacucuuaucugg

SEQ ID NO: 2541382 - RNA, 14 nt, Chlamydophila pneumoniae J138
cucuucaagagcuu

SEQ ID NO: 2541383 - RNA, 19 nt, Chlamydophila pneumoniae J138
cucuucacuuauaagcugc

SEQ ID NO: 2541384 - RNA, 22 nt, Chlamydophila pneumoniae J138
cucuucagcagguucuugaauc

SEQ ID NO: 2541385 - RNA, 20 nt, Chlamydophila pneumoniae J138
cucuucauugcaaaaaugaa

SEQ ID NO: 2541386 - RNA, 14 nt, Chlamydophila pneumoniae J138
cucuucauuuucuu

SEQ ID NO: 2541387 - RNA, 13 nt, Chlamydophila pneumoniae J138
cucuuccaaaagu

SEQ ID NO: 2541388 - RNA, 15 nt, Chlamydophila pneumoniae J138
cucuucccuuguuau

SEQ ID NO: 2541389 - RNA, 14 nt, Chlamydophila pneumoniae J138
cucuuccugcugcu

SEQ ID NO: 2541390 - RNA, 15 nt, Chlamydophila pneumoniae J138
cucuuccugcugcuu

SEQ ID NO: 2541391 - RNA, 18 nt, Chlamydophila pneumoniae J138
cucuuccuucuacagauu

SEQ ID NO: 2541392 - RNA, 15 nt, Chlamydophila pneumoniae J138
cucuuccuucuauug

SEQ ID NO: 2541393 - RNA, 15 nt, Chlamydophila pneumoniae J138
cucuucuuuggaugc

SEQ ID NO: 2541394 - RNA, 20 nt, Chlamydophila pneumoniae J138
cucuugauugcuaucaaaga

SEQ ID NO: 2541395 - RNA, 18 nt, Chlamydophila pneumoniae J138
cucuugcgaacuauccua

SEQ ID NO: 2541396 - RNA, 20 nt, Chlamydophila pneumoniae J138
cucuugcgucacauuuguug

SEQ ID NO: 2541397 - RNA, 15 nt, Chlamydophila pneumoniae J138
cucuuggaugaccuu

SEQ ID NO: 2541398 - RNA, 18 nt, Chlamydophila pneumoniae J138
cucuuuaaaaauagaaau

SEQ ID NO: 2541399 - RNA, 20 nt, Chlamydophila pneumoniae J138
cucuuuaaaaauagaaauaa

SEQ ID NO: 2541400 - RNA, 21 nt, Chlamydophila pneumoniae J138
cucuuuagcaaacauuuuuau

SEQ ID NO: 2541401 - RNA, 20 nt, Chlamydophila pneumoniae J138
cucuuuauauuuuuugagaa

SEQ ID NO: 2541402 - RNA, 16 nt, Chlamydophila pneumoniae J138
cucuuucagcucaagu

SEQ ID NO: 2541403 - RNA, 20 nt, Chlamydophila pneumoniae J138
cucuuucauacuaaaaucuu

SEQ ID NO: 2541404 - RNA, 15 nt, Chlamydophila pneumoniae J138
cucuuuuaaagugag

SEQ ID NO: 2541405 - RNA, 18 nt, Chlamydophila pneumoniae J138
cucuuuuagagccuuuuc

SEQ ID NO: 2541406 - RNA, 20 nt, Chlamydophila pneumoniae J138
cugaaagaacacuccugacu

SEQ ID NO: 2541407 - RNA, 15 nt, Chlamydophila pneumoniae J138
cugaaaucaaaaaaa

SEQ ID NO: 2541408 - RNA, 16 nt, Chlamydophila pneumoniae J138
cugaaaucaaaaaaaa

SEQ ID NO: 2541409 - RNA, 15 nt, Chlamydophila pneumoniae J138
cugaaauccugggca

SEQ ID NO: 2541410 - RNA, 16 nt, Chlamydophila pneumoniae J138
cugaacaucuccagca

SEQ ID NO: 2541411 - RNA, 23 nt, Chlamydophila pneumoniae J138
cugaaccgcaaaaagcuucuuuc

SEQ ID NO: 2541412 - RNA, 14 nt, Chlamydophila pneumoniae J138
cugaacgagguaac

SEQ ID NO: 2541413 - RNA, 17 nt, Chlamydophila pneumoniae J138
cugaacgccaucuccac

SEQ ID NO: 2541414 - RNA, 15 nt, Chlamydophila pneumoniae J138
cugaagaccccucuu

SEQ ID NO: 2541415 - RNA, 19 nt, Chlamydophila pneumoniae J138
cugaagagcaauuaagaaa

SEQ ID NO: 2541416 - RNA, 15 nt, Chlamydophila pneumoniae J138
cugaagaggccugca

SEQ ID NO: 2541417 - RNA, 20 nt, Chlamydophila pneumoniae J138
cugaagauauauuuuuaaag

SEQ ID NO: 2541418 - RNA, 21 nt, Chlamydophila pneumoniae J138
cugaagauauauuuuuaaaga

SEQ ID NO: 2541419 - RNA, 20 nt, Chlamydophila pneumoniae J138
cugaagaucccugagccugu

SEQ ID NO: 2541420 - RNA, 14 nt, Chlamydophila pneumoniae J138
cugaagaugagaaa

SEQ ID NO: 2541421 - RNA, 10 nt, Chlamydophila pneumoniae J138
cugaagauuu

SEQ ID NO: 2541422 - RNA, 24 nt, Chlamydophila pneumoniae J138
cugaagcagcuucugcaggauuug

SEQ ID NO: 2541423 - RNA, 16 nt, Chlamydophila pneumoniae J138
cugaagccaugacaaa

SEQ ID NO: 2541424 - RNA, 11 nt, Chlamydophila pneumoniae J138
cugaagcugca

SEQ ID NO: 2541425 - RNA, 15 nt, Chlamydophila pneumoniae J138
cugaagcugcaaacu

SEQ ID NO: 2541426 - RNA, 16 nt, Chlamydophila pneumoniae J138
cuucguuagaaaccau

SEQ ID NO: 2541427 - RNA, 22 nt, Chlamydophila pneumoniae J138
cuucguuucuuugaguuaagca

SEQ ID NO: 2541428 - RNA, 19 nt, Chlamydophila pneumoniae J138
cuucuaaaaacucuucauc

SEQ ID NO: 2541429 - RNA, 20 nt, Chlamydophila pneumoniae J138
cuucuaaggaaauuacaauc

SEQ ID NO: 2541430 - RNA, 12 nt, Chlamydophila pneumoniae J138
cuucuacaccau

SEQ ID NO: 2541431 - RNA, 13 nt, Chlamydophila pneumoniae J138
cuucuacagcauc

SEQ ID NO: 2541432 - RNA, 17 nt, Chlamydophila pneumoniae J138
cuucuagguauuuguuu

SEQ ID NO: 2541433 - RNA, 19 nt, Chlamydophila pneumoniae J138
cuucuagguauuuguuuca

SEQ ID NO: 2541434 - RNA, 16 nt, Chlamydophila pneumoniae J138
cuucuaugguaaucac

SEQ ID NO: 2541435 - RNA, 15 nt, Chlamydophila pneumoniae J138
cuucuauuucuauua

SEQ ID NO: 2541436 - RNA, 11 nt, Chlamydophila pneumoniae J138
cuucucaaaga

SEQ ID NO: 2541437 - RNA, 16 nt, Chlamydophila pneumoniae J138
cuucucaaagacaaug

SEQ ID NO: 2541438 - RNA, 11 nt, Chlamydophila pneumoniae J138
cuucucagaaa

SEQ ID NO: 2541439 - RNA, 15 nt, Chlamydophila pneumoniae J138
cuucuccaaauaaag

SEQ ID NO: 2541440 - RNA, 14 nt, Chlamydophila pneumoniae J138
cuucuccaacccca

SEQ ID NO: 2541441 - RNA, 14 nt, Chlamydophila pneumoniae J138
cuucuccagagcaa

SEQ ID NO: 2541442 - RNA, 17 nt, Chlamydophila pneumoniae J138
cuucuccagagcaagau

SEQ ID NO: 2541443 - RNA, 16 nt, Chlamydophila pneumoniae J138
cuucucccgcuaauua

SEQ ID NO: 2541444 - RNA, 13 nt, Chlamydophila pneumoniae J138
cuucucccucuaa

SEQ ID NO: 2541445 - RNA, 19 nt, Chlamydophila pneumoniae J138
cuucucccucuaaacauaa

SEQ ID NO: 2541446 - RNA, 14 nt, Chlamydophila pneumoniae J138
cuucucccuguauu

SEQ ID NO: 2541447 - RNA, 16 nt, Chlamydophila pneumoniae J138
cuucuccucgcaaucc

SEQ ID NO: 2541448 - RNA, 23 nt, Chlamydophila pneumoniae J138
cuucuccugaaccgcaaaaagcu

SEQ ID NO: 2541449 - RNA, 19 nt, Chlamydophila pneumoniae J138
cuucucgucauucugcaag

SEQ ID NO: 2541450 - RNA, 19 nt, Chlamydophila pneumoniae J138
cuucucuaagaaauuuucu

SEQ ID NO: 2541451 - RNA, 14 nt, Chlamydophila pneumoniae J138
cuucucuacuaaaa

SEQ ID NO: 2541452 - RNA, 22 nt, Chlamydophila pneumoniae J138
cuucucuaguuguaauuucuug

SEQ ID NO: 2541453 - RNA, 13 nt, Chlamydophila pneumoniae J138
cuucucuguaucg

SEQ ID NO: 2541454 - RNA, 22 nt, Chlamydophila pneumoniae J138
cuucucuguugggagcuuccuc

SEQ ID NO: 2541455 - RNA, 22 nt, Chlamydophila pneumoniae J138
cuucugaacuguucauaaucca

SEQ ID NO: 2541456 - RNA, 16 nt, Chlamydophila pneumoniae J138
cuucugacaauaacau

SEQ ID NO: 2541457 - RNA, 15 nt, Chlamydophila pneumoniae J138
cuucugcaggauuug

SEQ ID NO: 2541458 - RNA, 15 nt, Chlamydophila pneumoniae J138
cuucuggagaaaaaa

SEQ ID NO: 2541459 - RNA, 18 nt, Chlamydophila pneumoniae J138
cuucuggauacguuuuuc

SEQ ID NO: 2541460 - RNA, 21 nt, Chlamydophila pneumoniae J138
cuucuggauacguuuuucccu

SEQ ID NO: 2541461 - RNA, 10 nt, Chlamydophila pneumoniae J138
cuucuguaaa

SEQ ID NO: 2541462 - RNA, 23 nt, Chlamydophila pneumoniae J138
cuucuguaauuuuuuucaaagga

SEQ ID NO: 2541463 - RNA, 20 nt, Chlamydophila pneumoniae J138
cuucuguaguuuguucacuu

SEQ ID NO: 2541464 - RNA, 14 nt, Chlamydophila pneumoniae J138
cuucugucuguauu

SEQ ID NO: 2541465 - RNA, 12 nt, Chlamydophila pneumoniae J138
cuucugugcauc

SEQ ID NO: 2541466 - RNA, 18 nt, Chlamydophila pneumoniae J138
cuucuuagaagagaaagu

SEQ ID NO: 2541467 - RNA, 16 nt, Chlamydophila pneumoniae J138
cuucuuaguaaagaau

SEQ ID NO: 2541468 - RNA, 14 nt, Chlamydophila pneumoniae J138
cuucuuaucuucua

SEQ ID NO: 2541469 - RNA, 14 nt, Chlamydophila pneumoniae J138
cuucuucagagcuc

SEQ ID NO: 2541470 - RNA, 12 nt, Chlamydophila pneumoniae J138
cuucuucagagu

SEQ ID NO: 2541471 - RNA, 15 nt, Chlamydophila pneumoniae J138
cuucuucagcuuuuu

SEQ ID NO: 2541472 - RNA, 22 nt, Chlamydophila pneumoniae J138
cuucuucagcuuuuucaauagc

SEQ ID NO: 2541473 - RNA, 20 nt, Chlamydophila pneumoniae J138
cuucuucccuuucaaaggca

SEQ ID NO: 2541474 - RNA, 15 nt, Chlamydophila pneumoniae J138
cuucuucggaucugu

SEQ ID NO: 2541475 - RNA, 15 nt, Chlamydophila pneumoniae J138
cuucuucuauagaau

SEQ ID NO: 2541476 - RNA, 15 nt, Chlamydophila pneumoniae J138
cuucuucuuguucuu

SEQ ID NO: 2541477 - RNA, 12 nt, Chlamydophila pneumoniae J138
cuucuugcaaag

SEQ ID NO: 2541478 - RNA, 16 nt, Chlamydophila pneumoniae J138
cuucuugcaaagauaa

SEQ ID NO: 2541479 - RNA, 17 nt, Chlamydophila pneumoniae J138
cuucuugcaaucuuuga

SEQ ID NO: 2541480 - RNA, 22 nt, Chlamydophila pneumoniae J138
cuucuuuaggguaaagaaauau

SEQ ID NO: 2541481 - RNA, 19 nt, Chlamydophila pneumoniae J138
cuucuuuaucuagcucuuc

SEQ ID NO: 2541482 - RNA, 12 nt, Chlamydophila pneumoniae J138
cuucuuucaaag

SEQ ID NO: 2541483 - RNA, 13 nt, Chlamydophila pneumoniae J138
cuucuuucaaagc

SEQ ID NO: 2541484 - RNA, 20 nt, Chlamydophila pneumoniae J138
cuucuuuccauaaagcccca

SEQ ID NO: 2541485 - RNA, 15 nt, Chlamydophila pneumoniae J138
cuucuuuccauagau

SEQ ID NO: 2541486 - RNA, 14 nt, Chlamydophila pneumoniae J138
cuucuuucugcucu

SEQ ID NO: 2541487 - RNA, 23 nt, Chlamydophila pneumoniae J138
cuucuuuuauauuaagaauggau

SEQ ID NO: 2541488 - RNA, 17 nt, Chlamydophila pneumoniae J138
cuucuuuuuuuuucuua

SEQ ID NO: 2541489 - RNA, 19 nt, Chlamydophila pneumoniae J138
cuugaaauugcucuugcuc

SEQ ID NO: 2541490 - RNA, 11 nt, Chlamydophila pneumoniae J138
cuugaacagag

SEQ ID NO: 2541491 - RNA, 13 nt, Chlamydophila pneumoniae J138
cuugaagaucucc

SEQ ID NO: 2541492 - RNA, 15 nt, Chlamydophila pneumoniae J138
cuugaaguucuucaa

SEQ ID NO: 2541493 - RNA, 15 nt, Chlamydophila pneumoniae J138
cuugaaguuuuuucu

SEQ ID NO: 2541494 - RNA, 16 nt, Chlamydophila pneumoniae J138
cuugaaguuuuuucuc

SEQ ID NO: 2541495 - RNA, 23 nt, Chlamydophila pneumoniae J138
cuugaccucaucagaaguggccu

SEQ ID NO: 2541496 - RNA, 20 nt, Chlamydophila pneumoniae J138
cuugacggcaggacucuuua

SEQ ID NO: 2541497 - RNA, 22 nt, Chlamydophila pneumoniae J138
cuugacuaaauccaccaaugau

SEQ ID NO: 2541498 - RNA, 22 nt, Chlamydophila pneumoniae J138
cuugacucuaauucagaaagac

SEQ ID NO: 2541499 - RNA, 17 nt, Chlamydophila pneumoniae J138
cuugagaaaagaacagg

SEQ ID NO: 2541500 - RNA, 18 nt, Chlamydophila pneumoniae J138
cuugagaaaagaacaggg

SEQ ID NO: 2541501 - RNA, 21 nt, Chlamydophila pneumoniae J138
cuugagagauauagcguacag

SEQ ID NO: 2541502 - RNA, 15 nt, Chlamydophila pneumoniae J138
cuugaggaauucuuu

SEQ ID NO: 2541503 - RNA, 18 nt, Chlamydophila pneumoniae J138
cuugauauuguucuucca

SEQ ID NO: 2541504 - RNA, 14 nt, Chlamydophila pneumoniae J138
cuugauauuugucu

SEQ ID NO: 2541505 - RNA, 17 nt, Chlamydophila pneumoniae J138
cuugauccuuuccaaga

SEQ ID NO: 2541506 - RNA, 18 nt, Chlamydophila pneumoniae J138
cuugauccuuuccaagaa

SEQ ID NO: 2541507 - RNA, 21 nt, Chlamydophila pneumoniae J138
cuugaucuacaaaaacuagaa

SEQ ID NO: 2541508 - RNA, 23 nt, Chlamydophila pneumoniae J138
cuugauguacaguaaaguaugca

SEQ ID NO: 2541509 - RNA, 15 nt, Chlamydophila pneumoniae J138
cuugauuccuuaagu

SEQ ID NO: 2541510 - RNA, 15 nt, Chlamydophila pneumoniae J138
cuugauucucuucca

SEQ ID NO: 2541511 - RNA, 20 nt, Chlamydophila pneumoniae J138
cuugauuugggaugaucucu

SEQ ID NO: 2541512 - RNA, 18 nt, Chlamydophila pneumoniae J138
cuugauuuguuuagcaua

SEQ ID NO: 2541513 - RNA, 17 nt, Chlamydophila pneumoniae J138
cuugcaaaacagcauca

SEQ ID NO: 2541514 - RNA, 21 nt, Chlamydophila pneumoniae J138
cuugcaaaacagcaucaggau

SEQ ID NO: 2541515 - RNA, 18 nt, Chlamydophila pneumoniae J138
cuugcagcccugcauagu

SEQ ID NO: 2541516 - RNA, 15 nt, Chlamydophila pneumoniae J138
cuugcgacauaacca

SEQ ID NO: 2541517 - RNA, 19 nt, Chlamydophila pneumoniae J138
cuugcgauacaauaaacaa

SEQ ID NO: 2541518 - RNA, 18 nt, Chlamydophila pneumoniae J138
cuugcucaggagauacaa

SEQ ID NO: 2541519 - RNA, 17 nt, Chlamydophila pneumoniae J138
cuugcucugaagcucgg

SEQ ID NO: 2541520 - RNA, 17 nt, Chlamydophila pneumoniae J138
cuugcucuuuaauaagg

SEQ ID NO: 2541521 - RNA, 22 nt, Chlamydophila pneumoniae J138
cuugcugauccucggcaucuuu

SEQ ID NO: 2541522 - RNA, 23 nt, Chlamydophila pneumoniae J138
cuugcuuugugaguucuuccuuc

SEQ ID NO: 2541523 - RNA, 16 nt, Chlamydophila pneumoniae J138
cuugcuuuuaacgcua

SEQ ID NO: 2541524 - RNA, 15 nt, Chlamydophila pneumoniae J138
cuuggaaaucagaau

SEQ ID NO: 2541525 - RNA, 13 nt, Chlamydophila pneumoniae J138
cuuggauuucuuc

SEQ ID NO: 2541526 - RNA, 17 nt, Chlamydophila pneumoniae J138
cuuugaucgcuugugca

SEQ ID NO: 2541527 - RNA, 16 nt, Chlamydophila pneumoniae J138
cuuugcaucccuaggg

SEQ ID NO: 2541528 - RNA, 14 nt, Chlamydophila pneumoniae J138
cuuugcaugaggag

SEQ ID NO: 2541529 - RNA, 21 nt, Chlamydophila pneumoniae J138
cuuugcaugaggagaccuuua

SEQ ID NO: 2541530 - RNA, 20 nt, Chlamydophila pneumoniae J138
cuuugccaacagcugggauc

SEQ ID NO: 2541531 - RNA, 22 nt, Chlamydophila pneumoniae J138
cuuugcuuaaaaagucugaauc

SEQ ID NO: 2541532 - RNA, 16 nt, Chlamydophila pneumoniae J138
cuuugcuuauuucccc

SEQ ID NO: 2541533 - RNA, 14 nt, Chlamydophila pneumoniae J138
cuuugggauaaaaa

SEQ ID NO: 2541534 - RNA, 16 nt, Chlamydophila pneumoniae J138
cuuugugaguucuucc

SEQ ID NO: 2541535 - RNA, 22 nt, Chlamydophila pneumoniae J138
cuuugugaguucuuccuucuuc

SEQ ID NO: 2541536 - RNA, 16 nt, Chlamydophila pneumoniae J138
cuuugugauuacagca

SEQ ID NO: 2541537 - RNA, 18 nt, Chlamydophila pneumoniae J138
cuuuguuaauagaagauc

SEQ ID NO: 2541538 - RNA, 23 nt, Chlamydophila pneumoniae J138
cuuuuacgaaugagaucagcucc

SEQ ID NO: 2541539 - RNA, 17 nt, Chlamydophila pneumoniae J138
cuuuuagagccuuuuca

SEQ ID NO: 2541540 - RNA, 23 nt, Chlamydophila pneumoniae J138
cuuuuagagccuuuucagauuuu

SEQ ID NO: 2541541 - RNA, 16 nt, Chlamydophila pneumoniae J138
cuuuuagguagagaau

SEQ ID NO: 2541542 - RNA, 13 nt, Chlamydophila pneumoniae J138
cuuuuaugaugua

SEQ ID NO: 2541543 - RNA, 15 nt, Chlamydophila pneumoniae J138
cuuuuauuaagggaa

SEQ ID NO: 2541544 - RNA, 12 nt, Chlamydophila pneumoniae J138
cuuuucaaaaga

SEQ ID NO: 2541545 - RNA, 13 nt, Chlamydophila pneumoniae J138
cuuuucauuuuua

SEQ ID NO: 2541546 - RNA, 20 nt, Chlamydophila pneumoniae J138
cuuuuccggggagaacuuca

SEQ ID NO: 2541547 - RNA, 23 nt, Chlamydophila pneumoniae J138
cuuuuccugcagcagccuuggcu

SEQ ID NO: 2541548 - RNA, 19 nt, Chlamydophila pneumoniae J138
cuuuucggaucagaaugca

SEQ ID NO: 2541549 - RNA, 14 nt, Chlamydophila pneumoniae J138
cuuuucguauagag

SEQ ID NO: 2541550 - RNA, 22 nt, Chlamydophila pneumoniae J138
cuuuucuaagcaauauuucugu

SEQ ID NO: 2541551 - RNA, 16 nt, Chlamydophila pneumoniae J138
cuuuucuacaugcuca

SEQ ID NO: 2541552 - RNA, 10 nt, Chlamydophila pneumoniae J138
cuuuucuaga

SEQ ID NO: 2541553 - RNA, 13 nt, Chlamydophila pneumoniae J138
cuuuucuagaaaa

SEQ ID NO: 2541554 - RNA, 13 nt, Chlamydophila pneumoniae J138
cuuuucuccuucu

SEQ ID NO: 2541555 - RNA, 21 nt, Chlamydophila pneumoniae J138
cuuuucugaaucuuuuguuuu

SEQ ID NO: 2541556 - RNA, 12 nt, Chlamydophila pneumoniae J138
cuuuucuuauca

SEQ ID NO: 2541557 - RNA, 14 nt, Chlamydophila pneumoniae J138
cuuuucuucuucgg

SEQ ID NO: 2541558 - RNA, 13 nt, Chlamydophila pneumoniae J138
cuuuucuuuuucu

SEQ ID NO: 2541559 - RNA, 17 nt, Chlamydophila pneumoniae J138
cuuuugaagauccugag

SEQ ID NO: 2541560 - RNA, 19 nt, Chlamydophila pneumoniae J138
cuuuugaagauccugagua

SEQ ID NO: 2541561 - RNA, 17 nt, Chlamydophila pneumoniae J138
cuuuugacaauaagaaa

SEQ ID NO: 2541562 - RNA, 15 nt, Chlamydophila pneumoniae J138
cuuuugcaaaucuuc

SEQ ID NO: 2541563 - RNA, 13 nt, Chlamydophila pneumoniae J138
cuuuugcaaguuu

SEQ ID NO: 2541564 - RNA, 23 nt, Chlamydophila pneumoniae J138
cuuuugcuacagcuucuuuucca

SEQ ID NO: 2541565 - RNA, 13 nt, Chlamydophila pneumoniae J138
cuuuuguauuaaa

SEQ ID NO: 2541566 - RNA, 17 nt, Chlamydophila pneumoniae J138
cuuuugugaagauaaga

SEQ ID NO: 2541567 - RNA, 15 nt, Chlamydophila pneumoniae J138
cuuuuguuugucuuc

SEQ ID NO: 2541568 - RNA, 17 nt, Chlamydophila pneumoniae J138
cuuuuguuugucuucca

SEQ ID NO: 2541569 - RNA, 18 nt, Chlamydophila pneumoniae J138
cuuuuguuuuagcucuuu

SEQ ID NO: 2541570 - RNA, 20 nt, Chlamydophila pneumoniae J138
cuuuuuaggaaaggauaucu

SEQ ID NO: 2541571 - RNA, 21 nt, Chlamydophila pneumoniae J138
cuuuuuaguauacuaagacug

SEQ ID NO: 2541572 - RNA, 17 nt, Chlamydophila pneumoniae J138
cuuuuuaucaugagaau

SEQ ID NO: 2541573 - RNA, 18 nt, Chlamydophila pneumoniae J138
cuuuuuauugauaaugau

SEQ ID NO: 2541574 - RNA, 14 nt, Chlamydophila pneumoniae J138
cuuuuucagcuucu

SEQ ID NO: 2541575 - RNA, 23 nt, Chlamydophila pneumoniae J138
cuuuuucuugaaaaauccugaga

SEQ ID NO: 2541576 - RNA, 19 nt, Chlamydophila pneumoniae J138
cuuuuucuugauuagagaa

SEQ ID NO: 2541577 - RNA, 20 nt, Chlamydophila pneumoniae J138
cuuuuugauuagaguuuuug

SEQ ID NO: 2541578 - RNA, 14 nt, Chlamydophila pneumoniae J138
cuuuuugcagaucu

SEQ ID NO: 2541579 - RNA, 15 nt, Chlamydophila pneumoniae J138
cuuuuugccaauuuu

SEQ ID NO: 2541580 - RNA, 21 nt, Chlamydophila pneumoniae J138
cuuuuuggaaguuguuuuuug

SEQ ID NO: 2541581 - RNA, 23 nt, Chlamydophila pneumoniae J138
cuuuuuggaaguuguuuuuugag

SEQ ID NO: 2541582 - RNA, 20 nt, Chlamydophila pneumoniae J138
cuuuuuuacuaucuccuaga

SEQ ID NO: 2541583 - RNA, 23 nt, Chlamydophila pneumoniae J138
cuuuuuuauguccguauuuuuua

SEQ ID NO: 2541584 - RNA, 21 nt, Chlamydophila pneumoniae J138
cuuuuuuucuucucuaagaaa

SEQ ID NO: 2541585 - RNA, 13 nt, Chlamydophila pneumoniae J138
gaaaaaauaucuc

SEQ ID NO: 2541586 - RNA, 23 nt, Chlamydophila pneumoniae J138
gaaaaaccccuagaacuuuacaa

SEQ ID NO: 2541587 - RNA, 16 nt, Chlamydophila pneumoniae J138
gaaaaagaaucucuga

SEQ ID NO: 2541588 - RNA, 20 nt, Chlamydophila pneumoniae J138
gaaaaagccuaugggaggaa

SEQ ID NO: 2541589 - RNA, 21 nt, Chlamydophila pneumoniae J138
gaaaaagccuaugggaggaau

SEQ ID NO: 2541590 - RNA, 13 nt, Chlamydophila pneumoniae J138
gaaaaaggaggau

SEQ ID NO: 2541591 - RNA, 18 nt, Chlamydophila pneumoniae J138
gaaaaauaucggaagaga

SEQ ID NO: 2541592 - RNA, 13 nt, Chlamydophila pneumoniae J138
gaaaaaucccugu

SEQ ID NO: 2541593 - RNA, 16 nt, Chlamydophila pneumoniae J138
gaaaaaucccuguucu

SEQ ID NO: 2541594 - RNA, 11 nt, Chlamydophila pneumoniae J138
gaaaaauccug

SEQ ID NO: 2541595 - RNA, 14 nt, Chlamydophila pneumoniae J138
gaaaacaaggcaaa

SEQ ID NO: 2541596 - RNA, 19 nt, Chlamydophila pneumoniae J138
gaaaacaaggcaaaaaguu

SEQ ID NO: 2541597 - RNA, 13 nt, Chlamydophila pneumoniae J138
gaaaacauagaga

SEQ ID NO: 2541598 - RNA, 14 nt, Chlamydophila pneumoniae J138
gaaaacauagagau

SEQ ID NO: 2541599 - RNA, 17 nt, Chlamydophila pneumoniae J138
gaaaacaucuguauauu

SEQ ID NO: 2541600 - RNA, 19 nt, Chlamydophila pneumoniae J138
gaaaacaucuguauauucu

SEQ ID NO: 2541601 - RNA, 16 nt, Chlamydophila pneumoniae J138
gaaaacgccaacugua

SEQ ID NO: 2541602 - RNA, 17 nt, Chlamydophila pneumoniae J138
gaaaacgcccucuagaa

SEQ ID NO: 2541603 - RNA, 10 nt, Chlamydophila pneumoniae J138
gaaaacuuca

SEQ ID NO: 2541604 - RNA, 12 nt, Chlamydophila pneumoniae J138
gaaaagaaaaga

SEQ ID NO: 2541605 - RNA, 15 nt, Chlamydophila pneumoniae J138
gaaaagaacagggga

SEQ ID NO: 2541606 - RNA, 13 nt, Chlamydophila pneumoniae J138
gaaaagaaugugc

SEQ ID NO: 2541607 - RNA, 19 nt, Chlamydophila pneumoniae J138
gaaaagauucuaaaucaac

SEQ ID NO: 2541608 - RNA, 22 nt, Chlamydophila pneumoniae J138
gaaaagauucuaaaucaacuac

SEQ ID NO: 2541609 - RNA, 22 nt, Chlamydophila pneumoniae J138
gaaaagauuugcgaaucuaaga

SEQ ID NO: 2541610 - RNA, 16 nt, Chlamydophila pneumoniae J138
gaaaaggaugcaucuc

SEQ ID NO: 2541611 - RNA, 20 nt, Chlamydophila pneumoniae J138
gaaaaggauugcacucaucu

SEQ ID NO: 2541612 - RNA, 21 nt, Chlamydophila pneumoniae J138
gaaaaggcccccuacagcaga

SEQ ID NO: 2541613 - RNA, 16 nt, Chlamydophila pneumoniae J138
gaaaagugugaggaga

SEQ ID NO: 2541614 - RNA, 16 nt, Chlamydophila pneumoniae J138
gaaaauaagaagcagc

SEQ ID NO: 2541615 - RNA, 23 nt, Chlamydophila pneumoniae J138
gaaaauaucaccuacaucagacu

SEQ ID NO: 2541616 - RNA, 14 nt, Chlamydophila pneumoniae J138
gaaaaucaacucuc

SEQ ID NO: 2541617 - RNA, 16 nt, Chlamydophila pneumoniae J138
gaaaaucaacucucca

SEQ ID NO: 2541618 - RNA, 23 nt, Chlamydophila pneumoniae J138
gaaaaucaacucuccauccucag

SEQ ID NO: 2541619 - RNA, 18 nt, Chlamydophila pneumoniae J138
gaaaaucaagaagagaaa

SEQ ID NO: 2541620 - RNA, 14 nt, Chlamydophila pneumoniae J138
gaaaaucugcagca

SEQ ID NO: 2541621 - RNA, 22 nt, Chlamydophila pneumoniae J138
gaaaaucuuuaagguugcuuuu

SEQ ID NO: 2541622 - RNA, 19 nt, Chlamydophila pneumoniae J138
gaaacaccguuaauuuuug

SEQ ID NO: 2541623 - RNA, 19 nt, Chlamydophila pneumoniae J138
gaaacauagaaucauugag

SEQ ID NO: 2541624 - RNA, 24 nt, Chlamydophila pneumoniae J138
gaaacaucggagaacuuccugauu

SEQ ID NO: 2541625 - RNA, 23 nt, Chlamydophila pneumoniae J138
gaaacauggcgguguuuccuucg

SEQ ID NO: 2541626 - RNA, 17 nt, Chlamydophila pneumoniae J138
gaacguacucuucuuuu

SEQ ID NO: 2541627 - RNA, 21 nt, Chlamydophila pneumoniae J138
gaacguauacgucccacaaaa

SEQ ID NO: 2541628 - RNA, 23 nt, Chlamydophila pneumoniae J138
gaacgucuaaagacgaagggagu

SEQ ID NO: 2541629 - RNA, 17 nt, Chlamydophila pneumoniae J138
gaacgugcaucucuuca

SEQ ID NO: 2541630 - RNA, 13 nt, Chlamydophila pneumoniae J138
gaacgugcugcga

SEQ ID NO: 2541631 - RNA, 14 nt, Chlamydophila pneumoniae J138
gaacuaaagagauc

SEQ ID NO: 2541632 - RNA, 18 nt, Chlamydophila pneumoniae J138
gaacuaaaggaacugugc

SEQ ID NO: 2541633 - RNA, 21 nt, Chlamydophila pneumoniae J138
gaacuacgggcaauauaucca

SEQ ID NO: 2541634 - RNA, 19 nt, Chlamydophila pneumoniae J138
gaacuauaggaagcucuuc

SEQ ID NO: 2541635 - RNA, 23 nt, Chlamydophila pneumoniae J138
gaacuauaggaagcucuucuacu

SEQ ID NO: 2541636 - RNA, 21 nt, Chlamydophila pneumoniae J138
gaacuauccuguuucaacaua

SEQ ID NO: 2541637 - RNA, 21 nt, Chlamydophila pneumoniae J138
gaacucacaaacaacagaaau

SEQ ID NO: 2541638 - RNA, 17 nt, Chlamydophila pneumoniae J138
gaacuccuuugagucuu

SEQ ID NO: 2541639 - RNA, 15 nt, Chlamydophila pneumoniae J138
gaacuguacgaauuu

SEQ ID NO: 2541640 - RNA, 23 nt, Chlamydophila pneumoniae J138
gaacugugccauaacgcaucgcu

SEQ ID NO: 2541641 - RNA, 23 nt, Chlamydophila pneumoniae J138
gaacuucagcuuugcuuaaaaag

SEQ ID NO: 2541642 - RNA, 14 nt, Chlamydophila pneumoniae J138
gaacuugggaugcu

SEQ ID NO: 2541643 - RNA, 14 nt, Chlamydophila pneumoniae J138
gaacuuuagggaag

SEQ ID NO: 2541644 - RNA, 21 nt, Chlamydophila pneumoniae J138
gaacuuucgucuuugcuuucu

SEQ ID NO: 2541645 - RNA, 14 nt, Chlamydophila pneumoniae J138
gaagaaaaaucuac

SEQ ID NO: 2541646 - RNA, 19 nt, Chlamydophila pneumoniae J138
gaagaaacuucucuaggaa

SEQ ID NO: 2541647 - RNA, 15 nt, Chlamydophila pneumoniae J138
gaagaaaggaccauu

SEQ ID NO: 2541648 - RNA, 14 nt, Chlamydophila pneumoniae J138
gaagaaauuaacaa

SEQ ID NO: 2541649 - RNA, 23 nt, Chlamydophila pneumoniae J138
gaagaaauuaaguaggccuccuu

SEQ ID NO: 2541650 - RNA, 13 nt, Chlamydophila pneumoniae J138
gaagaagggacuu

SEQ ID NO: 2541651 - RNA, 20 nt, Chlamydophila pneumoniae J138
gaagaauuucauaagagaac

SEQ ID NO: 2541652 - RNA, 18 nt, Chlamydophila pneumoniae J138
gaagaauuucgucuucau

SEQ ID NO: 2541653 - RNA, 14 nt, Chlamydophila pneumoniae J138
gaagacaaguaaac

SEQ ID NO: 2541654 - RNA, 21 nt, Chlamydophila pneumoniae J138
gaagacaaguaaacagcaaag

SEQ ID NO: 2541655 - RNA, 18 nt, Chlamydophila pneumoniae J138
gaagacccucgaaccacu

SEQ ID NO: 2541656 - RNA, 24 nt, Chlamydophila pneumoniae J138
gaagacguucgacaacaacauaaa

SEQ ID NO: 2541657 - RNA, 14 nt, Chlamydophila pneumoniae J138
gaagacucucauca

SEQ ID NO: 2541658 - RNA, 22 nt, Chlamydophila pneumoniae J138
gaagacucucaucagcaaaacu

SEQ ID NO: 2541659 - RNA, 16 nt, Chlamydophila pneumoniae J138
gaagacuuguucuuca

SEQ ID NO: 2541660 - RNA, 15 nt, Chlamydophila pneumoniae J138
gaagagaaaguagag

SEQ ID NO: 2541661 - RNA, 19 nt, Chlamydophila pneumoniae J138
gaagagcaauuaagaaacu

SEQ ID NO: 2541662 - RNA, 18 nt, Chlamydophila pneumoniae J138
gaagagcauuuaaaacgg

SEQ ID NO: 2541663 - RNA, 13 nt, Chlamydophila pneumoniae J138
gaagaggaaugcc

SEQ ID NO: 2541664 - RNA, 18 nt, Chlamydophila pneumoniae J138
gaagagguguccauaaug

SEQ ID NO: 2541665 - RNA, 16 nt, Chlamydophila pneumoniae J138
gaagaucccugagccu

SEQ ID NO: 2541666 - RNA, 16 nt, Chlamydophila pneumoniae J138
gaagauccuagagaau

SEQ ID NO: 2541667 - RNA, 13 nt, Chlamydophila pneumoniae J138
gaagauccugagu

SEQ ID NO: 2541668 - RNA, 19 nt, Chlamydophila pneumoniae J138
gaagaucgucggaagacuu

SEQ ID NO: 2541669 - RNA, 18 nt, Chlamydophila pneumoniae J138
gaagaucucccgaugagg

SEQ ID NO: 2541670 - RNA, 18 nt, Chlamydophila pneumoniae J138
gaagaucuugaacagaga

SEQ ID NO: 2541671 - RNA, 22 nt, Chlamydophila pneumoniae J138
gaagaugagcgagguauucucu

SEQ ID NO: 2541672 - RNA, 17 nt, Chlamydophila pneumoniae J138
gaagauggcaaggaaaa

SEQ ID NO: 2541673 - RNA, 18 nt, Chlamydophila pneumoniae J138
gaagauggcaaggaaaau

SEQ ID NO: 2541674 - RNA, 12 nt, Chlamydophila pneumoniae J138
gaagauucaagc

SEQ ID NO: 2541675 - RNA, 16 nt, Chlamydophila pneumoniae J138
gaagauuuagggaaga

SEQ ID NO: 2541676 - RNA, 20 nt, Chlamydophila pneumoniae J138
gaagcaacuaaacucuccaa

SEQ ID NO: 2541677 - RNA, 17 nt, Chlamydophila pneumoniae J138
gaagcagaaacuuuaaa

SEQ ID NO: 2541678 - RNA, 15 nt, Chlamydophila pneumoniae J138
gaagcaguuuaggua

SEQ ID NO: 2541679 - RNA, 14 nt, Chlamydophila pneumoniae J138
gaagcaucuucgau

SEQ ID NO: 2541680 - RNA, 14 nt, Chlamydophila pneumoniae J138
gaagccaccaucug

SEQ ID NO: 2541681 - RNA, 16 nt, Chlamydophila pneumoniae J138
gaagccaccaucuguu

SEQ ID NO: 2541682 - RNA, 18 nt, Chlamydophila pneumoniae J138
gaagccauuuucuaagag

SEQ ID NO: 2541683 - RNA, 21 nt, Chlamydophila pneumoniae J138
gaagcccgcaguuuaucucua

SEQ ID NO: 2541684 - RNA, 17 nt, Chlamydophila pneumoniae J138
gaagcgcgaggagcgau

SEQ ID NO: 2541685 - RNA, 15 nt, Chlamydophila pneumoniae J138
gaagcggagcaucuu

SEQ ID NO: 2541686 - RNA, 14 nt, Chlamydophila pneumoniae J138
gaagcguagcaaag

SEQ ID NO: 2541687 - RNA, 23 nt, Chlamydophila pneumoniae J138
gaagcuaucauuauacuucguua

SEQ ID NO: 2541688 - RNA, 22 nt, Chlamydophila pneumoniae J138
gaagcuauuccacggcggagaa

SEQ ID NO: 2541689 - RNA, 22 nt, Chlamydophila pneumoniae J138
gaagcucacucuuuaaaaaccc

SEQ ID NO: 2541690 - RNA, 21 nt, Chlamydophila pneumoniae J138
gaagcucuaucuuugguaugc

SEQ ID NO: 2541691 - RNA, 13 nt, Chlamydophila pneumoniae J138
gaagcugcugcua

SEQ ID NO: 2541692 - RNA, 12 nt, Chlamydophila pneumoniae J138
gaagcugcuucu

SEQ ID NO: 2541693 - RNA, 23 nt, Chlamydophila pneumoniae J138
gaagcugucgcaaaugcagucuc

SEQ ID NO: 2541694 - RNA, 19 nt, Chlamydophila pneumoniae J138
gaagcugucguccuaauuu

SEQ ID NO: 2541695 - RNA, 14 nt, Chlamydophila pneumoniae J138
gaagcuucaaugau

SEQ ID NO: 2541696 - RNA, 15 nt, Chlamydophila pneumoniae J138
gaagcuugcugauuu

SEQ ID NO: 2541697 - RNA, 18 nt, Chlamydophila pneumoniae J138
gaaggaaaaggcccccua

SEQ ID NO: 2541698 - RNA, 13 nt, Chlamydophila pneumoniae J138
gaaggaaaucaca

SEQ ID NO: 2541699 - RNA, 12 nt, Chlamydophila pneumoniae J138
gaaggaagaucu

SEQ ID NO: 2541700 - RNA, 20 nt, Chlamydophila pneumoniae J138
gaaggaagaucuugaacaga

SEQ ID NO: 2541701 - RNA, 13 nt, Chlamydophila pneumoniae J138
gaaggaauuugcu

SEQ ID NO: 2541702 - RNA, 17 nt, Chlamydophila pneumoniae J138
gaaggaggaguccuucu

SEQ ID NO: 2541703 - RNA, 21 nt, Chlamydophila pneumoniae J138
gaaggaucauaccgacaagca

SEQ ID NO: 2541704 - RNA, 18 nt, Chlamydophila pneumoniae J138
gaaggaucugaugcacca

SEQ ID NO: 2541705 - RNA, 23 nt, Chlamydophila pneumoniae J138
gaaggcaccaacacuuuuaaaga

SEQ ID NO: 2541706 - RNA, 12 nt, Chlamydophila pneumoniae J138
gaaggcagagaa

SEQ ID NO: 2541707 - RNA, 21 nt, Chlamydophila pneumoniae J138
gaaggccaagauucucacucu

SEQ ID NO: 2541708 - RNA, 21 nt, Chlamydophila pneumoniae J138
gaaggcggcuuuuugcaagcu

SEQ ID NO: 2541709 - RNA, 16 nt, Chlamydophila pneumoniae J138
gaaggcuuguuucugu

SEQ ID NO: 2541710 - RNA, 22 nt, Chlamydophila pneumoniae J138
gaagguaaauuuuuaaaacucc

SEQ ID NO: 2541711 - RNA, 18 nt, Chlamydophila pneumoniae J138
gaagguguggguacaggg

SEQ ID NO: 2541712 - RNA, 21 nt, Chlamydophila pneumoniae J138
gaagguguuuuggcugcuuuu

SEQ ID NO: 2541713 - RNA, 15 nt, Chlamydophila pneumoniae J138
gaagguuuauuagaa

SEQ ID NO: 2541714 - RNA, 20 nt, Chlamydophila pneumoniae J138
gaaguaaucgucacugcgca

SEQ ID NO: 2541715 - RNA, 16 nt, Chlamydophila pneumoniae J138
gaaguacaagugaaga

SEQ ID NO: 2541716 - RNA, 15 nt, Chlamydophila pneumoniae J138
gaaguagggucccuu

SEQ ID NO: 2541717 - RNA, 19 nt, Chlamydophila pneumoniae J138
gaaguauucgauuccugag

SEQ ID NO: 2541718 - RNA, 21 nt, Chlamydophila pneumoniae J138
gaaguccauguacagaaaaua

SEQ ID NO: 2541719 - RNA, 18 nt, Chlamydophila pneumoniae J138
gaagucccacaaaugaua

SEQ ID NO: 2541720 - RNA, 22 nt, Chlamydophila pneumoniae J138
gaaguccuagggagugaggaau

SEQ ID NO: 2541721 - RNA, 13 nt, Chlamydophila pneumoniae J138
gaagucuucaggu

SEQ ID NO: 2541722 - RNA, 16 nt, Chlamydophila pneumoniae J138
gaagucuucaggugaa

SEQ ID NO: 2541723 - RNA, 20 nt, Chlamydophila pneumoniae J138
gaagucuucuugcugauccu

SEQ ID NO: 2541724 - RNA, 13 nt, Chlamydophila pneumoniae J138
gaagugcuuugag

SEQ ID NO: 2541725 - RNA, 16 nt, Chlamydophila pneumoniae J138
gaaguuacgugagaac

SEQ ID NO: 2541726 - RNA, 15 nt, Chlamydophila pneumoniae J138
uuauagauaugccuc

SEQ ID NO: 2541727 - RNA, 23 nt, Chlamydophila pneumoniae J138
uuauaggaauaacaccaaaagaa

SEQ ID NO: 2541728 - RNA, 14 nt, Chlamydophila pneumoniae J138
uuauauaaagaucu

SEQ ID NO: 2541729 - RNA, 16 nt, Chlamydophila pneumoniae J138
uuauauaaagaucuuu

SEQ ID NO: 2541730 - RNA, 17 nt, Chlamydophila pneumoniae J138
uuauauaccacuacuga

SEQ ID NO: 2541731 - RNA, 11 nt, Chlamydophila pneumoniae J138
uuauauuaaga

SEQ ID NO: 2541732 - RNA, 22 nt, Chlamydophila pneumoniae J138
uuaucacagauguaaucuugau

SEQ ID NO: 2541733 - RNA, 23 nt, Chlamydophila pneumoniae J138
aaaugugaaaucguaucuuuuug

SEQ ID NO: 2541734 - RNA, 21 nt, Chlamydophila pneumoniae J138
aaauguugauagguagaggca

SEQ ID NO: 2541735 - RNA, 21 nt, Chlamydophila pneumoniae J138
aaauguuuugcgauaucuaua

SEQ ID NO: 2541736 - RNA, 17 nt, Chlamydophila pneumoniae J138
aaauuaagaacccgaua

SEQ ID NO: 2541737 - RNA, 17 nt, Chlamydophila pneumoniae J138
aaauuaagucacacuuu

SEQ ID NO: 2541738 - RNA, 22 nt, Chlamydophila pneumoniae J138
aaauuaagucacacuuuccguu

SEQ ID NO: 2541739 - RNA, 20 nt, Chlamydophila pneumoniae J138
aaauuaccuugagacaaaga

SEQ ID NO: 2541740 - RNA, 13 nt, Chlamydophila pneumoniae J138
aaauuacuguggu

SEQ ID NO: 2541741 - RNA, 17 nt, Chlamydophila pneumoniae J138
aaauuaucagagacaag

SEQ ID NO: 2541742 - RNA, 16 nt, Chlamydophila pneumoniae J138
aaauuaucuccaaaga

SEQ ID NO: 2541743 - RNA, 21 nt, Chlamydophila pneumoniae J138
aaauucaagacuauagaaaag

SEQ ID NO: 2541744 - RNA, 22 nt, Chlamydophila pneumoniae J138
aaauucaagacuauagaaaagg

SEQ ID NO: 2541745 - RNA, 16 nt, Chlamydophila pneumoniae J138
aaauucaggacccuuu

SEQ ID NO: 2541746 - RNA, 19 nt, Chlamydophila pneumoniae J138
aaauucaguauaagaugcu

SEQ ID NO: 2541747 - RNA, 22 nt, Chlamydophila pneumoniae J138
aaauucaugccuuuggcaauca

SEQ ID NO: 2541748 - RNA, 14 nt, Chlamydophila pneumoniae J138
aaauucauuaaaau

SEQ ID NO: 2541749 - RNA, 14 nt, Chlamydophila pneumoniae J138
aaauucauuaagaa

SEQ ID NO: 2541750 - RNA, 11 nt, Chlamydophila pneumoniae J138
aaauucccaua

SEQ ID NO: 2541751 - RNA, 23 nt, Chlamydophila pneumoniae J138
aaauuccgacccagucaaaauau

SEQ ID NO: 2541752 - RNA, 23 nt, Chlamydophila pneumoniae J138
aaauucuagaccugccaagauac

SEQ ID NO: 2541753 - RNA, 23 nt, Chlamydophila pneumoniae J138
aaauucucauaaccuaaggcaug

SEQ ID NO: 2541754 - RNA, 18 nt, Chlamydophila pneumoniae J138
aaauucuguaaagugaaa

SEQ ID NO: 2541755 - RNA, 17 nt, Chlamydophila pneumoniae J138
aaauucuucgagagcau

SEQ ID NO: 2541756 - RNA, 20 nt, Chlamydophila pneumoniae J138
aaauugaugagcucuccauu

SEQ ID NO: 2541757 - RNA, 17 nt, Chlamydophila pneumoniae J138
aaauugcauuuaaacua

SEQ ID NO: 2541758 - RNA, 12 nt, Chlamydophila pneumoniae J138
aaauugcucuug

SEQ ID NO: 2541759 - RNA, 16 nt, Chlamydophila pneumoniae J138
aaauuggcuuuugaga

SEQ ID NO: 2541760 - RNA, 14 nt, Chlamydophila pneumoniae J138
aaauaaccccucca

SEQ ID NO: 2541761 - RNA, 20 nt, Chlamydophila pneumoniae J138
aaauaaccuagaaggaggag

SEQ ID NO: 2541762 - RNA, 18 nt, Chlamydophila pneumoniae J138
aaauaaucuucaaaagac

SEQ ID NO: 2541763 - RNA, 19 nt, Chlamydophila pneumoniae J138
aaauaauuucccuaaaaug

SEQ ID NO: 2541764 - RNA, 15 nt, Chlamydophila pneumoniae J138
aaauaauuuuauuag

SEQ ID NO: 2541765 - RNA, 12 nt, Chlamydophila pneumoniae J138
aaauacagauuc

SEQ ID NO: 2541766 - RNA, 17 nt, Chlamydophila pneumoniae J138
aaauacaggccugaugu

SEQ ID NO: 2541767 - RNA, 16 nt, Chlamydophila pneumoniae J138
aaauaccaagaugucu

SEQ ID NO: 2541768 - RNA, 14 nt, Chlamydophila pneumoniae J138
aaauaccaaggcug

SEQ ID NO: 2541769 - RNA, 21 nt, Chlamydophila pneumoniae J138
aaauaccccaucuaauccugu

SEQ ID NO: 2541770 - RNA, 22 nt, Chlamydophila pneumoniae J138
aaaaaaagaccaaauaauuaaa

SEQ ID NO: 2541771 - RNA, 13 nt, Chlamydophila pneumoniae J138
aaaaaaaucuucu

SEQ ID NO: 2541772 - RNA, 13 nt, Chlamydophila pneumoniae J138
aaaaaacaguaga

SEQ ID NO: 2541773 - RNA, 11 nt, Chlamydophila pneumoniae J138
aaaaaagagac

SEQ ID NO: 2541774 - RNA, 11 nt, Chlamydophila pneumoniae J138
aaaaaagccaa

SEQ ID NO: 2541775 - RNA, 23 nt, Chlamydophila pneumoniae J138
aaaaaauaucuccguuaccaaaa

SEQ ID NO: 2541776 - RNA, 11 nt, Chlamydophila pneumoniae J138
aaaaaaucaau

SEQ ID NO: 2541777 - RNA, 22 nt, Chlamydophila pneumoniae J138
aaaaaaucccagauuacaagag

SEQ ID NO: 2541778 - RNA, 19 nt, Chlamydophila pneumoniae J138
aaaaaaucucgagaagacc

SEQ ID NO: 2541779 - RNA, 21 nt, Chlamydophila pneumoniae J138
aaaaaaucuucuuagccaaaa

SEQ ID NO: 2541780 - RNA, 23 nt, Chlamydophila pneumoniae J138
aaaaaaugcuccugcaaaaaacc

SEQ ID NO: 2541781 - RNA, 12 nt, Chlamydophila pneumoniae J138
aaaaaauucuaa

SEQ ID NO: 2541782 - RNA, 14 nt, Chlamydophila pneumoniae J138
aaaaaauuuuauag

SEQ ID NO: 2541783 - RNA, 22 nt, Chlamydophila pneumoniae J138
aaaaacacugcgcaaagaacuc

SEQ ID NO: 2541784 - RNA, 19 nt, Chlamydophila pneumoniae J138
aaaaaccagccaauaacau

SEQ ID NO: 2541785 - RNA, 23 nt, Chlamydophila pneumoniae J138
aaaaaccccuagaacuuuacaau

SEQ ID NO: 2541786 - RNA, 16 nt, Chlamydophila pneumoniae J138
aaaaacccucaaagaa

SEQ ID NO: 2541787 - RNA, 13 nt, Chlamydophila pneumoniae J138
aaaaaccuucucc

SEQ ID NO: 2541788 - RNA, 16 nt, Chlamydophila pneumoniae J138
aaaaacgguaaauauc

SEQ ID NO: 2541789 - RNA, 18 nt, Chlamydophila pneumoniae J138
aaaaacgguaaauaucuu

SEQ ID NO: 2541790 - RNA, 19 nt, Chlamydophila pneumoniae J138
aaaaacugcgcuagcucca

SEQ ID NO: 2541791 - RNA, 16 nt, Chlamydophila pneumoniae J138
aaaaacuguguuuucu

SEQ ID NO: 2541792 - RNA, 16 nt, Chlamydophila pneumoniae J138
aaaaacuucuaacugu

SEQ ID NO: 2541793 - RNA, 12 nt, Chlamydophila pneumoniae J138
aaaaagaaagag

SEQ ID NO: 2541794 - RNA, 20 nt, Chlamydophila pneumoniae J138
aaaaagagcccaaaaacacu

SEQ ID NO: 2541795 - RNA, 19 nt, Chlamydophila pneumoniae J138
aaaaagccuaugauaaagc

SEQ ID NO: 2541796 - RNA, 21 nt, Chlamydophila pneumoniae J138
aaaaagcugacacucagcucc

SEQ ID NO: 2541797 - RNA, 14 nt, Chlamydophila pneumoniae J138
aaaaagcuucuuuc

SEQ ID NO: 2541798 - RNA, 18 nt, Chlamydophila pneumoniae J138
aaaaaguaguuuuaagaa

SEQ ID NO: 2541799 - RNA, 13 nt, Chlamydophila pneumoniae J138
aaaaagucugaau

SEQ ID NO: 2541800 - RNA, 21 nt, Chlamydophila pneumoniae J138
aaaaaguuccauagaguaucu

SEQ ID NO: 2541801 - RNA, 22 nt, Chlamydophila pneumoniae J138
aaaaaguuccauagaguaucua

SEQ ID NO: 2541802 - RNA, 18 nt, Chlamydophila pneumoniae J138
aaaaaguugaggaaagga

SEQ ID NO: 2541803 - RNA, 20 nt, Chlamydophila pneumoniae J138
aaaaauaccaagaugucucc

SEQ ID NO: 2541804 - RNA, 23 nt, Chlamydophila pneumoniae J138
aaaaaucccagauuacaagaggu

SEQ ID NO: 2541805 - RNA, 16 nt, Chlamydophila pneumoniae J138
aaaaaucccuguucua

SEQ ID NO: 2541806 - RNA, 16 nt, Chlamydophila pneumoniae J138
aaauugugaaaaaaaa

SEQ ID NO: 2541807 - RNA, 14 nt, Chlamydophila pneumoniae J138
aaauuguuggaauu

SEQ ID NO: 2541808 - RNA, 19 nt, Chlamydophila pneumoniae J138
aaauuguuuguaucaaaga

SEQ ID NO: 2541809 - RNA, 21 nt, Chlamydophila pneumoniae J138
aaauuuaucggcuaaagaaaa

SEQ ID NO: 2541810 - RNA, 22 nt, Chlamydophila pneumoniae J138
aaauuuaucggcuaaagaaaag

SEQ ID NO: 2541811 - RNA, 15 nt, Chlamydophila pneumoniae J138
aaauuucauuuagac

SEQ ID NO: 2541812 - RNA, 14 nt, Chlamydophila pneumoniae J138
aaauuucauuugaa

SEQ ID NO: 2541813 - RNA, 11 nt, Chlamydophila pneumoniae J138
aaauuucugaa

SEQ ID NO: 2541814 - RNA, 20 nt, Chlamydophila pneumoniae J138
aaauuugcucuccugcaaaa

SEQ ID NO: 2541815 - RNA, 21 nt, Chlamydophila pneumoniae J138
aaauuuucucgggauaaugcu

SEQ ID NO: 2541816 - RNA, 19 nt, Chlamydophila pneumoniae J138
aaauuuucuugcgacauaa

SEQ ID NO: 2541817 - RNA, 15 nt, Chlamydophila pneumoniae J138
aaauuuugcaacaaa

SEQ ID NO: 2541818 - RNA, 17 nt, Chlamydophila pneumoniae J138
aaauuuuuuaggaucuu

SEQ ID NO: 2541819 - RNA, 14 nt, Chlamydophila pneumoniae J138
aacaaaaaaucaau

SEQ ID NO: 2541820 - RNA, 18 nt, Chlamydophila pneumoniae J138
aacaaaaaggacucuuuc

SEQ ID NO: 2541821 - RNA, 12 nt, Chlamydophila pneumoniae J138
aacaaaguuuau

SEQ ID NO: 2541822 - RNA, 14 nt, Chlamydophila pneumoniae J138
aacaacagaaaugu

SEQ ID NO: 2541823 - RNA, 16 nt, Chlamydophila pneumoniae J138
aacaacauaaagaagg

SEQ ID NO: 2541824 - RNA, 19 nt, Chlamydophila pneumoniae J138
aacaacauaaagaagguuu

SEQ ID NO: 2541825 - RNA, 11 nt, Chlamydophila pneumoniae J138
aacaacaucac

SEQ ID NO: 2541826 - RNA, 22 nt, Chlamydophila pneumoniae J138
aacaacaucacuuauauuuucu

SEQ ID NO: 2541827 - RNA, 21 nt, Chlamydophila pneumoniae J138
aacaacauucguuaggugacc

SEQ ID NO: 2541828 - RNA, 12 nt, Chlamydophila pneumoniae J138
aacaaccaaaag

SEQ ID NO: 2541829 - RNA, 19 nt, Chlamydophila pneumoniae J138
aacaaccaaaagaauuccu

SEQ ID NO: 2541830 - RNA, 21 nt, Chlamydophila pneumoniae J138
aacaacgcugcuucucuacua

SEQ ID NO: 2541831 - RNA, 11 nt, Chlamydophila pneumoniae J138
aacaacugaaa

SEQ ID NO: 2541832 - RNA, 16 nt, Chlamydophila pneumoniae J138
aacaacugaaaaacca

SEQ ID NO: 2541833 - RNA, 23 nt, Chlamydophila pneumoniae J138
aacaacuuuccggguaaguacac

SEQ ID NO: 2541834 - RNA, 16 nt, Chlamydophila pneumoniae J138
aacaagacgaaagcac

SEQ ID NO: 2541835 - RNA, 22 nt, Chlamydophila pneumoniae J138
aacaagagcgcauuuuacagcg

SEQ ID NO: 2541836 - RNA, 16 nt, Chlamydophila pneumoniae J138
aacaagauaaccugag

SEQ ID NO: 2541837 - RNA, 23 nt, Chlamydophila pneumoniae J138
aacaagcuuuuaauguguucuua

SEQ ID NO: 2541838 - RNA, 15 nt, Chlamydophila pneumoniae J138
aacaaggauuaugaa

SEQ ID NO: 2541839 - RNA, 19 nt, Chlamydophila pneumoniae J138
aacaagggaagagaaaacg

SEQ ID NO: 2541840 - RNA, 19 nt, Chlamydophila pneumoniae J138
aacaaguaccaagaaaaua

SEQ ID NO: 2541841 - RNA, 17 nt, Chlamydophila pneumoniae J138
aacaaguuuuuucaauc

SEQ ID NO: 2541842 - RNA, 16 nt, Chlamydophila pneumoniae J138
aacaauaguaaagcau

SEQ ID NO: 2541843 - RNA, 13 nt, Chlamydophila pneumoniae J138
aacaaucuuucuu

SEQ ID NO: 2541844 - RNA, 15 nt, Chlamydophila pneumoniae J138
aacacaaauagcaag

SEQ ID NO: 2541845 - RNA, 21 nt, Chlamydophila pneumoniae J138
aacaccaucacauccuguagu

SEQ ID NO: 2541846 - RNA, 20 nt, Chlamydophila pneumoniae J138
aacacccucccucauaagau

SEQ ID NO: 2541847 - RNA, 18 nt, Chlamydophila pneumoniae J138
aacaccguuaauuuuugc

SEQ ID NO: 2541848 - RNA, 14 nt, Chlamydophila pneumoniae J138
aacaccucaauacg

SEQ ID NO: 2541849 - RNA, 18 nt, Chlamydophila pneumoniae J138
aacacgagugccuucuuc

SEQ ID NO: 2541850 - RNA, 20 nt, Chlamydophila pneumoniae J138
aacacgcccacggaaagcac

SEQ ID NO: 2541851 - RNA, 20 nt, Chlamydophila pneumoniae J138
aacacgccugcgaaagcgag

SEQ ID NO: 2541852 - RNA, 16 nt, Chlamydophila pneumoniae J138
aacacgucgaacauga

SEQ ID NO: 2541853 - RNA, 21 nt, Chlamydophila pneumoniae J138
aacacucucuaccaucaugaa

SEQ ID NO: 2541854 - RNA, 21 nt, Chlamydophila pneumoniae J138
aacacugaacgccaucuccac

SEQ ID NO: 2541855 - RNA, 22 nt, Chlamydophila pneumoniae J138
aacacugcgcaaagaacucaac

SEQ ID NO: 2541856 - RNA, 17 nt, Chlamydophila pneumoniae J138
aacacuuuguuuuucaa

SEQ ID NO: 2541857 - RNA, 13 nt, Chlamydophila pneumoniae J138
aacacuuuuaaag

SEQ ID NO: 2541858 - RNA, 15 nt, Chlamydophila pneumoniae J138
aacagagcgccucca

SEQ ID NO: 2541859 - RNA, 16 nt, Chlamydophila pneumoniae J138
aacagagcgccuccac

SEQ ID NO: 2541860 - RNA, 18 nt, Chlamydophila pneumoniae J138
aacagagcgucuauuaga

SEQ ID NO: 2541861 - RNA, 22 nt, Chlamydophila pneumoniae J138
aacagaucuuuaucauugcuau

SEQ ID NO: 2541862 - RNA, 23 nt, Chlamydophila pneumoniae J138
aacagauuuuucaagaacuccuu

SEQ ID NO: 2541863 - RNA, 14 nt, Chlamydophila pneumoniae J138
aacagcaacacucg

SEQ ID NO: 2541864 - RNA, 19 nt, Chlamydophila pneumoniae J138
aacagcauggacuccaaga

SEQ ID NO: 2541865 - RNA, 21 nt, Chlamydophila pneumoniae J138
aacagcauggacuccaagaau

SEQ ID NO: 2541866 - RNA, 19 nt, Chlamydophila pneumoniae J138
aacagccuagcaaaacugu

SEQ ID NO: 2541867 - RNA, 13 nt, Chlamydophila pneumoniae J138
aacagcuucagga

SEQ ID NO: 2541868 - RNA, 16 nt, Chlamydophila pneumoniae J138
aacaggaauaggcucu

SEQ ID NO: 2541869 - RNA, 15 nt, Chlamydophila pneumoniae J138
aacaguccucucccu

SEQ ID NO: 2541870 - RNA, 15 nt, Chlamydophila pneumoniae J138
aacagugguaugcuu

SEQ ID NO: 2541871 - RNA, 22 nt, Chlamydophila pneumoniae J138
aacagugguaugcuuuuccuuc

SEQ ID NO: 2541872 - RNA, 22 nt, Chlamydophila pneumoniae J138
aacaguguagccuuucuuuuua

SEQ ID NO: 2541873 - RNA, 15 nt, Chlamydophila pneumoniae J138
aacaguucuuucugc

SEQ ID NO: 2541874 - RNA, 16 nt, Chlamydophila pneumoniae J138
aacauaaagaagguuu

SEQ ID NO: 2541875 - RNA, 15 nt, Chlamydophila pneumoniae J138
aacauaacaugagaa

SEQ ID NO: 2541876 - RNA, 22 nt, Chlamydophila pneumoniae J138
aaaaguuuuuguucauccagaa

SEQ ID NO: 2541877 - RNA, 14 nt, Chlamydophila pneumoniae J138
aaaauaaaaggagc

SEQ ID NO: 2541878 - RNA, 12 nt, Chlamydophila pneumoniae J138
aaaauaaacucu

SEQ ID NO: 2541879 - RNA, 14 nt, Chlamydophila pneumoniae J138
aaaauaaauuuuau

SEQ ID NO: 2541880 - RNA, 22 nt, Chlamydophila pneumoniae J138
aaaauaaccccuccaaaaucau

SEQ ID NO: 2541881 - RNA, 17 nt, Chlamydophila pneumoniae J138
aaaauacagccagcaga

SEQ ID NO: 2541882 - RNA, 15 nt, Chlamydophila pneumoniae J138
aaaauaucacauucc

SEQ ID NO: 2541883 - RNA, 18 nt, Chlamydophila pneumoniae J138
aaaauaucaccuacauca

SEQ ID NO: 2541884 - RNA, 20 nt, Chlamydophila pneumoniae J138
aaaauaucauucacuauugu

SEQ ID NO: 2541885 - RNA, 15 nt, Chlamydophila pneumoniae J138
aaaauauucuuucaa

SEQ ID NO: 2541886 - RNA, 14 nt, Chlamydophila pneumoniae J138
aaaaucaaauagau

SEQ ID NO: 2541887 - RNA, 16 nt, Chlamydophila pneumoniae J138
aaaaucaacucuccau

SEQ ID NO: 2541888 - RNA, 17 nt, Chlamydophila pneumoniae J138
aaaaucaagaagagaaa

SEQ ID NO: 2541889 - RNA, 22 nt, Chlamydophila pneumoniae J138
aaaaucaagaagagaaaagaua

SEQ ID NO: 2541890 - RNA, 15 nt, Chlamydophila pneumoniae J138
aaaaucaaucuugau

SEQ ID NO: 2541891 - RNA, 20 nt, Chlamydophila pneumoniae J138
aaaaucauaggcuauaauua

SEQ ID NO: 2541892 - RNA, 18 nt, Chlamydophila pneumoniae J138
aaaaucgacuaucugcuu

SEQ ID NO: 2541893 - RNA, 21 nt, Chlamydophila pneumoniae J138
aaaaucguuuuauuuuaggag

SEQ ID NO: 2541894 - RNA, 14 nt, Chlamydophila pneumoniae J138
aaaaucuccucucu

SEQ ID NO: 2541895 - RNA, 16 nt, Chlamydophila pneumoniae J138
aaaaucugcagcagau

SEQ ID NO: 2541896 - RNA, 22 nt, Chlamydophila pneumoniae J138
aaaaucuucuuagccaaaauuu

SEQ ID NO: 2541897 - RNA, 11 nt, Chlamydophila pneumoniae J138
aaaaugaccgc

SEQ ID NO: 2541898 - RNA, 19 nt, Chlamydophila pneumoniae J138
aaaaugauaccaccuaaaa

SEQ ID NO: 2541899 - RNA, 18 nt, Chlamydophila pneumoniae J138
aaaaugcacuuugaauaa

SEQ ID NO: 2541900 - RNA, 21 nt, Chlamydophila pneumoniae J138
aaaaugcgcacggauucuaaa

SEQ ID NO: 2541901 - RNA, 19 nt, Chlamydophila pneumoniae J138
aaaaugcuccugcaaaaaa

SEQ ID NO: 2541902 - RNA, 23 nt, Chlamydophila pneumoniae J138
aaaaugcuccugcaaaaaaccag

SEQ ID NO: 2541903 - RNA, 20 nt, Chlamydophila pneumoniae J138
aaaauuaaagugaaagcaac

SEQ ID NO: 2541904 - RNA, 20 nt, Chlamydophila pneumoniae J138
aaaauuaagaacccgauaca

SEQ ID NO: 2541905 - RNA, 14 nt, Chlamydophila pneumoniae J138
aaaauuauuaaacu

SEQ ID NO: 2541906 - RNA, 15 nt, Chlamydophila pneumoniae J138
aaaauucaaaucccu

SEQ ID NO: 2541907 - RNA, 23 nt, Chlamydophila pneumoniae J138
aaaauucgaauucucagaaagcc

SEQ ID NO: 2541908 - RNA, 20 nt, Chlamydophila pneumoniae J138
aaaauucucagauugcuuga

SEQ ID NO: 2541909 - RNA, 17 nt, Chlamydophila pneumoniae J138
aaaauucuguaaaguga

SEQ ID NO: 2541910 - RNA, 18 nt, Chlamydophila pneumoniae J138
aaaauucuucgagagcau

SEQ ID NO: 2541911 - RNA, 18 nt, Chlamydophila pneumoniae J138
aaaauugcauuuaaacua

SEQ ID NO: 2541912 - RNA, 22 nt, Chlamydophila pneumoniae J138
aaaauugcccauugaccugcuu

SEQ ID NO: 2541913 - RNA, 20 nt, Chlamydophila pneumoniae J138
aaaauuuucaggaacuuuac

SEQ ID NO: 2541914 - RNA, 17 nt, Chlamydophila pneumoniae J138
aaaauuuugauaccucu

SEQ ID NO: 2541915 - RNA, 16 nt, Chlamydophila pneumoniae J138
aaacaaaagccauucc

SEQ ID NO: 2541916 - RNA, 12 nt, Chlamydophila pneumoniae J138
aaacaaaaucuu

SEQ ID NO: 2541917 - RNA, 15 nt, Chlamydophila pneumoniae J138
aaacaaaaucuuuua

SEQ ID NO: 2541918 - RNA, 18 nt, Chlamydophila pneumoniae J138
aaacaacugaaaaaccau

SEQ ID NO: 2541919 - RNA, 16 nt, Chlamydophila pneumoniae J138
aaacaacuugguaagc

SEQ ID NO: 2541920 - RNA, 19 nt, Chlamydophila pneumoniae J138
aaacaagaagaucaaagau

SEQ ID NO: 2541921 - RNA, 16 nt, Chlamydophila pneumoniae J138
aaacaagcuuuuaaug

SEQ ID NO: 2541922 - RNA, 18 nt, Chlamydophila pneumoniae J138
aaacaaucuaaagguuuu

SEQ ID NO: 2541923 - RNA, 21 nt, Chlamydophila pneumoniae J138
aaacaaucuuguaaguuacgg

SEQ ID NO: 2541924 - RNA, 22 nt, Chlamydophila pneumoniae J138
aaacaaucuuguaaguuacgga

SEQ ID NO: 2541925 - RNA, 12 nt, Chlamydophila pneumoniae J138
aaacaauuucaa

SEQ ID NO: 2541926 - RNA, 17 nt, Chlamydophila pneumoniae J138
aaacacaaauagcaaga

SEQ ID NO: 2541927 - RNA, 19 nt, Chlamydophila pneumoniae J138
aaacacaaauagcaagagc

SEQ ID NO: 2541928 - RNA, 22 nt, Chlamydophila pneumoniae J138
aaacaccguuaauuuuugcuaa

SEQ ID NO: 2541929 - RNA, 19 nt, Chlamydophila pneumoniae J138
aaacacugcgcaaagaacu

SEQ ID NO: 2541930 - RNA, 14 nt, Chlamydophila pneumoniae J138
aaacagaaauugcu

SEQ ID NO: 2541931 - RNA, 18 nt, Chlamydophila pneumoniae J138
aaacagauuuuucaagaa

SEQ ID NO: 2541932 - RNA, 21 nt, Chlamydophila pneumoniae J138
aaacagauuuuucaagaacuc

SEQ ID NO: 2541933 - RNA, 22 nt, Chlamydophila pneumoniae J138
aaacagcgguugccuuucucuu

SEQ ID NO: 2541934 - RNA, 17 nt, Chlamydophila pneumoniae J138
aaacaggaauaggcucu

SEQ ID NO: 2541935 - RNA, 19 nt, Chlamydophila pneumoniae J138
aaacaguaggcgaugcaaa

SEQ ID NO: 2541936 - RNA, 18 nt, Chlamydophila pneumoniae J138
aaacauagagauucuaca

SEQ ID NO: 2541937 - RNA, 12 nt, Chlamydophila pneumoniae J138
aaacaucaaaga

SEQ ID NO: 2541938 - RNA, 15 nt, Chlamydophila pneumoniae J138
aaacaucacucagga

SEQ ID NO: 2541939 - RNA, 15 nt, Chlamydophila pneumoniae J138
aaacaucagagaacu

SEQ ID NO: 2541940 - RNA, 19 nt, Chlamydophila pneumoniae J138
aaacaucggagaacuuccu

SEQ ID NO: 2541941 - RNA, 20 nt, Chlamydophila pneumoniae J138
aaacaucggagaacuuccug

SEQ ID NO: 2541942 - RNA, 19 nt, Chlamydophila pneumoniae J138
aaacauuuuuaaggaaagu

SEQ ID NO: 2541943 - RNA, 18 nt, Chlamydophila pneumoniae J138
aaacauuuuuauuuccuu

SEQ ID NO: 2541944 - RNA, 16 nt, Chlamydophila pneumoniae J138
aaaccaauugagcucu

SEQ ID NO: 2541945 - RNA, 20 nt, Chlamydophila pneumoniae J138
aaaccacagaaugauaagaa

SEQ ID NO: 2541946 - RNA, 15 nt, Chlamydophila pneumoniae J138
aaaccacagcaaaga

SEQ ID NO: 2541947 - RNA, 13 nt, Chlamydophila pneumoniae J138
aaaccaggaacaa

SEQ ID NO: 2541948 - RNA, 16 nt, Chlamydophila pneumoniae J138
aaaccaggaacaaagg

SEQ ID NO: 2541949 - RNA, 17 nt, Chlamydophila pneumoniae J138
aaaccauaagaaugguu

SEQ ID NO: 2541950 - RNA, 14 nt, Chlamydophila pneumoniae J138
aaacccauguuucu

SEQ ID NO: 2541951 - RNA, 17 nt, Chlamydophila pneumoniae J138
aaacccucaaagaauac

SEQ ID NO: 2541952 - RNA, 19 nt, Chlamydophila pneumoniae J138
aaacccucuccagaagucg

SEQ ID NO: 2541953 - RNA, 16 nt, Chlamydophila pneumoniae J138
aaaccguaacugaggc

SEQ ID NO: 2541954 - RNA, 15 nt, Chlamydophila pneumoniae J138
aaaccguaggauucu

SEQ ID NO: 2541955 - RNA, 14 nt, Chlamydophila pneumoniae J138
aaaccuucucucuu

SEQ ID NO: 2541956 - RNA, 12 nt, Chlamydophila pneumoniae J138
aaacgaaagcag

SEQ ID NO: 2541957 - RNA, 14 nt, Chlamydophila pneumoniae J138
aaacgaaagcagug

SEQ ID NO: 2541958 - RNA, 16 nt, Chlamydophila pneumoniae J138
aaacgaaagcagugug

SEQ ID NO: 2541959 - RNA, 12 nt, Chlamydophila pneumoniae J138
aaacgaauacug

SEQ ID NO: 2541960 - RNA, 16 nt, Chlamydophila pneumoniae J138
aaacgaauuucuuguu

SEQ ID NO: 2541961 - RNA, 19 nt, Chlamydophila pneumoniae J138
aaacgagacugcaaaggaa

SEQ ID NO: 2541962 - RNA, 22 nt, Chlamydophila pneumoniae J138
aaacgaugagcacauucaagau

SEQ ID NO: 2541963 - RNA, 14 nt, Chlamydophila pneumoniae J138
aaacgcaccuuagc

SEQ ID NO: 2541964 - RNA, 21 nt, Chlamydophila pneumoniae J138
aaacgcccucuagaagacaca

SEQ ID NO: 2541965 - RNA, 15 nt, Chlamydophila pneumoniae J138
aaacgcccuucagga

SEQ ID NO: 2541966 - RNA, 18 nt, Chlamydophila pneumoniae J138
aaacgcccuucaggacau

SEQ ID NO: 2541967 - RNA, 13 nt, Chlamydophila pneumoniae J138
aaacgcgagcuau

SEQ ID NO: 2541968 - RNA, 13 nt, Chlamydophila pneumoniae J138
aaacgcucuccua

SEQ ID NO: 2541969 - RNA, 16 nt, Chlamydophila pneumoniae J138
aaacgcucuccuagac

SEQ ID NO: 2541970 - RNA, 19 nt, Chlamydophila pneumoniae J138
aaacggcuguacuucccca

SEQ ID NO: 2541971 - RNA, 17 nt, Chlamydophila pneumoniae J138
aaacgguaaauaucuua

SEQ ID NO: 2541972 - RNA, 17 nt, Chlamydophila pneumoniae J138
aaacuaaaucaacuaca

SEQ ID NO: 2541973 - RNA, 14 nt, Chlamydophila pneumoniae J138
aaacuacauucuaa

SEQ ID NO: 2541974 - RNA, 12 nt, Chlamydophila pneumoniae J138
aaacuaggaaaa

SEQ ID NO: 2541975 - RNA, 16 nt, Chlamydophila pneumoniae J138
aaacuaggaaaagcau

SEQ ID NO: 2541976 - RNA, 20 nt, Chlamydophila pneumoniae J138
aauagucucuguaagaacgu

SEQ ID NO: 2541977 - RNA, 23 nt, Chlamydophila pneumoniae J138
aauagugaggccuccauuucuag

SEQ ID NO: 2541978 - RNA, 15 nt, Chlamydophila pneumoniae J138
aauauaaaagaagac

SEQ ID NO: 2541979 - RNA, 23 nt, Chlamydophila pneumoniae J138
aauauacagauguuuucguaaau

SEQ ID NO: 2541980 - RNA, 16 nt, Chlamydophila pneumoniae J138
aauauacucuugcuug

SEQ ID NO: 2541981 - RNA, 18 nt, Chlamydophila pneumoniae J138
aauauagagaacuccauu

SEQ ID NO: 2541982 - RNA, 17 nt, Chlamydophila pneumoniae J138
aauauagagaucuagau

SEQ ID NO: 2541983 - RNA, 21 nt, Chlamydophila pneumoniae J138
aauauauccaggaucugugug

SEQ ID NO: 2541984 - RNA, 20 nt, Chlamydophila pneumoniae J138
aauauaucgcguguaaaagc

SEQ ID NO: 2541985 - RNA, 22 nt, Chlamydophila pneumoniae J138
aauauaucgcguguaaaagcuu

SEQ ID NO: 2541986 - RNA, 20 nt, Chlamydophila pneumoniae J138
aauaucaccuacaucagacu

SEQ ID NO: 2541987 - RNA, 17 nt, Chlamydophila pneumoniae J138
aauaucaggacaaugaa

SEQ ID NO: 2541988 - RNA, 12 nt, Chlamydophila pneumoniae J138
aauaucaucacu

SEQ ID NO: 2541989 - RNA, 16 nt, Chlamydophila pneumoniae J138
aauauccuaaauauau

SEQ ID NO: 2541990 - RNA, 22 nt, Chlamydophila pneumoniae J138
aauaucgaguucuuuuugcaga

SEQ ID NO: 2541991 - RNA, 18 nt, Chlamydophila pneumoniae J138
aauaucuccgccauaaca

SEQ ID NO: 2541992 - RNA, 21 nt, Chlamydophila pneumoniae J138
aauaucuccgccauaacacuu

SEQ ID NO: 2541993 - RNA, 14 nt, Chlamydophila pneumoniae J138
aauaugcucuccuu

SEQ ID NO: 2541994 - RNA, 23 nt, Chlamydophila pneumoniae J138
aauauggacagcguauaggaaac

SEQ ID NO: 2541995 - RNA, 22 nt, Chlamydophila pneumoniae J138
aauaugguaguuugccuucuua

SEQ ID NO: 2541996 - RNA, 15 nt, Chlamydophila pneumoniae J138
aauauucuuggaaga

SEQ ID NO: 2541997 - RNA, 12 nt, Chlamydophila pneumoniae J138
aaucaaauucaa

SEQ ID NO: 2541998 - RNA, 14 nt, Chlamydophila pneumoniae J138
aaucaacaucacaa

SEQ ID NO: 2541999 - RNA, 14 nt, Chlamydophila pneumoniae J138
aaucaaccaaaaug

SEQ ID NO: 2542000 - RNA, 18 nt, Chlamydophila pneumoniae J138
aaucaagaguuucgaauu

SEQ ID NO: 2542001 - RNA, 13 nt, Chlamydophila pneumoniae J138
aaucaauaaaaug

SEQ ID NO: 2542002 - RNA, 14 nt, Chlamydophila pneumoniae J138
aaucaauccaagaa

SEQ ID NO: 2542003 - RNA, 13 nt, Chlamydophila pneumoniae J138
aaucaauccacaa

SEQ ID NO: 2542004 - RNA, 22 nt, Chlamydophila pneumoniae J138
aaucaauccuauggcagcagga

SEQ ID NO: 2542005 - RNA, 19 nt, Chlamydophila pneumoniae J138
aaucaccaauuuuuucccc

SEQ ID NO: 2542006 - RNA, 18 nt, Chlamydophila pneumoniae J138
aaucacgacgucaucacc

SEQ ID NO: 2542007 - RNA, 17 nt, Chlamydophila pneumoniae J138
aaucacuuaauaauguu

SEQ ID NO: 2542008 - RNA, 20 nt, Chlamydophila pneumoniae J138
aaucacuuaauaauguuuua

SEQ ID NO: 2542009 - RNA, 14 nt, Chlamydophila pneumoniae J138
aaucagaagugauc

SEQ ID NO: 2542010 - RNA, 13 nt, Chlamydophila pneumoniae J138
aaucagaggagcc

SEQ ID NO: 2542011 - RNA, 14 nt, Chlamydophila pneumoniae J138
aaucagaggagccu

SEQ ID NO: 2542012 - RNA, 20 nt, Chlamydophila pneumoniae J138
aaucagaggagccuccauaa

SEQ ID NO: 2542013 - RNA, 23 nt, Chlamydophila pneumoniae J138
aaucagcaacaucguuaauauaa

SEQ ID NO: 2542014 - RNA, 17 nt, Chlamydophila pneumoniae J138
aaucagcacacugcuua

SEQ ID NO: 2542015 - RNA, 13 nt, Chlamydophila pneumoniae J138
aaucaguccuaaa

SEQ ID NO: 2542016 - RNA, 20 nt, Chlamydophila pneumoniae J138
aaucauaaccaaaagaauua

SEQ ID NO: 2542017 - RNA, 21 nt, Chlamydophila pneumoniae J138
aaucauagagauaucaucaaa

SEQ ID NO: 2542018 - RNA, 13 nt, Chlamydophila pneumoniae J138
aaucauaucugcg

SEQ ID NO: 2542019 - RNA, 15 nt, Chlamydophila pneumoniae J138
aaucaucaaaaagau

SEQ ID NO: 2542020 - RNA, 20 nt, Chlamydophila pneumoniae J138
aaucaugccgagauuuuuac

SEQ ID NO: 2542021 - RNA, 20 nt, Chlamydophila pneumoniae J138
aaucauuagaguuugguuug

SEQ ID NO: 2542022 - RNA, 23 nt, Chlamydophila pneumoniae J138
aaucauuggaaccauaggauagg

SEQ ID NO: 2542023 - RNA, 21 nt, Chlamydophila pneumoniae J138
aauccaaaaaaugcuccugca

SEQ ID NO: 2542024 - RNA, 16 nt, Chlamydophila pneumoniae J138
aauccaacaaagauga

SEQ ID NO: 2542025 - RNA, 13 nt, Chlamydophila pneumoniae J138
aauccaagaauag

SEQ ID NO: 2542026 - RNA, 17 nt, Chlamydophila pneumoniae J138
aauccaaggggcuccca

SEQ ID NO: 2542027 - RNA, 16 nt, Chlamydophila pneumoniae J138
aauccacgcuccucua

SEQ ID NO: 2542028 - RNA, 19 nt, Chlamydophila pneumoniae J138
aauccagaauuuucugcga

SEQ ID NO: 2542029 - RNA, 13 nt, Chlamydophila pneumoniae J138
aauccaguuuuuu

SEQ ID NO: 2542030 - RNA, 20 nt, Chlamydophila pneumoniae J138
aauccauaguccuagcagag

SEQ ID NO: 2542031 - RNA, 21 nt, Chlamydophila pneumoniae J138
aauccauucugagaaagaagu

SEQ ID NO: 2542032 - RNA, 22 nt, Chlamydophila pneumoniae J138
aauccauucugagaaagaaguc

SEQ ID NO: 2542033 - RNA, 22 nt, Chlamydophila pneumoniae J138
aauccauuuugcccacuucuac

SEQ ID NO: 2542034 - RNA, 22 nt, Chlamydophila pneumoniae J138
aaucccugaugcaguaauucca

SEQ ID NO: 2542035 - RNA, 15 nt, Chlamydophila pneumoniae J138
aaucccugcacucuu

SEQ ID NO: 2542036 - RNA, 20 nt, Chlamydophila pneumoniae J138
aaucccugcacucuuucaga

SEQ ID NO: 2542037 - RNA, 22 nt, Chlamydophila pneumoniae J138
aaucccuguucuagcaaaucua

SEQ ID NO: 2542038 - RNA, 23 nt, Chlamydophila pneumoniae J138
aaucccuguucuagcaaaucuaa

SEQ ID NO: 2542039 - RNA, 14 nt, Chlamydophila pneumoniae J138
aauccuaauuccuu

SEQ ID NO: 2542040 - RNA, 20 nt, Chlamydophila pneumoniae J138
aauccugcauacccuucuuc

SEQ ID NO: 2542041 - RNA, 23 nt, Chlamydophila pneumoniae J138
aauccugcucguaaaucuggaau

SEQ ID NO: 2542042 - RNA, 21 nt, Chlamydophila pneumoniae J138
aauccuguaacacccucccuc

SEQ ID NO: 2542043 - RNA, 20 nt, Chlamydophila pneumoniae J138
aauccuguagggaaagacuc

SEQ ID NO: 2542044 - RNA, 12 nt, Chlamydophila pneumoniae J138
aauccuuccuua

SEQ ID NO: 2542045 - RNA, 13 nt, Chlamydophila pneumoniae J138
aauccuuccuuac

SEQ ID NO: 2542046 - RNA, 21 nt, Chlamydophila pneumoniae J138
aauccuuccuuacaagcuucc

SEQ ID NO: 2542047 - RNA, 12 nt, Chlamydophila pneumoniae J138
aauccuucuuuc

SEQ ID NO: 2542048 - RNA, 23 nt, Chlamydophila pneumoniae J138
aauccuuuaguuaacuccuucaa

SEQ ID NO: 2542049 - RNA, 16 nt, Chlamydophila pneumoniae J138
aauccuuuauguauaa

SEQ ID NO: 2542050 - RNA, 15 nt, Chlamydophila pneumoniae J138
aauccuuuggaagcu

SEQ ID NO: 2542051 - RNA, 19 nt, Chlamydophila pneumoniae J138
aaucgagagaagaaauucu

SEQ ID NO: 2542052 - RNA, 22 nt, Chlamydophila pneumoniae J138
aaucgagagaagaaauucugac

SEQ ID NO: 2542053 - RNA, 17 nt, Chlamydophila pneumoniae J138
aaucgauaacguugccu

SEQ ID NO: 2542054 - RNA, 16 nt, Chlamydophila pneumoniae J138
aaucgcaucaaaaaau

SEQ ID NO: 2542055 - RNA, 16 nt, Chlamydophila pneumoniae J138
aaucgcuguaaauuca

SEQ ID NO: 2542056 - RNA, 21 nt, Chlamydophila pneumoniae J138
aaucgcuguuuuagcauagca

SEQ ID NO: 2542057 - RNA, 20 nt, Chlamydophila pneumoniae J138
auaucaccagguccuucugg

SEQ ID NO: 2542058 - RNA, 16 nt, Chlamydophila pneumoniae J138
auaucaccuacaucag

SEQ ID NO: 2542059 - RNA, 14 nt, Chlamydophila pneumoniae J138
auaucagcaaaaaa

SEQ ID NO: 2542060 - RNA, 16 nt, Chlamydophila pneumoniae J138
auaucagcaaaaaacu

SEQ ID NO: 2542061 - RNA, 13 nt, Chlamydophila pneumoniae J138
auaucagcuucuu

SEQ ID NO: 2542062 - RNA, 19 nt, Chlamydophila pneumoniae J138
auaucagcuucuugaugua

SEQ ID NO: 2542063 - RNA, 23 nt, Chlamydophila pneumoniae J138
auaucaguauggcguuuuuuuug

SEQ ID NO: 2542064 - RNA, 19 nt, Chlamydophila pneumoniae J138
auaucauauuuuuguccug

SEQ ID NO: 2542065 - RNA, 14 nt, Chlamydophila pneumoniae J138
auaucaucaaaaga

SEQ ID NO: 2542066 - RNA, 14 nt, Chlamydophila pneumoniae J138
auaucaucacuaag

SEQ ID NO: 2542067 - RNA, 14 nt, Chlamydophila pneumoniae J138
auaucaucuuccuc

SEQ ID NO: 2542068 - RNA, 16 nt, Chlamydophila pneumoniae J138
auaucauuaagaagau

SEQ ID NO: 2542069 - RNA, 20 nt, Chlamydophila pneumoniae J138
auauccguauggauuucucc

SEQ ID NO: 2542070 - RNA, 17 nt, Chlamydophila pneumoniae J138
auaucgaccuuaaaauu

SEQ ID NO: 2542071 - RNA, 22 nt, Chlamydophila pneumoniae J138
auaucgaguucuuuuugcagau

SEQ ID NO: 2542072 - RNA, 13 nt, Chlamydophila pneumoniae J138
auaucgauaggau

SEQ ID NO: 2542073 - RNA, 22 nt, Chlamydophila pneumoniae J138
auaucgccuuccuuaacaacau

SEQ ID NO: 2542074 - RNA, 19 nt, Chlamydophila pneumoniae J138
auaucgcguguaaaagcuu

SEQ ID NO: 2542075 - RNA, 20 nt, Chlamydophila pneumoniae J138
auaucgguuucuuuuuuuug

SEQ ID NO: 2542076 - RNA, 15 nt, Chlamydophila pneumoniae J138
auaucguaggaccua

SEQ ID NO: 2542077 - RNA, 15 nt, Chlamydophila pneumoniae J138
auaucuauaaaugua

SEQ ID NO: 2542078 - RNA, 14 nt, Chlamydophila pneumoniae J138
aaguucauaaccug

SEQ ID NO: 2542079 - RNA, 15 nt, Chlamydophila pneumoniae J138
aaguucaucaaauaa

SEQ ID NO: 2542080 - RNA, 18 nt, Chlamydophila pneumoniae J138
aaguuccauagaguaucu

SEQ ID NO: 2542081 - RNA, 12 nt, Chlamydophila pneumoniae J138
aaguuccuucag

SEQ ID NO: 2542082 - RNA, 23 nt, Chlamydophila pneumoniae J138
aaguucggcgccuucaaaaaaca

SEQ ID NO: 2542083 - RNA, 21 nt, Chlamydophila pneumoniae J138
aaguucgggucgauguucucg

SEQ ID NO: 2542084 - RNA, 13 nt, Chlamydophila pneumoniae J138
aaguucucaaaga

SEQ ID NO: 2542085 - RNA, 17 nt, Chlamydophila pneumoniae J138
aaguucuuggaaaaaag

SEQ ID NO: 2542086 - RNA, 19 nt, Chlamydophila pneumoniae J138
aaguucuuggaaaaaagga

SEQ ID NO: 2542087 - RNA, 22 nt, Chlamydophila pneumoniae J138
aaguugaaaugagugagaaugc

SEQ ID NO: 2542088 - RNA, 16 nt, Chlamydophila pneumoniae J138
aaguugaccuuuuuca

SEQ ID NO: 2542089 - RNA, 13 nt, Chlamydophila pneumoniae J138
aaguugagagaga

SEQ ID NO: 2542090 - RNA, 15 nt, Chlamydophila pneumoniae J138
aaguugaguugcgua

SEQ ID NO: 2542091 - RNA, 20 nt, Chlamydophila pneumoniae J138
aaguugaguugcguacgaua

SEQ ID NO: 2542092 - RNA, 15 nt, Chlamydophila pneumoniae J138
aaguugauacuugua

SEQ ID NO: 2542093 - RNA, 16 nt, Chlamydophila pneumoniae J138
aaguugccuaaagaga

SEQ ID NO: 2542094 - RNA, 17 nt, Chlamydophila pneumoniae J138
aaguuguagugaaugag

SEQ ID NO: 2542095 - RNA, 20 nt, Chlamydophila pneumoniae J138
aaguuguagugaaugagcuu

SEQ ID NO: 2542096 - RNA, 17 nt, Chlamydophila pneumoniae J138
aaguuguugauaauuac

SEQ ID NO: 2542097 - RNA, 19 nt, Chlamydophila pneumoniae J138
aaguuguuuauuuagcauu

SEQ ID NO: 2542098 - RNA, 16 nt, Chlamydophila pneumoniae J138
aaguuuacaaauaaaa

SEQ ID NO: 2542099 - RNA, 23 nt, Chlamydophila pneumoniae J138
aaguuucuuuugcaaaucuucga

SEQ ID NO: 2542100 - RNA, 20 nt, Chlamydophila pneumoniae J138
aaguuuguagcagcaagaac

SEQ ID NO: 2542101 - RNA, 15 nt, Chlamydophila pneumoniae J138
aaguuuugaggauuu

SEQ ID NO: 2542102 - RNA, 23 nt, Chlamydophila pneumoniae J138
aaguuuugaggauuucuugcaag

SEQ ID NO: 2542103 - RNA, 20 nt, Chlamydophila pneumoniae J138
aaguuuugcucucuagauuu

SEQ ID NO: 2542104 - RNA, 21 nt, Chlamydophila pneumoniae J138
aaguuuuuuaagugcuuuuag

SEQ ID NO: 2542105 - RNA, 16 nt, Chlamydophila pneumoniae J138
aaguuuuuucaauccu

SEQ ID NO: 2542106 - RNA, 20 nt, Chlamydophila pneumoniae J138
aaguuuuuucucucuuuauc

SEQ ID NO: 2542107 - RNA, 22 nt, Chlamydophila pneumoniae J138
aauaaaaaaacccucaaagaau

SEQ ID NO: 2542108 - RNA, 14 nt, Chlamydophila pneumoniae J138
aauaaaagaacauu

SEQ ID NO: 2542109 - RNA, 12 nt, Chlamydophila pneumoniae J138
aauaaaaugauu

SEQ ID NO: 2542110 - RNA, 14 nt, Chlamydophila pneumoniae J138
aauaaaauguccaa

SEQ ID NO: 2542111 - RNA, 12 nt, Chlamydophila pneumoniae J138
aauaaaauuuaa

SEQ ID NO: 2542112 - RNA, 18 nt, Chlamydophila pneumoniae J138
aauaaaauuuaaaaaaau

SEQ ID NO: 2542113 - RNA, 20 nt, Chlamydophila pneumoniae J138
aauaaacugacguuuuuccc

SEQ ID NO: 2542114 - RNA, 13 nt, Chlamydophila pneumoniae J138
aauaaauuuaucu

SEQ ID NO: 2542115 - RNA, 17 nt, Chlamydophila pneumoniae J138
aauaacaccaaaagaau

SEQ ID NO: 2542116 - RNA, 13 nt, Chlamydophila pneumoniae J138
aauaaccagaaga

SEQ ID NO: 2542117 - RNA, 22 nt, Chlamydophila pneumoniae J138
aauaaccgaaacuucucagaua

SEQ ID NO: 2542118 - RNA, 17 nt, Chlamydophila pneumoniae J138
aauaagauccaaaaauu

SEQ ID NO: 2542119 - RNA, 19 nt, Chlamydophila pneumoniae J138
aauaagauuuuaagaccuu

SEQ ID NO: 2542120 - RNA, 14 nt, Chlamydophila pneumoniae J138
aauaagauuuugaa

SEQ ID NO: 2542121 - RNA, 16 nt, Chlamydophila pneumoniae J138
aauaagcaggaaaagc

SEQ ID NO: 2542122 - RNA, 19 nt, Chlamydophila pneumoniae J138
aauaagcuugccagcagaa

SEQ ID NO: 2542123 - RNA, 21 nt, Chlamydophila pneumoniae J138
aauaagcuuuccucuccaaaa

SEQ ID NO: 2542124 - RNA, 16 nt, Chlamydophila pneumoniae J138
aauaauacuuaauccu

SEQ ID NO: 2542125 - RNA, 14 nt, Chlamydophila pneumoniae J138
aauaauagcaagua

SEQ ID NO: 2542126 - RNA, 17 nt, Chlamydophila pneumoniae J138
aauaauaggauaagaaa

SEQ ID NO: 2542127 - RNA, 17 nt, Chlamydophila pneumoniae J138
aauaaucaaccaaaaug

SEQ ID NO: 2542128 - RNA, 16 nt, Chlamydophila pneumoniae J138
aauaauggcaugacgg

SEQ ID NO: 2542129 - RNA, 20 nt, Chlamydophila pneumoniae J138
aauaauguuuuaauagcuaa

SEQ ID NO: 2542130 - RNA, 14 nt, Chlamydophila pneumoniae J138
aauaauuacuugga

SEQ ID NO: 2542131 - RNA, 22 nt, Chlamydophila pneumoniae J138
aauaauuuguuuagaaaaagau

SEQ ID NO: 2542132 - RNA, 19 nt, Chlamydophila pneumoniae J138
aauacaaaacaaaagccau

SEQ ID NO: 2542133 - RNA, 14 nt, Chlamydophila pneumoniae J138
aauacaaacaagaa

SEQ ID NO: 2542134 - RNA, 16 nt, Chlamydophila pneumoniae J138
aauacagcauaaaaau

SEQ ID NO: 2542135 - RNA, 15 nt, Chlamydophila pneumoniae J138
aauacagccagcaga

SEQ ID NO: 2542136 - RNA, 17 nt, Chlamydophila pneumoniae J138
aauacaggaaucuccuc

SEQ ID NO: 2542137 - RNA, 13 nt, Chlamydophila pneumoniae J138
aauacaggagaau

SEQ ID NO: 2542138 - RNA, 19 nt, Chlamydophila pneumoniae J138
aauacauagguaaaaccag

SEQ ID NO: 2542139 - RNA, 19 nt, Chlamydophila pneumoniae J138
aauacaucaccacugcucc

SEQ ID NO: 2542140 - RNA, 20 nt, Chlamydophila pneumoniae J138
aauacaucuuaagagcaaac

SEQ ID NO: 2542141 - RNA, 13 nt, Chlamydophila pneumoniae J138
aauaccagaagca

SEQ ID NO: 2542142 - RNA, 14 nt, Chlamydophila pneumoniae J138
aauaccagaagcaa

SEQ ID NO: 2542143 - RNA, 19 nt, Chlamydophila pneumoniae J138
aauaccagaagcaaaggua

SEQ ID NO: 2542144 - RNA, 13 nt, Chlamydophila pneumoniae J138
aauaccagauaaa

SEQ ID NO: 2542145 - RNA, 17 nt, Chlamydophila pneumoniae J138
aauaccagauaaagcaa

SEQ ID NO: 2542146 - RNA, 15 nt, Chlamydophila pneumoniae J138
aauaccaucucuuuc

SEQ ID NO: 2542147 - RNA, 18 nt, Chlamydophila pneumoniae J138
aauaccucagaaauuccu

SEQ ID NO: 2542148 - RNA, 21 nt, Chlamydophila pneumoniae J138
aauaccuguacgguaaaucca

SEQ ID NO: 2542149 - RNA, 22 nt, Chlamydophila pneumoniae J138
aauaccuguacgguaaauccau

SEQ ID NO: 2542150 - RNA, 21 nt, Chlamydophila pneumoniae J138
aauaccuuucuaagaauucuu

SEQ ID NO: 2542151 - RNA, 15 nt, Chlamydophila pneumoniae J138
aauacgaucugcuuu

SEQ ID NO: 2542152 - RNA, 16 nt, Chlamydophila pneumoniae J138
aauacgaucugcuuug

SEQ ID NO: 2542153 - RNA, 14 nt, Chlamydophila pneumoniae J138
aauacgaucuuuug

SEQ ID NO: 2542154 - RNA, 15 nt, Chlamydophila pneumoniae J138
aauacgcuuuucuuc

SEQ ID NO: 2542155 - RNA, 19 nt, Chlamydophila pneumoniae J138
aauacgcuuuucuucuuua

SEQ ID NO: 2542156 - RNA, 16 nt, Chlamydophila pneumoniae J138
aauacggacauaccua

SEQ ID NO: 2542157 - RNA, 23 nt, Chlamydophila pneumoniae J138
aauacguccagccugcaccagac

SEQ ID NO: 2542158 - RNA, 22 nt, Chlamydophila pneumoniae J138
aauacuaagaagcucacucuuu

SEQ ID NO: 2542159 - RNA, 19 nt, Chlamydophila pneumoniae J138
aauacuccacuuuuuuccc

SEQ ID NO: 2542160 - RNA, 12 nt, Chlamydophila pneumoniae J138
aauacucuguuu

SEQ ID NO: 2542161 - RNA, 22 nt, Chlamydophila pneumoniae J138
aauacuggagagguaaccagag

SEQ ID NO: 2542162 - RNA, 18 nt, Chlamydophila pneumoniae J138
aauacuguucgauaagaa

SEQ ID NO: 2542163 - RNA, 19 nt, Chlamydophila pneumoniae J138
aauacuguucgauaagaac

SEQ ID NO: 2542164 - RNA, 14 nt, Chlamydophila pneumoniae J138
aauacuuaauccug

SEQ ID NO: 2542165 - RNA, 16 nt, Chlamydophila pneumoniae J138
aauacuuaauccugua

SEQ ID NO: 2542166 - RNA, 19 nt, Chlamydophila pneumoniae J138
aauacuuaggaauuuuucu

SEQ ID NO: 2542167 - RNA, 13 nt, Chlamydophila pneumoniae J138
aauacuucuccug

SEQ ID NO: 2542168 - RNA, 15 nt, Chlamydophila pneumoniae J138
aauacuucuccugaa

SEQ ID NO: 2542169 - RNA, 20 nt, Chlamydophila pneumoniae J138
aauagaaaagguauuaggaa

SEQ ID NO: 2542170 - RNA, 14 nt, Chlamydophila pneumoniae J138
aauagaaauaagca

SEQ ID NO: 2542171 - RNA, 15 nt, Chlamydophila pneumoniae J138
aauagacacuugcuu

SEQ ID NO: 2542172 - RNA, 15 nt, Chlamydophila pneumoniae J138
aauagacaggaugga

SEQ ID NO: 2542173 - RNA, 13 nt, Chlamydophila pneumoniae J138
aauagagaaacuu

SEQ ID NO: 2542174 - RNA, 22 nt, Chlamydophila pneumoniae J138
aauagagaaagagugccaagag

SEQ ID NO: 2542175 - RNA, 21 nt, Chlamydophila pneumoniae J138
aauagagaagaagcaaaagau

SEQ ID NO: 2542176 - RNA, 21 nt, Chlamydophila pneumoniae J138
aauagauccugaaaguacaga

SEQ ID NO: 2542177 - RNA, 18 nt, Chlamydophila pneumoniae J138
aauagauucguuauccuc

SEQ ID NO: 2542178 - RNA, 17 nt, Chlamydophila pneumoniae J138
aauagcaaagauuucug

SEQ ID NO: 2542179 - RNA, 18 nt, Chlamydophila pneumoniae J138
aaugaggacacaacucuu

SEQ ID NO: 2542180 - RNA, 22 nt, Chlamydophila pneumoniae J138
aaugaggguggaacuauccugu

SEQ ID NO: 2542181 - RNA, 12 nt, Chlamydophila pneumoniae J138
aaugauaagaaa

SEQ ID NO: 2542182 - RNA, 17 nt, Chlamydophila pneumoniae J138
aaugauauaaaagcuga

SEQ ID NO: 2542183 - RNA, 20 nt, Chlamydophila pneumoniae J138
aaugauucauaacauugcuu

SEQ ID NO: 2542184 - RNA, 23 nt, Chlamydophila pneumoniae J138
aaugcaaaccaaaaaaguaacua

SEQ ID NO: 2542185 - RNA, 16 nt, Chlamydophila pneumoniae J138
aaugcacuuugaauaa

SEQ ID NO: 2542186 - RNA, 20 nt, Chlamydophila pneumoniae J138
aaugcaguucuuguuaaagu

SEQ ID NO: 2542187 - RNA, 16 nt, Chlamydophila pneumoniae J138
aaugccaauaugguag

SEQ ID NO: 2542188 - RNA, 13 nt, Chlamydophila pneumoniae J138
aaugccagcagcg

SEQ ID NO: 2542189 - RNA, 19 nt, Chlamydophila pneumoniae J138
aaugccauucuuaucugcu

SEQ ID NO: 2542190 - RNA, 16 nt, Chlamydophila pneumoniae J138
aaugcccuuuagggaa

SEQ ID NO: 2542191 - RNA, 23 nt, Chlamydophila pneumoniae J138
aaugcccuuuagggaauccccaa

SEQ ID NO: 2542192 - RNA, 17 nt, Chlamydophila pneumoniae J138
aaugccgaguaguccug

SEQ ID NO: 2542193 - RNA, 22 nt, Chlamydophila pneumoniae J138
aaugccucuuucauacuaaaau

SEQ ID NO: 2542194 - RNA, 17 nt, Chlamydophila pneumoniae J138
aaugccuuaaauguauu

SEQ ID NO: 2542195 - RNA, 22 nt, Chlamydophila pneumoniae J138
aaugcgaugcggucagaaacau

SEQ ID NO: 2542196 - RNA, 20 nt, Chlamydophila pneumoniae J138
aaugcuacgguuuucugccu

SEQ ID NO: 2542197 - RNA, 13 nt, Chlamydophila pneumoniae J138
aaugcuagaguuu

SEQ ID NO: 2542198 - RNA, 13 nt, Chlamydophila pneumoniae J138
aaugcuauuuucc

SEQ ID NO: 2542199 - RNA, 22 nt, Chlamydophila pneumoniae J138
aaugcuccuugggucuuuuuau

SEQ ID NO: 2542200 - RNA, 21 nt, Chlamydophila pneumoniae J138
aaugcugagggaucuucucua

SEQ ID NO: 2542201 - RNA, 18 nt, Chlamydophila pneumoniae J138
aaugcuguagauuguuag

SEQ ID NO: 2542202 - RNA, 16 nt, Chlamydophila pneumoniae J138
aauggaaauagagaaa

SEQ ID NO: 2542203 - RNA, 20 nt, Chlamydophila pneumoniae J138
aauggcagcuuggaugggaa

SEQ ID NO: 2542204 - RNA, 21 nt, Chlamydophila pneumoniae J138
aauggcagcuuggaugggaau

SEQ ID NO: 2542205 - RNA, 16 nt, Chlamydophila pneumoniae J138
aauggcaugaaagaua

SEQ ID NO: 2542206 - RNA, 15 nt, Chlamydophila pneumoniae J138
aauggcgauaaaugc

SEQ ID NO: 2542207 - RNA, 16 nt, Chlamydophila pneumoniae J138
aauguaagaaggcaga

SEQ ID NO: 2542208 - RNA, 24 nt, Chlamydophila pneumoniae J138
aauguauaggcauuaauaacuuua

SEQ ID NO: 2542209 - RNA, 21 nt, Chlamydophila pneumoniae J138
aauguauccuucuacaaugau

SEQ ID NO: 2542210 - RNA, 21 nt, Chlamydophila pneumoniae J138
aauguaucggggauugcaaaa

SEQ ID NO: 2542211 - RNA, 18 nt, Chlamydophila pneumoniae J138
aauguccaacucagcuuu

SEQ ID NO: 2542212 - RNA, 22 nt, Chlamydophila pneumoniae J138
aaugucgguuuguuaaacccaa

SEQ ID NO: 2542213 - RNA, 23 nt, Chlamydophila pneumoniae J138
aaugucguaccccgcagcaaaaa

SEQ ID NO: 2542214 - RNA, 14 nt, Chlamydophila pneumoniae J138
aaugucgucucaga

SEQ ID NO: 2542215 - RNA, 19 nt, Chlamydophila pneumoniae J138
aaugugacgcaagagacaa

SEQ ID NO: 2542216 - RNA, 23 nt, Chlamydophila pneumoniae J138
aaugugcaauaggaaaaaauacc

SEQ ID NO: 2542217 - RNA, 18 nt, Chlamydophila pneumoniae J138
aaugugcucggacagaaa

SEQ ID NO: 2542218 - RNA, 17 nt, Chlamydophila pneumoniae J138
aaugugcuuuugguucu

SEQ ID NO: 2542219 - RNA, 20 nt, Chlamydophila pneumoniae J138
aauguucccaaauagaaaau

SEQ ID NO: 2542220 - RNA, 16 nt, Chlamydophila pneumoniae J138
aauguucgaagaucuu

SEQ ID NO: 2542221 - RNA, 21 nt, Chlamydophila pneumoniae J138
aauguugggaugaucucguag

SEQ ID NO: 2542222 - RNA, 18 nt, Chlamydophila pneumoniae J138
aauguuuggccaacagcu

SEQ ID NO: 2542223 - RNA, 23 nt, Chlamydophila pneumoniae J138
aauguuuuccucgaguauggcaa

SEQ ID NO: 2542224 - RNA, 14 nt, Chlamydophila pneumoniae J138
aauuaaacuuucuu

SEQ ID NO: 2542225 - RNA, 16 nt, Chlamydophila pneumoniae J138
aauuaacagagcgccu

SEQ ID NO: 2542226 - RNA, 13 nt, Chlamydophila pneumoniae J138
aauuaagaaacua

SEQ ID NO: 2542227 - RNA, 14 nt, Chlamydophila pneumoniae J138
aauuaauaaaagag

SEQ ID NO: 2542228 - RNA, 15 nt, Chlamydophila pneumoniae J138
aauuaccauuuugca

SEQ ID NO: 2542229 - RNA, 21 nt, Chlamydophila pneumoniae J138
aauuaccuugagacaaagaau

SEQ ID NO: 2542230 - RNA, 21 nt, Chlamydophila pneumoniae J138
aauuacgcucuccauggcuuc

SEQ ID NO: 2542231 - RNA, 14 nt, Chlamydophila pneumoniae J138
aauuacuuggauaa

SEQ ID NO: 2542232 - RNA, 23 nt, Chlamydophila pneumoniae J138
aauuacuuggauaacacgaguuu

SEQ ID NO: 2542233 - RNA, 15 nt, Chlamydophila pneumoniae J138
aauuagaaucagagg

SEQ ID NO: 2542234 - RNA, 17 nt, Chlamydophila pneumoniae J138
aauuagagaaauuuuua

SEQ ID NO: 2542235 - RNA, 18 nt, Chlamydophila pneumoniae J138
aauuagagaaauuuuuaa

SEQ ID NO: 2542236 - RNA, 13 nt, Chlamydophila pneumoniae J138
aauuagagagaau

SEQ ID NO: 2542237 - RNA, 17 nt, Chlamydophila pneumoniae J138
aauuagagggauuugua

SEQ ID NO: 2542238 - RNA, 15 nt, Chlamydophila pneumoniae J138
aauuagaguaugagg

SEQ ID NO: 2542239 - RNA, 17 nt, Chlamydophila pneumoniae J138
aauuagggcuuuuacuc

SEQ ID NO: 2542240 - RNA, 15 nt, Chlamydophila pneumoniae J138
aauuaguaaaugccu

SEQ ID NO: 2542241 - RNA, 13 nt, Chlamydophila pneumoniae J138
aauuauccagaaa

SEQ ID NO: 2542242 - RNA, 17 nt, Chlamydophila pneumoniae J138
aauuauccagaaagauu

SEQ ID NO: 2542243 - RNA, 19 nt, Chlamydophila pneumoniae J138
aauuaucuccaaagaucau

SEQ ID NO: 2542244 - RNA, 13 nt, Chlamydophila pneumoniae J138
aauucaaaaagag

SEQ ID NO: 2542245 - RNA, 14 nt, Chlamydophila pneumoniae J138
aauucaaaaagaga

SEQ ID NO: 2542246 - RNA, 13 nt, Chlamydophila pneumoniae J138
aauucaaaucccu

SEQ ID NO: 2542247 - RNA, 20 nt, Chlamydophila pneumoniae J138
aauucaggacccuuuuccuc

SEQ ID NO: 2542248 - RNA, 12 nt, Chlamydophila pneumoniae J138
aauucauauuua

SEQ ID NO: 2542249 - RNA, 21 nt, Chlamydophila pneumoniae J138
aauucauccagauuagaaaag

SEQ ID NO: 2542250 - RNA, 23 nt, Chlamydophila pneumoniae J138
aauucaugcaaaacaacaucacu

SEQ ID NO: 2542251 - RNA, 13 nt, Chlamydophila pneumoniae J138
aauuccaaaauaa

SEQ ID NO: 2542252 - RNA, 15 nt, Chlamydophila pneumoniae J138
aauuccaauuuuugc

SEQ ID NO: 2542253 - RNA, 15 nt, Chlamydophila pneumoniae J138
aauuccagaaaaaga

SEQ ID NO: 2542254 - RNA, 22 nt, Chlamydophila pneumoniae J138
aauuccauagguuagaaaugaa

SEQ ID NO: 2542255 - RNA, 20 nt, Chlamydophila pneumoniae J138
aauucccguagguagagcug

SEQ ID NO: 2542256 - RNA, 17 nt, Chlamydophila pneumoniae J138
aauuccuaaaacaagaa

SEQ ID NO: 2542257 - RNA, 20 nt, Chlamydophila pneumoniae J138
aauuccuaaaacaagaagau

SEQ ID NO: 2542258 - RNA, 17 nt, Chlamydophila pneumoniae J138
aauuccuucucagaaag

SEQ ID NO: 2542259 - RNA, 18 nt, Chlamydophila pneumoniae J138
aauuccuucucagaaaga

SEQ ID NO: 2542260 - RNA, 22 nt, Chlamydophila pneumoniae J138
aauuccuucucagaaagauauc

SEQ ID NO: 2542261 - RNA, 16 nt, Chlamydophila pneumoniae J138
aauucgaauucucaga

SEQ ID NO: 2542262 - RNA, 15 nt, Chlamydophila pneumoniae J138
aauucggcagaaggc

SEQ ID NO: 2542263 - RNA, 17 nt, Chlamydophila pneumoniae J138
aauucuagaccugccaa

SEQ ID NO: 2542264 - RNA, 16 nt, Chlamydophila pneumoniae J138
aauucucagaaagccu

SEQ ID NO: 2542265 - RNA, 15 nt, Chlamydophila pneumoniae J138
aauucucucucugca

SEQ ID NO: 2542266 - RNA, 19 nt, Chlamydophila pneumoniae J138
aauucucugacacuccuca

SEQ ID NO: 2542267 - RNA, 22 nt, Chlamydophila pneumoniae J138
aauucucugacacuccucagaa

SEQ ID NO: 2542268 - RNA, 18 nt, Chlamydophila pneumoniae J138
aauucugaagauauauuu

SEQ ID NO: 2542269 - RNA, 22 nt, Chlamydophila pneumoniae J138
aauucuuuaugagagagcucuu

SEQ ID NO: 2542270 - RNA, 12 nt, Chlamydophila pneumoniae J138
aauucuuuuccu

SEQ ID NO: 2542271 - RNA, 23 nt, Chlamydophila pneumoniae J138
aauugaacguagcuacaaaauua

SEQ ID NO: 2542272 - RNA, 14 nt, Chlamydophila pneumoniae J138
aauugacuggaggc

SEQ ID NO: 2542273 - RNA, 23 nt, Chlamydophila pneumoniae J138
aauugagaaauauaacucucuag

SEQ ID NO: 2542274 - RNA, 16 nt, Chlamydophila pneumoniae J138
aauugagcucucuagc

SEQ ID NO: 2542275 - RNA, 18 nt, Chlamydophila pneumoniae J138
aauugcauuaagauaaac

SEQ ID NO: 2542276 - RNA, 13 nt, Chlamydophila pneumoniae J138
aauugcauucuua

SEQ ID NO: 2542277 - RNA, 15 nt, Chlamydophila pneumoniae J138
aauugcucuugcucu

SEQ ID NO: 2542278 - RNA, 18 nt, Chlamydophila pneumoniae J138
aaggaagaagaagaagga

SEQ ID NO: 2542279 - RNA, 23 nt, Chlamydophila pneumoniae J138
aaggaagaucuugaacagagacu

SEQ ID NO: 2542280 - RNA, 22 nt, Chlamydophila pneumoniae J138
aaggaagggauguuuaauacaa

SEQ ID NO: 2542281 - RNA, 13 nt, Chlamydophila pneumoniae J138
aaggaaguuauaa

SEQ ID NO: 2542282 - RNA, 16 nt, Chlamydophila pneumoniae J138
aaggacaaucaacauu

SEQ ID NO: 2542283 - RNA, 18 nt, Chlamydophila pneumoniae J138
aaggaccacaauuccuaa

SEQ ID NO: 2542284 - RNA, 23 nt, Chlamydophila pneumoniae J138
aaggaccuguuuucuuuucugaa

SEQ ID NO: 2542285 - RNA, 13 nt, Chlamydophila pneumoniae J138
aaggacucuuucu

SEQ ID NO: 2542286 - RNA, 14 nt, Chlamydophila pneumoniae J138
aaggagauuccuaa

SEQ ID NO: 2542287 - RNA, 21 nt, Chlamydophila pneumoniae J138
aaggagcggaguaacuaauaa

SEQ ID NO: 2542288 - RNA, 21 nt, Chlamydophila pneumoniae J138
aaggaggaggagcacuaggca

SEQ ID NO: 2542289 - RNA, 16 nt, Chlamydophila pneumoniae J138
aaggagguccuuggca

SEQ ID NO: 2542290 - RNA, 15 nt, Chlamydophila pneumoniae J138
aaggaucauuaaagu

SEQ ID NO: 2542291 - RNA, 23 nt, Chlamydophila pneumoniae J138
aaggaucccaucaucgagcugau

SEQ ID NO: 2542292 - RNA, 17 nt, Chlamydophila pneumoniae J138
aaggauucuaugaggac

SEQ ID NO: 2542293 - RNA, 21 nt, Chlamydophila pneumoniae J138
aaggauucugagaaguuaaga

SEQ ID NO: 2542294 - RNA, 22 nt, Chlamydophila pneumoniae J138
aaggauuugcucuguaguaaag

SEQ ID NO: 2542295 - RNA, 18 nt, Chlamydophila pneumoniae J138
aaggauuuugagacgaaa

SEQ ID NO: 2542296 - RNA, 12 nt, Chlamydophila pneumoniae J138
aaggcaagaugu

SEQ ID NO: 2542297 - RNA, 19 nt, Chlamydophila pneumoniae J138
aaggcacagcaaugacauu

SEQ ID NO: 2542298 - RNA, 15 nt, Chlamydophila pneumoniae J138
aaggcaccaacacuu

SEQ ID NO: 2542299 - RNA, 22 nt, Chlamydophila pneumoniae J138
aaggcagagaacuuucgucuuu

SEQ ID NO: 2542300 - RNA, 13 nt, Chlamydophila pneumoniae J138
aaggcauaacugu

SEQ ID NO: 2542301 - RNA, 19 nt, Chlamydophila pneumoniae J138
aaggcaugccuacaggcaa

SEQ ID NO: 2542302 - RNA, 16 nt, Chlamydophila pneumoniae J138
aaggcauggcacaguc

SEQ ID NO: 2542303 - RNA, 19 nt, Chlamydophila pneumoniae J138
aaggcccccuacagcagaa

SEQ ID NO: 2542304 - RNA, 21 nt, Chlamydophila pneumoniae J138
aaggcgaaaucuucaccacaa

SEQ ID NO: 2542305 - RNA, 18 nt, Chlamydophila pneumoniae J138
aaggcggcuuuuugcaag

SEQ ID NO: 2542306 - RNA, 21 nt, Chlamydophila pneumoniae J138
aaggcguuuuuuaauucucug

SEQ ID NO: 2542307 - RNA, 14 nt, Chlamydophila pneumoniae J138
aaggcuaaaaccua

SEQ ID NO: 2542308 - RNA, 23 nt, Chlamydophila pneumoniae J138
aaggcugccagagauucuucaca

SEQ ID NO: 2542309 - RNA, 18 nt, Chlamydophila pneumoniae J138
aaggcugcuugagacuug

SEQ ID NO: 2542310 - RNA, 14 nt, Chlamydophila pneumoniae J138
aaggcuugaggauu

SEQ ID NO: 2542311 - RNA, 23 nt, Chlamydophila pneumoniae J138
aaggcuuuucuuuuucuagggau

SEQ ID NO: 2542312 - RNA, 13 nt, Chlamydophila pneumoniae J138
aagggaggagaac

SEQ ID NO: 2542313 - RNA, 16 nt, Chlamydophila pneumoniae J138
aagggaggagaacuuc

SEQ ID NO: 2542314 - RNA, 14 nt, Chlamydophila pneumoniae J138
aagggaucuccuuc

SEQ ID NO: 2542315 - RNA, 17 nt, Chlamydophila pneumoniae J138
aagggaugcucuagaaa

SEQ ID NO: 2542316 - RNA, 23 nt, Chlamydophila pneumoniae J138
aagggaugggaucggucuuuucu

SEQ ID NO: 2542317 - RNA, 22 nt, Chlamydophila pneumoniae J138
aagggauguuuaauacaaaaaa

SEQ ID NO: 2542318 - RNA, 17 nt, Chlamydophila pneumoniae J138
aaggggcguucuugaaa

SEQ ID NO: 2542319 - RNA, 20 nt, Chlamydophila pneumoniae J138
aagguaaaacuacaggaaaa

SEQ ID NO: 2542320 - RNA, 21 nt, Chlamydophila pneumoniae J138
aagguaacauccauagagaac

SEQ ID NO: 2542321 - RNA, 15 nt, Chlamydophila pneumoniae J138
aagguagaguccaca

SEQ ID NO: 2542322 - RNA, 17 nt, Chlamydophila pneumoniae J138
aagguagaguccacagu

SEQ ID NO: 2542323 - RNA, 20 nt, Chlamydophila pneumoniae J138
aagguaguuuucuucuuuaa

SEQ ID NO: 2542324 - RNA, 16 nt, Chlamydophila pneumoniae J138
aagguauuucucucca

SEQ ID NO: 2542325 - RNA, 19 nt, Chlamydophila pneumoniae J138
aagguauuucucuccacag

SEQ ID NO: 2542326 - RNA, 17 nt, Chlamydophila pneumoniae J138
aaggucacagcauuuuc

SEQ ID NO: 2542327 - RNA, 20 nt, Chlamydophila pneumoniae J138
aagguccaugucuaaagauu

SEQ ID NO: 2542328 - RNA, 16 nt, Chlamydophila pneumoniae J138
aaggucugcgucuuua

SEQ ID NO: 2542329 - RNA, 19 nt, Chlamydophila pneumoniae J138
aagguucccuacuccauug

SEQ ID NO: 2542330 - RNA, 22 nt, Chlamydophila pneumoniae J138
aagguugagacguaaccacagg

SEQ ID NO: 2542331 - RNA, 14 nt, Chlamydophila pneumoniae J138
aagguuuuaaauuu

SEQ ID NO: 2542332 - RNA, 15 nt, Chlamydophila pneumoniae J138
aaguaaaacugcgcu

SEQ ID NO: 2542333 - RNA, 15 nt, Chlamydophila pneumoniae J138
aaguaaagaaauucu

SEQ ID NO: 2542334 - RNA, 21 nt, Chlamydophila pneumoniae J138
aaguaaaucagacuuaaagua

SEQ ID NO: 2542335 - RNA, 14 nt, Chlamydophila pneumoniae J138
aaguaacgauaaga

SEQ ID NO: 2542336 - RNA, 16 nt, Chlamydophila pneumoniae J138
aaguaacuaucuacac

SEQ ID NO: 2542337 - RNA, 22 nt, Chlamydophila pneumoniae J138
aaguacagaaaggaccuccuca

SEQ ID NO: 2542338 - RNA, 20 nt, Chlamydophila pneumoniae J138
aaguaccuucucgucauucu

SEQ ID NO: 2542339 - RNA, 18 nt, Chlamydophila pneumoniae J138
aaguacuaauuacagaau

SEQ ID NO: 2542340 - RNA, 15 nt, Chlamydophila pneumoniae J138
aaguacugggguagu

SEQ ID NO: 2542341 - RNA, 16 nt, Chlamydophila pneumoniae J138
aaguagaauccuucuc

SEQ ID NO: 2542342 - RNA, 18 nt, Chlamydophila pneumoniae J138
aaguaggauugauaaauu

SEQ ID NO: 2542343 - RNA, 22 nt, Chlamydophila pneumoniae J138
aaguaggauugauaaauuugcu

SEQ ID NO: 2542344 - RNA, 18 nt, Chlamydophila pneumoniae J138
aaguagggaacaaaaaag

SEQ ID NO: 2542345 - RNA, 21 nt, Chlamydophila pneumoniae J138
aaguaguggacuauagaugcc

SEQ ID NO: 2542346 - RNA, 23 nt, Chlamydophila pneumoniae J138
aaguauagacgggcuuauaaacu

SEQ ID NO: 2542347 - RNA, 16 nt, Chlamydophila pneumoniae J138
aaguaucucaucacgu

SEQ ID NO: 2542348 - RNA, 22 nt, Chlamydophila pneumoniae J138
aaguaucuugauguuugucaca

SEQ ID NO: 2542349 - RNA, 11 nt, Chlamydophila pneumoniae J138
aagucaaaaug

SEQ ID NO: 2542350 - RNA, 18 nt, Chlamydophila pneumoniae J138
aagucaaauacuucuccu

SEQ ID NO: 2542351 - RNA, 16 nt, Chlamydophila pneumoniae J138
aagucacaaauuuuug

SEQ ID NO: 2542352 - RNA, 17 nt, Chlamydophila pneumoniae J138
aagucaccuuacaucca

SEQ ID NO: 2542353 - RNA, 17 nt, Chlamydophila pneumoniae J138
aagucacggcgaaagcu

SEQ ID NO: 2542354 - RNA, 19 nt, Chlamydophila pneumoniae J138
aagucagccaagacaaaaa

SEQ ID NO: 2542355 - RNA, 13 nt, Chlamydophila pneumoniae J138
aagucaugaggac

SEQ ID NO: 2542356 - RNA, 16 nt, Chlamydophila pneumoniae J138
aaguccaacaucagcu

SEQ ID NO: 2542357 - RNA, 18 nt, Chlamydophila pneumoniae J138
aaguccaagaucaaacga

SEQ ID NO: 2542358 - RNA, 23 nt, Chlamydophila pneumoniae J138
aaguccagacuuuccucucuuua

SEQ ID NO: 2542359 - RNA, 19 nt, Chlamydophila pneumoniae J138
aagucgauacccaaagagg

SEQ ID NO: 2542360 - RNA, 19 nt, Chlamydophila pneumoniae J138
aagucuucccucuccuuga

SEQ ID NO: 2542361 - RNA, 15 nt, Chlamydophila pneumoniae J138
aagugacuuccucca

SEQ ID NO: 2542362 - RNA, 16 nt, Chlamydophila pneumoniae J138
aagugacuuccuccaa

SEQ ID NO: 2542363 - RNA, 20 nt, Chlamydophila pneumoniae J138
aagugacuuccuccaaaauu

SEQ ID NO: 2542364 - RNA, 18 nt, Chlamydophila pneumoniae J138
aagugauaaggaagaauu

SEQ ID NO: 2542365 - RNA, 17 nt, Chlamydophila pneumoniae J138
aagugaucuugagaaaa

SEQ ID NO: 2542366 - RNA, 22 nt, Chlamydophila pneumoniae J138
aagugcgagguaugaauaggaa

SEQ ID NO: 2542367 - RNA, 14 nt, Chlamydophila pneumoniae J138
aagugcguuccuau

SEQ ID NO: 2542368 - RNA, 16 nt, Chlamydophila pneumoniae J138
aagugcucaguaaaua

SEQ ID NO: 2542369 - RNA, 19 nt, Chlamydophila pneumoniae J138
aagugcucaguaaauauuu

SEQ ID NO: 2542370 - RNA, 20 nt, Chlamydophila pneumoniae J138
aagugcuuucaggaguucuu

SEQ ID NO: 2542371 - RNA, 18 nt, Chlamydophila pneumoniae J138
aaguguguaaauguuuug

SEQ ID NO: 2542372 - RNA, 14 nt, Chlamydophila pneumoniae J138
aaguuagccuggcu

SEQ ID NO: 2542373 - RNA, 16 nt, Chlamydophila pneumoniae J138
aaguuagguagauaga

SEQ ID NO: 2542374 - RNA, 22 nt, Chlamydophila pneumoniae J138
aaguuauacggccgacucuaca

SEQ ID NO: 2542375 - RNA, 13 nt, Chlamydophila pneumoniae J138
aaguucacaagca

SEQ ID NO: 2542376 - RNA, 20 nt, Chlamydophila pneumoniae J138
aaguucagacgugcucucua

SEQ ID NO: 2542377 - RNA, 13 nt, Chlamydophila pneumoniae J138
aaguucaguaaaa

SEQ ID NO: 2542378 - RNA, 22 nt, Chlamydophila pneumoniae J138
aagagcuuguucuguaacacuu

SEQ ID NO: 2542379 - RNA, 20 nt, Chlamydophila pneumoniae J138
aagaggcucccaucgucccu

SEQ ID NO: 2542380 - RNA, 12 nt, Chlamydophila pneumoniae J138
aagaggggagcu

SEQ ID NO: 2542381 - RNA, 18 nt, Chlamydophila pneumoniae J138
aagagguaauaauaguga

SEQ ID NO: 2542382 - RNA, 18 nt, Chlamydophila pneumoniae J138
aagaguagccccagcaac

SEQ ID NO: 2542383 - RNA, 20 nt, Chlamydophila pneumoniae J138
aagagucucacucuuuucua

SEQ ID NO: 2542384 - RNA, 14 nt, Chlamydophila pneumoniae J138
aagagucucuugcu

SEQ ID NO: 2542385 - RNA, 22 nt, Chlamydophila pneumoniae J138
aagagucuuugaugcuaaacga

SEQ ID NO: 2542386 - RNA, 20 nt, Chlamydophila pneumoniae J138
aagagugguuccugaaaagc

SEQ ID NO: 2542387 - RNA, 15 nt, Chlamydophila pneumoniae J138
aagagugucuaagau

SEQ ID NO: 2542388 - RNA, 20 nt, Chlamydophila pneumoniae J138
aagaguuccaagacaauaaa

SEQ ID NO: 2542389 - RNA, 15 nt, Chlamydophila pneumoniae J138
aagauaaacagcaca

SEQ ID NO: 2542390 - RNA, 13 nt, Chlamydophila pneumoniae J138
aagauaaacauac

SEQ ID NO: 2542391 - RNA, 13 nt, Chlamydophila pneumoniae J138
aagauaaacauua

SEQ ID NO: 2542392 - RNA, 19 nt, Chlamydophila pneumoniae J138
aagauaaacauuaagugau

SEQ ID NO: 2542393 - RNA, 15 nt, Chlamydophila pneumoniae J138
aagauaaagaauucu

SEQ ID NO: 2542394 - RNA, 12 nt, Chlamydophila pneumoniae J138
aagauaaauccc

SEQ ID NO: 2542395 - RNA, 14 nt, Chlamydophila pneumoniae J138
aagauaagaccaga

SEQ ID NO: 2542396 - RNA, 20 nt, Chlamydophila pneumoniae J138
aagauaaggaccagguguag

SEQ ID NO: 2542397 - RNA, 19 nt, Chlamydophila pneumoniae J138
aagauaauagagaagaagc

SEQ ID NO: 2542398 - RNA, 20 nt, Chlamydophila pneumoniae J138
aagauaaucauuaagacuca

SEQ ID NO: 2542399 - RNA, 17 nt, Chlamydophila pneumoniae J138
aagauaaugucuccauc

SEQ ID NO: 2542400 - RNA, 16 nt, Chlamydophila pneumoniae J138
aagauacgaaguccca

SEQ ID NO: 2542401 - RNA, 19 nt, Chlamydophila pneumoniae J138
aagauagacucucacugag

SEQ ID NO: 2542402 - RNA, 18 nt, Chlamydophila pneumoniae J138
aagauagcgacgucauca

SEQ ID NO: 2542403 - RNA, 17 nt, Chlamydophila pneumoniae J138
aagauaguuauuaauaa

SEQ ID NO: 2542404 - RNA, 18 nt, Chlamydophila pneumoniae J138
aagauauagauucaugaa

SEQ ID NO: 2542405 - RNA, 15 nt, Chlamydophila pneumoniae J138
aagauauauuuuuaa

SEQ ID NO: 2542406 - RNA, 17 nt, Chlamydophila pneumoniae J138
aagauaucccaaagcua

SEQ ID NO: 2542407 - RNA, 13 nt, Chlamydophila pneumoniae J138
aagauauccuuuu

SEQ ID NO: 2542408 - RNA, 12 nt, Chlamydophila pneumoniae J138
aagauaucugcu

SEQ ID NO: 2542409 - RNA, 15 nt, Chlamydophila pneumoniae J138
aagauauguccguga

SEQ ID NO: 2542410 - RNA, 19 nt, Chlamydophila pneumoniae J138
aagaucaauauagagaacu

SEQ ID NO: 2542411 - RNA, 23 nt, Chlamydophila pneumoniae J138
aagaucaauauagagaacuccau

SEQ ID NO: 2542412 - RNA, 15 nt, Chlamydophila pneumoniae J138
aagaucaguuuuuuc

SEQ ID NO: 2542413 - RNA, 14 nt, Chlamydophila pneumoniae J138
aagaucauaugcac

SEQ ID NO: 2542414 - RNA, 23 nt, Chlamydophila pneumoniae J138
aagaucgcucgaucgugcucugc

SEQ ID NO: 2542415 - RNA, 22 nt, Chlamydophila pneumoniae J138
aagaucggaguuaucaaaagga

SEQ ID NO: 2542416 - RNA, 23 nt, Chlamydophila pneumoniae J138
aagaucgucggaagacuuuuuaa

SEQ ID NO: 2542417 - RNA, 17 nt, Chlamydophila pneumoniae J138
aagaucuaacuucacca

SEQ ID NO: 2542418 - RNA, 18 nt, Chlamydophila pneumoniae J138
aagaucuccgaagacuac

SEQ ID NO: 2542419 - RNA, 12 nt, Chlamydophila pneumoniae J138
aagaucucuuuu

SEQ ID NO: 2542420 - RNA, 17 nt, Chlamydophila pneumoniae J138
aagaucuucauaaccaa

SEQ ID NO: 2542421 - RNA, 22 nt, Chlamydophila pneumoniae J138
aagaugaauaccagaagcaaag

SEQ ID NO: 2542422 - RNA, 20 nt, Chlamydophila pneumoniae J138
aagaugacgagcccuagaua

SEQ ID NO: 2542423 - RNA, 13 nt, Chlamydophila pneumoniae J138
aagaugagaaaau

SEQ ID NO: 2542424 - RNA, 22 nt, Chlamydophila pneumoniae J138
aagaugcugaaccuuugguaga

SEQ ID NO: 2542425 - RNA, 16 nt, Chlamydophila pneumoniae J138
aagauggcaaggaaaa

SEQ ID NO: 2542426 - RNA, 18 nt, Chlamydophila pneumoniae J138
aagauggcaaggaaaauu

SEQ ID NO: 2542427 - RNA, 21 nt, Chlamydophila pneumoniae J138
aagauguauaaggauaucuuc

SEQ ID NO: 2542428 - RNA, 14 nt, Chlamydophila pneumoniae J138
aagauuauucuaga

SEQ ID NO: 2542429 - RNA, 19 nt, Chlamydophila pneumoniae J138
aagauuauuuguuucuucc

SEQ ID NO: 2542430 - RNA, 11 nt, Chlamydophila pneumoniae J138
aagauuccuaa

SEQ ID NO: 2542431 - RNA, 22 nt, Chlamydophila pneumoniae J138
aagauuccuaacuucugaagga

SEQ ID NO: 2542432 - RNA, 19 nt, Chlamydophila pneumoniae J138
aagauuccuuaccuauaua

SEQ ID NO: 2542433 - RNA, 16 nt, Chlamydophila pneumoniae J138
aagauucuuuaaucua

SEQ ID NO: 2542434 - RNA, 21 nt, Chlamydophila pneumoniae J138
aagauugcagguagauccuau

SEQ ID NO: 2542435 - RNA, 24 nt, Chlamydophila pneumoniae J138
aagauugcagguagauccuauagu

SEQ ID NO: 2542436 - RNA, 23 nt, Chlamydophila pneumoniae J138
aagauuuccaauccauucugaga

SEQ ID NO: 2542437 - RNA, 15 nt, Chlamydophila pneumoniae J138
aagauuuccccaaga

SEQ ID NO: 2542438 - RNA, 22 nt, Chlamydophila pneumoniae J138
aguucauguugcucauccuuua

SEQ ID NO: 2542439 - RNA, 19 nt, Chlamydophila pneumoniae J138
aguucauuagcuaaaucaa

SEQ ID NO: 2542440 - RNA, 18 nt, Chlamydophila pneumoniae J138
aguuccaagacaauaaaa

SEQ ID NO: 2542441 - RNA, 20 nt, Chlamydophila pneumoniae J138
aguuccaagacaauaaaaaa

SEQ ID NO: 2542442 - RNA, 23 nt, Chlamydophila pneumoniae J138
aguuccaagacaauaaaaaagag

SEQ ID NO: 2542443 - RNA, 16 nt, Chlamydophila pneumoniae J138
aguucccacuggacuu

SEQ ID NO: 2542444 - RNA, 20 nt, Chlamydophila pneumoniae J138
aguuccgcggccaucauuaa

SEQ ID NO: 2542445 - RNA, 20 nt, Chlamydophila pneumoniae J138
aguuccuuauuguagagagu

SEQ ID NO: 2542446 - RNA, 16 nt, Chlamydophila pneumoniae J138
aguucgcacuaauuuc

SEQ ID NO: 2542447 - RNA, 17 nt, Chlamydophila pneumoniae J138
aguucgcggaucuucuu

SEQ ID NO: 2542448 - RNA, 17 nt, Chlamydophila pneumoniae J138
aguucgggcuaaucauu

SEQ ID NO: 2542449 - RNA, 20 nt, Chlamydophila pneumoniae J138
aguucgggcuaaucauuaga

SEQ ID NO: 2542450 - RNA, 17 nt, Chlamydophila pneumoniae J138
aguucguuggcccagag

SEQ ID NO: 2542451 - RNA, 21 nt, Chlamydophila pneumoniae J138
aguucuaggaugcuugugaga

SEQ ID NO: 2542452 - RNA, 14 nt, Chlamydophila pneumoniae J138
aguucucaaagaca

SEQ ID NO: 2542453 - RNA, 13 nt, Chlamydophila pneumoniae J138
aguucuucauucc

SEQ ID NO: 2542454 - RNA, 10 nt, Chlamydophila pneumoniae J138
aguucuuccu

SEQ ID NO: 2542455 - RNA, 14 nt, Chlamydophila pneumoniae J138
aguucuuccuucuu

SEQ ID NO: 2542456 - RNA, 14 nt, Chlamydophila pneumoniae J138
aguucuucuuuacu

SEQ ID NO: 2542457 - RNA, 13 nt, Chlamydophila pneumoniae J138
aguucuugaaacu

SEQ ID NO: 2542458 - RNA, 17 nt, Chlamydophila pneumoniae J138
aguucuugaaacucuau

SEQ ID NO: 2542459 - RNA, 19 nt, Chlamydophila pneumoniae J138
aguucuuguaauaaaagaa

SEQ ID NO: 2542460 - RNA, 21 nt, Chlamydophila pneumoniae J138
aguucuuguaauaaaagaaca

SEQ ID NO: 2542461 - RNA, 15 nt, Chlamydophila pneumoniae J138
aguucuuguuaaagu

SEQ ID NO: 2542462 - RNA, 23 nt, Chlamydophila pneumoniae J138
aguucuuguuaaaguaaaaaaua

SEQ ID NO: 2542463 - RNA, 18 nt, Chlamydophila pneumoniae J138
aguucuuuagcuacagaa

SEQ ID NO: 2542464 - RNA, 22 nt, Chlamydophila pneumoniae J138
aguucuuuuugcagaucuuuua

SEQ ID NO: 2542465 - RNA, 12 nt, Chlamydophila pneumoniae J138
aguugaaaugag

SEQ ID NO: 2542466 - RNA, 21 nt, Chlamydophila pneumoniae J138
aguugaaaugagugagaaugc

SEQ ID NO: 2542467 - RNA, 20 nt, Chlamydophila pneumoniae J138
aguugaacugacaccaggag

SEQ ID NO: 2542468 - RNA, 21 nt, Chlamydophila pneumoniae J138
aguugaaguuuugcucucuag

SEQ ID NO: 2542469 - RNA, 13 nt, Chlamydophila pneumoniae J138
aguugaggaaagg

SEQ ID NO: 2542470 - RNA, 15 nt, Chlamydophila pneumoniae J138
aguugaggaaaggag

SEQ ID NO: 2542471 - RNA, 16 nt, Chlamydophila pneumoniae J138
aguugaugagaaaaag

SEQ ID NO: 2542472 - RNA, 14 nt, Chlamydophila pneumoniae J138
aguugauuguagag

SEQ ID NO: 2542473 - RNA, 17 nt, Chlamydophila pneumoniae J138
aguugauuguagagaca

SEQ ID NO: 2542474 - RNA, 19 nt, Chlamydophila pneumoniae J138
aguugauuguagagacaua

SEQ ID NO: 2542475 - RNA, 19 nt, Chlamydophila pneumoniae J138
aguugauuuagaaucuuuu

SEQ ID NO: 2542476 - RNA, 22 nt, Chlamydophila pneumoniae J138
aguugauuuagaaucuuuucua

SEQ ID NO: 2542477 - RNA, 17 nt, Chlamydophila pneumoniae J138
aguuggaacauaucgau

SEQ ID NO: 2542478 - RNA, 21 nt, Chlamydophila pneumoniae J138
aguuggaucaaggaguacucu

SEQ ID NO: 2542479 - RNA, 17 nt, Chlamydophila pneumoniae J138
aguuggcguuuucuaga

SEQ ID NO: 2542480 - RNA, 13 nt, Chlamydophila pneumoniae J138
aguugggcauuua

SEQ ID NO: 2542481 - RNA, 23 nt, Chlamydophila pneumoniae J138
aguugguugcagucguauucagg

SEQ ID NO: 2542482 - RNA, 18 nt, Chlamydophila pneumoniae J138
aguuguagugaaugagcu

SEQ ID NO: 2542483 - RNA, 18 nt, Chlamydophila pneumoniae J138
aguuguauccagcucaag

SEQ ID NO: 2542484 - RNA, 19 nt, Chlamydophila pneumoniae J138
aguuguuguggaaucacgu

SEQ ID NO: 2542485 - RNA, 19 nt, Chlamydophila pneumoniae J138
aguuguuuuuugagauaca

SEQ ID NO: 2542486 - RNA, 18 nt, Chlamydophila pneumoniae J138
aguuuaaacgucuuauga

SEQ ID NO: 2542487 - RNA, 17 nt, Chlamydophila pneumoniae J138
aguuuaauguuuggcca

SEQ ID NO: 2542488 - RNA, 20 nt, Chlamydophila pneumoniae J138
aguuuacaaauaaaaugauu

SEQ ID NO: 2542489 - RNA, 21 nt, Chlamydophila pneumoniae J138
aguuuaccugaaaaaacagua

SEQ ID NO: 2542490 - RNA, 17 nt, Chlamydophila pneumoniae J138
aguuucaaucucuccuu

SEQ ID NO: 2542491 - RNA, 23 nt, Chlamydophila pneumoniae J138
aguuucaaucucuccuugacaaa

SEQ ID NO: 2542492 - RNA, 18 nt, Chlamydophila pneumoniae J138
aguuucacauaguuuaau

SEQ ID NO: 2542493 - RNA, 16 nt, Chlamydophila pneumoniae J138
aguuugccuucuuauc

SEQ ID NO: 2542494 - RNA, 17 nt, Chlamydophila pneumoniae J138
aguuuguagcagcaaga

SEQ ID NO: 2542495 - RNA, 21 nt, Chlamydophila pneumoniae J138
aguuuguagcagcaagaacau

SEQ ID NO: 2542496 - RNA, 16 nt, Chlamydophila pneumoniae J138
aguuuguucacuuggu

SEQ ID NO: 2542497 - RNA, 20 nt, Chlamydophila pneumoniae J138
aguuuguuuuaauuguagag

SEQ ID NO: 2542498 - RNA, 16 nt, Chlamydophila pneumoniae J138
aguuuucaagucugua

SEQ ID NO: 2542499 - RNA, 13 nt, Chlamydophila pneumoniae J138
aguuuucauaauc

SEQ ID NO: 2542500 - RNA, 19 nt, Chlamydophila pneumoniae J138
aguuuucgauacacaagau

SEQ ID NO: 2542501 - RNA, 16 nt, Chlamydophila pneumoniae J138
aguuuugaggauuucu

SEQ ID NO: 2542502 - RNA, 18 nt, Chlamydophila pneumoniae J138
aguuuuuaauuuucuguu

SEQ ID NO: 2542503 - RNA, 16 nt, Chlamydophila pneumoniae J138
aguuuuuauuuuuaaa

SEQ ID NO: 2542504 - RNA, 19 nt, Chlamydophila pneumoniae J138
aguuuuuguucauccagaa

SEQ ID NO: 2542505 - RNA, 22 nt, Chlamydophila pneumoniae J138
aguuuuuuaaauaccuagagcu

SEQ ID NO: 2542506 - RNA, 22 nt, Chlamydophila pneumoniae J138
aguuuuuuaagugcuuuuagau

SEQ ID NO: 2542507 - RNA, 17 nt, Chlamydophila pneumoniae J138
aguuuuuuucuaaauuu

SEQ ID NO: 2542508 - RNA, 12 nt, Chlamydophila pneumoniae J138
aguuuuuuucuu

SEQ ID NO: 2542509 - RNA, 14 nt, Chlamydophila pneumoniae J138
auaaaaaaacccuc

SEQ ID NO: 2542510 - RNA, 13 nt, Chlamydophila pneumoniae J138
auaaaaaagagag

SEQ ID NO: 2542511 - RNA, 22 nt, Chlamydophila pneumoniae J138
auaaaacgcuauuguuuguccu

SEQ ID NO: 2542512 - RNA, 13 nt, Chlamydophila pneumoniae J138
auaaaagaaagaa

SEQ ID NO: 2542513 - RNA, 14 nt, Chlamydophila pneumoniae J138
auaaaagaaagaau

SEQ ID NO: 2542514 - RNA, 17 nt, Chlamydophila pneumoniae J138
auaaaagagcucaaaaa

SEQ ID NO: 2542515 - RNA, 17 nt, Chlamydophila pneumoniae J138
auaaaaggguagcgaau

SEQ ID NO: 2542516 - RNA, 20 nt, Chlamydophila pneumoniae J138
auaaaaggguagcgaaugaa

SEQ ID NO: 2542517 - RNA, 12 nt, Chlamydophila pneumoniae J138
auaaaauagccc

SEQ ID NO: 2542518 - RNA, 12 nt, Chlamydophila pneumoniae J138
auaaaauaggaa

SEQ ID NO: 2542519 - RNA, 15 nt, Chlamydophila pneumoniae J138
auaaaaucauguccu

SEQ ID NO: 2542520 - RNA, 23 nt, Chlamydophila pneumoniae J138
auaaaaucguuuuauuuuaggag

SEQ ID NO: 2542521 - RNA, 16 nt, Chlamydophila pneumoniae J138
auaaaaugagcucacg

SEQ ID NO: 2542522 - RNA, 13 nt, Chlamydophila pneumoniae J138
auaaaauuggcuu

SEQ ID NO: 2542523 - RNA, 17 nt, Chlamydophila pneumoniae J138
auaaaauuuaaaaaaau

SEQ ID NO: 2542524 - RNA, 14 nt, Chlamydophila pneumoniae J138
auaaaccuuugguu

SEQ ID NO: 2542525 - RNA, 15 nt, Chlamydophila pneumoniae J138
auaaaccuuugguuu

SEQ ID NO: 2542526 - RNA, 19 nt, Chlamydophila pneumoniae J138
auaaacuccacgaauucuu

SEQ ID NO: 2542527 - RNA, 20 nt, Chlamydophila pneumoniae J138
auaaacucuuguugucuaug

SEQ ID NO: 2542528 - RNA, 22 nt, Chlamydophila pneumoniae J138
auaaacuucaaugaagaaaaau

SEQ ID NO: 2542529 - RNA, 12 nt, Chlamydophila pneumoniae J138
auaaagaagaaa

SEQ ID NO: 2542530 - RNA, 16 nt, Chlamydophila pneumoniae J138
auaaagacaucucuuu

SEQ ID NO: 2542531 - RNA, 12 nt, Chlamydophila pneumoniae J138
auaaagaggcuc

SEQ ID NO: 2542532 - RNA, 21 nt, Chlamydophila pneumoniae J138
auaaagaucgggucuacaaca

SEQ ID NO: 2542533 - RNA, 22 nt, Chlamydophila pneumoniae J138
auaaagcaaagauaaagaaguu

SEQ ID NO: 2542534 - RNA, 15 nt, Chlamydophila pneumoniae J138
auaaagcaaaugccu

SEQ ID NO: 2542535 - RNA, 14 nt, Chlamydophila pneumoniae J138
auaaaggacauaga

SEQ ID NO: 2542536 - RNA, 20 nt, Chlamydophila pneumoniae J138
auaaaggaccuguuuucuuu

SEQ ID NO: 2542537 - RNA, 24 nt, Chlamydophila pneumoniae J138
auaaaggcauaacugugcuccaua

SEQ ID NO: 2542538 - RNA, 16 nt, Chlamydophila pneumoniae J138
auaaauacaggagaau

SEQ ID NO: 2542539 - RNA, 19 nt, Chlamydophila pneumoniae J138
auaaauacaggccugaugu

SEQ ID NO: 2542540 - RNA, 21 nt, Chlamydophila pneumoniae J138
auaaauccccaccaacaaugc

SEQ ID NO: 2542541 - RNA, 19 nt, Chlamydophila pneumoniae J138
auaaaucuauauccacaau

SEQ ID NO: 2542542 - RNA, 21 nt, Chlamydophila pneumoniae J138
auaaaugcuauuuuccucuau

SEQ ID NO: 2542543 - RNA, 17 nt, Chlamydophila pneumoniae J138
auaaauggaggauacuc

SEQ ID NO: 2542544 - RNA, 12 nt, Chlamydophila pneumoniae J138
auaaauuugcuu

SEQ ID NO: 2542545 - RNA, 14 nt, Chlamydophila pneumoniae J138
auaacaccaaaaga

SEQ ID NO: 2542546 - RNA, 15 nt, Chlamydophila pneumoniae J138
auaacaccaaaagaa

SEQ ID NO: 2542547 - RNA, 20 nt, Chlamydophila pneumoniae J138
auaacaccaaaagaauacuc

SEQ ID NO: 2542548 - RNA, 22 nt, Chlamydophila pneumoniae J138
auaacacuucuuucuugcucug

SEQ ID NO: 2542549 - RNA, 23 nt, Chlamydophila pneumoniae J138
auaacagagauggucuuggguuu

SEQ ID NO: 2542550 - RNA, 14 nt, Chlamydophila pneumoniae J138
auaacaucaagaau

SEQ ID NO: 2542551 - RNA, 16 nt, Chlamydophila pneumoniae J138
auaacaucaagaauuu

SEQ ID NO: 2542552 - RNA, 21 nt, Chlamydophila pneumoniae J138
auaacaucuaaaaaugcacuu

SEQ ID NO: 2542553 - RNA, 16 nt, Chlamydophila pneumoniae J138
auaacaugcgcagaau

SEQ ID NO: 2542554 - RNA, 21 nt, Chlamydophila pneumoniae J138
auaacaugcgcagaauaaaau

SEQ ID NO: 2542555 - RNA, 16 nt, Chlamydophila pneumoniae J138
auaacauuuagauaaa

SEQ ID NO: 2542556 - RNA, 20 nt, Chlamydophila pneumoniae J138
auaacauuuagauaaagaaa

SEQ ID NO: 2542557 - RNA, 18 nt, Chlamydophila pneumoniae J138
auaaccaaguaaaucaga

SEQ ID NO: 2542558 - RNA, 20 nt, Chlamydophila pneumoniae J138
auaaccaaguaaaucagacu

SEQ ID NO: 2542559 - RNA, 15 nt, Chlamydophila pneumoniae J138
auaaccagaagacuc

SEQ ID NO: 2542560 - RNA, 19 nt, Chlamydophila pneumoniae J138
auaaccaggggcuuuccuu

SEQ ID NO: 2542561 - RNA, 20 nt, Chlamydophila pneumoniae J138
auaaccaggggcuuuccuuc

SEQ ID NO: 2542562 - RNA, 15 nt, Chlamydophila pneumoniae J138
auaaccuaaggcaug

SEQ ID NO: 2542563 - RNA, 20 nt, Chlamydophila pneumoniae J138
auaaccuaaggcauggcaca

SEQ ID NO: 2542564 - RNA, 12 nt, Chlamydophila pneumoniae J138
auaaccugagag

SEQ ID NO: 2542565 - RNA, 13 nt, Chlamydophila pneumoniae J138
auaaccugggcaa

SEQ ID NO: 2542566 - RNA, 21 nt, Chlamydophila pneumoniae J138
auaaccuuugacaacaccaca

SEQ ID NO: 2542567 - RNA, 23 nt, Chlamydophila pneumoniae J138
auaacgggguugucucuacaggg

SEQ ID NO: 2542568 - RNA, 21 nt, Chlamydophila pneumoniae J138
auaacuccacuaccaaggcag

SEQ ID NO: 2542569 - RNA, 23 nt, Chlamydophila pneumoniae J138
auaacuccaggggauaaaacuau

SEQ ID NO: 2542570 - RNA, 21 nt, Chlamydophila pneumoniae J138
auaacugcauacaaggcacau

SEQ ID NO: 2542571 - RNA, 19 nt, Chlamydophila pneumoniae J138
auaacuuugcaugaggaga

SEQ ID NO: 2542572 - RNA, 18 nt, Chlamydophila pneumoniae J138
auaagaaaucaguccuaa

SEQ ID NO: 2542573 - RNA, 15 nt, Chlamydophila pneumoniae J138
auaagaccagaaagg

SEQ ID NO: 2542574 - RNA, 13 nt, Chlamydophila pneumoniae J138
auaagagacauuu

SEQ ID NO: 2542575 - RNA, 15 nt, Chlamydophila pneumoniae J138
auaagauaauagaga

SEQ ID NO: 2542576 - RNA, 17 nt, Chlamydophila pneumoniae J138
auaagauaauagagaag

SEQ ID NO: 2542577 - RNA, 15 nt, Chlamydophila pneumoniae J138
auaagauagcucuug

SEQ ID NO: 2542578 - RNA, 13 nt, Chlamydophila pneumoniae J138
auaagaucaauau

SEQ ID NO: 2542579 - RNA, 14 nt, Chlamydophila pneumoniae J138
auaagauuuugaaa

SEQ ID NO: 2542580 - RNA, 16 nt, Chlamydophila pneumoniae J138
auaagcaagcaacuga

SEQ ID NO: 2542581 - RNA, 20 nt, Chlamydophila pneumoniae J138
auaagcaggaaaagcaaaau

SEQ ID NO: 2542582 - RNA, 17 nt, Chlamydophila pneumoniae J138
auaagcuugccagcaga

SEQ ID NO: 2542583 - RNA, 18 nt, Chlamydophila pneumoniae J138
auaagcuugccagcagaa

SEQ ID NO: 2542584 - RNA, 21 nt, Chlamydophila pneumoniae J138
auaagcuugccagcagaaguu

SEQ ID NO: 2542585 - RNA, 18 nt, Chlamydophila pneumoniae J138
auaaggagauuccuaaac

SEQ ID NO: 2542586 - RNA, 21 nt, Chlamydophila pneumoniae J138
auaaggauguuguggaucaga

SEQ ID NO: 2542587 - RNA, 18 nt, Chlamydophila pneumoniae J138
auaagggggaucuucaga

SEQ ID NO: 2542588 - RNA, 23 nt, Chlamydophila pneumoniae J138
auaagggggaucuucagagagaa

SEQ ID NO: 2542589 - RNA, 16 nt, Chlamydophila pneumoniae J138
auaagucaaaaugugc

SEQ ID NO: 2542590 - RNA, 20 nt, Chlamydophila pneumoniae J138
auaagucgaaucuaaaaacu

SEQ ID NO: 2542591 - RNA, 19 nt, Chlamydophila pneumoniae J138
auaagugacuuuucuucuu

SEQ ID NO: 2542592 - RNA, 11 nt, Chlamydophila pneumoniae J138
auaaguucuuc

SEQ ID NO: 2542593 - RNA, 15 nt, Chlamydophila pneumoniae J138
auaauaaaagcaccc

SEQ ID NO: 2542594 - RNA, 21 nt, Chlamydophila pneumoniae J138
auaauacguaccguauccucu

SEQ ID NO: 2542595 - RNA, 15 nt, Chlamydophila pneumoniae J138
auaauagagaagaag

SEQ ID NO: 2542596 - RNA, 15 nt, Chlamydophila pneumoniae J138
auaauaggauaagaa

SEQ ID NO: 2542597 - RNA, 16 nt, Chlamydophila pneumoniae J138
auaauaggauaagaaa

SEQ ID NO: 2542598 - RNA, 17 nt, Chlamydophila pneumoniae J138
auaauaggauaagaaau

SEQ ID NO: 2542599 - RNA, 18 nt, Chlamydophila pneumoniae J138
auaauaggauaagaaauu

SEQ ID NO: 2542600 - RNA, 19 nt, Chlamydophila pneumoniae J138
auaauaggauaagaaauua

SEQ ID NO: 2542601 - RNA, 14 nt, Chlamydophila pneumoniae J138
auaauagugagcuc

SEQ ID NO: 2542602 - RNA, 22 nt, Chlamydophila pneumoniae J138
auaauagugagcucccugaugu

SEQ ID NO: 2542603 - RNA, 18 nt, Chlamydophila pneumoniae J138
auaauaucgguuccuaua

SEQ ID NO: 2542604 - RNA, 13 nt, Chlamydophila pneumoniae J138
auaaucaaccaaa

SEQ ID NO: 2542605 - RNA, 18 nt, Chlamydophila pneumoniae J138
auaaucacuuaauaaugu

SEQ ID NO: 2542606 - RNA, 20 nt, Chlamydophila pneumoniae J138
auaaucagaggagccuccau

SEQ ID NO: 2542607 - RNA, 14 nt, Chlamydophila pneumoniae J138
auaauccaagauac

SEQ ID NO: 2542608 - RNA, 15 nt, Chlamydophila pneumoniae J138
auaaucucaccagaa

SEQ ID NO: 2542609 - RNA, 19 nt, Chlamydophila pneumoniae J138
auaaucuccaaacauuuuu

SEQ ID NO: 2542610 - RNA, 17 nt, Chlamydophila pneumoniae J138
auaaucuguaagaaaau

SEQ ID NO: 2542611 - RNA, 20 nt, Chlamydophila pneumoniae J138
auaaucuguaagaaaaugag

SEQ ID NO: 2542612 - RNA, 14 nt, Chlamydophila pneumoniae J138
auaaucuucaaaag

SEQ ID NO: 2542613 - RNA, 13 nt, Chlamydophila pneumoniae J138
auaaugaagcagg

SEQ ID NO: 2542614 - RNA, 19 nt, Chlamydophila pneumoniae J138
auaaugauuccuagaaucu

SEQ ID NO: 2542615 - RNA, 17 nt, Chlamydophila pneumoniae J138
auaauguuuuaauagcu

SEQ ID NO: 2542616 - RNA, 12 nt, Chlamydophila pneumoniae J138
auaauuaaacuc

SEQ ID NO: 2542617 - RNA, 13 nt, Chlamydophila pneumoniae J138
auaauuaaauaua

SEQ ID NO: 2542618 - RNA, 15 nt, Chlamydophila pneumoniae J138
auaauuagaacagca

SEQ ID NO: 2542619 - RNA, 18 nt, Chlamydophila pneumoniae J138
auaauuauguagaucuac

SEQ ID NO: 2542620 - RNA, 18 nt, Chlamydophila pneumoniae J138
auaauucugcacauccgu

SEQ ID NO: 2542621 - RNA, 16 nt, Chlamydophila pneumoniae J138
auaauuuguuuagaaa

SEQ ID NO: 2542622 - RNA, 23 nt, Chlamydophila pneumoniae J138
auaauuuguuuagaaaaagaucu

SEQ ID NO: 2542623 - RNA, 13 nt, Chlamydophila pneumoniae J138
auacaaaaaauaa

SEQ ID NO: 2542624 - RNA, 14 nt, Chlamydophila pneumoniae J138
auacaaaaaauaaa

SEQ ID NO: 2542625 - RNA, 17 nt, Chlamydophila pneumoniae J138
auacaaaacaaaagcca

SEQ ID NO: 2542626 - RNA, 18 nt, Chlamydophila pneumoniae J138
auacaaaacaaaagccau

SEQ ID NO: 2542627 - RNA, 22 nt, Chlamydophila pneumoniae J138
auacaaacaagaagcguacuuu

SEQ ID NO: 2542628 - RNA, 15 nt, Chlamydophila pneumoniae J138
auacaaacaucgaaa

SEQ ID NO: 2542629 - RNA, 19 nt, Chlamydophila pneumoniae J138
auacaacgguauguauggu

SEQ ID NO: 2542630 - RNA, 17 nt, Chlamydophila pneumoniae J138
auacaagcgaaagcagc

SEQ ID NO: 2542631 - RNA, 17 nt, Chlamydophila pneumoniae J138
auacaaguaauuccccu

SEQ ID NO: 2542632 - RNA, 17 nt, Chlamydophila pneumoniae J138
auacaauccagaaucuc

SEQ ID NO: 2542633 - RNA, 14 nt, Chlamydophila pneumoniae J138
auacacaaaucauu

SEQ ID NO: 2542634 - RNA, 16 nt, Chlamydophila pneumoniae J138
auacacucagcguucg

SEQ ID NO: 2542635 - RNA, 20 nt, Chlamydophila pneumoniae J138
auacagauguuuucguaaau

SEQ ID NO: 2542636 - RNA, 15 nt, Chlamydophila pneumoniae J138
auacagcauaaaaau

SEQ ID NO: 2542637 - RNA, 16 nt, Chlamydophila pneumoniae J138
auacagcauaaaaauu

SEQ ID NO: 2542638 - RNA, 14 nt, Chlamydophila pneumoniae J138
auacagccagcaga

SEQ ID NO: 2542639 - RNA, 16 nt, Chlamydophila pneumoniae J138
auacagccagcagaag

SEQ ID NO: 2542640 - RNA, 19 nt, Chlamydophila pneumoniae J138
aucagauccaugaacagca

SEQ ID NO: 2542641 - RNA, 18 nt, Chlamydophila pneumoniae J138
aucagauguaaagagcaa

SEQ ID NO: 2542642 - RNA, 20 nt, Chlamydophila pneumoniae J138
aucagauguaaagagcaaca

SEQ ID NO: 2542643 - RNA, 17 nt, Chlamydophila pneumoniae J138
aucagcaacauaaaguu

SEQ ID NO: 2542644 - RNA, 14 nt, Chlamydophila pneumoniae J138
aucagcacacugcu

SEQ ID NO: 2542645 - RNA, 15 nt, Chlamydophila pneumoniae J138
aucagcacacugcuu

SEQ ID NO: 2542646 - RNA, 19 nt, Chlamydophila pneumoniae J138
aucagcuggguaaguccac

SEQ ID NO: 2542647 - RNA, 14 nt, Chlamydophila pneumoniae J138
aucagcuguugcgu

SEQ ID NO: 2542648 - RNA, 17 nt, Chlamydophila pneumoniae J138
aucaggacaaugaagaa

SEQ ID NO: 2542649 - RNA, 18 nt, Chlamydophila pneumoniae J138
aucaggauggucauacca

SEQ ID NO: 2542650 - RNA, 19 nt, Chlamydophila pneumoniae J138
aucaggauucuaaaaagaa

SEQ ID NO: 2542651 - RNA, 14 nt, Chlamydophila pneumoniae J138
aucagggacucuuu

SEQ ID NO: 2542652 - RNA, 16 nt, Chlamydophila pneumoniae J138
aucagugcugccauga

SEQ ID NO: 2542653 - RNA, 15 nt, Chlamydophila pneumoniae J138
aucaguucaucuaga

SEQ ID NO: 2542654 - RNA, 17 nt, Chlamydophila pneumoniae J138
aucaguucauuuuggca

SEQ ID NO: 2542655 - RNA, 15 nt, Chlamydophila pneumoniae J138
aucauaacuagggua

SEQ ID NO: 2542656 - RNA, 22 nt, Chlamydophila pneumoniae J138
aucauagaugucaguaucaaua

SEQ ID NO: 2542657 - RNA, 19 nt, Chlamydophila pneumoniae J138
aucauagccaucauagcaa

SEQ ID NO: 2542658 - RNA, 12 nt, Chlamydophila pneumoniae J138
aucauauuuuuc

SEQ ID NO: 2542659 - RNA, 17 nt, Chlamydophila pneumoniae J138
aucauauuuuucuugaa

SEQ ID NO: 2542660 - RNA, 12 nt, Chlamydophila pneumoniae J138
aucaucagaaau

SEQ ID NO: 2542661 - RNA, 15 nt, Chlamydophila pneumoniae J138
aucaucagaaaucaa

SEQ ID NO: 2542662 - RNA, 21 nt, Chlamydophila pneumoniae J138
aucaucuacgauguuuucuua

SEQ ID NO: 2542663 - RNA, 10 nt, Chlamydophila pneumoniae J138
aucaucuccc

SEQ ID NO: 2542664 - RNA, 22 nt, Chlamydophila pneumoniae J138
auccuccuagguucuuuuuuug

SEQ ID NO: 2542665 - RNA, 16 nt, Chlamydophila pneumoniae J138
auccucggcaucuuug

SEQ ID NO: 2542666 - RNA, 19 nt, Chlamydophila pneumoniae J138
auccucggcaucuuuggca

SEQ ID NO: 2542667 - RNA, 23 nt, Chlamydophila pneumoniae J138
auccucugcugcgacacgaauuu

SEQ ID NO: 2542668 - RNA, 17 nt, Chlamydophila pneumoniae J138
auccugaaaguacagaa

SEQ ID NO: 2542669 - RNA, 22 nt, Chlamydophila pneumoniae J138
auccugaacaucuccagcagca

SEQ ID NO: 2542670 - RNA, 17 nt, Chlamydophila pneumoniae J138
auccugagaccauacac

SEQ ID NO: 2542671 - RNA, 22 nt, Chlamydophila pneumoniae J138
auccugagaccauacacaaauc

SEQ ID NO: 2542672 - RNA, 18 nt, Chlamydophila pneumoniae J138
auccugcaauccacgcuc

SEQ ID NO: 2542673 - RNA, 15 nt, Chlamydophila pneumoniae J138
auccuggagcaugag

SEQ ID NO: 2542674 - RNA, 21 nt, Chlamydophila pneumoniae J138
auccuuaucuugcugcccaaa

SEQ ID NO: 2542675 - RNA, 21 nt, Chlamydophila pneumoniae J138
auccuucacucguugccaauc

SEQ ID NO: 2542676 - RNA, 20 nt, Chlamydophila pneumoniae J138
auccuuccaagugcucagua

SEQ ID NO: 2542677 - RNA, 16 nt, Chlamydophila pneumoniae J138
auccuuccuuacaagc

SEQ ID NO: 2542678 - RNA, 17 nt, Chlamydophila pneumoniae J138
auccuuccuuauuggua

SEQ ID NO: 2542679 - RNA, 16 nt, Chlamydophila pneumoniae J138
auccuucgaccuauuu

SEQ ID NO: 2542680 - RNA, 14 nt, Chlamydophila pneumoniae J138
auccuucucccucu

SEQ ID NO: 2542681 - RNA, 13 nt, Chlamydophila pneumoniae J138
auccuucuuuacc

SEQ ID NO: 2542682 - RNA, 15 nt, Chlamydophila pneumoniae J138
auccuuucacaaaga

SEQ ID NO: 2542683 - RNA, 17 nt, Chlamydophila pneumoniae J138
auccuuucacaaagaau

SEQ ID NO: 2542684 - RNA, 15 nt, Chlamydophila pneumoniae J138
auccuuuccaagaag

SEQ ID NO: 2542685 - RNA, 15 nt, Chlamydophila pneumoniae J138
auccuuuggaagcua

SEQ ID NO: 2542686 - RNA, 15 nt, Chlamydophila pneumoniae J138
aucgaaaaauaccuc

SEQ ID NO: 2542687 - RNA, 17 nt, Chlamydophila pneumoniae J138
aucgaacagagaugcaa

SEQ ID NO: 2542688 - RNA, 22 nt, Chlamydophila pneumoniae J138
aucgaaucuugauauugaaaga

SEQ ID NO: 2542689 - RNA, 19 nt, Chlamydophila pneumoniae J138
aucgacaccuauaccaaau

SEQ ID NO: 2542690 - RNA, 13 nt, Chlamydophila pneumoniae J138
aucgacucuucca

SEQ ID NO: 2542691 - RNA, 23 nt, Chlamydophila pneumoniae J138
aucgagaaaugcucuucugcagc

SEQ ID NO: 2542692 - RNA, 20 nt, Chlamydophila pneumoniae J138
aucgagcucuuuaagaacuu

SEQ ID NO: 2542693 - RNA, 23 nt, Chlamydophila pneumoniae J138
aucgauaacgauuucuugaagau

SEQ ID NO: 2542694 - RNA, 14 nt, Chlamydophila pneumoniae J138
aucgaucucugugg

SEQ ID NO: 2542695 - RNA, 23 nt, Chlamydophila pneumoniae J138
aucgaucucugugguuccuggau

SEQ ID NO: 2542696 - RNA, 15 nt, Chlamydophila pneumoniae J138
aucgcaaucaaagag

SEQ ID NO: 2542697 - RNA, 20 nt, Chlamydophila pneumoniae J138
aucgcaaucagcaacaucgu

SEQ ID NO: 2542698 - RNA, 15 nt, Chlamydophila pneumoniae J138
aucgcgaagcuuucc

SEQ ID NO: 2542699 - RNA, 22 nt, Chlamydophila pneumoniae J138
aucggaucuuuucuuucuaaga

SEQ ID NO: 2542700 - RNA, 12 nt, Chlamydophila pneumoniae J138
aucggauuuuac

SEQ ID NO: 2542701 - RNA, 16 nt, Chlamydophila pneumoniae J138
aucggcagcagcauaa

SEQ ID NO: 2542702 - RNA, 22 nt, Chlamydophila pneumoniae J138
aucguaagccggcgguggaaaa

SEQ ID NO: 2542703 - RNA, 21 nt, Chlamydophila pneumoniae J138
aucguaauguauccuucuaca

SEQ ID NO: 2542704 - RNA, 15 nt, Chlamydophila pneumoniae J138
aucguacaggacugu

SEQ ID NO: 2542705 - RNA, 15 nt, Chlamydophila pneumoniae J138
aucguaucuuuuugc

SEQ ID NO: 2542706 - RNA, 16 nt, Chlamydophila pneumoniae J138
aucgucccuaaagcuu

SEQ ID NO: 2542707 - RNA, 22 nt, Chlamydophila pneumoniae J138
aucgugacucuuaucuggagau

SEQ ID NO: 2542708 - RNA, 19 nt, Chlamydophila pneumoniae J138
aucgugauugcugucagaa

SEQ ID NO: 2542709 - RNA, 20 nt, Chlamydophila pneumoniae J138
aucgugauugcugucagaac

SEQ ID NO: 2542710 - RNA, 23 nt, Chlamydophila pneumoniae J138
aucgugauugcugucagaacaag

SEQ ID NO: 2542711 - RNA, 20 nt, Chlamydophila pneumoniae J138
aucguuuuguggcuuuucua

SEQ ID NO: 2542712 - RNA, 18 nt, Chlamydophila pneumoniae J138
aucuaaaaacuucccauc

SEQ ID NO: 2542713 - RNA, 20 nt, Chlamydophila pneumoniae J138
aucuaaaagcacuuaaaaaa

SEQ ID NO: 2542714 - RNA, 15 nt, Chlamydophila pneumoniae J138
aucuaaagaaaugua

SEQ ID NO: 2542715 - RNA, 20 nt, Chlamydophila pneumoniae J138
aucuaaagguuuuaaauuua

SEQ ID NO: 2542716 - RNA, 17 nt, Chlamydophila pneumoniae J138
aucuaaauaagauuuua

SEQ ID NO: 2542717 - RNA, 19 nt, Chlamydophila pneumoniae J138
aucuaaccaaccuuguuga

SEQ ID NO: 2542718 - RNA, 15 nt, Chlamydophila pneumoniae J138
aucuaagaauaugga

SEQ ID NO: 2542719 - RNA, 18 nt, Chlamydophila pneumoniae J138
aucuaagauccugagacc

SEQ ID NO: 2542720 - RNA, 18 nt, Chlamydophila pneumoniae J138
aucuaagaugguuauuau

SEQ ID NO: 2542721 - RNA, 23 nt, Chlamydophila pneumoniae J138
aucuaagccagaggcccgaagca

SEQ ID NO: 2542722 - RNA, 17 nt, Chlamydophila pneumoniae J138
aucuacaaaaacuagaa

SEQ ID NO: 2542723 - RNA, 19 nt, Chlamydophila pneumoniae J138
aucuacaaaaacuagaaua

SEQ ID NO: 2542724 - RNA, 18 nt, Chlamydophila pneumoniae J138
aucuacaaacagauuuuu

SEQ ID NO: 2542725 - RNA, 21 nt, Chlamydophila pneumoniae J138
aucuacaaacagauuuuucaa

SEQ ID NO: 2542726 - RNA, 20 nt, Chlamydophila pneumoniae J138
aucuacaagacuacgacaga

SEQ ID NO: 2542727 - RNA, 13 nt, Chlamydophila pneumoniae J138
aucuacagagaga

SEQ ID NO: 2542728 - RNA, 18 nt, Chlamydophila pneumoniae J138
aucuacagagagaaacuu

SEQ ID NO: 2542729 - RNA, 15 nt, Chlamydophila pneumoniae J138
aucuaccgugaagau

SEQ ID NO: 2542730 - RNA, 17 nt, Chlamydophila pneumoniae J138
aucuaccgugaagauuu

SEQ ID NO: 2542731 - RNA, 15 nt, Chlamydophila pneumoniae J138
aucuacgagcauuca

SEQ ID NO: 2542732 - RNA, 17 nt, Chlamydophila pneumoniae J138
aucuacgauguuuucuu

SEQ ID NO: 2542733 - RNA, 16 nt, Chlamydophila pneumoniae J138
aucuagaaagauuuau

SEQ ID NO: 2542734 - RNA, 14 nt, Chlamydophila pneumoniae J138
aucuagaacauaca

SEQ ID NO: 2542735 - RNA, 21 nt, Chlamydophila pneumoniae J138
aucuagaagcauucucaauuc

SEQ ID NO: 2542736 - RNA, 18 nt, Chlamydophila pneumoniae J138
aucuagagucucuuucag

SEQ ID NO: 2542737 - RNA, 20 nt, Chlamydophila pneumoniae J138
aucuagggacuucucaaaga

SEQ ID NO: 2542738 - RNA, 15 nt, Chlamydophila pneumoniae J138
aucuaggucgauauc

SEQ ID NO: 2542739 - RNA, 22 nt, Chlamydophila pneumoniae J138
aucuaggucgauaucccacaga

SEQ ID NO: 2542740 - RNA, 23 nt, Chlamydophila pneumoniae J138
aucuauagcauuguuuggcaguu

SEQ ID NO: 2542741 - RNA, 21 nt, Chlamydophila pneumoniae J138
aucuauauccacaaucucuuu

SEQ ID NO: 2542742 - RNA, 17 nt, Chlamydophila pneumoniae J138
aucuaugaaguccugau

SEQ ID NO: 2542743 - RNA, 15 nt, Chlamydophila pneumoniae J138
aucuaugagaguaag

SEQ ID NO: 2542744 - RNA, 16 nt, Chlamydophila pneumoniae J138
aucucaaaaucaaaua

SEQ ID NO: 2542745 - RNA, 22 nt, Chlamydophila pneumoniae J138
aucucaguaggagcagcggcac

SEQ ID NO: 2542746 - RNA, 12 nt, Chlamydophila pneumoniae J138
aucucagugaac

SEQ ID NO: 2542747 - RNA, 17 nt, Chlamydophila pneumoniae J138
aucucauuccagcaucu

SEQ ID NO: 2542748 - RNA, 19 nt, Chlamydophila pneumoniae J138
aucuccaaacauuuuuaag

SEQ ID NO: 2542749 - RNA, 21 nt, Chlamydophila pneumoniae J138
aucuccaaacauuuuuaagga

SEQ ID NO: 2542750 - RNA, 14 nt, Chlamydophila pneumoniae J138
aucuccaaagauca

SEQ ID NO: 2542751 - RNA, 17 nt, Chlamydophila pneumoniae J138
aucuccagaaauuuuua

SEQ ID NO: 2542752 - RNA, 20 nt, Chlamydophila pneumoniae J138
aucuccgauagagauucuuu

SEQ ID NO: 2542753 - RNA, 22 nt, Chlamydophila pneumoniae J138
aucuccgcauggcguaaugcuc

SEQ ID NO: 2542754 - RNA, 14 nt, Chlamydophila pneumoniae J138
aucuccucaucaga

SEQ ID NO: 2542755 - RNA, 12 nt, Chlamydophila pneumoniae J138
aucuccucucuc

SEQ ID NO: 2542756 - RNA, 16 nt, Chlamydophila pneumoniae J138
aucuccugcagguuug

SEQ ID NO: 2542757 - RNA, 22 nt, Chlamydophila pneumoniae J138
aucucgcuauuccauaaaaaug

SEQ ID NO: 2542758 - RNA, 18 nt, Chlamydophila pneumoniae J138
aucucgggagaacaugcc

SEQ ID NO: 2542759 - RNA, 20 nt, Chlamydophila pneumoniae J138
aucucguacguggaaaguag

SEQ ID NO: 2542760 - RNA, 22 nt, Chlamydophila pneumoniae J138
aucucguagcuauuuuugagga

SEQ ID NO: 2542761 - RNA, 22 nt, Chlamydophila pneumoniae J138
aucucguagcucaggaaaacuu

SEQ ID NO: 2542762 - RNA, 24 nt, Chlamydophila pneumoniae J138
aucucuaccgaacagagcgucuau

SEQ ID NO: 2542763 - RNA, 21 nt, Chlamydophila pneumoniae J138
aucucuagggauaauuaaacu

SEQ ID NO: 2542764 - RNA, 23 nt, Chlamydophila pneumoniae J138
aucucuagggauaauuaaacucu

SEQ ID NO: 2542765 - RNA, 15 nt, Chlamydophila pneumoniae J138
aucucuccacagggu

SEQ ID NO: 2542766 - RNA, 13 nt, Chlamydophila pneumoniae J138
aucucuccucccc

SEQ ID NO: 2542767 - RNA, 19 nt, Chlamydophila pneumoniae J138
aucucuccuugacaaauaa

SEQ ID NO: 2542768 - RNA, 14 nt, Chlamydophila pneumoniae J138
aucucucuuuaaaa

SEQ ID NO: 2542769 - RNA, 19 nt, Chlamydophila pneumoniae J138
aucucugaccaucaaugag

SEQ ID NO: 2542770 - RNA, 22 nt, Chlamydophila pneumoniae J138
aucucugacuugcaagcuucuu

SEQ ID NO: 2542771 - RNA, 21 nt, Chlamydophila pneumoniae J138
aucucugcccccuguuugaac

SEQ ID NO: 2542772 - RNA, 18 nt, Chlamydophila pneumoniae J138
aucucuggaauacauucc

SEQ ID NO: 2542773 - RNA, 19 nt, Chlamydophila pneumoniae J138
aucucuggaauacauuccu

SEQ ID NO: 2542774 - RNA, 13 nt, Chlamydophila pneumoniae J138
aucucugugccau

SEQ ID NO: 2542775 - RNA, 22 nt, Chlamydophila pneumoniae J138
aucucugugccaucuguagacc

SEQ ID NO: 2542776 - RNA, 16 nt, Chlamydophila pneumoniae J138
aucucugugguuccug

SEQ ID NO: 2542777 - RNA, 23 nt, Chlamydophila pneumoniae J138
aucucuguuuuuugaaaacuuca

SEQ ID NO: 2542778 - RNA, 17 nt, Chlamydophila pneumoniae J138
aucucuuaaaacaugag

SEQ ID NO: 2542779 - RNA, 17 nt, Chlamydophila pneumoniae J138
aucucuucuguaggaac

SEQ ID NO: 2542780 - RNA, 15 nt, Chlamydophila pneumoniae J138
aucucuuuaaauguu

SEQ ID NO: 2542781 - RNA, 11 nt, Chlamydophila pneumoniae J138
aucucuuucac

SEQ ID NO: 2542782 - RNA, 14 nt, Chlamydophila pneumoniae J138
aucucuuucacaaa

SEQ ID NO: 2542783 - RNA, 19 nt, Chlamydophila pneumoniae J138
aucucuuucacaaaggcga

SEQ ID NO: 2542784 - RNA, 19 nt, Chlamydophila pneumoniae J138
aucucuuuuggaagaccuu

SEQ ID NO: 2542785 - RNA, 23 nt, Chlamydophila pneumoniae J138
aucucuuuuggaagaccuuugga

SEQ ID NO: 2542786 - RNA, 20 nt, Chlamydophila pneumoniae J138
aucugacagaccuugcauua

SEQ ID NO: 2542787 - RNA, 21 nt, Chlamydophila pneumoniae J138
aucugagcauaacuugaagaa

SEQ ID NO: 2542788 - RNA, 23 nt, Chlamydophila pneumoniae J138
aucugagucauaagcucuauuuc

SEQ ID NO: 2542789 - RNA, 14 nt, Chlamydophila pneumoniae J138
aucugauagaacag

SEQ ID NO: 2542790 - RNA, 21 nt, Chlamydophila pneumoniae J138
aucugcaauuccgaagaagaa

SEQ ID NO: 2542791 - RNA, 19 nt, Chlamydophila pneumoniae J138
aucugcagguaagggaugc

SEQ ID NO: 2542792 - RNA, 17 nt, Chlamydophila pneumoniae J138
aucugcauaauuuuucu

SEQ ID NO: 2542793 - RNA, 12 nt, Chlamydophila pneumoniae J138
aucugcauucca

SEQ ID NO: 2542794 - RNA, 22 nt, Chlamydophila pneumoniae J138
aucugcgacaaaaaugccugaa

SEQ ID NO: 2542795 - RNA, 15 nt, Chlamydophila pneumoniae J138
aucugcguuuaaggg

SEQ ID NO: 2542796 - RNA, 17 nt, Chlamydophila pneumoniae J138
aucugcuucuacgguaa

SEQ ID NO: 2542797 - RNA, 23 nt, Chlamydophila pneumoniae J138
aucuguaauagcaggaguuuuca

SEQ ID NO: 2542798 - RNA, 14 nt, Chlamydophila pneumoniae J138
aucuguaguaggca

SEQ ID NO: 2542799 - RNA, 20 nt, Chlamydophila pneumoniae J138
aucuguauaugcuuggcaau

SEQ ID NO: 2542800 - RNA, 15 nt, Chlamydophila pneumoniae J138
aucuguauccuuccu

SEQ ID NO: 2542801 - RNA, 15 nt, Chlamydophila pneumoniae J138
aucugucauuaaaaa

SEQ ID NO: 2542802 - RNA, 17 nt, Chlamydophila pneumoniae J138
aucugucauuaaaaauu

SEQ ID NO: 2542803 - RNA, 14 nt, Chlamydophila pneumoniae J138
aucuguuaaaaaca

SEQ ID NO: 2542804 - RNA, 15 nt, Chlamydophila pneumoniae J138
aucuguuaaaaacaa

SEQ ID NO: 2542805 - RNA, 17 nt, Chlamydophila pneumoniae J138
aucuuaguccaugaauc

SEQ ID NO: 2542806 - RNA, 12 nt, Chlamydophila pneumoniae J138
aucuuauagaca

SEQ ID NO: 2542807 - RNA, 15 nt, Chlamydophila pneumoniae J138
aucuuaucaagagcu

SEQ ID NO: 2542808 - RNA, 15 nt, Chlamydophila pneumoniae J138
aucuuaugggagaag

SEQ ID NO: 2542809 - RNA, 20 nt, Chlamydophila pneumoniae J138
aucuuauugacuagcucucu

SEQ ID NO: 2542810 - RNA, 11 nt, Chlamydophila pneumoniae J138
aucuucaaaag

SEQ ID NO: 2542811 - RNA, 12 nt, Chlamydophila pneumoniae J138
aucuucaaaaga

SEQ ID NO: 2542812 - RNA, 21 nt, Chlamydophila pneumoniae J138
aucuucacgacauacaucaaa

SEQ ID NO: 2542813 - RNA, 16 nt, Chlamydophila pneumoniae J138
aucuucagaauuuuau

SEQ ID NO: 2542814 - RNA, 13 nt, Chlamydophila pneumoniae J138
aucuucagagaga

SEQ ID NO: 2542815 - RNA, 15 nt, Chlamydophila pneumoniae J138
aucuucagagagaac

SEQ ID NO: 2542816 - RNA, 22 nt, Chlamydophila pneumoniae J138
aucuucagagagaacaggaggu

SEQ ID NO: 2542817 - RNA, 13 nt, Chlamydophila pneumoniae J138
aucuucauaacca

SEQ ID NO: 2542818 - RNA, 15 nt, Chlamydophila pneumoniae J138
aucuuccccuaaaaa

SEQ ID NO: 2542819 - RNA, 17 nt, Chlamydophila pneumoniae J138
aucuuccccuaaaaauu

SEQ ID NO: 2542820 - RNA, 19 nt, Chlamydophila pneumoniae J138
aucuucuaaaaccacagaa

SEQ ID NO: 2542821 - RNA, 11 nt, Chlamydophila pneumoniae J138
aucuucucuau

SEQ ID NO: 2542822 - RNA, 13 nt, Chlamydophila pneumoniae J138
aucuucugaaauc

SEQ ID NO: 2542823 - RNA, 19 nt, Chlamydophila pneumoniae J138
aucuucuggguucuccaca

SEQ ID NO: 2542824 - RNA, 22 nt, Chlamydophila pneumoniae J138
aucuucuucuggcugagagaag

SEQ ID NO: 2542825 - RNA, 23 nt, Chlamydophila pneumoniae J138
aucuucuucuggcugagagaagc

SEQ ID NO: 2542826 - RNA, 18 nt, Chlamydophila pneumoniae J138
aucuucuuggcuuucccc

SEQ ID NO: 2542827 - RNA, 15 nt, Chlamydophila pneumoniae J138
aucuucuuugccaau

SEQ ID NO: 2542828 - RNA, 13 nt, Chlamydophila pneumoniae J138
aucuugaaaguac

SEQ ID NO: 2542829 - RNA, 15 nt, Chlamydophila pneumoniae J138
aucuugaacagagac

SEQ ID NO: 2542830 - RNA, 23 nt, Chlamydophila pneumoniae J138
aucuugaacagagacuuccucuu

SEQ ID NO: 2542831 - RNA, 14 nt, Chlamydophila pneumoniae J138
aucuugagaaaaga

SEQ ID NO: 2542832 - RNA, 19 nt, Chlamydophila pneumoniae J138
aucuugagccacuuuuaau

SEQ ID NO: 2542833 - RNA, 14 nt, Chlamydophila pneumoniae J138
aucuugauaaaaga

SEQ ID NO: 2542834 - RNA, 16 nt, Chlamydophila pneumoniae J138
aucuugauaaaagaua

SEQ ID NO: 2542835 - RNA, 15 nt, Chlamydophila pneumoniae J138
aucuugauuaggaac

SEQ ID NO: 2542836 - RNA, 14 nt, Chlamydophila pneumoniae J138
aucuuguacauccu

SEQ ID NO: 2542837 - RNA, 20 nt, Chlamydophila pneumoniae J138
aucuuuaagauuuuuagaau

SEQ ID NO: 2542838 - RNA, 22 nt, Chlamydophila pneumoniae J138
aucuuuaguuuaccugaaaaaa

SEQ ID NO: 2542839 - RNA, 14 nt, Chlamydophila pneumoniae J138
aucuuuauuuuuaa

SEQ ID NO: 2542840 - RNA, 22 nt, Chlamydophila pneumoniae J138
aucuuucaaggaacauuugagc

SEQ ID NO: 2542841 - RNA, 19 nt, Chlamydophila pneumoniae J138
aucuuucaauguaauugcg

SEQ ID NO: 2542842 - RNA, 14 nt, Chlamydophila pneumoniae J138
aucuuucaucaaug

SEQ ID NO: 2542843 - RNA, 12 nt, Chlamydophila pneumoniae J138
aucuuucuucua

SEQ ID NO: 2542844 - RNA, 18 nt, Chlamydophila pneumoniae J138
aucuuucuucuagagcuu

SEQ ID NO: 2542845 - RNA, 15 nt, Chlamydophila pneumoniae J138
aucuuugaacaaaaa

SEQ ID NO: 2542846 - RNA, 17 nt, Chlamydophila pneumoniae J138
aucuuuggcacaauccu

SEQ ID NO: 2542847 - RNA, 18 nt, Chlamydophila pneumoniae J138
aucuuuggcacaauccuc

SEQ ID NO: 2542848 - RNA, 17 nt, Chlamydophila pneumoniae J138
aucuuuggguucuucca

SEQ ID NO: 2542849 - RNA, 16 nt, Chlamydophila pneumoniae J138
aucuuuuacagacuga

SEQ ID NO: 2542850 - RNA, 15 nt, Chlamydophila pneumoniae J138
aucuuuucaaaagaa

SEQ ID NO: 2542851 - RNA, 14 nt, Chlamydophila pneumoniae J138
aucuuuucuacuuc

SEQ ID NO: 2542852 - RNA, 13 nt, Chlamydophila pneumoniae J138
aucuuuucuagaa

SEQ ID NO: 2542853 - RNA, 18 nt, Chlamydophila pneumoniae J138
aucuuuucuuucuaagau

SEQ ID NO: 2542854 - RNA, 23 nt, Chlamydophila pneumoniae J138
aucuuuugauuaggcuucagaga

SEQ ID NO: 2542855 - RNA, 16 nt, Chlamydophila pneumoniae J138
aucuuuuugccaguuc

SEQ ID NO: 2542856 - RNA, 12 nt, Chlamydophila pneumoniae J138
aucuuuuuuaaa

SEQ ID NO: 2542857 - RNA, 13 nt, Chlamydophila pneumoniae J138
aucuuuuuuaaag

SEQ ID NO: 2542858 - RNA, 14 nt, Chlamydophila pneumoniae J138
aucuuuuuuaaagc

SEQ ID NO: 2542859 - RNA, 16 nt, Chlamydophila pneumoniae J138
aucuuuuuuaaagcua

SEQ ID NO: 2542860 - RNA, 16 nt, Chlamydophila pneumoniae J138
augaaacgaaagcagu

SEQ ID NO: 2542861 - RNA, 14 nt, Chlamydophila pneumoniae J138
augaaagcuguauu

SEQ ID NO: 2542862 - RNA, 17 nt, Chlamydophila pneumoniae J138
augaaauacuccacuuu

SEQ ID NO: 2542863 - RNA, 18 nt, Chlamydophila pneumoniae J138
augaaauaguguuucuuu

SEQ ID NO: 2542864 - RNA, 14 nt, Chlamydophila pneumoniae J138
augaacgauuucuu

SEQ ID NO: 2542865 - RNA, 19 nt, Chlamydophila pneumoniae J138
augaacucaggcuuuaagu

SEQ ID NO: 2542866 - RNA, 20 nt, Chlamydophila pneumoniae J138
augaacugccugagaaaagu

SEQ ID NO: 2542867 - RNA, 12 nt, Chlamydophila pneumoniae J138
augaagaaaaau

SEQ ID NO: 2542868 - RNA, 19 nt, Chlamydophila pneumoniae J138
augaagagugguuccugaa

SEQ ID NO: 2542869 - RNA, 22 nt, Chlamydophila pneumoniae J138
augaagccaaaaggcacagcaa

SEQ ID NO: 2542870 - RNA, 20 nt, Chlamydophila pneumoniae J138
augaauaccagaagcaaagg

SEQ ID NO: 2542871 - RNA, 17 nt, Chlamydophila pneumoniae J138
augaaucacagcgcugu

SEQ ID NO: 2542872 - RNA, 17 nt, Chlamydophila pneumoniae J138
augaaucacaucuaaag

SEQ ID NO: 2542873 - RNA, 20 nt, Chlamydophila pneumoniae J138
augaaucacaucuaaagauu

SEQ ID NO: 2542874 - RNA, 21 nt, Chlamydophila pneumoniae J138
augaaucgaagaacagaggau

SEQ ID NO: 2542875 - RNA, 14 nt, Chlamydophila pneumoniae J138
augaaugacugcag

SEQ ID NO: 2542876 - RNA, 14 nt, Chlamydophila pneumoniae J138
augacaacagagac

SEQ ID NO: 2542877 - RNA, 16 nt, Chlamydophila pneumoniae J138
augacaacagagacaa

SEQ ID NO: 2542878 - RNA, 20 nt, Chlamydophila pneumoniae J138
augacacagagaacaauaaa

SEQ ID NO: 2542879 - RNA, 18 nt, Chlamydophila pneumoniae J138
augacagggaaagaacag

SEQ ID NO: 2542880 - RNA, 13 nt, Chlamydophila pneumoniae J138
augaccuuauagu

SEQ ID NO: 2542881 - RNA, 17 nt, Chlamydophila pneumoniae J138
augacggauccuagaau

SEQ ID NO: 2542882 - RNA, 20 nt, Chlamydophila pneumoniae J138
augacguuaauaaagaggcu

SEQ ID NO: 2542883 - RNA, 22 nt, Chlamydophila pneumoniae J138
augacuauuuucauuccaagau

SEQ ID NO: 2542884 - RNA, 12 nt, Chlamydophila pneumoniae J138
augacucuagag

SEQ ID NO: 2542885 - RNA, 18 nt, Chlamydophila pneumoniae J138
augacuggcgacuugcca

SEQ ID NO: 2542886 - RNA, 19 nt, Chlamydophila pneumoniae J138
augacuugacacaggaggu

SEQ ID NO: 2542887 - RNA, 20 nt, Chlamydophila pneumoniae J138
augacuugacacaggagguu

SEQ ID NO: 2542888 - RNA, 22 nt, Chlamydophila pneumoniae J138
augacuuuuguugcaauuccau

SEQ ID NO: 2542889 - RNA, 20 nt, Chlamydophila pneumoniae J138
augagaaauacgcuuuucuu

SEQ ID NO: 2542890 - RNA, 22 nt, Chlamydophila pneumoniae J138
augagaacgucuaaagacgaag

SEQ ID NO: 2542891 - RNA, 17 nt, Chlamydophila pneumoniae J138
augagaauuuucaugau

SEQ ID NO: 2542892 - RNA, 21 nt, Chlamydophila pneumoniae J138
augagaauuuucaugauauuu

SEQ ID NO: 2542893 - RNA, 18 nt, Chlamydophila pneumoniae J138
augagagagcucuucagc

SEQ ID NO: 2542894 - RNA, 16 nt, Chlamydophila pneumoniae J138
augagaucagcuccca

SEQ ID NO: 2542895 - RNA, 13 nt, Chlamydophila pneumoniae J138
augagauccaaag

SEQ ID NO: 2542896 - RNA, 23 nt, Chlamydophila pneumoniae J138
augagauccaaagccugaaaaau

SEQ ID NO: 2542897 - RNA, 23 nt, Chlamydophila pneumoniae J138
augagauuccuaugaucagagag

SEQ ID NO: 2542898 - RNA, 20 nt, Chlamydophila pneumoniae J138
augagcgagguauucucugg

SEQ ID NO: 2542899 - RNA, 20 nt, Chlamydophila pneumoniae J138
augagcuccaaaauaaucuc

SEQ ID NO: 2542900 - RNA, 15 nt, Chlamydophila pneumoniae J138
augagcucuauuucu

SEQ ID NO: 2542901 - RNA, 21 nt, Chlamydophila pneumoniae J138
augaggagcucccucuagagc

SEQ ID NO: 2542902 - RNA, 18 nt, Chlamydophila pneumoniae J138
augaggauacacuucuaa

SEQ ID NO: 2542903 - RNA, 13 nt, Chlamydophila pneumoniae J138
augagggaaaugc

SEQ ID NO: 2542904 - RNA, 19 nt, Chlamydophila pneumoniae J138
augagggucggauuuagau

SEQ ID NO: 2542905 - RNA, 14 nt, Chlamydophila pneumoniae J138
augauaaagccugc

SEQ ID NO: 2542906 - RNA, 17 nt, Chlamydophila pneumoniae J138
augauaaagccugcacg

SEQ ID NO: 2542907 - RNA, 20 nt, Chlamydophila pneumoniae J138
augauaccaagaugaagaaa

SEQ ID NO: 2542908 - RNA, 13 nt, Chlamydophila pneumoniae J138
augauaucaccag

SEQ ID NO: 2542909 - RNA, 23 nt, Chlamydophila pneumoniae J138
augauauccucaauuuguuucuu

SEQ ID NO: 2542910 - RNA, 19 nt, Chlamydophila pneumoniae J138
augauauuuuuauuuaaaa

SEQ ID NO: 2542911 - RNA, 19 nt, Chlamydophila pneumoniae J138
augaucagagagaggggag

SEQ ID NO: 2542912 - RNA, 19 nt, Chlamydophila pneumoniae J138
augauccacugcuuuaggc

SEQ ID NO: 2542913 - RNA, 17 nt, Chlamydophila pneumoniae J138
augaucgggguuucaga

SEQ ID NO: 2542914 - RNA, 15 nt, Chlamydophila pneumoniae J138
augaucuuuaggaaa

SEQ ID NO: 2542915 - RNA, 17 nt, Chlamydophila pneumoniae J138
augaugacauugcaaua

SEQ ID NO: 2542916 - RNA, 18 nt, Chlamydophila pneumoniae J138
augaugagaacguccuca

SEQ ID NO: 2542917 - RNA, 19 nt, Chlamydophila pneumoniae J138
augaugcaagcagauagag

SEQ ID NO: 2542918 - RNA, 17 nt, Chlamydophila pneumoniae J138
augaugcauauugccuu

SEQ ID NO: 2542919 - RNA, 20 nt, Chlamydophila pneumoniae J138
augaugccauugaucagaau

SEQ ID NO: 2542920 - RNA, 14 nt, Chlamydophila pneumoniae J138
augauguguugauu

SEQ ID NO: 2542921 - RNA, 15 nt, Chlamydophila pneumoniae J138
augauguuuuuuaac

SEQ ID NO: 2542922 - RNA, 15 nt, Chlamydophila pneumoniae J138
augauuacaucuaac

SEQ ID NO: 2542923 - RNA, 22 nt, Chlamydophila pneumoniae J138
augauuucuuuagcuuuauuga

SEQ ID NO: 2542924 - RNA, 23 nt, Chlamydophila pneumoniae J138
augcaaaacaacaucacuaucau

SEQ ID NO: 2542925 - RNA, 17 nt, Chlamydophila pneumoniae J138
augcaaaauaauuacuu

SEQ ID NO: 2542926 - RNA, 21 nt, Chlamydophila pneumoniae J138
augcaaauuccagaaaaagaa

SEQ ID NO: 2542927 - RNA, 16 nt, Chlamydophila pneumoniae J138
augcaacggagaaauu

SEQ ID NO: 2542928 - RNA, 12 nt, Chlamydophila pneumoniae J138
augcacaaaaua

SEQ ID NO: 2542929 - RNA, 14 nt, Chlamydophila pneumoniae J138
augcacaaaauaaa

SEQ ID NO: 2542930 - RNA, 16 nt, Chlamydophila pneumoniae J138
augcaccauaauauaa

SEQ ID NO: 2542931 - RNA, 21 nt, Chlamydophila pneumoniae J138
augcacgcuuucgucuaaaau

SEQ ID NO: 2542932 - RNA, 20 nt, Chlamydophila pneumoniae J138
augcagauacuaaacuccau

SEQ ID NO: 2542933 - RNA, 12 nt, Chlamydophila pneumoniae J138
augcagaucaua

SEQ ID NO: 2542934 - RNA, 15 nt, Chlamydophila pneumoniae J138
augcaggccaggaga

SEQ ID NO: 2542935 - RNA, 14 nt, Chlamydophila pneumoniae J138
augcaguucuuguu

SEQ ID NO: 2542936 - RNA, 19 nt, Chlamydophila pneumoniae J138
augcauacguuaacaagga

SEQ ID NO: 2542937 - RNA, 18 nt, Chlamydophila pneumoniae J138
augcauagaauaaagauu

SEQ ID NO: 2542938 - RNA, 21 nt, Chlamydophila pneumoniae J138
augcauagaauaaagauuuua

SEQ ID NO: 2542939 - RNA, 14 nt, Chlamydophila pneumoniae J138
augcaucaagagau

SEQ ID NO: 2542940 - RNA, 15 nt, Chlamydophila pneumoniae J138
augcaucaaugaagu

SEQ ID NO: 2542941 - RNA, 15 nt, Chlamydophila pneumoniae J138
augcaucucuuaaaa

SEQ ID NO: 2542942 - RNA, 18 nt, Chlamydophila pneumoniae J138
augcaucucuuaaaacau

SEQ ID NO: 2542943 - RNA, 21 nt, Chlamydophila pneumoniae J138
augcaucucuuaaaacaugag

SEQ ID NO: 2542944 - RNA, 22 nt, Chlamydophila pneumoniae J138
augcauucugauccgaaaagaa

SEQ ID NO: 2542945 - RNA, 23 nt, Chlamydophila pneumoniae J138
augcauuuguuuggaaaugagag

SEQ ID NO: 2542946 - RNA, 13 nt, Chlamydophila pneumoniae J138
augccaguuccua

SEQ ID NO: 2542947 - RNA, 15 nt, Chlamydophila pneumoniae J138
augccaguuccuaaa

SEQ ID NO: 2542948 - RNA, 19 nt, Chlamydophila pneumoniae J138
augccaguuccuaaagcuu

SEQ ID NO: 2542949 - RNA, 17 nt, Chlamydophila pneumoniae J138
augccauugaucagaau

SEQ ID NO: 2542950 - RNA, 19 nt, Chlamydophila pneumoniae J138
augccauugaucagaaucu

SEQ ID NO: 2542951 - RNA, 15 nt, Chlamydophila pneumoniae J138
augccauuguagaga

SEQ ID NO: 2542952 - RNA, 16 nt, Chlamydophila pneumoniae J138
augcccuuuagggaau

SEQ ID NO: 2542953 - RNA, 17 nt, Chlamydophila pneumoniae J138
augccuaaauagcucag

SEQ ID NO: 2542954 - RNA, 22 nt, Chlamydophila pneumoniae J138
augccuaaauagcucaguuggu

SEQ ID NO: 2542955 - RNA, 21 nt, Chlamydophila pneumoniae J138
augccuacaggcaaggagagc

SEQ ID NO: 2542956 - RNA, 21 nt, Chlamydophila pneumoniae J138
augccuauuaagucaccuuaa

SEQ ID NO: 2542957 - RNA, 15 nt, Chlamydophila pneumoniae J138
augccucaggucugc

SEQ ID NO: 2542958 - RNA, 23 nt, Chlamydophila pneumoniae J138
augccucaggucugcugaggaga

SEQ ID NO: 2542959 - RNA, 20 nt, Chlamydophila pneumoniae J138
augccucuuucauacuaaaa

SEQ ID NO: 2542960 - RNA, 23 nt, Chlamydophila pneumoniae J138
augccuggccaucaucaccagaa

SEQ ID NO: 2542961 - RNA, 23 nt, Chlamydophila pneumoniae J138
augcuaaauuugucaucacauca

SEQ ID NO: 2542962 - RNA, 12 nt, Chlamydophila pneumoniae J138
augcuaauaaaa

SEQ ID NO: 2542963 - RNA, 21 nt, Chlamydophila pneumoniae J138
augcuaauuggauauagggag

SEQ ID NO: 2542964 - RNA, 22 nt, Chlamydophila pneumoniae J138
augcuauagcuggaucuucuga

SEQ ID NO: 2542965 - RNA, 12 nt, Chlamydophila pneumoniae J138
augcuaucccac

SEQ ID NO: 2542966 - RNA, 17 nt, Chlamydophila pneumoniae J138
augcuauuuuccucuau

SEQ ID NO: 2542967 - RNA, 18 nt, Chlamydophila pneumoniae J138
augcucauuaauaauauc

SEQ ID NO: 2542968 - RNA, 21 nt, Chlamydophila pneumoniae J138
augcuccuugggucuuuuuau

SEQ ID NO: 2542969 - RNA, 16 nt, Chlamydophila pneumoniae J138
augcugaaccuuuggu

SEQ ID NO: 2542970 - RNA, 15 nt, Chlamydophila pneumoniae J138
augcuguugauucaa

SEQ ID NO: 2542971 - RNA, 17 nt, Chlamydophila pneumoniae J138
augcuuagcaaaggcaa

SEQ ID NO: 2542972 - RNA, 16 nt, Chlamydophila pneumoniae J138
augcuuagccauggca

SEQ ID NO: 2542973 - RNA, 19 nt, Chlamydophila pneumoniae J138
augcuugaaguucucaaag

SEQ ID NO: 2542974 - RNA, 20 nt, Chlamydophila pneumoniae J138
augcuugucgcgacaagaca

SEQ ID NO: 2542975 - RNA, 15 nt, Chlamydophila pneumoniae J138
auggaaacauagaau

SEQ ID NO: 2542976 - RNA, 14 nt, Chlamydophila pneumoniae J138
auggaaagaaacaa

SEQ ID NO: 2542977 - RNA, 13 nt, Chlamydophila pneumoniae J138
auggaacauccuu

SEQ ID NO: 2542978 - RNA, 13 nt, Chlamydophila pneumoniae J138
auggaaugccaaa

SEQ ID NO: 2542979 - RNA, 17 nt, Chlamydophila pneumoniae J138
auggaauggcuuuuguu

SEQ ID NO: 2542980 - RNA, 14 nt, Chlamydophila pneumoniae J138
auggacaagcaaaa

SEQ ID NO: 2542981 - RNA, 18 nt, Chlamydophila pneumoniae J138
auggagaaggacacuaga

SEQ ID NO: 2542982 - RNA, 15 nt, Chlamydophila pneumoniae J138
auggaucccuguagu

SEQ ID NO: 2542983 - RNA, 21 nt, Chlamydophila pneumoniae J138
auggauccuucaucagcuucc

SEQ ID NO: 2542984 - RNA, 12 nt, Chlamydophila pneumoniae J138
auggaugaucuc

SEQ ID NO: 2542985 - RNA, 18 nt, Chlamydophila pneumoniae J138
auggcagcuuggauggga

SEQ ID NO: 2542986 - RNA, 18 nt, Chlamydophila pneumoniae J138
auggcauagcgaaaguca

SEQ ID NO: 2542987 - RNA, 16 nt, Chlamydophila pneumoniae J138
auggcaucuaagccag

SEQ ID NO: 2542988 - RNA, 15 nt, Chlamydophila pneumoniae J138
auggcggucuuuguu

SEQ ID NO: 2542989 - RNA, 18 nt, Chlamydophila pneumoniae J138
auggcugucacggaagaa

SEQ ID NO: 2542990 - RNA, 12 nt, Chlamydophila pneumoniae J138
augggaaucuug

SEQ ID NO: 2542991 - RNA, 15 nt, Chlamydophila pneumoniae J138
augggaauuugauuu

SEQ ID NO: 2542992 - RNA, 22 nt, Chlamydophila pneumoniae J138
auggggauuaucccaaacuucu

SEQ ID NO: 2542993 - RNA, 23 nt, Chlamydophila pneumoniae J138
auggguuuccuggucuccagaag

SEQ ID NO: 2542994 - RNA, 22 nt, Chlamydophila pneumoniae J138
augguauucccuaacaggaaag

SEQ ID NO: 2542995 - RNA, 19 nt, Chlamydophila pneumoniae J138
auggucaggaagaaaggau

SEQ ID NO: 2542996 - RNA, 16 nt, Chlamydophila pneumoniae J138
auggucccuauagaac

SEQ ID NO: 2542997 - RNA, 20 nt, Chlamydophila pneumoniae J138
auggucucccucacaagaag

SEQ ID NO: 2542998 - RNA, 19 nt, Chlamydophila pneumoniae J138
auggucuuggguuuuaaau

SEQ ID NO: 2542999 - RNA, 22 nt, Chlamydophila pneumoniae J138
augguguucuucagcccacugu

SEQ ID NO: 2543000 - RNA, 14 nt, Chlamydophila pneumoniae J138
auguaagaauguag

SEQ ID NO: 2543001 - RNA, 17 nt, Chlamydophila pneumoniae J138
auguaaucauaaaaaaa

SEQ ID NO: 2543002 - RNA, 13 nt, Chlamydophila pneumoniae J138
auguacagaaaau

SEQ ID NO: 2543003 - RNA, 16 nt, Chlamydophila pneumoniae J138
auguacagaaaauaag

SEQ ID NO: 2543004 - RNA, 18 nt, Chlamydophila pneumoniae J138
auguacagaaaauaagaa

SEQ ID NO: 2543005 - RNA, 16 nt, Chlamydophila pneumoniae J138
auguacaguaaaguau

SEQ ID NO: 2543006 - RNA, 16 nt, Chlamydophila pneumoniae J138
auguacauagaggaga

SEQ ID NO: 2543007 - RNA, 22 nt, Chlamydophila pneumoniae J138
auguacccagcgaugucuuuga

SEQ ID NO: 2543008 - RNA, 15 nt, Chlamydophila pneumoniae J138
auguacugaugugaa

SEQ ID NO: 2543009 - RNA, 24 nt, Chlamydophila pneumoniae J138
auguagaaggggguucuaagaaau

SEQ ID NO: 2543010 - RNA, 14 nt, Chlamydophila pneumoniae J138
auguagaucuacaa

SEQ ID NO: 2543011 - RNA, 16 nt, Chlamydophila pneumoniae J138
auguagcuguuccaag

SEQ ID NO: 2543012 - RNA, 21 nt, Chlamydophila pneumoniae J138
auguaguuugggaugacuggc

SEQ ID NO: 2543013 - RNA, 15 nt, Chlamydophila pneumoniae J138
auguauaaacuccac

SEQ ID NO: 2543014 - RNA, 13 nt, Chlamydophila pneumoniae J138
auguauaaaguuu

SEQ ID NO: 2543015 - RNA, 23 nt, Chlamydophila pneumoniae J138
auguaucggggauugcaaaauuu

SEQ ID NO: 2543016 - RNA, 22 nt, Chlamydophila pneumoniae J138
auguauggugcgcgucuccuug

SEQ ID NO: 2543017 - RNA, 23 nt, Chlamydophila pneumoniae J138
auguauggugcgcgucuccuuga

SEQ ID NO: 2543018 - RNA, 15 nt, Chlamydophila pneumoniae J138
augucaguaucaaua

SEQ ID NO: 2543019 - RNA, 22 nt, Chlamydophila pneumoniae J138
augucaguaucaauaaucggcc

SEQ ID NO: 2543020 - RNA, 17 nt, Chlamydophila pneumoniae J138
auguccauuaauauccc

SEQ ID NO: 2543021 - RNA, 21 nt, Chlamydophila pneumoniae J138
auguccgugagcaacaagcug

SEQ ID NO: 2543022 - RNA, 22 nt, Chlamydophila pneumoniae J138
auguccguucgagagguucccu

SEQ ID NO: 2543023 - RNA, 16 nt, Chlamydophila pneumoniae J138
auguccuucaaaaugu

SEQ ID NO: 2543024 - RNA, 19 nt, Chlamydophila pneumoniae J138
auguccuucaaaauguuua

SEQ ID NO: 2543025 - RNA, 16 nt, Chlamydophila pneumoniae J138
augucgcgaaaguaaa

SEQ ID NO: 2543026 - RNA, 17 nt, Chlamydophila pneumoniae J138
augucgucucagaaaaa

SEQ ID NO: 2543027 - RNA, 14 nt, Chlamydophila pneumoniae J138
augucuaaaggagu

SEQ ID NO: 2543028 - RNA, 17 nt, Chlamydophila pneumoniae J138
augucuaagucagaggu

SEQ ID NO: 2543029 - RNA, 18 nt, Chlamydophila pneumoniae J138
augucuaagucagagguu

SEQ ID NO: 2543030 - RNA, 19 nt, Chlamydophila pneumoniae J138
augucuccaaagauacauu

SEQ ID NO: 2543031 - RNA, 14 nt, Chlamydophila pneumoniae J138
augucuccauacag

SEQ ID NO: 2543032 - RNA, 20 nt, Chlamydophila pneumoniae J138
augucuuguugcaugggaau

SEQ ID NO: 2543033 - RNA, 16 nt, Chlamydophila pneumoniae J138
augucuuugaauauau

SEQ ID NO: 2543034 - RNA, 20 nt, Chlamydophila pneumoniae J138
augugaagccauuuucuaag

SEQ ID NO: 2543035 - RNA, 19 nt, Chlamydophila pneumoniae J138
augugacgcaagagacaag

SEQ ID NO: 2543036 - RNA, 13 nt, Chlamydophila pneumoniae J138
augugcugaagac

SEQ ID NO: 2543037 - RNA, 18 nt, Chlamydophila pneumoniae J138
augugcuuuugguucuug

SEQ ID NO: 2543038 - RNA, 24 nt, Chlamydophila pneumoniae J138
augugguucccccuaagguagcua

SEQ ID NO: 2543039 - RNA, 16 nt, Chlamydophila pneumoniae J138
augugucuugcugauu

SEQ ID NO: 2543040 - RNA, 13 nt, Chlamydophila pneumoniae J138
auguguuuccuuu

SEQ ID NO: 2543041 - RNA, 16 nt, Chlamydophila pneumoniae J138
auguguuuccuuuucu

SEQ ID NO: 2543042 - RNA, 17 nt, Chlamydophila pneumoniae J138
auguguuuccuuuucuc

SEQ ID NO: 2543043 - RNA, 15 nt, Chlamydophila pneumoniae J138
auguuaaucuaauuu

SEQ ID NO: 2543044 - RNA, 13 nt, Chlamydophila pneumoniae J138
auguuaugaguuu

SEQ ID NO: 2543045 - RNA, 15 nt, Chlamydophila pneumoniae J138
auguuaugaguuuuu

SEQ ID NO: 2543046 - RNA, 12 nt, Chlamydophila pneumoniae J138
auguuauggacu

SEQ ID NO: 2543047 - RNA, 16 nt, Chlamydophila pneumoniae J138
auguucccaaauagaa

SEQ ID NO: 2543048 - RNA, 14 nt, Chlamydophila pneumoniae J138
auguucgauuuucu

SEQ ID NO: 2543049 - RNA, 20 nt, Chlamydophila pneumoniae J138
auguugcuaagcgaaccaaa

SEQ ID NO: 2543050 - RNA, 14 nt, Chlamydophila pneumoniae J138
auguuuaaagcaua

SEQ ID NO: 2543051 - RNA, 20 nt, Chlamydophila pneumoniae J138
auguuucuaagcugaaagaa

SEQ ID NO: 2543052 - RNA, 15 nt, Chlamydophila pneumoniae J138
auguuucuuccugaa

SEQ ID NO: 2543053 - RNA, 20 nt, Chlamydophila pneumoniae J138
auguuuguaguguugaauaa

SEQ ID NO: 2543054 - RNA, 22 nt, Chlamydophila pneumoniae J138
auguuuguaguguugaauaaga

SEQ ID NO: 2543055 - RNA, 14 nt, Chlamydophila pneumoniae J138
auguuuugacauag

SEQ ID NO: 2543056 - RNA, 17 nt, Chlamydophila pneumoniae J138
auuaaaaauuuaaaaga

SEQ ID NO: 2543057 - RNA, 13 nt, Chlamydophila pneumoniae J138
auuugaacaugag

SEQ ID NO: 2543058 - RNA, 23 nt, Chlamydophila pneumoniae J138
auuugaauaguugugagacuuuc

SEQ ID NO: 2543059 - RNA, 20 nt, Chlamydophila pneumoniae J138
auuugacguuguguugcaag

SEQ ID NO: 2543060 - RNA, 14 nt, Chlamydophila pneumoniae J138
auuugauucccgga

SEQ ID NO: 2543061 - RNA, 15 nt, Chlamydophila pneumoniae J138
auuugauuuuucaaa

SEQ ID NO: 2543062 - RNA, 16 nt, Chlamydophila pneumoniae J138
auuugauuuuucaaau

SEQ ID NO: 2543063 - RNA, 19 nt, Chlamydophila pneumoniae J138
auuugcaacaaucuuucuu

SEQ ID NO: 2543064 - RNA, 23 nt, Chlamydophila pneumoniae J138
auuugcaagagccggaacuucag

SEQ ID NO: 2543065 - RNA, 22 nt, Chlamydophila pneumoniae J138
auuugcauuaccuuaucgccaa

SEQ ID NO: 2543066 - RNA, 17 nt, Chlamydophila pneumoniae J138
auuugcgacaccuacaa

SEQ ID NO: 2543067 - RNA, 15 nt, Chlamydophila pneumoniae J138
auuugcugcauccca

SEQ ID NO: 2543068 - RNA, 23 nt, Chlamydophila pneumoniae J138
auuugcuuccaacggacauuuuc

SEQ ID NO: 2543069 - RNA, 19 nt, Chlamydophila pneumoniae J138
auuuguaagaaucauaaca

SEQ ID NO: 2543070 - RNA, 16 nt, Chlamydophila pneumoniae J138
auuugucaucacauca

SEQ ID NO: 2543071 - RNA, 19 nt, Chlamydophila pneumoniae J138
auuuguccuuugcuaagaa

SEQ ID NO: 2543072 - RNA, 17 nt, Chlamydophila pneumoniae J138
auuugugcgucaucaac

SEQ ID NO: 2543073 - RNA, 22 nt, Chlamydophila pneumoniae J138
auuugugggacucuuccuucua

SEQ ID NO: 2543074 - RNA, 20 nt, Chlamydophila pneumoniae J138
auuuguugucagcuuugcuu

SEQ ID NO: 2543075 - RNA, 22 nt, Chlamydophila pneumoniae J138
auuuguugucagcuuugcuuau

SEQ ID NO: 2543076 - RNA, 18 nt, Chlamydophila pneumoniae J138
auuuuaaaaucuccucuc

SEQ ID NO: 2543077 - RNA, 16 nt, Chlamydophila pneumoniae J138
auuuuaaagcaaaaau

SEQ ID NO: 2543078 - RNA, 13 nt, Chlamydophila pneumoniae J138
auuuuaaagucac

SEQ ID NO: 2543079 - RNA, 13 nt, Chlamydophila pneumoniae J138
auuuuaaauuuug

SEQ ID NO: 2543080 - RNA, 15 nt, Chlamydophila pneumoniae J138
auuuuaaauuuuguu

SEQ ID NO: 2543081 - RNA, 14 nt, Chlamydophila pneumoniae J138
auuuuacgaaucuu

SEQ ID NO: 2543082 - RNA, 20 nt, Chlamydophila pneumoniae J138
auuuuacgaaucuuuuucau

SEQ ID NO: 2543083 - RNA, 21 nt, Chlamydophila pneumoniae J138
auuuuacuugcgauacaauaa

SEQ ID NO: 2543084 - RNA, 19 nt, Chlamydophila pneumoniae J138
auuuuagaacuucaaugaa

SEQ ID NO: 2543085 - RNA, 22 nt, Chlamydophila pneumoniae J138
auuuuagauacgcuuacaaaua

SEQ ID NO: 2543086 - RNA, 22 nt, Chlamydophila pneumoniae J138
auuuuaggaagcuuaucaagaa

SEQ ID NO: 2543087 - RNA, 17 nt, Chlamydophila pneumoniae J138
auuuuaguaagaucgcu

SEQ ID NO: 2543088 - RNA, 22 nt, Chlamydophila pneumoniae J138
auuuuaucugcgacaaaaaugc

SEQ ID NO: 2543089 - RNA, 18 nt, Chlamydophila pneumoniae J138
auuuuauuaguuuugaaa

SEQ ID NO: 2543090 - RNA, 12 nt, Chlamydophila pneumoniae J138
auuuucaagcuu

SEQ ID NO: 2543091 - RNA, 15 nt, Chlamydophila pneumoniae J138
auuuucaagcuuucg

SEQ ID NO: 2543092 - RNA, 14 nt, Chlamydophila pneumoniae J138
auuuucagcacuga

SEQ ID NO: 2543093 - RNA, 17 nt, Chlamydophila pneumoniae J138
auuuucagccugucuau

SEQ ID NO: 2543094 - RNA, 21 nt, Chlamydophila pneumoniae J138
auuuucagccugucuauaaaa

SEQ ID NO: 2543095 - RNA, 17 nt, Chlamydophila pneumoniae J138
auuuucaggagaccagg

SEQ ID NO: 2543096 - RNA, 15 nt, Chlamydophila pneumoniae J138
auuuucauagcagcu

SEQ ID NO: 2543097 - RNA, 23 nt, Chlamydophila pneumoniae J138
auuuucaugggcagcgauauaag

SEQ ID NO: 2543098 - RNA, 15 nt, Chlamydophila pneumoniae J138
auuuucccaauaucc

SEQ ID NO: 2543099 - RNA, 17 nt, Chlamydophila pneumoniae J138
auuuucccaauauccuc

SEQ ID NO: 2543100 - RNA, 17 nt, Chlamydophila pneumoniae J138
auuuucccauuacagcc

SEQ ID NO: 2543101 - RNA, 17 nt, Chlamydophila pneumoniae J138
auuuuccgcaaaggaaa

SEQ ID NO: 2543102 - RNA, 16 nt, Chlamydophila pneumoniae J138
auuuugacguaaugca

SEQ ID NO: 2543103 - RNA, 17 nt, Chlamydophila pneumoniae J138
auuuugacuugucccaa

SEQ ID NO: 2543104 - RNA, 19 nt, Chlamydophila pneumoniae J138
auuuugcaaaugaaaagag

SEQ ID NO: 2543105 - RNA, 11 nt, Chlamydophila pneumoniae J138
auuuuggugag

SEQ ID NO: 2543106 - RNA, 14 nt, Chlamydophila pneumoniae J138
auuuuuaaauacag

SEQ ID NO: 2543107 - RNA, 16 nt, Chlamydophila pneumoniae J138
auuuuuagaauagaag

SEQ ID NO: 2543108 - RNA, 18 nt, Chlamydophila pneumoniae J138
auuuuuaggaucuuuguu

SEQ ID NO: 2543109 - RNA, 16 nt, Chlamydophila pneumoniae J138
auuuuuauaauauuuu

SEQ ID NO: 2543110 - RNA, 14 nt, Chlamydophila pneumoniae J138
auuuuuauuuaaaa

SEQ ID NO: 2543111 - RNA, 22 nt, Chlamydophila pneumoniae J138
auuuuucaagaacuccuuugag

SEQ ID NO: 2543112 - RNA, 13 nt, Chlamydophila pneumoniae J138
auuuuuccagaaa

SEQ ID NO: 2543113 - RNA, 14 nt, Chlamydophila pneumoniae J138
auuuuuccagaaau

SEQ ID NO: 2543114 - RNA, 14 nt, Chlamydophila pneumoniae J138
auuuuuccuccucc

SEQ ID NO: 2543115 - RNA, 16 nt, Chlamydophila pneumoniae J138
auuuuucuuuuagaga

SEQ ID NO: 2543116 - RNA, 20 nt, Chlamydophila pneumoniae J138
auuuuucuuuuagagaaauc

SEQ ID NO: 2543117 - RNA, 15 nt, Chlamydophila pneumoniae J138
auuuuugaauaugau

SEQ ID NO: 2543118 - RNA, 13 nt, Chlamydophila pneumoniae J138
auuuuugcagagu

SEQ ID NO: 2543119 - RNA, 15 nt, Chlamydophila pneumoniae J138
auuuuugcuaaacaa

SEQ ID NO: 2543120 - RNA, 18 nt, Chlamydophila pneumoniae J138
auuuuuuaauaaaauuua

SEQ ID NO: 2543121 - RNA, 19 nt, Chlamydophila pneumoniae J138
auuuuuuacguucuuucuu

SEQ ID NO: 2543122 - RNA, 14 nt, Chlamydophila pneumoniae J138
auuuuuucauuguu

SEQ ID NO: 2543123 - RNA, 14 nt, Chlamydophila pneumoniae J138
auuuuuuccuuaau

SEQ ID NO: 2543124 - RNA, 16 nt, Chlamydophila pneumoniae J138
auuuuuucuguuccug

SEQ ID NO: 2543125 - RNA, 11 nt, Chlamydophila pneumoniae J138
auuuuuucuug

SEQ ID NO: 2543126 - RNA, 16 nt, Chlamydophila pneumoniae J138
auuuuuugagaaauau

SEQ ID NO: 2543127 - RNA, 13 nt, Chlamydophila pneumoniae J138
caaaaaacgauga

SEQ ID NO: 2543128 - RNA, 13 nt, Chlamydophila pneumoniae J138
caaaaaaguaacu

SEQ ID NO: 2543129 - RNA, 15 nt, Chlamydophila pneumoniae J138
caaaaaaguaacuau

SEQ ID NO: 2543130 - RNA, 13 nt, Chlamydophila pneumoniae J138
caaaaaaugcucc

SEQ ID NO: 2543131 - RNA, 17 nt, Chlamydophila pneumoniae J138
caaaaagcuucuuucuu

SEQ ID NO: 2543132 - RNA, 18 nt, Chlamydophila pneumoniae J138
caaaaagcuucuuucuua

SEQ ID NO: 2543133 - RNA, 19 nt, Chlamydophila pneumoniae J138
caaaaauaaacauauucuc

SEQ ID NO: 2543134 - RNA, 22 nt, Chlamydophila pneumoniae J138
caaaaauaaacauauucuccuu

SEQ ID NO: 2543135 - RNA, 23 nt, Chlamydophila pneumoniae J138
caaaaauaaacauauucuccuua

SEQ ID NO: 2543136 - RNA, 21 nt, Chlamydophila pneumoniae J138
caaaaaucgugcuuagagccu

SEQ ID NO: 2543137 - RNA, 22 nt, Chlamydophila pneumoniae J138
caaaaaugauaccaccuaaaau

SEQ ID NO: 2543138 - RNA, 10 nt, Chlamydophila pneumoniae J138
caaaaauucc

SEQ ID NO: 2543139 - RNA, 14 nt, Chlamydophila pneumoniae J138
caaaacaaaagcca

SEQ ID NO: 2543140 - RNA, 19 nt, Chlamydophila pneumoniae J138
caaaacauaaccuccucuu

SEQ ID NO: 2543141 - RNA, 22 nt, Chlamydophila pneumoniae J138
caaaaccuggauugauccacag

SEQ ID NO: 2543142 - RNA, 11 nt, Chlamydophila pneumoniae J138
caaaagaaaag

SEQ ID NO: 2543143 - RNA, 18 nt, Chlamydophila pneumoniae J138
caaaagaaaucaaacauu

SEQ ID NO: 2543144 - RNA, 19 nt, Chlamydophila pneumoniae J138
caaaagaaaucaaacauua

SEQ ID NO: 2543145 - RNA, 21 nt, Chlamydophila pneumoniae J138
caaaagaauuaagaagaagcu

SEQ ID NO: 2543146 - RNA, 16 nt, Chlamydophila pneumoniae J138
caaaagaauuccuaaa

SEQ ID NO: 2543147 - RNA, 21 nt, Chlamydophila pneumoniae J138
caaaagaauuccuaaaacgag

SEQ ID NO: 2543148 - RNA, 14 nt, Chlamydophila pneumoniae J138
caaaagaccaaaaa

SEQ ID NO: 2543149 - RNA, 18 nt, Chlamydophila pneumoniae J138
caaaagccauuccauauc

SEQ ID NO: 2543150 - RNA, 21 nt, Chlamydophila pneumoniae J138
caaaagccauuccauauccau

SEQ ID NO: 2543151 - RNA, 17 nt, Chlamydophila pneumoniae J138
caaaaggcacagcaaug

SEQ ID NO: 2543152 - RNA, 20 nt, Chlamydophila pneumoniae J138
caaaaggcacagcaaugaca

SEQ ID NO: 2543153 - RNA, 15 nt, Chlamydophila pneumoniae J138
caaaagguuuuauaa

SEQ ID NO: 2543154 - RNA, 21 nt, Chlamydophila pneumoniae J138
caaaagguuuuauaaagaucg

SEQ ID NO: 2543155 - RNA, 20 nt, Chlamydophila pneumoniae J138
caaaaguaaucacuucagca

SEQ ID NO: 2543156 - RNA, 16 nt, Chlamydophila pneumoniae J138
caaaagucaugaggac

SEQ ID NO: 2543157 - RNA, 18 nt, Chlamydophila pneumoniae J138
caaaagucaugaggacug

SEQ ID NO: 2543158 - RNA, 19 nt, Chlamydophila pneumoniae J138
caaaaguuuugaggauuuc

SEQ ID NO: 2543159 - RNA, 24 nt, Chlamydophila pneumoniae J138
caaaauaaaaaaacccucaaagaa

SEQ ID NO: 2543160 - RNA, 16 nt, Chlamydophila pneumoniae J138
caaaauaaucucgcag

SEQ ID NO: 2543161 - RNA, 12 nt, Chlamydophila pneumoniae J138
caaaaucucuau

SEQ ID NO: 2543162 - RNA, 17 nt, Chlamydophila pneumoniae J138
caaaaugcgaggaaaaa

SEQ ID NO: 2543163 - RNA, 18 nt, Chlamydophila pneumoniae J138
caaaaugcgaggaaaaag

SEQ ID NO: 2543164 - RNA, 16 nt, Chlamydophila pneumoniae J138
caaaaugggauccugc

SEQ ID NO: 2543165 - RNA, 22 nt, Chlamydophila pneumoniae J138
caaaaugucuuuuucaauugcu

SEQ ID NO: 2543166 - RNA, 21 nt, Chlamydophila pneumoniae J138
caaaauuaccguuuccuccuc

SEQ ID NO: 2543167 - RNA, 17 nt, Chlamydophila pneumoniae J138
caaaauuauguauaaac

SEQ ID NO: 2543168 - RNA, 18 nt, Chlamydophila pneumoniae J138
caaaauuauguauaaacu

SEQ ID NO: 2543169 - RNA, 22 nt, Chlamydophila pneumoniae J138
caaaauuauguauaaacuccac

SEQ ID NO: 2543170 - RNA, 12 nt, Chlamydophila pneumoniae J138
caaacaucaaag

SEQ ID NO: 2543171 - RNA, 17 nt, Chlamydophila pneumoniae J138
caaacaucacucaggau

SEQ ID NO: 2543172 - RNA, 18 nt, Chlamydophila pneumoniae J138
caaacaucauuguugcug

SEQ ID NO: 2543173 - RNA, 22 nt, Chlamydophila pneumoniae J138
caaacauggacaauauagagau

SEQ ID NO: 2543174 - RNA, 14 nt, Chlamydophila pneumoniae J138
caaacauuuuuaag

SEQ ID NO: 2543175 - RNA, 12 nt, Chlamydophila pneumoniae J138
caaaccaaaaaa

SEQ ID NO: 2543176 - RNA, 23 nt, Chlamydophila pneumoniae J138
caaaccagguagagugucuuccu

SEQ ID NO: 2543177 - RNA, 19 nt, Chlamydophila pneumoniae J138
caaaccauccgacuuuccu

SEQ ID NO: 2543178 - RNA, 21 nt, Chlamydophila pneumoniae J138
caaacccauauuugaauaaag

SEQ ID NO: 2543179 - RNA, 21 nt, Chlamydophila pneumoniae J138
caaacccugggcucacucuaa

SEQ ID NO: 2543180 - RNA, 14 nt, Chlamydophila pneumoniae J138
caaaccucuaaaaa

SEQ ID NO: 2543181 - RNA, 15 nt, Chlamydophila pneumoniae J138
caaaccucuaaaaac

SEQ ID NO: 2543182 - RNA, 21 nt, Chlamydophila pneumoniae J138
caaacgcaaugauuucucuaa

SEQ ID NO: 2543183 - RNA, 19 nt, Chlamydophila pneumoniae J138
caaacuaacauagauaagg

SEQ ID NO: 2543184 - RNA, 16 nt, Chlamydophila pneumoniae J138
caaacuccuuuuaaaa

SEQ ID NO: 2543185 - RNA, 14 nt, Chlamydophila pneumoniae J138
caaacugaucugaa

SEQ ID NO: 2543186 - RNA, 17 nt, Chlamydophila pneumoniae J138
caaacugaugccaagaa

SEQ ID NO: 2543187 - RNA, 21 nt, Chlamydophila pneumoniae J138
caaacugauuaguuuguuuua

SEQ ID NO: 2543188 - RNA, 22 nt, Chlamydophila pneumoniae J138
caaacugauuaguuuguuuuaa

SEQ ID NO: 2543189 - RNA, 19 nt, Chlamydophila pneumoniae J138
caaacuucgauuggaagca

SEQ ID NO: 2543190 - RNA, 14 nt, Chlamydophila pneumoniae J138
caaacuucuucucg

SEQ ID NO: 2543191 - RNA, 21 nt, Chlamydophila pneumoniae J138
caaacuuggucauuauaguag

SEQ ID NO: 2543192 - RNA, 18 nt, Chlamydophila pneumoniae J138
caaacuuguuuucguaag

SEQ ID NO: 2543193 - RNA, 21 nt, Chlamydophila pneumoniae J138
caaagaaaauucucagauugc

SEQ ID NO: 2543194 - RNA, 20 nt, Chlamydophila pneumoniae J138
caaagaacagcacucucugc

SEQ ID NO: 2543195 - RNA, 17 nt, Chlamydophila pneumoniae J138
caaagaacucaacuuuu

SEQ ID NO: 2543196 - RNA, 19 nt, Chlamydophila pneumoniae J138
caaagaacucaacuuuuuu

SEQ ID NO: 2543197 - RNA, 21 nt, Chlamydophila pneumoniae J138
caaagaacuuaaaauucaaau

SEQ ID NO: 2543198 - RNA, 13 nt, Chlamydophila pneumoniae J138
caaagacaggcuc

SEQ ID NO: 2543199 - RNA, 20 nt, Chlamydophila pneumoniae J138
caaagacaggcucaugaaau

SEQ ID NO: 2543200 - RNA, 23 nt, Chlamydophila pneumoniae J138
caaagacuagagucacuagcaga

SEQ ID NO: 2543201 - RNA, 14 nt, Chlamydophila pneumoniae J138
caaagacucaugaa

SEQ ID NO: 2543202 - RNA, 13 nt, Chlamydophila pneumoniae J138
caaagacuuuugc

SEQ ID NO: 2543203 - RNA, 15 nt, Chlamydophila pneumoniae J138
caaagagcaaaggag

SEQ ID NO: 2543204 - RNA, 14 nt, Chlamydophila pneumoniae J138
caaagaguuuuuua

SEQ ID NO: 2543205 - RNA, 13 nt, Chlamydophila pneumoniae J138
caaagauauaagg

SEQ ID NO: 2543206 - RNA, 13 nt, Chlamydophila pneumoniae J138
caaagaucacuga

SEQ ID NO: 2543207 - RNA, 23 nt, Chlamydophila pneumoniae J138
caaagaucaguuuuuucuucuga

SEQ ID NO: 2543208 - RNA, 16 nt, Chlamydophila pneumoniae J138
caaagaugcgcucgga

SEQ ID NO: 2543209 - RNA, 12 nt, Chlamydophila pneumoniae J138
caaagauuccua

SEQ ID NO: 2543210 - RNA, 13 nt, Chlamydophila pneumoniae J138
caaagauuccuaa

SEQ ID NO: 2543211 - RNA, 14 nt, Chlamydophila pneumoniae J138
caaagauuuccaau

SEQ ID NO: 2543212 - RNA, 20 nt, Chlamydophila pneumoniae J138
caaagauuucugcuguguua

SEQ ID NO: 2543213 - RNA, 15 nt, Chlamydophila pneumoniae J138
caaagcaaagagcaa

SEQ ID NO: 2543214 - RNA, 19 nt, Chlamydophila pneumoniae J138
caaagcagauccugcuucu

SEQ ID NO: 2543215 - RNA, 16 nt, Chlamydophila pneumoniae J138
caaagcccccuccccc

SEQ ID NO: 2543216 - RNA, 17 nt, Chlamydophila pneumoniae J138
caaagccggcccacuca

SEQ ID NO: 2543217 - RNA, 20 nt, Chlamydophila pneumoniae J138
caaagccggcccacucaaaa

SEQ ID NO: 2543218 - RNA, 15 nt, Chlamydophila pneumoniae J138
caaagccugaaaaau

SEQ ID NO: 2543219 - RNA, 20 nt, Chlamydophila pneumoniae J138
caaagcgucuaucuagauuu

SEQ ID NO: 2543220 - RNA, 22 nt, Chlamydophila pneumoniae J138
caaagcuaggcgauaguaaaca

SEQ ID NO: 2543221 - RNA, 20 nt, Chlamydophila pneumoniae J138
caaagcuauuucucuaucau

SEQ ID NO: 2543222 - RNA, 22 nt, Chlamydophila pneumoniae J138
caaagcuuguuccacuugcucu

SEQ ID NO: 2543223 - RNA, 11 nt, Chlamydophila pneumoniae J138
caaaggaaggg

SEQ ID NO: 2543224 - RNA, 15 nt, Chlamydophila pneumoniae J138
caaaggagaaagaau

SEQ ID NO: 2543225 - RNA, 19 nt, Chlamydophila pneumoniae J138
caaaggagaaagaauugua

SEQ ID NO: 2543226 - RNA, 15 nt, Chlamydophila pneumoniae J138
caaaggcaaccucug

SEQ ID NO: 2543227 - RNA, 18 nt, Chlamydophila pneumoniae J138
caaagugacuuccuccaa

SEQ ID NO: 2543228 - RNA, 12 nt, Chlamydophila pneumoniae J138
caaaguuuauga

SEQ ID NO: 2543229 - RNA, 19 nt, Chlamydophila pneumoniae J138
caaaguuuaugacacagcu

SEQ ID NO: 2543230 - RNA, 20 nt, Chlamydophila pneumoniae J138
caaauaagccaguacuaaau

SEQ ID NO: 2543231 - RNA, 13 nt, Chlamydophila pneumoniae J138
caaauaaggcugc

SEQ ID NO: 2543232 - RNA, 21 nt, Chlamydophila pneumoniae J138
caaauaaggcugcuaucaaca

SEQ ID NO: 2543233 - RNA, 22 nt, Chlamydophila pneumoniae J138
caaauaaguccuguuugaaaau

SEQ ID NO: 2543234 - RNA, 17 nt, Chlamydophila pneumoniae J138
caaauaauuaaauauau

SEQ ID NO: 2543235 - RNA, 20 nt, Chlamydophila pneumoniae J138
caaauaauuaaauauauaaa

SEQ ID NO: 2543236 - RNA, 21 nt, Chlamydophila pneumoniae J138
caaauaggaucucucuuuccu

SEQ ID NO: 2543237 - RNA, 22 nt, Chlamydophila pneumoniae J138
caaauaggaucucucuuuccuu

SEQ ID NO: 2543238 - RNA, 20 nt, Chlamydophila pneumoniae J138
caaauauaguuuucauaauc

SEQ ID NO: 2543239 - RNA, 18 nt, Chlamydophila pneumoniae J138
caaauauugcgaacuuuu

SEQ ID NO: 2543240 - RNA, 13 nt, Chlamydophila pneumoniae J138
caaaucaucaaaa

SEQ ID NO: 2543241 - RNA, 21 nt, Chlamydophila pneumoniae J138
caaaucaucgcaaucaaagag

SEQ ID NO: 2543242 - RNA, 14 nt, Chlamydophila pneumoniae J138
caaaucccugaugc

SEQ ID NO: 2543243 - RNA, 21 nt, Chlamydophila pneumoniae J138
caaaucuaucugcacuuucuu

SEQ ID NO: 2543244 - RNA, 19 nt, Chlamydophila pneumoniae J138
caaaucuuacauaaaccuu

SEQ ID NO: 2543245 - RNA, 23 nt, Chlamydophila pneumoniae J138
caaaucuucgaauuuuuguuuua

SEQ ID NO: 2543246 - RNA, 14 nt, Chlamydophila pneumoniae J138
caaaugaaaagaga

SEQ ID NO: 2543247 - RNA, 17 nt, Chlamydophila pneumoniae J138
caaaugcagucucagga

SEQ ID NO: 2543248 - RNA, 13 nt, Chlamydophila pneumoniae J138
caaauguucucuc

SEQ ID NO: 2543249 - RNA, 22 nt, Chlamydophila pneumoniae J138
caaauuaccuugagacaaagaa

SEQ ID NO: 2543250 - RNA, 16 nt, Chlamydophila pneumoniae J138
caaauucaaaauagaa

SEQ ID NO: 2543251 - RNA, 18 nt, Chlamydophila pneumoniae J138
caaauucaaaauagaagc

SEQ ID NO: 2543252 - RNA, 14 nt, Chlamydophila pneumoniae J138
caaauucaaccaaa

SEQ ID NO: 2543253 - RNA, 13 nt, Chlamydophila pneumoniae J138
caaauucauuaag

SEQ ID NO: 2543254 - RNA, 18 nt, Chlamydophila pneumoniae J138
caaauuccuucucagaaa

SEQ ID NO: 2543255 - RNA, 14 nt, Chlamydophila pneumoniae J138
caaauugagaaaua

SEQ ID NO: 2543256 - RNA, 17 nt, Chlamydophila pneumoniae J138
caaauugagaaauauaa

SEQ ID NO: 2543257 - RNA, 19 nt, Chlamydophila pneumoniae J138
caaauugagaaauauaacu

SEQ ID NO: 2543258 - RNA, 17 nt, Chlamydophila pneumoniae J138
caaauugcaauuuucua

SEQ ID NO: 2543259 - RNA, 23 nt, Chlamydophila pneumoniae J138
caaauuuaucggcuaaagaaaag

SEQ ID NO: 2543260 - RNA, 17 nt, Chlamydophila pneumoniae J138
caaauuucuucuggaua

SEQ ID NO: 2543261 - RNA, 16 nt, Chlamydophila pneumoniae J138
caaauuuuucgagaau

SEQ ID NO: 2543262 - RNA, 21 nt, Chlamydophila pneumoniae J138
caacaaaggcuccaaacgcaa

SEQ ID NO: 2543263 - RNA, 17 nt, Chlamydophila pneumoniae J138
caacaacgcucccuaug

SEQ ID NO: 2543264 - RNA, 15 nt, Chlamydophila pneumoniae J138
caacaagggaaagaa

SEQ ID NO: 2543265 - RNA, 22 nt, Chlamydophila pneumoniae J138
caacaaguucuuggaaaaaagg

SEQ ID NO: 2543266 - RNA, 17 nt, Chlamydophila pneumoniae J138
caacacccggcuuuucc

SEQ ID NO: 2543267 - RNA, 13 nt, Chlamydophila pneumoniae J138
caacaccucccac

SEQ ID NO: 2543268 - RNA, 16 nt, Chlamydophila pneumoniae J138
caacacgcacaaacua

SEQ ID NO: 2543269 - RNA, 15 nt, Chlamydophila pneumoniae J138
caacagcaacacucg

SEQ ID NO: 2543270 - RNA, 18 nt, Chlamydophila pneumoniae J138
caacagguaagacgagca

SEQ ID NO: 2543271 - RNA, 15 nt, Chlamydophila pneumoniae J138
caacaguaauuauuu

SEQ ID NO: 2543272 - RNA, 22 nt, Chlamydophila pneumoniae J138
caacaguguagccuuucuuuuu

SEQ ID NO: 2543273 - RNA, 15 nt, Chlamydophila pneumoniae J138
caacaguucuuucug

SEQ ID NO: 2543274 - RNA, 13 nt, Chlamydophila pneumoniae J138
caacauaaagaag

SEQ ID NO: 2543275 - RNA, 13 nt, Chlamydophila pneumoniae J138
caacauaacauga

SEQ ID NO: 2543276 - RNA, 20 nt, Chlamydophila pneumoniae J138
caacauaacaugagaaauac

SEQ ID NO: 2543277 - RNA, 22 nt, Chlamydophila pneumoniae J138
caacauacaccccaguuucuug

SEQ ID NO: 2543278 - RNA, 13 nt, Chlamydophila pneumoniae J138
caacaucaaagaa

SEQ ID NO: 2543279 - RNA, 14 nt, Chlamydophila pneumoniae J138
caacaucaaagaau

SEQ ID NO: 2543280 - RNA, 18 nt, Chlamydophila pneumoniae J138
caacaugcgcguauaagg

SEQ ID NO: 2543281 - RNA, 20 nt, Chlamydophila pneumoniae J138
caacauugaguugguuuugu

SEQ ID NO: 2543282 - RNA, 23 nt, Chlamydophila pneumoniae J138
caaccaaaaugcauuugccccua

SEQ ID NO: 2543283 - RNA, 18 nt, Chlamydophila pneumoniae J138
caaccacacaggauuguu

SEQ ID NO: 2543284 - RNA, 16 nt, Chlamydophila pneumoniae J138
caaccaguugagucaa

SEQ ID NO: 2543285 - RNA, 18 nt, Chlamydophila pneumoniae J138
caaccaucccauauggau

SEQ ID NO: 2543286 - RNA, 18 nt, Chlamydophila pneumoniae J138
caacccgaauuccucucc

SEQ ID NO: 2543287 - RNA, 15 nt, Chlamydophila pneumoniae J138
caaccgccuuuauau

SEQ ID NO: 2543288 - RNA, 20 nt, Chlamydophila pneumoniae J138
caaccgccuuuauauaaagg

SEQ ID NO: 2543289 - RNA, 23 nt, Chlamydophila pneumoniae J138
caaccuagaaucacauaaaauaa

SEQ ID NO: 2543290 - RNA, 22 nt, Chlamydophila pneumoniae J138
caaccuucgauuccaggcucua

SEQ ID NO: 2543291 - RNA, 16 nt, Chlamydophila pneumoniae J138
caaccuuuccuaaaau

SEQ ID NO: 2543292 - RNA, 18 nt, Chlamydophila pneumoniae J138
caaccuuuccuaaaauaa

SEQ ID NO: 2543293 - RNA, 22 nt, Chlamydophila pneumoniae J138
caacgguguucauaaucagaac

SEQ ID NO: 2543294 - RNA, 20 nt, Chlamydophila pneumoniae J138
caacuaaacgagcuguccag

SEQ ID NO: 2543295 - RNA, 12 nt, Chlamydophila pneumoniae J138
caacuaaacucu

SEQ ID NO: 2543296 - RNA, 16 nt, Chlamydophila pneumoniae J138
caacuaaacucuccaa

SEQ ID NO: 2543297 - RNA, 21 nt, Chlamydophila pneumoniae J138
caacuacagagggcuucauuc

SEQ ID NO: 2543298 - RNA, 16 nt, Chlamydophila pneumoniae J138
caacuagaccaauaaa

SEQ ID NO: 2543299 - RNA, 21 nt, Chlamydophila pneumoniae J138
caacucauccuaaauuaaaua

SEQ ID NO: 2543300 - RNA, 20 nt, Chlamydophila pneumoniae J138
caacucuacaagugucugag

SEQ ID NO: 2543301 - RNA, 14 nt, Chlamydophila pneumoniae J138
caacucuccauccu

SEQ ID NO: 2543302 - RNA, 21 nt, Chlamydophila pneumoniae J138
caacucucccauguaguaaau

SEQ ID NO: 2543303 - RNA, 15 nt, Chlamydophila pneumoniae J138
caacucuucagcagg

SEQ ID NO: 2543304 - RNA, 15 nt, Chlamydophila pneumoniae J138
caacucuugacaacg

SEQ ID NO: 2543305 - RNA, 13 nt, Chlamydophila pneumoniae J138
caacucuuuaauu

SEQ ID NO: 2543306 - RNA, 20 nt, Chlamydophila pneumoniae J138
caacucuuuaggucuugucu

SEQ ID NO: 2543307 - RNA, 14 nt, Chlamydophila pneumoniae J138
caacuucuccaacu

SEQ ID NO: 2543308 - RNA, 23 nt, Chlamydophila pneumoniae J138
caacuucugacaauaacaugcgc

SEQ ID NO: 2543309 - RNA, 14 nt, Chlamydophila pneumoniae J138
caacuucuucguua

SEQ ID NO: 2543310 - RNA, 19 nt, Chlamydophila pneumoniae J138
caacuuuguuaauagaaga

SEQ ID NO: 2543311 - RNA, 23 nt, Chlamydophila pneumoniae J138
caacuuuguuaauagaagaucau

SEQ ID NO: 2543312 - RNA, 21 nt, Chlamydophila pneumoniae J138
caacuuuuuuacuaucuccua

SEQ ID NO: 2543313 - RNA, 16 nt, Chlamydophila pneumoniae J138
caagaaaacaaaguca

SEQ ID NO: 2543314 - RNA, 16 nt, Chlamydophila pneumoniae J138
caagaaaauaucaccu

SEQ ID NO: 2543315 - RNA, 18 nt, Chlamydophila pneumoniae J138
caagaaauauacugccag

SEQ ID NO: 2543316 - RNA, 14 nt, Chlamydophila pneumoniae J138
caagaacaauaagu

SEQ ID NO: 2543317 - RNA, 16 nt, Chlamydophila pneumoniae J138
caagaacaauaaguag

SEQ ID NO: 2543318 - RNA, 14 nt, Chlamydophila pneumoniae J138
caagaacauaaccu

SEQ ID NO: 2543319 - RNA, 22 nt, Chlamydophila pneumoniae J138
caagaacauaaccucggucucg

SEQ ID NO: 2543320 - RNA, 20 nt, Chlamydophila pneumoniae J138
caagaaccuguuuuucuaaa

SEQ ID NO: 2543321 - RNA, 23 nt, Chlamydophila pneumoniae J138
caagaaccuguuuuucuaaaaug

SEQ ID NO: 2543322 - RNA, 18 nt, Chlamydophila pneumoniae J138
caagaacuugagcacaaa

SEQ ID NO: 2543323 - RNA, 22 nt, Chlamydophila pneumoniae J138
caagaagaugauuggacaagug

SEQ ID NO: 2543324 - RNA, 11 nt, Chlamydophila pneumoniae J138
caagaagaugu

SEQ ID NO: 2543325 - RNA, 17 nt, Chlamydophila pneumoniae J138
caagaagcguacuuuac

SEQ ID NO: 2543326 - RNA, 18 nt, Chlamydophila pneumoniae J138
caagaauagcaggaagga

SEQ ID NO: 2543327 - RNA, 18 nt, Chlamydophila pneumoniae J138
caagaaucacugcgugau

SEQ ID NO: 2543328 - RNA, 18 nt, Chlamydophila pneumoniae J138
caagaaugaaucgaagaa

SEQ ID NO: 2543329 - RNA, 17 nt, Chlamydophila pneumoniae J138
caagaauuucuucuuuc

SEQ ID NO: 2543330 - RNA, 15 nt, Chlamydophila pneumoniae J138
caagacaaaaaaggg

SEQ ID NO: 2543331 - RNA, 20 nt, Chlamydophila pneumoniae J138
caagacaaaaaagggaucuc

SEQ ID NO: 2543332 - RNA, 21 nt, Chlamydophila pneumoniae J138
caagacaaaaaagggaucucc

SEQ ID NO: 2543333 - RNA, 15 nt, Chlamydophila pneumoniae J138
caagacaauaaaaaa

SEQ ID NO: 2543334 - RNA, 21 nt, Chlamydophila pneumoniae J138
caagaccacuuaggguucuca

SEQ ID NO: 2543335 - RNA, 16 nt, Chlamydophila pneumoniae J138
caagacgaaagcacau

SEQ ID NO: 2543336 - RNA, 21 nt, Chlamydophila pneumoniae J138
caagacgaaagcacauaagau

SEQ ID NO: 2543337 - RNA, 12 nt, Chlamydophila pneumoniae J138
caagacgacacu

SEQ ID NO: 2543338 - RNA, 17 nt, Chlamydophila pneumoniae J138
caagacuacgacagaag

SEQ ID NO: 2543339 - RNA, 15 nt, Chlamydophila pneumoniae J138
caagacuauagaaaa

SEQ ID NO: 2543340 - RNA, 19 nt, Chlamydophila pneumoniae J138
caagacuauagaaaaggau

SEQ ID NO: 2543341 - RNA, 12 nt, Chlamydophila pneumoniae J138
caagagacaaga

SEQ ID NO: 2543342 - RNA, 18 nt, Chlamydophila pneumoniae J138
caagagacaagaaaauau

SEQ ID NO: 2543343 - RNA, 15 nt, Chlamydophila pneumoniae J138
caagagcccuugugc

SEQ ID NO: 2543344 - RNA, 22 nt, Chlamydophila pneumoniae J138
caagaggcuguccuugcagccc

SEQ ID NO: 2543345 - RNA, 15 nt, Chlamydophila pneumoniae J138
caagaggucgaagau

SEQ ID NO: 2543346 - RNA, 21 nt, Chlamydophila pneumoniae J138
caagaggucgaagauucaaag

SEQ ID NO: 2543347 - RNA, 16 nt, Chlamydophila pneumoniae J138
caagaguucucuuuga

SEQ ID NO: 2543348 - RNA, 16 nt, Chlamydophila pneumoniae J138
caagauaaaucccacu

SEQ ID NO: 2543349 - RNA, 17 nt, Chlamydophila pneumoniae J138
caagauacuacuuacaa

SEQ ID NO: 2543350 - RNA, 20 nt, Chlamydophila pneumoniae J138
caagauacuacuuacaagaa

SEQ ID NO: 2543351 - RNA, 14 nt, Chlamydophila pneumoniae J138
caagaucaaacgaa

SEQ ID NO: 2543352 - RNA, 17 nt, Chlamydophila pneumoniae J138
caagauuaugaugccuc

SEQ ID NO: 2543353 - RNA, 15 nt, Chlamydophila pneumoniae J138
caagauucucagcuu

SEQ ID NO: 2543354 - RNA, 22 nt, Chlamydophila pneumoniae J138
caagauucucagcuucaucaga

SEQ ID NO: 2543355 - RNA, 13 nt, Chlamydophila pneumoniae J138
caagauuuuguag

SEQ ID NO: 2543356 - RNA, 16 nt, Chlamydophila pneumoniae J138
caagcaacucuucagc

SEQ ID NO: 2543357 - RNA, 22 nt, Chlamydophila pneumoniae J138
caagcaggugugugguaaaaau

SEQ ID NO: 2543358 - RNA, 23 nt, Chlamydophila pneumoniae J138
caagcaggugugugguaaaaaua

SEQ ID NO: 2543359 - RNA, 16 nt, Chlamydophila pneumoniae J138
caagcaguaacugcaa

SEQ ID NO: 2543360 - RNA, 14 nt, Chlamydophila pneumoniae J138
caagcauaaacucc

SEQ ID NO: 2543361 - RNA, 14 nt, Chlamydophila pneumoniae J138
caagcauccuagaa

SEQ ID NO: 2543362 - RNA, 22 nt, Chlamydophila pneumoniae J138
caagcauccuagaacuugggau

SEQ ID NO: 2543363 - RNA, 14 nt, Chlamydophila pneumoniae J138
caagcucaagagca

SEQ ID NO: 2543364 - RNA, 19 nt, Chlamydophila pneumoniae J138
caagcucaagagcaugcuu

SEQ ID NO: 2543365 - RNA, 12 nt, Chlamydophila pneumoniae J138
caagcucgcgua

SEQ ID NO: 2543366 - RNA, 22 nt, Chlamydophila pneumoniae J138
caagcucuggauugaaagagcu

SEQ ID NO: 2543367 - RNA, 11 nt, Chlamydophila pneumoniae J138
caaggaaaauu

SEQ ID NO: 2543368 - RNA, 19 nt, Chlamydophila pneumoniae J138
caaggagucacuggcauca

SEQ ID NO: 2543369 - RNA, 15 nt, Chlamydophila pneumoniae J138
caaggauuaugaauc

SEQ ID NO: 2543370 - RNA, 17 nt, Chlamydophila pneumoniae J138
caaggauuaugaauccu

SEQ ID NO: 2543371 - RNA, 19 nt, Chlamydophila pneumoniae J138
caaggauuaugaauccuug

SEQ ID NO: 2543372 - RNA, 22 nt, Chlamydophila pneumoniae J138
caaggauuaugaauccuugaaa

SEQ ID NO: 2543373 - RNA, 21 nt, Chlamydophila pneumoniae J138
caaggcaaaaaguugaggaaa

SEQ ID NO: 2543374 - RNA, 18 nt, Chlamydophila pneumoniae J138
caaggccuaaucuuguag

SEQ ID NO: 2543375 - RNA, 23 nt, Chlamydophila pneumoniae J138
caaggcgaguguagauuauugau

SEQ ID NO: 2543376 - RNA, 17 nt, Chlamydophila pneumoniae J138
caaggcgccuaacaacu

SEQ ID NO: 2543377 - RNA, 19 nt, Chlamydophila pneumoniae J138
caaggcugcugauccaaaa

SEQ ID NO: 2543378 - RNA, 15 nt, Chlamydophila pneumoniae J138
caagggaaagaaacu

SEQ ID NO: 2543379 - RNA, 20 nt, Chlamydophila pneumoniae J138
caaggggcguucuugaaaaa

SEQ ID NO: 2543380 - RNA, 15 nt, Chlamydophila pneumoniae J138
caagguaacauccau

SEQ ID NO: 2543381 - RNA, 16 nt, Chlamydophila pneumoniae J138
caagguaacauccaua

SEQ ID NO: 2543382 - RNA, 21 nt, Chlamydophila pneumoniae J138
caagguaacauccauagagaa

SEQ ID NO: 2543383 - RNA, 22 nt, Chlamydophila pneumoniae J138
caagguaacauccauagagaac

SEQ ID NO: 2543384 - RNA, 15 nt, Chlamydophila pneumoniae J138
caagguacuuuauag

SEQ ID NO: 2543385 - RNA, 23 nt, Chlamydophila pneumoniae J138
caaggucacagcauuuucucuga

SEQ ID NO: 2543386 - RNA, 20 nt, Chlamydophila pneumoniae J138
caagguguugauuucgugaa

SEQ ID NO: 2543387 - RNA, 12 nt, Chlamydophila pneumoniae J138
caaguaaagaaa

SEQ ID NO: 2543388 - RNA, 18 nt, Chlamydophila pneumoniae J138
caaguaaucaugauaaaa

SEQ ID NO: 2543389 - RNA, 18 nt, Chlamydophila pneumoniae J138
caaguaccuucucgucau

SEQ ID NO: 2543390 - RNA, 15 nt, Chlamydophila pneumoniae J138
caaguagcucucucc

SEQ ID NO: 2543391 - RNA, 14 nt, Chlamydophila pneumoniae J138
caagucauaaagau

SEQ ID NO: 2543392 - RNA, 16 nt, Chlamydophila pneumoniae J138
caaguccgugagagga

SEQ ID NO: 2543393 - RNA, 21 nt, Chlamydophila pneumoniae J138
caagucugcuugggacauuuc

SEQ ID NO: 2543394 - RNA, 22 nt, Chlamydophila pneumoniae J138
caagugcucaguaaauauuuua

SEQ ID NO: 2543395 - RNA, 19 nt, Chlamydophila pneumoniae J138
caagugugcggucucaugu

SEQ ID NO: 2543396 - RNA, 15 nt, Chlamydophila pneumoniae J138
caaguguguauugua

SEQ ID NO: 2543397 - RNA, 19 nt, Chlamydophila pneumoniae J138
caaguucuaccuauauuuc

SEQ ID NO: 2543398 - RNA, 19 nt, Chlamydophila pneumoniae J138
caaguugacgcacuucuuc

SEQ ID NO: 2543399 - RNA, 14 nt, Chlamydophila pneumoniae J138
caaguugagagaga

SEQ ID NO: 2543400 - RNA, 23 nt, Chlamydophila pneumoniae J138
caauaaaaggcuauuguguuuuu

SEQ ID NO: 2543401 - RNA, 22 nt, Chlamydophila pneumoniae J138
caauaaaaggguagcgaaugaa

SEQ ID NO: 2543402 - RNA, 18 nt, Chlamydophila pneumoniae J138
caauaaauccaaaaaaug

SEQ ID NO: 2543403 - RNA, 18 nt, Chlamydophila pneumoniae J138
caauaaccagaagacucc

SEQ ID NO: 2543404 - RNA, 22 nt, Chlamydophila pneumoniae J138
caauaaccaggggcuuuccuuc

SEQ ID NO: 2543405 - RNA, 18 nt, Chlamydophila pneumoniae J138
caauaagcuugccagcag

SEQ ID NO: 2543406 - RNA, 20 nt, Chlamydophila pneumoniae J138
caauaagcuugccagcagaa

SEQ ID NO: 2543407 - RNA, 19 nt, Chlamydophila pneumoniae J138
caauaauaacgcuccaaug

SEQ ID NO: 2543408 - RNA, 21 nt, Chlamydophila pneumoniae J138
caauaaucacuguuugauuau

SEQ ID NO: 2543409 - RNA, 23 nt, Chlamydophila pneumoniae J138
caauaaucggccgaguuucuccg

SEQ ID NO: 2543410 - RNA, 15 nt, Chlamydophila pneumoniae J138
caauaauuucaaaga

SEQ ID NO: 2543411 - RNA, 16 nt, Chlamydophila pneumoniae J138
caauaauuucaaagau

SEQ ID NO: 2543412 - RNA, 23 nt, Chlamydophila pneumoniae J138
caauacagauguaaaugcuccuu

SEQ ID NO: 2543413 - RNA, 14 nt, Chlamydophila pneumoniae J138
caauaccagauaaa

SEQ ID NO: 2543414 - RNA, 14 nt, Chlamydophila pneumoniae J138
caauacgaucuuuu

SEQ ID NO: 2543415 - RNA, 20 nt, Chlamydophila pneumoniae J138
caauacgccgggccacuuca

SEQ ID NO: 2543416 - RNA, 23 nt, Chlamydophila pneumoniae J138
caauacuggagagguaaccagag

SEQ ID NO: 2543417 - RNA, 19 nt, Chlamydophila pneumoniae J138
caauagcaauggcuuuuuu

SEQ ID NO: 2543418 - RNA, 13 nt, Chlamydophila pneumoniae J138
caauagcagcagc

SEQ ID NO: 2543419 - RNA, 16 nt, Chlamydophila pneumoniae J138
caauagccaaagacuc

SEQ ID NO: 2543420 - RNA, 12 nt, Chlamydophila pneumoniae J138
caauagcuucca

SEQ ID NO: 2543421 - RNA, 18 nt, Chlamydophila pneumoniae J138
caauaggaauuagagaaa

SEQ ID NO: 2543422 - RNA, 22 nt, Chlamydophila pneumoniae J138
caauaggccagaauguacauag

SEQ ID NO: 2543423 - RNA, 17 nt, Chlamydophila pneumoniae J138
caauauaaaugcuauuu

SEQ ID NO: 2543424 - RNA, 20 nt, Chlamydophila pneumoniae J138
caauauaaaugcuauuuucc

SEQ ID NO: 2543425 - RNA, 21 nt, Chlamydophila pneumoniae J138
caauauaaaugcuauuuuccu

SEQ ID NO: 2543426 - RNA, 13 nt, Chlamydophila pneumoniae J138
caauauagagaac

SEQ ID NO: 2543427 - RNA, 21 nt, Chlamydophila pneumoniae J138
caauauagagaacuccauuca

SEQ ID NO: 2543428 - RNA, 22 nt, Chlamydophila pneumoniae J138
caauauagagaacuccauucag

SEQ ID NO: 2543429 - RNA, 13 nt, Chlamydophila pneumoniae J138
caaucaauaaaau

SEQ ID NO: 2543430 - RNA, 15 nt, Chlamydophila pneumoniae J138
caaucacacuacauu

SEQ ID NO: 2543431 - RNA, 15 nt, Chlamydophila pneumoniae J138
caaucacauaaagau

SEQ ID NO: 2543432 - RNA, 23 nt, Chlamydophila pneumoniae J138
caaucaccguacuucccucauga

SEQ ID NO: 2543433 - RNA, 14 nt, Chlamydophila pneumoniae J138
caaucaguucaucu

SEQ ID NO: 2543434 - RNA, 19 nt, Chlamydophila pneumoniae J138
caauccacgcuccucuaac

SEQ ID NO: 2543435 - RNA, 17 nt, Chlamydophila pneumoniae J138
caaucccccagcauuca

SEQ ID NO: 2543436 - RNA, 19 nt, Chlamydophila pneumoniae J138
caauccccugcaucucugc

SEQ ID NO: 2543437 - RNA, 20 nt, Chlamydophila pneumoniae J138
caaucccgaguccuaaaauu

SEQ ID NO: 2543438 - RNA, 12 nt, Chlamydophila pneumoniae J138
caaucccucuac

SEQ ID NO: 2543439 - RNA, 14 nt, Chlamydophila pneumoniae J138
caaucccucuaccc

SEQ ID NO: 2543440 - RNA, 15 nt, Chlamydophila pneumoniae J138
caaucgcaucaaaaa

SEQ ID NO: 2543441 - RNA, 22 nt, Chlamydophila pneumoniae J138
caaucguagccccauagagccu

SEQ ID NO: 2543442 - RNA, 14 nt, Chlamydophila pneumoniae J138
caaucuaaaaucac

SEQ ID NO: 2543443 - RNA, 21 nt, Chlamydophila pneumoniae J138
caaucuaaaaucacacuaaau

SEQ ID NO: 2543444 - RNA, 19 nt, Chlamydophila pneumoniae J138
caaucuaaagguuuuaaau

SEQ ID NO: 2543445 - RNA, 19 nt, Chlamydophila pneumoniae J138
caaucucuagggauaauua

SEQ ID NO: 2543446 - RNA, 14 nt, Chlamydophila pneumoniae J138
caaucucuuuaaaa

SEQ ID NO: 2543447 - RNA, 13 nt, Chlamydophila pneumoniae J138
caaucugcugaag

SEQ ID NO: 2543448 - RNA, 16 nt, Chlamydophila pneumoniae J138
caaucugcugaaggga

SEQ ID NO: 2543449 - RNA, 17 nt, Chlamydophila pneumoniae J138
caaucugguuaagcacc

SEQ ID NO: 2543450 - RNA, 18 nt, Chlamydophila pneumoniae J138
caaucugguuaagcacca

SEQ ID NO: 2543451 - RNA, 14 nt, Chlamydophila pneumoniae J138
caaucuuccuuaac

SEQ ID NO: 2543452 - RNA, 19 nt, Chlamydophila pneumoniae J138
caaucuugagcauccaaaa

SEQ ID NO: 2543453 - RNA, 19 nt, Chlamydophila pneumoniae J138
caaucuuucauucccuuuu

SEQ ID NO: 2543454 - RNA, 14 nt, Chlamydophila pneumoniae J138
caaucuuucuucua

SEQ ID NO: 2543455 - RNA, 10 nt, Chlamydophila pneumoniae J138
caaucuuuga

SEQ ID NO: 2543456 - RNA, 15 nt, Chlamydophila pneumoniae J138
caaugaaggccaaga

SEQ ID NO: 2543457 - RNA, 21 nt, Chlamydophila pneumoniae J138
caaugacuguaggaccugugu

SEQ ID NO: 2543458 - RNA, 16 nt, Chlamydophila pneumoniae J138
caaugagcucuauuuc

SEQ ID NO: 2543459 - RNA, 15 nt, Chlamydophila pneumoniae J138
caaugauauaaaagc

SEQ ID NO: 2543460 - RNA, 14 nt, Chlamydophila pneumoniae J138
caaugauuucucua

SEQ ID NO: 2543461 - RNA, 19 nt, Chlamydophila pneumoniae J138
caaugcaaccuguaaagac

SEQ ID NO: 2543462 - RNA, 16 nt, Chlamydophila pneumoniae J138
caaugcagcuaacgaa

SEQ ID NO: 2543463 - RNA, 15 nt, Chlamydophila pneumoniae J138
caaugcaugaaucuc

SEQ ID NO: 2543464 - RNA, 11 nt, Chlamydophila pneumoniae J138
caaugcauuug

SEQ ID NO: 2543465 - RNA, 16 nt, Chlamydophila pneumoniae J138
caaugcuaucuccaga

SEQ ID NO: 2543466 - RNA, 21 nt, Chlamydophila pneumoniae J138
caaugcuugucgcgacaagac

SEQ ID NO: 2543467 - RNA, 15 nt, Chlamydophila pneumoniae J138
caauggcgauaaaug

SEQ ID NO: 2543468 - RNA, 20 nt, Chlamydophila pneumoniae J138
caauggcuuuuuuuguccca

SEQ ID NO: 2543469 - RNA, 17 nt, Chlamydophila pneumoniae J138
caaugucgucucagaaa

SEQ ID NO: 2543470 - RNA, 20 nt, Chlamydophila pneumoniae J138
caauguuaaucuaauuuuag

SEQ ID NO: 2543471 - RNA, 20 nt, Chlamydophila pneumoniae J138
caauguuuagaauuuguccu

SEQ ID NO: 2543472 - RNA, 20 nt, Chlamydophila pneumoniae J138
caauguuuguaguguugaau

SEQ ID NO: 2543473 - RNA, 18 nt, Chlamydophila pneumoniae J138
caauuaaaaaauuaucuc

SEQ ID NO: 2543474 - RNA, 20 nt, Chlamydophila pneumoniae J138
caauuccauagguuagaaau

SEQ ID NO: 2543475 - RNA, 15 nt, Chlamydophila pneumoniae J138
caauuccgaagaaga

SEQ ID NO: 2543476 - RNA, 18 nt, Chlamydophila pneumoniae J138
caauuccgaagaagaaag

SEQ ID NO: 2543477 - RNA, 17 nt, Chlamydophila pneumoniae J138
caauuccuaaaacaaga

SEQ ID NO: 2543478 - RNA, 20 nt, Chlamydophila pneumoniae J138
caauuccuaaaacaagaaga

SEQ ID NO: 2543479 - RNA, 15 nt, Chlamydophila pneumoniae J138
caauucgguagagcu

SEQ ID NO: 2543480 - RNA, 17 nt, Chlamydophila pneumoniae J138
caauucuuaaaaagcua

SEQ ID NO: 2543481 - RNA, 21 nt, Chlamydophila pneumoniae J138
caauucuuaaaaagcuaaaca

SEQ ID NO: 2543482 - RNA, 15 nt, Chlamydophila pneumoniae J138
caauucuucaugcug

SEQ ID NO: 2543483 - RNA, 13 nt, Chlamydophila pneumoniae J138
caauugaaaauuc

SEQ ID NO: 2543484 - RNA, 20 nt, Chlamydophila pneumoniae J138
caauugccaugcccacagac

SEQ ID NO: 2543485 - RNA, 15 nt, Chlamydophila pneumoniae J138
caauuguaaauacaa

SEQ ID NO: 2543486 - RNA, 18 nt, Chlamydophila pneumoniae J138
caauuguaaauacaaaac

SEQ ID NO: 2543487 - RNA, 22 nt, Chlamydophila pneumoniae J138
caauuguaucuguauccuuccu

SEQ ID NO: 2543488 - RNA, 17 nt, Chlamydophila pneumoniae J138
caauuuccugcauggcu

SEQ ID NO: 2543489 - RNA, 16 nt, Chlamydophila pneumoniae J138
caauuuggauuuaugu

SEQ ID NO: 2543490 - RNA, 23 nt, Chlamydophila pneumoniae J138
caauuuguuucuucugugcauca

SEQ ID NO: 2543491 - RNA, 18 nt, Chlamydophila pneumoniae J138
caauuuucuucagcacuu

SEQ ID NO: 2543492 - RNA, 18 nt, Chlamydophila pneumoniae J138
caauuuuuauaauauuuu

SEQ ID NO: 2543493 - RNA, 13 nt, Chlamydophila pneumoniae J138
cacaaaaccugga

SEQ ID NO: 2543494 - RNA, 15 nt, Chlamydophila pneumoniae J138
cacaaaauaaaaccc

SEQ ID NO: 2543495 - RNA, 12 nt, Chlamydophila pneumoniae J138
cacaaaauuugu

SEQ ID NO: 2543496 - RNA, 19 nt, Chlamydophila pneumoniae J138
cacaaacaacagaaauguu

SEQ ID NO: 2543497 - RNA, 17 nt, Chlamydophila pneumoniae J138
cacaaaccucuaaaaac

SEQ ID NO: 2543498 - RNA, 16 nt, Chlamydophila pneumoniae J138
cacaaagaauucagag

SEQ ID NO: 2543499 - RNA, 20 nt, Chlamydophila pneumoniae J138
cacaaaucauuuaaagcuga

SEQ ID NO: 2543500 - RNA, 14 nt, Chlamydophila pneumoniae J138
cacaacucuuuaau

SEQ ID NO: 2543501 - RNA, 15 nt, Chlamydophila pneumoniae J138
cacaagugcauuauc

SEQ ID NO: 2543502 - RNA, 15 nt, Chlamydophila pneumoniae J138
cacaauauaaaugcu

SEQ ID NO: 2543503 - RNA, 22 nt, Chlamydophila pneumoniae J138
cacaauccucacuauuaauacu

SEQ ID NO: 2543504 - RNA, 13 nt, Chlamydophila pneumoniae J138
cacaaucgcauca

SEQ ID NO: 2543505 - RNA, 18 nt, Chlamydophila pneumoniae J138
cacaauuccuaaaacaag

SEQ ID NO: 2543506 - RNA, 17 nt, Chlamydophila pneumoniae J138
cacaauuguaaauacaa

SEQ ID NO: 2543507 - RNA, 16 nt, Chlamydophila pneumoniae J138
cacaauuuuaaaaucu

SEQ ID NO: 2543508 - RNA, 19 nt, Chlamydophila pneumoniae J138
cacacgaucuucggaauac

SEQ ID NO: 2543509 - RNA, 22 nt, Chlamydophila pneumoniae J138
cacacugcuuacaauugaaaau

SEQ ID NO: 2543510 - RNA, 15 nt, Chlamydophila pneumoniae J138
cacagaaugauaaga

SEQ ID NO: 2543511 - RNA, 20 nt, Chlamydophila pneumoniae J138
cacagaaugauaagaaagcu

SEQ ID NO: 2543512 - RNA, 17 nt, Chlamydophila pneumoniae J138
cacagacugcaggaaau

SEQ ID NO: 2543513 - RNA, 15 nt, Chlamydophila pneumoniae J138
cacagacuugaggaa

SEQ ID NO: 2543514 - RNA, 21 nt, Chlamydophila pneumoniae J138
cacagagaacaauaaacgaga

SEQ ID NO: 2543515 - RNA, 14 nt, Chlamydophila pneumoniae J138
cacagagaauugca

SEQ ID NO: 2543516 - RNA, 22 nt, Chlamydophila pneumoniae J138
cacagagaugcuucuaaacaau

SEQ ID NO: 2543517 - RNA, 15 nt, Chlamydophila pneumoniae J138
cacagauaggaacca

SEQ ID NO: 2543518 - RNA, 19 nt, Chlamydophila pneumoniae J138
cacagauguaaucuugauc

SEQ ID NO: 2543519 - RNA, 17 nt, Chlamydophila pneumoniae J138
cacagcuaaucaaucca

SEQ ID NO: 2543520 - RNA, 17 nt, Chlamydophila pneumoniae J138
cacagcuaugauugaaa

SEQ ID NO: 2543521 - RNA, 14 nt, Chlamydophila pneumoniae J138
cacagcuguacaga

SEQ ID NO: 2543522 - RNA, 17 nt, Chlamydophila pneumoniae J138
cacaggcauggucuccc

SEQ ID NO: 2543523 - RNA, 19 nt, Chlamydophila pneumoniae J138
cacaggggaacgcucucua

SEQ ID NO: 2543524 - RNA, 13 nt, Chlamydophila pneumoniae J138
cacauaaaauaau

SEQ ID NO: 2543525 - RNA, 17 nt, Chlamydophila pneumoniae J138
cacauaaagaucuuuau

SEQ ID NO: 2543526 - RNA, 23 nt, Chlamydophila pneumoniae J138
cacauacucuucauccugaucuu

SEQ ID NO: 2543527 - RNA, 14 nt, Chlamydophila pneumoniae J138
cacauagaaacagu

SEQ ID NO: 2543528 - RNA, 22 nt, Chlamydophila pneumoniae J138
cacauccuuguagaacuucuca

SEQ ID NO: 2543529 - RNA, 14 nt, Chlamydophila pneumoniae J138
cacaucuuucucua

SEQ ID NO: 2543530 - RNA, 17 nt, Chlamydophila pneumoniae J138
cacauuccaagaaaaau

SEQ ID NO: 2543531 - RNA, 14 nt, Chlamydophila pneumoniae J138
cacauucuucugau

SEQ ID NO: 2543532 - RNA, 18 nt, Chlamydophila pneumoniae J138
cacauugcgggcucaaag

SEQ ID NO: 2543533 - RNA, 17 nt, Chlamydophila pneumoniae J138
cacauuguuuaaguccu

SEQ ID NO: 2543534 - RNA, 18 nt, Chlamydophila pneumoniae J138
cacauuugcuuuaacaga

SEQ ID NO: 2543535 - RNA, 15 nt, Chlamydophila pneumoniae J138
caccaacaacaauaa

SEQ ID NO: 2543536 - RNA, 13 nt, Chlamydophila pneumoniae J138
caccaagggaugc

SEQ ID NO: 2543537 - RNA, 17 nt, Chlamydophila pneumoniae J138
caccaaugauaauuuca

SEQ ID NO: 2543538 - RNA, 13 nt, Chlamydophila pneumoniae J138
caccaauuuuuuc

SEQ ID NO: 2543539 - RNA, 19 nt, Chlamydophila pneumoniae J138
caccacgaacuucagcaag

SEQ ID NO: 2543540 - RNA, 23 nt, Chlamydophila pneumoniae J138
caccacgaacuucagcaagaaaa

SEQ ID NO: 2543541 - RNA, 19 nt, Chlamydophila pneumoniae J138
caccagaagcaacuaaacu

SEQ ID NO: 2543542 - RNA, 21 nt, Chlamydophila pneumoniae J138
caccagaaggaagguucucaa

SEQ ID NO: 2543543 - RNA, 17 nt, Chlamydophila pneumoniae J138
caccagcucgagaucuu

SEQ ID NO: 2543544 - RNA, 17 nt, Chlamydophila pneumoniae J138
caccaggagcuccuccu

SEQ ID NO: 2543545 - RNA, 18 nt, Chlamydophila pneumoniae J138
caccaggagcuccuccuu

SEQ ID NO: 2543546 - RNA, 18 nt, Chlamydophila pneumoniae J138
caccagggguuucuaaau

SEQ ID NO: 2543547 - RNA, 15 nt, Chlamydophila pneumoniae J138
caccagguccuucug

SEQ ID NO: 2543548 - RNA, 13 nt, Chlamydophila pneumoniae J138
caccauaauauaa

SEQ ID NO: 2543549 - RNA, 13 nt, Chlamydophila pneumoniae J138
caccauauucuca

SEQ ID NO: 2543550 - RNA, 19 nt, Chlamydophila pneumoniae J138
caccaucacauccuguagu

SEQ ID NO: 2543551 - RNA, 21 nt, Chlamydophila pneumoniae J138
caccauccaaagcuauuucuc

SEQ ID NO: 2543552 - RNA, 20 nt, Chlamydophila pneumoniae J138
caccaucuguugaucuucua

SEQ ID NO: 2543553 - RNA, 17 nt, Chlamydophila pneumoniae J138
caccauuuuugaauaug

SEQ ID NO: 2543554 - RNA, 22 nt, Chlamydophila pneumoniae J138
cacccaaacugaugccaagaaa

SEQ ID NO: 2543555 - RNA, 12 nt, Chlamydophila pneumoniae J138
cacccucccuca

SEQ ID NO: 2543556 - RNA, 22 nt, Chlamydophila pneumoniae J138
caccgcgcauagcaacuacaga

SEQ ID NO: 2543557 - RNA, 15 nt, Chlamydophila pneumoniae J138
caccuaaaaugcagg

SEQ ID NO: 2543558 - RNA, 16 nt, Chlamydophila pneumoniae J138
caccuaaaguuugagc

SEQ ID NO: 2543559 - RNA, 18 nt, Chlamydophila pneumoniae J138
caccuaaaguuugagcua

SEQ ID NO: 2543560 - RNA, 11 nt, Chlamydophila pneumoniae J138
caccugaagag

SEQ ID NO: 2543561 - RNA, 12 nt, Chlamydophila pneumoniae J138
caccugcccauu

SEQ ID NO: 2543562 - RNA, 14 nt, Chlamydophila pneumoniae J138
caccuuacauccaa

SEQ ID NO: 2543563 - RNA, 20 nt, Chlamydophila pneumoniae J138
caccuuagagugacucauca

SEQ ID NO: 2543564 - RNA, 22 nt, Chlamydophila pneumoniae J138
cacgaauccguaccagcugaua

SEQ ID NO: 2543565 - RNA, 17 nt, Chlamydophila pneumoniae J138
cacgaauuucuaacuua

SEQ ID NO: 2543566 - RNA, 21 nt, Chlamydophila pneumoniae J138
cacgaccuacaccaucuuuaa

SEQ ID NO: 2543567 - RNA, 18 nt, Chlamydophila pneumoniae J138
cacgaccucgaauuccuc

SEQ ID NO: 2543568 - RNA, 20 nt, Chlamydophila pneumoniae J138
cacgaccucgaauuccuccc

SEQ ID NO: 2543569 - RNA, 15 nt, Chlamydophila pneumoniae J138
cacgagauucugcuu

SEQ ID NO: 2543570 - RNA, 17 nt, Chlamydophila pneumoniae J138
cacgaggccauccuuuu

SEQ ID NO: 2543571 - RNA, 16 nt, Chlamydophila pneumoniae J138
cacgagucccuucuuu

SEQ ID NO: 2543572 - RNA, 17 nt, Chlamydophila pneumoniae J138
cacgagucccuucuuuc

SEQ ID NO: 2543573 - RNA, 17 nt, Chlamydophila pneumoniae J138
cacgaucuucggaauac

SEQ ID NO: 2543574 - RNA, 18 nt, Chlamydophila pneumoniae J138
cacgccacaaguuauccu

SEQ ID NO: 2543575 - RNA, 12 nt, Chlamydophila pneumoniae J138
cacgccuauaga

SEQ ID NO: 2543576 - RNA, 17 nt, Chlamydophila pneumoniae J138
cacgccuccuucaaaga

SEQ ID NO: 2543577 - RNA, 20 nt, Chlamydophila pneumoniae J138
cacgccuccuucaaagauau

SEQ ID NO: 2543578 - RNA, 23 nt, Chlamydophila pneumoniae J138
cacgcucacgagucccuucuuuc

SEQ ID NO: 2543579 - RNA, 13 nt, Chlamydophila pneumoniae J138
cacggaaauauuc

SEQ ID NO: 2543580 - RNA, 17 nt, Chlamydophila pneumoniae J138
cacggacacuauuaucu

SEQ ID NO: 2543581 - RNA, 14 nt, Chlamydophila pneumoniae J138
cacggacuccgucu

SEQ ID NO: 2543582 - RNA, 17 nt, Chlamydophila pneumoniae J138
cacggacuccgucuccu

SEQ ID NO: 2543583 - RNA, 17 nt, Chlamydophila pneumoniae J138
cacggauuuucucuaca

SEQ ID NO: 2543584 - RNA, 23 nt, Chlamydophila pneumoniae J138
cacggcggagaauaucaucuucc

SEQ ID NO: 2543585 - RNA, 19 nt, Chlamydophila pneumoniae J138
cacguucccacgagcacaa

SEQ ID NO: 2543586 - RNA, 15 nt, Chlamydophila pneumoniae J138
cacguucugcaacaa

SEQ ID NO: 2543587 - RNA, 16 nt, Chlamydophila pneumoniae J138
cacguuugacaaauuu

SEQ ID NO: 2543588 - RNA, 16 nt, Chlamydophila pneumoniae J138
cacuaaaagggaagcu

SEQ ID NO: 2543589 - RNA, 17 nt, Chlamydophila pneumoniae J138
cacuaaaagggaagcuu

SEQ ID NO: 2543590 - RNA, 20 nt, Chlamydophila pneumoniae J138
cacuaaacgaucaaauuccu

SEQ ID NO: 2543591 - RNA, 15 nt, Chlamydophila pneumoniae J138
cacuaaccgaugaua

SEQ ID NO: 2543592 - RNA, 18 nt, Chlamydophila pneumoniae J138
cacuaaguuuaggcagga

SEQ ID NO: 2543593 - RNA, 23 nt, Chlamydophila pneumoniae J138
cacuaaucucaggcauucuucau

SEQ ID NO: 2543594 - RNA, 17 nt, Chlamydophila pneumoniae J138
cacuacauuauaaucac

SEQ ID NO: 2543595 - RNA, 13 nt, Chlamydophila pneumoniae J138
cacuacuguucua

SEQ ID NO: 2543596 - RNA, 12 nt, Chlamydophila pneumoniae J138
cacuagcagaag

SEQ ID NO: 2543597 - RNA, 21 nt, Chlamydophila pneumoniae J138
cacuauccggaaggaguucuu

SEQ ID NO: 2543598 - RNA, 12 nt, Chlamydophila pneumoniae J138
cacuaucuucua

SEQ ID NO: 2543599 - RNA, 18 nt, Chlamydophila pneumoniae J138
cacuauguguuuccuuuu

SEQ ID NO: 2543600 - RNA, 16 nt, Chlamydophila pneumoniae J138
cacuauuaucugcaga

SEQ ID NO: 2543601 - RNA, 14 nt, Chlamydophila pneumoniae J138
cacucaaacccucu

SEQ ID NO: 2543602 - RNA, 14 nt, Chlamydophila pneumoniae J138
cacucagcucccau

SEQ ID NO: 2543603 - RNA, 12 nt, Chlamydophila pneumoniae J138
cacucccuaggu

SEQ ID NO: 2543604 - RNA, 14 nt, Chlamydophila pneumoniae J138
cacuccugaaggga

SEQ ID NO: 2543605 - RNA, 18 nt, Chlamydophila pneumoniae J138
cacucgauuauuucuugu

SEQ ID NO: 2543606 - RNA, 18 nt, Chlamydophila pneumoniae J138
cacucguugccaaucuuu

SEQ ID NO: 2543607 - RNA, 13 nt, Chlamydophila pneumoniae J138
cacucuaagcgaa

SEQ ID NO: 2543608 - RNA, 20 nt, Chlamydophila pneumoniae J138
cacucuaucauaucuucaaa

SEQ ID NO: 2543609 - RNA, 21 nt, Chlamydophila pneumoniae J138
cacucucugcagggaauccug

SEQ ID NO: 2543610 - RNA, 15 nt, Chlamydophila pneumoniae J138
cacugaacgccaucu

SEQ ID NO: 2543611 - RNA, 20 nt, Chlamydophila pneumoniae J138
cacugaacgccaucuccaca

SEQ ID NO: 2543612 - RNA, 14 nt, Chlamydophila pneumoniae J138
cacugaugaaaaag

SEQ ID NO: 2543613 - RNA, 18 nt, Chlamydophila pneumoniae J138
cacugaugaaaaagcuga

SEQ ID NO: 2543614 - RNA, 13 nt, Chlamydophila pneumoniae J138
cacugcgagagaa

SEQ ID NO: 2543615 - RNA, 24 nt, Chlamydophila pneumoniae J138
cacuggaaugacauaagcacucuu

SEQ ID NO: 2543616 - RNA, 17 nt, Chlamydophila pneumoniae J138
cacuguaucagcaagcc

SEQ ID NO: 2543617 - RNA, 18 nt, Chlamydophila pneumoniae J138
cacuguuuuccagaaauc

SEQ ID NO: 2543618 - RNA, 23 nt, Chlamydophila pneumoniae J138
cacuuaauaauguuuuaauagcu

SEQ ID NO: 2543619 - RNA, 16 nt, Chlamydophila pneumoniae J138
cacuuacuucaagaaa

SEQ ID NO: 2543620 - RNA, 17 nt, Chlamydophila pneumoniae J138
cacuuacuucaagaaaa

SEQ ID NO: 2543621 - RNA, 13 nt, Chlamydophila pneumoniae J138
cacuuauguucua

SEQ ID NO: 2543622 - RNA, 14 nt, Chlamydophila pneumoniae J138
cacuucagcacgaa

SEQ ID NO: 2543623 - RNA, 18 nt, Chlamydophila pneumoniae J138
cacuucucuguaucgaua

SEQ ID NO: 2543624 - RNA, 19 nt, Chlamydophila pneumoniae J138
cacuucuuuaggagcauag

SEQ ID NO: 2543625 - RNA, 20 nt, Chlamydophila pneumoniae J138
cacuugcauggauccuucau

SEQ ID NO: 2543626 - RNA, 18 nt, Chlamydophila pneumoniae J138
cacuugcgguuuuggaua

SEQ ID NO: 2543627 - RNA, 18 nt, Chlamydophila pneumoniae J138
cacuugcucuuuaggaua

SEQ ID NO: 2543628 - RNA, 17 nt, Chlamydophila pneumoniae J138
cacuuucuuuuuuaauc

SEQ ID NO: 2543629 - RNA, 17 nt, Chlamydophila pneumoniae J138
cacuuugacuauuggga

SEQ ID NO: 2543630 - RNA, 15 nt, Chlamydophila pneumoniae J138
cacuuuguuuuucaa

SEQ ID NO: 2543631 - RNA, 14 nt, Chlamydophila pneumoniae J138
cagaaaaagaacau

SEQ ID NO: 2543632 - RNA, 14 nt, Chlamydophila pneumoniae J138
cagaaaaaucuaac

SEQ ID NO: 2543633 - RNA, 14 nt, Chlamydophila pneumoniae J138
cagaaacaugaagu

SEQ ID NO: 2543634 - RNA, 21 nt, Chlamydophila pneumoniae J138
cagaaacuagggagaucuuau

SEQ ID NO: 2543635 - RNA, 12 nt, Chlamydophila pneumoniae J138
cagaaacuccag

SEQ ID NO: 2543636 - RNA, 19 nt, Chlamydophila pneumoniae J138
cagaaacuggcggauugcu

SEQ ID NO: 2543637 - RNA, 18 nt, Chlamydophila pneumoniae J138
cagaaagaaggucuucca

SEQ ID NO: 2543638 - RNA, 21 nt, Chlamydophila pneumoniae J138
cagaaagaaggucuuccaucu

SEQ ID NO: 2543639 - RNA, 15 nt, Chlamydophila pneumoniae J138
cagaaagacgaucuu

SEQ ID NO: 2543640 - RNA, 17 nt, Chlamydophila pneumoniae J138
cagaaagagcuaaagaa

SEQ ID NO: 2543641 - RNA, 18 nt, Chlamydophila pneumoniae J138
cagaaagauaucccaaag

SEQ ID NO: 2543642 - RNA, 22 nt, Chlamydophila pneumoniae J138
cagaaagauugugcucacgaau

SEQ ID NO: 2543643 - RNA, 18 nt, Chlamydophila pneumoniae J138
cagaaaggagauccacag

SEQ ID NO: 2543644 - RNA, 20 nt, Chlamydophila pneumoniae J138
cagaaaggcuuuucuuuuuc

SEQ ID NO: 2543645 - RNA, 21 nt, Chlamydophila pneumoniae J138
cagaaauacguccagccugca

SEQ ID NO: 2543646 - RNA, 17 nt, Chlamydophila pneumoniae J138
cagaaaugaagccaaaa

SEQ ID NO: 2543647 - RNA, 18 nt, Chlamydophila pneumoniae J138
cagaaauugcuucuucca

SEQ ID NO: 2543648 - RNA, 19 nt, Chlamydophila pneumoniae J138
cagaacaacgcugcuucuc

SEQ ID NO: 2543649 - RNA, 13 nt, Chlamydophila pneumoniae J138
cagaacuucucca

SEQ ID NO: 2543650 - RNA, 13 nt, Chlamydophila pneumoniae J138
cagaagcaaaggu

SEQ ID NO: 2543651 - RNA, 21 nt, Chlamydophila pneumoniae J138
cagaagcaacuaaacucucca

SEQ ID NO: 2543652 - RNA, 17 nt, Chlamydophila pneumoniae J138
cagaagccaccaaaaau

SEQ ID NO: 2543653 - RNA, 20 nt, Chlamydophila pneumoniae J138
cagaaggacccuccuuugua

SEQ ID NO: 2543654 - RNA, 14 nt, Chlamydophila pneumoniae J138
cagaagguaaauuu

SEQ ID NO: 2543655 - RNA, 15 nt, Chlamydophila pneumoniae J138
cagaagguaaauuuu

SEQ ID NO: 2543656 - RNA, 20 nt, Chlamydophila pneumoniae J138
cagaagguuccacagagacc

SEQ ID NO: 2543657 - RNA, 17 nt, Chlamydophila pneumoniae J138
cagaaguccuaucaaag

SEQ ID NO: 2543658 - RNA, 16 nt, Chlamydophila pneumoniae J138
cagaagucuuggacgu

SEQ ID NO: 2543659 - RNA, 17 nt, Chlamydophila pneumoniae J138
cagaagugaucuugaga

SEQ ID NO: 2543660 - RNA, 23 nt, Chlamydophila pneumoniae J138
cagaagugaucuugagaaaagaa

SEQ ID NO: 2543661 - RNA, 14 nt, Chlamydophila pneumoniae J138
cagaaguuccuacu

SEQ ID NO: 2543662 - RNA, 23 nt, Chlamydophila pneumoniae J138
cagaaguuccuacuucugcagga

SEQ ID NO: 2543663 - RNA, 13 nt, Chlamydophila pneumoniae J138
cagaaguuccuuc

SEQ ID NO: 2543664 - RNA, 17 nt, Chlamydophila pneumoniae J138
cagaaguuccuucagga

SEQ ID NO: 2543665 - RNA, 19 nt, Chlamydophila pneumoniae J138
cagaaguuccuucaggauu

SEQ ID NO: 2543666 - RNA, 20 nt, Chlamydophila pneumoniae J138
cagaauaggaacaaagcucu

SEQ ID NO: 2543667 - RNA, 14 nt, Chlamydophila pneumoniae J138
cagaaucccgugcu

SEQ ID NO: 2543668 - RNA, 13 nt, Chlamydophila pneumoniae J138
cagaauccugagu

SEQ ID NO: 2543669 - RNA, 19 nt, Chlamydophila pneumoniae J138
cagaauccugaguaaaauc

SEQ ID NO: 2543670 - RNA, 20 nt, Chlamydophila pneumoniae J138
cagaauccugaguaaaauca

SEQ ID NO: 2543671 - RNA, 17 nt, Chlamydophila pneumoniae J138
cagaaucuaaguaaaac

SEQ ID NO: 2543672 - RNA, 16 nt, Chlamydophila pneumoniae J138
cagaaugauaagaaag

SEQ ID NO: 2543673 - RNA, 14 nt, Chlamydophila pneumoniae J138
cagaauuuuaucag

SEQ ID NO: 2543674 - RNA, 15 nt, Chlamydophila pneumoniae J138
cagacacaaaaagcu

SEQ ID NO: 2543675 - RNA, 13 nt, Chlamydophila pneumoniae J138
cagaccuaaaaag

SEQ ID NO: 2543676 - RNA, 22 nt, Chlamydophila pneumoniae J138
cagaccuaaaaaggucagcccu

SEQ ID NO: 2543677 - RNA, 23 nt, Chlamydophila pneumoniae J138
cagaccuaaaaaggucagcccug

SEQ ID NO: 2543678 - RNA, 19 nt, Chlamydophila pneumoniae J138
cagaccucucccuugggau

SEQ ID NO: 2543679 - RNA, 20 nt, Chlamydophila pneumoniae J138
cagaccucucccuugggauu

SEQ ID NO: 2543680 - RNA, 14 nt, Chlamydophila pneumoniae J138
cagacuuuccucuc

SEQ ID NO: 2543681 - RNA, 12 nt, Chlamydophila pneumoniae J138
cagagaaaauca

SEQ ID NO: 2543682 - RNA, 14 nt, Chlamydophila pneumoniae J138
cagagaaaaucaac

SEQ ID NO: 2543683 - RNA, 15 nt, Chlamydophila pneumoniae J138
cagagaaaaucaacu

SEQ ID NO: 2543684 - RNA, 19 nt, Chlamydophila pneumoniae J138
cagagaaauuaacagagcg

SEQ ID NO: 2543685 - RNA, 17 nt, Chlamydophila pneumoniae J138
cagagaccuucucuuca

SEQ ID NO: 2543686 - RNA, 16 nt, Chlamydophila pneumoniae J138
cagagacuuccucuuc

SEQ ID NO: 2543687 - RNA, 21 nt, Chlamydophila pneumoniae J138
cagagacuuccucuucaauuu

SEQ ID NO: 2543688 - RNA, 22 nt, Chlamydophila pneumoniae J138
cagagacuuccucuucaauuuc

SEQ ID NO: 2543689 - RNA, 16 nt, Chlamydophila pneumoniae J138
cagagaugcuucuaaa

SEQ ID NO: 2543690 - RNA, 19 nt, Chlamydophila pneumoniae J138
cagagaugcuucuaaacaa

SEQ ID NO: 2543691 - RNA, 17 nt, Chlamydophila pneumoniae J138
cagagauugccaggaga

SEQ ID NO: 2543692 - RNA, 14 nt, Chlamydophila pneumoniae J138
cagagauuuuaaag

SEQ ID NO: 2543693 - RNA, 16 nt, Chlamydophila pneumoniae J138
cagagcauaggguuuc

SEQ ID NO: 2543694 - RNA, 16 nt, Chlamydophila pneumoniae J138
cagagccucacuaacg

SEQ ID NO: 2543695 - RNA, 17 nt, Chlamydophila pneumoniae J138
cagagcuucuaaaaacu

SEQ ID NO: 2543696 - RNA, 19 nt, Chlamydophila pneumoniae J138
cagagcuucuaaaaacucu

SEQ ID NO: 2543697 - RNA, 16 nt, Chlamydophila pneumoniae J138
cagaggaaucuaagaa

SEQ ID NO: 2543698 - RNA, 14 nt, Chlamydophila pneumoniae J138
cagaggagccucca

SEQ ID NO: 2543699 - RNA, 18 nt, Chlamydophila pneumoniae J138
cagaggagccuccauaau

SEQ ID NO: 2543700 - RNA, 20 nt, Chlamydophila pneumoniae J138
cagaggucgauuugaacaug

SEQ ID NO: 2543701 - RNA, 21 nt, Chlamydophila pneumoniae J138
cagaguacgugaucucacgaa

SEQ ID NO: 2543702 - RNA, 22 nt, Chlamydophila pneumoniae J138
cagagucugggauguucaaagc

SEQ ID NO: 2543703 - RNA, 15 nt, Chlamydophila pneumoniae J138
cagaguuuaaagcuu

SEQ ID NO: 2543704 - RNA, 17 nt, Chlamydophila pneumoniae J138
cagaguuuuaaacugcu

SEQ ID NO: 2543705 - RNA, 21 nt, Chlamydophila pneumoniae J138
cagauaaaaagaaguaaucgu

SEQ ID NO: 2543706 - RNA, 18 nt, Chlamydophila pneumoniae J138
cagauaccaaaauaccau

SEQ ID NO: 2543707 - RNA, 21 nt, Chlamydophila pneumoniae J138
cagauacguuucccccauaaa

SEQ ID NO: 2543708 - RNA, 16 nt, Chlamydophila pneumoniae J138
cagauacuucuuccac

SEQ ID NO: 2543709 - RNA, 18 nt, Chlamydophila pneumoniae J138
cagauagagcuucuuuau

SEQ ID NO: 2543710 - RNA, 20 nt, Chlamydophila pneumoniae J138
cagauaggauggaguacuuc

SEQ ID NO: 2543711 - RNA, 16 nt, Chlamydophila pneumoniae J138
cagauaggguaagauu

SEQ ID NO: 2543712 - RNA, 15 nt, Chlamydophila pneumoniae J138
cagauaucaaagcau

SEQ ID NO: 2543713 - RNA, 19 nt, Chlamydophila pneumoniae J138
cagaucaaugccuugcguu

SEQ ID NO: 2543714 - RNA, 22 nt, Chlamydophila pneumoniae J138
cagaucauaucggcagcagcau

SEQ ID NO: 2543715 - RNA, 20 nt, Chlamydophila pneumoniae J138
cagaucccgggaguuuucag

SEQ ID NO: 2543716 - RNA, 11 nt, Chlamydophila pneumoniae J138
cagauccugcu

SEQ ID NO: 2543717 - RNA, 16 nt, Chlamydophila pneumoniae J138
cagauccugcuucuau

SEQ ID NO: 2543718 - RNA, 13 nt, Chlamydophila pneumoniae J138
cagaucucuuuag

SEQ ID NO: 2543719 - RNA, 14 nt, Chlamydophila pneumoniae J138
cagaucugcauaau

SEQ ID NO: 2543720 - RNA, 16 nt, Chlamydophila pneumoniae J138
cagaucugcauaauuu

SEQ ID NO: 2543721 - RNA, 17 nt, Chlamydophila pneumoniae J138
cagaucuuuuaugcgag

SEQ ID NO: 2543722 - RNA, 23 nt, Chlamydophila pneumoniae J138
cagaugagagguguacaguugcg

SEQ ID NO: 2543723 - RNA, 19 nt, Chlamydophila pneumoniae J138
cagaugcuucaaggcaucu

SEQ ID NO: 2543724 - RNA, 15 nt, Chlamydophila pneumoniae J138
cagauguaaaugcuc

SEQ ID NO: 2543725 - RNA, 17 nt, Chlamydophila pneumoniae J138
cagauguaaucuugauc

SEQ ID NO: 2543726 - RNA, 16 nt, Chlamydophila pneumoniae J138
cagauguuuucguaaa

SEQ ID NO: 2543727 - RNA, 22 nt, Chlamydophila pneumoniae J138
cagauguuuucguaaauaugaa

SEQ ID NO: 2543728 - RNA, 18 nt, Chlamydophila pneumoniae J138
cagauuagaaaagauaaa

SEQ ID NO: 2543729 - RNA, 16 nt, Chlamydophila pneumoniae J138
cagauucugaagagag

SEQ ID NO: 2543730 - RNA, 15 nt, Chlamydophila pneumoniae J138
cagauugcacuugcg

SEQ ID NO: 2543731 - RNA, 17 nt, Chlamydophila pneumoniae J138
cagauugcacuugcggu

SEQ ID NO: 2543732 - RNA, 16 nt, Chlamydophila pneumoniae J138
cagauuguucaaaaau

SEQ ID NO: 2543733 - RNA, 17 nt, Chlamydophila pneumoniae J138
cagcaaccuuuccuaaa

SEQ ID NO: 2543734 - RNA, 17 nt, Chlamydophila pneumoniae J138
cagcaagaucuaacuuc

SEQ ID NO: 2543735 - RNA, 12 nt, Chlamydophila pneumoniae J138
cagcaaggaagu

SEQ ID NO: 2543736 - RNA, 17 nt, Chlamydophila pneumoniae J138
cagcaaggaaguuauaa

SEQ ID NO: 2543737 - RNA, 23 nt, Chlamydophila pneumoniae J138
cagcacaagaaccuguuuuucua

SEQ ID NO: 2543738 - RNA, 17 nt, Chlamydophila pneumoniae J138
cagcacaggcauggucu

SEQ ID NO: 2543739 - RNA, 20 nt, Chlamydophila pneumoniae J138
cagcaccuuuaggaagcugu

SEQ ID NO: 2543740 - RNA, 14 nt, Chlamydophila pneumoniae J138
cagcacucuuuuuc

SEQ ID NO: 2543741 - RNA, 18 nt, Chlamydophila pneumoniae J138
cagcacuuuuauuaugua

SEQ ID NO: 2543742 - RNA, 15 nt, Chlamydophila pneumoniae J138
cagcagaaucauaau

SEQ ID NO: 2543743 - RNA, 13 nt, Chlamydophila pneumoniae J138
cagcagaugaaac

SEQ ID NO: 2543744 - RNA, 14 nt, Chlamydophila pneumoniae J138
cagcagcauuuucu

SEQ ID NO: 2543745 - RNA, 16 nt, Chlamydophila pneumoniae J138
cagcagcguccccccc

SEQ ID NO: 2543746 - RNA, 20 nt, Chlamydophila pneumoniae J138
cagcagcgucccccccgggu

SEQ ID NO: 2543747 - RNA, 16 nt, Chlamydophila pneumoniae J138
cagcagguucuugaau

SEQ ID NO: 2543748 - RNA, 15 nt, Chlamydophila pneumoniae J138
cagcauaaaaauucu

SEQ ID NO: 2543749 - RNA, 18 nt, Chlamydophila pneumoniae J138
cagcauaaaaauucucau

SEQ ID NO: 2543750 - RNA, 22 nt, Chlamydophila pneumoniae J138
cagcauaaggauucugagaagu

SEQ ID NO: 2543751 - RNA, 15 nt, Chlamydophila pneumoniae J138
cagcauggacuccaa

SEQ ID NO: 2543752 - RNA, 19 nt, Chlamydophila pneumoniae J138
cagcauggacuccaagaau

SEQ ID NO: 2543753 - RNA, 19 nt, Chlamydophila pneumoniae J138
cagcaugugcagaagguuc

SEQ ID NO: 2543754 - RNA, 20 nt, Chlamydophila pneumoniae J138
cagcauuaagauaaacagca

SEQ ID NO: 2543755 - RNA, 22 nt, Chlamydophila pneumoniae J138
cagcauuaagauaaacagcaca

SEQ ID NO: 2543756 - RNA, 23 nt, Chlamydophila pneumoniae J138
cagcauuaagauaaacagcacag

SEQ ID NO: 2543757 - RNA, 17 nt, Chlamydophila pneumoniae J138
cagcauugccuggggau

SEQ ID NO: 2543758 - RNA, 13 nt, Chlamydophila pneumoniae J138
cagccagcagaag

SEQ ID NO: 2543759 - RNA, 12 nt, Chlamydophila pneumoniae J138
cagcccacuguu

SEQ ID NO: 2543760 - RNA, 15 nt, Chlamydophila pneumoniae J138
cagccucuucucuac

SEQ ID NO: 2543761 - RNA, 22 nt, Chlamydophila pneumoniae J138
cagccuggaaagcuucuggauu

SEQ ID NO: 2543762 - RNA, 13 nt, Chlamydophila pneumoniae J138
cagccugucuaua

SEQ ID NO: 2543763 - RNA, 19 nt, Chlamydophila pneumoniae J138
cagccugucuauaaaauaa

SEQ ID NO: 2543764 - RNA, 22 nt, Chlamydophila pneumoniae J138
cagccugugagcucucgacgaa

SEQ ID NO: 2543765 - RNA, 20 nt, Chlamydophila pneumoniae J138
cagccuugauugaacagucu

SEQ ID NO: 2543766 - RNA, 21 nt, Chlamydophila pneumoniae J138
cagccuuggcucuagaaauau

SEQ ID NO: 2543767 - RNA, 24 nt, Chlamydophila pneumoniae J138
cagcgacaacacgcccacggaaag

SEQ ID NO: 2543768 - RNA, 17 nt, Chlamydophila pneumoniae J138
cagcgaggaguuuucca

SEQ ID NO: 2543769 - RNA, 23 nt, Chlamydophila pneumoniae J138
cagcgaggaguuuuccaaaguca

SEQ ID NO: 2543770 - RNA, 18 nt, Chlamydophila pneumoniae J138
cagcgauauaagacucca

SEQ ID NO: 2543771 - RNA, 21 nt, Chlamydophila pneumoniae J138
cagcgcugugaggaaaauucc

SEQ ID NO: 2543772 - RNA, 22 nt, Chlamydophila pneumoniae J138
cagcgugaauaucaucacuaag

SEQ ID NO: 2543773 - RNA, 14 nt, Chlamydophila pneumoniae J138
cagcguuucuaggg

SEQ ID NO: 2543774 - RNA, 15 nt, Chlamydophila pneumoniae J138
cagcuaacgaaguga

SEQ ID NO: 2543775 - RNA, 21 nt, Chlamydophila pneumoniae J138
cagcuaaucauagccaucaua

SEQ ID NO: 2543776 - RNA, 19 nt, Chlamydophila pneumoniae J138
cagcuaauuuaaaugccuu

SEQ ID NO: 2543777 - RNA, 21 nt, Chlamydophila pneumoniae J138
cagcuaauuuaaaugccuuaa

SEQ ID NO: 2543778 - RNA, 19 nt, Chlamydophila pneumoniae J138
cagcuagagcacauagaaa

SEQ ID NO: 2543779 - RNA, 21 nt, Chlamydophila pneumoniae J138
cagcuauagauuuaagagucu

SEQ ID NO: 2543780 - RNA, 12 nt, Chlamydophila pneumoniae J138
cagcuccauaag

SEQ ID NO: 2543781 - RNA, 23 nt, Chlamydophila pneumoniae J138
cagcucucuugauugcuaucaaa

SEQ ID NO: 2543782 - RNA, 20 nt, Chlamydophila pneumoniae J138
cagcugagcuaucuucaagu

SEQ ID NO: 2543783 - RNA, 13 nt, Chlamydophila pneumoniae J138
cagcugugguggu

SEQ ID NO: 2543784 - RNA, 23 nt, Chlamydophila pneumoniae J138
cagcuucccaagcagaagacccu

SEQ ID NO: 2543785 - RNA, 15 nt, Chlamydophila pneumoniae J138
cagcuucgcaaucuu

SEQ ID NO: 2543786 - RNA, 18 nt, Chlamydophila pneumoniae J138
cagcuucgcaaucuuuga

SEQ ID NO: 2543787 - RNA, 17 nt, Chlamydophila pneumoniae J138
cagcuucuauugcugua

SEQ ID NO: 2543788 - RNA, 11 nt, Chlamydophila pneumoniae J138
cagcuucuuga

SEQ ID NO: 2543789 - RNA, 20 nt, Chlamydophila pneumoniae J138
cagcuuguuuuugcaaggca

SEQ ID NO: 2543790 - RNA, 17 nt, Chlamydophila pneumoniae J138
cagcuuuagcuuuuacu

SEQ ID NO: 2543791 - RNA, 22 nt, Chlamydophila pneumoniae J138
cagcuuuaucaggaucuugauu

SEQ ID NO: 2543792 - RNA, 23 nt, Chlamydophila pneumoniae J138
cagcuuugcuuaaaaagucugaa

SEQ ID NO: 2543793 - RNA, 17 nt, Chlamydophila pneumoniae J138
cagcuuuuucaauagca

SEQ ID NO: 2543794 - RNA, 20 nt, Chlamydophila pneumoniae J138
caggaaaacgcccucuagaa

SEQ ID NO: 2543795 - RNA, 18 nt, Chlamydophila pneumoniae J138
caggaaacguucuuucaa

SEQ ID NO: 2543796 - RNA, 17 nt, Chlamydophila pneumoniae J138
caggaaagaauaggggu

SEQ ID NO: 2543797 - RNA, 17 nt, Chlamydophila pneumoniae J138
caggaacccuggaugaa

SEQ ID NO: 2543798 - RNA, 16 nt, Chlamydophila pneumoniae J138
caggaacuaaaaguuu

SEQ ID NO: 2543799 - RNA, 13 nt, Chlamydophila pneumoniae J138
caggaaguccaug

SEQ ID NO: 2543800 - RNA, 23 nt, Chlamydophila pneumoniae J138
caggaaguccauguacagaaaau

SEQ ID NO: 2543801 - RNA, 19 nt, Chlamydophila pneumoniae J138
caggaaguccgauagcaau

SEQ ID NO: 2543802 - RNA, 19 nt, Chlamydophila pneumoniae J138
caggaauaaucaaccaaaa

SEQ ID NO: 2543803 - RNA, 23 nt, Chlamydophila pneumoniae J138
caggaaucacuguaucagcaagc

SEQ ID NO: 2543804 - RNA, 18 nt, Chlamydophila pneumoniae J138
caggaauucucaucggca

SEQ ID NO: 2543805 - RNA, 17 nt, Chlamydophila pneumoniae J138
caggaccugugaguaaa

SEQ ID NO: 2543806 - RNA, 20 nt, Chlamydophila pneumoniae J138
caggaccugugaguaaaaug

SEQ ID NO: 2543807 - RNA, 17 nt, Chlamydophila pneumoniae J138
caggacguaaaaagaaa

SEQ ID NO: 2543808 - RNA, 16 nt, Chlamydophila pneumoniae J138
caggagcuagaagagc

SEQ ID NO: 2543809 - RNA, 17 nt, Chlamydophila pneumoniae J138
caggagcuagaagagcg

SEQ ID NO: 2543810 - RNA, 14 nt, Chlamydophila pneumoniae J138
caggagcuccuccu

SEQ ID NO: 2543811 - RNA, 11 nt, Chlamydophila pneumoniae J138
caggaggcgcg

SEQ ID NO: 2543812 - RNA, 17 nt, Chlamydophila pneumoniae J138
caggaguuuuccuaaau

SEQ ID NO: 2543813 - RNA, 22 nt, Chlamydophila pneumoniae J138
caggauacucugaacaggaaua

SEQ ID NO: 2543814 - RNA, 17 nt, Chlamydophila pneumoniae J138
caggauauugcggaaau

SEQ ID NO: 2543815 - RNA, 19 nt, Chlamydophila pneumoniae J138
caggauucuauaacuacaa

SEQ ID NO: 2543816 - RNA, 15 nt, Chlamydophila pneumoniae J138
caggcaucacuaauc

SEQ ID NO: 2543817 - RNA, 13 nt, Chlamydophila pneumoniae J138
caggcauucuuca

SEQ ID NO: 2543818 - RNA, 14 nt, Chlamydophila pneumoniae J138
caggccugaugucu

SEQ ID NO: 2543819 - RNA, 18 nt, Chlamydophila pneumoniae J138
caggccuggugcuuaaaa

SEQ ID NO: 2543820 - RNA, 14 nt, Chlamydophila pneumoniae J138
caggcuacauaguu

SEQ ID NO: 2543821 - RNA, 21 nt, Chlamydophila pneumoniae J138
caggcuccaucacgaggagcu

SEQ ID NO: 2543822 - RNA, 14 nt, Chlamydophila pneumoniae J138
caggcugaaccaaa

SEQ ID NO: 2543823 - RNA, 23 nt, Chlamydophila pneumoniae J138
caggcugaaccaaaucuaucugc

SEQ ID NO: 2543824 - RNA, 14 nt, Chlamydophila pneumoniae J138
cagggaaagaacag

SEQ ID NO: 2543825 - RNA, 23 nt, Chlamydophila pneumoniae J138
cagggaaagaacagcagaaacgg

SEQ ID NO: 2543826 - RNA, 21 nt, Chlamydophila pneumoniae J138
cagggaauccuguaacacccu

SEQ ID NO: 2543827 - RNA, 14 nt, Chlamydophila pneumoniae J138
cagggacagaaguc

SEQ ID NO: 2543828 - RNA, 22 nt, Chlamydophila pneumoniae J138
cagggccugagaccauaaaauc

SEQ ID NO: 2543829 - RNA, 23 nt, Chlamydophila pneumoniae J138
caggggaugugauguucugcugc

SEQ ID NO: 2543830 - RNA, 13 nt, Chlamydophila pneumoniae J138
caggggugagauc

SEQ ID NO: 2543831 - RNA, 14 nt, Chlamydophila pneumoniae J138
cagguaaacaacaa

SEQ ID NO: 2543832 - RNA, 21 nt, Chlamydophila pneumoniae J138
cagguaagggaugcucuagaa

SEQ ID NO: 2543833 - RNA, 19 nt, Chlamydophila pneumoniae J138
cagguagagugucuuccuu

SEQ ID NO: 2543834 - RNA, 22 nt, Chlamydophila pneumoniae J138
cagguagucccuuucuauuuca

SEQ ID NO: 2543835 - RNA, 18 nt, Chlamydophila pneumoniae J138
cagguccuucuggaguga

SEQ ID NO: 2543836 - RNA, 20 nt, Chlamydophila pneumoniae J138
caggucguaaacggacgcua

SEQ ID NO: 2543837 - RNA, 18 nt, Chlamydophila pneumoniae J138
cagguucacuucaucgac

SEQ ID NO: 2543838 - RNA, 18 nt, Chlamydophila pneumoniae J138
cagguucugaaauugucu

SEQ ID NO: 2543839 - RNA, 20 nt, Chlamydophila pneumoniae J138
cagguuguccuauagagaau

SEQ ID NO: 2543840 - RNA, 20 nt, Chlamydophila pneumoniae J138
caguaaaacacaaauagcaa

SEQ ID NO: 2543841 - RNA, 22 nt, Chlamydophila pneumoniae J138
caguaaaagacugaaaagaucg

SEQ ID NO: 2543842 - RNA, 18 nt, Chlamydophila pneumoniae J138
caguacuaaauuaguaaa

SEQ ID NO: 2543843 - RNA, 21 nt, Chlamydophila pneumoniae J138
caguagagccucuaagaaaau

SEQ ID NO: 2543844 - RNA, 17 nt, Chlamydophila pneumoniae J138
caguagaggaauucugg

SEQ ID NO: 2543845 - RNA, 16 nt, Chlamydophila pneumoniae J138
caguagaucuucugaa

SEQ ID NO: 2543846 - RNA, 22 nt, Chlamydophila pneumoniae J138
caguaggagcagcggcacccuc

SEQ ID NO: 2543847 - RNA, 22 nt, Chlamydophila pneumoniae J138
caguaggcgaugcaaauuccag

SEQ ID NO: 2543848 - RNA, 14 nt, Chlamydophila pneumoniae J138
caguagguaagaag

SEQ ID NO: 2543849 - RNA, 14 nt, Chlamydophila pneumoniae J138
caguaguguaucua

SEQ ID NO: 2543850 - RNA, 16 nt, Chlamydophila pneumoniae J138
caguauaaucagaagu

SEQ ID NO: 2543851 - RNA, 13 nt, Chlamydophila pneumoniae J138
caguauagagaag

SEQ ID NO: 2543852 - RNA, 19 nt, Chlamydophila pneumoniae J138
caguaucaauaaucggccg

SEQ ID NO: 2543853 - RNA, 15 nt, Chlamydophila pneumoniae J138
caguaucguaacuuc

SEQ ID NO: 2543854 - RNA, 19 nt, Chlamydophila pneumoniae J138
caguauggcguuuuuuuug

SEQ ID NO: 2543855 - RNA, 18 nt, Chlamydophila pneumoniae J138
caguauucccuccgcagu

SEQ ID NO: 2543856 - RNA, 13 nt, Chlamydophila pneumoniae J138
caguccucucccu

SEQ ID NO: 2543857 - RNA, 14 nt, Chlamydophila pneumoniae J138
caguccucucccuu

SEQ ID NO: 2543858 - RNA, 15 nt, Chlamydophila pneumoniae J138
cagucguauucaggu

SEQ ID NO: 2543859 - RNA, 19 nt, Chlamydophila pneumoniae J138
cagucgugagaagcaucuu

SEQ ID NO: 2543860 - RNA, 22 nt, Chlamydophila pneumoniae J138
cagucucauggauuacugaaga

SEQ ID NO: 2543861 - RNA, 14 nt, Chlamydophila pneumoniae J138
cagucuccuggaac

SEQ ID NO: 2543862 - RNA, 22 nt, Chlamydophila pneumoniae J138
cagucuccuggaacaguauaau

SEQ ID NO: 2543863 - RNA, 15 nt, Chlamydophila pneumoniae J138
cagucugugagaaau

SEQ ID NO: 2543864 - RNA, 23 nt, Chlamydophila pneumoniae J138
cagucuugcgccagcaaagauua

SEQ ID NO: 2543865 - RNA, 19 nt, Chlamydophila pneumoniae J138
cagugaacucuucaagagc

SEQ ID NO: 2543866 - RNA, 21 nt, Chlamydophila pneumoniae J138
cagugauuccugucauuccua

SEQ ID NO: 2543867 - RNA, 16 nt, Chlamydophila pneumoniae J138
cagugcugccaugaca

SEQ ID NO: 2543868 - RNA, 20 nt, Chlamydophila pneumoniae J138
caguggacggggagagccau

SEQ ID NO: 2543869 - RNA, 18 nt, Chlamydophila pneumoniae J138
caguggcuuauagagaga

SEQ ID NO: 2543870 - RNA, 18 nt, Chlamydophila pneumoniae J138
caguguauuguuugcuau

SEQ ID NO: 2543871 - RNA, 21 nt, Chlamydophila pneumoniae J138
caguguuauuuggacguacua

SEQ ID NO: 2543872 - RNA, 13 nt, Chlamydophila pneumoniae J138
caguuaaagagca

SEQ ID NO: 2543873 - RNA, 14 nt, Chlamydophila pneumoniae J138
caguuaaagagcau

SEQ ID NO: 2543874 - RNA, 17 nt, Chlamydophila pneumoniae J138
caguuaaagagcauccu

SEQ ID NO: 2543875 - RNA, 21 nt, Chlamydophila pneumoniae J138
caguucauguugcucauccuu

SEQ ID NO: 2543876 - RNA, 20 nt, Chlamydophila pneumoniae J138
caguuccuaaagcuuuugcu

SEQ ID NO: 2543877 - RNA, 15 nt, Chlamydophila pneumoniae J138
caguucgacaaccaa

SEQ ID NO: 2543878 - RNA, 11 nt, Chlamydophila pneumoniae J138
caguucuucau

SEQ ID NO: 2543879 - RNA, 21 nt, Chlamydophila pneumoniae J138
caguucuugaaacucuaucag

SEQ ID NO: 2543880 - RNA, 20 nt, Chlamydophila pneumoniae J138
cauagguaauacgagaggaa

SEQ ID NO: 2543881 - RNA, 15 nt, Chlamydophila pneumoniae J138
cauaguggcucagug

SEQ ID NO: 2543882 - RNA, 14 nt, Chlamydophila pneumoniae J138
cauaguguuccaaa

SEQ ID NO: 2543883 - RNA, 20 nt, Chlamydophila pneumoniae J138
cauaguuuuuauuuuuaaau

SEQ ID NO: 2543884 - RNA, 21 nt, Chlamydophila pneumoniae J138
cauaguuuuuauuuuuaaaua

SEQ ID NO: 2543885 - RNA, 20 nt, Chlamydophila pneumoniae J138
cauauaaagacucucuucca

SEQ ID NO: 2543886 - RNA, 22 nt, Chlamydophila pneumoniae J138
cauauaaagacucucuuccaaa

SEQ ID NO: 2543887 - RNA, 19 nt, Chlamydophila pneumoniae J138
cauaucaucgauaucuaag

SEQ ID NO: 2543888 - RNA, 20 nt, Chlamydophila pneumoniae J138
cauaucuccuuuaaauaaaa

SEQ ID NO: 2543889 - RNA, 14 nt, Chlamydophila pneumoniae J138
cauaugcuccagaa

SEQ ID NO: 2543890 - RNA, 18 nt, Chlamydophila pneumoniae J138
cauauucuaagcuuauuu

SEQ ID NO: 2543891 - RNA, 22 nt, Chlamydophila pneumoniae J138
cauauugagcagcguagacagg

SEQ ID NO: 2543892 - RNA, 12 nt, Chlamydophila pneumoniae J138
cauauugcaaag

SEQ ID NO: 2543893 - RNA, 15 nt, Chlamydophila pneumoniae J138
cauauugcaaagcau

SEQ ID NO: 2543894 - RNA, 14 nt, Chlamydophila pneumoniae J138
cauauugccuucuu

SEQ ID NO: 2543895 - RNA, 18 nt, Chlamydophila pneumoniae J138
cauauuuacgaaaacauc

SEQ ID NO: 2543896 - RNA, 17 nt, Chlamydophila pneumoniae J138
cauauuuauuuaaacca

SEQ ID NO: 2543897 - RNA, 14 nt, Chlamydophila pneumoniae J138
cauauuugaauaaa

SEQ ID NO: 2543898 - RNA, 16 nt, Chlamydophila pneumoniae J138
cauauuuuucuugaag

SEQ ID NO: 2543899 - RNA, 20 nt, Chlamydophila pneumoniae J138
cauauuuuucuugaagguuc

SEQ ID NO: 2543900 - RNA, 13 nt, Chlamydophila pneumoniae J138
caucaaaaaauac

SEQ ID NO: 2543901 - RNA, 12 nt, Chlamydophila pneumoniae J138
caucaaaaagau

SEQ ID NO: 2543902 - RNA, 23 nt, Chlamydophila pneumoniae J138
caucaaaagauaugucuugcuuu

SEQ ID NO: 2543903 - RNA, 23 nt, Chlamydophila pneumoniae J138
caucaaagaauuauugauauuau

SEQ ID NO: 2543904 - RNA, 19 nt, Chlamydophila pneumoniae J138
caucaaauaaggcugcuau

SEQ ID NO: 2543905 - RNA, 13 nt, Chlamydophila pneumoniae J138
caucaaggccuau

SEQ ID NO: 2543906 - RNA, 21 nt, Chlamydophila pneumoniae J138
caucaaucacucuaugaucua

SEQ ID NO: 2543907 - RNA, 21 nt, Chlamydophila pneumoniae J138
caucaaugcgauuacuucacg

SEQ ID NO: 2543908 - RNA, 20 nt, Chlamydophila pneumoniae J138
caucaaugguuaaaacccau

SEQ ID NO: 2543909 - RNA, 23 nt, Chlamydophila pneumoniae J138
caucaaugguuaaaacccauguu

SEQ ID NO: 2543910 - RNA, 15 nt, Chlamydophila pneumoniae J138
caucacaaucgugau

SEQ ID NO: 2543911 - RNA, 18 nt, Chlamydophila pneumoniae J138
caucacgaggagcuuuua

SEQ ID NO: 2543912 - RNA, 23 nt, Chlamydophila pneumoniae J138
caucacuaagauacgaaguccca

SEQ ID NO: 2543913 - RNA, 14 nt, Chlamydophila pneumoniae J138
caucacuaaucuca

SEQ ID NO: 2543914 - RNA, 14 nt, Chlamydophila pneumoniae J138
caucagaagcuccu

SEQ ID NO: 2543915 - RNA, 14 nt, Chlamydophila pneumoniae J138
caucagaaguggcc

SEQ ID NO: 2543916 - RNA, 18 nt, Chlamydophila pneumoniae J138
caucagaaguggccuugc

SEQ ID NO: 2543917 - RNA, 17 nt, Chlamydophila pneumoniae J138
caucagacugaagagca

SEQ ID NO: 2543918 - RNA, 14 nt, Chlamydophila pneumoniae J138
caucaggauucucu

SEQ ID NO: 2543919 - RNA, 21 nt, Chlamydophila pneumoniae J138
caucaggcggaugaccuucuc

SEQ ID NO: 2543920 - RNA, 13 nt, Chlamydophila pneumoniae J138
caucaguuccauu

SEQ ID NO: 2543921 - RNA, 21 nt, Chlamydophila pneumoniae J138
caucauaaagugcgagguaug

SEQ ID NO: 2543922 - RNA, 12 nt, Chlamydophila pneumoniae J138
caucaucaccag

SEQ ID NO: 2543923 - RNA, 18 nt, Chlamydophila pneumoniae J138
cauccaaaaugucuuuuu

SEQ ID NO: 2543924 - RNA, 16 nt, Chlamydophila pneumoniae J138
cauccaaauagaguga

SEQ ID NO: 2543925 - RNA, 17 nt, Chlamydophila pneumoniae J138
cauccaagccucccgaa

SEQ ID NO: 2543926 - RNA, 22 nt, Chlamydophila pneumoniae J138
cauccacgaccucgaauuccuc

SEQ ID NO: 2543927 - RNA, 22 nt, Chlamydophila pneumoniae J138
cauccauucuuaauauaaaaga

SEQ ID NO: 2543928 - RNA, 17 nt, Chlamydophila pneumoniae J138
caucccauucaauaauu

SEQ ID NO: 2543929 - RNA, 22 nt, Chlamydophila pneumoniae J138
caucccuagggaaagcaucuuu

SEQ ID NO: 2543930 - RNA, 19 nt, Chlamydophila pneumoniae J138
caucccuggauuucuucug

SEQ ID NO: 2543931 - RNA, 12 nt, Chlamydophila pneumoniae J138
caucccuucuuc

SEQ ID NO: 2543932 - RNA, 17 nt, Chlamydophila pneumoniae J138
caucccuucuucuuuua

SEQ ID NO: 2543933 - RNA, 15 nt, Chlamydophila pneumoniae J138
cauccgaagacucaa

SEQ ID NO: 2543934 - RNA, 14 nt, Chlamydophila pneumoniae J138
cauccucagucucu

SEQ ID NO: 2543935 - RNA, 21 nt, Chlamydophila pneumoniae J138
cauccucaucaucagaaauca

SEQ ID NO: 2543936 - RNA, 22 nt, Chlamydophila pneumoniae J138
cauccuguagagcaagauucuu

SEQ ID NO: 2543937 - RNA, 22 nt, Chlamydophila pneumoniae J138
cauccuuguagaacuucucaag

SEQ ID NO: 2543938 - RNA, 15 nt, Chlamydophila pneumoniae J138
caucgaaaccacagc

SEQ ID NO: 2543939 - RNA, 12 nt, Chlamydophila pneumoniae J138
caucgaagaacu

SEQ ID NO: 2543940 - RNA, 13 nt, Chlamydophila pneumoniae J138
caucgaagaacuu

SEQ ID NO: 2543941 - RNA, 19 nt, Chlamydophila pneumoniae J138
caucgaagcgccgcauuac

SEQ ID NO: 2543942 - RNA, 17 nt, Chlamydophila pneumoniae J138
caucgacaaguaccuuc

SEQ ID NO: 2543943 - RNA, 18 nt, Chlamydophila pneumoniae J138
caucgacaaguaccuucu

SEQ ID NO: 2543944 - RNA, 19 nt, Chlamydophila pneumoniae J138
caucgcaguuccauagcua

SEQ ID NO: 2543945 - RNA, 22 nt, Chlamydophila pneumoniae J138
caucgccgaccaucauaauuug

SEQ ID NO: 2543946 - RNA, 19 nt, Chlamydophila pneumoniae J138
caucgguucggucucuucu

SEQ ID NO: 2543947 - RNA, 24 nt, Chlamydophila pneumoniae J138
caucgguucggucucuucucuguu

SEQ ID NO: 2543948 - RNA, 17 nt, Chlamydophila pneumoniae J138
caucgguuuccaagaca

SEQ ID NO: 2543949 - RNA, 19 nt, Chlamydophila pneumoniae J138
caucgucuccaaaaauucc

SEQ ID NO: 2543950 - RNA, 14 nt, Chlamydophila pneumoniae J138
caucguuaauauaa

SEQ ID NO: 2543951 - RNA, 14 nt, Chlamydophila pneumoniae J138
caucuaaaaaugca

SEQ ID NO: 2543952 - RNA, 20 nt, Chlamydophila pneumoniae J138
caucuaacgucagcuguccu

SEQ ID NO: 2543953 - RNA, 15 nt, Chlamydophila pneumoniae J138
caucuaacucuaauc

SEQ ID NO: 2543954 - RNA, 13 nt, Chlamydophila pneumoniae J138
caucuaagccaga

SEQ ID NO: 2543955 - RNA, 19 nt, Chlamydophila pneumoniae J138
caucuacgauguuuucuua

SEQ ID NO: 2543956 - RNA, 21 nt, Chlamydophila pneumoniae J138
caucuacgauguuuucuuauc

SEQ ID NO: 2543957 - RNA, 22 nt, Chlamydophila pneumoniae J138
caucuacgauguuuucuuaucc

SEQ ID NO: 2543958 - RNA, 22 nt, Chlamydophila pneumoniae J138
caucuagaaagauuuauuuugu

SEQ ID NO: 2543959 - RNA, 20 nt, Chlamydophila pneumoniae J138
caucuagaagcauucucaau

SEQ ID NO: 2543960 - RNA, 21 nt, Chlamydophila pneumoniae J138
caucuccaagauaauuaugua

SEQ ID NO: 2543961 - RNA, 13 nt, Chlamydophila pneumoniae J138
caucuccugaagc

SEQ ID NO: 2543962 - RNA, 14 nt, Chlamydophila pneumoniae J138
caucuccugaagcc

SEQ ID NO: 2543963 - RNA, 22 nt, Chlamydophila pneumoniae J138
caucucguugggcucauaaccc

SEQ ID NO: 2543964 - RNA, 14 nt, Chlamydophila pneumoniae J138
caucucucuccaaa

SEQ ID NO: 2543965 - RNA, 13 nt, Chlamydophila pneumoniae J138
caucucucuuuaa

SEQ ID NO: 2543966 - RNA, 23 nt, Chlamydophila pneumoniae J138
caucucuggaauacauuccuagc

SEQ ID NO: 2543967 - RNA, 22 nt, Chlamydophila pneumoniae J138
caucuggaauggccacagcuau

SEQ ID NO: 2543968 - RNA, 15 nt, Chlamydophila pneumoniae J138
caucuguauauucuc

SEQ ID NO: 2543969 - RNA, 14 nt, Chlamydophila pneumoniae J138
caucugucauuaaa

SEQ ID NO: 2543970 - RNA, 21 nt, Chlamydophila pneumoniae J138
caucugucauuaaaaauuuaa

SEQ ID NO: 2543971 - RNA, 23 nt, Chlamydophila pneumoniae J138
caucugucauuaaaaauuuaaaa

SEQ ID NO: 2543972 - RNA, 23 nt, Chlamydophila pneumoniae J138
caucuuaucaagagcucguaauc

SEQ ID NO: 2543973 - RNA, 21 nt, Chlamydophila pneumoniae J138
caucuucucgaacaggagaga

SEQ ID NO: 2543974 - RNA, 17 nt, Chlamydophila pneumoniae J138
caucuucuuggcuuucc

SEQ ID NO: 2543975 - RNA, 12 nt, Chlamydophila pneumoniae J138
caucuuguucug

SEQ ID NO: 2543976 - RNA, 13 nt, Chlamydophila pneumoniae J138
caucuuucaucaa

SEQ ID NO: 2543977 - RNA, 13 nt, Chlamydophila pneumoniae J138
caucuuuuacaga

SEQ ID NO: 2543978 - RNA, 17 nt, Chlamydophila pneumoniae J138
caucuuuuacagacuga

SEQ ID NO: 2543979 - RNA, 15 nt, Chlamydophila pneumoniae J138
cauuuaaauggaugc

SEQ ID NO: 2543980 - RNA, 17 nt, Chlamydophila pneumoniae J138
cauuuagacaaucuacg

SEQ ID NO: 2543981 - RNA, 16 nt, Chlamydophila pneumoniae J138
cauuuagauaaagaaa

SEQ ID NO: 2543982 - RNA, 18 nt, Chlamydophila pneumoniae J138
cauuucgauaacacuucu

SEQ ID NO: 2543983 - RNA, 23 nt, Chlamydophila pneumoniae J138
cauuucgauaacacuucuuucuu

SEQ ID NO: 2543984 - RNA, 21 nt, Chlamydophila pneumoniae J138
cauuucguuuuuucuuaucug

SEQ ID NO: 2543985 - RNA, 18 nt, Chlamydophila pneumoniae J138
cauuucuacacgccacaa

SEQ ID NO: 2543986 - RNA, 22 nt, Chlamydophila pneumoniae J138
cauuucuggagaaugccccuuc

SEQ ID NO: 2543987 - RNA, 17 nt, Chlamydophila pneumoniae J138
cauuugauucauaaaga

SEQ ID NO: 2543988 - RNA, 14 nt, Chlamydophila pneumoniae J138
cauuugcuuuaaca

SEQ ID NO: 2543989 - RNA, 22 nt, Chlamydophila pneumoniae J138
cauuuguaagaaucauaacaag

SEQ ID NO: 2543990 - RNA, 18 nt, Chlamydophila pneumoniae J138
cauuuucaggcugaacca

SEQ ID NO: 2543991 - RNA, 14 nt, Chlamydophila pneumoniae J138
cauuuucuaaagua

SEQ ID NO: 2543992 - RNA, 12 nt, Chlamydophila pneumoniae J138
cauuuuuaggau

SEQ ID NO: 2543993 - RNA, 15 nt, Chlamydophila pneumoniae J138
cauuuuucaauaacc

SEQ ID NO: 2543994 - RNA, 17 nt, Chlamydophila pneumoniae J138
cauuuuuggaaaaccau

SEQ ID NO: 2543995 - RNA, 20 nt, Chlamydophila pneumoniae J138
ccaaaaaaugcccguccccu

SEQ ID NO: 2543996 - RNA, 22 nt, Chlamydophila pneumoniae J138
ccaaaaaaugcccguccccucu

SEQ ID NO: 2543997 - RNA, 15 nt, Chlamydophila pneumoniae J138
ccaaaaauucccaua

SEQ ID NO: 2543998 - RNA, 19 nt, Chlamydophila pneumoniae J138
ccaaaaauucccauagcau

SEQ ID NO: 2543999 - RNA, 13 nt, Chlamydophila pneumoniae J138
ccaaaagaccaaa

SEQ ID NO: 2544000 - RNA, 15 nt, Chlamydophila pneumoniae J138
ccaaaauaaaaggag

SEQ ID NO: 2544001 - RNA, 16 nt, Chlamydophila pneumoniae J138
ccaaaauaaaaggagc

SEQ ID NO: 2544002 - RNA, 16 nt, Chlamydophila pneumoniae J138
ccaaaaugucuuuuuc

SEQ ID NO: 2544003 - RNA, 11 nt, Chlamydophila pneumoniae J138
ccaaacaugga

SEQ ID NO: 2544004 - RNA, 19 nt, Chlamydophila pneumoniae J138
ccaaaccucuuagcuauca

SEQ ID NO: 2544005 - RNA, 20 nt, Chlamydophila pneumoniae J138
ccaaacgaauuucuuguucc

SEQ ID NO: 2544006 - RNA, 14 nt, Chlamydophila pneumoniae J138
ccaaagaacagcac

SEQ ID NO: 2544007 - RNA, 21 nt, Chlamydophila pneumoniae J138
ccaaagaacagcacucucugc

SEQ ID NO: 2544008 - RNA, 21 nt, Chlamydophila pneumoniae J138
ccaaagaggggagcuauaaau

SEQ ID NO: 2544009 - RNA, 16 nt, Chlamydophila pneumoniae J138
ccaaagaucaucuuca

SEQ ID NO: 2544010 - RNA, 18 nt, Chlamydophila pneumoniae J138
ccaaagcagauccugcuu

SEQ ID NO: 2544011 - RNA, 23 nt, Chlamydophila pneumoniae J138
ccaaagcuauuucucuaucauca

SEQ ID NO: 2544012 - RNA, 14 nt, Chlamydophila pneumoniae J138
ccaaagcuucuuuc

SEQ ID NO: 2544013 - RNA, 15 nt, Chlamydophila pneumoniae J138
ccaaaggaaaauaau

SEQ ID NO: 2544014 - RNA, 19 nt, Chlamydophila pneumoniae J138
ccaaagucacucaaacccu

SEQ ID NO: 2544015 - RNA, 21 nt, Chlamydophila pneumoniae J138
ccaaagucacucaaacccucu

SEQ ID NO: 2544016 - RNA, 17 nt, Chlamydophila pneumoniae J138
ccaaaguuuguagcauu

SEQ ID NO: 2544017 - RNA, 13 nt, Chlamydophila pneumoniae J138
ccaaauaaagcaa

SEQ ID NO: 2544018 - RNA, 16 nt, Chlamydophila pneumoniae J138
ccaaauacgaacugua

SEQ ID NO: 2544019 - RNA, 13 nt, Chlamydophila pneumoniae J138
ccaaauccuccgc

SEQ ID NO: 2544020 - RNA, 15 nt, Chlamydophila pneumoniae J138
ccaaauccuccgccu

SEQ ID NO: 2544021 - RNA, 13 nt, Chlamydophila pneumoniae J138
ccaacaaagauga

SEQ ID NO: 2544022 - RNA, 17 nt, Chlamydophila pneumoniae J138
ccaacaagggaaagaaa

SEQ ID NO: 2544023 - RNA, 20 nt, Chlamydophila pneumoniae J138
ccaacacuuuuaaagauaag

SEQ ID NO: 2544024 - RNA, 15 nt, Chlamydophila pneumoniae J138
ccaacaguguagccu

SEQ ID NO: 2544025 - RNA, 15 nt, Chlamydophila pneumoniae J138
ccaacaguucuuucu

SEQ ID NO: 2544026 - RNA, 16 nt, Chlamydophila pneumoniae J138
ccaacaguucuuucug

SEQ ID NO: 2544027 - RNA, 19 nt, Chlamydophila pneumoniae J138
ccaacaucagcuguugcgu

SEQ ID NO: 2544028 - RNA, 17 nt, Chlamydophila pneumoniae J138
ccaacggcauaggauug

SEQ ID NO: 2544029 - RNA, 14 nt, Chlamydophila pneumoniae J138
ccaacuaaaacagc

SEQ ID NO: 2544030 - RNA, 11 nt, Chlamydophila pneumoniae J138
ccaacuagaau

SEQ ID NO: 2544031 - RNA, 13 nt, Chlamydophila pneumoniae J138
ccaacuccucuaa

SEQ ID NO: 2544032 - RNA, 12 nt, Chlamydophila pneumoniae J138
ccaacugagcua

SEQ ID NO: 2544033 - RNA, 18 nt, Chlamydophila pneumoniae J138
ccaacuuuugaagauccu

SEQ ID NO: 2544034 - RNA, 17 nt, Chlamydophila pneumoniae J138
ccaagaaaucucaguga

SEQ ID NO: 2544035 - RNA, 21 nt, Chlamydophila pneumoniae J138
ccaagaaugaaucgaagaaca

SEQ ID NO: 2544036 - RNA, 21 nt, Chlamydophila pneumoniae J138
ccaagacgcggaacucucuuc

SEQ ID NO: 2544037 - RNA, 22 nt, Chlamydophila pneumoniae J138
ccaagggagggacgacaaggag

SEQ ID NO: 2544038 - RNA, 22 nt, Chlamydophila pneumoniae J138
ccaaggggcguucuugaaaaaa

SEQ ID NO: 2544039 - RNA, 22 nt, Chlamydophila pneumoniae J138
ccaauaaccgaaacuucucaga

SEQ ID NO: 2544040 - RNA, 13 nt, Chlamydophila pneumoniae J138
ccaauacagcaua

SEQ ID NO: 2544041 - RNA, 14 nt, Chlamydophila pneumoniae J138
ccaauacuaaaacu

SEQ ID NO: 2544042 - RNA, 20 nt, Chlamydophila pneumoniae J138
ccaauauccagaaauacguc

SEQ ID NO: 2544043 - RNA, 17 nt, Chlamydophila pneumoniae J138
ccaauaugcucugccau

SEQ ID NO: 2544044 - RNA, 22 nt, Chlamydophila pneumoniae J138
ccaauccauucugagaaagaag

SEQ ID NO: 2544045 - RNA, 14 nt, Chlamydophila pneumoniae J138
ccaaucgauaacgu

SEQ ID NO: 2544046 - RNA, 19 nt, Chlamydophila pneumoniae J138
ccaaucgauaacguugccu

SEQ ID NO: 2544047 - RNA, 12 nt, Chlamydophila pneumoniae J138
ccaaucugcuga

SEQ ID NO: 2544048 - RNA, 13 nt, Chlamydophila pneumoniae J138
ccaaucuuccuua

SEQ ID NO: 2544049 - RNA, 12 nt, Chlamydophila pneumoniae J138
ccaaucuuucau

SEQ ID NO: 2544050 - RNA, 17 nt, Chlamydophila pneumoniae J138
ccaaugacgggagcucu

SEQ ID NO: 2544051 - RNA, 16 nt, Chlamydophila pneumoniae J138
ccaaugagcucuauuu

SEQ ID NO: 2544052 - RNA, 17 nt, Chlamydophila pneumoniae J138
ccaaugcuauuggaaca

SEQ ID NO: 2544053 - RNA, 23 nt, Chlamydophila pneumoniae J138
ccaaugggaauuugauuuuucaa

SEQ ID NO: 2544054 - RNA, 17 nt, Chlamydophila pneumoniae J138
ccaauuguaucuguauc

SEQ ID NO: 2544055 - RNA, 13 nt, Chlamydophila pneumoniae J138
ccaauuuuuuccc

SEQ ID NO: 2544056 - RNA, 17 nt, Chlamydophila pneumoniae J138
ccacaaaccucuaaaaa

SEQ ID NO: 2544057 - RNA, 15 nt, Chlamydophila pneumoniae J138
ccacaacauaacagg

SEQ ID NO: 2544058 - RNA, 23 nt, Chlamydophila pneumoniae J138
ccacaacuaaacgagcuguccag

SEQ ID NO: 2544059 - RNA, 23 nt, Chlamydophila pneumoniae J138
ccacaaguuauccuuaucuugcu

SEQ ID NO: 2544060 - RNA, 24 nt, Chlamydophila pneumoniae J138
ccacaauguuuagaauuuguccuu

SEQ ID NO: 2544061 - RNA, 14 nt, Chlamydophila pneumoniae J138
ccacaauuccuaaa

SEQ ID NO: 2544062 - RNA, 15 nt, Chlamydophila pneumoniae J138
ccacacaacucguuu

SEQ ID NO: 2544063 - RNA, 17 nt, Chlamydophila pneumoniae J138
ccacacaggauuguuau

SEQ ID NO: 2544064 - RNA, 16 nt, Chlamydophila pneumoniae J138
ccacagacugcaggaa

SEQ ID NO: 2544065 - RNA, 13 nt, Chlamydophila pneumoniae J138
ccacagcuucuuc

SEQ ID NO: 2544066 - RNA, 14 nt, Chlamydophila pneumoniae J138
ccacaggaaugaaa

SEQ ID NO: 2544067 - RNA, 22 nt, Chlamydophila pneumoniae J138
ccacaucaaagcaauuucuccu

SEQ ID NO: 2544068 - RNA, 23 nt, Chlamydophila pneumoniae J138
ccacaucuugagcuucaaaaagc

SEQ ID NO: 2544069 - RNA, 16 nt, Chlamydophila pneumoniae J138
ccacaugcccaaacau

SEQ ID NO: 2544070 - RNA, 16 nt, Chlamydophila pneumoniae J138
ccaccaggagcuccuc

SEQ ID NO: 2544071 - RNA, 14 nt, Chlamydophila pneumoniae J138
ccacgagauucugc

SEQ ID NO: 2544072 - RNA, 16 nt, Chlamydophila pneumoniae J138
ccacggauuuucucua

SEQ ID NO: 2544073 - RNA, 20 nt, Chlamydophila pneumoniae J138
ccacggauuuucucuacaca

SEQ ID NO: 2544074 - RNA, 13 nt, Chlamydophila pneumoniae J138
ccacguccauuuc

SEQ ID NO: 2544075 - RNA, 22 nt, Chlamydophila pneumoniae J138
ccacuaaguuuaggcaggaagu

SEQ ID NO: 2544076 - RNA, 13 nt, Chlamydophila pneumoniae J138
ccacuacugagcu

SEQ ID NO: 2544077 - RNA, 20 nt, Chlamydophila pneumoniae J138
ccacuacugagcuucuauuu

SEQ ID NO: 2544078 - RNA, 22 nt, Chlamydophila pneumoniae J138
ccacuccagaaaguauuccucu

SEQ ID NO: 2544079 - RNA, 12 nt, Chlamydophila pneumoniae J138
gaauuuuccuga

SEQ ID NO: 2544080 - RNA, 21 nt, Chlamydophila pneumoniae J138
gacaaaaaagggaucuccuuc

SEQ ID NO: 2544081 - RNA, 19 nt, Chlamydophila pneumoniae J138
gacaaaaaaucugaucuuc

SEQ ID NO: 2544082 - RNA, 17 nt, Chlamydophila pneumoniae J138
gacaaaggguuucuuuc

SEQ ID NO: 2544083 - RNA, 14 nt, Chlamydophila pneumoniae J138
gacaaauaaguccu

SEQ ID NO: 2544084 - RNA, 15 nt, Chlamydophila pneumoniae J138
gacaaauagaaagga

SEQ ID NO: 2544085 - RNA, 18 nt, Chlamydophila pneumoniae J138
gacaacaacauaaagaag

SEQ ID NO: 2544086 - RNA, 22 nt, Chlamydophila pneumoniae J138
gacaaggagucgugcaggagaa

SEQ ID NO: 2544087 - RNA, 20 nt, Chlamydophila pneumoniae J138
gacaagguggguagccagga

SEQ ID NO: 2544088 - RNA, 15 nt, Chlamydophila pneumoniae J138
gacaauaaaaaagag

SEQ ID NO: 2544089 - RNA, 21 nt, Chlamydophila pneumoniae J138
gacaauaccagauaaagcaaa

SEQ ID NO: 2544090 - RNA, 16 nt, Chlamydophila pneumoniae J138
gacaauauaagcacca

SEQ ID NO: 2544091 - RNA, 18 nt, Chlamydophila pneumoniae J138
gacaaucaacauucuucu

SEQ ID NO: 2544092 - RNA, 19 nt, Chlamydophila pneumoniae J138
gacaaucgcuguaaauuca

SEQ ID NO: 2544093 - RNA, 23 nt, Chlamydophila pneumoniae J138
gacaaugcaaccuguaaagacca

SEQ ID NO: 2544094 - RNA, 21 nt, Chlamydophila pneumoniae J138
gacacaaaaagcuuuuuucuc

SEQ ID NO: 2544095 - RNA, 12 nt, Chlamydophila pneumoniae J138
gacacaacucuu

SEQ ID NO: 2544096 - RNA, 16 nt, Chlamydophila pneumoniae J138
gacacagagaacaaua

SEQ ID NO: 2544097 - RNA, 21 nt, Chlamydophila pneumoniae J138
gacacagagaacaauaaacga

SEQ ID NO: 2544098 - RNA, 18 nt, Chlamydophila pneumoniae J138
gacaccaacaacaauaau

SEQ ID NO: 2544099 - RNA, 15 nt, Chlamydophila pneumoniae J138
gacaccuauaccaaa

SEQ ID NO: 2544100 - RNA, 19 nt, Chlamydophila pneumoniae J138
gacacgaacuuugaccaga

SEQ ID NO: 2544101 - RNA, 15 nt, Chlamydophila pneumoniae J138
gacacgccuccuuca

SEQ ID NO: 2544102 - RNA, 20 nt, Chlamydophila pneumoniae J138
gacacgccuccuucaaagau

SEQ ID NO: 2544103 - RNA, 23 nt, Chlamydophila pneumoniae J138
gacacgccuccuucaaagauaua

SEQ ID NO: 2544104 - RNA, 11 nt, Chlamydophila pneumoniae J138
gacacuaugug

SEQ ID NO: 2544105 - RNA, 17 nt, Chlamydophila pneumoniae J138
gacacucagcucccaug

SEQ ID NO: 2544106 - RNA, 19 nt, Chlamydophila pneumoniae J138
gacacuugcuuaaggaaac

SEQ ID NO: 2544107 - RNA, 23 nt, Chlamydophila pneumoniae J138
gacacuugcuuaaggaaacagug

SEQ ID NO: 2544108 - RNA, 19 nt, Chlamydophila pneumoniae J138
gacagacagucugugagaa

SEQ ID NO: 2544109 - RNA, 15 nt, Chlamydophila pneumoniae J138
gacagcagcauuuuc

SEQ ID NO: 2544110 - RNA, 17 nt, Chlamydophila pneumoniae J138
gacagcagcauuuucua

SEQ ID NO: 2544111 - RNA, 20 nt, Chlamydophila pneumoniae J138
gacagccggagcuucuaaga

SEQ ID NO: 2544112 - RNA, 17 nt, Chlamydophila pneumoniae J138
gacagcguauaggaaac

SEQ ID NO: 2544113 - RNA, 21 nt, Chlamydophila pneumoniae J138
gacagcugagaaauuccuaaa

SEQ ID NO: 2544114 - RNA, 14 nt, Chlamydophila pneumoniae J138
gacaggagcuacug

SEQ ID NO: 2544115 - RNA, 13 nt, Chlamydophila pneumoniae J138
gacagggaaagaa

SEQ ID NO: 2544116 - RNA, 13 nt, Chlamydophila pneumoniae J138
gacaguauucccu

SEQ ID NO: 2544117 - RNA, 23 nt, Chlamydophila pneumoniae J138
gacagucuccuggaacaguauaa

SEQ ID NO: 2544118 - RNA, 14 nt, Chlamydophila pneumoniae J138
gacagucugugaga

SEQ ID NO: 2544119 - RNA, 20 nt, Chlamydophila pneumoniae J138
gacagucugugagaaauagg

SEQ ID NO: 2544120 - RNA, 16 nt, Chlamydophila pneumoniae J138
gacauacaucaaaaug

SEQ ID NO: 2544121 - RNA, 22 nt, Chlamydophila pneumoniae J138
gacauacucgucaaauucauua

SEQ ID NO: 2544122 - RNA, 14 nt, Chlamydophila pneumoniae J138
gacaucuaauuuua

SEQ ID NO: 2544123 - RNA, 15 nt, Chlamydophila pneumoniae J138
gacaucuaauuuuaa

SEQ ID NO: 2544124 - RNA, 15 nt, Chlamydophila pneumoniae J138
gacaucuccaagaua

SEQ ID NO: 2544125 - RNA, 19 nt, Chlamydophila pneumoniae J138
gacaugagggcaugccuau

SEQ ID NO: 2544126 - RNA, 20 nt, Chlamydophila pneumoniae J138
gacaugccuaaauagcucag

SEQ ID NO: 2544127 - RNA, 21 nt, Chlamydophila pneumoniae J138
gacaugccuaaauagcucagu

SEQ ID NO: 2544128 - RNA, 23 nt, Chlamydophila pneumoniae J138
gacaugccuugguacuuaagcac

SEQ ID NO: 2544129 - RNA, 15 nt, Chlamydophila pneumoniae J138
gacaugcuuuccuuc

SEQ ID NO: 2544130 - RNA, 18 nt, Chlamydophila pneumoniae J138
gacauuauagaggucuuu

SEQ ID NO: 2544131 - RNA, 20 nt, Chlamydophila pneumoniae J138
gacauugaauccagcaccuu

SEQ ID NO: 2544132 - RNA, 16 nt, Chlamydophila pneumoniae J138
gacauuuucaagcuuu

SEQ ID NO: 2544133 - RNA, 23 nt, Chlamydophila pneumoniae J138
gaccaaacuucgauuggaagcaa

SEQ ID NO: 2544134 - RNA, 16 nt, Chlamydophila pneumoniae J138
gaccaaauaauuaaau

SEQ ID NO: 2544135 - RNA, 20 nt, Chlamydophila pneumoniae J138
gaccaacagauaggauggag

SEQ ID NO: 2544136 - RNA, 22 nt, Chlamydophila pneumoniae J138
gaccacuacuuaaagcuugaga

SEQ ID NO: 2544137 - RNA, 17 nt, Chlamydophila pneumoniae J138
gaccagaugauuuuuug

SEQ ID NO: 2544138 - RNA, 22 nt, Chlamydophila pneumoniae J138
gaccagaugcuaaagagucuuc

SEQ ID NO: 2544139 - RNA, 17 nt, Chlamydophila pneumoniae J138
gaccaguggcaggaaug

SEQ ID NO: 2544140 - RNA, 14 nt, Chlamydophila pneumoniae J138
gaccauaacagcac

SEQ ID NO: 2544141 - RNA, 15 nt, Chlamydophila pneumoniae J138
gaccauccuguagcu

SEQ ID NO: 2544142 - RNA, 19 nt, Chlamydophila pneumoniae J138
gaccgagaagcuucaauga

SEQ ID NO: 2544143 - RNA, 20 nt, Chlamydophila pneumoniae J138
gaccgcaaggagucacuggc

SEQ ID NO: 2544144 - RNA, 19 nt, Chlamydophila pneumoniae J138
gaccgcgagugugacugca

SEQ ID NO: 2544145 - RNA, 20 nt, Chlamydophila pneumoniae J138
gaccguccuccccauacaua

SEQ ID NO: 2544146 - RNA, 15 nt, Chlamydophila pneumoniae J138
gaccuacguuuucuc

SEQ ID NO: 2544147 - RNA, 15 nt, Chlamydophila pneumoniae J138
gaccucaucagaagu

SEQ ID NO: 2544148 - RNA, 19 nt, Chlamydophila pneumoniae J138
gaccucuagcucaaaucuc

SEQ ID NO: 2544149 - RNA, 19 nt, Chlamydophila pneumoniae J138
gaccugcaaacuccccagu

SEQ ID NO: 2544150 - RNA, 16 nt, Chlamydophila pneumoniae J138
gaccugcuuuuuuucu

SEQ ID NO: 2544151 - RNA, 16 nt, Chlamydophila pneumoniae J138
gacuaauaccuuucua

SEQ ID NO: 2544152 - RNA, 13 nt, Chlamydophila pneumoniae J138
gacuacaagauag

SEQ ID NO: 2544153 - RNA, 16 nt, Chlamydophila pneumoniae J138
gacuauagaaaaggau

SEQ ID NO: 2544154 - RNA, 18 nt, Chlamydophila pneumoniae J138
gacuauagaaaaggaugc

SEQ ID NO: 2544155 - RNA, 14 nt, Chlamydophila pneumoniae J138
gacuauagaugcca

SEQ ID NO: 2544156 - RNA, 18 nt, Chlamydophila pneumoniae J138
gacuaucgcaaauuucca

SEQ ID NO: 2544157 - RNA, 17 nt, Chlamydophila pneumoniae J138
gacuauguuuaaagcau

SEQ ID NO: 2544158 - RNA, 14 nt, Chlamydophila pneumoniae J138
gacuauuuuggaaa

SEQ ID NO: 2544159 - RNA, 21 nt, Chlamydophila pneumoniae J138
gacuauuuuggaaagcucuuu

SEQ ID NO: 2544160 - RNA, 16 nt, Chlamydophila pneumoniae J138
gacucaaucaaauuca

SEQ ID NO: 2544161 - RNA, 21 nt, Chlamydophila pneumoniae J138
gacucaugaaauaguguuucu

SEQ ID NO: 2544162 - RNA, 15 nt, Chlamydophila pneumoniae J138
gacuccaagaauagc

SEQ ID NO: 2544163 - RNA, 11 nt, Chlamydophila pneumoniae J138
gacucccaagg

SEQ ID NO: 2544164 - RNA, 21 nt, Chlamydophila pneumoniae J138
gacucgccgaaaguaucuuca

SEQ ID NO: 2544165 - RNA, 22 nt, Chlamydophila pneumoniae J138
gacucgccgaaaguaucuucag

SEQ ID NO: 2544166 - RNA, 16 nt, Chlamydophila pneumoniae J138
gacucgcgucaugcau

SEQ ID NO: 2544167 - RNA, 20 nt, Chlamydophila pneumoniae J138
gacucggaguguuggugaga

SEQ ID NO: 2544168 - RNA, 16 nt, Chlamydophila pneumoniae J138
gacucuaauucagaaa

SEQ ID NO: 2544169 - RNA, 14 nt, Chlamydophila pneumoniae J138
gacucuagaguacc

SEQ ID NO: 2544170 - RNA, 17 nt, Chlamydophila pneumoniae J138
gacucuaguuuuucuuu

SEQ ID NO: 2544171 - RNA, 19 nt, Chlamydophila pneumoniae J138
gacucucacugaguguccc

SEQ ID NO: 2544172 - RNA, 23 nt, Chlamydophila pneumoniae J138
gacucucaucagcaaaacucccg

SEQ ID NO: 2544173 - RNA, 23 nt, Chlamydophila pneumoniae J138
gacugaaaagaucguuaucaaaa

SEQ ID NO: 2544174 - RNA, 10 nt, Chlamydophila pneumoniae J138
gacugaaacu

SEQ ID NO: 2544175 - RNA, 11 nt, Chlamydophila pneumoniae J138
gacugaaacuc

SEQ ID NO: 2544176 - RNA, 14 nt, Chlamydophila pneumoniae J138
gacugcaaaggaag

SEQ ID NO: 2544177 - RNA, 17 nt, Chlamydophila pneumoniae J138
gacugcagauugcacuu

SEQ ID NO: 2544178 - RNA, 14 nt, Chlamydophila pneumoniae J138
gacugcuagagucc

SEQ ID NO: 2544179 - RNA, 17 nt, Chlamydophila pneumoniae J138
gacugcucuuucauuuc

SEQ ID NO: 2544180 - RNA, 18 nt, Chlamydophila pneumoniae J138
gacuggcgacuugccaau

SEQ ID NO: 2544181 - RNA, 19 nt, Chlamydophila pneumoniae J138
gacugugauugcguauaga

SEQ ID NO: 2544182 - RNA, 14 nt, Chlamydophila pneumoniae J138
gacuguuuguuuau

SEQ ID NO: 2544183 - RNA, 20 nt, Chlamydophila pneumoniae J138
gacuucaccuugaaguuuuu

SEQ ID NO: 2544184 - RNA, 21 nt, Chlamydophila pneumoniae J138
gacuucaccuugaaguuuuuu

SEQ ID NO: 2544185 - RNA, 23 nt, Chlamydophila pneumoniae J138
gacuucaccuugaaguuuuuucu

SEQ ID NO: 2544186 - RNA, 22 nt, Chlamydophila pneumoniae J138
gacuuccucuucaauuucuuca

SEQ ID NO: 2544187 - RNA, 18 nt, Chlamydophila pneumoniae J138
gacuucuggaagcuguug

SEQ ID NO: 2544188 - RNA, 20 nt, Chlamydophila pneumoniae J138
gacuucuuguccuguuaaga

SEQ ID NO: 2544189 - RNA, 20 nt, Chlamydophila pneumoniae J138
gacuugccaaucuuccuuaa

SEQ ID NO: 2544190 - RNA, 13 nt, Chlamydophila pneumoniae J138
gacuuguucuuca

SEQ ID NO: 2544191 - RNA, 23 nt, Chlamydophila pneumoniae J138
gacuuuagaaauuccaauuuuug

SEQ ID NO: 2544192 - RNA, 12 nt, Chlamydophila pneumoniae J138
gacuuuccucaa

SEQ ID NO: 2544193 - RNA, 12 nt, Chlamydophila pneumoniae J138
gacuuuccucuc

SEQ ID NO: 2544194 - RNA, 17 nt, Chlamydophila pneumoniae J138
gacuuuggucuucugua

SEQ ID NO: 2544195 - RNA, 19 nt, Chlamydophila pneumoniae J138
gagaaaagguaacauugga

SEQ ID NO: 2544196 - RNA, 13 nt, Chlamydophila pneumoniae J138
gagaaaaucaacu

SEQ ID NO: 2544197 - RNA, 17 nt, Chlamydophila pneumoniae J138
gagaaagcuucuaugaa

SEQ ID NO: 2544198 - RNA, 19 nt, Chlamydophila pneumoniae J138
gagaaagucgauuuccuuu

SEQ ID NO: 2544199 - RNA, 13 nt, Chlamydophila pneumoniae J138
gagaaaucacacu

SEQ ID NO: 2544200 - RNA, 18 nt, Chlamydophila pneumoniae J138
gagaaaugcucuucugca

SEQ ID NO: 2544201 - RNA, 21 nt, Chlamydophila pneumoniae J138
gagaacaugcccccacaaaac

SEQ ID NO: 2544202 - RNA, 14 nt, Chlamydophila pneumoniae J138
gagaacauguuucu

SEQ ID NO: 2544203 - RNA, 22 nt, Chlamydophila pneumoniae J138
gagaaccuucacaagaaaacaa

SEQ ID NO: 2544204 - RNA, 17 nt, Chlamydophila pneumoniae J138
gagaacguagcagaggc

SEQ ID NO: 2544205 - RNA, 11 nt, Chlamydophila pneumoniae J138
gagaacuucaa

SEQ ID NO: 2544206 - RNA, 12 nt, Chlamydophila pneumoniae J138
gagaacuucaac

SEQ ID NO: 2544207 - RNA, 22 nt, Chlamydophila pneumoniae J138
gagaacuuuaacgaagaaggga

SEQ ID NO: 2544208 - RNA, 17 nt, Chlamydophila pneumoniae J138
gagaagagguaauaaua

SEQ ID NO: 2544209 - RNA, 23 nt, Chlamydophila pneumoniae J138
gagaagcaucuucgauuucuagu

SEQ ID NO: 2544210 - RNA, 14 nt, Chlamydophila pneumoniae J138
gagaaguuugauaa

SEQ ID NO: 2544211 - RNA, 18 nt, Chlamydophila pneumoniae J138
gagaauacagagucugug

SEQ ID NO: 2544212 - RNA, 21 nt, Chlamydophila pneumoniae J138
gagaauacgaucugcuuugca

SEQ ID NO: 2544213 - RNA, 22 nt, Chlamydophila pneumoniae J138
gagaauacgaucugcuuugcau

SEQ ID NO: 2544214 - RNA, 13 nt, Chlamydophila pneumoniae J138
gagaaucaauaaa

SEQ ID NO: 2544215 - RNA, 18 nt, Chlamydophila pneumoniae J138
gagaauccuuuuuaggaa

SEQ ID NO: 2544216 - RNA, 17 nt, Chlamydophila pneumoniae J138
gagaaugaacaauagaa

SEQ ID NO: 2544217 - RNA, 19 nt, Chlamydophila pneumoniae J138
gagaaugacuuuagaaauu

SEQ ID NO: 2544218 - RNA, 12 nt, Chlamydophila pneumoniae J138
gagaaugcugua

SEQ ID NO: 2544219 - RNA, 12 nt, Chlamydophila pneumoniae J138
gagaauuuucau

SEQ ID NO: 2544220 - RNA, 17 nt, Chlamydophila pneumoniae J138
gagacaaagccacagcc

SEQ ID NO: 2544221 - RNA, 22 nt, Chlamydophila pneumoniae J138
gagacagacagucugugagaaa

SEQ ID NO: 2544222 - RNA, 22 nt, Chlamydophila pneumoniae J138
aaaagucucuagggaaaggagc

SEQ ID NO: 2544223 - RNA, 18 nt, Chlamydophila pneumoniae J138
aaaaguucagcaaggaag

SEQ ID NO: 2544224 - RNA, 22 nt, Chlamydophila pneumoniae J138
aaaaguuccccaauuucuuuuu

SEQ ID NO: 2544225 - RNA, 18 nt, Chlamydophila pneumoniae J138
aaaaguugaggaaaggag

SEQ ID NO: 2544226 - RNA, 14 nt, Chlamydophila pneumoniae J138
aaaaguugucuuug

SEQ ID NO: 2544227 - RNA, 13 nt, Chlamydophila pneumoniae J138
aaaauaaaaggag

SEQ ID NO: 2544228 - RNA, 17 nt, Chlamydophila pneumoniae J138
aaaauaaacauauucuc

SEQ ID NO: 2544229 - RNA, 17 nt, Chlamydophila pneumoniae J138
aaaauaaagaucuucau

SEQ ID NO: 2544230 - RNA, 18 nt, Chlamydophila pneumoniae J138
aaaauaauuuuauuaguu

SEQ ID NO: 2544231 - RNA, 18 nt, Chlamydophila pneumoniae J138
aaaauacagccagcagaa

SEQ ID NO: 2544232 - RNA, 23 nt, Chlamydophila pneumoniae J138
aaaauacauagguaaaaccagca

SEQ ID NO: 2544233 - RNA, 23 nt, Chlamydophila pneumoniae J138
aaaauagaaauaagcaucuagaa

SEQ ID NO: 2544234 - RNA, 13 nt, Chlamydophila pneumoniae J138
aaaauagacauuc

SEQ ID NO: 2544235 - RNA, 13 nt, Chlamydophila pneumoniae J138
aaaauagauaagu

SEQ ID NO: 2544236 - RNA, 13 nt, Chlamydophila pneumoniae J138
aaaauagauccug

SEQ ID NO: 2544237 - RNA, 20 nt, Chlamydophila pneumoniae J138
aaaauaggugacuucuuugc

SEQ ID NO: 2544238 - RNA, 20 nt, Chlamydophila pneumoniae J138
aaaauaguacgcuuuuuacu

SEQ ID NO: 2544239 - RNA, 16 nt, Chlamydophila pneumoniae J138
aaaauaucaccuacau

SEQ ID NO: 2544240 - RNA, 15 nt, Chlamydophila pneumoniae J138
aaaauaucauucacu

SEQ ID NO: 2544241 - RNA, 18 nt, Chlamydophila pneumoniae J138
aaaauaucauucacuauu

SEQ ID NO: 2544242 - RNA, 15 nt, Chlamydophila pneumoniae J138
aaaauauccuaaaua

SEQ ID NO: 2544243 - RNA, 22 nt, Chlamydophila pneumoniae J138
aaaauaucuccguuaccaaaaa

SEQ ID NO: 2544244 - RNA, 21 nt, Chlamydophila pneumoniae J138
aaaaucaaauagauuuuuacu

SEQ ID NO: 2544245 - RNA, 24 nt, Chlamydophila pneumoniae J138
aaaaucaagaagagaaaagauagu

SEQ ID NO: 2544246 - RNA, 18 nt, Chlamydophila pneumoniae J138
aaaaucaagccacagaga

SEQ ID NO: 2544247 - RNA, 22 nt, Chlamydophila pneumoniae J138
aaaaucacacuuucauccaaac

SEQ ID NO: 2544248 - RNA, 21 nt, Chlamydophila pneumoniae J138
aaaauccaggacuucgcaaau

SEQ ID NO: 2544249 - RNA, 18 nt, Chlamydophila pneumoniae J138
aaaaucgugcuuagagcc

SEQ ID NO: 2544250 - RNA, 20 nt, Chlamydophila pneumoniae J138
aaaaucuacauguaaagcaa

SEQ ID NO: 2544251 - RNA, 16 nt, Chlamydophila pneumoniae J138
aaaaucuccucucuca

SEQ ID NO: 2544252 - RNA, 21 nt, Chlamydophila pneumoniae J138
aaaaucuccucucucaauaag

SEQ ID NO: 2544253 - RNA, 19 nt, Chlamydophila pneumoniae J138
aaaaucucuaagaaucuau

SEQ ID NO: 2544254 - RNA, 19 nt, Chlamydophila pneumoniae J138
aaaaucugcagcagauacc

SEQ ID NO: 2544255 - RNA, 17 nt, Chlamydophila pneumoniae J138
aaaaucuuauuugaguu

SEQ ID NO: 2544256 - RNA, 17 nt, Chlamydophila pneumoniae J138
aaaaucuucuggaggga

SEQ ID NO: 2544257 - RNA, 18 nt, Chlamydophila pneumoniae J138
aaaaucuucuggagggag

SEQ ID NO: 2544258 - RNA, 13 nt, Chlamydophila pneumoniae J138
aaaaugaaagaaa

SEQ ID NO: 2544259 - RNA, 14 nt, Chlamydophila pneumoniae J138
aaaaugaaagaaac

SEQ ID NO: 2544260 - RNA, 17 nt, Chlamydophila pneumoniae J138
aaaaugaggacacaacu

SEQ ID NO: 2544261 - RNA, 21 nt, Chlamydophila pneumoniae J138
aaaaugaggacacaacucuuu

SEQ ID NO: 2544262 - RNA, 14 nt, Chlamydophila pneumoniae J138
aaaaugauucauaa

SEQ ID NO: 2544263 - RNA, 21 nt, Chlamydophila pneumoniae J138
aaaaugcacuuugaauaaugc

SEQ ID NO: 2544264 - RNA, 17 nt, Chlamydophila pneumoniae J138
aaaaugcccguccccuc

SEQ ID NO: 2544265 - RNA, 20 nt, Chlamydophila pneumoniae J138
aaaaugcgaggaaaaaggag

SEQ ID NO: 2544266 - RNA, 18 nt, Chlamydophila pneumoniae J138
aaaaugcuccugcaaaaa

SEQ ID NO: 2544267 - RNA, 17 nt, Chlamydophila pneumoniae J138
aaaaugggauccugcaa

SEQ ID NO: 2544268 - RNA, 22 nt, Chlamydophila pneumoniae J138
aaaauggugaagaauaauagca

SEQ ID NO: 2544269 - RNA, 19 nt, Chlamydophila pneumoniae J138
aaaauuaaagugaaagcaa

SEQ ID NO: 2544270 - RNA, 16 nt, Chlamydophila pneumoniae J138
aaaauuaagaacccga

SEQ ID NO: 2544271 - RNA, 19 nt, Chlamydophila pneumoniae J138
aaaauuaucuccaaagauc

SEQ ID NO: 2544272 - RNA, 20 nt, Chlamydophila pneumoniae J138
aaaauuauguauaaacucca

SEQ ID NO: 2544273 - RNA, 20 nt, Chlamydophila pneumoniae J138
aaaauucaaaucccugaugc

SEQ ID NO: 2544274 - RNA, 15 nt, Chlamydophila pneumoniae J138
aaaauucaugcaaaa

SEQ ID NO: 2544275 - RNA, 17 nt, Chlamydophila pneumoniae J138
aaaauucaugcaaaaca

SEQ ID NO: 2544276 - RNA, 19 nt, Chlamydophila pneumoniae J138
aaaauucccauagcaugag

SEQ ID NO: 2544277 - RNA, 23 nt, Chlamydophila pneumoniae J138
aaaauucgguaguggugaacuaa

SEQ ID NO: 2544278 - RNA, 19 nt, Chlamydophila pneumoniae J138
aaaauucuaaugguuuccc

SEQ ID NO: 2544279 - RNA, 14 nt, Chlamydophila pneumoniae J138
aaaauucuuaaaac

SEQ ID NO: 2544280 - RNA, 15 nt, Chlamydophila pneumoniae J138
aaaauucuuaaaacu

SEQ ID NO: 2544281 - RNA, 21 nt, Chlamydophila pneumoniae J138
aaaauugaacguagcuacaaa

SEQ ID NO: 2544282 - RNA, 22 nt, Chlamydophila pneumoniae J138
aaaauugauaguguucgagcau

SEQ ID NO: 2544283 - RNA, 21 nt, Chlamydophila pneumoniae J138
aaaauugcauuuaaacuaaga

SEQ ID NO: 2544284 - RNA, 13 nt, Chlamydophila pneumoniae J138
aaaauuguuggaa

SEQ ID NO: 2544285 - RNA, 22 nt, Chlamydophila pneumoniae J138
aaaauuguuuguaucaaagaaa

SEQ ID NO: 2544286 - RNA, 14 nt, Chlamydophila pneumoniae J138
aaaauuuaaaaaaa

SEQ ID NO: 2544287 - RNA, 17 nt, Chlamydophila pneumoniae J138
aaaauuuucaggaacuu

SEQ ID NO: 2544288 - RNA, 12 nt, Chlamydophila pneumoniae J138
aaaauuuuccca

SEQ ID NO: 2544289 - RNA, 11 nt, Chlamydophila pneumoniae J138
aaacaaaagca

SEQ ID NO: 2544290 - RNA, 15 nt, Chlamydophila pneumoniae J138
aaacaaaagccauuc

SEQ ID NO: 2544291 - RNA, 14 nt, Chlamydophila pneumoniae J138
aaacaacaaacuac

SEQ ID NO: 2544292 - RNA, 15 nt, Chlamydophila pneumoniae J138
aaacaacagaaaugu

SEQ ID NO: 2544293 - RNA, 23 nt, Chlamydophila pneumoniae J138
aaacaacgaucgucaguaaaaca

SEQ ID NO: 2544294 - RNA, 21 nt, Chlamydophila pneumoniae J138
aaacaacucccguuuuguugg

SEQ ID NO: 2544295 - RNA, 15 nt, Chlamydophila pneumoniae J138
aaacaagaaaaagca

SEQ ID NO: 2544296 - RNA, 15 nt, Chlamydophila pneumoniae J138
aaacaagaagaucaa

SEQ ID NO: 2544297 - RNA, 18 nt, Chlamydophila pneumoniae J138
aaacaagaagaucaaaga

SEQ ID NO: 2544298 - RNA, 17 nt, Chlamydophila pneumoniae J138
aaacaaucuaaagguuu

SEQ ID NO: 2544299 - RNA, 22 nt, Chlamydophila pneumoniae J138
aaacaaucuaaagguuuuaaau

SEQ ID NO: 2544300 - RNA, 22 nt, Chlamydophila pneumoniae J138
aaacaauuuccugcauggcuuu

SEQ ID NO: 2544301 - RNA, 11 nt, Chlamydophila pneumoniae J138
aaacacaaaua

SEQ ID NO: 2544302 - RNA, 20 nt, Chlamydophila pneumoniae J138
aaacacaaauagcaagagcu

SEQ ID NO: 2544303 - RNA, 16 nt, Chlamydophila pneumoniae J138
aaacacucaugaaagu

SEQ ID NO: 2544304 - RNA, 17 nt, Chlamydophila pneumoniae J138
aaacacugaacgccauc

SEQ ID NO: 2544305 - RNA, 18 nt, Chlamydophila pneumoniae J138
aaacacugcgcaaagaac

SEQ ID NO: 2544306 - RNA, 22 nt, Chlamydophila pneumoniae J138
aaacacuuuggauaggauagga

SEQ ID NO: 2544307 - RNA, 14 nt, Chlamydophila pneumoniae J138
aaacagcaaaguaa

SEQ ID NO: 2544308 - RNA, 15 nt, Chlamydophila pneumoniae J138
aaacagcaucaggau

SEQ ID NO: 2544309 - RNA, 23 nt, Chlamydophila pneumoniae J138
aaacagcaucaggauucucucug

SEQ ID NO: 2544310 - RNA, 16 nt, Chlamydophila pneumoniae J138
aaacaggaauaggcuc

SEQ ID NO: 2544311 - RNA, 15 nt, Chlamydophila pneumoniae J138
aaacaucagcaacau

SEQ ID NO: 2544312 - RNA, 16 nt, Chlamydophila pneumoniae J138
aaacaucgcagcagga

SEQ ID NO: 2544313 - RNA, 19 nt, Chlamydophila pneumoniae J138
aaacauuaccguucccuaa

SEQ ID NO: 2544314 - RNA, 15 nt, Chlamydophila pneumoniae J138
aaacauuagucaaug

SEQ ID NO: 2544315 - RNA, 13 nt, Chlamydophila pneumoniae J138
aaacauuuaaguc

SEQ ID NO: 2544316 - RNA, 17 nt, Chlamydophila pneumoniae J138
aaaccaaaaaaguaacu

SEQ ID NO: 2544317 - RNA, 19 nt, Chlamydophila pneumoniae J138
aaaccacggauuuucucua

SEQ ID NO: 2544318 - RNA, 14 nt, Chlamydophila pneumoniae J138
aaaccacuucucug

SEQ ID NO: 2544319 - RNA, 21 nt, Chlamydophila pneumoniae J138
aaaccauauugcaaagcaucu

SEQ ID NO: 2544320 - RNA, 17 nt, Chlamydophila pneumoniae J138
aaaccaucacuuccugu

SEQ ID NO: 2544321 - RNA, 22 nt, Chlamydophila pneumoniae J138
aaagauaaucuguaagaaaaug

SEQ ID NO: 2544322 - RNA, 21 nt, Chlamydophila pneumoniae J138
aaagauagcgacgucaucaua

SEQ ID NO: 2544323 - RNA, 16 nt, Chlamydophila pneumoniae J138
aaagauaguuauuaau

SEQ ID NO: 2544324 - RNA, 21 nt, Chlamydophila pneumoniae J138
aaagauaguuauuaauaaauu

SEQ ID NO: 2544325 - RNA, 20 nt, Chlamydophila pneumoniae J138
aaagauauagauucaugaaa

SEQ ID NO: 2544326 - RNA, 14 nt, Chlamydophila pneumoniae J138
aaagauaugucuug

SEQ ID NO: 2544327 - RNA, 22 nt, Chlamydophila pneumoniae J138
aaagaucauggauucacaucuu

SEQ ID NO: 2544328 - RNA, 22 nt, Chlamydophila pneumoniae J138
aaagaucgaucucugugguucc

SEQ ID NO: 2544329 - RNA, 22 nt, Chlamydophila pneumoniae J138
aaagaucgggucuacaacaguu

SEQ ID NO: 2544330 - RNA, 18 nt, Chlamydophila pneumoniae J138
aaagaucgugaucaaaga

SEQ ID NO: 2544331 - RNA, 21 nt, Chlamydophila pneumoniae J138
aaagaucgugaucaaagaaca

SEQ ID NO: 2544332 - RNA, 19 nt, Chlamydophila pneumoniae J138
aaagaucguuagagaccca

SEQ ID NO: 2544333 - RNA, 11 nt, Chlamydophila pneumoniae J138
aaagauuaagg

SEQ ID NO: 2544334 - RNA, 17 nt, Chlamydophila pneumoniae J138
aaagauuauucuagagu

SEQ ID NO: 2544335 - RNA, 12 nt, Chlamydophila pneumoniae J138
aaagauuccuaa

SEQ ID NO: 2544336 - RNA, 20 nt, Chlamydophila pneumoniae J138
aaagauuccuaagcuauaga

SEQ ID NO: 2544337 - RNA, 19 nt, Chlamydophila pneumoniae J138
aaagauucuaaaucaacua

SEQ ID NO: 2544338 - RNA, 15 nt, Chlamydophila pneumoniae J138
aaagauuucugcugu

SEQ ID NO: 2544339 - RNA, 17 nt, Chlamydophila pneumoniae J138
aaagcaaaaugguuguu

SEQ ID NO: 2544340 - RNA, 21 nt, Chlamydophila pneumoniae J138
aaagcaaagauaaagaaguuu

SEQ ID NO: 2544341 - RNA, 14 nt, Chlamydophila pneumoniae J138
aaagcaaccuuaaa

SEQ ID NO: 2544342 - RNA, 20 nt, Chlamydophila pneumoniae J138
aaagcaaucguguuuuccug

SEQ ID NO: 2544343 - RNA, 18 nt, Chlamydophila pneumoniae J138
aaagcaauuucuccuagg

SEQ ID NO: 2544344 - RNA, 21 nt, Chlamydophila pneumoniae J138
aaagcaauuucuccuaggucu

SEQ ID NO: 2544345 - RNA, 11 nt, Chlamydophila pneumoniae J138
aaagcacauac

SEQ ID NO: 2544346 - RNA, 19 nt, Chlamydophila pneumoniae J138
aaagcacuuaaaaaacuuc

SEQ ID NO: 2544347 - RNA, 12 nt, Chlamydophila pneumoniae J138
aaagcagcgaag

SEQ ID NO: 2544348 - RNA, 18 nt, Chlamydophila pneumoniae J138
aaagcaggagcaucauua

SEQ ID NO: 2544349 - RNA, 22 nt, Chlamydophila pneumoniae J138
aaagcauacuuauauuggcuuu

SEQ ID NO: 2544350 - RNA, 14 nt, Chlamydophila pneumoniae J138
aaagcauaguguau

SEQ ID NO: 2544351 - RNA, 20 nt, Chlamydophila pneumoniae J138
aaagcaucacggacuccguc

SEQ ID NO: 2544352 - RNA, 19 nt, Chlamydophila pneumoniae J138
aaagcaucuuucaucaaug

SEQ ID NO: 2544353 - RNA, 12 nt, Chlamydophila pneumoniae J138
aaagccacagcc

SEQ ID NO: 2544354 - RNA, 23 nt, Chlamydophila pneumoniae J138
aaagcccauuccugcaguauuau

SEQ ID NO: 2544355 - RNA, 23 nt, Chlamydophila pneumoniae J138
aaagccggcccacucaaaagaag

SEQ ID NO: 2544356 - RNA, 23 nt, Chlamydophila pneumoniae J138
aaagccguguaccucucaucaaa

SEQ ID NO: 2544357 - RNA, 16 nt, Chlamydophila pneumoniae J138
aaagccuaugauaaag

SEQ ID NO: 2544358 - RNA, 19 nt, Chlamydophila pneumoniae J138
aaagccuaugauaaagccu

SEQ ID NO: 2544359 - RNA, 12 nt, Chlamydophila pneumoniae J138
aaagccugucuu

SEQ ID NO: 2544360 - RNA, 18 nt, Chlamydophila pneumoniae J138
aaagcgaccugcaaauga

SEQ ID NO: 2544361 - RNA, 21 nt, Chlamydophila pneumoniae J138
aaagcgcaaaucuuacauaaa

SEQ ID NO: 2544362 - RNA, 20 nt, Chlamydophila pneumoniae J138
aaagcuacggaugggcacuc

SEQ ID NO: 2544363 - RNA, 16 nt, Chlamydophila pneumoniae J138
aaagcuauauaggguu

SEQ ID NO: 2544364 - RNA, 20 nt, Chlamydophila pneumoniae J138
aaagcuauuguuuuucaaua

SEQ ID NO: 2544365 - RNA, 22 nt, Chlamydophila pneumoniae J138
aaagcucuccuucagaguugau

SEQ ID NO: 2544366 - RNA, 16 nt, Chlamydophila pneumoniae J138
aaagcucuuucauaag

SEQ ID NO: 2544367 - RNA, 18 nt, Chlamydophila pneumoniae J138
aaagcucuuucauaagau

SEQ ID NO: 2544368 - RNA, 16 nt, Chlamydophila pneumoniae J138
aaagcugaauccaggu

SEQ ID NO: 2544369 - RNA, 22 nt, Chlamydophila pneumoniae J138
aaagcuguaaccaacaucaaag

SEQ ID NO: 2544370 - RNA, 23 nt, Chlamydophila pneumoniae J138
aaagcuuguuccacuugcucuuu

SEQ ID NO: 2544371 - RNA, 23 nt, Chlamydophila pneumoniae J138
aaagcuuuuccguaaguaaccaa

SEQ ID NO: 2544372 - RNA, 13 nt, Chlamydophila pneumoniae J138
aaagcuuuugcua

SEQ ID NO: 2544373 - RNA, 16 nt, Chlamydophila pneumoniae J138
aaagcuuuuuucucuu

SEQ ID NO: 2544374 - RNA, 19 nt, Chlamydophila pneumoniae J138
aaagcuuuuuucucuugcu

SEQ ID NO: 2544375 - RNA, 15 nt, Chlamydophila pneumoniae J138
aaaggaaaauaaucu

SEQ ID NO: 2544376 - RNA, 20 nt, Chlamydophila pneumoniae J138
aaaggaacuucguuucgcuu

SEQ ID NO: 2544377 - RNA, 22 nt, Chlamydophila pneumoniae J138
aaaggaacuucguuucgcuuug

SEQ ID NO: 2544378 - RNA, 18 nt, Chlamydophila pneumoniae J138
aaaggaaucccuuuuuaa

SEQ ID NO: 2544379 - RNA, 17 nt, Chlamydophila pneumoniae J138
aaaggaaucucgggaga

SEQ ID NO: 2544380 - RNA, 20 nt, Chlamydophila pneumoniae J138
aaaggacauagacuuugagu

SEQ ID NO: 2544381 - RNA, 17 nt, Chlamydophila pneumoniae J138
aaaggaccacaauuccu

SEQ ID NO: 2544382 - RNA, 17 nt, Chlamydophila pneumoniae J138
aaaggaccauuaauuuc

SEQ ID NO: 2544383 - RNA, 16 nt, Chlamydophila pneumoniae J138
aaaggaccuguuuucu

SEQ ID NO: 2544384 - RNA, 17 nt, Chlamydophila pneumoniae J138
aaaggaccuguuuucuu

SEQ ID NO: 2544385 - RNA, 16 nt, Chlamydophila pneumoniae J138
aaaggagaaagaauug

SEQ ID NO: 2544386 - RNA, 21 nt, Chlamydophila pneumoniae J138
aaaggagugggcuucaacucu

SEQ ID NO: 2544387 - RNA, 23 nt, Chlamydophila pneumoniae J138
aaaggauauugauaaaucccgaa

SEQ ID NO: 2544388 - RNA, 15 nt, Chlamydophila pneumoniae J138
aaaggaucauuaaag

SEQ ID NO: 2544389 - RNA, 21 nt, Chlamydophila pneumoniae J138
aaaggcucuuuuagagccuuu

SEQ ID NO: 2544390 - RNA, 13 nt, Chlamydophila pneumoniae J138
aaaggcuuuucuu

SEQ ID NO: 2544391 - RNA, 16 nt, Chlamydophila pneumoniae J138
aaagggcgcuucccua

SEQ ID NO: 2544392 - RNA, 19 nt, Chlamydophila pneumoniae J138
aaaggggcuccuaaagcau

SEQ ID NO: 2544393 - RNA, 14 nt, Chlamydophila pneumoniae J138
aaagguauuucucu

SEQ ID NO: 2544394 - RNA, 16 nt, Chlamydophila pneumoniae J138
aaaggugaaaguacag

SEQ ID NO: 2544395 - RNA, 17 nt, Chlamydophila pneumoniae J138
aaagguugauuggaucu

SEQ ID NO: 2544396 - RNA, 14 nt, Chlamydophila pneumoniae J138
aaagguuguaagga

SEQ ID NO: 2544397 - RNA, 13 nt, Chlamydophila pneumoniae J138
aaagguuuuaaaa

SEQ ID NO: 2544398 - RNA, 14 nt, Chlamydophila pneumoniae J138
aaagguuuuaaauu

SEQ ID NO: 2544399 - RNA, 14 nt, Chlamydophila pneumoniae J138
aaagguuuuauaaa

SEQ ID NO: 2544400 - RNA, 16 nt, Chlamydophila pneumoniae J138
aaagguuuugaagcuc

SEQ ID NO: 2544401 - RNA, 14 nt, Chlamydophila pneumoniae J138
aaaguaaaaaauac

SEQ ID NO: 2544402 - RNA, 17 nt, Chlamydophila pneumoniae J138
aaaguaacgauaagaag

SEQ ID NO: 2544403 - RNA, 14 nt, Chlamydophila pneumoniae J138
aaaguaacuaucua

SEQ ID NO: 2544404 - RNA, 16 nt, Chlamydophila pneumoniae J138
aaaguaacuaucuaca

SEQ ID NO: 2544405 - RNA, 14 nt, Chlamydophila pneumoniae J138
aaaguaaucacuuc

SEQ ID NO: 2544406 - RNA, 16 nt, Chlamydophila pneumoniae J138
aaaguaccuaggaucu

SEQ ID NO: 2544407 - RNA, 17 nt, Chlamydophila pneumoniae J138
aaaguaccuaggaucua

SEQ ID NO: 2544408 - RNA, 16 nt, Chlamydophila pneumoniae J138
aaaguacgaccaacuc

SEQ ID NO: 2544409 - RNA, 18 nt, Chlamydophila pneumoniae J138
aaaguacgcauaggccaa

SEQ ID NO: 2544410 - RNA, 12 nt, Chlamydophila pneumoniae J138
aaaguacuacaa

SEQ ID NO: 2544411 - RNA, 14 nt, Chlamydophila pneumoniae J138
aaaguagaauccuu

SEQ ID NO: 2544412 - RNA, 17 nt, Chlamydophila pneumoniae J138
aaaguaggcacaucauu

SEQ ID NO: 2544413 - RNA, 20 nt, Chlamydophila pneumoniae J138
aaaguaggggcaguuccuaa

SEQ ID NO: 2544414 - RNA, 16 nt, Chlamydophila pneumoniae J138
aaaguaguuuuaagaa

SEQ ID NO: 2544415 - RNA, 18 nt, Chlamydophila pneumoniae J138
aaaguauuccucuuagga

SEQ ID NO: 2544416 - RNA, 18 nt, Chlamydophila pneumoniae J138
aaagucacggcgaaagcu

SEQ ID NO: 2544417 - RNA, 18 nt, Chlamydophila pneumoniae J138
aaagucacucaaacccuc

SEQ ID NO: 2544418 - RNA, 15 nt, Chlamydophila pneumoniae J138
aaaguccaagaucaa

SEQ ID NO: 2544419 - RNA, 23 nt, Chlamydophila pneumoniae J138
aaagugaaauugaacucucaguu

SEQ ID NO: 2544420 - RNA, 20 nt, Chlamydophila pneumoniae J138
aaagugacuuccuccaaaau

SEQ ID NO: 2544421 - RNA, 13 nt, Chlamydophila pneumoniae J138
aaaugcuccugca

SEQ ID NO: 2544422 - RNA, 22 nt, Chlamydophila pneumoniae J138
aaaugcuccugcaaaaaaccag

SEQ ID NO: 2544423 - RNA, 22 nt, Chlamydophila pneumoniae J138
aaauggugaagaauaauagcaa

SEQ ID NO: 2544424 - RNA, 10 nt, Chlamydophila pneumoniae J138
aaauguaggg

SEQ ID NO: 2544425 - RNA, 17 nt, Chlamydophila pneumoniae J138
aaauguauaggcauuaa

SEQ ID NO: 2544426 - RNA, 18 nt, Chlamydophila pneumoniae J138
aaaugugaaaucguaucu

SEQ ID NO: 2544427 - RNA, 22 nt, Chlamydophila pneumoniae J138
aaaugugcucggacagaaagau

SEQ ID NO: 2544428 - RNA, 21 nt, Chlamydophila pneumoniae J138
aaauguuuaucgacucuucca

SEQ ID NO: 2544429 - RNA, 20 nt, Chlamydophila pneumoniae J138
aaauguuuugcgauaucuau

SEQ ID NO: 2544430 - RNA, 12 nt, Chlamydophila pneumoniae J138
aaauuaaauauc

SEQ ID NO: 2544431 - RNA, 16 nt, Chlamydophila pneumoniae J138
aaauuaaauucuuuuc

SEQ ID NO: 2544432 - RNA, 13 nt, Chlamydophila pneumoniae J138
aaauuaacaacac

SEQ ID NO: 2544433 - RNA, 12 nt, Chlamydophila pneumoniae J138
aaauuaacagag

SEQ ID NO: 2544434 - RNA, 21 nt, Chlamydophila pneumoniae J138
aaauuaccguuuccuccucuu

SEQ ID NO: 2544435 - RNA, 20 nt, Chlamydophila pneumoniae J138
aaauuaguaaaugccucuuu

SEQ ID NO: 2544436 - RNA, 18 nt, Chlamydophila pneumoniae J138
aaauucaaaauagaagcc

SEQ ID NO: 2544437 - RNA, 16 nt, Chlamydophila pneumoniae J138
aaauucauuaagaaca

SEQ ID NO: 2544438 - RNA, 21 nt, Chlamydophila pneumoniae J138
aaauuccaauuuuugcauaga

SEQ ID NO: 2544439 - RNA, 12 nt, Chlamydophila pneumoniae J138
aaauuccucuug

SEQ ID NO: 2544440 - RNA, 14 nt, Chlamydophila pneumoniae J138
aaauuccuucucag

SEQ ID NO: 2544441 - RNA, 17 nt, Chlamydophila pneumoniae J138
aaauuccuucucagaaa

SEQ ID NO: 2544442 - RNA, 22 nt, Chlamydophila pneumoniae J138
aaauuccuucucagaaagauau

SEQ ID NO: 2544443 - RNA, 18 nt, Chlamydophila pneumoniae J138
aaauucgaauucucagaa

SEQ ID NO: 2544444 - RNA, 13 nt, Chlamydophila pneumoniae J138
aaauucuaagcgc

SEQ ID NO: 2544445 - RNA, 21 nt, Chlamydophila pneumoniae J138
aaauucuagguuucaggaaau

SEQ ID NO: 2544446 - RNA, 20 nt, Chlamydophila pneumoniae J138
aaauucuggaauuucccaua

SEQ ID NO: 2544447 - RNA, 22 nt, Chlamydophila pneumoniae J138
aaauucuggagucgagcagaaa

SEQ ID NO: 2544448 - RNA, 12 nt, Chlamydophila pneumoniae J138
aaauucuguaaa

SEQ ID NO: 2544449 - RNA, 15 nt, Chlamydophila pneumoniae J138
aaauucuuaaaacug

SEQ ID NO: 2544450 - RNA, 21 nt, Chlamydophila pneumoniae J138
aaauucuuaacaauauaugcu

SEQ ID NO: 2544451 - RNA, 16 nt, Chlamydophila pneumoniae J138
aaauucuuuucuacau

SEQ ID NO: 2544452 - RNA, 17 nt, Chlamydophila pneumoniae J138
aaauugaauaucgaguu

SEQ ID NO: 2544453 - RNA, 20 nt, Chlamydophila pneumoniae J138
aaauuguuaucaggaacuaa

SEQ ID NO: 2544454 - RNA, 20 nt, Chlamydophila pneumoniae J138
aaauuguuggaauugcauua

SEQ ID NO: 2544455 - RNA, 20 nt, Chlamydophila pneumoniae J138
aaauuguuuguaucaaagaa

SEQ ID NO: 2544456 - RNA, 13 nt, Chlamydophila pneumoniae J138
aaauuguuuuugc

SEQ ID NO: 2544457 - RNA, 22 nt, Chlamydophila pneumoniae J138
aaauuuaagauaucgaccuuaa

SEQ ID NO: 2544458 - RNA, 20 nt, Chlamydophila pneumoniae J138
aaauuuccgcuguauuuuca

SEQ ID NO: 2544459 - RNA, 23 nt, Chlamydophila pneumoniae J138
aaauuuccuaccuauauuuuuua

SEQ ID NO: 2544460 - RNA, 18 nt, Chlamydophila pneumoniae J138
aaauuucugaaacaaugc

SEQ ID NO: 2544461 - RNA, 23 nt, Chlamydophila pneumoniae J138
aaauuugcucuccugcaaaaagu

SEQ ID NO: 2544462 - RNA, 13 nt, Chlamydophila pneumoniae J138
aaauuugucauca

SEQ ID NO: 2544463 - RNA, 17 nt, Chlamydophila pneumoniae J138
aaauuuucccauuacag

SEQ ID NO: 2544464 - RNA, 11 nt, Chlamydophila pneumoniae J138
aaauuuucuaa

SEQ ID NO: 2544465 - RNA, 12 nt, Chlamydophila pneumoniae J138
aaauuuuuaaaa

SEQ ID NO: 2544466 - RNA, 12 nt, Chlamydophila pneumoniae J138
aaauuuuuccuu

SEQ ID NO: 2544467 - RNA, 16 nt, Chlamydophila pneumoniae J138
aacaaaaacugcgcua

SEQ ID NO: 2544468 - RNA, 20 nt, Chlamydophila pneumoniae J138
aacaaaaaggacucuuucua

SEQ ID NO: 2544469 - RNA, 19 nt, Chlamydophila pneumoniae J138
aacaaaaggcccaacucuu

SEQ ID NO: 2544470 - RNA, 21 nt, Chlamydophila pneumoniae J138
aacaaacuuguuuucguaaga

SEQ ID NO: 2544471 - RNA, 17 nt, Chlamydophila pneumoniae J138
aacaaagguuauggaug

SEQ ID NO: 2544472 - RNA, 22 nt, Chlamydophila pneumoniae J138
aacaaaguuuaugacacagcua

SEQ ID NO: 2544473 - RNA, 15 nt, Chlamydophila pneumoniae J138
aacaacagaaauguu

SEQ ID NO: 2544474 - RNA, 14 nt, Chlamydophila pneumoniae J138
aacaacauaaagaa

SEQ ID NO: 2544475 - RNA, 15 nt, Chlamydophila pneumoniae J138
aacaacauaaagaag

SEQ ID NO: 2544476 - RNA, 17 nt, Chlamydophila pneumoniae J138
aacaacauaaagaaggu

SEQ ID NO: 2544477 - RNA, 23 nt, Chlamydophila pneumoniae J138
aacaacaucacuaucauggacaa

SEQ ID NO: 2544478 - RNA, 19 nt, Chlamydophila pneumoniae J138
aacaaccaucccauaugga

SEQ ID NO: 2544479 - RNA, 22 nt, Chlamydophila pneumoniae J138
aacaacucucccauguaguaaa

SEQ ID NO: 2544480 - RNA, 14 nt, Chlamydophila pneumoniae J138
aacaacugaaaaac

SEQ ID NO: 2544481 - RNA, 12 nt, Chlamydophila pneumoniae J138
aacaacuucuga

SEQ ID NO: 2544482 - RNA, 14 nt, Chlamydophila pneumoniae J138
aacaagaagaucaa

SEQ ID NO: 2544483 - RNA, 15 nt, Chlamydophila pneumoniae J138
aacaagaagaucaaa

SEQ ID NO: 2544484 - RNA, 14 nt, Chlamydophila pneumoniae J138
aacaagacgaaagc

SEQ ID NO: 2544485 - RNA, 23 nt, Chlamydophila pneumoniae J138
aacaagauaaccugagaguguug

SEQ ID NO: 2544486 - RNA, 22 nt, Chlamydophila pneumoniae J138
aacaagcugcugagcagcaaaa

SEQ ID NO: 2544487 - RNA, 16 nt, Chlamydophila pneumoniae J138
aacaagggaaagaaac

SEQ ID NO: 2544488 - RNA, 18 nt, Chlamydophila pneumoniae J138
aacaagggaaagaaacua

SEQ ID NO: 2544489 - RNA, 14 nt, Chlamydophila pneumoniae J138
aacaaguaccaaga

SEQ ID NO: 2544490 - RNA, 14 nt, Chlamydophila pneumoniae J138
aacaagucggcagg

SEQ ID NO: 2544491 - RNA, 23 nt, Chlamydophila pneumoniae J138
aacaauaaacgagacugcaaagg

SEQ ID NO: 2544492 - RNA, 14 nt, Chlamydophila pneumoniae J138
aacaaucuuucuuc

SEQ ID NO: 2544493 - RNA, 16 nt, Chlamydophila pneumoniae J138
aacaaucuuucuucua

SEQ ID NO: 2544494 - RNA, 18 nt, Chlamydophila pneumoniae J138
aacaaucuuucuucuaga

SEQ ID NO: 2544495 - RNA, 15 nt, Chlamydophila pneumoniae J138
aacaaugcaucccug

SEQ ID NO: 2544496 - RNA, 15 nt, Chlamydophila pneumoniae J138
aacaauguaaauuga

SEQ ID NO: 2544497 - RNA, 14 nt, Chlamydophila pneumoniae J138
aacacaaauagcaa

SEQ ID NO: 2544498 - RNA, 20 nt, Chlamydophila pneumoniae J138
aacacaaauagcaagagcua

SEQ ID NO: 2544499 - RNA, 20 nt, Chlamydophila pneumoniae J138
aacacagauaggaaccacuu

SEQ ID NO: 2544500 - RNA, 15 nt, Chlamydophila pneumoniae J138
aacaccauaaaacaa

SEQ ID NO: 2544501 - RNA, 15 nt, Chlamydophila pneumoniae J138
aacacccggcuuuuc

SEQ ID NO: 2544502 - RNA, 17 nt, Chlamydophila pneumoniae J138
aacacccggcuuuucca

SEQ ID NO: 2544503 - RNA, 19 nt, Chlamydophila pneumoniae J138
aacaccgaaggcacuggca

SEQ ID NO: 2544504 - RNA, 17 nt, Chlamydophila pneumoniae J138
aacaccguuaauuuuug

SEQ ID NO: 2544505 - RNA, 16 nt, Chlamydophila pneumoniae J138
aacacgcacaaacuaa

SEQ ID NO: 2544506 - RNA, 23 nt, Chlamydophila pneumoniae J138
aacacgucacuggggcauaagaa

SEQ ID NO: 2544507 - RNA, 17 nt, Chlamydophila pneumoniae J138
aacacgucgaacaugac

SEQ ID NO: 2544508 - RNA, 19 nt, Chlamydophila pneumoniae J138
aacacucucuaccaucaug

SEQ ID NO: 2544509 - RNA, 22 nt, Chlamydophila pneumoniae J138
aacacuuaguccgguuucuucu

SEQ ID NO: 2544510 - RNA, 14 nt, Chlamydophila pneumoniae J138
aacagaaauugcuu

SEQ ID NO: 2544511 - RNA, 16 nt, Chlamydophila pneumoniae J138
aacagaaauugcuucu

SEQ ID NO: 2544512 - RNA, 20 nt, Chlamydophila pneumoniae J138
aacagauaagacaauaaaau

SEQ ID NO: 2544513 - RNA, 17 nt, Chlamydophila pneumoniae J138
aacagaucuuuaucauu

SEQ ID NO: 2544514 - RNA, 20 nt, Chlamydophila pneumoniae J138
aacagauuuuucaagaacuc

SEQ ID NO: 2544515 - RNA, 18 nt, Chlamydophila pneumoniae J138
aacagcacucacgcucuc

SEQ ID NO: 2544516 - RNA, 20 nt, Chlamydophila pneumoniae J138
aacagcacucacgcucucgc

SEQ ID NO: 2544517 - RNA, 15 nt, Chlamydophila pneumoniae J138
aacagcacucucugc

SEQ ID NO: 2544518 - RNA, 21 nt, Chlamydophila pneumoniae J138
aacagcgguugccuuucucuu

SEQ ID NO: 2544519 - RNA, 22 nt, Chlamydophila pneumoniae J138
aacagcuccuggauauugucaa

SEQ ID NO: 2544520 - RNA, 17 nt, Chlamydophila pneumoniae J138
aacaggaauagaaaauc

SEQ ID NO: 2544521 - RNA, 18 nt, Chlamydophila pneumoniae J138
aacguagaugucuugguu

SEQ ID NO: 2544522 - RNA, 18 nt, Chlamydophila pneumoniae J138
aacguagcuacaaaauua

SEQ ID NO: 2544523 - RNA, 16 nt, Chlamydophila pneumoniae J138
aacguauccuugauuu

SEQ ID NO: 2544524 - RNA, 20 nt, Chlamydophila pneumoniae J138
aacguauccuugauuuuaaa

SEQ ID NO: 2544525 - RNA, 19 nt, Chlamydophila pneumoniae J138
aacgugauugcugcugcua

SEQ ID NO: 2544526 - RNA, 15 nt, Chlamydophila pneumoniae J138
aacgugcugcgaauu

SEQ ID NO: 2544527 - RNA, 12 nt, Chlamydophila pneumoniae J138
aacguugauugg

SEQ ID NO: 2544528 - RNA, 15 nt, Chlamydophila pneumoniae J138
aacuaaaacagccua

SEQ ID NO: 2544529 - RNA, 22 nt, Chlamydophila pneumoniae J138
aacuaaaaugguaaaccuaccu

SEQ ID NO: 2544530 - RNA, 15 nt, Chlamydophila pneumoniae J138
aacuaaauucuuaac

SEQ ID NO: 2544531 - RNA, 20 nt, Chlamydophila pneumoniae J138
aacuaacuguaauuucaauu

SEQ ID NO: 2544532 - RNA, 19 nt, Chlamydophila pneumoniae J138
aacuaagaauaccuauagg

SEQ ID NO: 2544533 - RNA, 14 nt, Chlamydophila pneumoniae J138
aacuaccagaugcc

SEQ ID NO: 2544534 - RNA, 18 nt, Chlamydophila pneumoniae J138
aacuacucucauucaccu

SEQ ID NO: 2544535 - RNA, 17 nt, Chlamydophila pneumoniae J138
aacuacuuaaauccuaa

SEQ ID NO: 2544536 - RNA, 17 nt, Chlamydophila pneumoniae J138
aacuagagaucuuuuua

SEQ ID NO: 2544537 - RNA, 17 nt, Chlamydophila pneumoniae J138
aacuaggaaaagcauag

SEQ ID NO: 2544538 - RNA, 22 nt, Chlamydophila pneumoniae J138
aacuagguuauuaucaaaguga

SEQ ID NO: 2544539 - RNA, 19 nt, Chlamydophila pneumoniae J138
aacuauaauauaacugcau

SEQ ID NO: 2544540 - RNA, 17 nt, Chlamydophila pneumoniae J138
aacuauguuauccauac

SEQ ID NO: 2544541 - RNA, 16 nt, Chlamydophila pneumoniae J138
aacucaaucucuuuga

SEQ ID NO: 2544542 - RNA, 17 nt, Chlamydophila pneumoniae J138
aacucaaucucuuugac

SEQ ID NO: 2544543 - RNA, 12 nt, Chlamydophila pneumoniae J138
aacucagagauu

SEQ ID NO: 2544544 - RNA, 13 nt, Chlamydophila pneumoniae J138
aacucagcuuuca

SEQ ID NO: 2544545 - RNA, 22 nt, Chlamydophila pneumoniae J138
aacucaucacaauuuuaaaauc

SEQ ID NO: 2544546 - RNA, 20 nt, Chlamydophila pneumoniae J138
aacucauccuaaauuaaaua

SEQ ID NO: 2544547 - RNA, 15 nt, Chlamydophila pneumoniae J138
aacuccaaaauauuc

SEQ ID NO: 2544548 - RNA, 16 nt, Chlamydophila pneumoniae J138
aacuccaaaauauucu

SEQ ID NO: 2544549 - RNA, 12 nt, Chlamydophila pneumoniae J138
aacuccacgcca

SEQ ID NO: 2544550 - RNA, 17 nt, Chlamydophila pneumoniae J138
aacuccaggggauaaaa

SEQ ID NO: 2544551 - RNA, 22 nt, Chlamydophila pneumoniae J138
aacuccaggggauaaaacuaua

SEQ ID NO: 2544552 - RNA, 18 nt, Chlamydophila pneumoniae J138
aacuccccaguuuuccau

SEQ ID NO: 2544553 - RNA, 15 nt, Chlamydophila pneumoniae J138
aacucccguuuuguu

SEQ ID NO: 2544554 - RNA, 18 nt, Chlamydophila pneumoniae J138
aacuccgcccgucuuaga

SEQ ID NO: 2544555 - RNA, 14 nt, Chlamydophila pneumoniae J138
aacucuaaucugau

SEQ ID NO: 2544556 - RNA, 18 nt, Chlamydophila pneumoniae J138
aacucuaaucugauucaa

SEQ ID NO: 2544557 - RNA, 15 nt, Chlamydophila pneumoniae J138
aacucuagaucuuca

SEQ ID NO: 2544558 - RNA, 14 nt, Chlamydophila pneumoniae J138
aacucucaguuaaa

SEQ ID NO: 2544559 - RNA, 20 nt, Chlamydophila pneumoniae J138
aacucucccauguaguaaau

SEQ ID NO: 2544560 - RNA, 12 nt, Chlamydophila pneumoniae J138
aacucucuuccu

SEQ ID NO: 2544561 - RNA, 18 nt, Chlamydophila pneumoniae J138
aacucugaaguacacuac

SEQ ID NO: 2544562 - RNA, 19 nt, Chlamydophila pneumoniae J138
aacucuuaaagguaaagcu

SEQ ID NO: 2544563 - RNA, 20 nt, Chlamydophila pneumoniae J138
aacucuuaaagguaaagcuu

SEQ ID NO: 2544564 - RNA, 14 nt, Chlamydophila pneumoniae J138
aacucuucaagagc

SEQ ID NO: 2544565 - RNA, 19 nt, Chlamydophila pneumoniae J138
aacucuuuaauugugcucu

SEQ ID NO: 2544566 - RNA, 20 nt, Chlamydophila pneumoniae J138
aacucuuuaggucuugucua

SEQ ID NO: 2544567 - RNA, 13 nt, Chlamydophila pneumoniae J138
aacucuuugagga

SEQ ID NO: 2544568 - RNA, 21 nt, Chlamydophila pneumoniae J138
aacugacguuuuucccuaccu

SEQ ID NO: 2544569 - RNA, 22 nt, Chlamydophila pneumoniae J138
aacugagcaacuucuucguuag

SEQ ID NO: 2544570 - RNA, 23 nt, Chlamydophila pneumoniae J138
aacugaggcaaagauuuccaauc

SEQ ID NO: 2544571 - RNA, 15 nt, Chlamydophila pneumoniae J138
aacugaugccaagaa

SEQ ID NO: 2544572 - RNA, 22 nt, Chlamydophila pneumoniae J138
aacugauuaguuuguuuuaauu

SEQ ID NO: 2544573 - RNA, 13 nt, Chlamydophila pneumoniae J138
aacugcaaaaaga

SEQ ID NO: 2544574 - RNA, 15 nt, Chlamydophila pneumoniae J138
aacugcauaaucuca

SEQ ID NO: 2544575 - RNA, 18 nt, Chlamydophila pneumoniae J138
aacugccugagaaaaguu

SEQ ID NO: 2544576 - RNA, 18 nt, Chlamydophila pneumoniae J138
aacugcgauacucucagc

SEQ ID NO: 2544577 - RNA, 21 nt, Chlamydophila pneumoniae J138
aacugcgauacucucagcaaa

SEQ ID NO: 2544578 - RNA, 23 nt, Chlamydophila pneumoniae J138
aacugcgcuagcuccagcaucac

SEQ ID NO: 2544579 - RNA, 18 nt, Chlamydophila pneumoniae J138
aacugcgcuaucaucauu

SEQ ID NO: 2544580 - RNA, 16 nt, Chlamydophila pneumoniae J138
aacugcuccugaagcu

SEQ ID NO: 2544581 - RNA, 18 nt, Chlamydophila pneumoniae J138
aacugcuuggucacacca

SEQ ID NO: 2544582 - RNA, 20 nt, Chlamydophila pneumoniae J138
aacugcuuggucacaccaaa

SEQ ID NO: 2544583 - RNA, 18 nt, Chlamydophila pneumoniae J138
aacuggcaaucuaaaauc

SEQ ID NO: 2544584 - RNA, 19 nt, Chlamydophila pneumoniae J138
aacuggcaaucuaaaauca

SEQ ID NO: 2544585 - RNA, 16 nt, Chlamydophila pneumoniae J138
aacugugccauaacgc

SEQ ID NO: 2544586 - RNA, 19 nt, Chlamydophila pneumoniae J138
aacuguguucaauagcaaa

SEQ ID NO: 2544587 - RNA, 13 nt, Chlamydophila pneumoniae J138
aacuguguuuucu

SEQ ID NO: 2544588 - RNA, 17 nt, Chlamydophila pneumoniae J138
aacuuaaagacuugcuu

SEQ ID NO: 2544589 - RNA, 13 nt, Chlamydophila pneumoniae J138
aacuucaaaaguu

SEQ ID NO: 2544590 - RNA, 14 nt, Chlamydophila pneumoniae J138
aacuucaacaaagg

SEQ ID NO: 2544591 - RNA, 16 nt, Chlamydophila pneumoniae J138
aacuucaaugaaagcu

SEQ ID NO: 2544592 - RNA, 18 nt, Chlamydophila pneumoniae J138
aacuucagcaagaaaaua

SEQ ID NO: 2544593 - RNA, 21 nt, Chlamydophila pneumoniae J138
aacuucgauuggaagcaaaga

SEQ ID NO: 2544594 - RNA, 17 nt, Chlamydophila pneumoniae J138
aacuucguuagaaacca

SEQ ID NO: 2544595 - RNA, 14 nt, Chlamydophila pneumoniae J138
aacuucuaaaagca

SEQ ID NO: 2544596 - RNA, 13 nt, Chlamydophila pneumoniae J138
aacuucuaacugu

SEQ ID NO: 2544597 - RNA, 16 nt, Chlamydophila pneumoniae J138
aacuucucagauaaaa

SEQ ID NO: 2544598 - RNA, 12 nt, Chlamydophila pneumoniae J138
aacuucucuagg

SEQ ID NO: 2544599 - RNA, 14 nt, Chlamydophila pneumoniae J138
aacuucuucguuag

SEQ ID NO: 2544600 - RNA, 18 nt, Chlamydophila pneumoniae J138
aacuucuucguuagagaa

SEQ ID NO: 2544601 - RNA, 17 nt, Chlamydophila pneumoniae J138
aacuugaagaaguacaa

SEQ ID NO: 2544602 - RNA, 22 nt, Chlamydophila pneumoniae J138
aacuugaagaaguacaagugaa

SEQ ID NO: 2544603 - RNA, 14 nt, Chlamydophila pneumoniae J138
aacuugaauaccaa

SEQ ID NO: 2544604 - RNA, 14 nt, Chlamydophila pneumoniae J138
aacuugagccaaca

SEQ ID NO: 2544605 - RNA, 17 nt, Chlamydophila pneumoniae J138
aacuuggugagcagcuu

SEQ ID NO: 2544606 - RNA, 21 nt, Chlamydophila pneumoniae J138
aacuuguuuucguaagagaau

SEQ ID NO: 2544607 - RNA, 20 nt, Chlamydophila pneumoniae J138
aacuuuaggauucaguuccu

SEQ ID NO: 2544608 - RNA, 24 nt, Chlamydophila pneumoniae J138
aacuuuaggauucaguuccucauc

SEQ ID NO: 2544609 - RNA, 22 nt, Chlamydophila pneumoniae J138
aacuuucgaagcgcucuacaaa

SEQ ID NO: 2544610 - RNA, 17 nt, Chlamydophila pneumoniae J138
aacuuucugggagaaag

SEQ ID NO: 2544611 - RNA, 13 nt, Chlamydophila pneumoniae J138
aacuuucuucucu

SEQ ID NO: 2544612 - RNA, 19 nt, Chlamydophila pneumoniae J138
aacuuugaccagaugauuu

SEQ ID NO: 2544613 - RNA, 23 nt, Chlamydophila pneumoniae J138
aacuuugaccagaugauuuuuug

SEQ ID NO: 2544614 - RNA, 16 nt, Chlamydophila pneumoniae J138
aacuuugaggcaaguc

SEQ ID NO: 2544615 - RNA, 18 nt, Chlamydophila pneumoniae J138
aacuuugaggcaagucuc

SEQ ID NO: 2544616 - RNA, 15 nt, Chlamydophila pneumoniae J138
aagaaaaagcaucua

SEQ ID NO: 2544617 - RNA, 20 nt, Chlamydophila pneumoniae J138
aagaaaaaucuacauguaaa

SEQ ID NO: 2544618 - RNA, 19 nt, Chlamydophila pneumoniae J138
aagaaaagugugaggagac

SEQ ID NO: 2544619 - RNA, 15 nt, Chlamydophila pneumoniae J138
aagaaaauaaagauc

SEQ ID NO: 2544620 - RNA, 11 nt, Chlamydophila pneumoniae J138
aagaaacuucc

SEQ ID NO: 2544621 - RNA, 18 nt, Chlamydophila pneumoniae J138
aagaguccgaagccuuca

SEQ ID NO: 2544622 - RNA, 17 nt, Chlamydophila pneumoniae J138
aagagucucacucuuuu

SEQ ID NO: 2544623 - RNA, 20 nt, Chlamydophila pneumoniae J138
aagagucucuugcuuuugua

SEQ ID NO: 2544624 - RNA, 19 nt, Chlamydophila pneumoniae J138
aagagucuuccuagaccua

SEQ ID NO: 2544625 - RNA, 12 nt, Chlamydophila pneumoniae J138
aagagucuugca

SEQ ID NO: 2544626 - RNA, 13 nt, Chlamydophila pneumoniae J138
aagagugccaaga

SEQ ID NO: 2544627 - RNA, 17 nt, Chlamydophila pneumoniae J138
aagagugccaagagcau

SEQ ID NO: 2544628 - RNA, 22 nt, Chlamydophila pneumoniae J138
aagaguuguuguggaaucacgu

SEQ ID NO: 2544629 - RNA, 16 nt, Chlamydophila pneumoniae J138
aagaguuuuuuagagg

SEQ ID NO: 2544630 - RNA, 13 nt, Chlamydophila pneumoniae J138
aagauaaacagca

SEQ ID NO: 2544631 - RNA, 17 nt, Chlamydophila pneumoniae J138
aagauaaacagcacagg

SEQ ID NO: 2544632 - RNA, 12 nt, Chlamydophila pneumoniae J138
aagauaaagaag

SEQ ID NO: 2544633 - RNA, 13 nt, Chlamydophila pneumoniae J138
aagauaaagaagu

SEQ ID NO: 2544634 - RNA, 18 nt, Chlamydophila pneumoniae J138
aagauaaucuguaagaaa

SEQ ID NO: 2544635 - RNA, 20 nt, Chlamydophila pneumoniae J138
aagauaaucuguaagaaaau

SEQ ID NO: 2544636 - RNA, 14 nt, Chlamydophila pneumoniae J138
aagauagacucuca

SEQ ID NO: 2544637 - RNA, 13 nt, Chlamydophila pneumoniae J138
aagauaguauuuu

SEQ ID NO: 2544638 - RNA, 18 nt, Chlamydophila pneumoniae J138
aagauaguauuuuugaaa

SEQ ID NO: 2544639 - RNA, 19 nt, Chlamydophila pneumoniae J138
aagauaguauuuuugaaac

SEQ ID NO: 2544640 - RNA, 21 nt, Chlamydophila pneumoniae J138
aagauauauuuuuaaagagag

SEQ ID NO: 2544641 - RNA, 13 nt, Chlamydophila pneumoniae J138
aagauauucaaga

SEQ ID NO: 2544642 - RNA, 22 nt, Chlamydophila pneumoniae J138
aagaucauggauucacaucuua

SEQ ID NO: 2544643 - RNA, 22 nt, Chlamydophila pneumoniae J138
aagaucuaacuucaccauauaa

SEQ ID NO: 2544644 - RNA, 19 nt, Chlamydophila pneumoniae J138
aagaucuccgccuacaaua

SEQ ID NO: 2544645 - RNA, 18 nt, Chlamydophila pneumoniae J138
aagaucucuuuuggaaga

SEQ ID NO: 2544646 - RNA, 17 nt, Chlamydophila pneumoniae J138
aagaucuugaacagaga

SEQ ID NO: 2544647 - RNA, 18 nt, Chlamydophila pneumoniae J138
aagaucuugguuaugcua

SEQ ID NO: 2544648 - RNA, 15 nt, Chlamydophila pneumoniae J138
aagaugaagaaacuu

SEQ ID NO: 2544649 - RNA, 15 nt, Chlamydophila pneumoniae J138
aagaugaauaccaga

SEQ ID NO: 2544650 - RNA, 16 nt, Chlamydophila pneumoniae J138
aagaugaauaccagaa

SEQ ID NO: 2544651 - RNA, 15 nt, Chlamydophila pneumoniae J138
aagaugagaaaaucu

SEQ ID NO: 2544652 - RNA, 17 nt, Chlamydophila pneumoniae J138
aagaugcagauacuaaa

SEQ ID NO: 2544653 - RNA, 22 nt, Chlamydophila pneumoniae J138
aagaugcauucugauccgaaaa

SEQ ID NO: 2544654 - RNA, 21 nt, Chlamydophila pneumoniae J138
aagauguguuuuaacaacuag

SEQ ID NO: 2544655 - RNA, 24 nt, Chlamydophila pneumoniae J138
aagauuauuuguuucuuccauaca

SEQ ID NO: 2544656 - RNA, 14 nt, Chlamydophila pneumoniae J138
aagauucaaagaag

SEQ ID NO: 2544657 - RNA, 15 nt, Chlamydophila pneumoniae J138
aagauucaaagaagu

SEQ ID NO: 2544658 - RNA, 16 nt, Chlamydophila pneumoniae J138
aagauucaaagaaguc

SEQ ID NO: 2544659 - RNA, 17 nt, Chlamydophila pneumoniae J138
aagauucaaagaagucg

SEQ ID NO: 2544660 - RNA, 22 nt, Chlamydophila pneumoniae J138
aagauucucagcuucaucagaa

SEQ ID NO: 2544661 - RNA, 14 nt, Chlamydophila pneumoniae J138
aagauugaaggcac

SEQ ID NO: 2544662 - RNA, 18 nt, Chlamydophila pneumoniae J138
aagauugugcucaauaca

SEQ ID NO: 2544663 - RNA, 19 nt, Chlamydophila pneumoniae J138
aagauuuauuuugucuuuu

SEQ ID NO: 2544664 - RNA, 23 nt, Chlamydophila pneumoniae J138
aagauuuuaggggguuuuucuau

SEQ ID NO: 2544665 - RNA, 14 nt, Chlamydophila pneumoniae J138
aagauuuugaaaau

SEQ ID NO: 2544666 - RNA, 13 nt, Chlamydophila pneumoniae J138
aagauuuuuucuu

SEQ ID NO: 2544667 - RNA, 13 nt, Chlamydophila pneumoniae J138
aagcaaaaacuuu

SEQ ID NO: 2544668 - RNA, 13 nt, Chlamydophila pneumoniae J138
aagcaaaagauca

SEQ ID NO: 2544669 - RNA, 22 nt, Chlamydophila pneumoniae J138
aagcaaagaaaauucucagauu

SEQ ID NO: 2544670 - RNA, 17 nt, Chlamydophila pneumoniae J138
aagcaaagauaaagaag

SEQ ID NO: 2544671 - RNA, 20 nt, Chlamydophila pneumoniae J138
aagcaaagauaaagaaguuu

SEQ ID NO: 2544672 - RNA, 17 nt, Chlamydophila pneumoniae J138
aagcaacuaaacucucc

SEQ ID NO: 2544673 - RNA, 18 nt, Chlamydophila pneumoniae J138
aagcaacuaaacucucca

SEQ ID NO: 2544674 - RNA, 20 nt, Chlamydophila pneumoniae J138
aagcaaggcugccagagauu

SEQ ID NO: 2544675 - RNA, 13 nt, Chlamydophila pneumoniae J138
aagcaauaucugu

SEQ ID NO: 2544676 - RNA, 21 nt, Chlamydophila pneumoniae J138
aagcaaucccccagcauucac

SEQ ID NO: 2544677 - RNA, 21 nt, Chlamydophila pneumoniae J138
aagcacuaaaagggaagcuuc

SEQ ID NO: 2544678 - RNA, 14 nt, Chlamydophila pneumoniae J138
aagcacuuaaaaaa

SEQ ID NO: 2544679 - RNA, 19 nt, Chlamydophila pneumoniae J138
aagcacuuguuuuuucuuc

SEQ ID NO: 2544680 - RNA, 13 nt, Chlamydophila pneumoniae J138
aagcagaaacuuu

SEQ ID NO: 2544681 - RNA, 18 nt, Chlamydophila pneumoniae J138
aagcagaggguuccaaga

SEQ ID NO: 2544682 - RNA, 12 nt, Chlamydophila pneumoniae J138
aagcagggaaaa

SEQ ID NO: 2544683 - RNA, 22 nt, Chlamydophila pneumoniae J138
aagcaggugugugguaaaaaua

SEQ ID NO: 2544684 - RNA, 20 nt, Chlamydophila pneumoniae J138
aagcaguaacugcaaagaga

SEQ ID NO: 2544685 - RNA, 13 nt, Chlamydophila pneumoniae J138
aagcauagcccga

SEQ ID NO: 2544686 - RNA, 21 nt, Chlamydophila pneumoniae J138
aagcauagcccgaaauucauu

SEQ ID NO: 2544687 - RNA, 20 nt, Chlamydophila pneumoniae J138
aagcauagucgucuuuuaaa

SEQ ID NO: 2544688 - RNA, 22 nt, Chlamydophila pneumoniae J138
aagcauagucgucuuuuaaaga

SEQ ID NO: 2544689 - RNA, 22 nt, Chlamydophila pneumoniae J138
aagcauauacuguuaacaagua

SEQ ID NO: 2544690 - RNA, 18 nt, Chlamydophila pneumoniae J138
aagcaucuuucaucaaug

SEQ ID NO: 2544691 - RNA, 21 nt, Chlamydophila pneumoniae J138
aagcauguuauauagacaaug

SEQ ID NO: 2544692 - RNA, 18 nt, Chlamydophila pneumoniae J138
aagcauucugcuagagcu

SEQ ID NO: 2544693 - RNA, 19 nt, Chlamydophila pneumoniae J138
aagcauucugcuagagcuu

SEQ ID NO: 2544694 - RNA, 23 nt, Chlamydophila pneumoniae J138
aagcauucugcuagagcuuucag

SEQ ID NO: 2544695 - RNA, 21 nt, Chlamydophila pneumoniae J138
aagcauuuuugggaaaagaaa

SEQ ID NO: 2544696 - RNA, 23 nt, Chlamydophila pneumoniae J138
aagcauuuuugggaaaagaaaag

SEQ ID NO: 2544697 - RNA, 21 nt, Chlamydophila pneumoniae J138
aagccaaaaggcacagcaaug

SEQ ID NO: 2544698 - RNA, 14 nt, Chlamydophila pneumoniae J138
aagccaaauaccaa

SEQ ID NO: 2544699 - RNA, 14 nt, Chlamydophila pneumoniae J138
aagccacagagaau

SEQ ID NO: 2544700 - RNA, 18 nt, Chlamydophila pneumoniae J138
aagccacauucuucugau

SEQ ID NO: 2544701 - RNA, 15 nt, Chlamydophila pneumoniae J138
aagccauuccauauc

SEQ ID NO: 2544702 - RNA, 23 nt, Chlamydophila pneumoniae J138
aagccauuuucuaagagaucuac

SEQ ID NO: 2544703 - RNA, 20 nt, Chlamydophila pneumoniae J138
aagccccacccacuccagaa

SEQ ID NO: 2544704 - RNA, 19 nt, Chlamydophila pneumoniae J138
aagcccuaauucauauuua

SEQ ID NO: 2544705 - RNA, 20 nt, Chlamydophila pneumoniae J138
aagcccucauccccucagaa

SEQ ID NO: 2544706 - RNA, 23 nt, Chlamydophila pneumoniae J138
aagccggcccacucaaaagaaga

SEQ ID NO: 2544707 - RNA, 22 nt, Chlamydophila pneumoniae J138
aagccguguaccucucaucaaa

SEQ ID NO: 2544708 - RNA, 22 nt, Chlamydophila pneumoniae J138
aagccuaaaucuauacccaguu

SEQ ID NO: 2544709 - RNA, 20 nt, Chlamydophila pneumoniae J138
aagccuccucaagauaaauc

SEQ ID NO: 2544710 - RNA, 23 nt, Chlamydophila pneumoniae J138
aagccuccucaagauaaauccca

SEQ ID NO: 2544711 - RNA, 17 nt, Chlamydophila pneumoniae J138
aagccugcggcaaguau

SEQ ID NO: 2544712 - RNA, 18 nt, Chlamydophila pneumoniae J138
aagccugucuuaucuaaa

SEQ ID NO: 2544713 - RNA, 13 nt, Chlamydophila pneumoniae J138
aagccuucauucc

SEQ ID NO: 2544714 - RNA, 14 nt, Chlamydophila pneumoniae J138
aagccuucauucca

SEQ ID NO: 2544715 - RNA, 12 nt, Chlamydophila pneumoniae J138
aagccuuccuug

SEQ ID NO: 2544716 - RNA, 13 nt, Chlamydophila pneumoniae J138
aagccuuccuugu

SEQ ID NO: 2544717 - RNA, 18 nt, Chlamydophila pneumoniae J138
aagccuuccuuguuguau

SEQ ID NO: 2544718 - RNA, 20 nt, Chlamydophila pneumoniae J138
aagccuuucuuauuacagaa

SEQ ID NO: 2544719 - RNA, 21 nt, Chlamydophila pneumoniae J138
aagcgcaaaucuuacauaaac

SEQ ID NO: 2544720 - RNA, 16 nt, Chlamydophila pneumoniae J138
aagguaaaacuacagg

SEQ ID NO: 2544721 - RNA, 17 nt, Chlamydophila pneumoniae J138
aagguaaauuuuuaaaa

SEQ ID NO: 2544722 - RNA, 22 nt, Chlamydophila pneumoniae J138
aagguacugcucaaugacacgg

SEQ ID NO: 2544723 - RNA, 16 nt, Chlamydophila pneumoniae J138
aagguagcuagcguuu

SEQ ID NO: 2544724 - RNA, 16 nt, Chlamydophila pneumoniae J138
aagguauuaggaagua

SEQ ID NO: 2544725 - RNA, 18 nt, Chlamydophila pneumoniae J138
aagguauuucucuccaca

SEQ ID NO: 2544726 - RNA, 14 nt, Chlamydophila pneumoniae J138
aaggucacagcauu

SEQ ID NO: 2544727 - RNA, 22 nt, Chlamydophila pneumoniae J138
aaggucugcgucuuuaauuaaa

SEQ ID NO: 2544728 - RNA, 19 nt, Chlamydophila pneumoniae J138
aagguuacaccuaaaguuu

SEQ ID NO: 2544729 - RNA, 13 nt, Chlamydophila pneumoniae J138
aagguuccaaaaa

SEQ ID NO: 2544730 - RNA, 12 nt, Chlamydophila pneumoniae J138
aagguucucaaa

SEQ ID NO: 2544731 - RNA, 22 nt, Chlamydophila pneumoniae J138
aagguugcuaagaucuuuagaa

SEQ ID NO: 2544732 - RNA, 15 nt, Chlamydophila pneumoniae J138
aagguugcuuuucua

SEQ ID NO: 2544733 - RNA, 21 nt, Chlamydophila pneumoniae J138
aagguugcuuuucuaggauuu

SEQ ID NO: 2544734 - RNA, 14 nt, Chlamydophila pneumoniae J138
aagguuuccaugag

SEQ ID NO: 2544735 - RNA, 17 nt, Chlamydophila pneumoniae J138
aagguuuccaugagaau

SEQ ID NO: 2544736 - RNA, 18 nt, Chlamydophila pneumoniae J138
aagguuuuauaaagaucg

SEQ ID NO: 2544737 - RNA, 15 nt, Chlamydophila pneumoniae J138
aagguuuugaagcuc

SEQ ID NO: 2544738 - RNA, 16 nt, Chlamydophila pneumoniae J138
aaguaaaauuucugua

SEQ ID NO: 2544739 - RNA, 20 nt, Chlamydophila pneumoniae J138
aaguaacuaucuacacagua

SEQ ID NO: 2544740 - RNA, 17 nt, Chlamydophila pneumoniae J138
aaguaagguuccaaaaa

SEQ ID NO: 2544741 - RNA, 18 nt, Chlamydophila pneumoniae J138
aaguaaucaugauaaaaa

SEQ ID NO: 2544742 - RNA, 23 nt, Chlamydophila pneumoniae J138
aaguaaugugcgcacaagggauu

SEQ ID NO: 2544743 - RNA, 21 nt, Chlamydophila pneumoniae J138
aaguacaagugaagacaagua

SEQ ID NO: 2544744 - RNA, 22 nt, Chlamydophila pneumoniae J138
aaguacaagugaagacaaguaa

SEQ ID NO: 2544745 - RNA, 14 nt, Chlamydophila pneumoniae J138
aaguacacauuguc

SEQ ID NO: 2544746 - RNA, 15 nt, Chlamydophila pneumoniae J138
aaguacacauugucu

SEQ ID NO: 2544747 - RNA, 22 nt, Chlamydophila pneumoniae J138
aaguacauuaucacagcaaucu

SEQ ID NO: 2544748 - RNA, 19 nt, Chlamydophila pneumoniae J138
aaguacgaccaacuccuca

SEQ ID NO: 2544749 - RNA, 22 nt, Chlamydophila pneumoniae J138
aaguacgaccaacuccucaaaa

SEQ ID NO: 2544750 - RNA, 22 nt, Chlamydophila pneumoniae J138
aaguacgcaguaucguaacuuc

SEQ ID NO: 2544751 - RNA, 13 nt, Chlamydophila pneumoniae J138
aaguacuacaaua

SEQ ID NO: 2544752 - RNA, 15 nt, Chlamydophila pneumoniae J138
aaguagaauccuucu

SEQ ID NO: 2544753 - RNA, 14 nt, Chlamydophila pneumoniae J138
aaguagcucucucc

SEQ ID NO: 2544754 - RNA, 15 nt, Chlamydophila pneumoniae J138
aaguaggauugauaa

SEQ ID NO: 2544755 - RNA, 23 nt, Chlamydophila pneumoniae J138
aaguaucuucaguagaguuagaa

SEQ ID NO: 2544756 - RNA, 21 nt, Chlamydophila pneumoniae J138
aaguauuccucuuaggagagc

SEQ ID NO: 2544757 - RNA, 17 nt, Chlamydophila pneumoniae J138
aaguauucgauuccuga

SEQ ID NO: 2544758 - RNA, 23 nt, Chlamydophila pneumoniae J138
aagucaaacaucacucaggauau

SEQ ID NO: 2544759 - RNA, 14 nt, Chlamydophila pneumoniae J138
aagucacaaauuuu

SEQ ID NO: 2544760 - RNA, 18 nt, Chlamydophila pneumoniae J138
aagucacggcgaaagcua

SEQ ID NO: 2544761 - RNA, 23 nt, Chlamydophila pneumoniae J138
aagucacggcgaaagcuacagcu

SEQ ID NO: 2544762 - RNA, 21 nt, Chlamydophila pneumoniae J138
aagucacucaaacccucucca

SEQ ID NO: 2544763 - RNA, 21 nt, Chlamydophila pneumoniae J138
aagucagccaagacaaaaaag

SEQ ID NO: 2544764 - RNA, 14 nt, Chlamydophila pneumoniae J138
aaguccacaagccu

SEQ ID NO: 2544765 - RNA, 16 nt, Chlamydophila pneumoniae J138
aaguccagacuuuccu

SEQ ID NO: 2544766 - RNA, 17 nt, Chlamydophila pneumoniae J138
aaguccagacuuuccuc

SEQ ID NO: 2544767 - RNA, 20 nt, Chlamydophila pneumoniae J138
aaguccgauagcaaugaugu

SEQ ID NO: 2544768 - RNA, 15 nt, Chlamydophila pneumoniae J138
aaguccuaucaaagc

SEQ ID NO: 2544769 - RNA, 19 nt, Chlamydophila pneumoniae J138
aaguccuccauguacaguu

SEQ ID NO: 2544770 - RNA, 22 nt, Chlamydophila pneumoniae J138
aaguccuggauuuuaaagcaaa

SEQ ID NO: 2544771 - RNA, 17 nt, Chlamydophila pneumoniae J138
aagucgaaucuaaaaac

SEQ ID NO: 2544772 - RNA, 13 nt, Chlamydophila pneumoniae J138
aagucuccauaau

SEQ ID NO: 2544773 - RNA, 17 nt, Chlamydophila pneumoniae J138
aagucuccauaauucug

SEQ ID NO: 2544774 - RNA, 21 nt, Chlamydophila pneumoniae J138
aagucuucaaugacuucugga

SEQ ID NO: 2544775 - RNA, 22 nt, Chlamydophila pneumoniae J138
aagucuuggacguuccuuucuc

SEQ ID NO: 2544776 - RNA, 19 nt, Chlamydophila pneumoniae J138
aagugaggagaauagcaag

SEQ ID NO: 2544777 - RNA, 14 nt, Chlamydophila pneumoniae J138
aagugaucagaaau

SEQ ID NO: 2544778 - RNA, 18 nt, Chlamydophila pneumoniae J138
aagugaucuugagaaaag

SEQ ID NO: 2544779 - RNA, 15 nt, Chlamydophila pneumoniae J138
aaguguauuuaaauu

SEQ ID NO: 2544780 - RNA, 20 nt, Chlamydophila pneumoniae J138
aagugucugaguuagcuuuu

SEQ ID NO: 2544781 - RNA, 20 nt, Chlamydophila pneumoniae J138
aaguuagcuaacucggaaaa

SEQ ID NO: 2544782 - RNA, 17 nt, Chlamydophila pneumoniae J138
aaguucagcaaggaagu

SEQ ID NO: 2544783 - RNA, 19 nt, Chlamydophila pneumoniae J138
aaguucggcgccuucaaaa

SEQ ID NO: 2544784 - RNA, 15 nt, Chlamydophila pneumoniae J138
aaguugaccuuuuuc

SEQ ID NO: 2544785 - RNA, 17 nt, Chlamydophila pneumoniae J138
aaguugaccuuuuucau

SEQ ID NO: 2544786 - RNA, 18 nt, Chlamydophila pneumoniae J138
aaguugacgcacuucuuc

SEQ ID NO: 2544787 - RNA, 21 nt, Chlamydophila pneumoniae J138
aaguugcaacucucuuuaaac

SEQ ID NO: 2544788 - RNA, 22 nt, Chlamydophila pneumoniae J138
aaguuguuucuuguagcucccg

SEQ ID NO: 2544789 - RNA, 14 nt, Chlamydophila pneumoniae J138
aaguuuacaaauaa

SEQ ID NO: 2544790 - RNA, 14 nt, Chlamydophila pneumoniae J138
aaguuuaggcagga

SEQ ID NO: 2544791 - RNA, 16 nt, Chlamydophila pneumoniae J138
aaguuucaaucucucc

SEQ ID NO: 2544792 - RNA, 19 nt, Chlamydophila pneumoniae J138
aaguuugauaagcuaacac

SEQ ID NO: 2544793 - RNA, 15 nt, Chlamydophila pneumoniae J138
aaguuugcaugcaac

SEQ ID NO: 2544794 - RNA, 19 nt, Chlamydophila pneumoniae J138
aaguuugucguaauugcug

SEQ ID NO: 2544795 - RNA, 17 nt, Chlamydophila pneumoniae J138
aaguuuucgauacacaa

SEQ ID NO: 2544796 - RNA, 20 nt, Chlamydophila pneumoniae J138
aaguuuugauuuugcaguga

SEQ ID NO: 2544797 - RNA, 12 nt, Chlamydophila pneumoniae J138
aaguuuugcucu

SEQ ID NO: 2544798 - RNA, 14 nt, Chlamydophila pneumoniae J138
aauaaaaaagagag

SEQ ID NO: 2544799 - RNA, 12 nt, Chlamydophila pneumoniae J138
aauaaaagaaag

SEQ ID NO: 2544800 - RNA, 13 nt, Chlamydophila pneumoniae J138
aauaaaagcaccc

SEQ ID NO: 2544801 - RNA, 14 nt, Chlamydophila pneumoniae J138
aauaaaauuuaaaa

SEQ ID NO: 2544802 - RNA, 15 nt, Chlamydophila pneumoniae J138
aauaaaauuuaaaaa

SEQ ID NO: 2544803 - RNA, 15 nt, Chlamydophila pneumoniae J138
aauaaaccacgaauu

SEQ ID NO: 2544804 - RNA, 18 nt, Chlamydophila pneumoniae J138
aauaaaggacauagacuu

SEQ ID NO: 2544805 - RNA, 14 nt, Chlamydophila pneumoniae J138
aauaaaguccucca

SEQ ID NO: 2544806 - RNA, 16 nt, Chlamydophila pneumoniae J138
aauaaauccaaaaaau

SEQ ID NO: 2544807 - RNA, 18 nt, Chlamydophila pneumoniae J138
aauaacaccaaaagaaua

SEQ ID NO: 2544808 - RNA, 21 nt, Chlamydophila pneumoniae J138
aauaacuauaauauaacugca

SEQ ID NO: 2544809 - RNA, 13 nt, Chlamydophila pneumoniae J138
aauaagauccaaa

SEQ ID NO: 2544810 - RNA, 15 nt, Chlamydophila pneumoniae J138
aauaagauccaaaaa

SEQ ID NO: 2544811 - RNA, 15 nt, Chlamydophila pneumoniae J138
aauaagauuuugaaa

SEQ ID NO: 2544812 - RNA, 15 nt, Chlamydophila pneumoniae J138
aauaagcaggaaaag

SEQ ID NO: 2544813 - RNA, 18 nt, Chlamydophila pneumoniae J138
aauaagccaguacuaaau

SEQ ID NO: 2544814 - RNA, 18 nt, Chlamydophila pneumoniae J138
aauaagcuugccagcaga

SEQ ID NO: 2544815 - RNA, 20 nt, Chlamydophila pneumoniae J138
aauaagcuugccagcagaag

SEQ ID NO: 2544816 - RNA, 22 nt, Chlamydophila pneumoniae J138
aauaagcuugccagcagaaguu

SEQ ID NO: 2544817 - RNA, 20 nt, Chlamydophila pneumoniae J138
aauaaggcugcuaucaacau

SEQ ID NO: 2544818 - RNA, 14 nt, Chlamydophila pneumoniae J138
aauaaguccuguuu

SEQ ID NO: 2544819 - RNA, 12 nt, Chlamydophila pneumoniae J138
aauaauagcaag

SEQ ID NO: 2544820 - RNA, 20 nt, Chlamydophila pneumoniae J138
aaucaagccacagagaauug

SEQ ID NO: 2544821 - RNA, 13 nt, Chlamydophila pneumoniae J138
aaucaauccaaga

SEQ ID NO: 2544822 - RNA, 15 nt, Chlamydophila pneumoniae J138
aaucacauaaaauaa

SEQ ID NO: 2544823 - RNA, 19 nt, Chlamydophila pneumoniae J138
aaucacaucaguuccauuu

SEQ ID NO: 2544824 - RNA, 15 nt, Chlamydophila pneumoniae J138
aaucaccaauuuuuu

SEQ ID NO: 2544825 - RNA, 16 nt, Chlamydophila pneumoniae J138
aaucaccaauuuuuuc

SEQ ID NO: 2544826 - RNA, 17 nt, Chlamydophila pneumoniae J138
aaucaccauauccauga

SEQ ID NO: 2544827 - RNA, 20 nt, Chlamydophila pneumoniae J138
aaucacgacgucaucaccau

SEQ ID NO: 2544828 - RNA, 14 nt, Chlamydophila pneumoniae J138
aaucacucuaugau

SEQ ID NO: 2544829 - RNA, 21 nt, Chlamydophila pneumoniae J138
aaucacucuaugaucuacaga

SEQ ID NO: 2544830 - RNA, 12 nt, Chlamydophila pneumoniae J138
aaucacucucua

SEQ ID NO: 2544831 - RNA, 19 nt, Chlamydophila pneumoniae J138
aaucacuuaauaauguuuu

SEQ ID NO: 2544832 - RNA, 15 nt, Chlamydophila pneumoniae J138
aaucagugcugccau

SEQ ID NO: 2544833 - RNA, 15 nt, Chlamydophila pneumoniae J138
aaucauaaaaaaagc

SEQ ID NO: 2544834 - RNA, 23 nt, Chlamydophila pneumoniae J138
aaucauaacaagucuaucgacac

SEQ ID NO: 2544835 - RNA, 12 nt, Chlamydophila pneumoniae J138
aaucauaaccaa

SEQ ID NO: 2544836 - RNA, 18 nt, Chlamydophila pneumoniae J138
aaucauaaccaaaagaau

SEQ ID NO: 2544837 - RNA, 21 nt, Chlamydophila pneumoniae J138
aaucauagccaucauagcaaa

SEQ ID NO: 2544838 - RNA, 12 nt, Chlamydophila pneumoniae J138
aaucauaucugc

SEQ ID NO: 2544839 - RNA, 15 nt, Chlamydophila pneumoniae J138
aaucaugauaaaaau

SEQ ID NO: 2544840 - RNA, 23 nt, Chlamydophila pneumoniae J138
aaucaugauaaaaauuuucagga

SEQ ID NO: 2544841 - RNA, 19 nt, Chlamydophila pneumoniae J138
aaucauuagaguuugguuu

SEQ ID NO: 2544842 - RNA, 14 nt, Chlamydophila pneumoniae J138
aauccaaaaaagag

SEQ ID NO: 2544843 - RNA, 19 nt, Chlamydophila pneumoniae J138
aauccaaaaacuucuaacu

SEQ ID NO: 2544844 - RNA, 17 nt, Chlamydophila pneumoniae J138
aauccaaagacuuuuua

SEQ ID NO: 2544845 - RNA, 15 nt, Chlamydophila pneumoniae J138
aauccaacaaagaug

SEQ ID NO: 2544846 - RNA, 17 nt, Chlamydophila pneumoniae J138
aauccaacaaagaugac

SEQ ID NO: 2544847 - RNA, 12 nt, Chlamydophila pneumoniae J138
aauccacauccu

SEQ ID NO: 2544848 - RNA, 14 nt, Chlamydophila pneumoniae J138
aauccaccaaugau

SEQ ID NO: 2544849 - RNA, 21 nt, Chlamydophila pneumoniae J138
aauccaccaaugauaauuuca

SEQ ID NO: 2544850 - RNA, 14 nt, Chlamydophila pneumoniae J138
aauccacgcuccuc

SEQ ID NO: 2544851 - RNA, 19 nt, Chlamydophila pneumoniae J138
aauccagauuguucaaaaa

SEQ ID NO: 2544852 - RNA, 23 nt, Chlamydophila pneumoniae J138
aauccagauuguucaaaaauaga

SEQ ID NO: 2544853 - RNA, 18 nt, Chlamydophila pneumoniae J138
aauccagcaacaaccaaa

SEQ ID NO: 2544854 - RNA, 21 nt, Chlamydophila pneumoniae J138
aauccagcaacaaccaaaaga

SEQ ID NO: 2544855 - RNA, 15 nt, Chlamydophila pneumoniae J138
aauccauucugagaa

SEQ ID NO: 2544856 - RNA, 18 nt, Chlamydophila pneumoniae J138
aauccauucugagaaaga

SEQ ID NO: 2544857 - RNA, 20 nt, Chlamydophila pneumoniae J138
aauccauucugagaaagaag

SEQ ID NO: 2544858 - RNA, 22 nt, Chlamydophila pneumoniae J138
aaucccacuaucuguaauuccc

SEQ ID NO: 2544859 - RNA, 15 nt, Chlamydophila pneumoniae J138
aauccccaauguuuu

SEQ ID NO: 2544860 - RNA, 17 nt, Chlamydophila pneumoniae J138
aaucccccagcauucac

SEQ ID NO: 2544861 - RNA, 19 nt, Chlamydophila pneumoniae J138
aauccccgggauuguucuu

SEQ ID NO: 2544862 - RNA, 22 nt, Chlamydophila pneumoniae J138
aauccccgggauuguucuuuac

SEQ ID NO: 2544863 - RNA, 16 nt, Chlamydophila pneumoniae J138
aaucccgugcuaggaa

SEQ ID NO: 2544864 - RNA, 17 nt, Chlamydophila pneumoniae J138
aaucccgugcuaggaag

SEQ ID NO: 2544865 - RNA, 18 nt, Chlamydophila pneumoniae J138
aaucccgugcuaggaaga

SEQ ID NO: 2544866 - RNA, 19 nt, Chlamydophila pneumoniae J138
aaucccuguguguuuuuuc

SEQ ID NO: 2544867 - RNA, 21 nt, Chlamydophila pneumoniae J138
aauccgauaagauaaagaauu

SEQ ID NO: 2544868 - RNA, 16 nt, Chlamydophila pneumoniae J138
aauccggcauaaaaaa

SEQ ID NO: 2544869 - RNA, 12 nt, Chlamydophila pneumoniae J138
aauccuaaaaag

SEQ ID NO: 2544870 - RNA, 22 nt, Chlamydophila pneumoniae J138
aauccuaaaaaggguuccucuu

SEQ ID NO: 2544871 - RNA, 20 nt, Chlamydophila pneumoniae J138
aauccuccuagguucuuuuu

SEQ ID NO: 2544872 - RNA, 20 nt, Chlamydophila pneumoniae J138
aauccucugaaggauuugcu

SEQ ID NO: 2544873 - RNA, 16 nt, Chlamydophila pneumoniae J138
aauccugaguaaaauc

SEQ ID NO: 2544874 - RNA, 17 nt, Chlamydophila pneumoniae J138
aauccugaguaaaauca

SEQ ID NO: 2544875 - RNA, 18 nt, Chlamydophila pneumoniae J138
aauccugaguaaaaucau

SEQ ID NO: 2544876 - RNA, 21 nt, Chlamydophila pneumoniae J138
aauccugcauacccuucuucu

SEQ ID NO: 2544877 - RNA, 16 nt, Chlamydophila pneumoniae J138
aauccugggcaaugau

SEQ ID NO: 2544878 - RNA, 22 nt, Chlamydophila pneumoniae J138
aauccugggcaaugaucaaaaa

SEQ ID NO: 2544879 - RNA, 21 nt, Chlamydophila pneumoniae J138
aauccuguagggaaagacuca

SEQ ID NO: 2544880 - RNA, 19 nt, Chlamydophila pneumoniae J138
aauccuguucuacauagau

SEQ ID NO: 2544881 - RNA, 16 nt, Chlamydophila pneumoniae J138
aauccuucuauagcaa

SEQ ID NO: 2544882 - RNA, 14 nt, Chlamydophila pneumoniae J138
aauccuucucccuc

SEQ ID NO: 2544883 - RNA, 19 nt, Chlamydophila pneumoniae J138
aauccuucuuucugcucuu

SEQ ID NO: 2544884 - RNA, 18 nt, Chlamydophila pneumoniae J138
aauccuuucacaaagaau

SEQ ID NO: 2544885 - RNA, 18 nt, Chlamydophila pneumoniae J138
aauccuuuggaagcuauc

SEQ ID NO: 2544886 - RNA, 21 nt, Chlamydophila pneumoniae J138
aauccuuuuuaggaaaggaua

SEQ ID NO: 2544887 - RNA, 23 nt, Chlamydophila pneumoniae J138
aaucgaauagcucuggagauugc

SEQ ID NO: 2544888 - RNA, 23 nt, Chlamydophila pneumoniae J138
aaucgagagaagaaauucugacu

SEQ ID NO: 2544889 - RNA, 20 nt, Chlamydophila pneumoniae J138
aaucgauaacguugccuguu

SEQ ID NO: 2544890 - RNA, 19 nt, Chlamydophila pneumoniae J138
aaucgccuuacaauuuaaa

SEQ ID NO: 2544891 - RNA, 15 nt, Chlamydophila pneumoniae J138
aaucguguuuuccug

SEQ ID NO: 2544892 - RNA, 21 nt, Chlamydophila pneumoniae J138
aaucguucuuagcgcauguau

SEQ ID NO: 2544893 - RNA, 23 nt, Chlamydophila pneumoniae J138
aaucguuucucuggcaaugacuu

SEQ ID NO: 2544894 - RNA, 14 nt, Chlamydophila pneumoniae J138
aaucuaaaaucaca

SEQ ID NO: 2544895 - RNA, 16 nt, Chlamydophila pneumoniae J138
aaucuaaaaucacacu

SEQ ID NO: 2544896 - RNA, 21 nt, Chlamydophila pneumoniae J138
aaucuaaguaaaacugcgcua

SEQ ID NO: 2544897 - RNA, 16 nt, Chlamydophila pneumoniae J138
aaucuauaggauuugc

SEQ ID NO: 2544898 - RNA, 15 nt, Chlamydophila pneumoniae J138
aaucuauagucuguu

SEQ ID NO: 2544899 - RNA, 16 nt, Chlamydophila pneumoniae J138
aaucuauagucuguuu

SEQ ID NO: 2544900 - RNA, 13 nt, Chlamydophila pneumoniae J138
aaucuaugaauac

SEQ ID NO: 2544901 - RNA, 17 nt, Chlamydophila pneumoniae J138
aaucucaaaaucaaaua

SEQ ID NO: 2544902 - RNA, 19 nt, Chlamydophila pneumoniae J138
aaucucagugaacucuuca

SEQ ID NO: 2544903 - RNA, 22 nt, Chlamydophila pneumoniae J138
aaucucagugaacucuucaaga

SEQ ID NO: 2544904 - RNA, 22 nt, Chlamydophila pneumoniae J138
aaucucauuccagcaucuucuc

SEQ ID NO: 2544905 - RNA, 22 nt, Chlamydophila pneumoniae J138
aaucuccaaacauuuuuaagga

SEQ ID NO: 2544906 - RNA, 14 nt, Chlamydophila pneumoniae J138
aaucucgcuauucc

SEQ ID NO: 2544907 - RNA, 15 nt, Chlamydophila pneumoniae J138
aaucucgcuauucca

SEQ ID NO: 2544908 - RNA, 23 nt, Chlamydophila pneumoniae J138
aaucucgcuauuccauaaaaaug

SEQ ID NO: 2544909 - RNA, 16 nt, Chlamydophila pneumoniae J138
aaucucgggagaacau

SEQ ID NO: 2544910 - RNA, 23 nt, Chlamydophila pneumoniae J138
aaucucuagggauaauuaaacuc

SEQ ID NO: 2544911 - RNA, 13 nt, Chlamydophila pneumoniae J138
aaucucuccuuga

SEQ ID NO: 2544912 - RNA, 20 nt, Chlamydophila pneumoniae J138
aaucucuucuguaggaacaa

SEQ ID NO: 2544913 - RNA, 19 nt, Chlamydophila pneumoniae J138
aaucucuuucauaaauuca

SEQ ID NO: 2544914 - RNA, 16 nt, Chlamydophila pneumoniae J138
aaucugaaucucauaa

SEQ ID NO: 2544915 - RNA, 21 nt, Chlamydophila pneumoniae J138
aaucugaaugccugccaaucc

SEQ ID NO: 2544916 - RNA, 12 nt, Chlamydophila pneumoniae J138
aaucuggaagca

SEQ ID NO: 2544917 - RNA, 15 nt, Chlamydophila pneumoniae J138
aaucuggaaugacua

SEQ ID NO: 2544918 - RNA, 14 nt, Chlamydophila pneumoniae J138
aaucuggggcuucc

SEQ ID NO: 2544919 - RNA, 18 nt, Chlamydophila pneumoniae J138
aauucucugacacuccuc

SEQ ID NO: 2544920 - RNA, 13 nt, Chlamydophila pneumoniae J138
aauucuuaaaaag

SEQ ID NO: 2544921 - RNA, 21 nt, Chlamydophila pneumoniae J138
aauucuucuacagaauaggaa

SEQ ID NO: 2544922 - RNA, 22 nt, Chlamydophila pneumoniae J138
aauucuucuacagaauaggaac

SEQ ID NO: 2544923 - RNA, 23 nt, Chlamydophila pneumoniae J138
aauucuuuaugagagagcucuuc

SEQ ID NO: 2544924 - RNA, 16 nt, Chlamydophila pneumoniae J138
aauucuuugccaagga

SEQ ID NO: 2544925 - RNA, 22 nt, Chlamydophila pneumoniae J138
aauugacugcuagaguccaagg

SEQ ID NO: 2544926 - RNA, 22 nt, Chlamydophila pneumoniae J138
aauugagaaauauaacucucua

SEQ ID NO: 2544927 - RNA, 20 nt, Chlamydophila pneumoniae J138
aauugagcucucuagcuguu

SEQ ID NO: 2544928 - RNA, 15 nt, Chlamydophila pneumoniae J138
aauugcaaaguacua

SEQ ID NO: 2544929 - RNA, 21 nt, Chlamydophila pneumoniae J138
aauugcaaaguacuacaauaa

SEQ ID NO: 2544930 - RNA, 22 nt, Chlamydophila pneumoniae J138
aauugcagucacuacuguucua

SEQ ID NO: 2544931 - RNA, 22 nt, Chlamydophila pneumoniae J138
aauugcauuaagauaaacauua

SEQ ID NO: 2544932 - RNA, 16 nt, Chlamydophila pneumoniae J138
aauugcucuugcucua

SEQ ID NO: 2544933 - RNA, 21 nt, Chlamydophila pneumoniae J138
aauugcuggaggccaaagaac

SEQ ID NO: 2544934 - RNA, 22 nt, Chlamydophila pneumoniae J138
aauugcuugcgcaucagcagcu

SEQ ID NO: 2544935 - RNA, 18 nt, Chlamydophila pneumoniae J138
aauuggcguaauaauucc

SEQ ID NO: 2544936 - RNA, 13 nt, Chlamydophila pneumoniae J138
aauugguggagcu

SEQ ID NO: 2544937 - RNA, 19 nt, Chlamydophila pneumoniae J138
aauugguggagcucauuua

SEQ ID NO: 2544938 - RNA, 13 nt, Chlamydophila pneumoniae J138
aauuguagagaga

SEQ ID NO: 2544939 - RNA, 21 nt, Chlamydophila pneumoniae J138
aauuguaucuguauccuuccu

SEQ ID NO: 2544940 - RNA, 22 nt, Chlamydophila pneumoniae J138
aauugucugaggacaguauucc

SEQ ID NO: 2544941 - RNA, 15 nt, Chlamydophila pneumoniae J138
aauugugcucucuaa

SEQ ID NO: 2544942 - RNA, 16 nt, Chlamydophila pneumoniae J138
aauuguucuugaaguu

SEQ ID NO: 2544943 - RNA, 16 nt, Chlamydophila pneumoniae J138
aauuguuggaauugca

SEQ ID NO: 2544944 - RNA, 16 nt, Chlamydophila pneumoniae J138
aauuuaaaucugcaag

SEQ ID NO: 2544945 - RNA, 13 nt, Chlamydophila pneumoniae J138
aauuuaaaugccu

SEQ ID NO: 2544946 - RNA, 18 nt, Chlamydophila pneumoniae J138
aauuuagaggagacucua

SEQ ID NO: 2544947 - RNA, 11 nt, Chlamydophila pneumoniae J138
aauuuccaaag

SEQ ID NO: 2544948 - RNA, 14 nt, Chlamydophila pneumoniae J138
aauuuccaaaggaa

SEQ ID NO: 2544949 - RNA, 16 nt, Chlamydophila pneumoniae J138
aauuuccaaaggaaaa

SEQ ID NO: 2544950 - RNA, 19 nt, Chlamydophila pneumoniae J138
aauuuccaaucacacuaca

SEQ ID NO: 2544951 - RNA, 18 nt, Chlamydophila pneumoniae J138
aauuuccuaccuauauuu

SEQ ID NO: 2544952 - RNA, 16 nt, Chlamydophila pneumoniae J138
aauuuccugcauggcu

SEQ ID NO: 2544953 - RNA, 21 nt, Chlamydophila pneumoniae J138
aauuuccuuagaagggaaagu

SEQ ID NO: 2544954 - RNA, 21 nt, Chlamydophila pneumoniae J138
aauuuccuucaggauuuucca

SEQ ID NO: 2544955 - RNA, 20 nt, Chlamydophila pneumoniae J138
aauuucggacgauauuuaga

SEQ ID NO: 2544956 - RNA, 15 nt, Chlamydophila pneumoniae J138
aauuucuauaguuca

SEQ ID NO: 2544957 - RNA, 20 nt, Chlamydophila pneumoniae J138
aauuucuccaguaucuucuc

SEQ ID NO: 2544958 - RNA, 22 nt, Chlamydophila pneumoniae J138
aauuucuccaguaucuucucuu

SEQ ID NO: 2544959 - RNA, 15 nt, Chlamydophila pneumoniae J138
aauuucuccuagguc

SEQ ID NO: 2544960 - RNA, 14 nt, Chlamydophila pneumoniae J138
aauuucugaaacaa

SEQ ID NO: 2544961 - RNA, 17 nt, Chlamydophila pneumoniae J138
aauuucugaaacaaugc

SEQ ID NO: 2544962 - RNA, 13 nt, Chlamydophila pneumoniae J138
aauuucuucauca

SEQ ID NO: 2544963 - RNA, 23 nt, Chlamydophila pneumoniae J138
aauuucuuguuccaauagagucu

SEQ ID NO: 2544964 - RNA, 14 nt, Chlamydophila pneumoniae J138
aauuugauuuuuca

SEQ ID NO: 2544965 - RNA, 20 nt, Chlamydophila pneumoniae J138
aauuugauuuuucaaauucu

SEQ ID NO: 2544966 - RNA, 17 nt, Chlamydophila pneumoniae J138
aauuugccugaaauccu

SEQ ID NO: 2544967 - RNA, 18 nt, Chlamydophila pneumoniae J138
aauuugccugaaauccug

SEQ ID NO: 2544968 - RNA, 14 nt, Chlamydophila pneumoniae J138
aauuugcgaagucc

SEQ ID NO: 2544969 - RNA, 16 nt, Chlamydophila pneumoniae J138
aauuugcuaugucugu

SEQ ID NO: 2544970 - RNA, 20 nt, Chlamydophila pneumoniae J138
aauuuuauaggaauaacacc

SEQ ID NO: 2544971 - RNA, 18 nt, Chlamydophila pneumoniae J138
aauuuuauuaguuacuga

SEQ ID NO: 2544972 - RNA, 23 nt, Chlamydophila pneumoniae J138
aauuuucagccugucuauaaaau

SEQ ID NO: 2544973 - RNA, 18 nt, Chlamydophila pneumoniae J138
aauuuucagucuuccuuu

SEQ ID NO: 2544974 - RNA, 15 nt, Chlamydophila pneumoniae J138
aauuuucccauuaca

SEQ ID NO: 2544975 - RNA, 14 nt, Chlamydophila pneumoniae J138
aauuuucuaaagau

SEQ ID NO: 2544976 - RNA, 22 nt, Chlamydophila pneumoniae J138
aauuuugauaccucuccgucau

SEQ ID NO: 2544977 - RNA, 19 nt, Chlamydophila pneumoniae J138
aauuuuuccuucaacacac

SEQ ID NO: 2544978 - RNA, 15 nt, Chlamydophila pneumoniae J138
aauuuuucgagaaua

SEQ ID NO: 2544979 - RNA, 15 nt, Chlamydophila pneumoniae J138
aauuuuucuaagaaa

SEQ ID NO: 2544980 - RNA, 19 nt, Chlamydophila pneumoniae J138
aauuuuugcuaaacaaugc

SEQ ID NO: 2544981 - RNA, 20 nt, Chlamydophila pneumoniae J138
aauuuuugcuaaacaaugca

SEQ ID NO: 2544982 - RNA, 19 nt, Chlamydophila pneumoniae J138
aauuuuuuguuaaauuccc

SEQ ID NO: 2544983 - RNA, 17 nt, Chlamydophila pneumoniae J138
aauuuuuuucaaaggag

SEQ ID NO: 2544984 - RNA, 20 nt, Chlamydophila pneumoniae J138
acaaaaaagggaucuccuuc

SEQ ID NO: 2544985 - RNA, 15 nt, Chlamydophila pneumoniae J138
acaaaaaggacucuu

SEQ ID NO: 2544986 - RNA, 12 nt, Chlamydophila pneumoniae J138
acaaaaaugccu

SEQ ID NO: 2544987 - RNA, 18 nt, Chlamydophila pneumoniae J138
acaaaaccuggauugauc

SEQ ID NO: 2544988 - RNA, 23 nt, Chlamydophila pneumoniae J138
acaaaagucucuagggaaaggag

SEQ ID NO: 2544989 - RNA, 12 nt, Chlamydophila pneumoniae J138
acaaaauaaaac

SEQ ID NO: 2544990 - RNA, 20 nt, Chlamydophila pneumoniae J138
acaaaauucaugcaaaacaa

SEQ ID NO: 2544991 - RNA, 22 nt, Chlamydophila pneumoniae J138
acaaacaucgaaaccacagcaa

SEQ ID NO: 2544992 - RNA, 24 nt, Chlamydophila pneumoniae J138
acaaacccauauuugaauaaagga

SEQ ID NO: 2544993 - RNA, 13 nt, Chlamydophila pneumoniae J138
acaaacucuucca

SEQ ID NO: 2544994 - RNA, 15 nt, Chlamydophila pneumoniae J138
acaaagaucacugag

SEQ ID NO: 2544995 - RNA, 13 nt, Chlamydophila pneumoniae J138
acaaagccacagc

SEQ ID NO: 2544996 - RNA, 21 nt, Chlamydophila pneumoniae J138
acaaagcucuccuucagaguu

SEQ ID NO: 2544997 - RNA, 18 nt, Chlamydophila pneumoniae J138
acaaaggguuucuuucca

SEQ ID NO: 2544998 - RNA, 17 nt, Chlamydophila pneumoniae J138
acaaaguaggauugaua

SEQ ID NO: 2544999 - RNA, 20 nt, Chlamydophila pneumoniae J138
acaaaguaggauugauaaau

SEQ ID NO: 2545000 - RNA, 15 nt, Chlamydophila pneumoniae J138
acaaauagcucugcg

SEQ ID NO: 2545001 - RNA, 19 nt, Chlamydophila pneumoniae J138
acaaaugcgguaucuccgg

SEQ ID NO: 2545002 - RNA, 19 nt, Chlamydophila pneumoniae J138
acaaaugugacgcaagaga

SEQ ID NO: 2545003 - RNA, 22 nt, Chlamydophila pneumoniae J138
acaaaugugacgcaagagacaa

SEQ ID NO: 2545004 - RNA, 22 nt, Chlamydophila pneumoniae J138
acaacaaacuaccagaugccuu

SEQ ID NO: 2545005 - RNA, 13 nt, Chlamydophila pneumoniae J138
acaacaauaauac

SEQ ID NO: 2545006 - RNA, 19 nt, Chlamydophila pneumoniae J138
acaacaccucccaccaagg

SEQ ID NO: 2545007 - RNA, 13 nt, Chlamydophila pneumoniae J138
acaacagagacaa

SEQ ID NO: 2545008 - RNA, 14 nt, Chlamydophila pneumoniae J138
acaacagagacaag

SEQ ID NO: 2545009 - RNA, 22 nt, Chlamydophila pneumoniae J138
acaacaguugcggagaugccau

SEQ ID NO: 2545010 - RNA, 17 nt, Chlamydophila pneumoniae J138
acaacauaaagaagguu

SEQ ID NO: 2545011 - RNA, 15 nt, Chlamydophila pneumoniae J138
acaacaucacuauca

SEQ ID NO: 2545012 - RNA, 17 nt, Chlamydophila pneumoniae J138
acaacaucaugaaauac

SEQ ID NO: 2545013 - RNA, 18 nt, Chlamydophila pneumoniae J138
acaacauugaguugguuu

SEQ ID NO: 2545014 - RNA, 13 nt, Chlamydophila pneumoniae J138
acaaccacuuccu

SEQ ID NO: 2545015 - RNA, 16 nt, Chlamydophila pneumoniae J138
acaaccgccuuuauau

SEQ ID NO: 2545016 - RNA, 21 nt, Chlamydophila pneumoniae J138
acaaccuagaaucacauaaaa

SEQ ID NO: 2545017 - RNA, 17 nt, Chlamydophila pneumoniae J138
acaacgcaggaagaaca

SEQ ID NO: 2545018 - RNA, 14 nt, Chlamydophila pneumoniae J138
acacuuuguuuuuc

SEQ ID NO: 2545019 - RNA, 19 nt, Chlamydophila pneumoniae J138
acagaaaagaaugugcuuu

SEQ ID NO: 2545020 - RNA, 15 nt, Chlamydophila pneumoniae J138
acagaaagauugugc

SEQ ID NO: 2545021 - RNA, 16 nt, Chlamydophila pneumoniae J138
acagaaaggcuuuucu

SEQ ID NO: 2545022 - RNA, 20 nt, Chlamydophila pneumoniae J138
acagaaauugcuucuuccaa

SEQ ID NO: 2545023 - RNA, 21 nt, Chlamydophila pneumoniae J138
acagaagucuuggacguuccu

SEQ ID NO: 2545024 - RNA, 16 nt, Chlamydophila pneumoniae J138
acagaaugauaagaaa

SEQ ID NO: 2545025 - RNA, 17 nt, Chlamydophila pneumoniae J138
acagaaugauaagaaag

SEQ ID NO: 2545026 - RNA, 19 nt, Chlamydophila pneumoniae J138
acagaccguccuccccaua

SEQ ID NO: 2545027 - RNA, 16 nt, Chlamydophila pneumoniae J138
acagacugaagucguu

SEQ ID NO: 2545028 - RNA, 17 nt, Chlamydophila pneumoniae J138
acagagaccuucucuuc

SEQ ID NO: 2545029 - RNA, 21 nt, Chlamydophila pneumoniae J138
acagagcgucuauuagauuuc

SEQ ID NO: 2545030 - RNA, 16 nt, Chlamydophila pneumoniae J138
acagauaggaaccacu

SEQ ID NO: 2545031 - RNA, 21 nt, Chlamydophila pneumoniae J138
acagauaugcugaauuccucu

SEQ ID NO: 2545032 - RNA, 15 nt, Chlamydophila pneumoniae J138
acagauguaaaugcu

SEQ ID NO: 2545033 - RNA, 20 nt, Chlamydophila pneumoniae J138
acagcaaucugcagguaagg

SEQ ID NO: 2545034 - RNA, 14 nt, Chlamydophila pneumoniae J138
acagcauaaaaauu

SEQ ID NO: 2545035 - RNA, 16 nt, Chlamydophila pneumoniae J138
acagcauaaaaauucu

SEQ ID NO: 2545036 - RNA, 22 nt, Chlamydophila pneumoniae J138
acagcaucaggauucucucugc

SEQ ID NO: 2545037 - RNA, 16 nt, Chlamydophila pneumoniae J138
acagcaucggcaacca

SEQ ID NO: 2545038 - RNA, 21 nt, Chlamydophila pneumoniae J138
acagcauggacuccaagaaua

SEQ ID NO: 2545039 - RNA, 13 nt, Chlamydophila pneumoniae J138
acagccagcagaa

SEQ ID NO: 2545040 - RNA, 16 nt, Chlamydophila pneumoniae J138
acagccuguuuucuuc

SEQ ID NO: 2545041 - RNA, 19 nt, Chlamydophila pneumoniae J138
acagcgcgaucacuuuccu

SEQ ID NO: 2545042 - RNA, 17 nt, Chlamydophila pneumoniae J138
acagcguguauccaucu

SEQ ID NO: 2545043 - RNA, 14 nt, Chlamydophila pneumoniae J138
acagcuaauacauc

SEQ ID NO: 2545044 - RNA, 22 nt, Chlamydophila pneumoniae J138
acagcuaaucaauccaagaaua

SEQ ID NO: 2545045 - RNA, 13 nt, Chlamydophila pneumoniae J138
acagcuaaucaua

SEQ ID NO: 2545046 - RNA, 16 nt, Chlamydophila pneumoniae J138
acagcuccauuuaaau

SEQ ID NO: 2545047 - RNA, 17 nt, Chlamydophila pneumoniae J138
acagcuccauuuaaaug

SEQ ID NO: 2545048 - RNA, 20 nt, Chlamydophila pneumoniae J138
acagcugcuagagcagcugu

SEQ ID NO: 2545049 - RNA, 14 nt, Chlamydophila pneumoniae J138
acagcuucuuuucc

SEQ ID NO: 2545050 - RNA, 16 nt, Chlamydophila pneumoniae J138
acagcuucuuuuccag

SEQ ID NO: 2545051 - RNA, 18 nt, Chlamydophila pneumoniae J138
acagcuucuuuuccagca

SEQ ID NO: 2545052 - RNA, 16 nt, Chlamydophila pneumoniae J138
acagcuuuaaucagag

SEQ ID NO: 2545053 - RNA, 14 nt, Chlamydophila pneumoniae J138
acagcuuuaucuuc

SEQ ID NO: 2545054 - RNA, 12 nt, Chlamydophila pneumoniae J138
acaggaaagaau

SEQ ID NO: 2545055 - RNA, 14 nt, Chlamydophila pneumoniae J138
acaggaauaggcuc

SEQ ID NO: 2545056 - RNA, 20 nt, Chlamydophila pneumoniae J138
acaggaauucucaucggcau

SEQ ID NO: 2545057 - RNA, 12 nt, Chlamydophila pneumoniae J138
acaggagaagcg

SEQ ID NO: 2545058 - RNA, 18 nt, Chlamydophila pneumoniae J138
acaggcaggccacuuccu

SEQ ID NO: 2545059 - RNA, 19 nt, Chlamydophila pneumoniae J138
acaggcaggccacuuccua

SEQ ID NO: 2545060 - RNA, 18 nt, Chlamydophila pneumoniae J138
acaggcuacauaguuuuu

SEQ ID NO: 2545061 - RNA, 22 nt, Chlamydophila pneumoniae J138
acagggccugagaccauaaaau

SEQ ID NO: 2545062 - RNA, 22 nt, Chlamydophila pneumoniae J138
acaguaggcgaugcaaauucca

SEQ ID NO: 2545063 - RNA, 12 nt, Chlamydophila pneumoniae J138
acagucauaaaa

SEQ ID NO: 2545064 - RNA, 22 nt, Chlamydophila pneumoniae J138
acaguccucucccuuaaggaaa

SEQ ID NO: 2545065 - RNA, 23 nt, Chlamydophila pneumoniae J138
acaguccuuuaccaucgucucca

SEQ ID NO: 2545066 - RNA, 17 nt, Chlamydophila pneumoniae J138
acagucugugagaaaua

SEQ ID NO: 2545067 - RNA, 16 nt, Chlamydophila pneumoniae J138
acagugacacgcuuuc

SEQ ID NO: 2545068 - RNA, 20 nt, Chlamydophila pneumoniae J138
acagugguaugcuuuuccuu

SEQ ID NO: 2545069 - RNA, 21 nt, Chlamydophila pneumoniae J138
acaguugcgcgcccucuucua

SEQ ID NO: 2545070 - RNA, 16 nt, Chlamydophila pneumoniae J138
acaguuuguaaaaagc

SEQ ID NO: 2545071 - RNA, 19 nt, Chlamydophila pneumoniae J138
acauaaagaagguuucuag

SEQ ID NO: 2545072 - RNA, 13 nt, Chlamydophila pneumoniae J138
acauaaagaucuu

SEQ ID NO: 2545073 - RNA, 21 nt, Chlamydophila pneumoniae J138
acauaaagaucuuuauuuuua

SEQ ID NO: 2545074 - RNA, 13 nt, Chlamydophila pneumoniae J138
acauaaaguuaua

SEQ ID NO: 2545075 - RNA, 20 nt, Chlamydophila pneumoniae J138
acauaaaucaacaucacaau

SEQ ID NO: 2545076 - RNA, 20 nt, Chlamydophila pneumoniae J138
acauaaccucggucucgcug

SEQ ID NO: 2545077 - RNA, 21 nt, Chlamydophila pneumoniae J138
acauaaccucggucucgcugu

SEQ ID NO: 2545078 - RNA, 22 nt, Chlamydophila pneumoniae J138
acauaacgggguugucucuaca

SEQ ID NO: 2545079 - RNA, 22 nt, Chlamydophila pneumoniae J138
acauaagcacucuuaauuaaaa

SEQ ID NO: 2545080 - RNA, 18 nt, Chlamydophila pneumoniae J138
acauacaucaaaaugcug

SEQ ID NO: 2545081 - RNA, 18 nt, Chlamydophila pneumoniae J138
acauacucgucaaauuca

SEQ ID NO: 2545082 - RNA, 19 nt, Chlamydophila pneumoniae J138
acauacucgucaaauucau

SEQ ID NO: 2545083 - RNA, 22 nt, Chlamydophila pneumoniae J138
acauagaaaacauaucccauag

SEQ ID NO: 2545084 - RNA, 24 nt, Chlamydophila pneumoniae J138
acauagagauucuacaaauuaccu

SEQ ID NO: 2545085 - RNA, 18 nt, Chlamydophila pneumoniae J138
acauagggaaaguucagu

SEQ ID NO: 2545086 - RNA, 18 nt, Chlamydophila pneumoniae J138
acauaguuuaauaaaucu

SEQ ID NO: 2545087 - RNA, 18 nt, Chlamydophila pneumoniae J138
acauauacguggcuucca

SEQ ID NO: 2545088 - RNA, 23 nt, Chlamydophila pneumoniae J138
acauaucuccuuuaaauaaaauc

SEQ ID NO: 2545089 - RNA, 13 nt, Chlamydophila pneumoniae J138
acauauucuccuu

SEQ ID NO: 2545090 - RNA, 22 nt, Chlamydophila pneumoniae J138
acauauucuccuuaccaauaug

SEQ ID NO: 2545091 - RNA, 13 nt, Chlamydophila pneumoniae J138
acaucaaagaauu

SEQ ID NO: 2545092 - RNA, 19 nt, Chlamydophila pneumoniae J138
acaucaaagcaauuucucc

SEQ ID NO: 2545093 - RNA, 16 nt, Chlamydophila pneumoniae J138
acaucaaauaguucau

SEQ ID NO: 2545094 - RNA, 23 nt, Chlamydophila pneumoniae J138
acaucaagaauuucuucuuucca

SEQ ID NO: 2545095 - RNA, 11 nt, Chlamydophila pneumoniae J138
acaucaaugau

SEQ ID NO: 2545096 - RNA, 14 nt, Chlamydophila pneumoniae J138
acaucaccacugcu

SEQ ID NO: 2545097 - RNA, 22 nt, Chlamydophila pneumoniae J138
acaucacuuauauuuucuauuc

SEQ ID NO: 2545098 - RNA, 19 nt, Chlamydophila pneumoniae J138
acaucagacugaagagcaa

SEQ ID NO: 2545099 - RNA, 19 nt, Chlamydophila pneumoniae J138
acaucaucagaagcuccug

SEQ ID NO: 2545100 - RNA, 17 nt, Chlamydophila pneumoniae J138
acaucaugaaauacccg

SEQ ID NO: 2545101 - RNA, 20 nt, Chlamydophila pneumoniae J138
acaucauuaucauaaauacg

SEQ ID NO: 2545102 - RNA, 21 nt, Chlamydophila pneumoniae J138
acaucccccgggaagcugucg

SEQ ID NO: 2545103 - RNA, 14 nt, Chlamydophila pneumoniae J138
acauccuuguagaa

SEQ ID NO: 2545104 - RNA, 18 nt, Chlamydophila pneumoniae J138
acauccuuguagaacuuc

SEQ ID NO: 2545105 - RNA, 18 nt, Chlamydophila pneumoniae J138
acaucgaaaccacagcaa

SEQ ID NO: 2545106 - RNA, 13 nt, Chlamydophila pneumoniae J138
acaucguauauaa

SEQ ID NO: 2545107 - RNA, 14 nt, Chlamydophila pneumoniae J138
acaucuaacucuaa

SEQ ID NO: 2545108 - RNA, 22 nt, Chlamydophila pneumoniae J138
acaucuccaagauaauuaugua

SEQ ID NO: 2545109 - RNA, 22 nt, Chlamydophila pneumoniae J138
acaucuccaagccaugcaauga

SEQ ID NO: 2545110 - RNA, 16 nt, Chlamydophila pneumoniae J138
acaucuccugcagguu

SEQ ID NO: 2545111 - RNA, 14 nt, Chlamydophila pneumoniae J138
acaucuccuuucaa

SEQ ID NO: 2545112 - RNA, 12 nt, Chlamydophila pneumoniae J138
acaucucuuuaa

SEQ ID NO: 2545113 - RNA, 15 nt, Chlamydophila pneumoniae J138
acaucugugauuaau

SEQ ID NO: 2545114 - RNA, 13 nt, Chlamydophila pneumoniae J138
acaucuuaaaaac

SEQ ID NO: 2545115 - RNA, 14 nt, Chlamydophila pneumoniae J138
acaucuuaaaaacu

SEQ ID NO: 2545116 - RNA, 15 nt, Chlamydophila pneumoniae J138
acaucuuaaaaacua

SEQ ID NO: 2545117 - RNA, 18 nt, Chlamydophila pneumoniae J138
acaucuugagcuucaaaa

SEQ ID NO: 2545118 - RNA, 22 nt, Chlamydophila pneumoniae J138
accauccgacuuuccucaaagc

SEQ ID NO: 2545119 - RNA, 16 nt, Chlamydophila pneumoniae J138
accauccuguagcuuu

SEQ ID NO: 2545120 - RNA, 19 nt, Chlamydophila pneumoniae J138
accaucgucuccaaaaauu

SEQ ID NO: 2545121 - RNA, 20 nt, Chlamydophila pneumoniae J138
accaucugcguuuaaggguu

SEQ ID NO: 2545122 - RNA, 22 nt, Chlamydophila pneumoniae J138
accaugaccuuuagcugcugaa

SEQ ID NO: 2545123 - RNA, 17 nt, Chlamydophila pneumoniae J138
accauucuugaagaucu

SEQ ID NO: 2545124 - RNA, 16 nt, Chlamydophila pneumoniae J138
acccaaagaggggagc

SEQ ID NO: 2545125 - RNA, 14 nt, Chlamydophila pneumoniae J138
acccaacaguucuu

SEQ ID NO: 2545126 - RNA, 13 nt, Chlamydophila pneumoniae J138
acccaagagaccc

SEQ ID NO: 2545127 - RNA, 18 nt, Chlamydophila pneumoniae J138
acccaauucuuaaaaagc

SEQ ID NO: 2545128 - RNA, 16 nt, Chlamydophila pneumoniae J138
acccaccauucuugaa

SEQ ID NO: 2545129 - RNA, 22 nt, Chlamydophila pneumoniae J138
acccaccauucuugaagaucuc

SEQ ID NO: 2545130 - RNA, 16 nt, Chlamydophila pneumoniae J138
acccacgcaugccucu

SEQ ID NO: 2545131 - RNA, 20 nt, Chlamydophila pneumoniae J138
acccacgcaugccucuuggu

SEQ ID NO: 2545132 - RNA, 13 nt, Chlamydophila pneumoniae J138
acccacuccagaa

SEQ ID NO: 2545133 - RNA, 20 nt, Chlamydophila pneumoniae J138
acccagagaauguucccaaa

SEQ ID NO: 2545134 - RNA, 18 nt, Chlamydophila pneumoniae J138
acccaguuguauccagcu

SEQ ID NO: 2545135 - RNA, 18 nt, Chlamydophila pneumoniae J138
acccauaaugguacaaua

SEQ ID NO: 2545136 - RNA, 20 nt, Chlamydophila pneumoniae J138
acccauauuugaauaaagga

SEQ ID NO: 2545137 - RNA, 13 nt, Chlamydophila pneumoniae J138
acccaucuagaaa

SEQ ID NO: 2545138 - RNA, 22 nt, Chlamydophila pneumoniae J138
acccauguuucuuccugaauca

SEQ ID NO: 2545139 - RNA, 23 nt, Chlamydophila pneumoniae J138
acccauugaauuuaugggugaga

SEQ ID NO: 2545140 - RNA, 20 nt, Chlamydophila pneumoniae J138
accccaaucaguucaucuag

SEQ ID NO: 2545141 - RNA, 22 nt, Chlamydophila pneumoniae J138
accccacgcuaaacuaaaaugg

SEQ ID NO: 2545142 - RNA, 21 nt, Chlamydophila pneumoniae J138
acccucaaagaauacucuaag

SEQ ID NO: 2545143 - RNA, 18 nt, Chlamydophila pneumoniae J138
acccuucagaauucucaa

SEQ ID NO: 2545144 - RNA, 20 nt, Chlamydophila pneumoniae J138
acccuuuauacuguuuuucu

SEQ ID NO: 2545145 - RNA, 14 nt, Chlamydophila pneumoniae J138
accgaaaaaccuuc

SEQ ID NO: 2545146 - RNA, 19 nt, Chlamydophila pneumoniae J138
accgaaaaaccuucuccaa

SEQ ID NO: 2545147 - RNA, 15 nt, Chlamydophila pneumoniae J138
accgaaacuucucag

SEQ ID NO: 2545148 - RNA, 13 nt, Chlamydophila pneumoniae J138
accgaacagagcg

SEQ ID NO: 2545149 - RNA, 20 nt, Chlamydophila pneumoniae J138
accgaaucucuccagcuuga

SEQ ID NO: 2545150 - RNA, 19 nt, Chlamydophila pneumoniae J138
accgaauuuucaauuguaa

SEQ ID NO: 2545151 - RNA, 13 nt, Chlamydophila pneumoniae J138
accgagacuauuu

SEQ ID NO: 2545152 - RNA, 21 nt, Chlamydophila pneumoniae J138
accgcaaaaagcuucuuucuu

SEQ ID NO: 2545153 - RNA, 23 nt, Chlamydophila pneumoniae J138
accgccugacgauaguacuuauc

SEQ ID NO: 2545154 - RNA, 15 nt, Chlamydophila pneumoniae J138
accgcgagugugacu

SEQ ID NO: 2545155 - RNA, 17 nt, Chlamydophila pneumoniae J138
accguaaagaaaagcaa

SEQ ID NO: 2545156 - RNA, 18 nt, Chlamydophila pneumoniae J138
accguaaagaaaagcaau

SEQ ID NO: 2545157 - RNA, 21 nt, Chlamydophila pneumoniae J138
accguaacugaggcaaagauu

SEQ ID NO: 2545158 - RNA, 21 nt, Chlamydophila pneumoniae J138
accgucacuguuuuccagaaa

SEQ ID NO: 2545159 - RNA, 20 nt, Chlamydophila pneumoniae J138
accgucccaugcguccaaua

SEQ ID NO: 2545160 - RNA, 14 nt, Chlamydophila pneumoniae J138
accguuaauuuuug

SEQ ID NO: 2545161 - RNA, 18 nt, Chlamydophila pneumoniae J138
accguuaauuuuugcuaa

SEQ ID NO: 2545162 - RNA, 15 nt, Chlamydophila pneumoniae J138
accguuuccuccucu

SEQ ID NO: 2545163 - RNA, 13 nt, Chlamydophila pneumoniae J138
accuaauacagga

SEQ ID NO: 2545164 - RNA, 17 nt, Chlamydophila pneumoniae J138
accuacguuuucucuau

SEQ ID NO: 2545165 - RNA, 16 nt, Chlamydophila pneumoniae J138
accuacuaaacccugu

SEQ ID NO: 2545166 - RNA, 17 nt, Chlamydophila pneumoniae J138
accuacugggaaaucua

SEQ ID NO: 2545167 - RNA, 13 nt, Chlamydophila pneumoniae J138
accuacuuauugu

SEQ ID NO: 2545168 - RNA, 17 nt, Chlamydophila pneumoniae J138
accuaggagaaaucaca

SEQ ID NO: 2545169 - RNA, 21 nt, Chlamydophila pneumoniae J138
accuaggagaaaucacacuua

SEQ ID NO: 2545170 - RNA, 22 nt, Chlamydophila pneumoniae J138
accuauagguucaccagaagca

SEQ ID NO: 2545171 - RNA, 14 nt, Chlamydophila pneumoniae J138
accuauauuuuuua

SEQ ID NO: 2545172 - RNA, 20 nt, Chlamydophila pneumoniae J138
accuaugacggauccuagaa

SEQ ID NO: 2545173 - RNA, 20 nt, Chlamydophila pneumoniae J138
accuauuugcaacaaucuuu

SEQ ID NO: 2545174 - RNA, 15 nt, Chlamydophila pneumoniae J138
accucaaagccaucu

SEQ ID NO: 2545175 - RNA, 18 nt, Chlamydophila pneumoniae J138
accucaucucgcagucca

SEQ ID NO: 2545176 - RNA, 17 nt, Chlamydophila pneumoniae J138
accucaucucuggaaua

SEQ ID NO: 2545177 - RNA, 19 nt, Chlamydophila pneumoniae J138
accucauggagguucucaa

SEQ ID NO: 2545178 - RNA, 22 nt, Chlamydophila pneumoniae J138
accuccaccaggagcuccuccu

SEQ ID NO: 2545179 - RNA, 20 nt, Chlamydophila pneumoniae J138
accuccuauuuucuuaugac

SEQ ID NO: 2545180 - RNA, 21 nt, Chlamydophila pneumoniae J138
accucgaauuccucccagccc

SEQ ID NO: 2545181 - RNA, 12 nt, Chlamydophila pneumoniae J138
accucuaauuug

SEQ ID NO: 2545182 - RNA, 15 nt, Chlamydophila pneumoniae J138
accucucaucaaagc

SEQ ID NO: 2545183 - RNA, 22 nt, Chlamydophila pneumoniae J138
accucucccuugggauuccuua

SEQ ID NO: 2545184 - RNA, 22 nt, Chlamydophila pneumoniae J138
accucuccgucauauuuaaaag

SEQ ID NO: 2545185 - RNA, 14 nt, Chlamydophila pneumoniae J138
accucugcauguug

SEQ ID NO: 2545186 - RNA, 19 nt, Chlamydophila pneumoniae J138
accucugcauguugcaaag

SEQ ID NO: 2545187 - RNA, 18 nt, Chlamydophila pneumoniae J138
accugcaaaugaagggau

SEQ ID NO: 2545188 - RNA, 19 nt, Chlamydophila pneumoniae J138
accuggauugauccacaga

SEQ ID NO: 2545189 - RNA, 10 nt, Chlamydophila pneumoniae J138
accugggcaa

SEQ ID NO: 2545190 - RNA, 21 nt, Chlamydophila pneumoniae J138
accuguaaagaccaaauagag

SEQ ID NO: 2545191 - RNA, 18 nt, Chlamydophila pneumoniae J138
accuguguaaugagcugg

SEQ ID NO: 2545192 - RNA, 13 nt, Chlamydophila pneumoniae J138
accuguuuucuuu

SEQ ID NO: 2545193 - RNA, 14 nt, Chlamydophila pneumoniae J138
accuguuuuucuaa

SEQ ID NO: 2545194 - RNA, 19 nt, Chlamydophila pneumoniae J138
accuuaguuuuuucuaagg

SEQ ID NO: 2545195 - RNA, 18 nt, Chlamydophila pneumoniae J138
accuucaaugauuucuuu

SEQ ID NO: 2545196 - RNA, 21 nt, Chlamydophila pneumoniae J138
accuucaaugauuucuuuagc

SEQ ID NO: 2545197 - RNA, 14 nt, Chlamydophila pneumoniae J138
accuugaaguuuuu

SEQ ID NO: 2545198 - RNA, 16 nt, Chlamydophila pneumoniae J138
accuugagacaaagaa

SEQ ID NO: 2545199 - RNA, 21 nt, Chlamydophila pneumoniae J138
accuugagacaaagaaucccc

SEQ ID NO: 2545200 - RNA, 19 nt, Chlamydophila pneumoniae J138
accuugugagagggucuca

SEQ ID NO: 2545201 - RNA, 12 nt, Chlamydophila pneumoniae J138
accuuuaggaac

SEQ ID NO: 2545202 - RNA, 15 nt, Chlamydophila pneumoniae J138
accuuuaggaagcug

SEQ ID NO: 2545203 - RNA, 23 nt, Chlamydophila pneumoniae J138
accuuuaggaagcuguacuugau

SEQ ID NO: 2545204 - RNA, 15 nt, Chlamydophila pneumoniae J138
accuuuccuaaaaua

SEQ ID NO: 2545205 - RNA, 19 nt, Chlamydophila pneumoniae J138
accuuuccuaaaauaauuu

SEQ ID NO: 2545206 - RNA, 18 nt, Chlamydophila pneumoniae J138
accuuugguagaaagaca

SEQ ID NO: 2545207 - RNA, 14 nt, Chlamydophila pneumoniae J138
acgaaaacaucugu

SEQ ID NO: 2545208 - RNA, 13 nt, Chlamydophila pneumoniae J138
acgaaaaggagaa

SEQ ID NO: 2545209 - RNA, 14 nt, Chlamydophila pneumoniae J138
acgaaaaucuacac

SEQ ID NO: 2545210 - RNA, 13 nt, Chlamydophila pneumoniae J138
acgaaagcacaua

SEQ ID NO: 2545211 - RNA, 15 nt, Chlamydophila pneumoniae J138
acgaaagcacauaag

SEQ ID NO: 2545212 - RNA, 17 nt, Chlamydophila pneumoniae J138
acgaaagcacauaagau

SEQ ID NO: 2545213 - RNA, 20 nt, Chlamydophila pneumoniae J138
acgaacaugccugaaaacaa

SEQ ID NO: 2545214 - RNA, 15 nt, Chlamydophila pneumoniae J138
acgaacuaaaggaac

SEQ ID NO: 2545215 - RNA, 21 nt, Chlamydophila pneumoniae J138
acgaacuuugaccagaugauu

SEQ ID NO: 2545216 - RNA, 19 nt, Chlamydophila pneumoniae J138
acgaaguuagcuaacucgg

SEQ ID NO: 2545217 - RNA, 14 nt, Chlamydophila pneumoniae J138
acgaauaauuaaau

SEQ ID NO: 2545218 - RNA, 16 nt, Chlamydophila pneumoniae J138
acuacugaaacacuuu

SEQ ID NO: 2545219 - RNA, 21 nt, Chlamydophila pneumoniae J138
acuacugagcuucuauuucua

SEQ ID NO: 2545220 - RNA, 21 nt, Chlamydophila pneumoniae J138
acuacuguagaguuuucuuuc

SEQ ID NO: 2545221 - RNA, 14 nt, Chlamydophila pneumoniae J138
acuacuuaaagcuu

SEQ ID NO: 2545222 - RNA, 21 nt, Chlamydophila pneumoniae J138
acuacuuaaagcuugagaaaa

SEQ ID NO: 2545223 - RNA, 15 nt, Chlamydophila pneumoniae J138
acuacuuaaauccua

SEQ ID NO: 2545224 - RNA, 14 nt, Chlamydophila pneumoniae J138
acuacuuacaagaa

SEQ ID NO: 2545225 - RNA, 17 nt, Chlamydophila pneumoniae J138
acuacuuacaagaacaa

SEQ ID NO: 2545226 - RNA, 12 nt, Chlamydophila pneumoniae J138
acuagaaaaaau

SEQ ID NO: 2545227 - RNA, 20 nt, Chlamydophila pneumoniae J138
acuagaaucaccaauuuuuu

SEQ ID NO: 2545228 - RNA, 17 nt, Chlamydophila pneumoniae J138
acuagaucccucaagcg

SEQ ID NO: 2545229 - RNA, 18 nt, Chlamydophila pneumoniae J138
acuaggcaugguaggagc

SEQ ID NO: 2545230 - RNA, 15 nt, Chlamydophila pneumoniae J138
acuaguucuucuuua

SEQ ID NO: 2545231 - RNA, 15 nt, Chlamydophila pneumoniae J138
acuauagaaaaggau

SEQ ID NO: 2545232 - RNA, 16 nt, Chlamydophila pneumoniae J138
acuauagaaaaggaug

SEQ ID NO: 2545233 - RNA, 18 nt, Chlamydophila pneumoniae J138
acuauagaaaaggaugca

SEQ ID NO: 2545234 - RNA, 17 nt, Chlamydophila pneumoniae J138
acuauagggagacucuu

SEQ ID NO: 2545235 - RNA, 18 nt, Chlamydophila pneumoniae J138
acuaucauggacaagcaa

SEQ ID NO: 2545236 - RNA, 23 nt, Chlamydophila pneumoniae J138
acuauccgcacucauaggguagu

SEQ ID NO: 2545237 - RNA, 11 nt, Chlamydophila pneumoniae J138
acuaucuacac

SEQ ID NO: 2545238 - RNA, 15 nt, Chlamydophila pneumoniae J138
acuaucuacacagua

SEQ ID NO: 2545239 - RNA, 17 nt, Chlamydophila pneumoniae J138
acuaucuacacaguagc

SEQ ID NO: 2545240 - RNA, 17 nt, Chlamydophila pneumoniae J138
acuaucucuguuuuuug

SEQ ID NO: 2545241 - RNA, 18 nt, Chlamydophila pneumoniae J138
acuaugguaagcauuucu

SEQ ID NO: 2545242 - RNA, 15 nt, Chlamydophila pneumoniae J138
acuauguuauccaua

SEQ ID NO: 2545243 - RNA, 15 nt, Chlamydophila pneumoniae J138
acuauuaauacuuug

SEQ ID NO: 2545244 - RNA, 18 nt, Chlamydophila pneumoniae J138
acuauuaauacuuugcca

SEQ ID NO: 2545245 - RNA, 23 nt, Chlamydophila pneumoniae J138
acuauuaggcuuuuuucuauuuu

SEQ ID NO: 2545246 - RNA, 21 nt, Chlamydophila pneumoniae J138
acuauugggagguucgcagaa

SEQ ID NO: 2545247 - RNA, 12 nt, Chlamydophila pneumoniae J138
acucaaacccuc

SEQ ID NO: 2545248 - RNA, 16 nt, Chlamydophila pneumoniae J138
acucaaauucaaaaua

SEQ ID NO: 2545249 - RNA, 16 nt, Chlamydophila pneumoniae J138
acucaacuuuuuuacu

SEQ ID NO: 2545250 - RNA, 16 nt, Chlamydophila pneumoniae J138
acucaaggaguuuuaa

SEQ ID NO: 2545251 - RNA, 20 nt, Chlamydophila pneumoniae J138
acucaaggaguuuuaacuaa

SEQ ID NO: 2545252 - RNA, 18 nt, Chlamydophila pneumoniae J138
acucacaaacaacagaaa

SEQ ID NO: 2545253 - RNA, 21 nt, Chlamydophila pneumoniae J138
acucacaaacaacagaaaugu

SEQ ID NO: 2545254 - RNA, 13 nt, Chlamydophila pneumoniae J138
acucacagaguuc

SEQ ID NO: 2545255 - RNA, 22 nt, Chlamydophila pneumoniae J138
acucacagaguucgcgaccugu

SEQ ID NO: 2545256 - RNA, 15 nt, Chlamydophila pneumoniae J138
acucagagaaaauca

SEQ ID NO: 2545257 - RNA, 14 nt, Chlamydophila pneumoniae J138
acucagagauugcc

SEQ ID NO: 2545258 - RNA, 16 nt, Chlamydophila pneumoniae J138
acucagcgcaucacga

SEQ ID NO: 2545259 - RNA, 23 nt, Chlamydophila pneumoniae J138
acucagcguucgcucucuuuaaa

SEQ ID NO: 2545260 - RNA, 18 nt, Chlamydophila pneumoniae J138
acucaggauauauagagc

SEQ ID NO: 2545261 - RNA, 20 nt, Chlamydophila pneumoniae J138
acucaggauauauagagcag

SEQ ID NO: 2545262 - RNA, 12 nt, Chlamydophila pneumoniae J138
acucaucacaau

SEQ ID NO: 2545263 - RNA, 13 nt, Chlamydophila pneumoniae J138
acucaucacaauu

SEQ ID NO: 2545264 - RNA, 14 nt, Chlamydophila pneumoniae J138
acucaucaguaaaa

SEQ ID NO: 2545265 - RNA, 18 nt, Chlamydophila pneumoniae J138
acucauccuaaauuaaau

SEQ ID NO: 2545266 - RNA, 16 nt, Chlamydophila pneumoniae J138
acucaucuugaguaag

SEQ ID NO: 2545267 - RNA, 19 nt, Chlamydophila pneumoniae J138
acuccaagaauagcaggaa

SEQ ID NO: 2545268 - RNA, 17 nt, Chlamydophila pneumoniae J138
acuccaagucagccaag

SEQ ID NO: 2545269 - RNA, 20 nt, Chlamydophila pneumoniae J138
acuccacgaauucuuuaaaa

SEQ ID NO: 2545270 - RNA, 14 nt, Chlamydophila pneumoniae J138
acuccacuuuuuuc

SEQ ID NO: 2545271 - RNA, 16 nt, Chlamydophila pneumoniae J138
acuccaggggauaaaa

SEQ ID NO: 2545272 - RNA, 14 nt, Chlamydophila pneumoniae J138
acuccaggguguuu

SEQ ID NO: 2545273 - RNA, 15 nt, Chlamydophila pneumoniae J138
acucccguuuuguug

SEQ ID NO: 2545274 - RNA, 16 nt, Chlamydophila pneumoniae J138
acuccgagcauuuuac

SEQ ID NO: 2545275 - RNA, 22 nt, Chlamydophila pneumoniae J138
acuccuaagucguuaacaucaa

SEQ ID NO: 2545276 - RNA, 14 nt, Chlamydophila pneumoniae J138
acuccugacucuua

SEQ ID NO: 2545277 - RNA, 13 nt, Chlamydophila pneumoniae J138
acuccuuaacaac

SEQ ID NO: 2545278 - RNA, 21 nt, Chlamydophila pneumoniae J138
acuccuuugagucuuuuucag

SEQ ID NO: 2545279 - RNA, 13 nt, Chlamydophila pneumoniae J138
acuccuuuuaaaa

SEQ ID NO: 2545280 - RNA, 16 nt, Chlamydophila pneumoniae J138
acucgauuauuucuug

SEQ ID NO: 2545281 - RNA, 18 nt, Chlamydophila pneumoniae J138
acucgauuauuucuuguu

SEQ ID NO: 2545282 - RNA, 17 nt, Chlamydophila pneumoniae J138
acucgccgaaaguaucu

SEQ ID NO: 2545283 - RNA, 22 nt, Chlamydophila pneumoniae J138
acucuaaucugauucaauugag

SEQ ID NO: 2545284 - RNA, 12 nt, Chlamydophila pneumoniae J138
acucuacaagug

SEQ ID NO: 2545285 - RNA, 14 nt, Chlamydophila pneumoniae J138
acucuacaaguguc

SEQ ID NO: 2545286 - RNA, 19 nt, Chlamydophila pneumoniae J138
acucuacaguaguaaauaa

SEQ ID NO: 2545287 - RNA, 21 nt, Chlamydophila pneumoniae J138
acucuacaguaguaaauaaua

SEQ ID NO: 2545288 - RNA, 15 nt, Chlamydophila pneumoniae J138
acucuacaucuucuu

SEQ ID NO: 2545289 - RNA, 15 nt, Chlamydophila pneumoniae J138
acucuagguuuucuc

SEQ ID NO: 2545290 - RNA, 22 nt, Chlamydophila pneumoniae J138
acucuaugaucuacagauaggg

SEQ ID NO: 2545291 - RNA, 15 nt, Chlamydophila pneumoniae J138
acucucacugagugu

SEQ ID NO: 2545292 - RNA, 22 nt, Chlamydophila pneumoniae J138
acucucaguuaaagagcauccu

SEQ ID NO: 2545293 - RNA, 16 nt, Chlamydophila pneumoniae J138
acucucaucagcaaaa

SEQ ID NO: 2545294 - RNA, 17 nt, Chlamydophila pneumoniae J138
acucuccaaaagcucua

SEQ ID NO: 2545295 - RNA, 16 nt, Chlamydophila pneumoniae J138
acucucuuccaaaagu

SEQ ID NO: 2545296 - RNA, 14 nt, Chlamydophila pneumoniae J138
acucucuuccuucu

SEQ ID NO: 2545297 - RNA, 20 nt, Chlamydophila pneumoniae J138
acucucuuccuucuccugua

SEQ ID NO: 2545298 - RNA, 23 nt, Chlamydophila pneumoniae J138
acucuguuuccuugugucuuaaa

SEQ ID NO: 2545299 - RNA, 17 nt, Chlamydophila pneumoniae J138
acucuuaucuggagaug

SEQ ID NO: 2545300 - RNA, 22 nt, Chlamydophila pneumoniae J138
acucuucaucgauaggaugaca

SEQ ID NO: 2545301 - RNA, 16 nt, Chlamydophila pneumoniae J138
acucuuccacaauguu

SEQ ID NO: 2545302 - RNA, 22 nt, Chlamydophila pneumoniae J138
acucuuccacaauguuuagaau

SEQ ID NO: 2545303 - RNA, 14 nt, Chlamydophila pneumoniae J138
acucuucuuuuuau

SEQ ID NO: 2545304 - RNA, 17 nt, Chlamydophila pneumoniae J138
acucuuuaaaaauagaa

SEQ ID NO: 2545305 - RNA, 15 nt, Chlamydophila pneumoniae J138
acucuuucagaaaga

SEQ ID NO: 2545306 - RNA, 15 nt, Chlamydophila pneumoniae J138
acucuuuuaagacaa

SEQ ID NO: 2545307 - RNA, 15 nt, Chlamydophila pneumoniae J138
acucuuuucuagaaa

SEQ ID NO: 2545308 - RNA, 16 nt, Chlamydophila pneumoniae J138
acucuuuucuagaaac

SEQ ID NO: 2545309 - RNA, 23 nt, Chlamydophila pneumoniae J138
acucuuuucuagaaacugcuccu

SEQ ID NO: 2545310 - RNA, 17 nt, Chlamydophila pneumoniae J138
acugaaaccuucucucu

SEQ ID NO: 2545311 - RNA, 18 nt, Chlamydophila pneumoniae J138
acugaacgccaucuccac

SEQ ID NO: 2545312 - RNA, 14 nt, Chlamydophila pneumoniae J138
acugaagagcaauu

SEQ ID NO: 2545313 - RNA, 24 nt, Chlamydophila pneumoniae J138
acugaagagcaauuaagaaacuag

SEQ ID NO: 2545314 - RNA, 13 nt, Chlamydophila pneumoniae J138
acugaccugauac

SEQ ID NO: 2545315 - RNA, 23 nt, Chlamydophila pneumoniae J138
acugacuucuaugauaucaccag

SEQ ID NO: 2545316 - RNA, 14 nt, Chlamydophila pneumoniae J138
acugagaguuccuu

SEQ ID NO: 2545317 - RNA, 17 nt, Chlamydophila pneumoniae J138
acugaucugaaauagca

SEQ ID NO: 2545318 - RNA, 18 nt, Chlamydophila pneumoniae J138
acuuguucuucauuauua

SEQ ID NO: 2545319 - RNA, 20 nt, Chlamydophila pneumoniae J138
acuuuacacuauaagacauu

SEQ ID NO: 2545320 - RNA, 23 nt, Chlamydophila pneumoniae J138
acuuuacuucggaugagauccaa

SEQ ID NO: 2545321 - RNA, 16 nt, Chlamydophila pneumoniae J138
acuuuagggaagaaau

SEQ ID NO: 2545322 - RNA, 18 nt, Chlamydophila pneumoniae J138
acuuuagggaagaaauua

SEQ ID NO: 2545323 - RNA, 23 nt, Chlamydophila pneumoniae J138
acuuuagggaagaaauuaacaac

SEQ ID NO: 2545324 - RNA, 15 nt, Chlamydophila pneumoniae J138
acuuuauagaaagua

SEQ ID NO: 2545325 - RNA, 12 nt, Chlamydophila pneumoniae J138
acuuuauucucu

SEQ ID NO: 2545326 - RNA, 16 nt, Chlamydophila pneumoniae J138
acuuucaagauugugc

SEQ ID NO: 2545327 - RNA, 14 nt, Chlamydophila pneumoniae J138
acuuuccucaaagc

SEQ ID NO: 2545328 - RNA, 17 nt, Chlamydophila pneumoniae J138
acuuuccucucuuuaua

SEQ ID NO: 2545329 - RNA, 18 nt, Chlamydophila pneumoniae J138
acuuuccuggguaagcau

SEQ ID NO: 2545330 - RNA, 22 nt, Chlamydophila pneumoniae J138
acuuucgaagcgcucuacaaau

SEQ ID NO: 2545331 - RNA, 17 nt, Chlamydophila pneumoniae J138
acuuucguguacagacc

SEQ ID NO: 2545332 - RNA, 22 nt, Chlamydophila pneumoniae J138
acuuucugagccccuugcaaaa

SEQ ID NO: 2545333 - RNA, 18 nt, Chlamydophila pneumoniae J138
gauugaggauaaguucuu

SEQ ID NO: 2545334 - RNA, 21 nt, Chlamydophila pneumoniae J138
gauugauaaauuugcuuccaa

SEQ ID NO: 2545335 - RNA, 16 nt, Chlamydophila pneumoniae J138
gauugauccacagauc

SEQ ID NO: 2545336 - RNA, 17 nt, Chlamydophila pneumoniae J138
gauugcacucaucuuga

SEQ ID NO: 2545337 - RNA, 13 nt, Chlamydophila pneumoniae J138
gauugccaggaga

SEQ ID NO: 2545338 - RNA, 13 nt, Chlamydophila pneumoniae J138
gauugcuaagcau

SEQ ID NO: 2545339 - RNA, 20 nt, Chlamydophila pneumoniae J138
gauugcuugaaguuugucgu

SEQ ID NO: 2545340 - RNA, 13 nt, Chlamydophila pneumoniae J138
gauuggaucuuga

SEQ ID NO: 2545341 - RNA, 17 nt, Chlamydophila pneumoniae J138
gauugguaaggagaguc

SEQ ID NO: 2545342 - RNA, 17 nt, Chlamydophila pneumoniae J138
gcacuuaaaaaacuucc

SEQ ID NO: 2545343 - RNA, 20 nt, Chlamydophila pneumoniae J138
gcacuuaucucuuucuugaa

SEQ ID NO: 2545344 - RNA, 14 nt, Chlamydophila pneumoniae J138
gcacuuguuuuuuc

SEQ ID NO: 2545345 - RNA, 13 nt, Chlamydophila pneumoniae J138
gcacuuucuuuuu

SEQ ID NO: 2545346 - RNA, 14 nt, Chlamydophila pneumoniae J138
gcacuuuuauuaug

SEQ ID NO: 2545347 - RNA, 14 nt, Chlamydophila pneumoniae J138
gcagaaacacugaa

SEQ ID NO: 2545348 - RNA, 17 nt, Chlamydophila pneumoniae J138
gcagaaacuuuaaaagc

SEQ ID NO: 2545349 - RNA, 20 nt, Chlamydophila pneumoniae J138
gcagaaguccuaucaaagca

SEQ ID NO: 2545350 - RNA, 21 nt, Chlamydophila pneumoniae J138
gcagaaguccuaucaaagcaa

SEQ ID NO: 2545351 - RNA, 12 nt, Chlamydophila pneumoniae J138
gcagaaguuccu

SEQ ID NO: 2545352 - RNA, 15 nt, Chlamydophila pneumoniae J138
gcagaaguuccuuca

SEQ ID NO: 2545353 - RNA, 17 nt, Chlamydophila pneumoniae J138
gcagaaguuccuucagg

SEQ ID NO: 2545354 - RNA, 21 nt, Chlamydophila pneumoniae J138
gcagacggggaucuaaagcau

SEQ ID NO: 2545355 - RNA, 20 nt, Chlamydophila pneumoniae J138
gcagagaaauuaacagagcg

SEQ ID NO: 2545356 - RNA, 18 nt, Chlamydophila pneumoniae J138
gcagagaugcuaacaacu

SEQ ID NO: 2545357 - RNA, 14 nt, Chlamydophila pneumoniae J138
gcagaguccuucuu

SEQ ID NO: 2545358 - RNA, 18 nt, Chlamydophila pneumoniae J138
gcagaguccuucuuuucc

SEQ ID NO: 2545359 - RNA, 19 nt, Chlamydophila pneumoniae J138
gcagaguccuucuuuuccg

SEQ ID NO: 2545360 - RNA, 19 nt, Chlamydophila pneumoniae J138
gcagaguuuuucccucgcu

SEQ ID NO: 2545361 - RNA, 22 nt, Chlamydophila pneumoniae J138
gcagaguuuuucccucgcuaaa

SEQ ID NO: 2545362 - RNA, 16 nt, Chlamydophila pneumoniae J138
gcagauagcuuacaga

SEQ ID NO: 2545363 - RNA, 21 nt, Chlamydophila pneumoniae J138
gcagcauaaguuagccuggcu

SEQ ID NO: 2545364 - RNA, 18 nt, Chlamydophila pneumoniae J138
gcagcuagaggcaaacag

SEQ ID NO: 2545365 - RNA, 17 nt, Chlamydophila pneumoniae J138
gcagcucggauggacua

SEQ ID NO: 2545366 - RNA, 18 nt, Chlamydophila pneumoniae J138
gcagcuucccaagcagaa

SEQ ID NO: 2545367 - RNA, 19 nt, Chlamydophila pneumoniae J138
gcaggaauaaucaaccaaa

SEQ ID NO: 2545368 - RNA, 21 nt, Chlamydophila pneumoniae J138
gcaggaauaaucaaccaaaau

SEQ ID NO: 2545369 - RNA, 13 nt, Chlamydophila pneumoniae J138
gcaggagaacaau

SEQ ID NO: 2545370 - RNA, 20 nt, Chlamydophila pneumoniae J138
gcaggcaucacuaaucucag

SEQ ID NO: 2545371 - RNA, 15 nt, Chlamydophila pneumoniae J138
gcaggccaggagacu

SEQ ID NO: 2545372 - RNA, 14 nt, Chlamydophila pneumoniae J138
gcagggaaaaugcg

SEQ ID NO: 2545373 - RNA, 18 nt, Chlamydophila pneumoniae J138
gcagggaauccuguaaca

SEQ ID NO: 2545374 - RNA, 17 nt, Chlamydophila pneumoniae J138
gcagggggccugccaug

SEQ ID NO: 2545375 - RNA, 22 nt, Chlamydophila pneumoniae J138
gcagguuugggugcuaaguugu

SEQ ID NO: 2545376 - RNA, 19 nt, Chlamydophila pneumoniae J138
gcaguaauuccaaaauaaa

SEQ ID NO: 2545377 - RNA, 18 nt, Chlamydophila pneumoniae J138
gcaguagguaagaagcug

SEQ ID NO: 2545378 - RNA, 20 nt, Chlamydophila pneumoniae J138
gcagucgugauauccaccuu

SEQ ID NO: 2545379 - RNA, 16 nt, Chlamydophila pneumoniae J138
gcaguugcaauaccaa

SEQ ID NO: 2545380 - RNA, 21 nt, Chlamydophila pneumoniae J138
gcaguugcuguggcauacucu

SEQ ID NO: 2545381 - RNA, 18 nt, Chlamydophila pneumoniae J138
gcauaaacaaagcgucua

SEQ ID NO: 2545382 - RNA, 15 nt, Chlamydophila pneumoniae J138
gcauaauccugaaug

SEQ ID NO: 2545383 - RNA, 15 nt, Chlamydophila pneumoniae J138
gcauaauuuuucuua

SEQ ID NO: 2545384 - RNA, 21 nt, Chlamydophila pneumoniae J138
gcauacucuauuaaggauucc

SEQ ID NO: 2545385 - RNA, 22 nt, Chlamydophila pneumoniae J138
gcauagagagaaggaauuaaaa

SEQ ID NO: 2545386 - RNA, 18 nt, Chlamydophila pneumoniae J138
gcauagagcucuaaaaaa

SEQ ID NO: 2545387 - RNA, 17 nt, Chlamydophila pneumoniae J138
gcauagcccgaaauuca

SEQ ID NO: 2545388 - RNA, 19 nt, Chlamydophila pneumoniae J138
gcauaguauuaaucuuauu

SEQ ID NO: 2545389 - RNA, 18 nt, Chlamydophila pneumoniae J138
gcauauugccuucuucuu

SEQ ID NO: 2545390 - RNA, 16 nt, Chlamydophila pneumoniae J138
gcaucaagagauagag

SEQ ID NO: 2545391 - RNA, 16 nt, Chlamydophila pneumoniae J138
gcaucacgaaaaggag

SEQ ID NO: 2545392 - RNA, 15 nt, Chlamydophila pneumoniae J138
gcaucagaaucguuc

SEQ ID NO: 2545393 - RNA, 22 nt, Chlamydophila pneumoniae J138
gcauccuguagagcaagauucu

SEQ ID NO: 2545394 - RNA, 16 nt, Chlamydophila pneumoniae J138
gcaucgccuuaagcuc

SEQ ID NO: 2545395 - RNA, 17 nt, Chlamydophila pneumoniae J138
gcaucgcuaucagcugg

SEQ ID NO: 2545396 - RNA, 14 nt, Chlamydophila pneumoniae J138
gcaucuagagucuc

SEQ ID NO: 2545397 - RNA, 19 nt, Chlamydophila pneumoniae J138
gcaucuagagucucuuuca

SEQ ID NO: 2545398 - RNA, 13 nt, Chlamydophila pneumoniae J138
gcaucucucuuua

SEQ ID NO: 2545399 - RNA, 11 nt, Chlamydophila pneumoniae J138
gcaucucugca

SEQ ID NO: 2545400 - RNA, 16 nt, Chlamydophila pneumoniae J138
gcaucuuauggaagag

SEQ ID NO: 2545401 - RNA, 17 nt, Chlamydophila pneumoniae J138
gcaucuucgauuucuag

SEQ ID NO: 2545402 - RNA, 13 nt, Chlamydophila pneumoniae J138
gcaucuucucgaa

SEQ ID NO: 2545403 - RNA, 20 nt, Chlamydophila pneumoniae J138
gcaucuugagguauuccuac

SEQ ID NO: 2545404 - RNA, 16 nt, Chlamydophila pneumoniae J138
gcaucuuggcgcacac

SEQ ID NO: 2545405 - RNA, 15 nt, Chlamydophila pneumoniae J138
gcaugaaucucuucu

SEQ ID NO: 2545406 - RNA, 21 nt, Chlamydophila pneumoniae J138
gcaugacgcuuuuccaaagca

SEQ ID NO: 2545407 - RNA, 16 nt, Chlamydophila pneumoniae J138
gcaugacuauuuucau

SEQ ID NO: 2545408 - RNA, 22 nt, Chlamydophila pneumoniae J138
gcaugcaucuuaucaagagcuc

SEQ ID NO: 2545409 - RNA, 22 nt, Chlamydophila pneumoniae J138
gcaugccauaaucuauaggauu

SEQ ID NO: 2545410 - RNA, 16 nt, Chlamydophila pneumoniae J138
gcauggacuccaagaa

SEQ ID NO: 2545411 - RNA, 16 nt, Chlamydophila pneumoniae J138
gcauggauccuucauc

SEQ ID NO: 2545412 - RNA, 21 nt, Chlamydophila pneumoniae J138
gcauggcuuugugagcugcug

SEQ ID NO: 2545413 - RNA, 22 nt, Chlamydophila pneumoniae J138
gcauguauuguguucccucuuc

SEQ ID NO: 2545414 - RNA, 19 nt, Chlamydophila pneumoniae J138
gcauguccauuaauauccc

SEQ ID NO: 2545415 - RNA, 16 nt, Chlamydophila pneumoniae J138
gcaugucguaggaagu

SEQ ID NO: 2545416 - RNA, 16 nt, Chlamydophila pneumoniae J138
gcauuaucuaagaaua

SEQ ID NO: 2545417 - RNA, 22 nt, Chlamydophila pneumoniae J138
gcauuccaggacguaaaaagaa

SEQ ID NO: 2545418 - RNA, 21 nt, Chlamydophila pneumoniae J138
gcauugcaaauaagccaguac

SEQ ID NO: 2545419 - RNA, 18 nt, Chlamydophila pneumoniae J138
gcauugccauaauaaagg

SEQ ID NO: 2545420 - RNA, 21 nt, Chlamydophila pneumoniae J138
gcauuguuuguccuaggagag

SEQ ID NO: 2545421 - RNA, 13 nt, Chlamydophila pneumoniae J138
gcauuuaaaacgg

SEQ ID NO: 2545422 - RNA, 21 nt, Chlamydophila pneumoniae J138
gcauuuccuaguguuagauga

SEQ ID NO: 2545423 - RNA, 15 nt, Chlamydophila pneumoniae J138
gcauuucuuucucuu

SEQ ID NO: 2545424 - RNA, 19 nt, Chlamydophila pneumoniae J138
gcauuugccccuaacuggc

SEQ ID NO: 2545425 - RNA, 21 nt, Chlamydophila pneumoniae J138
gcauuugccccuuccaauacu

SEQ ID NO: 2545426 - RNA, 19 nt, Chlamydophila pneumoniae J138
gcauuuuacgaaucuuuuu

SEQ ID NO: 2545427 - RNA, 22 nt, Chlamydophila pneumoniae J138
gccaaaaguuuugaggauuucu

SEQ ID NO: 2545428 - RNA, 17 nt, Chlamydophila pneumoniae J138
gccaaaauuuccuaccu

SEQ ID NO: 2545429 - RNA, 24 nt, Chlamydophila pneumoniae J138
gccaaagaacagcacucucugcag

SEQ ID NO: 2545430 - RNA, 15 nt, Chlamydophila pneumoniae J138
gccaaauaucucugg

SEQ ID NO: 2545431 - RNA, 12 nt, Chlamydophila pneumoniae J138
gccaacucucua

SEQ ID NO: 2545432 - RNA, 13 nt, Chlamydophila pneumoniae J138
gccaagaaauaua

SEQ ID NO: 2545433 - RNA, 20 nt, Chlamydophila pneumoniae J138
gccaagauacuacuuacaag

SEQ ID NO: 2545434 - RNA, 19 nt, Chlamydophila pneumoniae J138
gccaagggcuuggcuccug

SEQ ID NO: 2545435 - RNA, 12 nt, Chlamydophila pneumoniae J138
gccaaggucuuc

SEQ ID NO: 2545436 - RNA, 21 nt, Chlamydophila pneumoniae J138
gccaauuuucaggcccaccag

SEQ ID NO: 2545437 - RNA, 16 nt, Chlamydophila pneumoniae J138
gccaauuuuuguagac

SEQ ID NO: 2545438 - RNA, 15 nt, Chlamydophila pneumoniae J138
gccaccaacaguccu

SEQ ID NO: 2545439 - RNA, 18 nt, Chlamydophila pneumoniae J138
gccacccuuggcagagcc

SEQ ID NO: 2545440 - RNA, 21 nt, Chlamydophila pneumoniae J138
gccacuaaguuuaggcaggaa

SEQ ID NO: 2545441 - RNA, 22 nt, Chlamydophila pneumoniae J138
gccagaauguacauagaggaga

SEQ ID NO: 2545442 - RNA, 22 nt, Chlamydophila pneumoniae J138
gcugcaaucucaaaaucaaaua

SEQ ID NO: 2545443 - RNA, 19 nt, Chlamydophila pneumoniae J138
gcugcagcaaaacuaggaa

SEQ ID NO: 2545444 - RNA, 19 nt, Chlamydophila pneumoniae J138
gcugcgucaauaagcuugc

SEQ ID NO: 2545445 - RNA, 16 nt, Chlamydophila pneumoniae J138
gcugcugaauauaguu

SEQ ID NO: 2545446 - RNA, 13 nt, Chlamydophila pneumoniae J138
gcugcuucagaaa

SEQ ID NO: 2545447 - RNA, 11 nt, Chlamydophila pneumoniae J138
gcugcuuugac

SEQ ID NO: 2545448 - RNA, 19 nt, Chlamydophila pneumoniae J138
gcugcuuuuguuguuuuug

SEQ ID NO: 2545449 - RNA, 12 nt, Chlamydophila pneumoniae J138
gcuguacagaac

SEQ ID NO: 2545450 - RNA, 20 nt, Chlamydophila pneumoniae J138
gcuguacagaacaaugguuu

SEQ ID NO: 2545451 - RNA, 11 nt, Chlamydophila pneumoniae J138
gcuguauuuuc

SEQ ID NO: 2545452 - RNA, 18 nt, Chlamydophila pneumoniae J138
gcuguauuuucagcacug

SEQ ID NO: 2545453 - RNA, 16 nt, Chlamydophila pneumoniae J138
gcuguccagucuauag

SEQ ID NO: 2545454 - RNA, 20 nt, Chlamydophila pneumoniae J138
gcugucuagaacacucagag

SEQ ID NO: 2545455 - RNA, 13 nt, Chlamydophila pneumoniae J138
gcuguggugguga

SEQ ID NO: 2545456 - RNA, 14 nt, Chlamydophila pneumoniae J138
gcuguguaaaaguu

SEQ ID NO: 2545457 - RNA, 18 nt, Chlamydophila pneumoniae J138
gcuguguuauggaaauca

SEQ ID NO: 2545458 - RNA, 13 nt, Chlamydophila pneumoniae J138
gcuguuucucugu

SEQ ID NO: 2545459 - RNA, 15 nt, Chlamydophila pneumoniae J138
gcuguuucuucugaa

SEQ ID NO: 2545460 - RNA, 15 nt, Chlamydophila pneumoniae J138
gcuuaauaaacauca

SEQ ID NO: 2545461 - RNA, 15 nt, Chlamydophila pneumoniae J138
gcuuacuuucuuuua

SEQ ID NO: 2545462 - RNA, 16 nt, Chlamydophila pneumoniae J138
gcuuacuuucuuuuag

SEQ ID NO: 2545463 - RNA, 21 nt, Chlamydophila pneumoniae J138
gcuuagcgaucucucuuccug

SEQ ID NO: 2545464 - RNA, 17 nt, Chlamydophila pneumoniae J138
gcuuauagagagaauga

SEQ ID NO: 2545465 - RNA, 21 nt, Chlamydophila pneumoniae J138
gcuuauagagagaaugacuuu

SEQ ID NO: 2545466 - RNA, 20 nt, Chlamydophila pneumoniae J138
gcuuauccaaguguucgagu

SEQ ID NO: 2545467 - RNA, 16 nt, Chlamydophila pneumoniae J138
gcuucaaaaagcuccc

SEQ ID NO: 2545468 - RNA, 16 nt, Chlamydophila pneumoniae J138
gcuucacaucuuucuc

SEQ ID NO: 2545469 - RNA, 15 nt, Chlamydophila pneumoniae J138
gcuucaucaaaacau

SEQ ID NO: 2545470 - RNA, 17 nt, Chlamydophila pneumoniae J138
gcuucaucaaaacauaa

SEQ ID NO: 2545471 - RNA, 20 nt, Chlamydophila pneumoniae J138
gcuucaucacauuaagcuca

SEQ ID NO: 2545472 - RNA, 18 nt, Chlamydophila pneumoniae J138
gcuuccaucguuagauuu

SEQ ID NO: 2545473 - RNA, 19 nt, Chlamydophila pneumoniae J138
gcuuccgugcgauuucccc

SEQ ID NO: 2545474 - RNA, 19 nt, Chlamydophila pneumoniae J138
gcuuccugcuccucuucuu

SEQ ID NO: 2545475 - RNA, 16 nt, Chlamydophila pneumoniae J138
gcuucgcaaucuuuga

SEQ ID NO: 2545476 - RNA, 17 nt, Chlamydophila pneumoniae J138
gcuucgcaaucuuugau

SEQ ID NO: 2545477 - RNA, 17 nt, Chlamydophila pneumoniae J138
gcuucuaagaaacuucc

SEQ ID NO: 2545478 - RNA, 22 nt, Chlamydophila pneumoniae J138
gcuucuaagaaacuuccaaaac

SEQ ID NO: 2545479 - RNA, 20 nt, Chlamydophila pneumoniae J138
gcuucuaagaucuuuuguaa

SEQ ID NO: 2545480 - RNA, 17 nt, Chlamydophila pneumoniae J138
gcuucuccaaauaaagc

SEQ ID NO: 2545481 - RNA, 15 nt, Chlamydophila pneumoniae J138
gcuucuccaacuucc

SEQ ID NO: 2545482 - RNA, 14 nt, Chlamydophila pneumoniae J138
gcuucucccauagc

SEQ ID NO: 2545483 - RNA, 20 nt, Chlamydophila pneumoniae J138
gcuucuggagaaaaaauauc

SEQ ID NO: 2545484 - RNA, 23 nt, Chlamydophila pneumoniae J138
gcuucuggauucaaauuugcucu

SEQ ID NO: 2545485 - RNA, 20 nt, Chlamydophila pneumoniae J138
gcuucuuucucggucuuucu

SEQ ID NO: 2545486 - RNA, 11 nt, Chlamydophila pneumoniae J138
gcuucuuucuu

SEQ ID NO: 2545487 - RNA, 12 nt, Chlamydophila pneumoniae J138
gcuucuuuucca

SEQ ID NO: 2545488 - RNA, 17 nt, Chlamydophila pneumoniae J138
gcuucuuuuuuuuucuu

SEQ ID NO: 2545489 - RNA, 15 nt, Chlamydophila pneumoniae J138
gcuugaccucaucag

SEQ ID NO: 2545490 - RNA, 20 nt, Chlamydophila pneumoniae J138
gcuugauuuccugagagcgu

SEQ ID NO: 2545491 - RNA, 13 nt, Chlamydophila pneumoniae J138
gcuugcgcagcuu

SEQ ID NO: 2545492 - RNA, 21 nt, Chlamydophila pneumoniae J138
gcuuggggguggucuagagau

SEQ ID NO: 2545493 - RNA, 19 nt, Chlamydophila pneumoniae J138
gcuugucgcgacaagacaa

SEQ ID NO: 2545494 - RNA, 13 nt, Chlamydophila pneumoniae J138
gcuugucuaggag

SEQ ID NO: 2545495 - RNA, 21 nt, Chlamydophila pneumoniae J138
gcuugugcaugcaucuuauca

SEQ ID NO: 2545496 - RNA, 17 nt, Chlamydophila pneumoniae J138
gcuuguugguuaaaaua

SEQ ID NO: 2545497 - RNA, 13 nt, Chlamydophila pneumoniae J138
gcuuguuuuugca

SEQ ID NO: 2545498 - RNA, 21 nt, Chlamydophila pneumoniae J138
gcuuuaaauuuuuuaggaucu

SEQ ID NO: 2545499 - RNA, 16 nt, Chlamydophila pneumoniae J138
gcuuuaaguguuucuu

SEQ ID NO: 2545500 - RNA, 14 nt, Chlamydophila pneumoniae J138
gcuuuagaagcccg

SEQ ID NO: 2545501 - RNA, 12 nt, Chlamydophila pneumoniae J138
gcuuuaucucua

SEQ ID NO: 2545502 - RNA, 19 nt, Chlamydophila pneumoniae J138
gcuuucagaaaagaaaagu

SEQ ID NO: 2545503 - RNA, 14 nt, Chlamydophila pneumoniae J138
gcuuuccuuuugau

SEQ ID NO: 2545504 - RNA, 14 nt, Chlamydophila pneumoniae J138
gcuuugcaucccua

SEQ ID NO: 2545505 - RNA, 19 nt, Chlamydophila pneumoniae J138
gcuuugccgccucagcacc

SEQ ID NO: 2545506 - RNA, 15 nt, Chlamydophila pneumoniae J138
gcuuugcuuaaaaag

SEQ ID NO: 2545507 - RNA, 23 nt, Chlamydophila pneumoniae J138
gcuuugggcaucucucuuuaaaa

SEQ ID NO: 2545508 - RNA, 21 nt, Chlamydophila pneumoniae J138
gcuuugugagcugcugguccu

SEQ ID NO: 2545509 - RNA, 19 nt, Chlamydophila pneumoniae J138
gcuuugugaguucuuccuu

SEQ ID NO: 2545510 - RNA, 14 nt, Chlamydophila pneumoniae J138
gcuuuucauuuuua

SEQ ID NO: 2545511 - RNA, 13 nt, Chlamydophila pneumoniae J138
gcuuuuccuucug

SEQ ID NO: 2545512 - RNA, 12 nt, Chlamydophila pneumoniae J138
gcuuuucuucuu

SEQ ID NO: 2545513 - RNA, 15 nt, Chlamydophila pneumoniae J138
gcuuuucuucuuuag

SEQ ID NO: 2545514 - RNA, 14 nt, Chlamydophila pneumoniae J138
gcuuuucuuuuucu

SEQ ID NO: 2545515 - RNA, 19 nt, Chlamydophila pneumoniae J138
gcuuuucuuuuucuaggga

SEQ ID NO: 2545516 - RNA, 18 nt, Chlamydophila pneumoniae J138
gcuuuuguuuuguauuua

SEQ ID NO: 2545517 - RNA, 13 nt, Chlamydophila pneumoniae J138
gcuuuuugaauga

SEQ ID NO: 2545518 - RNA, 16 nt, Chlamydophila pneumoniae J138
gcuuuuugaaugaucc

SEQ ID NO: 2545519 - RNA, 12 nt, Chlamydophila pneumoniae J138
ggaaaaaauaga

SEQ ID NO: 2545520 - RNA, 18 nt, Chlamydophila pneumoniae J138
ggaaaaagccuuucuuau

SEQ ID NO: 2545521 - RNA, 16 nt, Chlamydophila pneumoniae J138
ggaaaaaggaggaugu

SEQ ID NO: 2545522 - RNA, 13 nt, Chlamydophila pneumoniae J138
ggaaaauaaucuu

SEQ ID NO: 2545523 - RNA, 17 nt, Chlamydophila pneumoniae J138
ggaaaauaaucuucaaa

SEQ ID NO: 2545524 - RNA, 22 nt, Chlamydophila pneumoniae J138
ggaaacagugguaugcuuuucc

SEQ ID NO: 2545525 - RNA, 19 nt, Chlamydophila pneumoniae J138
ggaaagacucaucuuugaa

SEQ ID NO: 2545526 - RNA, 14 nt, Chlamydophila pneumoniae J138
ggaaagcacauaca

SEQ ID NO: 2545527 - RNA, 17 nt, Chlamydophila pneumoniae J138
ggaaagccaagaagaug

SEQ ID NO: 2545528 - RNA, 15 nt, Chlamydophila pneumoniae J138
ggaaagcucuuucau

SEQ ID NO: 2545529 - RNA, 23 nt, Chlamydophila pneumoniae J138
ggaaagcucuuucauaagauugc

SEQ ID NO: 2545530 - RNA, 16 nt, Chlamydophila pneumoniae J138
ggaaaguucacaagca

SEQ ID NO: 2545531 - RNA, 21 nt, Chlamydophila pneumoniae J138
ggaaaucuaaacaguaggcga

SEQ ID NO: 2545532 - RNA, 23 nt, Chlamydophila pneumoniae J138
ggaaauuagguaguggccacaua

SEQ ID NO: 2545533 - RNA, 15 nt, Chlamydophila pneumoniae J138
ggaaauuauggaggg

SEQ ID NO: 2545534 - RNA, 16 nt, Chlamydophila pneumoniae J138
ggaacaagucuucaau

SEQ ID NO: 2545535 - RNA, 20 nt, Chlamydophila pneumoniae J138
ggaacauaucgauaggauuc

SEQ ID NO: 2545536 - RNA, 18 nt, Chlamydophila pneumoniae J138
ggaacaugccaaauaucu

SEQ ID NO: 2545537 - RNA, 22 nt, Chlamydophila pneumoniae J138
ggaacuaaagagaucacaggga

SEQ ID NO: 2545538 - RNA, 13 nt, Chlamydophila pneumoniae J138
ggaagaagaagaa

SEQ ID NO: 2545539 - RNA, 21 nt, Chlamydophila pneumoniae J138
ggaagaauuucauaagagaac

SEQ ID NO: 2545540 - RNA, 13 nt, Chlamydophila pneumoniae J138
ggaagacucucau

SEQ ID NO: 2545541 - RNA, 14 nt, Chlamydophila pneumoniae J138
ggaagacuuuuuaa

SEQ ID NO: 2545542 - RNA, 14 nt, Chlamydophila pneumoniae J138
ggaagcucuucuac

SEQ ID NO: 2545543 - RNA, 17 nt, Chlamydophila pneumoniae J138
ggcaucuuuuacagacu

SEQ ID NO: 2545544 - RNA, 15 nt, Chlamydophila pneumoniae J138
ggcauguuuaauauc

SEQ ID NO: 2545545 - RNA, 14 nt, Chlamydophila pneumoniae J138
ggcauucaggagca

SEQ ID NO: 2545546 - RNA, 21 nt, Chlamydophila pneumoniae J138
ggcauucuguaauuuugagaa

SEQ ID NO: 2545547 - RNA, 16 nt, Chlamydophila pneumoniae J138
ggcauuucuccacaug

SEQ ID NO: 2545548 - RNA, 21 nt, Chlamydophila pneumoniae J138
ggccaagagcuugucuuccac

SEQ ID NO: 2545549 - RNA, 20 nt, Chlamydophila pneumoniae J138
ggccaagauucucacucuau

SEQ ID NO: 2545550 - RNA, 13 nt, Chlamydophila pneumoniae J138
ggccacauuaagc

SEQ ID NO: 2545551 - RNA, 15 nt, Chlamydophila pneumoniae J138
ggccagcgcauuaac

SEQ ID NO: 2545552 - RNA, 17 nt, Chlamydophila pneumoniae J138
ggcccccuacagcagaa

SEQ ID NO: 2545553 - RNA, 18 nt, Chlamydophila pneumoniae J138
ggcccgauacaaauagcu

SEQ ID NO: 2545554 - RNA, 18 nt, Chlamydophila pneumoniae J138
ggcccugacuuagagucu

SEQ ID NO: 2545555 - RNA, 18 nt, Chlamydophila pneumoniae J138
ggccuauagcaaagaaca

SEQ ID NO: 2545556 - RNA, 13 nt, Chlamydophila pneumoniae J138
ggccucuucccaa

SEQ ID NO: 2545557 - RNA, 18 nt, Chlamydophila pneumoniae J138
ggccugagaccauaaaau

SEQ ID NO: 2545558 - RNA, 19 nt, Chlamydophila pneumoniae J138
ggccuugccaguauugaua

SEQ ID NO: 2545559 - RNA, 19 nt, Chlamydophila pneumoniae J138
ggcgccuucagcaacuaaa

SEQ ID NO: 2545560 - RNA, 20 nt, Chlamydophila pneumoniae J138
ggcggagaauaucaucuucc

SEQ ID NO: 2545561 - RNA, 21 nt, Chlamydophila pneumoniae J138
ggcguuccagcuccuuuugaa

SEQ ID NO: 2545562 - RNA, 18 nt, Chlamydophila pneumoniae J138
ggcuaaaggaucauuaaa

SEQ ID NO: 2545563 - RNA, 19 nt, Chlamydophila pneumoniae J138
ggcuaaauaaaccacgaau

SEQ ID NO: 2545564 - RNA, 16 nt, Chlamydophila pneumoniae J138
ggcuacuuuaagaccu

SEQ ID NO: 2545565 - RNA, 24 nt, Chlamydophila pneumoniae J138
ggcuauaauuaacguuucuucgca

SEQ ID NO: 2545566 - RNA, 13 nt, Chlamydophila pneumoniae J138
ggcuauagauacu

SEQ ID NO: 2545567 - RNA, 12 nt, Chlamydophila pneumoniae J138
ggcucaaagaaa

SEQ ID NO: 2545568 - RNA, 15 nt, Chlamydophila pneumoniae J138
ggcucuauaggggau

SEQ ID NO: 2545569 - RNA, 21 nt, Chlamydophila pneumoniae J138
ggcucucaaggucacagcauu

SEQ ID NO: 2545570 - RNA, 15 nt, Chlamydophila pneumoniae J138
ggcucuuuuagagcc

SEQ ID NO: 2545571 - RNA, 21 nt, Chlamydophila pneumoniae J138
ggcuggaaagccaagcuucca

SEQ ID NO: 2545572 - RNA, 16 nt, Chlamydophila pneumoniae J138
ggcugucuugaccaau

SEQ ID NO: 2545573 - RNA, 13 nt, Chlamydophila pneumoniae J138
ggcuuaagucuug

SEQ ID NO: 2545574 - RNA, 22 nt, Chlamydophila pneumoniae J138
ggcuucugagcuugccuaccca

SEQ ID NO: 2545575 - RNA, 19 nt, Chlamydophila pneumoniae J138
ggcuuuaaguguuucuuca

SEQ ID NO: 2545576 - RNA, 20 nt, Chlamydophila pneumoniae J138
ggcuuugccuuuagagacgc

SEQ ID NO: 2545577 - RNA, 15 nt, Chlamydophila pneumoniae J138
ggcuuuucuaaagcg

SEQ ID NO: 2545578 - RNA, 14 nt, Chlamydophila pneumoniae J138
ggcuuuuuccaaaa

SEQ ID NO: 2545579 - RNA, 13 nt, Chlamydophila pneumoniae J138
gggaaaagaaaag

SEQ ID NO: 2545580 - RNA, 11 nt, Chlamydophila pneumoniae J138
gggaaaaugcg

SEQ ID NO: 2545581 - RNA, 11 nt, Chlamydophila pneumoniae J138
gggaaagaaac

SEQ ID NO: 2545582 - RNA, 13 nt, Chlamydophila pneumoniae J138
gggaaagaaacua

SEQ ID NO: 2545583 - RNA, 16 nt, Chlamydophila pneumoniae J138
gggaaagacucaucuu

SEQ ID NO: 2545584 - RNA, 18 nt, Chlamydophila pneumoniae J138
gggaaauaccccaucuaa

SEQ ID NO: 2545585 - RNA, 17 nt, Chlamydophila pneumoniae J138
gggaagacucucaucag

SEQ ID NO: 2545586 - RNA, 14 nt, Chlamydophila pneumoniae J138
gggaagaggaaugc

SEQ ID NO: 2545587 - RNA, 20 nt, Chlamydophila pneumoniae J138
gggaagccuggaaaugaaua

SEQ ID NO: 2545588 - RNA, 20 nt, Chlamydophila pneumoniae J138
gggaauuaaacuuucuucuc

SEQ ID NO: 2545589 - RNA, 21 nt, Chlamydophila pneumoniae J138
gggaauuaaacuuucuucucu

SEQ ID NO: 2545590 - RNA, 22 nt, Chlamydophila pneumoniae J138
gggaauuaaacuuucuucucua

SEQ ID NO: 2545591 - RNA, 23 nt, Chlamydophila pneumoniae J138
gggaauuaaacuuucuucucuag

SEQ ID NO: 2545592 - RNA, 23 nt, Chlamydophila pneumoniae J138
gggaauuugauuuuucaaauucu

SEQ ID NO: 2545593 - RNA, 15 nt, Chlamydophila pneumoniae J138
gggacauuuccccau

SEQ ID NO: 2545594 - RNA, 14 nt, Chlamydophila pneumoniae J138
gggaucacagucuu

SEQ ID NO: 2545595 - RNA, 16 nt, Chlamydophila pneumoniae J138
gggauccugcaaagcc

SEQ ID NO: 2545596 - RNA, 17 nt, Chlamydophila pneumoniae J138
gggaucuccuugagaga

SEQ ID NO: 2545597 - RNA, 16 nt, Chlamydophila pneumoniae J138
gggaucuucagagaga

SEQ ID NO: 2545598 - RNA, 17 nt, Chlamydophila pneumoniae J138
gggaucuucagagagaa

SEQ ID NO: 2545599 - RNA, 22 nt, Chlamydophila pneumoniae J138
gggccagcgcauuaacgucauc

SEQ ID NO: 2545600 - RNA, 18 nt, Chlamydophila pneumoniae J138
gggcggacuauguuuaaa

SEQ ID NO: 2545601 - RNA, 13 nt, Chlamydophila pneumoniae J138
gggcuacaauacg

SEQ ID NO: 2545602 - RNA, 14 nt, Chlamydophila pneumoniae J138
ggggagucuuggau

SEQ ID NO: 2545603 - RNA, 22 nt, Chlamydophila pneumoniae J138
ggggaucuuaggaaauuuggau

SEQ ID NO: 2545604 - RNA, 15 nt, Chlamydophila pneumoniae J138
ggggauugauaacaa

SEQ ID NO: 2545605 - RNA, 15 nt, Chlamydophila pneumoniae J138
ggggcaguuccuaaa

SEQ ID NO: 2545606 - RNA, 13 nt, Chlamydophila pneumoniae J138
ggggcuuuccuuc

SEQ ID NO: 2545607 - RNA, 19 nt, Chlamydophila pneumoniae J138
gggguccauucugaccaaa

SEQ ID NO: 2545608 - RNA, 22 nt, Chlamydophila pneumoniae J138
gggguucccucuccuugaaaau

SEQ ID NO: 2545609 - RNA, 18 nt, Chlamydophila pneumoniae J138
ggguaaggcgaaaucuuc

SEQ ID NO: 2545610 - RNA, 12 nt, Chlamydophila pneumoniae J138
ggguaaguccac

SEQ ID NO: 2545611 - RNA, 18 nt, Chlamydophila pneumoniae J138
ggguaaguccacaagccu

SEQ ID NO: 2545612 - RNA, 15 nt, Chlamydophila pneumoniae J138
gggucuacaacaguu

SEQ ID NO: 2545613 - RNA, 13 nt, Chlamydophila pneumoniae J138
ggguguggcaaag

SEQ ID NO: 2545614 - RNA, 21 nt, Chlamydophila pneumoniae J138
ggguuguauuuccuucuuuua

SEQ ID NO: 2545615 - RNA, 23 nt, Chlamydophila pneumoniae J138
ggguuugucuccaaauguucucu

SEQ ID NO: 2545616 - RNA, 14 nt, Chlamydophila pneumoniae J138
gguaaagagcuucu

SEQ ID NO: 2545617 - RNA, 19 nt, Chlamydophila pneumoniae J138
gguaaagagcuucuucuaa

SEQ ID NO: 2545618 - RNA, 16 nt, Chlamydophila pneumoniae J138
gguaaauuuuuaaaac

SEQ ID NO: 2545619 - RNA, 12 nt, Chlamydophila pneumoniae J138
gguaaggaggaa

SEQ ID NO: 2545620 - RNA, 17 nt, Chlamydophila pneumoniae J138
gguacgcuuuuucuuga

SEQ ID NO: 2545621 - RNA, 19 nt, Chlamydophila pneumoniae J138
gguagauccuauaguaauu

SEQ ID NO: 2545622 - RNA, 21 nt, Chlamydophila pneumoniae J138
gguagcccugcaccaauugca

SEQ ID NO: 2545623 - RNA, 20 nt, Chlamydophila pneumoniae J138
gguagucccuuucuauuuca

SEQ ID NO: 2545624 - RNA, 24 nt, Chlamydophila pneumoniae J138
gguaguuugccuucuuaucuucua

SEQ ID NO: 2545625 - RNA, 16 nt, Chlamydophila pneumoniae J138
gguauagaaacaccgu

SEQ ID NO: 2545626 - RNA, 14 nt, Chlamydophila pneumoniae J138
gguauuucucucca

SEQ ID NO: 2545627 - RNA, 15 nt, Chlamydophila pneumoniae J138
ggucacagcauuuuc

SEQ ID NO: 2545628 - RNA, 22 nt, Chlamydophila pneumoniae J138
ggucacuauagaucucuugaag

SEQ ID NO: 2545629 - RNA, 14 nt, Chlamydophila pneumoniae J138
gguccaaacccugg

SEQ ID NO: 2545630 - RNA, 18 nt, Chlamydophila pneumoniae J138
ggucgagaaccuccacca

SEQ ID NO: 2545631 - RNA, 19 nt, Chlamydophila pneumoniae J138
ggucgauaucccacagaaa

SEQ ID NO: 2545632 - RNA, 16 nt, Chlamydophila pneumoniae J138
ggucgaucaagguguu

SEQ ID NO: 2545633 - RNA, 17 nt, Chlamydophila pneumoniae J138
ggucuaacuuagagcga

SEQ ID NO: 2545634 - RNA, 16 nt, Chlamydophila pneumoniae J138
ggucuuggguuuuaaa

SEQ ID NO: 2545635 - RNA, 16 nt, Chlamydophila pneumoniae J138
ggugaaaguacaggag

SEQ ID NO: 2545636 - RNA, 15 nt, Chlamydophila pneumoniae J138
ggugaacuaaaucuc

SEQ ID NO: 2545637 - RNA, 17 nt, Chlamydophila pneumoniae J138
ggugaagaauaauagca

SEQ ID NO: 2545638 - RNA, 18 nt, Chlamydophila pneumoniae J138
ggugagaucgaaaaauac

SEQ ID NO: 2545639 - RNA, 16 nt, Chlamydophila pneumoniae J138
ggugauauuuucuugu

SEQ ID NO: 2545640 - RNA, 14 nt, Chlamydophila pneumoniae J138
ggugcaucauuuuc

SEQ ID NO: 2545641 - RNA, 19 nt, Chlamydophila pneumoniae J138
ggugcuguuguaauaaaag

SEQ ID NO: 2545642 - RNA, 16 nt, Chlamydophila pneumoniae J138
gguggaacuauccugu

SEQ ID NO: 2545643 - RNA, 22 nt, Chlamydophila pneumoniae J138
guagaauccuucucccucuaaa

SEQ ID NO: 2545644 - RNA, 18 nt, Chlamydophila pneumoniae J138
guagacaacaagucuucc

SEQ ID NO: 2545645 - RNA, 19 nt, Chlamydophila pneumoniae J138
guagacaauaccagauaaa

SEQ ID NO: 2545646 - RNA, 14 nt, Chlamydophila pneumoniae J138
guagagcaagauuc

SEQ ID NO: 2545647 - RNA, 16 nt, Chlamydophila pneumoniae J138
guagagcaagauucuu

SEQ ID NO: 2545648 - RNA, 12 nt, Chlamydophila pneumoniae J138
guagagguacuu

SEQ ID NO: 2545649 - RNA, 21 nt, Chlamydophila pneumoniae J138
guagagucggccguauaacuu

SEQ ID NO: 2545650 - RNA, 20 nt, Chlamydophila pneumoniae J138
guagauagaaauucuguaga

SEQ ID NO: 2545651 - RNA, 18 nt, Chlamydophila pneumoniae J138
guagaucauaaacagcag

SEQ ID NO: 2545652 - RNA, 19 nt, Chlamydophila pneumoniae J138
guagaucuucugaaaucaa

SEQ ID NO: 2545653 - RNA, 16 nt, Chlamydophila pneumoniae J138
guagcaucucucucca

SEQ ID NO: 2545654 - RNA, 18 nt, Chlamydophila pneumoniae J138
guagcauuucuuucucuu

SEQ ID NO: 2545655 - RNA, 11 nt, Chlamydophila pneumoniae J138
guagccccagc

SEQ ID NO: 2545656 - RNA, 15 nt, Chlamydophila pneumoniae J138
guagccccagcaacc

SEQ ID NO: 2545657 - RNA, 23 nt, Chlamydophila pneumoniae J138
guagccccggucgucuuagaauc

SEQ ID NO: 2545658 - RNA, 18 nt, Chlamydophila pneumoniae J138
guagcgacguuugaucuu

SEQ ID NO: 2545659 - RNA, 19 nt, Chlamydophila pneumoniae J138
guagcguacguuuucucuu

SEQ ID NO: 2545660 - RNA, 22 nt, Chlamydophila pneumoniae J138
guagcuacggagagguuaugua

SEQ ID NO: 2545661 - RNA, 17 nt, Chlamydophila pneumoniae J138
guagcucaggaaaacuu

SEQ ID NO: 2545662 - RNA, 19 nt, Chlamydophila pneumoniae J138
guaggaacaugccaaauau

SEQ ID NO: 2545663 - RNA, 18 nt, Chlamydophila pneumoniae J138
guaggaccuacugggaaa

SEQ ID NO: 2545664 - RNA, 20 nt, Chlamydophila pneumoniae J138
guaggcacaucauuaucaua

SEQ ID NO: 2545665 - RNA, 21 nt, Chlamydophila pneumoniae J138
guaggcauacaguagaaacau

SEQ ID NO: 2545666 - RNA, 21 nt, Chlamydophila pneumoniae J138
guaggucucccuggucuguau

SEQ ID NO: 2545667 - RNA, 14 nt, Chlamydophila pneumoniae J138
guagguuuuuccaa

SEQ ID NO: 2545668 - RNA, 21 nt, Chlamydophila pneumoniae J138
guaguaaggagagacuguguu

SEQ ID NO: 2545669 - RNA, 16 nt, Chlamydophila pneumoniae J138
guaguaggcacuuauc

SEQ ID NO: 2545670 - RNA, 18 nt, Chlamydophila pneumoniae J138
guagucaaaaauucuucg

SEQ ID NO: 2545671 - RNA, 22 nt, Chlamydophila pneumoniae J138
guagucaugauuuuucaaucaa

SEQ ID NO: 2545672 - RNA, 18 nt, Chlamydophila pneumoniae J138
guagugagauacggagga

SEQ ID NO: 2545673 - RNA, 17 nt, Chlamydophila pneumoniae J138
guaguggugaacuaaau

SEQ ID NO: 2545674 - RNA, 13 nt, Chlamydophila pneumoniae J138
guaguucuugcca

SEQ ID NO: 2545675 - RNA, 19 nt, Chlamydophila pneumoniae J138
guaguugauuuagaaucuu

SEQ ID NO: 2545676 - RNA, 17 nt, Chlamydophila pneumoniae J138
guaguuucuaaaacaga

SEQ ID NO: 2545677 - RNA, 19 nt, Chlamydophila pneumoniae J138
guaguuucuaaaacagaaa

SEQ ID NO: 2545678 - RNA, 17 nt, Chlamydophila pneumoniae J138
guaguuugccuucuuau

SEQ ID NO: 2545679 - RNA, 13 nt, Chlamydophila pneumoniae J138
guauaacaucuaa

SEQ ID NO: 2545680 - RNA, 20 nt, Chlamydophila pneumoniae J138
guauaacaucuaaaaaugca

SEQ ID NO: 2545681 - RNA, 19 nt, Chlamydophila pneumoniae J138
guauaauagugagcucccu

SEQ ID NO: 2545682 - RNA, 20 nt, Chlamydophila pneumoniae J138
guauaauuggcguaauaauu

SEQ ID NO: 2545683 - RNA, 15 nt, Chlamydophila pneumoniae J138
guauacauaucuccu

SEQ ID NO: 2545684 - RNA, 20 nt, Chlamydophila pneumoniae J138
guauaccauguuaucaagac

SEQ ID NO: 2545685 - RNA, 13 nt, Chlamydophila pneumoniae J138
guauagaaacacc

SEQ ID NO: 2545686 - RNA, 21 nt, Chlamydophila pneumoniae J138
guauagacuccuuaacaaccg

SEQ ID NO: 2545687 - RNA, 19 nt, Chlamydophila pneumoniae J138
guauagagcgguucuuucu

SEQ ID NO: 2545688 - RNA, 14 nt, Chlamydophila pneumoniae J138
guauagauuuuccg

SEQ ID NO: 2545689 - RNA, 13 nt, Chlamydophila pneumoniae J138
guauaggcauuaa

SEQ ID NO: 2545690 - RNA, 19 nt, Chlamydophila pneumoniae J138
guauauaagauaauagaga

SEQ ID NO: 2545691 - RNA, 21 nt, Chlamydophila pneumoniae J138
guauaucagcaaaaaacugca

SEQ ID NO: 2545692 - RNA, 21 nt, Chlamydophila pneumoniae J138
guauauccacgaucuagaaga

SEQ ID NO: 2545693 - RNA, 23 nt, Chlamydophila pneumoniae J138
guaucaauaaugacucuagagua

SEQ ID NO: 2545694 - RNA, 20 nt, Chlamydophila pneumoniae J138
guaucagcaagcccuccagu

SEQ ID NO: 2545695 - RNA, 23 nt, Chlamydophila pneumoniae J138
guauccgcugcccaugcuuaucu

SEQ ID NO: 2545696 - RNA, 23 nt, Chlamydophila pneumoniae J138
guaucgacuuuuuuaagaguguc

SEQ ID NO: 2545697 - RNA, 19 nt, Chlamydophila pneumoniae J138
guaucgagcucuuuaagaa

SEQ ID NO: 2545698 - RNA, 14 nt, Chlamydophila pneumoniae J138
guaucuccggaacg

SEQ ID NO: 2545699 - RNA, 16 nt, Chlamydophila pneumoniae J138
guaucuguauccuucc

SEQ ID NO: 2545700 - RNA, 12 nt, Chlamydophila pneumoniae J138
guaucuucagua

SEQ ID NO: 2545701 - RNA, 19 nt, Chlamydophila pneumoniae J138
guaugagcuccaaaauaau

SEQ ID NO: 2545702 - RNA, 17 nt, Chlamydophila pneumoniae J138
guaugaggagauaaaga

SEQ ID NO: 2545703 - RNA, 16 nt, Chlamydophila pneumoniae J138
guaugaucaagaggag

SEQ ID NO: 2545704 - RNA, 21 nt, Chlamydophila pneumoniae J138
guauggauuucuccagcagcu

SEQ ID NO: 2545705 - RNA, 22 nt, Chlamydophila pneumoniae J138
guauuccuuggauuucuucuuc

SEQ ID NO: 2545706 - RNA, 14 nt, Chlamydophila pneumoniae J138
guauucugaagcug

SEQ ID NO: 2545707 - RNA, 16 nt, Chlamydophila pneumoniae J138
guauuuugcaaaugaa

SEQ ID NO: 2545708 - RNA, 11 nt, Chlamydophila pneumoniae J138
gucaaaauauc

SEQ ID NO: 2545709 - RNA, 21 nt, Chlamydophila pneumoniae J138
gucaaaauaucauucacuauu

SEQ ID NO: 2545710 - RNA, 16 nt, Chlamydophila pneumoniae J138
gucaaagguuuuaaaa

SEQ ID NO: 2545711 - RNA, 16 nt, Chlamydophila pneumoniae J138
gucaauaagcuugcca

SEQ ID NO: 2545712 - RNA, 21 nt, Chlamydophila pneumoniae J138
gucaauaagcuugccagcaga

SEQ ID NO: 2545713 - RNA, 22 nt, Chlamydophila pneumoniae J138
gucaauaagcuugccagcagaa

SEQ ID NO: 2545714 - RNA, 14 nt, Chlamydophila pneumoniae J138
gucacaaugaucuu

SEQ ID NO: 2545715 - RNA, 19 nt, Chlamydophila pneumoniae J138
gucacacugcgagagaaag

SEQ ID NO: 2545716 - RNA, 19 nt, Chlamydophila pneumoniae J138
gucaccuuaauggcuccua

SEQ ID NO: 2545717 - RNA, 21 nt, Chlamydophila pneumoniae J138
gucaccuuaauggcuccuacu

SEQ ID NO: 2545718 - RNA, 23 nt, Chlamydophila pneumoniae J138
gucacggaagaacccauugaauu

SEQ ID NO: 2545719 - RNA, 23 nt, Chlamydophila pneumoniae J138
gucagcccugccucacagcuaau

SEQ ID NO: 2545720 - RNA, 16 nt, Chlamydophila pneumoniae J138
gucaggagguggugga

SEQ ID NO: 2545721 - RNA, 15 nt, Chlamydophila pneumoniae J138
gucagguaaagagcu

SEQ ID NO: 2545722 - RNA, 23 nt, Chlamydophila pneumoniae J138
gucaucaguggcgacugcaacag

SEQ ID NO: 2545723 - RNA, 19 nt, Chlamydophila pneumoniae J138
gucauguauccgaaaucug

SEQ ID NO: 2545724 - RNA, 22 nt, Chlamydophila pneumoniae J138
gucauucuauggucucccucac

SEQ ID NO: 2545725 - RNA, 17 nt, Chlamydophila pneumoniae J138
guccaagguucugggaa

SEQ ID NO: 2545726 - RNA, 16 nt, Chlamydophila pneumoniae J138
guccagacuuuccucu

SEQ ID NO: 2545727 - RNA, 16 nt, Chlamydophila pneumoniae J138
guccagccugcaccag

SEQ ID NO: 2545728 - RNA, 14 nt, Chlamydophila pneumoniae J138
guccauaauuucuu

SEQ ID NO: 2545729 - RNA, 18 nt, Chlamydophila pneumoniae J138
guccauaauuucuuucac

SEQ ID NO: 2545730 - RNA, 13 nt, Chlamydophila pneumoniae J138
guccauucugacc

SEQ ID NO: 2545731 - RNA, 12 nt, Chlamydophila pneumoniae J138
gucccaaucaag

SEQ ID NO: 2545732 - RNA, 15 nt, Chlamydophila pneumoniae J138
gucccacaaaugaua

SEQ ID NO: 2545733 - RNA, 21 nt, Chlamydophila pneumoniae J138
gucccuagaaucaucugguau

SEQ ID NO: 2545734 - RNA, 13 nt, Chlamydophila pneumoniae J138
gucccuuucagua

SEQ ID NO: 2545735 - RNA, 17 nt, Chlamydophila pneumoniae J138
guccgucaggaacccug

SEQ ID NO: 2545736 - RNA, 16 nt, Chlamydophila pneumoniae J138
guccuagcagagaaau

SEQ ID NO: 2545737 - RNA, 14 nt, Chlamydophila pneumoniae J138
guccuaggagagcu

SEQ ID NO: 2545738 - RNA, 15 nt, Chlamydophila pneumoniae J138
guccuaggagagcua

SEQ ID NO: 2545739 - RNA, 17 nt, Chlamydophila pneumoniae J138
guccuaucaaagcaaaa

SEQ ID NO: 2545740 - RNA, 19 nt, Chlamydophila pneumoniae J138
guccuccauggaaagaaac

SEQ ID NO: 2545741 - RNA, 20 nt, Chlamydophila pneumoniae J138
guccuccauggaaagaaaca

SEQ ID NO: 2545742 - RNA, 12 nt, Chlamydophila pneumoniae J138
guguuuccuucg

SEQ ID NO: 2545743 - RNA, 17 nt, Chlamydophila pneumoniae J138
guuaaacaaaguaggau

SEQ ID NO: 2545744 - RNA, 20 nt, Chlamydophila pneumoniae J138
guuaacaagauucucagcuu

SEQ ID NO: 2545745 - RNA, 19 nt, Chlamydophila pneumoniae J138
guuaacaaguaccaagaaa

SEQ ID NO: 2545746 - RNA, 21 nt, Chlamydophila pneumoniae J138
guuaacaaguaccaagaaaau

SEQ ID NO: 2545747 - RNA, 11 nt, Chlamydophila pneumoniae J138
guuaacaucaa

SEQ ID NO: 2545748 - RNA, 13 nt, Chlamydophila pneumoniae J138
guuaacuccuuca

SEQ ID NO: 2545749 - RNA, 15 nt, Chlamydophila pneumoniae J138
guuaagcaauaucug

SEQ ID NO: 2545750 - RNA, 15 nt, Chlamydophila pneumoniae J138
guuaagcaccauaau

SEQ ID NO: 2545751 - RNA, 11 nt, Chlamydophila pneumoniae J138
guuaauaagaa

SEQ ID NO: 2545752 - RNA, 21 nt, Chlamydophila pneumoniae J138
guuacagcguugcuaagcaua

SEQ ID NO: 2545753 - RNA, 15 nt, Chlamydophila pneumoniae J138
guuaccaaaaacugg

SEQ ID NO: 2545754 - RNA, 23 nt, Chlamydophila pneumoniae J138
guuacgcucguagguaugagcuc

SEQ ID NO: 2545755 - RNA, 16 nt, Chlamydophila pneumoniae J138
guuagaaaccaugaug

SEQ ID NO: 2545756 - RNA, 19 nt, Chlamydophila pneumoniae J138
guuagaaaccaugaugcaa

SEQ ID NO: 2545757 - RNA, 15 nt, Chlamydophila pneumoniae J138
guuagaugaagagug

SEQ ID NO: 2545758 - RNA, 15 nt, Chlamydophila pneumoniae J138
guuauauagacaaug

SEQ ID NO: 2545759 - RNA, 13 nt, Chlamydophila pneumoniae J138
guuauauuuuucu

SEQ ID NO: 2545760 - RNA, 21 nt, Chlamydophila pneumoniae J138
guuaucaaaagguuuuauaaa

SEQ ID NO: 2545761 - RNA, 20 nt, Chlamydophila pneumoniae J138
guuaucucccaagacgagaa

SEQ ID NO: 2545762 - RNA, 16 nt, Chlamydophila pneumoniae J138
guuauuaauaaauuua

SEQ ID NO: 2545763 - RNA, 15 nt, Chlamydophila pneumoniae J138
guuauuaucaaagug

SEQ ID NO: 2545764 - RNA, 13 nt, Chlamydophila pneumoniae J138
guuauugaguguu

SEQ ID NO: 2545765 - RNA, 15 nt, Chlamydophila pneumoniae J138
guuauuguuucuaug

SEQ ID NO: 2545766 - RNA, 22 nt, Chlamydophila pneumoniae J138
guucaacuuuguuaauagaaga

SEQ ID NO: 2545767 - RNA, 19 nt, Chlamydophila pneumoniae J138
guucaauuucuauaguuca

SEQ ID NO: 2545768 - RNA, 14 nt, Chlamydophila pneumoniae J138
guucacauuuucau

SEQ ID NO: 2545769 - RNA, 23 nt, Chlamydophila pneumoniae J138
guucaccagaagcauugaggaca

SEQ ID NO: 2545770 - RNA, 19 nt, Chlamydophila pneumoniae J138
guucacuucaucgacagua

SEQ ID NO: 2545771 - RNA, 15 nt, Chlamydophila pneumoniae J138
guucagcaaggaagu

SEQ ID NO: 2545772 - RNA, 18 nt, Chlamydophila pneumoniae J138
guuccaagacaauaaaaa

SEQ ID NO: 2545773 - RNA, 24 nt, Chlamydophila pneumoniae J138
guuccacagagaccuucucuucag

SEQ ID NO: 2545774 - RNA, 15 nt, Chlamydophila pneumoniae J138
guuccacuugcucuu

SEQ ID NO: 2545775 - RNA, 15 nt, Chlamydophila pneumoniae J138
guuccauaucaaaga

SEQ ID NO: 2545776 - RNA, 18 nt, Chlamydophila pneumoniae J138
guucccacuggacuucgu

SEQ ID NO: 2545777 - RNA, 18 nt, Chlamydophila pneumoniae J138
guucccuggaugaacucc

SEQ ID NO: 2545778 - RNA, 21 nt, Chlamydophila pneumoniae J138
guuccgaauaggcauuacaca

SEQ ID NO: 2545779 - RNA, 19 nt, Chlamydophila pneumoniae J138
guuccuacaggcaggccac

SEQ ID NO: 2545780 - RNA, 19 nt, Chlamydophila pneumoniae J138
guuccuauaugaaugauuu

SEQ ID NO: 2545781 - RNA, 14 nt, Chlamydophila pneumoniae J138
guuccucauccuca

SEQ ID NO: 2545782 - RNA, 20 nt, Chlamydophila pneumoniae J138
guuccugaaaagcauucugc

SEQ ID NO: 2545783 - RNA, 23 nt, Chlamydophila pneumoniae J138
guuccugaucccuuagaaauucu

SEQ ID NO: 2545784 - RNA, 20 nt, Chlamydophila pneumoniae J138
guuccugcuugauuuccuga

SEQ ID NO: 2545785 - RNA, 20 nt, Chlamydophila pneumoniae J138
guuccuguaguuugcagaga

SEQ ID NO: 2545786 - RNA, 20 nt, Chlamydophila pneumoniae J138
guucgacaacaacauaaaga

SEQ ID NO: 2545787 - RNA, 18 nt, Chlamydophila pneumoniae J138
guucgcggaucuucuucu

SEQ ID NO: 2545788 - RNA, 18 nt, Chlamydophila pneumoniae J138
guucggucucuucucugu

SEQ ID NO: 2545789 - RNA, 21 nt, Chlamydophila pneumoniae J138
guucuaugccauaaauacagg

SEQ ID NO: 2545790 - RNA, 18 nt, Chlamydophila pneumoniae J138
guucuccacaugcccaaa

SEQ ID NO: 2545791 - RNA, 19 nt, Chlamydophila pneumoniae J138
guucucccgugaacaaaaa

SEQ ID NO: 2545792 - RNA, 17 nt, Chlamydophila pneumoniae J138
guucucuaugacuucuu

SEQ ID NO: 2545793 - RNA, 19 nt, Chlamydophila pneumoniae J138
guucucuaugacuucuugu

SEQ ID NO: 2545794 - RNA, 18 nt, Chlamydophila pneumoniae J138
guucucuccagcuguggu

SEQ ID NO: 2545795 - RNA, 16 nt, Chlamydophila pneumoniae J138
guucuuagaaagcgca

SEQ ID NO: 2545796 - RNA, 18 nt, Chlamydophila pneumoniae J138
guucuucuuuacucaagu

SEQ ID NO: 2545797 - RNA, 16 nt, Chlamydophila pneumoniae J138
guucuuuacuacauga

SEQ ID NO: 2545798 - RNA, 15 nt, Chlamydophila pneumoniae J138
guucuuucaauaaca

SEQ ID NO: 2545799 - RNA, 17 nt, Chlamydophila pneumoniae J138
guucuuucaauaacaga

SEQ ID NO: 2545800 - RNA, 21 nt, Chlamydophila pneumoniae J138
guucuuucuagaaugaugcaa

SEQ ID NO: 2545801 - RNA, 13 nt, Chlamydophila pneumoniae J138
guucuuucuuucu

SEQ ID NO: 2545802 - RNA, 17 nt, Chlamydophila pneumoniae J138
guucuuuuguuugucuu

SEQ ID NO: 2545803 - RNA, 12 nt, Chlamydophila pneumoniae J138
guucuuuuugca

SEQ ID NO: 2545804 - RNA, 17 nt, Chlamydophila pneumoniae J138
guugaggaauuggcagg

SEQ ID NO: 2545805 - RNA, 19 nt, Chlamydophila pneumoniae J138
guugcaacucucuuuaaac

SEQ ID NO: 2545806 - RNA, 20 nt, Chlamydophila pneumoniae J138
guugcacucgauuauuucuu

SEQ ID NO: 2545807 - RNA, 13 nt, Chlamydophila pneumoniae J138
guugcacuuuccg

SEQ ID NO: 2545808 - RNA, 21 nt, Chlamydophila pneumoniae J138
guugcauuacgguuucuggga

SEQ ID NO: 2545809 - RNA, 15 nt, Chlamydophila pneumoniae J138
guugccuuucucuuc

SEQ ID NO: 2545810 - RNA, 23 nt, Chlamydophila pneumoniae J138
guugcgaacagcuccuggauauu

SEQ ID NO: 2545811 - RNA, 16 nt, Chlamydophila pneumoniae J138
guugcuaagaucuuua

SEQ ID NO: 2545812 - RNA, 22 nt, Chlamydophila pneumoniae J138
guugcuaagaucuuuagaauaa

SEQ ID NO: 2545813 - RNA, 20 nt, Chlamydophila pneumoniae J138
guuggaauugcauuaagaua

SEQ ID NO: 2545814 - RNA, 14 nt, Chlamydophila pneumoniae J138
guuggacugcaaga

SEQ ID NO: 2545815 - RNA, 15 nt, Chlamydophila pneumoniae J138
guuggaggaacaaua

SEQ ID NO: 2545816 - RNA, 12 nt, Chlamydophila pneumoniae J138
guuguacuuuua

SEQ ID NO: 2545817 - RNA, 21 nt, Chlamydophila pneumoniae J138
guuguagcuacaagucccccu

SEQ ID NO: 2545818 - RNA, 16 nt, Chlamydophila pneumoniae J138
guuguauccagcucaa

SEQ ID NO: 2545819 - RNA, 18 nt, Chlamydophila pneumoniae J138
guuguauuuccuucuuuu

SEQ ID NO: 2545820 - RNA, 22 nt, Chlamydophila pneumoniae J138
guuuaaagcauauucuaagcuu

SEQ ID NO: 2545821 - RNA, 18 nt, Chlamydophila pneumoniae J138
guuuaaguccuucuuccc

SEQ ID NO: 2545822 - RNA, 15 nt, Chlamydophila pneumoniae J138
guuuaauaaaucuau

SEQ ID NO: 2545823 - RNA, 14 nt, Chlamydophila pneumoniae J138
guuuaauacaaaaa

SEQ ID NO: 2545824 - RNA, 13 nt, Chlamydophila pneumoniae J138
guuuaauuccuug

SEQ ID NO: 2545825 - RNA, 22 nt, Chlamydophila pneumoniae J138
guuuacagaugcaugauccuau

SEQ ID NO: 2545826 - RNA, 12 nt, Chlamydophila pneumoniae J138
guuuagaaaaag

SEQ ID NO: 2545827 - RNA, 21 nt, Chlamydophila pneumoniae J138
guuuagaaaaagaucuaaguc

SEQ ID NO: 2545828 - RNA, 14 nt, Chlamydophila pneumoniae J138
guuuagauuuuucu

SEQ ID NO: 2545829 - RNA, 15 nt, Chlamydophila pneumoniae J138
guuuagcauagagcu

SEQ ID NO: 2545830 - RNA, 22 nt, Chlamydophila pneumoniae J138
guuuagcauagagcucuaaaaa

SEQ ID NO: 2545831 - RNA, 16 nt, Chlamydophila pneumoniae J138
guuucaaauaggaucu

SEQ ID NO: 2545832 - RNA, 21 nt, Chlamydophila pneumoniae J138
guuucaaauaggaucucucuu

SEQ ID NO: 2545833 - RNA, 12 nt, Chlamydophila pneumoniae J138
guuucaaucucu

SEQ ID NO: 2545834 - RNA, 14 nt, Chlamydophila pneumoniae J138
guuucaaucucucc

SEQ ID NO: 2545835 - RNA, 19 nt, Chlamydophila pneumoniae J138
guuucaaucucuccuugac

SEQ ID NO: 2545836 - RNA, 19 nt, Chlamydophila pneumoniae J138
guuucacaggcuacauagu

SEQ ID NO: 2545837 - RNA, 23 nt, Chlamydophila pneumoniae J138
guuucagaagucacaaauuuuug

SEQ ID NO: 2545838 - RNA, 21 nt, Chlamydophila pneumoniae J138
guuucaggaaacucaaucucu

SEQ ID NO: 2545839 - RNA, 15 nt, Chlamydophila pneumoniae J138
guuucaggucagcaa

SEQ ID NO: 2545840 - RNA, 14 nt, Chlamydophila pneumoniae J138
guuucaguuuuauc

SEQ ID NO: 2545841 - RNA, 23 nt, Chlamydophila pneumoniae J138
guuucauuuaaagaguccgaagc

SEQ ID NO: 2545842 - RNA, 15 nt, Chlamydophila pneumoniae J138
uaaaauuucuguagu

SEQ ID NO: 2545843 - RNA, 16 nt, Chlamydophila pneumoniae J138
uaaacagaucuuuauc

SEQ ID NO: 2545844 - RNA, 19 nt, Chlamydophila pneumoniae J138
uaaacagaucuuuaucauu

SEQ ID NO: 2545845 - RNA, 23 nt, Chlamydophila pneumoniae J138
uaaacagcgguugccuuucucuu

SEQ ID NO: 2545846 - RNA, 20 nt, Chlamydophila pneumoniae J138
uaaacauacaugcuaaucca

SEQ ID NO: 2545847 - RNA, 22 nt, Chlamydophila pneumoniae J138
uaaacccuguccaacuaaaaca

SEQ ID NO: 2545848 - RNA, 16 nt, Chlamydophila pneumoniae J138
uaaacccuucaagcaa

SEQ ID NO: 2545849 - RNA, 18 nt, Chlamydophila pneumoniae J138
uaaacccuucaagcaaau

SEQ ID NO: 2545850 - RNA, 15 nt, Chlamydophila pneumoniae J138
uaaaccgacauacuc

SEQ ID NO: 2545851 - RNA, 19 nt, Chlamydophila pneumoniae J138
uaaaccuggcauugccaua

SEQ ID NO: 2545852 - RNA, 15 nt, Chlamydophila pneumoniae J138
uaaaccuucaaugau

SEQ ID NO: 2545853 - RNA, 20 nt, Chlamydophila pneumoniae J138
uaaacgagcuguccagucua

SEQ ID NO: 2545854 - RNA, 18 nt, Chlamydophila pneumoniae J138
uaaacgaucaaauuccuu

SEQ ID NO: 2545855 - RNA, 16 nt, Chlamydophila pneumoniae J138
uaaacggacgcuagag

SEQ ID NO: 2545856 - RNA, 17 nt, Chlamydophila pneumoniae J138
uaaacggacgcuagaga

SEQ ID NO: 2545857 - RNA, 20 nt, Chlamydophila pneumoniae J138
uaaacuaaaaugguaaaccu

SEQ ID NO: 2545858 - RNA, 21 nt, Chlamydophila pneumoniae J138
uaaacuccauuguuguugcau

SEQ ID NO: 2545859 - RNA, 12 nt, Chlamydophila pneumoniae J138
uaaacucuccaa

SEQ ID NO: 2545860 - RNA, 14 nt, Chlamydophila pneumoniae J138
uaaacucuccaaaa

SEQ ID NO: 2545861 - RNA, 17 nt, Chlamydophila pneumoniae J138
uaaacucuuguugucua

SEQ ID NO: 2545862 - RNA, 17 nt, Chlamydophila pneumoniae J138
uaaacugcuacuuuaaa

SEQ ID NO: 2545863 - RNA, 21 nt, Chlamydophila pneumoniae J138
uaaacugggaagaccacgaaa

SEQ ID NO: 2545864 - RNA, 17 nt, Chlamydophila pneumoniae J138
uaaacuucaaugaagaa

SEQ ID NO: 2545865 - RNA, 22 nt, Chlamydophila pneumoniae J138
uaaacuucaaugaagaaaaauc

SEQ ID NO: 2545866 - RNA, 15 nt, Chlamydophila pneumoniae J138
uaaacuuucuucucu

SEQ ID NO: 2545867 - RNA, 17 nt, Chlamydophila pneumoniae J138
uaaacuuucuucucuag

SEQ ID NO: 2545868 - RNA, 21 nt, Chlamydophila pneumoniae J138
uaaacuuuguugggauuuuca

SEQ ID NO: 2545869 - RNA, 20 nt, Chlamydophila pneumoniae J138
uaaacuuuuuuucaaaucau

SEQ ID NO: 2545870 - RNA, 15 nt, Chlamydophila pneumoniae J138
uaaagaaaagcaauc

SEQ ID NO: 2545871 - RNA, 15 nt, Chlamydophila pneumoniae J138
uaaagaaacuucuga

SEQ ID NO: 2545872 - RNA, 16 nt, Chlamydophila pneumoniae J138
uaaagaaacuucugac

SEQ ID NO: 2545873 - RNA, 13 nt, Chlamydophila pneumoniae J138
uaaagaagguuuc

SEQ ID NO: 2545874 - RNA, 16 nt, Chlamydophila pneumoniae J138
uaaagaagguuucuag

SEQ ID NO: 2545875 - RNA, 15 nt, Chlamydophila pneumoniae J138
uaaagaaucacucuc

SEQ ID NO: 2545876 - RNA, 19 nt, Chlamydophila pneumoniae J138
uaaagaauuuguaacucuu

SEQ ID NO: 2545877 - RNA, 15 nt, Chlamydophila pneumoniae J138
uaaagacaucucuuu

SEQ ID NO: 2545878 - RNA, 17 nt, Chlamydophila pneumoniae J138
uaaagacaucucuuuaa

SEQ ID NO: 2545879 - RNA, 16 nt, Chlamydophila pneumoniae J138
uaaagaccaaauagag

SEQ ID NO: 2545880 - RNA, 17 nt, Chlamydophila pneumoniae J138
uaaagacccuucuuucc

SEQ ID NO: 2545881 - RNA, 17 nt, Chlamydophila pneumoniae J138
uaaagacucucuuccaa

SEQ ID NO: 2545882 - RNA, 15 nt, Chlamydophila pneumoniae J138
uaaagagaaucuccu

SEQ ID NO: 2545883 - RNA, 21 nt, Chlamydophila pneumoniae J138
uaaagagaaucuccucaucag

SEQ ID NO: 2545884 - RNA, 13 nt, Chlamydophila pneumoniae J138
uaaagagcauccu

SEQ ID NO: 2545885 - RNA, 23 nt, Chlamydophila pneumoniae J138
uaaagaguuuguucacauuuuca

SEQ ID NO: 2545886 - RNA, 15 nt, Chlamydophila pneumoniae J138
uaaagauaaucugua

SEQ ID NO: 2545887 - RNA, 17 nt, Chlamydophila pneumoniae J138
uaaagauaaucuguaag

SEQ ID NO: 2545888 - RNA, 22 nt, Chlamydophila pneumoniae J138
uaaagauaaucuguaagaaaau

SEQ ID NO: 2545889 - RNA, 19 nt, Chlamydophila pneumoniae J138
uaaagauacuuaucuuuaa

SEQ ID NO: 2545890 - RNA, 22 nt, Chlamydophila pneumoniae J138
uaaagauagcgacgucaucaua

SEQ ID NO: 2545891 - RNA, 23 nt, Chlamydophila pneumoniae J138
uaaagaucgggucuacaacaguu

SEQ ID NO: 2545892 - RNA, 18 nt, Chlamydophila pneumoniae J138
uaaagaucgugaucaaag

SEQ ID NO: 2545893 - RNA, 20 nt, Chlamydophila pneumoniae J138
uaaagaucgugaucaaagaa

SEQ ID NO: 2545894 - RNA, 16 nt, Chlamydophila pneumoniae J138
uaaagaucuucauaac

SEQ ID NO: 2545895 - RNA, 15 nt, Chlamydophila pneumoniae J138
uaaagauuggaauau

SEQ ID NO: 2545896 - RNA, 17 nt, Chlamydophila pneumoniae J138
uaaagcaaagauaaaga

SEQ ID NO: 2545897 - RNA, 19 nt, Chlamydophila pneumoniae J138
uaaagcaaagauaaagaag

SEQ ID NO: 2545898 - RNA, 14 nt, Chlamydophila pneumoniae J138
uaaagcaaaugccu

SEQ ID NO: 2545899 - RNA, 19 nt, Chlamydophila pneumoniae J138
uaaagccuccucaagauaa

SEQ ID NO: 2545900 - RNA, 22 nt, Chlamydophila pneumoniae J138
uaaagccuccucaagauaaauc

SEQ ID NO: 2545901 - RNA, 13 nt, Chlamydophila pneumoniae J138
uaaagcuaacaac

SEQ ID NO: 2545902 - RNA, 18 nt, Chlamydophila pneumoniae J138
uaaagcuccgagaaacaa

SEQ ID NO: 2545903 - RNA, 15 nt, Chlamydophila pneumoniae J138
uaaagcuucuuucuc

SEQ ID NO: 2545904 - RNA, 15 nt, Chlamydophila pneumoniae J138
uaaagcuugagaaaa

SEQ ID NO: 2545905 - RNA, 13 nt, Chlamydophila pneumoniae J138
uaaagcuuuuccg

SEQ ID NO: 2545906 - RNA, 21 nt, Chlamydophila pneumoniae J138
uaaaggaacugugccauaacg

SEQ ID NO: 2545907 - RNA, 13 nt, Chlamydophila pneumoniae J138
uaaaggacauaga

SEQ ID NO: 2545908 - RNA, 18 nt, Chlamydophila pneumoniae J138
uaaaggaccuguuuucuu

SEQ ID NO: 2545909 - RNA, 14 nt, Chlamydophila pneumoniae J138
uaaaggcucuuuua

SEQ ID NO: 2545910 - RNA, 15 nt, Chlamydophila pneumoniae J138
uaaagguugcuaaga

SEQ ID NO: 2545911 - RNA, 13 nt, Chlamydophila pneumoniae J138
uaaagguuuuaaa

SEQ ID NO: 2545912 - RNA, 14 nt, Chlamydophila pneumoniae J138
uaaagguuuuaaau

SEQ ID NO: 2545913 - RNA, 16 nt, Chlamydophila pneumoniae J138
uaaagguuuuaaauuu

SEQ ID NO: 2545914 - RNA, 20 nt, Chlamydophila pneumoniae J138
uaaaguaacgauaagaagcu

SEQ ID NO: 2545915 - RNA, 13 nt, Chlamydophila pneumoniae J138
uaaaguaggaauu

SEQ ID NO: 2545916 - RNA, 20 nt, Chlamydophila pneumoniae J138
uaaaguggcaaucuuuucuu

SEQ ID NO: 2545917 - RNA, 18 nt, Chlamydophila pneumoniae J138
uaaagugucauacgcagc

SEQ ID NO: 2545918 - RNA, 19 nt, Chlamydophila pneumoniae J138
uaaaguuugagcuaagcug

SEQ ID NO: 2545919 - RNA, 14 nt, Chlamydophila pneumoniae J138
uaaaguuuguaaaa

SEQ ID NO: 2545920 - RNA, 21 nt, Chlamydophila pneumoniae J138
uaaauacaaaacaaaagccau

SEQ ID NO: 2545921 - RNA, 18 nt, Chlamydophila pneumoniae J138
uaaauacaggagaaucca

SEQ ID NO: 2545922 - RNA, 22 nt, Chlamydophila pneumoniae J138
uaaauaccuagagcucugaaau

SEQ ID NO: 2545923 - RNA, 23 nt, Chlamydophila pneumoniae J138
uaaauacuuaggaauuuuucuag

SEQ ID NO: 2545924 - RNA, 18 nt, Chlamydophila pneumoniae J138
uaaauagaaaacauagag

SEQ ID NO: 2545925 - RNA, 14 nt, Chlamydophila pneumoniae J138
uaaauagaaaucuu

SEQ ID NO: 2545926 - RNA, 14 nt, Chlamydophila pneumoniae J138
uaaauagcucaguu

SEQ ID NO: 2545927 - RNA, 14 nt, Chlamydophila pneumoniae J138
uaaauaggcucuac

SEQ ID NO: 2545928 - RNA, 15 nt, Chlamydophila pneumoniae J138
uaaauaucuaauaaa

SEQ ID NO: 2545929 - RNA, 21 nt, Chlamydophila pneumoniae J138
uaaauaucuuaacgcuuagag

SEQ ID NO: 2545930 - RNA, 22 nt, Chlamydophila pneumoniae J138
uaaauaucuuaacgcuuagaga

SEQ ID NO: 2545931 - RNA, 14 nt, Chlamydophila pneumoniae J138
uaaauauuuuacca

SEQ ID NO: 2545932 - RNA, 20 nt, Chlamydophila pneumoniae J138
uaaaucaacaucacaaucgu

SEQ ID NO: 2545933 - RNA, 14 nt, Chlamydophila pneumoniae J138
uaaauccaaaaaau

SEQ ID NO: 2545934 - RNA, 21 nt, Chlamydophila pneumoniae J138
uaaaucgcugggauucguaau

SEQ ID NO: 2545935 - RNA, 16 nt, Chlamydophila pneumoniae J138
uaaaugacgcacacga

SEQ ID NO: 2545936 - RNA, 16 nt, Chlamydophila pneumoniae J138
uaaaugccucuuucau

SEQ ID NO: 2545937 - RNA, 21 nt, Chlamydophila pneumoniae J138
uaaaugccucuuucauacuaa

SEQ ID NO: 2545938 - RNA, 23 nt, Chlamydophila pneumoniae J138
uaaaugccucuuucauacuaaaa

SEQ ID NO: 2545939 - RNA, 22 nt, Chlamydophila pneumoniae J138
uaaauguauaggcauuaauaac

SEQ ID NO: 2545940 - RNA, 15 nt, Chlamydophila pneumoniae J138
uaaauguauugcaaa

SEQ ID NO: 2545941 - RNA, 13 nt, Chlamydophila pneumoniae J138
uaaauuaaauauc

SEQ ID NO: 2545942 - RNA, 16 nt, Chlamydophila pneumoniae J138
uaagauaaacauuaag

SEQ ID NO: 2545943 - RNA, 21 nt, Chlamydophila pneumoniae J138
uaagauaaacauuaagugaug

SEQ ID NO: 2545944 - RNA, 17 nt, Chlamydophila pneumoniae J138
uaagauaauagagaaga

SEQ ID NO: 2545945 - RNA, 18 nt, Chlamydophila pneumoniae J138
uaagauaauagagaagaa

SEQ ID NO: 2545946 - RNA, 21 nt, Chlamydophila pneumoniae J138
uaagauaauagagaagaagca

SEQ ID NO: 2545947 - RNA, 19 nt, Chlamydophila pneumoniae J138
uaagauagacucucacuga

SEQ ID NO: 2545948 - RNA, 20 nt, Chlamydophila pneumoniae J138
uaagauaucgaccuuaaaau

SEQ ID NO: 2545949 - RNA, 14 nt, Chlamydophila pneumoniae J138
uaagauaucuccag

SEQ ID NO: 2545950 - RNA, 23 nt, Chlamydophila pneumoniae J138
uaagauauguccgugagcaacaa

SEQ ID NO: 2545951 - RNA, 17 nt, Chlamydophila pneumoniae J138
uaagauauucaagagga

SEQ ID NO: 2545952 - RNA, 14 nt, Chlamydophila pneumoniae J138
uaagaucuuuagaa

SEQ ID NO: 2545953 - RNA, 18 nt, Chlamydophila pneumoniae J138
uaagaucuuuagaauaag

SEQ ID NO: 2545954 - RNA, 22 nt, Chlamydophila pneumoniae J138
uaagaucuuuagaauaagagcu

SEQ ID NO: 2545955 - RNA, 17 nt, Chlamydophila pneumoniae J138
uaagaugcugaaccuuu

SEQ ID NO: 2545956 - RNA, 20 nt, Chlamydophila pneumoniae J138
uaagauguggucuuccguau

SEQ ID NO: 2545957 - RNA, 14 nt, Chlamydophila pneumoniae J138
uaagauuauuuguu

SEQ ID NO: 2545958 - RNA, 18 nt, Chlamydophila pneumoniae J138
uaagauugccauguacau

SEQ ID NO: 2545959 - RNA, 22 nt, Chlamydophila pneumoniae J138
uaagauugccauguacaugcag

SEQ ID NO: 2545960 - RNA, 13 nt, Chlamydophila pneumoniae J138
uaagauuuccuua

SEQ ID NO: 2545961 - RNA, 12 nt, Chlamydophila pneumoniae J138
uaagauuuugaa

SEQ ID NO: 2545962 - RNA, 15 nt, Chlamydophila pneumoniae J138
uaagauuuuuagaau

SEQ ID NO: 2545963 - RNA, 13 nt, Chlamydophila pneumoniae J138
uaagcaauaucua

SEQ ID NO: 2545964 - RNA, 22 nt, Chlamydophila pneumoniae J138
uaagcaauauuucuguucugcu

SEQ ID NO: 2545965 - RNA, 19 nt, Chlamydophila pneumoniae J138
uaagcagugugcugauuuu

SEQ ID NO: 2545966 - RNA, 21 nt, Chlamydophila pneumoniae J138
uaagcauagcccgaaauucau

SEQ ID NO: 2545967 - RNA, 13 nt, Chlamydophila pneumoniae J138
uaagcaucuagaa

SEQ ID NO: 2545968 - RNA, 21 nt, Chlamydophila pneumoniae J138
uaagcucaaaauuuccucgac

SEQ ID NO: 2545969 - RNA, 17 nt, Chlamydophila pneumoniae J138
uaagcucauaagaaauu

SEQ ID NO: 2545970 - RNA, 14 nt, Chlamydophila pneumoniae J138
uaagcucuaagucc

SEQ ID NO: 2545971 - RNA, 19 nt, Chlamydophila pneumoniae J138
uaagcucuuaauuucugcu

SEQ ID NO: 2545972 - RNA, 15 nt, Chlamydophila pneumoniae J138
uaagcugcaaucuca

SEQ ID NO: 2545973 - RNA, 17 nt, Chlamydophila pneumoniae J138
uaagcuuuccucuccaa

SEQ ID NO: 2545974 - RNA, 20 nt, Chlamydophila pneumoniae J138
uaagcuuuuacccucgccaa

SEQ ID NO: 2545975 - RNA, 15 nt, Chlamydophila pneumoniae J138
uaagcuuuucuucca

SEQ ID NO: 2545976 - RNA, 22 nt, Chlamydophila pneumoniae J138
uaagcuuuucuuccaaagacug

SEQ ID NO: 2545977 - RNA, 23 nt, Chlamydophila pneumoniae J138
uaagcuuuucuuccaaagacuga

SEQ ID NO: 2545978 - RNA, 23 nt, Chlamydophila pneumoniae J138
uaaggaagaauuucgucuucaua

SEQ ID NO: 2545979 - RNA, 14 nt, Chlamydophila pneumoniae J138
uaaggacaaaucuc

SEQ ID NO: 2545980 - RNA, 15 nt, Chlamydophila pneumoniae J138
uaaggacaaaucucc

SEQ ID NO: 2545981 - RNA, 15 nt, Chlamydophila pneumoniae J138
uaaggaucccaucau

SEQ ID NO: 2545982 - RNA, 16 nt, Chlamydophila pneumoniae J138
uaaggauguuguggau

SEQ ID NO: 2545983 - RNA, 12 nt, Chlamydophila pneumoniae J138
uaagggcucuag

SEQ ID NO: 2545984 - RNA, 16 nt, Chlamydophila pneumoniae J138
uaagggcucuagauau

SEQ ID NO: 2545985 - RNA, 16 nt, Chlamydophila pneumoniae J138
uaagggcucuccuaaa

SEQ ID NO: 2545986 - RNA, 13 nt, Chlamydophila pneumoniae J138
uaaggguuuugaa

SEQ ID NO: 2545987 - RNA, 14 nt, Chlamydophila pneumoniae J138
uaagguuccaaaaa

SEQ ID NO: 2545988 - RNA, 19 nt, Chlamydophila pneumoniae J138
uaagguuuccaugagaaua

SEQ ID NO: 2545989 - RNA, 17 nt, Chlamydophila pneumoniae J138
uaaguaaccaauacagc

SEQ ID NO: 2545990 - RNA, 22 nt, Chlamydophila pneumoniae J138
uaaguacacauugucucuuuua

SEQ ID NO: 2545991 - RNA, 15 nt, Chlamydophila pneumoniae J138
uaaguccaacaucag

SEQ ID NO: 2545992 - RNA, 19 nt, Chlamydophila pneumoniae J138
uaaguccaacaucagcugu

SEQ ID NO: 2545993 - RNA, 19 nt, Chlamydophila pneumoniae J138
uaaguccuucuucccagcc

SEQ ID NO: 2545994 - RNA, 20 nt, Chlamydophila pneumoniae J138
uaagucuccauaauucugca

SEQ ID NO: 2545995 - RNA, 18 nt, Chlamydophila pneumoniae J138
uaagugacuuuucuucuu

SEQ ID NO: 2545996 - RNA, 20 nt, Chlamydophila pneumoniae J138
uaaguuacggaacucauuaa

SEQ ID NO: 2545997 - RNA, 15 nt, Chlamydophila pneumoniae J138
uaaguuagagacaca

SEQ ID NO: 2545998 - RNA, 17 nt, Chlamydophila pneumoniae J138
uaaguuagagacacaga

SEQ ID NO: 2545999 - RNA, 13 nt, Chlamydophila pneumoniae J138
uaaguucuuccaa

SEQ ID NO: 2546000 - RNA, 16 nt, Chlamydophila pneumoniae J138
uaaguuuguagcagca

SEQ ID NO: 2546001 - RNA, 20 nt, Chlamydophila pneumoniae J138
uaaguuuguagcagcaagaa

SEQ ID NO: 2546002 - RNA, 14 nt, Chlamydophila pneumoniae J138
uaauaaaagaacau

SEQ ID NO: 2546003 - RNA, 15 nt, Chlamydophila pneumoniae J138
uaauaaaagaacauu

SEQ ID NO: 2546004 - RNA, 14 nt, Chlamydophila pneumoniae J138
uaauaaaagcaccc

SEQ ID NO: 2546005 - RNA, 12 nt, Chlamydophila pneumoniae J138
uaauaaaaugcg

SEQ ID NO: 2546006 - RNA, 13 nt, Chlamydophila pneumoniae J138
uaauaaaauuuaa

SEQ ID NO: 2546007 - RNA, 16 nt, Chlamydophila pneumoniae J138
uaauaaaauuuaaaaa

SEQ ID NO: 2546008 - RNA, 22 nt, Chlamydophila pneumoniae J138
uaauaaagguugcuaagaucuu

SEQ ID NO: 2546009 - RNA, 12 nt, Chlamydophila pneumoniae J138
uaauaaaucuau

SEQ ID NO: 2546010 - RNA, 22 nt, Chlamydophila pneumoniae J138
uaauaaccugggggacuucaaa

SEQ ID NO: 2546011 - RNA, 15 nt, Chlamydophila pneumoniae J138
uaauaagaaccucua

SEQ ID NO: 2546012 - RNA, 16 nt, Chlamydophila pneumoniae J138
uaauaagcaggaaaag

SEQ ID NO: 2546013 - RNA, 18 nt, Chlamydophila pneumoniae J138
uaauaagcggaguccuuc

SEQ ID NO: 2546014 - RNA, 14 nt, Chlamydophila pneumoniae J138
uaauacaaaaaaua

SEQ ID NO: 2546015 - RNA, 18 nt, Chlamydophila pneumoniae J138
uaauacaaaaaauaaaau

SEQ ID NO: 2546016 - RNA, 21 nt, Chlamydophila pneumoniae J138
uaauacaaaaaauaaaaucaa

SEQ ID NO: 2546017 - RNA, 18 nt, Chlamydophila pneumoniae J138
uaauacggacuucacaaa

SEQ ID NO: 2546018 - RNA, 17 nt, Chlamydophila pneumoniae J138
uaauagcgacaugagaa

SEQ ID NO: 2546019 - RNA, 18 nt, Chlamydophila pneumoniae J138
uaauagcgacaugagaaa

SEQ ID NO: 2546020 - RNA, 21 nt, Chlamydophila pneumoniae J138
uaauagcgacaugagaaaucu

SEQ ID NO: 2546021 - RNA, 22 nt, Chlamydophila pneumoniae J138
uaauagcgacaugagaaaucuu

SEQ ID NO: 2546022 - RNA, 15 nt, Chlamydophila pneumoniae J138
uaauaggauaagaaa

SEQ ID NO: 2546023 - RNA, 14 nt, Chlamydophila pneumoniae J138
uaauauaaaagaag

SEQ ID NO: 2546024 - RNA, 16 nt, Chlamydophila pneumoniae J138
uaauaucgguuucuuu

SEQ ID NO: 2546025 - RNA, 13 nt, Chlamydophila pneumoniae J138
uaaucaaccaaaa

SEQ ID NO: 2546026 - RNA, 19 nt, Chlamydophila pneumoniae J138
uaaucaagccuaaaucuau

SEQ ID NO: 2546027 - RNA, 21 nt, Chlamydophila pneumoniae J138
uaaucagaagugaucuugaga

SEQ ID NO: 2546028 - RNA, 14 nt, Chlamydophila pneumoniae J138
uaaucauaucugcg

SEQ ID NO: 2546029 - RNA, 16 nt, Chlamydophila pneumoniae J138
uaaucaugauaaaaau

SEQ ID NO: 2546030 - RNA, 19 nt, Chlamydophila pneumoniae J138
uaaucaugauaaaaauuuu

SEQ ID NO: 2546031 - RNA, 23 nt, Chlamydophila pneumoniae J138
uaauccagauuguucaaaaauag

SEQ ID NO: 2546032 - RNA, 20 nt, Chlamydophila pneumoniae J138
uaauccagcaacaaccaaaa

SEQ ID NO: 2546033 - RNA, 22 nt, Chlamydophila pneumoniae J138
uaauccagcaacaaccaaaaga

SEQ ID NO: 2546034 - RNA, 12 nt, Chlamydophila pneumoniae J138
uaauccuccaaa

SEQ ID NO: 2546035 - RNA, 22 nt, Chlamydophila pneumoniae J138
uaauccuccucgaauggagugc

SEQ ID NO: 2546036 - RNA, 16 nt, Chlamydophila pneumoniae J138
uaauccucgauacugu

SEQ ID NO: 2546037 - RNA, 18 nt, Chlamydophila pneumoniae J138
uaauccucgauacuguug

SEQ ID NO: 2546038 - RNA, 23 nt, Chlamydophila pneumoniae J138
uaauccugaauggcucugucacu

SEQ ID NO: 2546039 - RNA, 21 nt, Chlamydophila pneumoniae J138
uaauccuguugucacuaagau

SEQ ID NO: 2546040 - RNA, 22 nt, Chlamydophila pneumoniae J138
uaauccuguugucacuaagaua

SEQ ID NO: 2546041 - RNA, 15 nt, Chlamydophila pneumoniae J138
uaauccuucuuucug

SEQ ID NO: 2546042 - RNA, 17 nt, Chlamydophila pneumoniae J138
uacagcuucuuuuccag

SEQ ID NO: 2546043 - RNA, 16 nt, Chlamydophila pneumoniae J138
uacaggaaaacgcccu

SEQ ID NO: 2546044 - RNA, 14 nt, Chlamydophila pneumoniae J138
uacaggaauucuca

SEQ ID NO: 2546045 - RNA, 19 nt, Chlamydophila pneumoniae J138
uacaggacuguuuguuuau

SEQ ID NO: 2546046 - RNA, 17 nt, Chlamydophila pneumoniae J138
uacaggagaagcggaag

SEQ ID NO: 2546047 - RNA, 23 nt, Chlamydophila pneumoniae J138
uacaggagcuagaagagcgucgu

SEQ ID NO: 2546048 - RNA, 14 nt, Chlamydophila pneumoniae J138
uacaggcaaggaga

SEQ ID NO: 2546049 - RNA, 17 nt, Chlamydophila pneumoniae J138
uacaguagcuugugcua

SEQ ID NO: 2546050 - RNA, 17 nt, Chlamydophila pneumoniae J138
uacaguaguaaauaaua

SEQ ID NO: 2546051 - RNA, 17 nt, Chlamydophila pneumoniae J138
uacagugacauccggau

SEQ ID NO: 2546052 - RNA, 22 nt, Chlamydophila pneumoniae J138
uacaguuggcguuuucuagaaa

SEQ ID NO: 2546053 - RNA, 16 nt, Chlamydophila pneumoniae J138
uacaguuuuuuucuaa

SEQ ID NO: 2546054 - RNA, 18 nt, Chlamydophila pneumoniae J138
uacaguuuuuuucuaaau

SEQ ID NO: 2546055 - RNA, 13 nt, Chlamydophila pneumoniae J138
uacauaguuuuua

SEQ ID NO: 2546056 - RNA, 21 nt, Chlamydophila pneumoniae J138
uacauaguuuuuauuuuuaaa

SEQ ID NO: 2546057 - RNA, 14 nt, Chlamydophila pneumoniae J138
uacaucaaaaugcu

SEQ ID NO: 2546058 - RNA, 14 nt, Chlamydophila pneumoniae J138
uacaucagacugaa

SEQ ID NO: 2546059 - RNA, 19 nt, Chlamydophila pneumoniae J138
uacaucaucagaagcuccu

SEQ ID NO: 2546060 - RNA, 18 nt, Chlamydophila pneumoniae J138
uacauccucacuagagau

SEQ ID NO: 2546061 - RNA, 21 nt, Chlamydophila pneumoniae J138
uacaucguauccaaauugcaa

SEQ ID NO: 2546062 - RNA, 17 nt, Chlamydophila pneumoniae J138
uacaucuccaagccaug

SEQ ID NO: 2546063 - RNA, 19 nt, Chlamydophila pneumoniae J138
uacaucuucuuggcuuucc

SEQ ID NO: 2546064 - RNA, 11 nt, Chlamydophila pneumoniae J138
uacauguaaac

SEQ ID NO: 2546065 - RNA, 13 nt, Chlamydophila pneumoniae J138
uacauguaaacaa

SEQ ID NO: 2546066 - RNA, 21 nt, Chlamydophila pneumoniae J138
uaccaaccuucgauuccaggc

SEQ ID NO: 2546067 - RNA, 20 nt, Chlamydophila pneumoniae J138
uaccaagacaauggaaauag

SEQ ID NO: 2546068 - RNA, 14 nt, Chlamydophila pneumoniae J138
uaccaauaugcucu

SEQ ID NO: 2546069 - RNA, 21 nt, Chlamydophila pneumoniae J138
uaccacagcuguacagaacaa

SEQ ID NO: 2546070 - RNA, 21 nt, Chlamydophila pneumoniae J138
uaccauaaggagauuccuaaa

SEQ ID NO: 2546071 - RNA, 17 nt, Chlamydophila pneumoniae J138
uaccaucgucuccaaaa

SEQ ID NO: 2546072 - RNA, 18 nt, Chlamydophila pneumoniae J138
uaccauugagauccauag

SEQ ID NO: 2546073 - RNA, 20 nt, Chlamydophila pneumoniae J138
uacccaaauuucuucuggau

SEQ ID NO: 2546074 - RNA, 17 nt, Chlamydophila pneumoniae J138
uacccaucuagaaacau

SEQ ID NO: 2546075 - RNA, 16 nt, Chlamydophila pneumoniae J138
uacccucggagacuca

SEQ ID NO: 2546076 - RNA, 19 nt, Chlamydophila pneumoniae J138
uacccuucagaauucucaa

SEQ ID NO: 2546077 - RNA, 14 nt, Chlamydophila pneumoniae J138
uacccuucuucuuc

SEQ ID NO: 2546078 - RNA, 19 nt, Chlamydophila pneumoniae J138
uaccgaccgaaucucucca

SEQ ID NO: 2546079 - RNA, 13 nt, Chlamydophila pneumoniae J138
uaccguaaagaaa

SEQ ID NO: 2546080 - RNA, 15 nt, Chlamydophila pneumoniae J138
uaccguaaagaaaag

SEQ ID NO: 2546081 - RNA, 20 nt, Chlamydophila pneumoniae J138
uaccguuuacaucaauuuua

SEQ ID NO: 2546082 - RNA, 19 nt, Chlamydophila pneumoniae J138
uaccuacuaaacccugucc

SEQ ID NO: 2546083 - RNA, 21 nt, Chlamydophila pneumoniae J138
uaccuauauuuuuuacauaac

SEQ ID NO: 2546084 - RNA, 19 nt, Chlamydophila pneumoniae J138
uaccugcauucauaaaaau

SEQ ID NO: 2546085 - RNA, 20 nt, Chlamydophila pneumoniae J138
uaccugcauucauaaaaaug

SEQ ID NO: 2546086 - RNA, 15 nt, Chlamydophila pneumoniae J138
uaccugcuaaacuuu

SEQ ID NO: 2546087 - RNA, 20 nt, Chlamydophila pneumoniae J138
uaccuuaguuuuuucuaagg

SEQ ID NO: 2546088 - RNA, 14 nt, Chlamydophila pneumoniae J138
uaccuuaucgccaa

SEQ ID NO: 2546089 - RNA, 19 nt, Chlamydophila pneumoniae J138
uaccuuaucgccaacggca

SEQ ID NO: 2546090 - RNA, 14 nt, Chlamydophila pneumoniae J138
uaccuuguuuuccu

SEQ ID NO: 2546091 - RNA, 15 nt, Chlamydophila pneumoniae J138
uaccuuucuaagaau

SEQ ID NO: 2546092 - RNA, 13 nt, Chlamydophila pneumoniae J138
uacgaaaacaucu

SEQ ID NO: 2546093 - RNA, 17 nt, Chlamydophila pneumoniae J138
uacgaaaacaucuguau

SEQ ID NO: 2546094 - RNA, 15 nt, Chlamydophila pneumoniae J138
uacgaacuaaaggaa

SEQ ID NO: 2546095 - RNA, 14 nt, Chlamydophila pneumoniae J138
uacgaauaaguuuu

SEQ ID NO: 2546096 - RNA, 13 nt, Chlamydophila pneumoniae J138
uacgaauccaaaa

SEQ ID NO: 2546097 - RNA, 17 nt, Chlamydophila pneumoniae J138
uacgaauccaaaaaaga

SEQ ID NO: 2546098 - RNA, 19 nt, Chlamydophila pneumoniae J138
uacgaauccaaaaaagagc

SEQ ID NO: 2546099 - RNA, 14 nt, Chlamydophila pneumoniae J138
uacgauguuuucuu

SEQ ID NO: 2546100 - RNA, 15 nt, Chlamydophila pneumoniae J138
uacgcaaguaaagaa

SEQ ID NO: 2546101 - RNA, 20 nt, Chlamydophila pneumoniae J138
uacgcaaguaaagaaauucu

SEQ ID NO: 2546102 - RNA, 20 nt, Chlamydophila pneumoniae J138
uacgcucguagguaugagcu

SEQ ID NO: 2546103 - RNA, 12 nt, Chlamydophila pneumoniae J138
uacgcucuccau

SEQ ID NO: 2546104 - RNA, 23 nt, Chlamydophila pneumoniae J138
uacggaaaauacagccagcagaa

SEQ ID NO: 2546105 - RNA, 20 nt, Chlamydophila pneumoniae J138
uacggaugggcacucuucca

SEQ ID NO: 2546106 - RNA, 21 nt, Chlamydophila pneumoniae J138
uacggaugggcacucuuccac

SEQ ID NO: 2546107 - RNA, 16 nt, Chlamydophila pneumoniae J138
uacggcuaaauaaacc

SEQ ID NO: 2546108 - RNA, 14 nt, Chlamydophila pneumoniae J138
uacgguuucuggga

SEQ ID NO: 2546109 - RNA, 15 nt, Chlamydophila pneumoniae J138
uacgguuucugggau

SEQ ID NO: 2546110 - RNA, 16 nt, Chlamydophila pneumoniae J138
uacguagcauaccuug

SEQ ID NO: 2546111 - RNA, 14 nt, Chlamydophila pneumoniae J138
uacgugaucaaaau

SEQ ID NO: 2546112 - RNA, 13 nt, Chlamydophila pneumoniae J138
uacguggcuucca

SEQ ID NO: 2546113 - RNA, 14 nt, Chlamydophila pneumoniae J138
uacguucuuucuuu

SEQ ID NO: 2546114 - RNA, 16 nt, Chlamydophila pneumoniae J138
uacguucuuucuuucu

SEQ ID NO: 2546115 - RNA, 12 nt, Chlamydophila pneumoniae J138
uacguuuucucu

SEQ ID NO: 2546116 - RNA, 14 nt, Chlamydophila pneumoniae J138
uacguuuuucccuu

SEQ ID NO: 2546117 - RNA, 17 nt, Chlamydophila pneumoniae J138
uacuaaaaucucauuuc

SEQ ID NO: 2546118 - RNA, 22 nt, Chlamydophila pneumoniae J138
uacuaaagaaagagucucacuc

SEQ ID NO: 2546119 - RNA, 16 nt, Chlamydophila pneumoniae J138
uacuaagaagcucacu

SEQ ID NO: 2546120 - RNA, 12 nt, Chlamydophila pneumoniae J138
uacuaucgguuu

SEQ ID NO: 2546121 - RNA, 13 nt, Chlamydophila pneumoniae J138
uacucauauuuug

SEQ ID NO: 2546122 - RNA, 16 nt, Chlamydophila pneumoniae J138
uacucauauuuugucu

SEQ ID NO: 2546123 - RNA, 15 nt, Chlamydophila pneumoniae J138
uacuccauuggcaua

SEQ ID NO: 2546124 - RNA, 16 nt, Chlamydophila pneumoniae J138
uacuccgagcauuuua

SEQ ID NO: 2546125 - RNA, 20 nt, Chlamydophila pneumoniae J138
uacucugaacaggaauagaa

SEQ ID NO: 2546126 - RNA, 16 nt, Chlamydophila pneumoniae J138
uacucuugcuugcuag

SEQ ID NO: 2546127 - RNA, 14 nt, Chlamydophila pneumoniae J138
uacucuuuaaaaau

SEQ ID NO: 2546128 - RNA, 16 nt, Chlamydophila pneumoniae J138
uacucuuuaaaaauag

SEQ ID NO: 2546129 - RNA, 17 nt, Chlamydophila pneumoniae J138
uacugaaaccuucucuc

SEQ ID NO: 2546130 - RNA, 19 nt, Chlamydophila pneumoniae J138
uacugaaucccguuaaaaa

SEQ ID NO: 2546131 - RNA, 18 nt, Chlamydophila pneumoniae J138
uacugaggaaaucgcauu

SEQ ID NO: 2546132 - RNA, 22 nt, Chlamydophila pneumoniae J138
uacugaggaaaucgcauuacaa

SEQ ID NO: 2546133 - RNA, 21 nt, Chlamydophila pneumoniae J138
uacuggagagguaaccagaga

SEQ ID NO: 2546134 - RNA, 16 nt, Chlamydophila pneumoniae J138
uacuguagaguuuucu

SEQ ID NO: 2546135 - RNA, 17 nt, Chlamydophila pneumoniae J138
uacuguccauccaaaua

SEQ ID NO: 2546136 - RNA, 14 nt, Chlamydophila pneumoniae J138
uacuuacaagaaca

SEQ ID NO: 2546137 - RNA, 23 nt, Chlamydophila pneumoniae J138
uacuuacuaaaggugaaaguaca

SEQ ID NO: 2546138 - RNA, 13 nt, Chlamydophila pneumoniae J138
uacuuauuguucu

SEQ ID NO: 2546139 - RNA, 21 nt, Chlamydophila pneumoniae J138
uacuucuccucgcaauccagg

SEQ ID NO: 2546140 - RNA, 12 nt, Chlamydophila pneumoniae J138
uacuucuccuga

SEQ ID NO: 2546141 - RNA, 20 nt, Chlamydophila pneumoniae J138
uacuucuguaguuuguucac

SEQ ID NO: 2546142 - RNA, 14 nt, Chlamydophila pneumoniae J138
uacuuuaagaccua

SEQ ID NO: 2546143 - RNA, 21 nt, Chlamydophila pneumoniae J138
uagauucguuauccucgucuu

SEQ ID NO: 2546144 - RNA, 17 nt, Chlamydophila pneumoniae J138
uagauuguuagugagau

SEQ ID NO: 2546145 - RNA, 14 nt, Chlamydophila pneumoniae J138
uagauuuaaaugca

SEQ ID NO: 2546146 - RNA, 17 nt, Chlamydophila pneumoniae J138
uagauuuguuagagcuu

SEQ ID NO: 2546147 - RNA, 14 nt, Chlamydophila pneumoniae J138
uagauuuuccgcaa

SEQ ID NO: 2546148 - RNA, 13 nt, Chlamydophila pneumoniae J138
uagauuuuuacuu

SEQ ID NO: 2546149 - RNA, 19 nt, Chlamydophila pneumoniae J138
uagauuuuuacuugcccaa

SEQ ID NO: 2546150 - RNA, 24 nt, Chlamydophila pneumoniae J138
uagauuuuucuuuuagagaaaucu

SEQ ID NO: 2546151 - RNA, 17 nt, Chlamydophila pneumoniae J138
uagcaaacggaacuaaa

SEQ ID NO: 2546152 - RNA, 14 nt, Chlamydophila pneumoniae J138
uagcaaagacaucu

SEQ ID NO: 2546153 - RNA, 16 nt, Chlamydophila pneumoniae J138
uagcaagcgcuagugc

SEQ ID NO: 2546154 - RNA, 17 nt, Chlamydophila pneumoniae J138
uagcaagcgcuagugca

SEQ ID NO: 2546155 - RNA, 20 nt, Chlamydophila pneumoniae J138
uagcaaugccuacaguagcu

SEQ ID NO: 2546156 - RNA, 13 nt, Chlamydophila pneumoniae J138
uagcagcaagaac

SEQ ID NO: 2546157 - RNA, 21 nt, Chlamydophila pneumoniae J138
uagcagcccgcacaucaugcu

SEQ ID NO: 2546158 - RNA, 16 nt, Chlamydophila pneumoniae J138
uagcaggaguuuucaa

SEQ ID NO: 2546159 - RNA, 22 nt, Chlamydophila pneumoniae J138
uagcagggggccugccaugaau

SEQ ID NO: 2546160 - RNA, 14 nt, Chlamydophila pneumoniae J138
uagcaguauagaga

SEQ ID NO: 2546161 - RNA, 14 nt, Chlamydophila pneumoniae J138
uagcauacaucgua

SEQ ID NO: 2546162 - RNA, 19 nt, Chlamydophila pneumoniae J138
uagcauacgacaguaauga

SEQ ID NO: 2546163 - RNA, 18 nt, Chlamydophila pneumoniae J138
uagcauagagcucuaaaa

SEQ ID NO: 2546164 - RNA, 20 nt, Chlamydophila pneumoniae J138
uagcauagccuuccauaucu

SEQ ID NO: 2546165 - RNA, 16 nt, Chlamydophila pneumoniae J138
uagcaucccaaguucu

SEQ ID NO: 2546166 - RNA, 17 nt, Chlamydophila pneumoniae J138
uagcaucccuucuucuu

SEQ ID NO: 2546167 - RNA, 20 nt, Chlamydophila pneumoniae J138
uagcaucccuucuucuuuua

SEQ ID NO: 2546168 - RNA, 23 nt, Chlamydophila pneumoniae J138
uagcaucccuucuucuuuuagac

SEQ ID NO: 2546169 - RNA, 16 nt, Chlamydophila pneumoniae J138
uagcauccuguagagc

SEQ ID NO: 2546170 - RNA, 14 nt, Chlamydophila pneumoniae J138
uagcauugcuugcg

SEQ ID NO: 2546171 - RNA, 16 nt, Chlamydophila pneumoniae J138
uagcauuucuuucucu

SEQ ID NO: 2546172 - RNA, 19 nt, Chlamydophila pneumoniae J138
uagcauuucuuucucuucg

SEQ ID NO: 2546173 - RNA, 12 nt, Chlamydophila pneumoniae J138
uagccaaaauuu

SEQ ID NO: 2546174 - RNA, 14 nt, Chlamydophila pneumoniae J138
uagccaaagacucu

SEQ ID NO: 2546175 - RNA, 18 nt, Chlamydophila pneumoniae J138
uagccaaagacucuugaa

SEQ ID NO: 2546176 - RNA, 19 nt, Chlamydophila pneumoniae J138
uagccaauauagaagcugc

SEQ ID NO: 2546177 - RNA, 12 nt, Chlamydophila pneumoniae J138
uagccauagugu

SEQ ID NO: 2546178 - RNA, 23 nt, Chlamydophila pneumoniae J138
uagccauggcaucuaagccagag

SEQ ID NO: 2546179 - RNA, 13 nt, Chlamydophila pneumoniae J138
uagccccauagag

SEQ ID NO: 2546180 - RNA, 16 nt, Chlamydophila pneumoniae J138
uagccccauagagccu

SEQ ID NO: 2546181 - RNA, 14 nt, Chlamydophila pneumoniae J138
uagccccuccaaca

SEQ ID NO: 2546182 - RNA, 19 nt, Chlamydophila pneumoniae J138
uagcccuacgaauccaaaa

SEQ ID NO: 2546183 - RNA, 23 nt, Chlamydophila pneumoniae J138
uagcccuagaguaaagaguagcc

SEQ ID NO: 2546184 - RNA, 11 nt, Chlamydophila pneumoniae J138
uagcccuugca

SEQ ID NO: 2546185 - RNA, 19 nt, Chlamydophila pneumoniae J138
uagccgacaugcuuuccuu

SEQ ID NO: 2546186 - RNA, 23 nt, Chlamydophila pneumoniae J138
uagccuuacggccccuggaauuu

SEQ ID NO: 2546187 - RNA, 19 nt, Chlamydophila pneumoniae J138
uagcgacgacgacgccuag

SEQ ID NO: 2546188 - RNA, 16 nt, Chlamydophila pneumoniae J138
uagcgcggucacuuca

SEQ ID NO: 2546189 - RNA, 17 nt, Chlamydophila pneumoniae J138
uagcgcuuccagcuucu

SEQ ID NO: 2546190 - RNA, 18 nt, Chlamydophila pneumoniae J138
uagcgcuuuuuuaaagug

SEQ ID NO: 2546191 - RNA, 22 nt, Chlamydophila pneumoniae J138
uagcgguacuugcgaaagaucc

SEQ ID NO: 2546192 - RNA, 14 nt, Chlamydophila pneumoniae J138
uagcgucucuucuu

SEQ ID NO: 2546193 - RNA, 13 nt, Chlamydophila pneumoniae J138
uagcuaagagcau

SEQ ID NO: 2546194 - RNA, 15 nt, Chlamydophila pneumoniae J138
uagcuacaagucccc

SEQ ID NO: 2546195 - RNA, 16 nt, Chlamydophila pneumoniae J138
uagcuacagauucuug

SEQ ID NO: 2546196 - RNA, 22 nt, Chlamydophila pneumoniae J138
uagcuacggagagguuauguac

SEQ ID NO: 2546197 - RNA, 15 nt, Chlamydophila pneumoniae J138
uagcuacuucuucuu

SEQ ID NO: 2546198 - RNA, 22 nt, Chlamydophila pneumoniae J138
uagcuagcguuuguaucacccg

SEQ ID NO: 2546199 - RNA, 15 nt, Chlamydophila pneumoniae J138
uagcuauucucaaau

SEQ ID NO: 2546200 - RNA, 22 nt, Chlamydophila pneumoniae J138
uagcucagcucuaauucuucua

SEQ ID NO: 2546201 - RNA, 16 nt, Chlamydophila pneumoniae J138
uagcucaggaaaacuu

SEQ ID NO: 2546202 - RNA, 18 nt, Chlamydophila pneumoniae J138
uagcucauuaucaagaaa

SEQ ID NO: 2546203 - RNA, 20 nt, Chlamydophila pneumoniae J138
uagcucauuaucaagaaauu

SEQ ID NO: 2546204 - RNA, 16 nt, Chlamydophila pneumoniae J138
uagcucccguuccuuu

SEQ ID NO: 2546205 - RNA, 19 nt, Chlamydophila pneumoniae J138
uagcucguuauauuuuucu

SEQ ID NO: 2546206 - RNA, 13 nt, Chlamydophila pneumoniae J138
uagcucuggagau

SEQ ID NO: 2546207 - RNA, 22 nt, Chlamydophila pneumoniae J138
uagcucuugcgaacuauccuaa

SEQ ID NO: 2546208 - RNA, 20 nt, Chlamydophila pneumoniae J138
uagcucuuugggauaaaaag

SEQ ID NO: 2546209 - RNA, 12 nt, Chlamydophila pneumoniae J138
uagcugcucuuu

SEQ ID NO: 2546210 - RNA, 18 nt, Chlamydophila pneumoniae J138
uagcugcucuuuuagaau

SEQ ID NO: 2546211 - RNA, 15 nt, Chlamydophila pneumoniae J138
uagcuuacuuucuuu

SEQ ID NO: 2546212 - RNA, 17 nt, Chlamydophila pneumoniae J138
uagcuuacuuucuuuua

SEQ ID NO: 2546213 - RNA, 18 nt, Chlamydophila pneumoniae J138
uagcuuuuaguuucccac

SEQ ID NO: 2546214 - RNA, 14 nt, Chlamydophila pneumoniae J138
uaggaacaaagcca

SEQ ID NO: 2546215 - RNA, 16 nt, Chlamydophila pneumoniae J138
uaggaacaugccaaau

SEQ ID NO: 2546216 - RNA, 20 nt, Chlamydophila pneumoniae J138
uaggaacaugccaaauaucu

SEQ ID NO: 2546217 - RNA, 18 nt, Chlamydophila pneumoniae J138
uaggaacuugaauaccaa

SEQ ID NO: 2546218 - RNA, 14 nt, Chlamydophila pneumoniae J138
uaggaagaugaaua

SEQ ID NO: 2546219 - RNA, 15 nt, Chlamydophila pneumoniae J138
uaggaagcucuucua

SEQ ID NO: 2546220 - RNA, 17 nt, Chlamydophila pneumoniae J138
uaggaaggucagaguau

SEQ ID NO: 2546221 - RNA, 16 nt, Chlamydophila pneumoniae J138
uaggaaucuuuuagag

SEQ ID NO: 2546222 - RNA, 18 nt, Chlamydophila pneumoniae J138
uaggaaugauaaugcagg

SEQ ID NO: 2546223 - RNA, 17 nt, Chlamydophila pneumoniae J138
uaggaauugcuguucca

SEQ ID NO: 2546224 - RNA, 18 nt, Chlamydophila pneumoniae J138
uaggacagcacauagagu

SEQ ID NO: 2546225 - RNA, 22 nt, Chlamydophila pneumoniae J138
uaggaccuacugggaaaucuaa

SEQ ID NO: 2546226 - RNA, 21 nt, Chlamydophila pneumoniae J138
uaggagaaaucacacuuaaag

SEQ ID NO: 2546227 - RNA, 21 nt, Chlamydophila pneumoniae J138
uaggagagcuugguuuucucc

SEQ ID NO: 2546228 - RNA, 14 nt, Chlamydophila pneumoniae J138
uaggauaagaaauu

SEQ ID NO: 2546229 - RNA, 17 nt, Chlamydophila pneumoniae J138
uaggauaagaaauuaaa

SEQ ID NO: 2546230 - RNA, 20 nt, Chlamydophila pneumoniae J138
uaggaucccugauuccuugg

SEQ ID NO: 2546231 - RNA, 13 nt, Chlamydophila pneumoniae J138
uaggaucucucuu

SEQ ID NO: 2546232 - RNA, 12 nt, Chlamydophila pneumoniae J138
uaggauucggac

SEQ ID NO: 2546233 - RNA, 14 nt, Chlamydophila pneumoniae J138
uaggauuuagacua

SEQ ID NO: 2546234 - RNA, 18 nt, Chlamydophila pneumoniae J138
uaggauuugcauagaggg

SEQ ID NO: 2546235 - RNA, 19 nt, Chlamydophila pneumoniae J138
uaggcacaucauuaucaua

SEQ ID NO: 2546236 - RNA, 17 nt, Chlamydophila pneumoniae J138
uaggcacuuaucucuuu

SEQ ID NO: 2546237 - RNA, 22 nt, Chlamydophila pneumoniae J138
uaggcaguggcucuauagggga

SEQ ID NO: 2546238 - RNA, 16 nt, Chlamydophila pneumoniae J138
uaggcauacaguagaa

SEQ ID NO: 2546239 - RNA, 13 nt, Chlamydophila pneumoniae J138
uaggcauuaauaa

SEQ ID NO: 2546240 - RNA, 12 nt, Chlamydophila pneumoniae J138
uaggcccaagaa

SEQ ID NO: 2546241 - RNA, 17 nt, Chlamydophila pneumoniae J138
uaggccgggauuuuaau

SEQ ID NO: 2546242 - RNA, 23 nt, Chlamydophila pneumoniae J138
uaggcuuuuuucuauuuucagga

SEQ ID NO: 2546243 - RNA, 13 nt, Chlamydophila pneumoniae J138
uauaguauuuuua

SEQ ID NO: 2546244 - RNA, 18 nt, Chlamydophila pneumoniae J138
uauaguauuuuuaaauac

SEQ ID NO: 2546245 - RNA, 18 nt, Chlamydophila pneumoniae J138
uauauaaagguuacaagc

SEQ ID NO: 2546246 - RNA, 21 nt, Chlamydophila pneumoniae J138
uauaucagcaaaaaacugcaa

SEQ ID NO: 2546247 - RNA, 17 nt, Chlamydophila pneumoniae J138
uauaucauuaagaagau

SEQ ID NO: 2546248 - RNA, 22 nt, Chlamydophila pneumoniae J138
uauaucgccguuaaagacuucu

SEQ ID NO: 2546249 - RNA, 19 nt, Chlamydophila pneumoniae J138
uauaucgcguguaaaagcu

SEQ ID NO: 2546250 - RNA, 20 nt, Chlamydophila pneumoniae J138
uauaugcuacaaacucuucc

SEQ ID NO: 2546251 - RNA, 21 nt, Chlamydophila pneumoniae J138
uauaugcuacaaacucuucca

SEQ ID NO: 2546252 - RNA, 12 nt, Chlamydophila pneumoniae J138
uauauugacaac

SEQ ID NO: 2546253 - RNA, 18 nt, Chlamydophila pneumoniae J138
gaaggggaagaggaaugc

SEQ ID NO: 2546254 - RNA, 23 nt, Chlamydophila pneumoniae J138
gaaggggagauuccccagggaga

SEQ ID NO: 2546255 - RNA, 18 nt, Chlamydophila pneumoniae J138
gaaguaagcgauggcagu

SEQ ID NO: 2546256 - RNA, 20 nt, Chlamydophila pneumoniae J138
gaaguacaagugaagacaag

SEQ ID NO: 2546257 - RNA, 23 nt, Chlamydophila pneumoniae J138
gaaguaguggacuauagaugcca

SEQ ID NO: 2546258 - RNA, 18 nt, Chlamydophila pneumoniae J138
gaagucacaaauuuuugc

SEQ ID NO: 2546259 - RNA, 15 nt, Chlamydophila pneumoniae J138
gaagucagugcuucu

SEQ ID NO: 2546260 - RNA, 17 nt, Chlamydophila pneumoniae J138
gaaguccagacuuuccu

SEQ ID NO: 2546261 - RNA, 17 nt, Chlamydophila pneumoniae J138
gaagucccacaaaugau

SEQ ID NO: 2546262 - RNA, 17 nt, Chlamydophila pneumoniae J138
gaaguccuaucaaagca

SEQ ID NO: 2546263 - RNA, 22 nt, Chlamydophila pneumoniae J138
gaaguccuggauuuuaaagcaa

SEQ ID NO: 2546264 - RNA, 15 nt, Chlamydophila pneumoniae J138
gaagucgaaagauca

SEQ ID NO: 2546265 - RNA, 19 nt, Chlamydophila pneumoniae J138
gaagucgcaguaaugccaa

SEQ ID NO: 2546266 - RNA, 21 nt, Chlamydophila pneumoniae J138
gaagucguuuagauuuuucuu

SEQ ID NO: 2546267 - RNA, 16 nt, Chlamydophila pneumoniae J138
gaagucuucuugcuga

SEQ ID NO: 2546268 - RNA, 18 nt, Chlamydophila pneumoniae J138
gaagugaggagaauagca

SEQ ID NO: 2546269 - RNA, 23 nt, Chlamydophila pneumoniae J138
gaagugaucuugagaaaagaaca

SEQ ID NO: 2546270 - RNA, 13 nt, Chlamydophila pneumoniae J138
gaaguguuucuuu

SEQ ID NO: 2546271 - RNA, 14 nt, Chlamydophila pneumoniae J138
gaaguuccuucagg

SEQ ID NO: 2546272 - RNA, 23 nt, Chlamydophila pneumoniae J138
gaaguugaaaugagugagaaugc

SEQ ID NO: 2546273 - RNA, 12 nt, Chlamydophila pneumoniae J138
gaaguuuugcuc

SEQ ID NO: 2546274 - RNA, 15 nt, Chlamydophila pneumoniae J138
gaaguuuugcucucu

SEQ ID NO: 2546275 - RNA, 22 nt, Chlamydophila pneumoniae J138
gaaguuuuuuaagugcuuuuag

SEQ ID NO: 2546276 - RNA, 13 nt, Chlamydophila pneumoniae J138
gaaguuuuuucuc

SEQ ID NO: 2546277 - RNA, 15 nt, Chlamydophila pneumoniae J138
gaaguuuuuucucuc

SEQ ID NO: 2546278 - RNA, 19 nt, Chlamydophila pneumoniae J138
gaauaaagcccuuuugaau

SEQ ID NO: 2546279 - RNA, 16 nt, Chlamydophila pneumoniae J138
gaauaaaggacauaga

SEQ ID NO: 2546280 - RNA, 19 nt, Chlamydophila pneumoniae J138
gaauaaaggacauagacuu

SEQ ID NO: 2546281 - RNA, 14 nt, Chlamydophila pneumoniae J138
gaauaagauuuuga

SEQ ID NO: 2546282 - RNA, 20 nt, Chlamydophila pneumoniae J138
gaauaagauuuugaaaauug

SEQ ID NO: 2546283 - RNA, 21 nt, Chlamydophila pneumoniae J138
gaauaaguuuugauuuugcag

SEQ ID NO: 2546284 - RNA, 17 nt, Chlamydophila pneumoniae J138
gaauaccguuuuaggaa

SEQ ID NO: 2546285 - RNA, 14 nt, Chlamydophila pneumoniae J138
gaauacucuagguu

SEQ ID NO: 2546286 - RNA, 21 nt, Chlamydophila pneumoniae J138
gaauacucuagguuuucucuu

SEQ ID NO: 2546287 - RNA, 18 nt, Chlamydophila pneumoniae J138
gaauagcaagcacuuucg

SEQ ID NO: 2546288 - RNA, 15 nt, Chlamydophila pneumoniae J138
gaauagcucuuuuca

SEQ ID NO: 2546289 - RNA, 19 nt, Chlamydophila pneumoniae J138
gaauagcuucugacucugu

SEQ ID NO: 2546290 - RNA, 12 nt, Chlamydophila pneumoniae J138
gaauaguuguga

SEQ ID NO: 2546291 - RNA, 21 nt, Chlamydophila pneumoniae J138
gaauaguugugagacuuucug

SEQ ID NO: 2546292 - RNA, 12 nt, Chlamydophila pneumoniae J138
gaauauagacuu

SEQ ID NO: 2546293 - RNA, 18 nt, Chlamydophila pneumoniae J138
gaauaucaucacuaagau

SEQ ID NO: 2546294 - RNA, 17 nt, Chlamydophila pneumoniae J138
gaauaucuuuugaaucu

SEQ ID NO: 2546295 - RNA, 16 nt, Chlamydophila pneumoniae J138
gaaucacguucccacg

SEQ ID NO: 2546296 - RNA, 19 nt, Chlamydophila pneumoniae J138
gaaucacuguaucagcaag

SEQ ID NO: 2546297 - RNA, 15 nt, Chlamydophila pneumoniae J138
gaaucagauuagagu

SEQ ID NO: 2546298 - RNA, 17 nt, Chlamydophila pneumoniae J138
gaaucagcuuaucuaua

SEQ ID NO: 2546299 - RNA, 16 nt, Chlamydophila pneumoniae J138
gaauccucuauccauc

SEQ ID NO: 2546300 - RNA, 18 nt, Chlamydophila pneumoniae J138
gaauccucuauccaucau

SEQ ID NO: 2546301 - RNA, 15 nt, Chlamydophila pneumoniae J138
gaauccuguucuaca

SEQ ID NO: 2546302 - RNA, 11 nt, Chlamydophila pneumoniae J138
gaauccuucuc

SEQ ID NO: 2546303 - RNA, 14 nt, Chlamydophila pneumoniae J138
gaauccuucucccu

SEQ ID NO: 2546304 - RNA, 16 nt, Chlamydophila pneumoniae J138
gaauccuugaaagacu

SEQ ID NO: 2546305 - RNA, 16 nt, Chlamydophila pneumoniae J138
gaaucgaagaacagag

SEQ ID NO: 2546306 - RNA, 23 nt, Chlamydophila pneumoniae J138
gaaucgccgcuugaggaggauug

SEQ ID NO: 2546307 - RNA, 14 nt, Chlamydophila pneumoniae J138
gaaucggaucuuca

SEQ ID NO: 2546308 - RNA, 14 nt, Chlamydophila pneumoniae J138
gaaucguucccauc

SEQ ID NO: 2546309 - RNA, 12 nt, Chlamydophila pneumoniae J138
gaaucuaagaug

SEQ ID NO: 2546310 - RNA, 21 nt, Chlamydophila pneumoniae J138
gaaucucauaaguauagagag

SEQ ID NO: 2546311 - RNA, 17 nt, Chlamydophila pneumoniae J138
gaaucucgggagaacau

SEQ ID NO: 2546312 - RNA, 22 nt, Chlamydophila pneumoniae J138
gaaucugacgugcauugaaucc

SEQ ID NO: 2546313 - RNA, 20 nt, Chlamydophila pneumoniae J138
gaaucugguuccuuaaagag

SEQ ID NO: 2546314 - RNA, 19 nt, Chlamydophila pneumoniae J138
gaaucuuaugggagaagcu

SEQ ID NO: 2546315 - RNA, 14 nt, Chlamydophila pneumoniae J138
gaaucuuuauuucu

SEQ ID NO: 2546316 - RNA, 15 nt, Chlamydophila pneumoniae J138
gaaugaagagaguuc

SEQ ID NO: 2546317 - RNA, 19 nt, Chlamydophila pneumoniae J138
gaaugaaucgaagaacaga

SEQ ID NO: 2546318 - RNA, 14 nt, Chlamydophila pneumoniae J138
gaaugagaacgucu

SEQ ID NO: 2546319 - RNA, 21 nt, Chlamydophila pneumoniae J138
gaaugagcuucacaucuuucu

SEQ ID NO: 2546320 - RNA, 23 nt, Chlamydophila pneumoniae J138
gaaugaucccuaacgaugcaggc

SEQ ID NO: 2546321 - RNA, 19 nt, Chlamydophila pneumoniae J138
gaaugccaaaccucuuagc

SEQ ID NO: 2546322 - RNA, 21 nt, Chlamydophila pneumoniae J138
gaaugccauucuuaucugcug

SEQ ID NO: 2546323 - RNA, 17 nt, Chlamydophila pneumoniae J138
gaaugcccuuuagggaa

SEQ ID NO: 2546324 - RNA, 15 nt, Chlamydophila pneumoniae J138
gaaugcggcuaauuu

SEQ ID NO: 2546325 - RNA, 19 nt, Chlamydophila pneumoniae J138
gaauggucucgaaauccua

SEQ ID NO: 2546326 - RNA, 19 nt, Chlamydophila pneumoniae J138
gaauguacauagaggagau

SEQ ID NO: 2546327 - RNA, 19 nt, Chlamydophila pneumoniae J138
gaauguaugugaaagauua

SEQ ID NO: 2546328 - RNA, 13 nt, Chlamydophila pneumoniae J138
gaauguucccaaa

SEQ ID NO: 2546329 - RNA, 23 nt, Chlamydophila pneumoniae J138
gaauguugggggagcucgcuaaa

SEQ ID NO: 2546330 - RNA, 17 nt, Chlamydophila pneumoniae J138
gaauuagagaaauuuuu

SEQ ID NO: 2546331 - RNA, 14 nt, Chlamydophila pneumoniae J138
gaauucaaacuccu

SEQ ID NO: 2546332 - RNA, 21 nt, Chlamydophila pneumoniae J138
gaauucaaacuccuuuuaaaa

SEQ ID NO: 2546333 - RNA, 20 nt, Chlamydophila pneumoniae J138
gaauucauccagauuagaaa

SEQ ID NO: 2546334 - RNA, 17 nt, Chlamydophila pneumoniae J138
gaauucuuuaaaaucuu

SEQ ID NO: 2546335 - RNA, 15 nt, Chlamydophila pneumoniae J138
gaauucuuugccaag

SEQ ID NO: 2546336 - RNA, 15 nt, Chlamydophila pneumoniae J138
gaauucuuuuccugc

SEQ ID NO: 2546337 - RNA, 14 nt, Chlamydophila pneumoniae J138
gaauugcauuaaga

SEQ ID NO: 2546338 - RNA, 15 nt, Chlamydophila pneumoniae J138
gaauuggaagcuuuu

SEQ ID NO: 2546339 - RNA, 18 nt, Chlamydophila pneumoniae J138
gaauuguaguucuuugaa

SEQ ID NO: 2546340 - RNA, 17 nt, Chlamydophila pneumoniae J138
gaauuguguguuuucau

SEQ ID NO: 2546341 - RNA, 21 nt, Chlamydophila pneumoniae J138
gaauuucuccaguaucuucuc

SEQ ID NO: 2546342 - RNA, 20 nt, Chlamydophila pneumoniae J138
gaauuugauuuuucaaauuc

SEQ ID NO: 2546343 - RNA, 17 nt, Chlamydophila pneumoniae J138
gaauuugccugaaaucc

SEQ ID NO: 2546344 - RNA, 18 nt, Chlamydophila pneumoniae J138
gaauuugccugaaauccu

SEQ ID NO: 2546345 - RNA, 19 nt, Chlamydophila pneumoniae J138
gaauuuucagccugucuau

SEQ ID NO: 2546346 - RNA, 22 nt, Chlamydophila pneumoniae J138
gaauuuucucauagcuuccugu

SEQ ID NO: 2546347 - RNA, 16 nt, Chlamydophila pneumoniae J138
gaauuuucuuuugcag

SEQ ID NO: 2546348 - RNA, 13 nt, Chlamydophila pneumoniae J138
gaauuuuucuagu

SEQ ID NO: 2546349 - RNA, 20 nt, Chlamydophila pneumoniae J138
gaauuuuucuaguucguuca

SEQ ID NO: 2546350 - RNA, 13 nt, Chlamydophila pneumoniae J138
gaauuuuuguuuu

SEQ ID NO: 2546351 - RNA, 22 nt, Chlamydophila pneumoniae J138
gaauuuuuguuuuaacucuaga

SEQ ID NO: 2546352 - RNA, 22 nt, Chlamydophila pneumoniae J138
gacaaaaaagggaucuccuuca

SEQ ID NO: 2546353 - RNA, 11 nt, Chlamydophila pneumoniae J138
gacaaaaaugc

SEQ ID NO: 2546354 - RNA, 13 nt, Chlamydophila pneumoniae J138
gacaaaaaugccu

SEQ ID NO: 2546355 - RNA, 17 nt, Chlamydophila pneumoniae J138
gacaaauaaguccuguu

SEQ ID NO: 2546356 - RNA, 20 nt, Chlamydophila pneumoniae J138
gacaaaucacgacgucauca

SEQ ID NO: 2546357 - RNA, 15 nt, Chlamydophila pneumoniae J138
gacaaaucucccaaa

SEQ ID NO: 2546358 - RNA, 17 nt, Chlamydophila pneumoniae J138
gacaacaagucuucccu

SEQ ID NO: 2546359 - RNA, 16 nt, Chlamydophila pneumoniae J138
gacaacaccucccacc

SEQ ID NO: 2546360 - RNA, 20 nt, Chlamydophila pneumoniae J138
gacaacagagacaagaccgu

SEQ ID NO: 2546361 - RNA, 15 nt, Chlamydophila pneumoniae J138
gacaagacaaugacu

SEQ ID NO: 2546362 - RNA, 20 nt, Chlamydophila pneumoniae J138
gacaagauggugagauuucu

SEQ ID NO: 2546363 - RNA, 19 nt, Chlamydophila pneumoniae J138
gacaaggagucgugcagga

SEQ ID NO: 2546364 - RNA, 21 nt, Chlamydophila pneumoniae J138
gacaaggagucgugcaggaga

SEQ ID NO: 2546365 - RNA, 16 nt, Chlamydophila pneumoniae J138
gacaauaaaaaagaga

SEQ ID NO: 2546366 - RNA, 16 nt, Chlamydophila pneumoniae J138
gacaauaaaauagccc

SEQ ID NO: 2546367 - RNA, 18 nt, Chlamydophila pneumoniae J138
gacaauaagaaaauccua

SEQ ID NO: 2546368 - RNA, 22 nt, Chlamydophila pneumoniae J138
gacaauauagaaaucgacaggg

SEQ ID NO: 2546369 - RNA, 14 nt, Chlamydophila pneumoniae J138
gacaauauagagau

SEQ ID NO: 2546370 - RNA, 16 nt, Chlamydophila pneumoniae J138
gacaaugacuguagga

SEQ ID NO: 2546371 - RNA, 17 nt, Chlamydophila pneumoniae J138
gacaauggaaauagaga

SEQ ID NO: 2546372 - RNA, 23 nt, Chlamydophila pneumoniae J138
gacacaaaaagcuuuuuucucuu

SEQ ID NO: 2546373 - RNA, 12 nt, Chlamydophila pneumoniae J138
gacacagagaac

SEQ ID NO: 2546374 - RNA, 15 nt, Chlamydophila pneumoniae J138
gacacagagcuucua

SEQ ID NO: 2546375 - RNA, 19 nt, Chlamydophila pneumoniae J138
gacacagcuaaucaaucca

SEQ ID NO: 2546376 - RNA, 22 nt, Chlamydophila pneumoniae J138
gacacaggagguucauucucau

SEQ ID NO: 2546377 - RNA, 19 nt, Chlamydophila pneumoniae J138
gacacgaauuccaagaucu

SEQ ID NO: 2546378 - RNA, 20 nt, Chlamydophila pneumoniae J138
gacacgaccacuacuuaaag

SEQ ID NO: 2546379 - RNA, 14 nt, Chlamydophila pneumoniae J138
gacacgcuuuccua

SEQ ID NO: 2546380 - RNA, 19 nt, Chlamydophila pneumoniae J138
gacacuauguguuuccuuu

SEQ ID NO: 2546381 - RNA, 23 nt, Chlamydophila pneumoniae J138
gacacuauguguuuccuuuucuc

SEQ ID NO: 2546382 - RNA, 15 nt, Chlamydophila pneumoniae J138
gacacuccucagaau

SEQ ID NO: 2546383 - RNA, 16 nt, Chlamydophila pneumoniae J138
gacagggaaagaacag

SEQ ID NO: 2546384 - RNA, 14 nt, Chlamydophila pneumoniae J138
gacagucucaugga

SEQ ID NO: 2546385 - RNA, 18 nt, Chlamydophila pneumoniae J138
gacauacaucaaaaugcu

SEQ ID NO: 2546386 - RNA, 18 nt, Chlamydophila pneumoniae J138
gacauacucgucaaauuc

SEQ ID NO: 2546387 - RNA, 19 nt, Chlamydophila pneumoniae J138
gacauacucgucaaauuca

SEQ ID NO: 2546388 - RNA, 20 nt, Chlamydophila pneumoniae J138
gacauauccaaugagagaga

SEQ ID NO: 2546389 - RNA, 17 nt, Chlamydophila pneumoniae J138
gacaucuccaagauaau

SEQ ID NO: 2546390 - RNA, 14 nt, Chlamydophila pneumoniae J138
gacauuccuuaauu

SEQ ID NO: 2546391 - RNA, 19 nt, Chlamydophila pneumoniae J138
gacauuuccccaugaaaau

SEQ ID NO: 2546392 - RNA, 21 nt, Chlamydophila pneumoniae J138
gacauuuucaagcuuucguuu

SEQ ID NO: 2546393 - RNA, 19 nt, Chlamydophila pneumoniae J138
gaccaaaaauaaacauauu

SEQ ID NO: 2546394 - RNA, 23 nt, Chlamydophila pneumoniae J138
gaccaaaaauaaacauauucucc

SEQ ID NO: 2546395 - RNA, 13 nt, Chlamydophila pneumoniae J138
gaccaaauagaga

SEQ ID NO: 2546396 - RNA, 18 nt, Chlamydophila pneumoniae J138
gaccaacuccucaaaaga

SEQ ID NO: 2546397 - RNA, 23 nt, Chlamydophila pneumoniae J138
gaccagaugauuuuuugaauccu

SEQ ID NO: 2546398 - RNA, 22 nt, Chlamydophila pneumoniae J138
gaccagguguagguuccugcuu

SEQ ID NO: 2546399 - RNA, 14 nt, Chlamydophila pneumoniae J138
gaccauaaaaucaa

SEQ ID NO: 2546400 - RNA, 16 nt, Chlamydophila pneumoniae J138
gaccaucgagcuacgu

SEQ ID NO: 2546401 - RNA, 22 nt, Chlamydophila pneumoniae J138
gacccuagguagcucgagauuu

SEQ ID NO: 2546402 - RNA, 13 nt, Chlamydophila pneumoniae J138
gaccgaaucucuc

SEQ ID NO: 2546403 - RNA, 21 nt, Chlamydophila pneumoniae J138
gaccgcaaggagucacuggca

SEQ ID NO: 2546404 - RNA, 19 nt, Chlamydophila pneumoniae J138
gaccuaagggcucuccuaa

SEQ ID NO: 2546405 - RNA, 12 nt, Chlamydophila pneumoniae J138
gaccuacaccau

SEQ ID NO: 2546406 - RNA, 17 nt, Chlamydophila pneumoniae J138
gaccuacuuauuguucu

SEQ ID NO: 2546407 - RNA, 21 nt, Chlamydophila pneumoniae J138
gaccucuguagguuuuuccaa

SEQ ID NO: 2546408 - RNA, 23 nt, Chlamydophila pneumoniae J138
gaccuguaguaaaauaagaaauc

SEQ ID NO: 2546409 - RNA, 16 nt, Chlamydophila pneumoniae J138
gaccugugaguaaaau

SEQ ID NO: 2546410 - RNA, 21 nt, Chlamydophila pneumoniae J138
gaccuguuuucuuuucugaag

SEQ ID NO: 2546411 - RNA, 20 nt, Chlamydophila pneumoniae J138
gaccuuccuuaucuucagaa

SEQ ID NO: 2546412 - RNA, 19 nt, Chlamydophila pneumoniae J138
gaccuucucaagaucuuca

SEQ ID NO: 2546413 - RNA, 20 nt, Chlamydophila pneumoniae J138
gaccuucucaagaucuucau

SEQ ID NO: 2546414 - RNA, 12 nt, Chlamydophila pneumoniae J138
gaccuucucuuc

SEQ ID NO: 2546415 - RNA, 17 nt, Chlamydophila pneumoniae J138
gaccuuggacucuaggg

SEQ ID NO: 2546416 - RNA, 22 nt, Chlamydophila pneumoniae J138
gacgaacaugccugaaaacaag

SEQ ID NO: 2546417 - RNA, 16 nt, Chlamydophila pneumoniae J138
gacgaacgaagaaaac

SEQ ID NO: 2546418 - RNA, 12 nt, Chlamydophila pneumoniae J138
gacgacaaauca

SEQ ID NO: 2546419 - RNA, 15 nt, Chlamydophila pneumoniae J138
gacgacaaggagucg

SEQ ID NO: 2546420 - RNA, 22 nt, Chlamydophila pneumoniae J138
gacgaccuacacguuacgaaug

SEQ ID NO: 2546421 - RNA, 23 nt, Chlamydophila pneumoniae J138
gacgagaacaugaccuuuaggaa

SEQ ID NO: 2546422 - RNA, 21 nt, Chlamydophila pneumoniae J138
gacgagcaugcuaagcaucag

SEQ ID NO: 2546423 - RNA, 22 nt, Chlamydophila pneumoniae J138
gacgagcccuagauagcaaauc

SEQ ID NO: 2546424 - RNA, 17 nt, Chlamydophila pneumoniae J138
gacgcacuucuucaaga

SEQ ID NO: 2546425 - RNA, 21 nt, Chlamydophila pneumoniae J138
gacgcacuucuucaagaaaug

SEQ ID NO: 2546426 - RNA, 22 nt, Chlamydophila pneumoniae J138
gacgcacuucuucaagaaaugc

SEQ ID NO: 2546427 - RNA, 16 nt, Chlamydophila pneumoniae J138
gacgcggaacucucuu

SEQ ID NO: 2546428 - RNA, 22 nt, Chlamydophila pneumoniae J138
gacgcggaacucucuuccccca

SEQ ID NO: 2546429 - RNA, 20 nt, Chlamydophila pneumoniae J138
gacgcucuaaacucucuucc

SEQ ID NO: 2546430 - RNA, 17 nt, Chlamydophila pneumoniae J138
gacggauaaauggagga

SEQ ID NO: 2546431 - RNA, 20 nt, Chlamydophila pneumoniae J138
gacguaauuacgcucuccau

SEQ ID NO: 2546432 - RNA, 21 nt, Chlamydophila pneumoniae J138
gacgucuucuuagaagagaaa

SEQ ID NO: 2546433 - RNA, 17 nt, Chlamydophila pneumoniae J138
gacgugggagacauucc

SEQ ID NO: 2546434 - RNA, 18 nt, Chlamydophila pneumoniae J138
gacgugggagacauucca

SEQ ID NO: 2546435 - RNA, 20 nt, Chlamydophila pneumoniae J138
gacgugguaagguuaucuuu

SEQ ID NO: 2546436 - RNA, 22 nt, Chlamydophila pneumoniae J138
gacguuaauaaagaggcuccca

SEQ ID NO: 2546437 - RNA, 23 nt, Chlamydophila pneumoniae J138
gacguucgacaacaacauaaaga

SEQ ID NO: 2546438 - RNA, 20 nt, Chlamydophila pneumoniae J138
gacguugcgaacagcuccug

SEQ ID NO: 2546439 - RNA, 21 nt, Chlamydophila pneumoniae J138
gacguuguugcaauucuucau

SEQ ID NO: 2546440 - RNA, 16 nt, Chlamydophila pneumoniae J138
gacguuugaucuucuc

SEQ ID NO: 2546441 - RNA, 16 nt, Chlamydophila pneumoniae J138
gacuaaaagaauaaua

SEQ ID NO: 2546442 - RNA, 23 nt, Chlamydophila pneumoniae J138
gacuaaacaagaaaaagcaucua

SEQ ID NO: 2546443 - RNA, 17 nt, Chlamydophila pneumoniae J138
gacuaaaugcgaggccc

SEQ ID NO: 2546444 - RNA, 20 nt, Chlamydophila pneumoniae J138
gacuacaucuuguucugcac

SEQ ID NO: 2546445 - RNA, 15 nt, Chlamydophila pneumoniae J138
gacuagcuuuucaug

SEQ ID NO: 2546446 - RNA, 13 nt, Chlamydophila pneumoniae J138
gacuauaaaaugc

SEQ ID NO: 2546447 - RNA, 15 nt, Chlamydophila pneumoniae J138
gacuauagaugccau

SEQ ID NO: 2546448 - RNA, 21 nt, Chlamydophila pneumoniae J138
gacuauagaugccauaagucc

SEQ ID NO: 2546449 - RNA, 12 nt, Chlamydophila pneumoniae J138
gacuauuuucau

SEQ ID NO: 2546450 - RNA, 18 nt, Chlamydophila pneumoniae J138
gacucagagaaaaucaac

SEQ ID NO: 2546451 - RNA, 19 nt, Chlamydophila pneumoniae J138
gacuccaagaauagcagga

SEQ ID NO: 2546452 - RNA, 22 nt, Chlamydophila pneumoniae J138
gacucuaguuuuucuuuagaga

SEQ ID NO: 2546453 - RNA, 14 nt, Chlamydophila pneumoniae J138
gacucucaucagca

SEQ ID NO: 2546454 - RNA, 21 nt, Chlamydophila pneumoniae J138
gacucugccaugucuaaagga

SEQ ID NO: 2546455 - RNA, 18 nt, Chlamydophila pneumoniae J138
gacucuuccaauuguaaa

SEQ ID NO: 2546456 - RNA, 17 nt, Chlamydophila pneumoniae J138
gacugaagagcaauuaa

SEQ ID NO: 2546457 - RNA, 15 nt, Chlamydophila pneumoniae J138
gacugcucuuucauu

SEQ ID NO: 2546458 - RNA, 18 nt, Chlamydophila pneumoniae J138
gacugcugacaucuccaa

SEQ ID NO: 2546459 - RNA, 15 nt, Chlamydophila pneumoniae J138
gacuguacaaaugca

SEQ ID NO: 2546460 - RNA, 16 nt, Chlamydophila pneumoniae J138
gacugucuaugaucca

SEQ ID NO: 2546461 - RNA, 16 nt, Chlamydophila pneumoniae J138
gacuuccuccaaaauu

SEQ ID NO: 2546462 - RNA, 19 nt, Chlamydophila pneumoniae J138
gacuucgaugucuuuccag

SEQ ID NO: 2546463 - RNA, 15 nt, Chlamydophila pneumoniae J138
gacuucgcaaauuuu

SEQ ID NO: 2546464 - RNA, 13 nt, Chlamydophila pneumoniae J138
gacuucucaaaga

SEQ ID NO: 2546465 - RNA, 22 nt, Chlamydophila pneumoniae J138
gacuucuggaagcuguuguucu

SEQ ID NO: 2546466 - RNA, 16 nt, Chlamydophila pneumoniae J138
gacuugcaagcuucuu

SEQ ID NO: 2546467 - RNA, 20 nt, Chlamydophila pneumoniae J138
gacuugcaagcuucuuguuu

SEQ ID NO: 2546468 - RNA, 17 nt, Chlamydophila pneumoniae J138
gacuuucauaugaauga

SEQ ID NO: 2546469 - RNA, 15 nt, Chlamydophila pneumoniae J138
gacuuuccucucuuu

SEQ ID NO: 2546470 - RNA, 15 nt, Chlamydophila pneumoniae J138
gacuuuuuuaagagu

SEQ ID NO: 2546471 - RNA, 16 nt, Chlamydophila pneumoniae J138
gagaaaaucugcagca

SEQ ID NO: 2546472 - RNA, 23 nt, Chlamydophila pneumoniae J138
gagaaacuuaguuuugaaaagau

SEQ ID NO: 2546473 - RNA, 16 nt, Chlamydophila pneumoniae J138
gagaaagagugccaag

SEQ ID NO: 2546474 - RNA, 20 nt, Chlamydophila pneumoniae J138
gagaaaguagagacaucgua

SEQ ID NO: 2546475 - RNA, 20 nt, Chlamydophila pneumoniae J138
gagaaauacgcuuuucuucu

SEQ ID NO: 2546476 - RNA, 21 nt, Chlamydophila pneumoniae J138
gagaaauuuuuaauuuuucua

SEQ ID NO: 2546477 - RNA, 18 nt, Chlamydophila pneumoniae J138
gagaaccuccaccaggag

SEQ ID NO: 2546478 - RNA, 17 nt, Chlamydophila pneumoniae J138
gagaacuucaacaaagg

SEQ ID NO: 2546479 - RNA, 15 nt, Chlamydophila pneumoniae J138
gagaacuuccugauu

SEQ ID NO: 2546480 - RNA, 19 nt, Chlamydophila pneumoniae J138
gagaagcucaucagcaacc

SEQ ID NO: 2546481 - RNA, 21 nt, Chlamydophila pneumoniae J138
gagaauacucuagguuuucuc

SEQ ID NO: 2546482 - RNA, 23 nt, Chlamydophila pneumoniae J138
gagaauauggccuagcuuucuug

SEQ ID NO: 2546483 - RNA, 16 nt, Chlamydophila pneumoniae J138
gagaaucuccucauca

SEQ ID NO: 2546484 - RNA, 15 nt, Chlamydophila pneumoniae J138
gagaaugacuuuaga

SEQ ID NO: 2546485 - RNA, 16 nt, Chlamydophila pneumoniae J138
gagaaugacuuuagaa

SEQ ID NO: 2546486 - RNA, 16 nt, Chlamydophila pneumoniae J138
gagaaugcccuguucu

SEQ ID NO: 2546487 - RNA, 22 nt, Chlamydophila pneumoniae J138
gagaauguucccaaauagaaaa

SEQ ID NO: 2546488 - RNA, 22 nt, Chlamydophila pneumoniae J138
gagaauugaaaauugcccauug

SEQ ID NO: 2546489 - RNA, 14 nt, Chlamydophila pneumoniae J138
gagaauuucuccag

SEQ ID NO: 2546490 - RNA, 16 nt, Chlamydophila pneumoniae J138
gagacaaagccacagc

SEQ ID NO: 2546491 - RNA, 14 nt, Chlamydophila pneumoniae J138
gagacaagaaaaua

SEQ ID NO: 2546492 - RNA, 19 nt, Chlamydophila pneumoniae J138
gagacaaguucaucaaaua

SEQ ID NO: 2546493 - RNA, 15 nt, Chlamydophila pneumoniae J138
gagacauuucuugau

SEQ ID NO: 2546494 - RNA, 20 nt, Chlamydophila pneumoniae J138
gagacccaacaguucuuucu

SEQ ID NO: 2546495 - RNA, 21 nt, Chlamydophila pneumoniae J138
gagaccuacuuauuguucuug

SEQ ID NO: 2546496 - RNA, 15 nt, Chlamydophila pneumoniae J138
gagaccuucucuuca

SEQ ID NO: 2546497 - RNA, 18 nt, Chlamydophila pneumoniae J138
gagacucuaguuuuucuu

SEQ ID NO: 2546498 - RNA, 19 nt, Chlamydophila pneumoniae J138
gagacucuaguuuuucuuu

SEQ ID NO: 2546499 - RNA, 16 nt, Chlamydophila pneumoniae J138
gagacugcaaaggaag

SEQ ID NO: 2546500 - RNA, 17 nt, Chlamydophila pneumoniae J138
gagacugcaaaggaagg

SEQ ID NO: 2546501 - RNA, 22 nt, Chlamydophila pneumoniae J138
gagagaaacaucggagaacuuc

SEQ ID NO: 2546502 - RNA, 21 nt, Chlamydophila pneumoniae J138
gagagaagcagaaucugugag

SEQ ID NO: 2546503 - RNA, 14 nt, Chlamydophila pneumoniae J138
gagagaaucgagaa

SEQ ID NO: 2546504 - RNA, 17 nt, Chlamydophila pneumoniae J138
gagagacuguguuuuua

SEQ ID NO: 2546505 - RNA, 13 nt, Chlamydophila pneumoniae J138
gagagagcucuuc

SEQ ID NO: 2546506 - RNA, 12 nt, Chlamydophila pneumoniae J138
gagagaggggag

SEQ ID NO: 2546507 - RNA, 19 nt, Chlamydophila pneumoniae J138
gagagagucggcuuuagaa

SEQ ID NO: 2546508 - RNA, 14 nt, Chlamydophila pneumoniae J138
gagagcaagauaau

SEQ ID NO: 2546509 - RNA, 14 nt, Chlamydophila pneumoniae J138
gagagccuuuccua

SEQ ID NO: 2546510 - RNA, 18 nt, Chlamydophila pneumoniae J138
gagagcuugguuuucucc

SEQ ID NO: 2546511 - RNA, 22 nt, Chlamydophila pneumoniae J138
gagagcuugguuuucuccuucu

SEQ ID NO: 2546512 - RNA, 21 nt, Chlamydophila pneumoniae J138
gagaggaaaucccgagauaug

SEQ ID NO: 2546513 - RNA, 22 nt, Chlamydophila pneumoniae J138
gagagguaaccagagagcuuuu

SEQ ID NO: 2546514 - RNA, 14 nt, Chlamydophila pneumoniae J138
gagagguucccuca

SEQ ID NO: 2546515 - RNA, 21 nt, Chlamydophila pneumoniae J138
gagaguccugggguucucuaa

SEQ ID NO: 2546516 - RNA, 20 nt, Chlamydophila pneumoniae J138
gagaguguuguuggagcaga

SEQ ID NO: 2546517 - RNA, 22 nt, Chlamydophila pneumoniae J138
gagaguucuuguaauaaaagaa

SEQ ID NO: 2546518 - RNA, 20 nt, Chlamydophila pneumoniae J138
gagauauugugaggggauga

SEQ ID NO: 2546519 - RNA, 23 nt, Chlamydophila pneumoniae J138
gagaucauuagcaucaucuccug

SEQ ID NO: 2546520 - RNA, 14 nt, Chlamydophila pneumoniae J138
gagauccuaagaga

SEQ ID NO: 2546521 - RNA, 22 nt, Chlamydophila pneumoniae J138
gagaucuuauagacagguacau

SEQ ID NO: 2546522 - RNA, 13 nt, Chlamydophila pneumoniae J138
gagaucuuugaga

SEQ ID NO: 2546523 - RNA, 21 nt, Chlamydophila pneumoniae J138
gagaucuuugagaucuugaau

SEQ ID NO: 2546524 - RNA, 21 nt, Chlamydophila pneumoniae J138
gagaucuuuuuauuaaaaucu

SEQ ID NO: 2546525 - RNA, 21 nt, Chlamydophila pneumoniae J138
gagaucuuuuugccaguucuu

SEQ ID NO: 2546526 - RNA, 21 nt, Chlamydophila pneumoniae J138
gagaugaaaggcucguagaua

SEQ ID NO: 2546527 - RNA, 14 nt, Chlamydophila pneumoniae J138
gagaugcuaacaac

SEQ ID NO: 2546528 - RNA, 15 nt, Chlamydophila pneumoniae J138
gagauugccaggaga

SEQ ID NO: 2546529 - RNA, 21 nt, Chlamydophila pneumoniae J138
gagauuuuccauaggaacaaa

SEQ ID NO: 2546530 - RNA, 17 nt, Chlamydophila pneumoniae J138
gagauuuuuucauacuu

SEQ ID NO: 2546531 - RNA, 14 nt, Chlamydophila pneumoniae J138
gagcaacaguaauu

SEQ ID NO: 2546532 - RNA, 23 nt, Chlamydophila pneumoniae J138
gagcaacuucuucguuagagaag

SEQ ID NO: 2546533 - RNA, 20 nt, Chlamydophila pneumoniae J138
gagcaagauaaucauuaaga

SEQ ID NO: 2546534 - RNA, 16 nt, Chlamydophila pneumoniae J138
gagcacauagaaacag

SEQ ID NO: 2546535 - RNA, 15 nt, Chlamydophila pneumoniae J138
gagcagaaacuccag

SEQ ID NO: 2546536 - RNA, 17 nt, Chlamydophila pneumoniae J138
gagcagcuguagugaua

SEQ ID NO: 2546537 - RNA, 23 nt, Chlamydophila pneumoniae J138
gagcagcuuuaucaggaucuuga

SEQ ID NO: 2546538 - RNA, 17 nt, Chlamydophila pneumoniae J138
gagcauagacucuuccu

SEQ ID NO: 2546539 - RNA, 16 nt, Chlamydophila pneumoniae J138
gagcaucauuaauucc

SEQ ID NO: 2546540 - RNA, 14 nt, Chlamydophila pneumoniae J138
gagcauccaaaaug

SEQ ID NO: 2546541 - RNA, 14 nt, Chlamydophila pneumoniae J138
gagcaucuuuucaa

SEQ ID NO: 2546542 - RNA, 20 nt, Chlamydophila pneumoniae J138
gagcaucuuuucaaaagaaa

SEQ ID NO: 2546543 - RNA, 17 nt, Chlamydophila pneumoniae J138
gagcaugagagucgaaa

SEQ ID NO: 2546544 - RNA, 19 nt, Chlamydophila pneumoniae J138
gagcauugacuugggauuc

SEQ ID NO: 2546545 - RNA, 21 nt, Chlamydophila pneumoniae J138
gagcauuuaaccccacaauca

SEQ ID NO: 2546546 - RNA, 20 nt, Chlamydophila pneumoniae J138
gagccacuuuuaauuucuua

SEQ ID NO: 2546547 - RNA, 16 nt, Chlamydophila pneumoniae J138
gagccggaacuucagg

SEQ ID NO: 2546548 - RNA, 17 nt, Chlamydophila pneumoniae J138
gagccgucuacuuuugu

SEQ ID NO: 2546549 - RNA, 20 nt, Chlamydophila pneumoniae J138
gagccgucuacuuuugugaa

SEQ ID NO: 2546550 - RNA, 19 nt, Chlamydophila pneumoniae J138
gagccuagagaguucuugu

SEQ ID NO: 2546551 - RNA, 20 nt, Chlamydophila pneumoniae J138
gagccuccauaaugcugaga

SEQ ID NO: 2546552 - RNA, 21 nt, Chlamydophila pneumoniae J138
gagcgaucgcaaucagcaaca

SEQ ID NO: 2546553 - RNA, 19 nt, Chlamydophila pneumoniae J138
gagcgcguuucaaauagga

SEQ ID NO: 2546554 - RNA, 16 nt, Chlamydophila pneumoniae J138
gagcgcuuucuuuuau

SEQ ID NO: 2546555 - RNA, 12 nt, Chlamydophila pneumoniae J138
gagcggaauuuc

SEQ ID NO: 2546556 - RNA, 15 nt, Chlamydophila pneumoniae J138
gagcgggagaaucaa

SEQ ID NO: 2546557 - RNA, 18 nt, Chlamydophila pneumoniae J138
gagcgguucuuucuagaa

SEQ ID NO: 2546558 - RNA, 11 nt, Chlamydophila pneumoniae J138
gagcuaagucu

SEQ ID NO: 2546559 - RNA, 18 nt, Chlamydophila pneumoniae J138
gagcuacaagaacugaag

SEQ ID NO: 2546560 - RNA, 21 nt, Chlamydophila pneumoniae J138
gagcuaccuagggucuucucg

SEQ ID NO: 2546561 - RNA, 12 nt, Chlamydophila pneumoniae J138
gagcuaucuuca

SEQ ID NO: 2546562 - RNA, 16 nt, Chlamydophila pneumoniae J138
gagcuauuuaggcaug

SEQ ID NO: 2546563 - RNA, 18 nt, Chlamydophila pneumoniae J138
gagcuauuuuacuuacua

SEQ ID NO: 2546564 - RNA, 20 nt, Chlamydophila pneumoniae J138
gagcucccucuagagcuuug

SEQ ID NO: 2546565 - RNA, 23 nt, Chlamydophila pneumoniae J138
gagcuccgcuagaggaucuucaa

SEQ ID NO: 2546566 - RNA, 12 nt, Chlamydophila pneumoniae J138
gagcuccuccuu

SEQ ID NO: 2546567 - RNA, 16 nt, Chlamydophila pneumoniae J138
gagcucgcaaaagcug

SEQ ID NO: 2546568 - RNA, 17 nt, Chlamydophila pneumoniae J138
gagcucuacucuacagu

SEQ ID NO: 2546569 - RNA, 13 nt, Chlamydophila pneumoniae J138
gagcucuugagaa

SEQ ID NO: 2546570 - RNA, 18 nt, Chlamydophila pneumoniae J138
gagcugauccagcuccau

SEQ ID NO: 2546571 - RNA, 14 nt, Chlamydophila pneumoniae J138
gagcugcugguccu

SEQ ID NO: 2546572 - RNA, 23 nt, Chlamydophila pneumoniae J138
gagcuggaagacuugcucugaag

SEQ ID NO: 2546573 - RNA, 17 nt, Chlamydophila pneumoniae J138
gagcuggacuucugguu

SEQ ID NO: 2546574 - RNA, 15 nt, Chlamydophila pneumoniae J138
gagcuuccauagcuu

SEQ ID NO: 2546575 - RNA, 13 nt, Chlamydophila pneumoniae J138
gagcuucuaucuu

SEQ ID NO: 2546576 - RNA, 17 nt, Chlamydophila pneumoniae J138
gagcuucuuuaucuagc

SEQ ID NO: 2546577 - RNA, 18 nt, Chlamydophila pneumoniae J138
gagcuugucuaggagcuu

SEQ ID NO: 2546578 - RNA, 15 nt, Chlamydophila pneumoniae J138
gagcuugucuuccac

SEQ ID NO: 2546579 - RNA, 22 nt, Chlamydophila pneumoniae J138
gagcuuguucuguaacacuucc

SEQ ID NO: 2546580 - RNA, 21 nt, Chlamydophila pneumoniae J138
gagcuuuuugcuuuucccuuu

SEQ ID NO: 2546581 - RNA, 13 nt, Chlamydophila pneumoniae J138
gaggaacaauacu

SEQ ID NO: 2546582 - RNA, 21 nt, Chlamydophila pneumoniae J138
gaggaacuucagcuuugcuua

SEQ ID NO: 2546583 - RNA, 22 nt, Chlamydophila pneumoniae J138
gaggaagcacaccaaguacagu

SEQ ID NO: 2546584 - RNA, 22 nt, Chlamydophila pneumoniae J138
gaggaaucauaaccaaaagaau

SEQ ID NO: 2546585 - RNA, 13 nt, Chlamydophila pneumoniae J138
gaggaaucuaaga

SEQ ID NO: 2546586 - RNA, 21 nt, Chlamydophila pneumoniae J138
gaggaaucugaaucucauaag

SEQ ID NO: 2546587 - RNA, 12 nt, Chlamydophila pneumoniae J138
gaggaaugaucc

SEQ ID NO: 2546588 - RNA, 16 nt, Chlamydophila pneumoniae J138
gaggaauucuggaaca

SEQ ID NO: 2546589 - RNA, 23 nt, Chlamydophila pneumoniae J138
gaggagacuugaucuacaaaaac

SEQ ID NO: 2546590 - RNA, 13 nt, Chlamydophila pneumoniae J138
gaggagauaaaga

SEQ ID NO: 2546591 - RNA, 18 nt, Chlamydophila pneumoniae J138
gaggagcgauagcucagc

SEQ ID NO: 2546592 - RNA, 19 nt, Chlamydophila pneumoniae J138
gaggagcgauagcucagcu

SEQ ID NO: 2546593 - RNA, 21 nt, Chlamydophila pneumoniae J138
gaggagcuuggggguggucua

SEQ ID NO: 2546594 - RNA, 11 nt, Chlamydophila pneumoniae J138
gaggaggagca

SEQ ID NO: 2546595 - RNA, 19 nt, Chlamydophila pneumoniae J138
gaggaguccuucuagguau

SEQ ID NO: 2546596 - RNA, 14 nt, Chlamydophila pneumoniae J138
gaggaguuuuccaa

SEQ ID NO: 2546597 - RNA, 16 nt, Chlamydophila pneumoniae J138
gaggauucuuuuugau

SEQ ID NO: 2546598 - RNA, 11 nt, Chlamydophila pneumoniae J138
gaggcaaagau

SEQ ID NO: 2546599 - RNA, 16 nt, Chlamydophila pneumoniae J138
gaggcacauguaggau

SEQ ID NO: 2546600 - RNA, 21 nt, Chlamydophila pneumoniae J138
gaggcggagguacguaucuuc

SEQ ID NO: 2546601 - RNA, 14 nt, Chlamydophila pneumoniae J138
gaggcuagaaaauc

SEQ ID NO: 2546602 - RNA, 19 nt, Chlamydophila pneumoniae J138
gaggcuucugagcuugccu

SEQ ID NO: 2546603 - RNA, 21 nt, Chlamydophila pneumoniae J138
gagggaucauguagcagagcc

SEQ ID NO: 2546604 - RNA, 19 nt, Chlamydophila pneumoniae J138
gagggaucuucucuaugaa

SEQ ID NO: 2546605 - RNA, 18 nt, Chlamydophila pneumoniae J138
gaggggacggaaaaucac

SEQ ID NO: 2546606 - RNA, 22 nt, Chlamydophila pneumoniae J138
gaggggccuaaagcuccgagaa

SEQ ID NO: 2546607 - RNA, 14 nt, Chlamydophila pneumoniae J138
gagguaaccagaga

SEQ ID NO: 2546608 - RNA, 20 nt, Chlamydophila pneumoniae J138
gagguagcaucucucuccaa

SEQ ID NO: 2546609 - RNA, 16 nt, Chlamydophila pneumoniae J138
gagguaugaauaggaa

SEQ ID NO: 2546610 - RNA, 20 nt, Chlamydophila pneumoniae J138
gagguucgcagaacuucucc

SEQ ID NO: 2546611 - RNA, 15 nt, Chlamydophila pneumoniae J138
gagguugagcaagaa

SEQ ID NO: 2546612 - RNA, 21 nt, Chlamydophila pneumoniae J138
gagguuucccgguaugaucaa

SEQ ID NO: 2546613 - RNA, 23 nt, Chlamydophila pneumoniae J138
gagguuucgaagcguuaacaacu

SEQ ID NO: 2546614 - RNA, 15 nt, Chlamydophila pneumoniae J138
gaguaaaaucauagg

SEQ ID NO: 2546615 - RNA, 19 nt, Chlamydophila pneumoniae J138
gaguaaggaacaauguaaa

SEQ ID NO: 2546616 - RNA, 23 nt, Chlamydophila pneumoniae J138
gaguaccgaccgaaucucuccag

SEQ ID NO: 2546617 - RNA, 21 nt, Chlamydophila pneumoniae J138
gaguagacaagagagagcugg

SEQ ID NO: 2546618 - RNA, 19 nt, Chlamydophila pneumoniae J138
gaguagccagacuggucua

SEQ ID NO: 2546619 - RNA, 13 nt, Chlamydophila pneumoniae J138
gaguagccccagc

SEQ ID NO: 2546620 - RNA, 23 nt, Chlamydophila pneumoniae J138
gaguagccccagcaacccgaauu

SEQ ID NO: 2546621 - RNA, 16 nt, Chlamydophila pneumoniae J138
gaguagcucaucuaga

SEQ ID NO: 2546622 - RNA, 19 nt, Chlamydophila pneumoniae J138
gaguaggguguauucugaa

SEQ ID NO: 2546623 - RNA, 20 nt, Chlamydophila pneumoniae J138
gaguaucuagcuuugucucu

SEQ ID NO: 2546624 - RNA, 14 nt, Chlamydophila pneumoniae J138
gaguaugaggagau

SEQ ID NO: 2546625 - RNA, 19 nt, Chlamydophila pneumoniae J138
gaguaugaggagauaaaga

SEQ ID NO: 2546626 - RNA, 19 nt, Chlamydophila pneumoniae J138
gaguauuuugcaaaugaaa

SEQ ID NO: 2546627 - RNA, 20 nt, Chlamydophila pneumoniae J138
gagucacuggcaucagugga

SEQ ID NO: 2546628 - RNA, 18 nt, Chlamydophila pneumoniae J138
gagucagguaaagagcuu

SEQ ID NO: 2546629 - RNA, 19 nt, Chlamydophila pneumoniae J138
gaguccuaaaauuucuagg

SEQ ID NO: 2546630 - RNA, 13 nt, Chlamydophila pneumoniae J138
gagucgauuuccc

SEQ ID NO: 2546631 - RNA, 17 nt, Chlamydophila pneumoniae J138
gagucucacucuuuucu

SEQ ID NO: 2546632 - RNA, 20 nt, Chlamydophila pneumoniae J138
gagucucuugcuuuuguaga

SEQ ID NO: 2546633 - RNA, 19 nt, Chlamydophila pneumoniae J138
gagucugcgucguuuuuga

SEQ ID NO: 2546634 - RNA, 14 nt, Chlamydophila pneumoniae J138
gagugacaccaaca

SEQ ID NO: 2546635 - RNA, 15 nt, Chlamydophila pneumoniae J138
gagugaccauagcau

SEQ ID NO: 2546636 - RNA, 13 nt, Chlamydophila pneumoniae J138
gagugacucauca

SEQ ID NO: 2546637 - RNA, 21 nt, Chlamydophila pneumoniae J138
gagugccaagagcaucacaaa

SEQ ID NO: 2546638 - RNA, 22 nt, Chlamydophila pneumoniae J138
gagugcguacucuucuuuggau

SEQ ID NO: 2546639 - RNA, 22 nt, Chlamydophila pneumoniae J138
gagugcucuaccccacgcuaaa

SEQ ID NO: 2546640 - RNA, 14 nt, Chlamydophila pneumoniae J138
gaguguauuguaaa

SEQ ID NO: 2546641 - RNA, 12 nt, Chlamydophila pneumoniae J138
gaguguuuucug

SEQ ID NO: 2546642 - RNA, 13 nt, Chlamydophila pneumoniae J138
gaguuagcuuuug

SEQ ID NO: 2546643 - RNA, 23 nt, Chlamydophila pneumoniae J138
gaguuccaagacaauaaaaaaga

SEQ ID NO: 2546644 - RNA, 21 nt, Chlamydophila pneumoniae J138
gaguucgcacuaauuuccuuc

SEQ ID NO: 2546645 - RNA, 23 nt, Chlamydophila pneumoniae J138
gaguucgcacuaauuuccuucag

SEQ ID NO: 2546646 - RNA, 19 nt, Chlamydophila pneumoniae J138
gaguucgcggaucuucuuc

SEQ ID NO: 2546647 - RNA, 15 nt, Chlamydophila pneumoniae J138
gaguucuuccuucuu

SEQ ID NO: 2546648 - RNA, 16 nt, Chlamydophila pneumoniae J138
gaguucuuccuucuuc

SEQ ID NO: 2546649 - RNA, 18 nt, Chlamydophila pneumoniae J138
gaguucuuccuucuucuu

SEQ ID NO: 2546650 - RNA, 18 nt, Chlamydophila pneumoniae J138
gaguucuuguaauaaaag

SEQ ID NO: 2546651 - RNA, 15 nt, Chlamydophila pneumoniae J138
gaguugccaggaaac

SEQ ID NO: 2546652 - RNA, 18 nt, Chlamydophila pneumoniae J138
gaguuucgaauucaauga

SEQ ID NO: 2546653 - RNA, 21 nt, Chlamydophila pneumoniae J138
gaguuuuaaacugcuacuuua

SEQ ID NO: 2546654 - RNA, 13 nt, Chlamydophila pneumoniae J138
gaguuuuacauca

SEQ ID NO: 2546655 - RNA, 13 nt, Chlamydophila pneumoniae J138
gaguuuucaaacu

SEQ ID NO: 2546656 - RNA, 23 nt, Chlamydophila pneumoniae J138
gaguuuuuguguuugacugaaac

SEQ ID NO: 2546657 - RNA, 22 nt, Chlamydophila pneumoniae J138
gaguuuuuuucuuauagggaau

SEQ ID NO: 2546658 - RNA, 17 nt, Chlamydophila pneumoniae J138
gauaaaacuauaaaagc

SEQ ID NO: 2546659 - RNA, 19 nt, Chlamydophila pneumoniae J138
gauaaaagguauuucucuc

SEQ ID NO: 2546660 - RNA, 12 nt, Chlamydophila pneumoniae J138
gauaaacagcac

SEQ ID NO: 2546661 - RNA, 14 nt, Chlamydophila pneumoniae J138
gauaaacagcacag

SEQ ID NO: 2546662 - RNA, 11 nt, Chlamydophila pneumoniae J138
gauaaacauac

SEQ ID NO: 2546663 - RNA, 19 nt, Chlamydophila pneumoniae J138
gauaaagacaucucuuuaa

SEQ ID NO: 2546664 - RNA, 19 nt, Chlamydophila pneumoniae J138
gauaaaggcauaacugugc

SEQ ID NO: 2546665 - RNA, 23 nt, Chlamydophila pneumoniae J138
gauaaauacccucggagacucag

SEQ ID NO: 2546666 - RNA, 15 nt, Chlamydophila pneumoniae J138
gauaaauccccacca

SEQ ID NO: 2546667 - RNA, 15 nt, Chlamydophila pneumoniae J138
gauaaaucccgaaca

SEQ ID NO: 2546668 - RNA, 15 nt, Chlamydophila pneumoniae J138
gauaaauggaggaua

SEQ ID NO: 2546669 - RNA, 18 nt, Chlamydophila pneumoniae J138
gauaagaacuuuagggaa

SEQ ID NO: 2546670 - RNA, 13 nt, Chlamydophila pneumoniae J138
gauaagauaaaga

SEQ ID NO: 2546671 - RNA, 15 nt, Chlamydophila pneumoniae J138
gauaagauaaagaau

SEQ ID NO: 2546672 - RNA, 13 nt, Chlamydophila pneumoniae J138
gauaaggaccagg

SEQ ID NO: 2546673 - RNA, 14 nt, Chlamydophila pneumoniae J138
gauaaguucuucca

SEQ ID NO: 2546674 - RNA, 15 nt, Chlamydophila pneumoniae J138
gauaaucagaggagc

SEQ ID NO: 2546675 - RNA, 16 nt, Chlamydophila pneumoniae J138
gauaaucagaggagcc

SEQ ID NO: 2546676 - RNA, 19 nt, Chlamydophila pneumoniae J138
gauaaucuguaagaaaaug

SEQ ID NO: 2546677 - RNA, 10 nt, Chlamydophila pneumoniae J138
gauaaugauu

SEQ ID NO: 2546678 - RNA, 17 nt, Chlamydophila pneumoniae J138
gauaaugauuccuagaa

SEQ ID NO: 2546679 - RNA, 19 nt, Chlamydophila pneumoniae J138
gauacauccucacuagaga

SEQ ID NO: 2546680 - RNA, 16 nt, Chlamydophila pneumoniae J138
gauaccaaaauaccau

SEQ ID NO: 2546681 - RNA, 20 nt, Chlamydophila pneumoniae J138
gauaccaagaugaagaaacu

SEQ ID NO: 2546682 - RNA, 17 nt, Chlamydophila pneumoniae J138
gauacccaaagagggga

SEQ ID NO: 2546683 - RNA, 14 nt, Chlamydophila pneumoniae J138
gauacccaucuaga

SEQ ID NO: 2546684 - RNA, 22 nt, Chlamydophila pneumoniae J138
gauaccgcuguuuuauagcauc

SEQ ID NO: 2546685 - RNA, 16 nt, Chlamydophila pneumoniae J138
gauaccggcaaauaaa

SEQ ID NO: 2546686 - RNA, 20 nt, Chlamydophila pneumoniae J138
gauacgugcagugaauccuu

SEQ ID NO: 2546687 - RNA, 13 nt, Chlamydophila pneumoniae J138
gauacguggaacu

SEQ ID NO: 2546688 - RNA, 17 nt, Chlamydophila pneumoniae J138
gauacucucagcaaaga

SEQ ID NO: 2546689 - RNA, 18 nt, Chlamydophila pneumoniae J138
gauacucugaacaggaau

SEQ ID NO: 2546690 - RNA, 17 nt, Chlamydophila pneumoniae J138
gauacuguuuuuuaucu

SEQ ID NO: 2546691 - RNA, 20 nt, Chlamydophila pneumoniae J138
gauacuuagcaaucaguaaa

SEQ ID NO: 2546692 - RNA, 14 nt, Chlamydophila pneumoniae J138
gauacuuaucuuua

SEQ ID NO: 2546693 - RNA, 15 nt, Chlamydophila pneumoniae J138
gauacuuaucuuuaa

SEQ ID NO: 2546694 - RNA, 13 nt, Chlamydophila pneumoniae J138
gauacuucuucca

SEQ ID NO: 2546695 - RNA, 22 nt, Chlamydophila pneumoniae J138
gauacuucuuccacgagauucu

SEQ ID NO: 2546696 - RNA, 19 nt, Chlamydophila pneumoniae J138
gauacuuguaccguaaaga

SEQ ID NO: 2546697 - RNA, 13 nt, Chlamydophila pneumoniae J138
gauagagauucuu

SEQ ID NO: 2546698 - RNA, 18 nt, Chlamydophila pneumoniae J138
gauagagcuucuuuaucu

SEQ ID NO: 2546699 - RNA, 17 nt, Chlamydophila pneumoniae J138
gauagcaaugauguuuu

SEQ ID NO: 2546700 - RNA, 21 nt, Chlamydophila pneumoniae J138
gauagcaauucgguagagcua

SEQ ID NO: 2546701 - RNA, 24 nt, Chlamydophila pneumoniae J138
gauagcauugucgaguauaauuga

SEQ ID NO: 2546702 - RNA, 19 nt, Chlamydophila pneumoniae J138
gauagccaucauaaaacgu

SEQ ID NO: 2546703 - RNA, 13 nt, Chlamydophila pneumoniae J138
gauagccauuaga

SEQ ID NO: 2546704 - RNA, 23 nt, Chlamydophila pneumoniae J138
gauagcgucuguuaacucagaga

SEQ ID NO: 2546705 - RNA, 19 nt, Chlamydophila pneumoniae J138
gauagcuaaaccuucagau

SEQ ID NO: 2546706 - RNA, 15 nt, Chlamydophila pneumoniae J138
gauagcugaugcuga

SEQ ID NO: 2546707 - RNA, 13 nt, Chlamydophila pneumoniae J138
gauaggaaccacu

SEQ ID NO: 2546708 - RNA, 21 nt, Chlamydophila pneumoniae J138
gauaggaaccacuuuagaauu

SEQ ID NO: 2546709 - RNA, 17 nt, Chlamydophila pneumoniae J138
gauaggguaagauugca

SEQ ID NO: 2546710 - RNA, 23 nt, Chlamydophila pneumoniae J138
gauaggugagguuugugcugcuu

SEQ ID NO: 2546711 - RNA, 22 nt, Chlamydophila pneumoniae J138
gauaguauuuuugaaaccaagg

SEQ ID NO: 2546712 - RNA, 19 nt, Chlamydophila pneumoniae J138
gauaguuuuugcuguuucu

SEQ ID NO: 2546713 - RNA, 15 nt, Chlamydophila pneumoniae J138
gauauagagagaguc

SEQ ID NO: 2546714 - RNA, 18 nt, Chlamydophila pneumoniae J138
gauauagauucaugaaau

SEQ ID NO: 2546715 - RNA, 16 nt, Chlamydophila pneumoniae J138
gauauauagagcagac

SEQ ID NO: 2546716 - RNA, 16 nt, Chlamydophila pneumoniae J138
gauaucaaagcauugc

SEQ ID NO: 2546717 - RNA, 11 nt, Chlamydophila pneumoniae J138
gauaucaccag

SEQ ID NO: 2546718 - RNA, 15 nt, Chlamydophila pneumoniae J138
gauaucgaccuuaaa

SEQ ID NO: 2546719 - RNA, 19 nt, Chlamydophila pneumoniae J138
gauaucggaccuacguuuu

SEQ ID NO: 2546720 - RNA, 12 nt, Chlamydophila pneumoniae J138
gauaucucuacc

SEQ ID NO: 2546721 - RNA, 20 nt, Chlamydophila pneumoniae J138
gauaucucuaccgaacagag

SEQ ID NO: 2546722 - RNA, 17 nt, Chlamydophila pneumoniae J138
gauaucugcucccuccu

SEQ ID NO: 2546723 - RNA, 22 nt, Chlamydophila pneumoniae J138
gauauguccgugagcaacaagc

SEQ ID NO: 2546724 - RNA, 13 nt, Chlamydophila pneumoniae J138
gauauuacagauu

SEQ ID NO: 2546725 - RNA, 20 nt, Chlamydophila pneumoniae J138
gauauugauaaaucccgaac

SEQ ID NO: 2546726 - RNA, 16 nt, Chlamydophila pneumoniae J138
gauauugcggaaauug

SEQ ID NO: 2546727 - RNA, 13 nt, Chlamydophila pneumoniae J138
gauauugucaaga

SEQ ID NO: 2546728 - RNA, 15 nt, Chlamydophila pneumoniae J138
gauauuguucuucca

SEQ ID NO: 2546729 - RNA, 17 nt, Chlamydophila pneumoniae J138
gaucaaagaacaauaaa

SEQ ID NO: 2546730 - RNA, 22 nt, Chlamydophila pneumoniae J138
gaucaauauagagaacuccauu

SEQ ID NO: 2546731 - RNA, 13 nt, Chlamydophila pneumoniae J138
gaucacagggaca

SEQ ID NO: 2546732 - RNA, 16 nt, Chlamydophila pneumoniae J138
gaucacauagaaaaca

SEQ ID NO: 2546733 - RNA, 17 nt, Chlamydophila pneumoniae J138
gaucacauagaaaacau

SEQ ID NO: 2546734 - RNA, 11 nt, Chlamydophila pneumoniae J138
gaucacugaga

SEQ ID NO: 2546735 - RNA, 23 nt, Chlamydophila pneumoniae J138
gaucaggauucuaaaaagaaaag

SEQ ID NO: 2546736 - RNA, 15 nt, Chlamydophila pneumoniae J138
gaucauaaacagcag

SEQ ID NO: 2546737 - RNA, 16 nt, Chlamydophila pneumoniae J138
gaucauaccgacaagc

SEQ ID NO: 2546738 - RNA, 23 nt, Chlamydophila pneumoniae J138
gaucauaucggcagcagcauaag

SEQ ID NO: 2546739 - RNA, 19 nt, Chlamydophila pneumoniae J138
gaucauaucuuaugccuuu

SEQ ID NO: 2546740 - RNA, 21 nt, Chlamydophila pneumoniae J138
gaucauaugcaccgauuggcu

SEQ ID NO: 2546741 - RNA, 20 nt, Chlamydophila pneumoniae J138
gaucauauuuauuuaaacca

SEQ ID NO: 2546742 - RNA, 21 nt, Chlamydophila pneumoniae J138
gaucaucuacgauguuuucuu

SEQ ID NO: 2546743 - RNA, 21 nt, Chlamydophila pneumoniae J138
gaucauuaaaguccaagauca

SEQ ID NO: 2546744 - RNA, 16 nt, Chlamydophila pneumoniae J138
gaucauuuuugcuaga

SEQ ID NO: 2546745 - RNA, 21 nt, Chlamydophila pneumoniae J138
gauccacagacugcaggaaau

SEQ ID NO: 2546746 - RNA, 18 nt, Chlamydophila pneumoniae J138
gauccagcccccaggcug

SEQ ID NO: 2546747 - RNA, 19 nt, Chlamydophila pneumoniae J138
gauccaucggcauuucucc

SEQ ID NO: 2546748 - RNA, 15 nt, Chlamydophila pneumoniae J138
gauccccuucauucu

SEQ ID NO: 2546749 - RNA, 18 nt, Chlamydophila pneumoniae J138
gaucccuaacgaugcagg

SEQ ID NO: 2546750 - RNA, 23 nt, Chlamydophila pneumoniae J138
gaucccuguaguuucuaaaacag

SEQ ID NO: 2546751 - RNA, 16 nt, Chlamydophila pneumoniae J138
gauccuuuccaagaag

SEQ ID NO: 2546752 - RNA, 12 nt, Chlamydophila pneumoniae J138
gaucgaaaaaua

SEQ ID NO: 2546753 - RNA, 18 nt, Chlamydophila pneumoniae J138
gaucgggucuacaacagu

SEQ ID NO: 2546754 - RNA, 17 nt, Chlamydophila pneumoniae J138
gaucgucaguaaaacac

SEQ ID NO: 2546755 - RNA, 20 nt, Chlamydophila pneumoniae J138
gaucuaaaagcacuuaaaaa

SEQ ID NO: 2546756 - RNA, 23 nt, Chlamydophila pneumoniae J138
gaucuaaaagcacuuaaaaaacu

SEQ ID NO: 2546757 - RNA, 21 nt, Chlamydophila pneumoniae J138
gaucuaacuucaccauauaau

SEQ ID NO: 2546758 - RNA, 23 nt, Chlamydophila pneumoniae J138
gaucuacagauaggguaagauug

SEQ ID NO: 2546759 - RNA, 17 nt, Chlamydophila pneumoniae J138
gaucuagaaaaugaaga

SEQ ID NO: 2546760 - RNA, 21 nt, Chlamydophila pneumoniae J138
gaucuagaaaaugaagagcuu

SEQ ID NO: 2546761 - RNA, 19 nt, Chlamydophila pneumoniae J138
gaucucgucuuggaaugcu

SEQ ID NO: 2546762 - RNA, 17 nt, Chlamydophila pneumoniae J138
gaucucuaguucuagaa

SEQ ID NO: 2546763 - RNA, 18 nt, Chlamydophila pneumoniae J138
gaucucucuuccugcugc

SEQ ID NO: 2546764 - RNA, 19 nt, Chlamydophila pneumoniae J138
gaucucuuuuggaagaccu

SEQ ID NO: 2546765 - RNA, 19 nt, Chlamydophila pneumoniae J138
gaucugaaguugaaaugag

SEQ ID NO: 2546766 - RNA, 21 nt, Chlamydophila pneumoniae J138
gaucugcagcguuucuaggga

SEQ ID NO: 2546767 - RNA, 19 nt, Chlamydophila pneumoniae J138
gaucuggagagggaaggaa

SEQ ID NO: 2546768 - RNA, 22 nt, Chlamydophila pneumoniae J138
gaucuucaauuggaggauaaau

SEQ ID NO: 2546769 - RNA, 17 nt, Chlamydophila pneumoniae J138
gaucuucagagagaaca

SEQ ID NO: 2546770 - RNA, 14 nt, Chlamydophila pneumoniae J138
gaucuucauaacca

SEQ ID NO: 2546771 - RNA, 15 nt, Chlamydophila pneumoniae J138
gaucuucuaaaacac

SEQ ID NO: 2546772 - RNA, 17 nt, Chlamydophila pneumoniae J138
gaucuucuaaaacaccu

SEQ ID NO: 2546773 - RNA, 16 nt, Chlamydophila pneumoniae J138
gaucuucuagaugugu

SEQ ID NO: 2546774 - RNA, 16 nt, Chlamydophila pneumoniae J138
gaucuucucauccaga

SEQ ID NO: 2546775 - RNA, 20 nt, Chlamydophila pneumoniae J138
gaucuugaacagagacuucc

SEQ ID NO: 2546776 - RNA, 18 nt, Chlamydophila pneumoniae J138
gaucuugagaaaagaaca

SEQ ID NO: 2546777 - RNA, 15 nt, Chlamydophila pneumoniae J138
gaucuuuagaauaag

SEQ ID NO: 2546778 - RNA, 23 nt, Chlamydophila pneumoniae J138
gaucuuuucuacuucaggaaaua

SEQ ID NO: 2546779 - RNA, 14 nt, Chlamydophila pneumoniae J138
gaucuuuucuuucu

SEQ ID NO: 2546780 - RNA, 20 nt, Chlamydophila pneumoniae J138
gaucuuuucuuucuaagaua

SEQ ID NO: 2546781 - RNA, 23 nt, Chlamydophila pneumoniae J138
gaucuuuugauaacuuugcauga

SEQ ID NO: 2546782 - RNA, 21 nt, Chlamydophila pneumoniae J138
gaucuuuuugccaguucuuga

SEQ ID NO: 2546783 - RNA, 17 nt, Chlamydophila pneumoniae J138
gaugaacagccucugug

SEQ ID NO: 2546784 - RNA, 15 nt, Chlamydophila pneumoniae J138
gaugaacauaauucg

SEQ ID NO: 2546785 - RNA, 23 nt, Chlamydophila pneumoniae J138
gaugaacguauagggaaccuuga

SEQ ID NO: 2546786 - RNA, 14 nt, Chlamydophila pneumoniae J138
gaugaauaccagaa

SEQ ID NO: 2546787 - RNA, 23 nt, Chlamydophila pneumoniae J138
gaugaauccaaaauaaauagaag

SEQ ID NO: 2546788 - RNA, 15 nt, Chlamydophila pneumoniae J138
gaugaccucaucucg

SEQ ID NO: 2546789 - RNA, 15 nt, Chlamydophila pneumoniae J138
gaugacuuucagagc

SEQ ID NO: 2546790 - RNA, 19 nt, Chlamydophila pneumoniae J138
gaugaggucuuuagcaaaa

SEQ ID NO: 2546791 - RNA, 19 nt, Chlamydophila pneumoniae J138
gaugcaaauccuguagaaa

SEQ ID NO: 2546792 - RNA, 22 nt, Chlamydophila pneumoniae J138
gaugcaaauccuguagaaacau

SEQ ID NO: 2546793 - RNA, 19 nt, Chlamydophila pneumoniae J138
gaugcaaauuccagaaaaa

SEQ ID NO: 2546794 - RNA, 20 nt, Chlamydophila pneumoniae J138
gaugcaaauuccagaaaaag

SEQ ID NO: 2546795 - RNA, 16 nt, Chlamydophila pneumoniae J138
gaugcaaugguugucu

SEQ ID NO: 2546796 - RNA, 14 nt, Chlamydophila pneumoniae J138
gaugcaccauaaua

SEQ ID NO: 2546797 - RNA, 16 nt, Chlamydophila pneumoniae J138
gaugcaccauaauaua

SEQ ID NO: 2546798 - RNA, 17 nt, Chlamydophila pneumoniae J138
gaugcaccauaauauaa

SEQ ID NO: 2546799 - RNA, 12 nt, Chlamydophila pneumoniae J138
gaugcagaucau

SEQ ID NO: 2546800 - RNA, 23 nt, Chlamydophila pneumoniae J138
gaugcagcauuuguaagaaucau

SEQ ID NO: 2546801 - RNA, 14 nt, Chlamydophila pneumoniae J138
gaugcaggccagga

SEQ ID NO: 2546802 - RNA, 16 nt, Chlamydophila pneumoniae J138
gaugcaucucuuaaaa

SEQ ID NO: 2546803 - RNA, 18 nt, Chlamydophila pneumoniae J138
gaugcaucucuuaaaaca

SEQ ID NO: 2546804 - RNA, 13 nt, Chlamydophila pneumoniae J138
gaugccaagaaau

SEQ ID NO: 2546805 - RNA, 14 nt, Chlamydophila pneumoniae J138
gaugccaagaaaua

SEQ ID NO: 2546806 - RNA, 15 nt, Chlamydophila pneumoniae J138
gaugccaagaaauau

SEQ ID NO: 2546807 - RNA, 15 nt, Chlamydophila pneumoniae J138
gaugccagccauagc

SEQ ID NO: 2546808 - RNA, 17 nt, Chlamydophila pneumoniae J138
gaugcuaaagagucuuc

SEQ ID NO: 2546809 - RNA, 15 nt, Chlamydophila pneumoniae J138
gaugcuacuuuccac

SEQ ID NO: 2546810 - RNA, 23 nt, Chlamydophila pneumoniae J138
gaugcucuagaaaacgcucuccu

SEQ ID NO: 2546811 - RNA, 17 nt, Chlamydophila pneumoniae J138
gaugcugaggacgcaga

SEQ ID NO: 2546812 - RNA, 17 nt, Chlamydophila pneumoniae J138
gaugcuugugagaugaa

SEQ ID NO: 2546813 - RNA, 14 nt, Chlamydophila pneumoniae J138
gauggaaucaggga

SEQ ID NO: 2546814 - RNA, 19 nt, Chlamydophila pneumoniae J138
gaugggaucggucuuuucu

SEQ ID NO: 2546815 - RNA, 15 nt, Chlamydophila pneumoniae J138
gauggucaggaagaa

SEQ ID NO: 2546816 - RNA, 13 nt, Chlamydophila pneumoniae J138
gaugguugcuucu

SEQ ID NO: 2546817 - RNA, 23 nt, Chlamydophila pneumoniae J138
gauguaacuaguaacuuaaucaa

SEQ ID NO: 2546818 - RNA, 19 nt, Chlamydophila pneumoniae J138
gauguacaagcuucaucaa

SEQ ID NO: 2546819 - RNA, 19 nt, Chlamydophila pneumoniae J138
gauguauaaaguuuguaaa

SEQ ID NO: 2546820 - RNA, 20 nt, Chlamydophila pneumoniae J138
gaugugauguucugcugcuu

SEQ ID NO: 2546821 - RNA, 15 nt, Chlamydophila pneumoniae J138
gauguuaaggcuucc

SEQ ID NO: 2546822 - RNA, 22 nt, Chlamydophila pneumoniae J138
gauguuauaagugacuuuucuu

SEQ ID NO: 2546823 - RNA, 17 nt, Chlamydophila pneumoniae J138
gauguuguggaucagaa

SEQ ID NO: 2546824 - RNA, 16 nt, Chlamydophila pneumoniae J138
gauuaaagagacugug

SEQ ID NO: 2546825 - RNA, 20 nt, Chlamydophila pneumoniae J138
gauuaaguucgucuaccauu

SEQ ID NO: 2546826 - RNA, 18 nt, Chlamydophila pneumoniae J138
gauuagaaaagauaaaac

SEQ ID NO: 2546827 - RNA, 14 nt, Chlamydophila pneumoniae J138
gauuaguaacuaaa

SEQ ID NO: 2546828 - RNA, 20 nt, Chlamydophila pneumoniae J138
gauuaguucucuaagacugu

SEQ ID NO: 2546829 - RNA, 16 nt, Chlamydophila pneumoniae J138
gauuaucccaaacuuc

SEQ ID NO: 2546830 - RNA, 23 nt, Chlamydophila pneumoniae J138
gauuaugaauccuugaaagacuc

SEQ ID NO: 2546831 - RNA, 15 nt, Chlamydophila pneumoniae J138
gauuaugaugccuca

SEQ ID NO: 2546832 - RNA, 22 nt, Chlamydophila pneumoniae J138
gauuauuuguuucuuccauaca

SEQ ID NO: 2546833 - RNA, 15 nt, Chlamydophila pneumoniae J138
gauucaaagaagucg

SEQ ID NO: 2546834 - RNA, 22 nt, Chlamydophila pneumoniae J138
gauucaaugcagcuaacgaagc

SEQ ID NO: 2546835 - RNA, 21 nt, Chlamydophila pneumoniae J138
gauucacaucuuaaaaacuac

SEQ ID NO: 2546836 - RNA, 11 nt, Chlamydophila pneumoniae J138
gauucaccaag

SEQ ID NO: 2546837 - RNA, 19 nt, Chlamydophila pneumoniae J138
gauucaguuccucauccuc

SEQ ID NO: 2546838 - RNA, 16 nt, Chlamydophila pneumoniae J138
gauucccugcggacag

SEQ ID NO: 2546839 - RNA, 13 nt, Chlamydophila pneumoniae J138
gauuccugaggcu

SEQ ID NO: 2546840 - RNA, 18 nt, Chlamydophila pneumoniae J138
gauuccugucauuccuaa

SEQ ID NO: 2546841 - RNA, 22 nt, Chlamydophila pneumoniae J138
gauucgaaaaacgguaaauauc

SEQ ID NO: 2546842 - RNA, 14 nt, Chlamydophila pneumoniae J138
gauucgaaagaacu

SEQ ID NO: 2546843 - RNA, 20 nt, Chlamydophila pneumoniae J138
gauucgcuacauaaaaugag

SEQ ID NO: 2546844 - RNA, 14 nt, Chlamydophila pneumoniae J138
gauucguuauccuc

SEQ ID NO: 2546845 - RNA, 22 nt, Chlamydophila pneumoniae J138
gauucguuauccucgucuucaa

SEQ ID NO: 2546846 - RNA, 14 nt, Chlamydophila pneumoniae J138
gauucuaaaagagc

SEQ ID NO: 2546847 - RNA, 14 nt, Chlamydophila pneumoniae J138
gauucuaaaucaac

SEQ ID NO: 2546848 - RNA, 23 nt, Chlamydophila pneumoniae J138
gauucucauaaaggcucuuuuag

SEQ ID NO: 2546849 - RNA, 17 nt, Chlamydophila pneumoniae J138
gauucuccgucccccgg

SEQ ID NO: 2546850 - RNA, 13 nt, Chlamydophila pneumoniae J138
gauucugcccaaa

SEQ ID NO: 2546851 - RNA, 16 nt, Chlamydophila pneumoniae J138
gauucuguauaaacaa

SEQ ID NO: 2546852 - RNA, 13 nt, Chlamydophila pneumoniae J138
gauucuucagaau

SEQ ID NO: 2546853 - RNA, 15 nt, Chlamydophila pneumoniae J138
gauucuuuaaucuau

SEQ ID NO: 2546854 - RNA, 21 nt, Chlamydophila pneumoniae J138
gauucuuuaaucuaucugcaa

SEQ ID NO: 2546855 - RNA, 23 nt, Chlamydophila pneumoniae J138
gauugaaacuuuuuuucuucucu

SEQ ID NO: 2546856 - RNA, 22 nt, Chlamydophila pneumoniae J138
gaaaaggcccccuacagcagaa

SEQ ID NO: 2546857 - RNA, 12 nt, Chlamydophila pneumoniae J138
gaaaauaaucuu

SEQ ID NO: 2546858 - RNA, 16 nt, Chlamydophila pneumoniae J138
gaaaauacagccagca

SEQ ID NO: 2546859 - RNA, 18 nt, Chlamydophila pneumoniae J138
gaaaauacagccagcaga

SEQ ID NO: 2546860 - RNA, 19 nt, Chlamydophila pneumoniae J138
gaaaauacagccagcagaa

SEQ ID NO: 2546861 - RNA, 23 nt, Chlamydophila pneumoniae J138
gaaaauaguacgcuuuuuacuga

SEQ ID NO: 2546862 - RNA, 16 nt, Chlamydophila pneumoniae J138
gaaaaucaagaagaga

SEQ ID NO: 2546863 - RNA, 11 nt, Chlamydophila pneumoniae J138
gaaaaucacac

SEQ ID NO: 2546864 - RNA, 20 nt, Chlamydophila pneumoniae J138
gaaaauccuaacaaaaggau

SEQ ID NO: 2546865 - RNA, 17 nt, Chlamydophila pneumoniae J138
gaaaauccuuaggggcg

SEQ ID NO: 2546866 - RNA, 24 nt, Chlamydophila pneumoniae J138
gaaaaucuacacgcuauagcaaca

SEQ ID NO: 2546867 - RNA, 20 nt, Chlamydophila pneumoniae J138
gaaaaucucuaagaaucuau

SEQ ID NO: 2546868 - RNA, 21 nt, Chlamydophila pneumoniae J138
gaaaaucucuaagaaucuaua

SEQ ID NO: 2546869 - RNA, 16 nt, Chlamydophila pneumoniae J138
gaaaaucugcagcaga

SEQ ID NO: 2546870 - RNA, 19 nt, Chlamydophila pneumoniae J138
gaaaaugauucauaacauu

SEQ ID NO: 2546871 - RNA, 17 nt, Chlamydophila pneumoniae J138
gaaaaugcgaucuucac

SEQ ID NO: 2546872 - RNA, 19 nt, Chlamydophila pneumoniae J138
gaaaauucaguauaagaug

SEQ ID NO: 2546873 - RNA, 14 nt, Chlamydophila pneumoniae J138
gaaaauuguuggaa

SEQ ID NO: 2546874 - RNA, 16 nt, Chlamydophila pneumoniae J138
gaaacaaccaucccau

SEQ ID NO: 2546875 - RNA, 12 nt, Chlamydophila pneumoniae J138
gaaacaacugaa

SEQ ID NO: 2546876 - RNA, 13 nt, Chlamydophila pneumoniae J138
gaaacacucauga

SEQ ID NO: 2546877 - RNA, 20 nt, Chlamydophila pneumoniae J138
gaaacacucaugaaagugcu

SEQ ID NO: 2546878 - RNA, 24 nt, Chlamydophila pneumoniae J138
gaaacacuuuggauaggauaggag

SEQ ID NO: 2546879 - RNA, 15 nt, Chlamydophila pneumoniae J138
gaaacagugguaugc

SEQ ID NO: 2546880 - RNA, 17 nt, Chlamydophila pneumoniae J138
gaaacaugaaguuguug

SEQ ID NO: 2546881 - RNA, 15 nt, Chlamydophila pneumoniae J138
gaaaccaugaugcaa

SEQ ID NO: 2546882 - RNA, 23 nt, Chlamydophila pneumoniae J138
gaaaccauuuaccccaggaauca

SEQ ID NO: 2546883 - RNA, 22 nt, Chlamydophila pneumoniae J138
gaaacccauaaugguacaauac

SEQ ID NO: 2546884 - RNA, 17 nt, Chlamydophila pneumoniae J138
gaaacccgcaacucuuu

SEQ ID NO: 2546885 - RNA, 20 nt, Chlamydophila pneumoniae J138
gaaaccggacugacuucuau

SEQ ID NO: 2546886 - RNA, 23 nt, Chlamydophila pneumoniae J138
gaaaccggacugacuucuaugau

SEQ ID NO: 2546887 - RNA, 13 nt, Chlamydophila pneumoniae J138
gaaaccuucagau

SEQ ID NO: 2546888 - RNA, 13 nt, Chlamydophila pneumoniae J138
gaaaccuucucuc

SEQ ID NO: 2546889 - RNA, 17 nt, Chlamydophila pneumoniae J138
gaaaccuucucucuuaa

SEQ ID NO: 2546890 - RNA, 22 nt, Chlamydophila pneumoniae J138
gaaacgcccuucaggacaugcc

SEQ ID NO: 2546891 - RNA, 16 nt, Chlamydophila pneumoniae J138
gaaacugcuccugaag

SEQ ID NO: 2546892 - RNA, 23 nt, Chlamydophila pneumoniae J138
gaaacuucugacccuguagcgaa

SEQ ID NO: 2546893 - RNA, 22 nt, Chlamydophila pneumoniae J138
gaaacuuuuccaaauuccuuca

SEQ ID NO: 2546894 - RNA, 22 nt, Chlamydophila pneumoniae J138
gaaacuuuugucgcaauaacaa

SEQ ID NO: 2546895 - RNA, 21 nt, Chlamydophila pneumoniae J138
gaaacuuuuuuucuucucuaa

SEQ ID NO: 2546896 - RNA, 22 nt, Chlamydophila pneumoniae J138
gaaacuuuuuuucuucucuaag

SEQ ID NO: 2546897 - RNA, 19 nt, Chlamydophila pneumoniae J138
gaaagaagagaauacgauc

SEQ ID NO: 2546898 - RNA, 16 nt, Chlamydophila pneumoniae J138
gaaagaaugccauucu

SEQ ID NO: 2546899 - RNA, 19 nt, Chlamydophila pneumoniae J138
gaaagaauuguaguucuuu

SEQ ID NO: 2546900 - RNA, 18 nt, Chlamydophila pneumoniae J138
gaaagacucaucuuugaa

SEQ ID NO: 2546901 - RNA, 17 nt, Chlamydophila pneumoniae J138
gaaagagcuaaagaaac

SEQ ID NO: 2546902 - RNA, 18 nt, Chlamydophila pneumoniae J138
gaaagagcuaaagaaacu

SEQ ID NO: 2546903 - RNA, 14 nt, Chlamydophila pneumoniae J138
gaaagauaaugucu

SEQ ID NO: 2546904 - RNA, 13 nt, Chlamydophila pneumoniae J138
gaaagcacauaag

SEQ ID NO: 2546905 - RNA, 15 nt, Chlamydophila pneumoniae J138
gaaagcaucuuucau

SEQ ID NO: 2546906 - RNA, 21 nt, Chlamydophila pneumoniae J138
gaaagccuuugcucacuguuu

SEQ ID NO: 2546907 - RNA, 14 nt, Chlamydophila pneumoniae J138
gaaagcuguauugg

SEQ ID NO: 2546908 - RNA, 17 nt, Chlamydophila pneumoniae J138
gaaaggaccuccucaca

SEQ ID NO: 2546909 - RNA, 16 nt, Chlamydophila pneumoniae J138
gaaaggcacuccaaaa

SEQ ID NO: 2546910 - RNA, 18 nt, Chlamydophila pneumoniae J138
gaaaguaaaauuucugua

SEQ ID NO: 2546911 - RNA, 19 nt, Chlamydophila pneumoniae J138
gaaaguagcaucccaaguu

SEQ ID NO: 2546912 - RNA, 23 nt, Chlamydophila pneumoniae J138
gaaaguauagacgggcuuauaaa

SEQ ID NO: 2546913 - RNA, 14 nt, Chlamydophila pneumoniae J138
gaaaguaucuucag

SEQ ID NO: 2546914 - RNA, 16 nt, Chlamydophila pneumoniae J138
gaaauaagcaucuaga

SEQ ID NO: 2546915 - RNA, 22 nt, Chlamydophila pneumoniae J138
gaaauaauuuguuuagaaaaag

SEQ ID NO: 2546916 - RNA, 21 nt, Chlamydophila pneumoniae J138
gaaauacgcuuuucuucuuua

SEQ ID NO: 2546917 - RNA, 16 nt, Chlamydophila pneumoniae J138
gaaauauaacucucua

SEQ ID NO: 2546918 - RNA, 14 nt, Chlamydophila pneumoniae J138
gaaauccacagaua

SEQ ID NO: 2546919 - RNA, 12 nt, Chlamydophila pneumoniae J138
gaaauccuccua

SEQ ID NO: 2546920 - RNA, 14 nt, Chlamydophila pneumoniae J138
gaaauccugggcaa

SEQ ID NO: 2546921 - RNA, 22 nt, Chlamydophila pneumoniae J138
gaaauccugggcaaugaucaaa

SEQ ID NO: 2546922 - RNA, 16 nt, Chlamydophila pneumoniae J138
gaaaucgcauuacaaa

SEQ ID NO: 2546923 - RNA, 20 nt, Chlamydophila pneumoniae J138
gaaaucguaucuuuuugcag

SEQ ID NO: 2546924 - RNA, 22 nt, Chlamydophila pneumoniae J138
gaaaugcaaaccaaaaaaguaa

SEQ ID NO: 2546925 - RNA, 22 nt, Chlamydophila pneumoniae J138
gaaaugcaguucuuguuaaagu

SEQ ID NO: 2546926 - RNA, 22 nt, Chlamydophila pneumoniae J138
gaaauguaagaaggcagagaac

SEQ ID NO: 2546927 - RNA, 19 nt, Chlamydophila pneumoniae J138
gaaauuaaagcuaacaacu

SEQ ID NO: 2546928 - RNA, 12 nt, Chlamydophila pneumoniae J138
gaaauuaacaga

SEQ ID NO: 2546929 - RNA, 21 nt, Chlamydophila pneumoniae J138
gaaauuaacagagcgccucca

SEQ ID NO: 2546930 - RNA, 20 nt, Chlamydophila pneumoniae J138
gaaauuaaguaggccuccuu

SEQ ID NO: 2546931 - RNA, 15 nt, Chlamydophila pneumoniae J138
gaaauuagguagugg

SEQ ID NO: 2546932 - RNA, 23 nt, Chlamydophila pneumoniae J138
gaaauuauagaugaucacaggcu

SEQ ID NO: 2546933 - RNA, 21 nt, Chlamydophila pneumoniae J138
gaaauugaacucucaguuaaa

SEQ ID NO: 2546934 - RNA, 22 nt, Chlamydophila pneumoniae J138
gaaauugaauaucgaguucuuu

SEQ ID NO: 2546935 - RNA, 14 nt, Chlamydophila pneumoniae J138
gaaauuucauucuc

SEQ ID NO: 2546936 - RNA, 15 nt, Chlamydophila pneumoniae J138
gaacaaaaaaucaau

SEQ ID NO: 2546937 - RNA, 17 nt, Chlamydophila pneumoniae J138
gaacaaagcucuccuuc

SEQ ID NO: 2546938 - RNA, 20 nt, Chlamydophila pneumoniae J138
gaacaaagcucuccuucaga

SEQ ID NO: 2546939 - RNA, 21 nt, Chlamydophila pneumoniae J138
gaacaacgcugcuucucuacu

SEQ ID NO: 2546940 - RNA, 13 nt, Chlamydophila pneumoniae J138
gaacaaggcuccg

SEQ ID NO: 2546941 - RNA, 22 nt, Chlamydophila pneumoniae J138
gaacaagucggcaggagaggua

SEQ ID NO: 2546942 - RNA, 19 nt, Chlamydophila pneumoniae J138
gaacaaguuuuuucaaucc

SEQ ID NO: 2546943 - RNA, 20 nt, Chlamydophila pneumoniae J138
gaacaaguuuuuucaauccu

SEQ ID NO: 2546944 - RNA, 19 nt, Chlamydophila pneumoniae J138
gaacaauacucucugcuuc

SEQ ID NO: 2546945 - RNA, 20 nt, Chlamydophila pneumoniae J138
gaacacccccgcagcuucuc

SEQ ID NO: 2546946 - RNA, 23 nt, Chlamydophila pneumoniae J138
gaacacccccgcagcuucucuag

SEQ ID NO: 2546947 - RNA, 12 nt, Chlamydophila pneumoniae J138
gaacacucucua

SEQ ID NO: 2546948 - RNA, 15 nt, Chlamydophila pneumoniae J138
gaacagcacucucug

SEQ ID NO: 2546949 - RNA, 17 nt, Chlamydophila pneumoniae J138
gaacagcacucucugca

SEQ ID NO: 2546950 - RNA, 22 nt, Chlamydophila pneumoniae J138
gaacagcauggacuccaagaau

SEQ ID NO: 2546951 - RNA, 23 nt, Chlamydophila pneumoniae J138
gaacagcauggacuccaagaaua

SEQ ID NO: 2546952 - RNA, 18 nt, Chlamydophila pneumoniae J138
gaacagccucugugguuu

SEQ ID NO: 2546953 - RNA, 23 nt, Chlamydophila pneumoniae J138
gaacagccucugugguuuuuauu

SEQ ID NO: 2546954 - RNA, 12 nt, Chlamydophila pneumoniae J138
gaacaggagaga

SEQ ID NO: 2546955 - RNA, 18 nt, Chlamydophila pneumoniae J138
gaacaggagagagaaggc

SEQ ID NO: 2546956 - RNA, 20 nt, Chlamydophila pneumoniae J138
gaacaggagagagaaggcuc

SEQ ID NO: 2546957 - RNA, 23 nt, Chlamydophila pneumoniae J138
gaacaggauugauaaauacccuc

SEQ ID NO: 2546958 - RNA, 18 nt, Chlamydophila pneumoniae J138
gaacaguauaaucagaag

SEQ ID NO: 2546959 - RNA, 19 nt, Chlamydophila pneumoniae J138
gaacagucuugcgccagca

SEQ ID NO: 2546960 - RNA, 14 nt, Chlamydophila pneumoniae J138
gaacaugccaaaua

SEQ ID NO: 2546961 - RNA, 16 nt, Chlamydophila pneumoniae J138
gaaccaaaaugaguuc

SEQ ID NO: 2546962 - RNA, 19 nt, Chlamydophila pneumoniae J138
gaaccaaaucuaucugcac

SEQ ID NO: 2546963 - RNA, 17 nt, Chlamydophila pneumoniae J138
gaacccuggaugaacau

SEQ ID NO: 2546964 - RNA, 14 nt, Chlamydophila pneumoniae J138
gaaccuaggaggau

SEQ ID NO: 2546965 - RNA, 21 nt, Chlamydophila pneumoniae J138
gaaccuaggaggauuuccuag

SEQ ID NO: 2546966 - RNA, 20 nt, Chlamydophila pneumoniae J138
gaaccuccaccaggagcucc

SEQ ID NO: 2546967 - RNA, 18 nt, Chlamydophila pneumoniae J138
gaacgaagacuuguucuu

SEQ ID NO: 2546968 - RNA, 19 nt, Chlamydophila pneumoniae J138
gaacgaagacuuguucuuc

SEQ ID NO: 2546969 - RNA, 16 nt, Chlamydophila pneumoniae J138
gaacgccccccccucu

SEQ ID NO: 2546970 - RNA, 19 nt, Chlamydophila pneumoniae J138
gaacgccccccccucucuc

SEQ ID NO: 2546971 - RNA, 15 nt, Chlamydophila pneumoniae J138
gaacgcugaguguau

SEQ ID NO: 2546972 - RNA, 16 nt, Chlamydophila pneumoniae J138
gaacguacuuagguaa

SEQ ID NO: 2546973 - RNA, 23 nt, Chlamydophila pneumoniae J138
gaacguagcagaggcagguaguc

SEQ ID NO: 2546974 - RNA, 16 nt, Chlamydophila pneumoniae J138
gaacguuacgucuuag

SEQ ID NO: 2546975 - RNA, 15 nt, Chlamydophila pneumoniae J138
gaacuaaaaguuuuu

SEQ ID NO: 2546976 - RNA, 19 nt, Chlamydophila pneumoniae J138
gaacuaaaaguuuuuuauu

SEQ ID NO: 2546977 - RNA, 13 nt, Chlamydophila pneumoniae J138
gaacuaacuguaa

SEQ ID NO: 2546978 - RNA, 16 nt, Chlamydophila pneumoniae J138
gaacuaacuguaauuu

SEQ ID NO: 2546979 - RNA, 22 nt, Chlamydophila pneumoniae J138
gaacuacgggcaauauauccag

SEQ ID NO: 2546980 - RNA, 17 nt, Chlamydophila pneumoniae J138
gaacuacuuaaauccua

SEQ ID NO: 2546981 - RNA, 13 nt, Chlamydophila pneumoniae J138
gaacuagaaaaaa

SEQ ID NO: 2546982 - RNA, 14 nt, Chlamydophila pneumoniae J138
gaacuauaggaagc

SEQ ID NO: 2546983 - RNA, 20 nt, Chlamydophila pneumoniae J138
gaacuauccuguuucaacau

SEQ ID NO: 2546984 - RNA, 14 nt, Chlamydophila pneumoniae J138
gaacucaucacaau

SEQ ID NO: 2546985 - RNA, 16 nt, Chlamydophila pneumoniae J138
gaacuccauucagaug

SEQ ID NO: 2546986 - RNA, 19 nt, Chlamydophila pneumoniae J138
gaacuccgcccgucuuaga

SEQ ID NO: 2546987 - RNA, 21 nt, Chlamydophila pneumoniae J138
gaacuccuuugagucuuuuuc

SEQ ID NO: 2546988 - RNA, 12 nt, Chlamydophila pneumoniae J138
gaacucugaagu

SEQ ID NO: 2546989 - RNA, 23 nt, Chlamydophila pneumoniae J138
gaacucuuaaagguaaagcuucu

SEQ ID NO: 2546990 - RNA, 15 nt, Chlamydophila pneumoniae J138
gaacucuuuaaaagg

SEQ ID NO: 2546991 - RNA, 13 nt, Chlamydophila pneumoniae J138
gaacugaagaguc

SEQ ID NO: 2546992 - RNA, 18 nt, Chlamydophila pneumoniae J138
gaacugggcauaguggcu

SEQ ID NO: 2546993 - RNA, 22 nt, Chlamydophila pneumoniae J138
gaacuguaacuugcauuuuuug

SEQ ID NO: 2546994 - RNA, 14 nt, Chlamydophila pneumoniae J138
gaacuuaaaauuca

SEQ ID NO: 2546995 - RNA, 16 nt, Chlamydophila pneumoniae J138
gaacuuaaaauucaaa

SEQ ID NO: 2546996 - RNA, 14 nt, Chlamydophila pneumoniae J138
gaacuucagcaaga

SEQ ID NO: 2546997 - RNA, 18 nt, Chlamydophila pneumoniae J138
gaacuucagcaagaaaau

SEQ ID NO: 2546998 - RNA, 19 nt, Chlamydophila pneumoniae J138
gaacuucagcaagaaaaua

SEQ ID NO: 2546999 - RNA, 15 nt, Chlamydophila pneumoniae J138
gaacuuccugauucu

SEQ ID NO: 2547000 - RNA, 20 nt, Chlamydophila pneumoniae J138
gaacuuuagggaagaaauua

SEQ ID NO: 2547001 - RNA, 16 nt, Chlamydophila pneumoniae J138
gaacuuucgucuuugc

SEQ ID NO: 2547002 - RNA, 22 nt, Chlamydophila pneumoniae J138
gaacuuugaccagaugauuuuu

SEQ ID NO: 2547003 - RNA, 22 nt, Chlamydophila pneumoniae J138
gaacuuuugggcccucucuuga

SEQ ID NO: 2547004 - RNA, 23 nt, Chlamydophila pneumoniae J138
gaagaaaauaaagaucuucauaa

SEQ ID NO: 2547005 - RNA, 16 nt, Chlamydophila pneumoniae J138
gaagaacuuagcaaug

SEQ ID NO: 2547006 - RNA, 16 nt, Chlamydophila pneumoniae J138
gaagaaggacaacuag

SEQ ID NO: 2547007 - RNA, 23 nt, Chlamydophila pneumoniae J138
gaagaaguacaagugaagacaag

SEQ ID NO: 2547008 - RNA, 17 nt, Chlamydophila pneumoniae J138
gaagaauuucauaagag

SEQ ID NO: 2547009 - RNA, 14 nt, Chlamydophila pneumoniae J138
gaagacacagggga

SEQ ID NO: 2547010 - RNA, 17 nt, Chlamydophila pneumoniae J138
gaagacaggagcuacug

SEQ ID NO: 2547011 - RNA, 22 nt, Chlamydophila pneumoniae J138
gaagaccccucuugcuuuuccg

SEQ ID NO: 2547012 - RNA, 19 nt, Chlamydophila pneumoniae J138
gaagacucucaucagcaaa

SEQ ID NO: 2547013 - RNA, 20 nt, Chlamydophila pneumoniae J138
gaagacucucaucagcaaaa

SEQ ID NO: 2547014 - RNA, 14 nt, Chlamydophila pneumoniae J138
gaagacuugcucug

SEQ ID NO: 2547015 - RNA, 17 nt, Chlamydophila pneumoniae J138
gaagacuuguucuucau

SEQ ID NO: 2547016 - RNA, 20 nt, Chlamydophila pneumoniae J138
gaagagaguauagucugguu

SEQ ID NO: 2547017 - RNA, 20 nt, Chlamydophila pneumoniae J138
gaagagcaauuaagaaacua

SEQ ID NO: 2547018 - RNA, 20 nt, Chlamydophila pneumoniae J138
gaagagcauuuaaaacggcu

SEQ ID NO: 2547019 - RNA, 13 nt, Chlamydophila pneumoniae J138
gaagagcuuccau

SEQ ID NO: 2547020 - RNA, 15 nt, Chlamydophila pneumoniae J138
gaagaguuguugugg

SEQ ID NO: 2547021 - RNA, 21 nt, Chlamydophila pneumoniae J138
gaagauauuaucgauaggaag

SEQ ID NO: 2547022 - RNA, 20 nt, Chlamydophila pneumoniae J138
gaagauccugaguauuuugc

SEQ ID NO: 2547023 - RNA, 17 nt, Chlamydophila pneumoniae J138
gaagaucuugaacagag

SEQ ID NO: 2547024 - RNA, 14 nt, Chlamydophila pneumoniae J138
gaagaugauauucu

SEQ ID NO: 2547025 - RNA, 13 nt, Chlamydophila pneumoniae J138
gaagaugauugga

SEQ ID NO: 2547026 - RNA, 23 nt, Chlamydophila pneumoniae J138
gaagauguauaaggauaucuucu

SEQ ID NO: 2547027 - RNA, 14 nt, Chlamydophila pneumoniae J138
gaagauucaaagaa

SEQ ID NO: 2547028 - RNA, 15 nt, Chlamydophila pneumoniae J138
gaagauucaaagaag

SEQ ID NO: 2547029 - RNA, 13 nt, Chlamydophila pneumoniae J138
gaagauucuuuaa

SEQ ID NO: 2547030 - RNA, 15 nt, Chlamydophila pneumoniae J138
gaagcaaagaaaauu

SEQ ID NO: 2547031 - RNA, 17 nt, Chlamydophila pneumoniae J138
gaagcaacuaaacucuc

SEQ ID NO: 2547032 - RNA, 18 nt, Chlamydophila pneumoniae J138
gaagcaacuaaacucucc

SEQ ID NO: 2547033 - RNA, 14 nt, Chlamydophila pneumoniae J138
gaagcaagaaucac

SEQ ID NO: 2547034 - RNA, 22 nt, Chlamydophila pneumoniae J138
gaagcacaccaaguacaguauc

SEQ ID NO: 2547035 - RNA, 12 nt, Chlamydophila pneumoniae J138
gaagcagaaacu

SEQ ID NO: 2547036 - RNA, 18 nt, Chlamydophila pneumoniae J138
gaagcagaaacuuuaaaa

SEQ ID NO: 2547037 - RNA, 17 nt, Chlamydophila pneumoniae J138
gaagcagggaaaaugcg

SEQ ID NO: 2547038 - RNA, 23 nt, Chlamydophila pneumoniae J138
gaagcauucccgacucaaucaaa

SEQ ID NO: 2547039 - RNA, 23 nt, Chlamydophila pneumoniae J138
gaagccagucuucauaagaguag

SEQ ID NO: 2547040 - RNA, 16 nt, Chlamydophila pneumoniae J138
gaagccuucauuccau

SEQ ID NO: 2547041 - RNA, 19 nt, Chlamydophila pneumoniae J138
gaagcgccgcauuacaggg

SEQ ID NO: 2547042 - RNA, 21 nt, Chlamydophila pneumoniae J138
gaagcgccgcauuacagggaa

SEQ ID NO: 2547043 - RNA, 14 nt, Chlamydophila pneumoniae J138
gaagcguuaacaac

SEQ ID NO: 2547044 - RNA, 19 nt, Chlamydophila pneumoniae J138
gaagcuccucacaucuccu

SEQ ID NO: 2547045 - RNA, 15 nt, Chlamydophila pneumoniae J138
gaagcucuaucuuug

SEQ ID NO: 2547046 - RNA, 17 nt, Chlamydophila pneumoniae J138
gaagcucuucuacuuua

SEQ ID NO: 2547047 - RNA, 15 nt, Chlamydophila pneumoniae J138
gaagcugacaaauag

SEQ ID NO: 2547048 - RNA, 20 nt, Chlamydophila pneumoniae J138
gaagcugagaauacaacccu

SEQ ID NO: 2547049 - RNA, 18 nt, Chlamydophila pneumoniae J138
gaagcugcucguuuuagc

SEQ ID NO: 2547050 - RNA, 16 nt, Chlamydophila pneumoniae J138
gaagcugcuucuucag

SEQ ID NO: 2547051 - RNA, 21 nt, Chlamydophila pneumoniae J138
gaagcuuccaucguuagauuu

SEQ ID NO: 2547052 - RNA, 15 nt, Chlamydophila pneumoniae J138
gaaggacaacuagac

SEQ ID NO: 2547053 - RNA, 12 nt, Chlamydophila pneumoniae J138
gaaggaguucuu

SEQ ID NO: 2547054 - RNA, 15 nt, Chlamydophila pneumoniae J138
gaaggcaccaacacu

SEQ ID NO: 2547055 - RNA, 20 nt, Chlamydophila pneumoniae J138
gaagggauguuuaauacaaa

SEQ ID NO: 2547056 - RNA, 14 nt, Chlamydophila pneumoniae J138
gaaggggaagagga

SEQ ID NO: 2547057 - RNA, 21 nt, Chlamydophila pneumoniae J138
cugcaaagcccccucccccac

SEQ ID NO: 2547058 - RNA, 14 nt, Chlamydophila pneumoniae J138
cugcacaguucaca

SEQ ID NO: 2547059 - RNA, 23 nt, Chlamydophila pneumoniae J138
cugcacgaucgcgauaagaagcu

SEQ ID NO: 2547060 - RNA, 20 nt, Chlamydophila pneumoniae J138
cugcacguggcuuuuguauu

SEQ ID NO: 2547061 - RNA, 11 nt, Chlamydophila pneumoniae J138
cugcagaagua

SEQ ID NO: 2547062 - RNA, 17 nt, Chlamydophila pneumoniae J138
cugcagagaaauucaug

SEQ ID NO: 2547063 - RNA, 12 nt, Chlamydophila pneumoniae J138
cugcagcaaaac

SEQ ID NO: 2547064 - RNA, 16 nt, Chlamydophila pneumoniae J138
cugcagcagaugaaac

SEQ ID NO: 2547065 - RNA, 23 nt, Chlamydophila pneumoniae J138
cugcagcagccuuggcucuagaa

SEQ ID NO: 2547066 - RNA, 19 nt, Chlamydophila pneumoniae J138
cugcagcaggugucagacu

SEQ ID NO: 2547067 - RNA, 16 nt, Chlamydophila pneumoniae J138
cugcagcguuucuagg

SEQ ID NO: 2547068 - RNA, 17 nt, Chlamydophila pneumoniae J138
cugcagguaagggaugc

SEQ ID NO: 2547069 - RNA, 21 nt, Chlamydophila pneumoniae J138
cugcaguauuauaaauagaaa

SEQ ID NO: 2547070 - RNA, 16 nt, Chlamydophila pneumoniae J138
cugcauaaucucacca

SEQ ID NO: 2547071 - RNA, 18 nt, Chlamydophila pneumoniae J138
cugcauaaucucaccaga

SEQ ID NO: 2547072 - RNA, 20 nt, Chlamydophila pneumoniae J138
cugcauaaucucaccagaag

SEQ ID NO: 2547073 - RNA, 15 nt, Chlamydophila pneumoniae J138
cugcauaauuuuucu

SEQ ID NO: 2547074 - RNA, 16 nt, Chlamydophila pneumoniae J138
cugcauaauuuuucuu

SEQ ID NO: 2547075 - RNA, 20 nt, Chlamydophila pneumoniae J138
cugcauacccuucuucuuca

SEQ ID NO: 2547076 - RNA, 14 nt, Chlamydophila pneumoniae J138
cugcauauaaagac

SEQ ID NO: 2547077 - RNA, 19 nt, Chlamydophila pneumoniae J138
cugcaucccaccgacaaga

SEQ ID NO: 2547078 - RNA, 11 nt, Chlamydophila pneumoniae J138
cugcauggcuu

SEQ ID NO: 2547079 - RNA, 14 nt, Chlamydophila pneumoniae J138
cugcauguugcaaa

SEQ ID NO: 2547080 - RNA, 13 nt, Chlamydophila pneumoniae J138
cugcauuccagga

SEQ ID NO: 2547081 - RNA, 19 nt, Chlamydophila pneumoniae J138
cugccagugacauaaucac

SEQ ID NO: 2547082 - RNA, 14 nt, Chlamydophila pneumoniae J138
cugcccuucggacu

SEQ ID NO: 2547083 - RNA, 15 nt, Chlamydophila pneumoniae J138
cugccucacagcuaa

SEQ ID NO: 2547084 - RNA, 20 nt, Chlamydophila pneumoniae J138
cugccuuaugcucauuaaua

SEQ ID NO: 2547085 - RNA, 23 nt, Chlamydophila pneumoniae J138
cugcgacacgaauuucuaacuua

SEQ ID NO: 2547086 - RNA, 16 nt, Chlamydophila pneumoniae J138
cugcgcaaagaacuca

SEQ ID NO: 2547087 - RNA, 15 nt, Chlamydophila pneumoniae J138
cugcgccaugcacaa

SEQ ID NO: 2547088 - RNA, 16 nt, Chlamydophila pneumoniae J138
cugcgcuagcuccagc

SEQ ID NO: 2547089 - RNA, 17 nt, Chlamydophila pneumoniae J138
cugcgcuagcuccagca

SEQ ID NO: 2547090 - RNA, 18 nt, Chlamydophila pneumoniae J138
cugcgcuaucaucauuuc

SEQ ID NO: 2547091 - RNA, 15 nt, Chlamydophila pneumoniae J138
cugcggaaggcuaaa

SEQ ID NO: 2547092 - RNA, 17 nt, Chlamydophila pneumoniae J138
cugcgucaauaagcuug

SEQ ID NO: 2547093 - RNA, 20 nt, Chlamydophila pneumoniae J138
cugcgugauuauuuaagacc

SEQ ID NO: 2547094 - RNA, 22 nt, Chlamydophila pneumoniae J138
cugcgugauuauuuaagaccaa

SEQ ID NO: 2547095 - RNA, 17 nt, Chlamydophila pneumoniae J138
cugcguuaaacccuuca

SEQ ID NO: 2547096 - RNA, 20 nt, Chlamydophila pneumoniae J138
cugcguuaaacccuucaagc

SEQ ID NO: 2547097 - RNA, 13 nt, Chlamydophila pneumoniae J138
cugcuaccugugu

SEQ ID NO: 2547098 - RNA, 23 nt, Chlamydophila pneumoniae J138
cugcuacgugaucaaaauuaucc

SEQ ID NO: 2547099 - RNA, 17 nt, Chlamydophila pneumoniae J138
cugcuacuuuaaagugg

SEQ ID NO: 2547100 - RNA, 12 nt, Chlamydophila pneumoniae J138
cugcuagagcuu

SEQ ID NO: 2547101 - RNA, 19 nt, Chlamydophila pneumoniae J138
cugcuagaguccaagguuc

SEQ ID NO: 2547102 - RNA, 17 nt, Chlamydophila pneumoniae J138
cugcucccuccuccucg

SEQ ID NO: 2547103 - RNA, 13 nt, Chlamydophila pneumoniae J138
cugcuccugaagc

SEQ ID NO: 2547104 - RNA, 15 nt, Chlamydophila pneumoniae J138
cugcuccugaagcug

SEQ ID NO: 2547105 - RNA, 22 nt, Chlamydophila pneumoniae J138
cugcucuauagcauuauucccu

SEQ ID NO: 2547106 - RNA, 21 nt, Chlamydophila pneumoniae J138
cugcucuauauauccugagug

SEQ ID NO: 2547107 - RNA, 22 nt, Chlamydophila pneumoniae J138
cugcucuauauauccugaguga

SEQ ID NO: 2547108 - RNA, 15 nt, Chlamydophila pneumoniae J138
cugcugagcagcaaa

SEQ ID NO: 2547109 - RNA, 17 nt, Chlamydophila pneumoniae J138
cugcugccaugcagccu

SEQ ID NO: 2547110 - RNA, 12 nt, Chlamydophila pneumoniae J138
cugcugcuacga

SEQ ID NO: 2547111 - RNA, 19 nt, Chlamydophila pneumoniae J138
cugcuuacaauugaaaauu

SEQ ID NO: 2547112 - RNA, 15 nt, Chlamydophila pneumoniae J138
cugcuucaaaacaua

SEQ ID NO: 2547113 - RNA, 15 nt, Chlamydophila pneumoniae J138
cugcuucgaccauaa

SEQ ID NO: 2547114 - RNA, 15 nt, Chlamydophila pneumoniae J138
cugcuugugaggcua

SEQ ID NO: 2547115 - RNA, 14 nt, Chlamydophila pneumoniae J138
cugcuuuuguuguu

SEQ ID NO: 2547116 - RNA, 18 nt, Chlamydophila pneumoniae J138
cugcuuuuguuguuuuug

SEQ ID NO: 2547117 - RNA, 14 nt, Chlamydophila pneumoniae J138
cugcuuuuuuucua

SEQ ID NO: 2547118 - RNA, 20 nt, Chlamydophila pneumoniae J138
cugcuuuuuuucuagaguuc

SEQ ID NO: 2547119 - RNA, 22 nt, Chlamydophila pneumoniae J138
cuggaaagccaagcuuccaacu

SEQ ID NO: 2547120 - RNA, 22 nt, Chlamydophila pneumoniae J138
cuggaaaugaauauaauuccaa

SEQ ID NO: 2547121 - RNA, 18 nt, Chlamydophila pneumoniae J138
cuggaagaauuucauaag

SEQ ID NO: 2547122 - RNA, 19 nt, Chlamydophila pneumoniae J138
cuggaaugacauaagcacu

SEQ ID NO: 2547123 - RNA, 15 nt, Chlamydophila pneumoniae J138
cuggaaugacuaaau

SEQ ID NO: 2547124 - RNA, 21 nt, Chlamydophila pneumoniae J138
cuggagaaugccccuucguua

SEQ ID NO: 2547125 - RNA, 21 nt, Chlamydophila pneumoniae J138
cuggagacaacuauguuaucc

SEQ ID NO: 2547126 - RNA, 17 nt, Chlamydophila pneumoniae J138
cuggagagguaaccaga

SEQ ID NO: 2547127 - RNA, 24 nt, Chlamydophila pneumoniae J138
cuggaggcgguggcaugccauaau

SEQ ID NO: 2547128 - RNA, 18 nt, Chlamydophila pneumoniae J138
cuggauugauccacagau

SEQ ID NO: 2547129 - RNA, 19 nt, Chlamydophila pneumoniae J138
cuggauuucuucuguuuuc

SEQ ID NO: 2547130 - RNA, 13 nt, Chlamydophila pneumoniae J138
cuggcuaaaggau

SEQ ID NO: 2547131 - RNA, 21 nt, Chlamydophila pneumoniae J138
cuggcuaaaggaucauuaaag

SEQ ID NO: 2547132 - RNA, 14 nt, Chlamydophila pneumoniae J138
cuggcuauggaaga

SEQ ID NO: 2547133 - RNA, 17 nt, Chlamydophila pneumoniae J138
cugggaagaccacgaaa

SEQ ID NO: 2547134 - RNA, 12 nt, Chlamydophila pneumoniae J138
cugggaagacuc

SEQ ID NO: 2547135 - RNA, 15 nt, Chlamydophila pneumoniae J138
cugggaagacucuca

SEQ ID NO: 2547136 - RNA, 19 nt, Chlamydophila pneumoniae J138
cugggaaggggagauuccc

SEQ ID NO: 2547137 - RNA, 14 nt, Chlamydophila pneumoniae J138
cugggaauucuuuu

SEQ ID NO: 2547138 - RNA, 20 nt, Chlamydophila pneumoniae J138
cugggaauucuuuuccugca

SEQ ID NO: 2547139 - RNA, 18 nt, Chlamydophila pneumoniae J138
cugggaauuguucuugaa

SEQ ID NO: 2547140 - RNA, 21 nt, Chlamydophila pneumoniae J138
cugggaauuguucuugaaguu

SEQ ID NO: 2547141 - RNA, 19 nt, Chlamydophila pneumoniae J138
cugggauguucaaagccau

SEQ ID NO: 2547142 - RNA, 14 nt, Chlamydophila pneumoniae J138
cugggauucguaau

SEQ ID NO: 2547143 - RNA, 20 nt, Chlamydophila pneumoniae J138
cugggggagcuagaaagucc

SEQ ID NO: 2547144 - RNA, 23 nt, Chlamydophila pneumoniae J138
cugggugcgucguaaucuuuuuu

SEQ ID NO: 2547145 - RNA, 21 nt, Chlamydophila pneumoniae J138
cuggguucuccacaugcccaa

SEQ ID NO: 2547146 - RNA, 17 nt, Chlamydophila pneumoniae J138
cugguacuuauguacug

SEQ ID NO: 2547147 - RNA, 18 nt, Chlamydophila pneumoniae J138
cugguccuaaaaaaagac

SEQ ID NO: 2547148 - RNA, 18 nt, Chlamydophila pneumoniae J138
cuggucuguauuuucuuc

SEQ ID NO: 2547149 - RNA, 19 nt, Chlamydophila pneumoniae J138
cuggucuguauuuucuuca

SEQ ID NO: 2547150 - RNA, 15 nt, Chlamydophila pneumoniae J138
cugguuuuucgauuu

SEQ ID NO: 2547151 - RNA, 17 nt, Chlamydophila pneumoniae J138
cugguuuuucuccugac

SEQ ID NO: 2547152 - RNA, 13 nt, Chlamydophila pneumoniae J138
cuguaaagauucu

SEQ ID NO: 2547153 - RNA, 20 nt, Chlamydophila pneumoniae J138
cuguaacacccucccucaua

SEQ ID NO: 2547154 - RNA, 19 nt, Chlamydophila pneumoniae J138
cuguaaccaacaucaaaga

SEQ ID NO: 2547155 - RNA, 18 nt, Chlamydophila pneumoniae J138
cuguaacuugcauuuuuu

SEQ ID NO: 2547156 - RNA, 17 nt, Chlamydophila pneumoniae J138
cuguaagaauccuugcu

SEQ ID NO: 2547157 - RNA, 23 nt, Chlamydophila pneumoniae J138
cuguaauuuuuuucaaaggagaa

SEQ ID NO: 2547158 - RNA, 16 nt, Chlamydophila pneumoniae J138
cuguaccacauacucu

SEQ ID NO: 2547159 - RNA, 13 nt, Chlamydophila pneumoniae J138
cuguacgguaaau

SEQ ID NO: 2547160 - RNA, 17 nt, Chlamydophila pneumoniae J138
cuguagaaacauuuaag

SEQ ID NO: 2547161 - RNA, 22 nt, Chlamydophila pneumoniae J138
cuguagaaacauuuaagucauu

SEQ ID NO: 2547162 - RNA, 21 nt, Chlamydophila pneumoniae J138
cuguagagcgcccgaaucuuu

SEQ ID NO: 2547163 - RNA, 20 nt, Chlamydophila pneumoniae J138
cuguagauuuucccuaagag

SEQ ID NO: 2547164 - RNA, 22 nt, Chlamydophila pneumoniae J138
cuguagguuuuuccaacuucaa

SEQ ID NO: 2547165 - RNA, 18 nt, Chlamydophila pneumoniae J138
cuguaguaaaauaagaaa

SEQ ID NO: 2547166 - RNA, 16 nt, Chlamydophila pneumoniae J138
cuguagugauacuuua

SEQ ID NO: 2547167 - RNA, 20 nt, Chlamydophila pneumoniae J138
cuguaguuagcauugcuugc

SEQ ID NO: 2547168 - RNA, 17 nt, Chlamydophila pneumoniae J138
cuguauagaaacuguua

SEQ ID NO: 2547169 - RNA, 19 nt, Chlamydophila pneumoniae J138
cuguaucgacuguacaaau

SEQ ID NO: 2547170 - RNA, 18 nt, Chlamydophila pneumoniae J138
cuguaucgauaguuuuug

SEQ ID NO: 2547171 - RNA, 21 nt, Chlamydophila pneumoniae J138
cuguaucgauaguuuuugcug

SEQ ID NO: 2547172 - RNA, 22 nt, Chlamydophila pneumoniae J138
cuguauuaaagaaucuaacucu

SEQ ID NO: 2547173 - RNA, 15 nt, Chlamydophila pneumoniae J138
cuguauuuucagcac

SEQ ID NO: 2547174 - RNA, 16 nt, Chlamydophila pneumoniae J138
cugucacuaucuucua

SEQ ID NO: 2547175 - RNA, 17 nt, Chlamydophila pneumoniae J138
cugucacuaucuucuaa

SEQ ID NO: 2547176 - RNA, 12 nt, Chlamydophila pneumoniae J138
cugucagaacaa

SEQ ID NO: 2547177 - RNA, 14 nt, Chlamydophila pneumoniae J138
cugucauccuugcg

SEQ ID NO: 2547178 - RNA, 21 nt, Chlamydophila pneumoniae J138
cuguccaacuaaaacagccua

SEQ ID NO: 2547179 - RNA, 14 nt, Chlamydophila pneumoniae J138
cuguccuccgagaa

SEQ ID NO: 2547180 - RNA, 17 nt, Chlamydophila pneumoniae J138
cuguccuugcagcccug

SEQ ID NO: 2547181 - RNA, 19 nt, Chlamydophila pneumoniae J138
cugucguccuaauuuuccu

SEQ ID NO: 2547182 - RNA, 23 nt, Chlamydophila pneumoniae J138
cugucuauaagauagcucuugcg

SEQ ID NO: 2547183 - RNA, 17 nt, Chlamydophila pneumoniae J138
cugucuuaucuaaagaa

SEQ ID NO: 2547184 - RNA, 21 nt, Chlamydophila pneumoniae J138
cugugauagguagcagcccgc

SEQ ID NO: 2547185 - RNA, 14 nt, Chlamydophila pneumoniae J138
cugugauaguagaa

SEQ ID NO: 2547186 - RNA, 22 nt, Chlamydophila pneumoniae J138
cugugauuuccugacuauaaaa

SEQ ID NO: 2547187 - RNA, 12 nt, Chlamydophila pneumoniae J138
cugugcauuuuc

SEQ ID NO: 2547188 - RNA, 13 nt, Chlamydophila pneumoniae J138
cugugcauuuucu

SEQ ID NO: 2547189 - RNA, 18 nt, Chlamydophila pneumoniae J138
cugugcauuuucuucuug

SEQ ID NO: 2547190 - RNA, 14 nt, Chlamydophila pneumoniae J138
cuguggaauuuucc

SEQ ID NO: 2547191 - RNA, 19 nt, Chlamydophila pneumoniae J138
cuguggcauacucuuugca

SEQ ID NO: 2547192 - RNA, 23 nt, Chlamydophila pneumoniae J138
cuguggcguaagcaauaucuaua

SEQ ID NO: 2547193 - RNA, 14 nt, Chlamydophila pneumoniae J138
cugugguauacauc

SEQ ID NO: 2547194 - RNA, 14 nt, Chlamydophila pneumoniae J138
cugugguuccugga

SEQ ID NO: 2547195 - RNA, 16 nt, Chlamydophila pneumoniae J138
cugugguuccuggauu

SEQ ID NO: 2547196 - RNA, 15 nt, Chlamydophila pneumoniae J138
cugugguuuuuauuc

SEQ ID NO: 2547197 - RNA, 16 nt, Chlamydophila pneumoniae J138
cuguguuuuauccacc

SEQ ID NO: 2547198 - RNA, 15 nt, Chlamydophila pneumoniae J138
cuguguuuucuaguc

SEQ ID NO: 2547199 - RNA, 13 nt, Chlamydophila pneumoniae J138
cuguguuuuuagg

SEQ ID NO: 2547200 - RNA, 14 nt, Chlamydophila pneumoniae J138
cuguuaacaagauu

SEQ ID NO: 2547201 - RNA, 16 nt, Chlamydophila pneumoniae J138
cuguuccaagagucuu

SEQ ID NO: 2547202 - RNA, 17 nt, Chlamydophila pneumoniae J138
cuguucccacuaagaau

SEQ ID NO: 2547203 - RNA, 17 nt, Chlamydophila pneumoniae J138
cuguucgauaagaacuu

SEQ ID NO: 2547204 - RNA, 16 nt, Chlamydophila pneumoniae J138
cuguucuucuucaguc

SEQ ID NO: 2547205 - RNA, 14 nt, Chlamydophila pneumoniae J138
cuguugaucuucua

SEQ ID NO: 2547206 - RNA, 15 nt, Chlamydophila pneumoniae J138
cuguugcacuuuccg

SEQ ID NO: 2547207 - RNA, 19 nt, Chlamydophila pneumoniae J138
cuguugggagcuuccucca

SEQ ID NO: 2547208 - RNA, 20 nt, Chlamydophila pneumoniae J138
cuguugggagcuuccuccaa

SEQ ID NO: 2547209 - RNA, 17 nt, Chlamydophila pneumoniae J138
cuguuggucucuauuua

SEQ ID NO: 2547210 - RNA, 18 nt, Chlamydophila pneumoniae J138
cuguuguaauaaaagaaa

SEQ ID NO: 2547211 - RNA, 13 nt, Chlamydophila pneumoniae J138
cuguuuacagaug

SEQ ID NO: 2547212 - RNA, 19 nt, Chlamydophila pneumoniae J138
cuguuuauggauuaucuua

SEQ ID NO: 2547213 - RNA, 13 nt, Chlamydophila pneumoniae J138
cuguuuguuuauu

SEQ ID NO: 2547214 - RNA, 17 nt, Chlamydophila pneumoniae J138
cuguuuuucguaagcug

SEQ ID NO: 2547215 - RNA, 17 nt, Chlamydophila pneumoniae J138
cuguuuuucuuccacac

SEQ ID NO: 2547216 - RNA, 22 nt, Chlamydophila pneumoniae J138
cuguuuuuugaaaacuucaaaa

SEQ ID NO: 2547217 - RNA, 16 nt, Chlamydophila pneumoniae J138
cuuaaaaaacuuccua

SEQ ID NO: 2547218 - RNA, 17 nt, Chlamydophila pneumoniae J138
cuuaaaaaacuuccuaa

SEQ ID NO: 2547219 - RNA, 14 nt, Chlamydophila pneumoniae J138
cuuaaaacaugaga

SEQ ID NO: 2547220 - RNA, 19 nt, Chlamydophila pneumoniae J138
cuuaaaagagaacauguuu

SEQ ID NO: 2547221 - RNA, 14 nt, Chlamydophila pneumoniae J138
cuuaaaauuccuga

SEQ ID NO: 2547222 - RNA, 20 nt, Chlamydophila pneumoniae J138
cuuaaaauucuguaaaguga

SEQ ID NO: 2547223 - RNA, 16 nt, Chlamydophila pneumoniae J138
cuuaaagcuugagaaa

SEQ ID NO: 2547224 - RNA, 23 nt, Chlamydophila pneumoniae J138
cuuaaagguaaaacuacaggaaa

SEQ ID NO: 2547225 - RNA, 11 nt, Chlamydophila pneumoniae J138
cuuaacaacau

SEQ ID NO: 2547226 - RNA, 19 nt, Chlamydophila pneumoniae J138
cuuaacaaccgccuuuaua

SEQ ID NO: 2547227 - RNA, 13 nt, Chlamydophila pneumoniae J138
cuuaaccuccuca

SEQ ID NO: 2547228 - RNA, 17 nt, Chlamydophila pneumoniae J138
cuuaaccuccucaagaa

SEQ ID NO: 2547229 - RNA, 16 nt, Chlamydophila pneumoniae J138
cuuaacuuuaggcccu

SEQ ID NO: 2547230 - RNA, 22 nt, Chlamydophila pneumoniae J138
cuuaagaauaaaauaggaaagu

SEQ ID NO: 2547231 - RNA, 17 nt, Chlamydophila pneumoniae J138
cuuaagaguuuuacauc

SEQ ID NO: 2547232 - RNA, 17 nt, Chlamydophila pneumoniae J138
cuuaagcucuaagucca

SEQ ID NO: 2547233 - RNA, 15 nt, Chlamydophila pneumoniae J138
cuuaauaauguuuua

SEQ ID NO: 2547234 - RNA, 17 nt, Chlamydophila pneumoniae J138
cuuaauaauguuuuaau

SEQ ID NO: 2547235 - RNA, 14 nt, Chlamydophila pneumoniae J138
cuuaauauaaaaga

SEQ ID NO: 2547236 - RNA, 20 nt, Chlamydophila pneumoniae J138
cuuaaugguagcuuaagaau

SEQ ID NO: 2547237 - RNA, 13 nt, Chlamydophila pneumoniae J138
cuuaauuaaaaac

SEQ ID NO: 2547238 - RNA, 20 nt, Chlamydophila pneumoniae J138
cuuacaauuuaaaucugcaa

SEQ ID NO: 2547239 - RNA, 15 nt, Chlamydophila pneumoniae J138
cuuacauaaaccuuu

SEQ ID NO: 2547240 - RNA, 16 nt, Chlamydophila pneumoniae J138
cuuacauccaauuuug

SEQ ID NO: 2547241 - RNA, 15 nt, Chlamydophila pneumoniae J138
cuuaccaauaugcuc

SEQ ID NO: 2547242 - RNA, 23 nt, Chlamydophila pneumoniae J138
cuuacggccccuggaauuucucc

SEQ ID NO: 2547243 - RNA, 20 nt, Chlamydophila pneumoniae J138
cuuacuaaagaaagagucuc

SEQ ID NO: 2547244 - RNA, 14 nt, Chlamydophila pneumoniae J138
cuuacugaagaagu

SEQ ID NO: 2547245 - RNA, 22 nt, Chlamydophila pneumoniae J138
cuuagaagggaaaguaccuuua

SEQ ID NO: 2547246 - RNA, 18 nt, Chlamydophila pneumoniae J138
cuuagaaucuaagauccu

SEQ ID NO: 2547247 - RNA, 20 nt, Chlamydophila pneumoniae J138
cuuagagcgaauguagccaa

SEQ ID NO: 2547248 - RNA, 19 nt, Chlamydophila pneumoniae J138
cuuagagucuucgacaagg

SEQ ID NO: 2547249 - RNA, 14 nt, Chlamydophila pneumoniae J138
cuuagaucuuuucu

SEQ ID NO: 2547250 - RNA, 16 nt, Chlamydophila pneumoniae J138
cuuagcaaucaguaaa

SEQ ID NO: 2547251 - RNA, 15 nt, Chlamydophila pneumoniae J138
cuuagcagcacccau

SEQ ID NO: 2547252 - RNA, 17 nt, Chlamydophila pneumoniae J138
cuuagcauuaggaaagu

SEQ ID NO: 2547253 - RNA, 16 nt, Chlamydophila pneumoniae J138
cuuagccccuccaaca

SEQ ID NO: 2547254 - RNA, 15 nt, Chlamydophila pneumoniae J138
cuuaggauucuuauc

SEQ ID NO: 2547255 - RNA, 20 nt, Chlamydophila pneumoniae J138
cuuaggauucuuaucacaaa

SEQ ID NO: 2547256 - RNA, 14 nt, Chlamydophila pneumoniae J138
cuuauaagcugcuu

SEQ ID NO: 2547257 - RNA, 13 nt, Chlamydophila pneumoniae J138
cuuauacacucca

SEQ ID NO: 2547258 - RNA, 16 nt, Chlamydophila pneumoniae J138
cuuauacccacaaaga

SEQ ID NO: 2547259 - RNA, 19 nt, Chlamydophila pneumoniae J138
cuuauauuggcuuucuaca

SEQ ID NO: 2547260 - RNA, 17 nt, Chlamydophila pneumoniae J138
cuuaucaagagcucgua

SEQ ID NO: 2547261 - RNA, 18 nt, Chlamydophila pneumoniae J138
cuuaucaugaaaaggauu

SEQ ID NO: 2547262 - RNA, 14 nt, Chlamydophila pneumoniae J138
cuuaucuaaagaaa

SEQ ID NO: 2547263 - RNA, 17 nt, Chlamydophila pneumoniae J138
cuuaucuaaagaaaugu

SEQ ID NO: 2547264 - RNA, 22 nt, Chlamydophila pneumoniae J138
cuuaucuugcugcccaaauuga

SEQ ID NO: 2547265 - RNA, 22 nt, Chlamydophila pneumoniae J138
cuuaugguuuuucaguuguuuc

SEQ ID NO: 2547266 - RNA, 17 nt, Chlamydophila pneumoniae J138
cuuauguagauugaucc

SEQ ID NO: 2547267 - RNA, 21 nt, Chlamydophila pneumoniae J138
cuuauguagauugauccagcc

SEQ ID NO: 2547268 - RNA, 22 nt, Chlamydophila pneumoniae J138
cuuauguuaaaaauaccaagau

SEQ ID NO: 2547269 - RNA, 15 nt, Chlamydophila pneumoniae J138
cuuauuacagaaagg

SEQ ID NO: 2547270 - RNA, 22 nt, Chlamydophila pneumoniae J138
cuuauuacagaaaggcuuuucu

SEQ ID NO: 2547271 - RNA, 17 nt, Chlamydophila pneumoniae J138
cuuauuauugaauaagc

SEQ ID NO: 2547272 - RNA, 15 nt, Chlamydophila pneumoniae J138
cuuauugcagaaucu

SEQ ID NO: 2547273 - RNA, 18 nt, Chlamydophila pneumoniae J138
cuuauuucuguaguucuu

SEQ ID NO: 2547274 - RNA, 19 nt, Chlamydophila pneumoniae J138
cuucaaaacauaaccuccu

SEQ ID NO: 2547275 - RNA, 21 nt, Chlamydophila pneumoniae J138
cuucaaaaguuccccaauuuc

SEQ ID NO: 2547276 - RNA, 18 nt, Chlamydophila pneumoniae J138
cuucaaaauguuuaucga

SEQ ID NO: 2547277 - RNA, 20 nt, Chlamydophila pneumoniae J138
cuucaaagauauagauucau

SEQ ID NO: 2547278 - RNA, 18 nt, Chlamydophila pneumoniae J138
cuucaaagucaaauacuu

SEQ ID NO: 2547279 - RNA, 12 nt, Chlamydophila pneumoniae J138
cuucaacucuau

SEQ ID NO: 2547280 - RNA, 16 nt, Chlamydophila pneumoniae J138
cuucaagaaaaacccc

SEQ ID NO: 2547281 - RNA, 16 nt, Chlamydophila pneumoniae J138
cuucaagccaaaacca

SEQ ID NO: 2547282 - RNA, 19 nt, Chlamydophila pneumoniae J138
cuucaaggcaucuucuuug

SEQ ID NO: 2547283 - RNA, 18 nt, Chlamydophila pneumoniae J138
cuucaagucgagaaacaa

SEQ ID NO: 2547284 - RNA, 19 nt, Chlamydophila pneumoniae J138
cuucaaguuucuuuugcaa

SEQ ID NO: 2547285 - RNA, 22 nt, Chlamydophila pneumoniae J138
cuucaaguuucuuuugcaaauc

SEQ ID NO: 2547286 - RNA, 22 nt, Chlamydophila pneumoniae J138
cuucaauacgcuagcucuuaaa

SEQ ID NO: 2547287 - RNA, 21 nt, Chlamydophila pneumoniae J138
cuucaauaggaauuagagaaa

SEQ ID NO: 2547288 - RNA, 18 nt, Chlamydophila pneumoniae J138
cuucaauagguaaggaaa

SEQ ID NO: 2547289 - RNA, 15 nt, Chlamydophila pneumoniae J138
cuucaaugauguguu

SEQ ID NO: 2547290 - RNA, 17 nt, Chlamydophila pneumoniae J138
cuucaaugauuucuuua

SEQ ID NO: 2547291 - RNA, 13 nt, Chlamydophila pneumoniae J138
cuucaauuucuuc

SEQ ID NO: 2547292 - RNA, 15 nt, Chlamydophila pneumoniae J138
cuucacaaagaacca

SEQ ID NO: 2547293 - RNA, 21 nt, Chlamydophila pneumoniae J138
cuucacuauuaggcuuuuuuc

SEQ ID NO: 2547294 - RNA, 16 nt, Chlamydophila pneumoniae J138
cuucacucuuucugua

SEQ ID NO: 2547295 - RNA, 19 nt, Chlamydophila pneumoniae J138
cuucacuuauaagcugcuu

SEQ ID NO: 2547296 - RNA, 16 nt, Chlamydophila pneumoniae J138
cuucagaaucuuugug

SEQ ID NO: 2547297 - RNA, 17 nt, Chlamydophila pneumoniae J138
cuucagaaucuuuguga

SEQ ID NO: 2547298 - RNA, 23 nt, Chlamydophila pneumoniae J138
cuucagagauuuuaaagccuccu

SEQ ID NO: 2547299 - RNA, 20 nt, Chlamydophila pneumoniae J138
cuucagauccgauauacuua

SEQ ID NO: 2547300 - RNA, 22 nt, Chlamydophila pneumoniae J138
cuucagcauagagagaaggaau

SEQ ID NO: 2547301 - RNA, 22 nt, Chlamydophila pneumoniae J138
cuucagcccacuguuuugcuuc

SEQ ID NO: 2547302 - RNA, 18 nt, Chlamydophila pneumoniae J138
cuucaggacgcacauuua

SEQ ID NO: 2547303 - RNA, 16 nt, Chlamydophila pneumoniae J138
cuucaggauuacggaa

SEQ ID NO: 2547304 - RNA, 20 nt, Chlamydophila pneumoniae J138
cuucaggauuacggaaaaua

SEQ ID NO: 2547305 - RNA, 21 nt, Chlamydophila pneumoniae J138
cuucaggugaaggaagaucuu

SEQ ID NO: 2547306 - RNA, 21 nt, Chlamydophila pneumoniae J138
cuucauauaaaacgaucccua

SEQ ID NO: 2547307 - RNA, 19 nt, Chlamydophila pneumoniae J138
cuucaucaaaacauaauga

SEQ ID NO: 2547308 - RNA, 21 nt, Chlamydophila pneumoniae J138
cuucaucagaagguaaauuuu

SEQ ID NO: 2547309 - RNA, 15 nt, Chlamydophila pneumoniae J138
cuucaucauaacuag

SEQ ID NO: 2547310 - RNA, 18 nt, Chlamydophila pneumoniae J138
cuucaucuucuaaauccc

SEQ ID NO: 2547311 - RNA, 11 nt, Chlamydophila pneumoniae J138
cuucauucaca

SEQ ID NO: 2547312 - RNA, 14 nt, Chlamydophila pneumoniae J138
cuucauuccaugag

SEQ ID NO: 2547313 - RNA, 15 nt, Chlamydophila pneumoniae J138
cuucauugcaaaaau

SEQ ID NO: 2547314 - RNA, 19 nt, Chlamydophila pneumoniae J138
cuuccaaaacgauccuguu

SEQ ID NO: 2547315 - RNA, 17 nt, Chlamydophila pneumoniae J138
cuuccaaaaguaggggc

SEQ ID NO: 2547316 - RNA, 19 nt, Chlamydophila pneumoniae J138
cuuccaaaaguaggggcag

SEQ ID NO: 2547317 - RNA, 18 nt, Chlamydophila pneumoniae J138
cuuccaacuucuguaucg

SEQ ID NO: 2547318 - RNA, 16 nt, Chlamydophila pneumoniae J138
cuuccaagugcucagu

SEQ ID NO: 2547319 - RNA, 16 nt, Chlamydophila pneumoniae J138
cuuccaauuguaaauc

SEQ ID NO: 2547320 - RNA, 20 nt, Chlamydophila pneumoniae J138
cuuccacuguucuucuucag

SEQ ID NO: 2547321 - RNA, 13 nt, Chlamydophila pneumoniae J138
cuuccagcuucuc

SEQ ID NO: 2547322 - RNA, 11 nt, Chlamydophila pneumoniae J138
cuuccauacag

SEQ ID NO: 2547323 - RNA, 23 nt, Chlamydophila pneumoniae J138
cuuccauacaggcuccucugcua

SEQ ID NO: 2547324 - RNA, 18 nt, Chlamydophila pneumoniae J138
cuuccauagcuuuagaag

SEQ ID NO: 2547325 - RNA, 14 nt, Chlamydophila pneumoniae J138
cuuccauaucuaga

SEQ ID NO: 2547326 - RNA, 20 nt, Chlamydophila pneumoniae J138
cuuccaucucuuuaaauguu

SEQ ID NO: 2547327 - RNA, 20 nt, Chlamydophila pneumoniae J138
cuucccaagcagaagacccu

SEQ ID NO: 2547328 - RNA, 15 nt, Chlamydophila pneumoniae J138
cuucccaucuuguuc

SEQ ID NO: 2547329 - RNA, 16 nt, Chlamydophila pneumoniae J138
cuucccaucuuguucu

SEQ ID NO: 2547330 - RNA, 22 nt, Chlamydophila pneumoniae J138
cuucccgaaggggaagaggaau

SEQ ID NO: 2547331 - RNA, 14 nt, Chlamydophila pneumoniae J138
cuucccucuccuug

SEQ ID NO: 2547332 - RNA, 20 nt, Chlamydophila pneumoniae J138
cuuccgugcgauuuccccuu

SEQ ID NO: 2547333 - RNA, 13 nt, Chlamydophila pneumoniae J138
cuuccuccaaaau

SEQ ID NO: 2547334 - RNA, 18 nt, Chlamydophila pneumoniae J138
cuuccucuucaauuucuu

SEQ ID NO: 2547335 - RNA, 16 nt, Chlamydophila pneumoniae J138
cuuccugcuccucuuc

SEQ ID NO: 2547336 - RNA, 13 nt, Chlamydophila pneumoniae J138
cuuccugcugcuu

SEQ ID NO: 2547337 - RNA, 17 nt, Chlamydophila pneumoniae J138
cuuccuuaaccuccuca

SEQ ID NO: 2547338 - RNA, 17 nt, Chlamydophila pneumoniae J138
cuuccuucuccuguaaa

SEQ ID NO: 2547339 - RNA, 14 nt, Chlamydophila pneumoniae J138
cuuccuucuucuuc

SEQ ID NO: 2547340 - RNA, 20 nt, Chlamydophila pneumoniae J138
cuuccuuuuucugcuucucc

SEQ ID NO: 2547341 - RNA, 18 nt, Chlamydophila pneumoniae J138
cuucgaagcggagcaucu

SEQ ID NO: 2547342 - RNA, 20 nt, Chlamydophila pneumoniae J138
cuucgaagcggagcaucuuu

SEQ ID NO: 2547343 - RNA, 22 nt, Chlamydophila pneumoniae J138
cuucgaagcggagcaucuuuuc

SEQ ID NO: 2547344 - RNA, 16 nt, Chlamydophila pneumoniae J138
cuucgaauuuuuguuu

SEQ ID NO: 2547345 - RNA, 15 nt, Chlamydophila pneumoniae J138
cuucgacaaggaagc

SEQ ID NO: 2547346 - RNA, 21 nt, Chlamydophila pneumoniae J138
cuucgacuucaccuugaaguu

SEQ ID NO: 2547347 - RNA, 15 nt, Chlamydophila pneumoniae J138
cuucgaugucuuucc

SEQ ID NO: 2547348 - RNA, 18 nt, Chlamydophila pneumoniae J138
cuucgaugucuuuccagg

SEQ ID NO: 2547349 - RNA, 21 nt, Chlamydophila pneumoniae J138
cuucgaugucuuuccaggcaa

SEQ ID NO: 2547350 - RNA, 19 nt, Chlamydophila pneumoniae J138
cuucgauguuauaagugac

SEQ ID NO: 2547351 - RNA, 23 nt, Chlamydophila pneumoniae J138
cuucgauuggaagcaaagaaaau

SEQ ID NO: 2547352 - RNA, 23 nt, Chlamydophila pneumoniae J138
cuucgcccauuaacuaagauaug

SEQ ID NO: 2547353 - RNA, 15 nt, Chlamydophila pneumoniae J138
cuucggaucuguaau

SEQ ID NO: 2547354 - RNA, 16 nt, Chlamydophila pneumoniae J138
cuucgggaucuaaaag

SEQ ID NO: 2547355 - RNA, 17 nt, Chlamydophila pneumoniae J138
cuucguaucuucgaggc

SEQ ID NO: 2547356 - RNA, 22 nt, Chlamydophila pneumoniae J138
cuucguuagaaaccaugaugca

SEQ ID NO: 2547357 - RNA, 15 nt, Chlamydophila pneumoniae J138
cuucguuucgcuuug

SEQ ID NO: 2547358 - RNA, 12 nt, Chlamydophila pneumoniae J138
cuucuaaaacca

SEQ ID NO: 2547359 - RNA, 12 nt, Chlamydophila pneumoniae J138
cuucuaaacaau

SEQ ID NO: 2547360 - RNA, 20 nt, Chlamydophila pneumoniae J138
cuucuaaagcugcuuuuucu

SEQ ID NO: 2547361 - RNA, 16 nt, Chlamydophila pneumoniae J138
cuucuaaggaaauuac

SEQ ID NO: 2547362 - RNA, 21 nt, Chlamydophila pneumoniae J138
cuucuacagaauaggaacaaa

SEQ ID NO: 2547363 - RNA, 14 nt, Chlamydophila pneumoniae J138
cuucuaugaauuga

SEQ ID NO: 2547364 - RNA, 18 nt, Chlamydophila pneumoniae J138
cuucuaugauaucaccag

SEQ ID NO: 2547365 - RNA, 22 nt, Chlamydophila pneumoniae J138
cuucuaugguaaucaccuuaga

SEQ ID NO: 2547366 - RNA, 16 nt, Chlamydophila pneumoniae J138
cuucuauuuuuuugga

SEQ ID NO: 2547367 - RNA, 14 nt, Chlamydophila pneumoniae J138
cuucucaaagacaa

SEQ ID NO: 2547368 - RNA, 18 nt, Chlamydophila pneumoniae J138
cuucucaagaucuucauc

SEQ ID NO: 2547369 - RNA, 19 nt, Chlamydophila pneumoniae J138
cuucucaagaucuucauca

SEQ ID NO: 2547370 - RNA, 19 nt, Chlamydophila pneumoniae J138
cuucucagaaagauauccc

SEQ ID NO: 2547371 - RNA, 13 nt, Chlamydophila pneumoniae J138
cuucuccucgcaa

SEQ ID NO: 2547372 - RNA, 11 nt, Chlamydophila pneumoniae J138
cuucuccugaa

SEQ ID NO: 2547373 - RNA, 22 nt, Chlamydophila pneumoniae J138
cuucucgguuuaaggcaauaga

SEQ ID NO: 2547374 - RNA, 14 nt, Chlamydophila pneumoniae J138
cuucucuaagaaau

SEQ ID NO: 2547375 - RNA, 18 nt, Chlamydophila pneumoniae J138
cuucucuaagaaauuuuc

SEQ ID NO: 2547376 - RNA, 18 nt, Chlamydophila pneumoniae J138
cuucucuaguuguaauuu

SEQ ID NO: 2547377 - RNA, 15 nt, Chlamydophila pneumoniae J138
cuucucucuuaaauu

SEQ ID NO: 2547378 - RNA, 19 nt, Chlamydophila pneumoniae J138
cuucucuguugggagcuuc

SEQ ID NO: 2547379 - RNA, 20 nt, Chlamydophila pneumoniae J138
cuucucuguugggagcuucc

SEQ ID NO: 2547380 - RNA, 21 nt, Chlamydophila pneumoniae J138
cuucucuuaugaaguccagac

SEQ ID NO: 2547381 - RNA, 16 nt, Chlamydophila pneumoniae J138
cuucugaaaucaaaaa

SEQ ID NO: 2547382 - RNA, 19 nt, Chlamydophila pneumoniae J138
cuucugaaaucaaaaaaaa

SEQ ID NO: 2547383 - RNA, 15 nt, Chlamydophila pneumoniae J138
cuucugaauagcucu

SEQ ID NO: 2547384 - RNA, 14 nt, Chlamydophila pneumoniae J138
cuucugacaauaac

SEQ ID NO: 2547385 - RNA, 17 nt, Chlamydophila pneumoniae J138
cuucugauacaucauca

SEQ ID NO: 2547386 - RNA, 23 nt, Chlamydophila pneumoniae J138
cuucuggauacguuuuucccuuu

SEQ ID NO: 2547387 - RNA, 16 nt, Chlamydophila pneumoniae J138
cuucuggcugagagaa

SEQ ID NO: 2547388 - RNA, 18 nt, Chlamydophila pneumoniae J138
cuucuggguucuccacau

SEQ ID NO: 2547389 - RNA, 20 nt, Chlamydophila pneumoniae J138
cuucuguaauuuuuuucaaa

SEQ ID NO: 2547390 - RNA, 15 nt, Chlamydophila pneumoniae J138
cuucuguaggaacaa

SEQ ID NO: 2547391 - RNA, 19 nt, Chlamydophila pneumoniae J138
cuucuguaucgacuguaca

SEQ ID NO: 2547392 - RNA, 17 nt, Chlamydophila pneumoniae J138
cuucugugcaucaguca

SEQ ID NO: 2547393 - RNA, 17 nt, Chlamydophila pneumoniae J138
cuucuuagccaaaauuu

SEQ ID NO: 2547394 - RNA, 15 nt, Chlamydophila pneumoniae J138
cuucuucaaagucaa

SEQ ID NO: 2547395 - RNA, 13 nt, Chlamydophila pneumoniae J138
cuucuucagcuuu

SEQ ID NO: 2547396 - RNA, 18 nt, Chlamydophila pneumoniae J138
cuucuucccagccuugau

SEQ ID NO: 2547397 - RNA, 17 nt, Chlamydophila pneumoniae J138
cuucuucgccuacaagu

SEQ ID NO: 2547398 - RNA, 20 nt, Chlamydophila pneumoniae J138
cuucuucguaagcugcaauc

SEQ ID NO: 2547399 - RNA, 23 nt, Chlamydophila pneumoniae J138
cuucuucuaaagcugcuuuuucu

SEQ ID NO: 2547400 - RNA, 20 nt, Chlamydophila pneumoniae J138
cuucuucuggcugagagaag

SEQ ID NO: 2547401 - RNA, 22 nt, Chlamydophila pneumoniae J138
cuucuucuggcugagagaagca

SEQ ID NO: 2547402 - RNA, 13 nt, Chlamydophila pneumoniae J138
cuucuucuucaaa

SEQ ID NO: 2547403 - RNA, 14 nt, Chlamydophila pneumoniae J138
cuucuugauuaaga

SEQ ID NO: 2547404 - RNA, 21 nt, Chlamydophila pneumoniae J138
cuucuuggcguuccagcuccu

SEQ ID NO: 2547405 - RNA, 15 nt, Chlamydophila pneumoniae J138
cuucuugugauccuu

SEQ ID NO: 2547406 - RNA, 21 nt, Chlamydophila pneumoniae J138
cuucuuguguuagugcuucag

SEQ ID NO: 2547407 - RNA, 14 nt, Chlamydophila pneumoniae J138
cuucuuguuuuugu

SEQ ID NO: 2547408 - RNA, 17 nt, Chlamydophila pneumoniae J138
cuucuuguuuuugugga

SEQ ID NO: 2547409 - RNA, 16 nt, Chlamydophila pneumoniae J138
cuucuuuacucaagug

SEQ ID NO: 2547410 - RNA, 20 nt, Chlamydophila pneumoniae J138
cuucuuuaggguaaagaaau

SEQ ID NO: 2547411 - RNA, 15 nt, Chlamydophila pneumoniae J138
cuucuuucaaagccu

SEQ ID NO: 2547412 - RNA, 18 nt, Chlamydophila pneumoniae J138
cuucuuucaauagcuucc

SEQ ID NO: 2547413 - RNA, 20 nt, Chlamydophila pneumoniae J138
cuucuuuccauagaucccua

SEQ ID NO: 2547414 - RNA, 18 nt, Chlamydophila pneumoniae J138
cuucuuucugcucuucua

SEQ ID NO: 2547415 - RNA, 14 nt, Chlamydophila pneumoniae J138
cuucuuucuugcuc

SEQ ID NO: 2547416 - RNA, 22 nt, Chlamydophila pneumoniae J138
cuucuuuuagacgugcucucuu

SEQ ID NO: 2547417 - RNA, 13 nt, Chlamydophila pneumoniae J138
cuugaaacucuau

SEQ ID NO: 2547418 - RNA, 23 nt, Chlamydophila pneumoniae J138
cuugaaaguacaggcuccaucac

SEQ ID NO: 2547419 - RNA, 15 nt, Chlamydophila pneumoniae J138
cuugaaauugcucuu

SEQ ID NO: 2547420 - RNA, 14 nt, Chlamydophila pneumoniae J138
cuugaacagagacu

SEQ ID NO: 2547421 - RNA, 18 nt, Chlamydophila pneumoniae J138
cuugaacagagacuuccu

SEQ ID NO: 2547422 - RNA, 15 nt, Chlamydophila pneumoniae J138
cuugaaguucucaaa

SEQ ID NO: 2547423 - RNA, 14 nt, Chlamydophila pneumoniae J138
cuugaaguuuuuuc

SEQ ID NO: 2547424 - RNA, 15 nt, Chlamydophila pneumoniae J138
cuugacaaauaaguc

SEQ ID NO: 2547425 - RNA, 20 nt, Chlamydophila pneumoniae J138
cuugacacaggagguucauu

SEQ ID NO: 2547426 - RNA, 22 nt, Chlamydophila pneumoniae J138
cuugacacaggagguucauucu

SEQ ID NO: 2547427 - RNA, 19 nt, Chlamydophila pneumoniae J138
cuugaccucaucagaagug

SEQ ID NO: 2547428 - RNA, 14 nt, Chlamydophila pneumoniae J138
cuugacucuaauuc

SEQ ID NO: 2547429 - RNA, 16 nt, Chlamydophila pneumoniae J138
cuugacucuaauucag

SEQ ID NO: 2547430 - RNA, 15 nt, Chlamydophila pneumoniae J138
cuugagcauccaaaa

SEQ ID NO: 2547431 - RNA, 18 nt, Chlamydophila pneumoniae J138
cuugagcauccaaaaugu

SEQ ID NO: 2547432 - RNA, 23 nt, Chlamydophila pneumoniae J138
cuugagccaacagguucacuuca

SEQ ID NO: 2547433 - RNA, 23 nt, Chlamydophila pneumoniae J138
cuugaggaccuuccuuaucuuca

SEQ ID NO: 2547434 - RNA, 23 nt, Chlamydophila pneumoniae J138
cuugaggaggauugacaaucgcu

SEQ ID NO: 2547435 - RNA, 15 nt, Chlamydophila pneumoniae J138
cuugagguauuccua

SEQ ID NO: 2547436 - RNA, 20 nt, Chlamydophila pneumoniae J138
cuugauaaaacgcuauuguu

SEQ ID NO: 2547437 - RNA, 17 nt, Chlamydophila pneumoniae J138
cuugauaaaagauagug

SEQ ID NO: 2547438 - RNA, 16 nt, Chlamydophila pneumoniae J138
cuugauacugaauccc

SEQ ID NO: 2547439 - RNA, 15 nt, Chlamydophila pneumoniae J138
cuugauauuguucuu

SEQ ID NO: 2547440 - RNA, 17 nt, Chlamydophila pneumoniae J138
cuugauauuguucuucc

SEQ ID NO: 2547441 - RNA, 12 nt, Chlamydophila pneumoniae J138
cuugaucaggau

SEQ ID NO: 2547442 - RNA, 22 nt, Chlamydophila pneumoniae J138
cuugaucaggauggucauacca

SEQ ID NO: 2547443 - RNA, 13 nt, Chlamydophila pneumoniae J138
cuugaucuacaaa

SEQ ID NO: 2547444 - RNA, 15 nt, Chlamydophila pneumoniae J138
cuugaucuacaaaaa

SEQ ID NO: 2547445 - RNA, 23 nt, Chlamydophila pneumoniae J138
cuugauggggaguuaggaucccu

SEQ ID NO: 2547446 - RNA, 19 nt, Chlamydophila pneumoniae J138
cuugauuaagaucuucguc

SEQ ID NO: 2547447 - RNA, 14 nt, Chlamydophila pneumoniae J138
cuugauuugggaug

SEQ ID NO: 2547448 - RNA, 19 nt, Chlamydophila pneumoniae J138
cuugauuuuaaaaugaccg

SEQ ID NO: 2547449 - RNA, 24 nt, Chlamydophila pneumoniae J138
cuugcaaaacagcaucaggauucu

SEQ ID NO: 2547450 - RNA, 16 nt, Chlamydophila pneumoniae J138
cuugcaaagauaacca

SEQ ID NO: 2547451 - RNA, 17 nt, Chlamydophila pneumoniae J138
cuugcaaggagcuuuuc

SEQ ID NO: 2547452 - RNA, 16 nt, Chlamydophila pneumoniae J138
cuugcaaucuuugaag

SEQ ID NO: 2547453 - RNA, 18 nt, Chlamydophila pneumoniae J138
cuugcagcgacaacacgc

SEQ ID NO: 2547454 - RNA, 18 nt, Chlamydophila pneumoniae J138
cuugcauuuuuuggaaua

SEQ ID NO: 2547455 - RNA, 15 nt, Chlamydophila pneumoniae J138
cuugccaaucuuccu

SEQ ID NO: 2547456 - RNA, 16 nt, Chlamydophila pneumoniae J138
cuugccagcagaaguu

SEQ ID NO: 2547457 - RNA, 18 nt, Chlamydophila pneumoniae J138
cuugccaguauugauaau

SEQ ID NO: 2547458 - RNA, 23 nt, Chlamydophila pneumoniae J138
cuugcgauacaauaaacaacgau

SEQ ID NO: 2547459 - RNA, 13 nt, Chlamydophila pneumoniae J138
cuugcgcagcuuc

SEQ ID NO: 2547460 - RNA, 17 nt, Chlamydophila pneumoniae J138
cuugcugauuucuuuuu

SEQ ID NO: 2547461 - RNA, 18 nt, Chlamydophila pneumoniae J138
cuugcugauuucuuuuuc

SEQ ID NO: 2547462 - RNA, 20 nt, Chlamydophila pneumoniae J138
cuugcugauuucuuuuucag

SEQ ID NO: 2547463 - RNA, 20 nt, Chlamydophila pneumoniae J138
cuugcugauuuuugcuaaga

SEQ ID NO: 2547464 - RNA, 21 nt, Chlamydophila pneumoniae J138
cuugcugcccaaauugagaaa

SEQ ID NO: 2547465 - RNA, 18 nt, Chlamydophila pneumoniae J138
cuugcuuauccaaguguu

SEQ ID NO: 2547466 - RNA, 13 nt, Chlamydophila pneumoniae J138
cuugcuugcuagg

SEQ ID NO: 2547467 - RNA, 21 nt, Chlamydophila pneumoniae J138
cuugcuuugugaguucuuccu

SEQ ID NO: 2547468 - RNA, 19 nt, Chlamydophila pneumoniae J138
cuuggaugggaaucuugaa

SEQ ID NO: 2547469 - RNA, 18 nt, Chlamydophila pneumoniae J138
cuuggauuucuucuucua

SEQ ID NO: 2547470 - RNA, 15 nt, Chlamydophila pneumoniae J138
cuuggcauacucuau

SEQ ID NO: 2547471 - RNA, 19 nt, Chlamydophila pneumoniae J138
cuugggcaaauaggagagc

SEQ ID NO: 2547472 - RNA, 19 nt, Chlamydophila pneumoniae J138
cuugguagcgucucuucuu

SEQ ID NO: 2547473 - RNA, 13 nt, Chlamydophila pneumoniae J138
cuuggucgcaagg

SEQ ID NO: 2547474 - RNA, 18 nt, Chlamydophila pneumoniae J138
cuuguaagacuaaaaaag

SEQ ID NO: 2547475 - RNA, 19 nt, Chlamydophila pneumoniae J138
cuuguaaguuacggaacuc

SEQ ID NO: 2547476 - RNA, 18 nt, Chlamydophila pneumoniae J138
cuuguaccguaaagaaaa

SEQ ID NO: 2547477 - RNA, 14 nt, Chlamydophila pneumoniae J138
cuuguagaacuucu

SEQ ID NO: 2547478 - RNA, 21 nt, Chlamydophila pneumoniae J138
cuuguagcucccguuccuuua

SEQ ID NO: 2547479 - RNA, 20 nt, Chlamydophila pneumoniae J138
cuugucacacugcgagagaa

SEQ ID NO: 2547480 - RNA, 16 nt, Chlamydophila pneumoniae J138
cuugucuaggagcuuc

SEQ ID NO: 2547481 - RNA, 19 nt, Chlamydophila pneumoniae J138
cuugugcuaaagcaggagc

SEQ ID NO: 2547482 - RNA, 23 nt, Chlamydophila pneumoniae J138
cuugugguuuuucuccucuuucu

SEQ ID NO: 2547483 - RNA, 13 nt, Chlamydophila pneumoniae J138
cuuguuaugaaaa

SEQ ID NO: 2547484 - RNA, 16 nt, Chlamydophila pneumoniae J138
cuuguucuaaaaugaa

SEQ ID NO: 2547485 - RNA, 18 nt, Chlamydophila pneumoniae J138
cuuguucuaaaaugaaau

SEQ ID NO: 2547486 - RNA, 13 nt, Chlamydophila pneumoniae J138
cuuguucuguaac

SEQ ID NO: 2547487 - RNA, 13 nt, Chlamydophila pneumoniae J138
cuuguucuucauu

SEQ ID NO: 2547488 - RNA, 18 nt, Chlamydophila pneumoniae J138
cuuguucuucuugauuaa

SEQ ID NO: 2547489 - RNA, 19 nt, Chlamydophila pneumoniae J138
cuuguucuucuugauuaag

SEQ ID NO: 2547490 - RNA, 18 nt, Chlamydophila pneumoniae J138
cuuguugguuaaaauaga

SEQ ID NO: 2547491 - RNA, 15 nt, Chlamydophila pneumoniae J138
cuuguuucuguuuuc

SEQ ID NO: 2547492 - RNA, 18 nt, Chlamydophila pneumoniae J138
cuuguuuuccuguguggu

SEQ ID NO: 2547493 - RNA, 13 nt, Chlamydophila pneumoniae J138
cuuuaaaaaccca

SEQ ID NO: 2547494 - RNA, 18 nt, Chlamydophila pneumoniae J138
cuuuaaaaauauaucuuc

SEQ ID NO: 2547495 - RNA, 17 nt, Chlamydophila pneumoniae J138
cuuuaaagauuccccau

SEQ ID NO: 2547496 - RNA, 23 nt, Chlamydophila pneumoniae J138
cuuuaaauucgccaaacgaauuu

SEQ ID NO: 2547497 - RNA, 12 nt, Chlamydophila pneumoniae J138
cuuuaaauuuuu

SEQ ID NO: 2547498 - RNA, 20 nt, Chlamydophila pneumoniae J138
cuuuaagaagcacuucuuua

SEQ ID NO: 2547499 - RNA, 16 nt, Chlamydophila pneumoniae J138
cuuuaagauuuuuaga

SEQ ID NO: 2547500 - RNA, 19 nt, Chlamydophila pneumoniae J138
cuuuaagguugcuuuucua

SEQ ID NO: 2547501 - RNA, 13 nt, Chlamydophila pneumoniae J138
cuuuaaucaagcc

SEQ ID NO: 2547502 - RNA, 21 nt, Chlamydophila pneumoniae J138
cuuuaaucaagccuaaaucua

SEQ ID NO: 2547503 - RNA, 15 nt, Chlamydophila pneumoniae J138
cuuuaauccugcaau

SEQ ID NO: 2547504 - RNA, 16 nt, Chlamydophila pneumoniae J138
cuuuacaauacacuca

SEQ ID NO: 2547505 - RNA, 23 nt, Chlamydophila pneumoniae J138
cuuuacgaugagguugagcaaga

SEQ ID NO: 2547506 - RNA, 19 nt, Chlamydophila pneumoniae J138
cuuuagaaauuccaauuuu

SEQ ID NO: 2547507 - RNA, 23 nt, Chlamydophila pneumoniae J138
cuuuagaaauuccaauuuuugca

SEQ ID NO: 2547508 - RNA, 22 nt, Chlamydophila pneumoniae J138
cuuuagagacgcuuuuaucugu

SEQ ID NO: 2547509 - RNA, 15 nt, Chlamydophila pneumoniae J138
cuuuaggaacuugaa

SEQ ID NO: 2547510 - RNA, 11 nt, Chlamydophila pneumoniae J138
cuuuagggaag

SEQ ID NO: 2547511 - RNA, 17 nt, Chlamydophila pneumoniae J138
cuuuaguuaacuccuuc

SEQ ID NO: 2547512 - RNA, 20 nt, Chlamydophila pneumoniae J138
cuuuauacuguuuuucuucc

SEQ ID NO: 2547513 - RNA, 15 nt, Chlamydophila pneumoniae J138
cuuuauagaaaguac

SEQ ID NO: 2547514 - RNA, 23 nt, Chlamydophila pneumoniae J138
cuuuaucuagcucuucaagguac

SEQ ID NO: 2547515 - RNA, 18 nt, Chlamydophila pneumoniae J138
cuuuauggcucaacuuaa

SEQ ID NO: 2547516 - RNA, 15 nt, Chlamydophila pneumoniae J138
cuuuauguauaacau

SEQ ID NO: 2547517 - RNA, 16 nt, Chlamydophila pneumoniae J138
cuuuauguauaacauc

SEQ ID NO: 2547518 - RNA, 14 nt, Chlamydophila pneumoniae J138
cuuuauguuuucuu

SEQ ID NO: 2547519 - RNA, 16 nt, Chlamydophila pneumoniae J138
cuuuauugauagcuga

SEQ ID NO: 2547520 - RNA, 15 nt, Chlamydophila pneumoniae J138
cuuuauuuaaauaaa

SEQ ID NO: 2547521 - RNA, 22 nt, Chlamydophila pneumoniae J138
cuuucaaaagaaaucaaacauu

SEQ ID NO: 2547522 - RNA, 16 nt, Chlamydophila pneumoniae J138
cuuucaaaccacggau

SEQ ID NO: 2547523 - RNA, 10 nt, Chlamydophila pneumoniae J138
cuuucaaagg

SEQ ID NO: 2547524 - RNA, 17 nt, Chlamydophila pneumoniae J138
cuuucaaccuccgcucu

SEQ ID NO: 2547525 - RNA, 22 nt, Chlamydophila pneumoniae J138
cuuucaagagcagugaaauuuu

SEQ ID NO: 2547526 - RNA, 14 nt, Chlamydophila pneumoniae J138
cuuucacaaagaau

SEQ ID NO: 2547527 - RNA, 20 nt, Chlamydophila pneumoniae J138
cuuucacgauaucuaccaaa

SEQ ID NO: 2547528 - RNA, 13 nt, Chlamydophila pneumoniae J138
cuuucagaaagaa

SEQ ID NO: 2547529 - RNA, 23 nt, Chlamydophila pneumoniae J138
cuuucauaagauagagcgacuuc

SEQ ID NO: 2547530 - RNA, 20 nt, Chlamydophila pneumoniae J138
cuuuccacguacgagaucag

SEQ ID NO: 2547531 - RNA, 23 nt, Chlamydophila pneumoniae J138
cuuuccauaaagccccacccacu

SEQ ID NO: 2547532 - RNA, 16 nt, Chlamydophila pneumoniae J138
caacagcuaauacauc

SEQ ID NO: 2547533 - RNA, 23 nt, Chlamydophila pneumoniae J138
caacagcuaauacaucaccacug

SEQ ID NO: 2547534 - RNA, 13 nt, Chlamydophila pneumoniae J138
caacaguaauuau

SEQ ID NO: 2547535 - RNA, 22 nt, Chlamydophila pneumoniae J138
caacaguucgacaaccaaaaca

SEQ ID NO: 2547536 - RNA, 12 nt, Chlamydophila pneumoniae J138
caacauaaagaa

SEQ ID NO: 2547537 - RNA, 17 nt, Chlamydophila pneumoniae J138
caacauaacaugagaaa

SEQ ID NO: 2547538 - RNA, 19 nt, Chlamydophila pneumoniae J138
caacauaacaugagaaaua

SEQ ID NO: 2547539 - RNA, 22 nt, Chlamydophila pneumoniae J138
caacauaaucauuauccauauc

SEQ ID NO: 2547540 - RNA, 12 nt, Chlamydophila pneumoniae J138
caacaucaugaa

SEQ ID NO: 2547541 - RNA, 12 nt, Chlamydophila pneumoniae J138
caacauccauuc

SEQ ID NO: 2547542 - RNA, 12 nt, Chlamydophila pneumoniae J138
caacauucguua

SEQ ID NO: 2547543 - RNA, 16 nt, Chlamydophila pneumoniae J138
caacauuuugccuuua

SEQ ID NO: 2547544 - RNA, 15 nt, Chlamydophila pneumoniae J138
caacccgaauuccuc

SEQ ID NO: 2547545 - RNA, 16 nt, Chlamydophila pneumoniae J138
caacccgaauuccucu

SEQ ID NO: 2547546 - RNA, 19 nt, Chlamydophila pneumoniae J138
caacccuauuuaaggacgu

SEQ ID NO: 2547547 - RNA, 13 nt, Chlamydophila pneumoniae J138
caaccucugcaug

SEQ ID NO: 2547548 - RNA, 16 nt, Chlamydophila pneumoniae J138
caacgaucgucaguaa

SEQ ID NO: 2547549 - RNA, 19 nt, Chlamydophila pneumoniae J138
caacgaucgucaguaaaac

SEQ ID NO: 2547550 - RNA, 19 nt, Chlamydophila pneumoniae J138
caacgcaugacgcuuuucc

SEQ ID NO: 2547551 - RNA, 13 nt, Chlamydophila pneumoniae J138
caacgcuucuuuu

SEQ ID NO: 2547552 - RNA, 19 nt, Chlamydophila pneumoniae J138
caacgcuucuuuuuggaua

SEQ ID NO: 2547553 - RNA, 13 nt, Chlamydophila pneumoniae J138
caacggacauuuu

SEQ ID NO: 2547554 - RNA, 14 nt, Chlamydophila pneumoniae J138
caacggauaagacg

SEQ ID NO: 2547555 - RNA, 20 nt, Chlamydophila pneumoniae J138
caacuaaaccuucaaugauu

SEQ ID NO: 2547556 - RNA, 14 nt, Chlamydophila pneumoniae J138
caacuaaacuggga

SEQ ID NO: 2547557 - RNA, 13 nt, Chlamydophila pneumoniae J138
caacuaaagcaua

SEQ ID NO: 2547558 - RNA, 16 nt, Chlamydophila pneumoniae J138
caacuaaagcauacuu

SEQ ID NO: 2547559 - RNA, 23 nt, Chlamydophila pneumoniae J138
caacuacagagggcuucauuccu

SEQ ID NO: 2547560 - RNA, 23 nt, Chlamydophila pneumoniae J138
caacuacauaauaagcaggaaaa

SEQ ID NO: 2547561 - RNA, 17 nt, Chlamydophila pneumoniae J138
caacuacuguagaguuu

SEQ ID NO: 2547562 - RNA, 13 nt, Chlamydophila pneumoniae J138
caacuccucaaaa

SEQ ID NO: 2547563 - RNA, 15 nt, Chlamydophila pneumoniae J138
caacucguuucagca

SEQ ID NO: 2547564 - RNA, 13 nt, Chlamydophila pneumoniae J138
caacucuccaucc

SEQ ID NO: 2547565 - RNA, 15 nt, Chlamydophila pneumoniae J138
caacucuccauccuc

SEQ ID NO: 2547566 - RNA, 22 nt, Chlamydophila pneumoniae J138
caacucucccauguaguaaauu

SEQ ID NO: 2547567 - RNA, 23 nt, Chlamydophila pneumoniae J138
caacucucuuuaaaccuggcauu

SEQ ID NO: 2547568 - RNA, 14 nt, Chlamydophila pneumoniae J138
caacucuuuaauug

SEQ ID NO: 2547569 - RNA, 21 nt, Chlamydophila pneumoniae J138
caacugaaaaaccauaagaau

SEQ ID NO: 2547570 - RNA, 19 nt, Chlamydophila pneumoniae J138
caacugauguuuuauagau

SEQ ID NO: 2547571 - RNA, 20 nt, Chlamydophila pneumoniae J138
caacugauguuuuauagaua

SEQ ID NO: 2547572 - RNA, 13 nt, Chlamydophila pneumoniae J138
caacuuccauaug

SEQ ID NO: 2547573 - RNA, 18 nt, Chlamydophila pneumoniae J138
caacuucuccaacuaaac

SEQ ID NO: 2547574 - RNA, 14 nt, Chlamydophila pneumoniae J138
caacuucugacaau

SEQ ID NO: 2547575 - RNA, 17 nt, Chlamydophila pneumoniae J138
caacuuuguuaauagaa

SEQ ID NO: 2547576 - RNA, 14 nt, Chlamydophila pneumoniae J138
caagaaaaaccccu

SEQ ID NO: 2547577 - RNA, 23 nt, Chlamydophila pneumoniae J138
caagaaaaauucuucgagagcau

SEQ ID NO: 2547578 - RNA, 23 nt, Chlamydophila pneumoniae J138
caagaaaauaggugacuucuuug

SEQ ID NO: 2547579 - RNA, 14 nt, Chlamydophila pneumoniae J138
caagaaaugcccug

SEQ ID NO: 2547580 - RNA, 19 nt, Chlamydophila pneumoniae J138
caagaaauucuucccaggu

SEQ ID NO: 2547581 - RNA, 18 nt, Chlamydophila pneumoniae J138
caagaacaguuugcucug

SEQ ID NO: 2547582 - RNA, 17 nt, Chlamydophila pneumoniae J138
caagaaccuguuuuucu

SEQ ID NO: 2547583 - RNA, 14 nt, Chlamydophila pneumoniae J138
caagaacugaagag

SEQ ID NO: 2547584 - RNA, 15 nt, Chlamydophila pneumoniae J138
caagaacugaagagu

SEQ ID NO: 2547585 - RNA, 17 nt, Chlamydophila pneumoniae J138
caagaagagaaaagaua

SEQ ID NO: 2547586 - RNA, 18 nt, Chlamydophila pneumoniae J138
caagaagagaaaagauag

SEQ ID NO: 2547587 - RNA, 16 nt, Chlamydophila pneumoniae J138
caagaagaucaaagau

SEQ ID NO: 2547588 - RNA, 21 nt, Chlamydophila pneumoniae J138
caagaauagcaggaaggaaua

SEQ ID NO: 2547589 - RNA, 21 nt, Chlamydophila pneumoniae J138
caagaauagccauaauuagaa

SEQ ID NO: 2547590 - RNA, 23 nt, Chlamydophila pneumoniae J138
caagaauauggguguaaauuuuu

SEQ ID NO: 2547591 - RNA, 19 nt, Chlamydophila pneumoniae J138
caagaauccgaucauaauu

SEQ ID NO: 2547592 - RNA, 24 nt, Chlamydophila pneumoniae J138
caagaauuucuucuuuccauagau

SEQ ID NO: 2547593 - RNA, 13 nt, Chlamydophila pneumoniae J138
caagacaaaguug

SEQ ID NO: 2547594 - RNA, 16 nt, Chlamydophila pneumoniae J138
caagacaauaaaaaag

SEQ ID NO: 2547595 - RNA, 15 nt, Chlamydophila pneumoniae J138
caagacgaaagcaca

SEQ ID NO: 2547596 - RNA, 14 nt, Chlamydophila pneumoniae J138
caagacgagaacau

SEQ ID NO: 2547597 - RNA, 16 nt, Chlamydophila pneumoniae J138
caagacgcggaacucu

SEQ ID NO: 2547598 - RNA, 18 nt, Chlamydophila pneumoniae J138
caagacuacgacagaagu

SEQ ID NO: 2547599 - RNA, 20 nt, Chlamydophila pneumoniae J138
caagacuauagaaaaggaug

SEQ ID NO: 2547600 - RNA, 16 nt, Chlamydophila pneumoniae J138
caagagacaagaaaau

SEQ ID NO: 2547601 - RNA, 17 nt, Chlamydophila pneumoniae J138
caagagacaagaaaaua

SEQ ID NO: 2547602 - RNA, 21 nt, Chlamydophila pneumoniae J138
caagagacaagaaaauaucac

SEQ ID NO: 2547603 - RNA, 20 nt, Chlamydophila pneumoniae J138
caagagcaucacaaacuaaa

SEQ ID NO: 2547604 - RNA, 23 nt, Chlamydophila pneumoniae J138
caagagcuccgcuagaggaucuu

SEQ ID NO: 2547605 - RNA, 23 nt, Chlamydophila pneumoniae J138
caagagcucguaauccuucuuuc

SEQ ID NO: 2547606 - RNA, 17 nt, Chlamydophila pneumoniae J138
caagagcucuugagaaa

SEQ ID NO: 2547607 - RNA, 16 nt, Chlamydophila pneumoniae J138
caagagcuugucuucc

SEQ ID NO: 2547608 - RNA, 22 nt, Chlamydophila pneumoniae J138
caagaggucgaagauucaaaga

SEQ ID NO: 2547609 - RNA, 21 nt, Chlamydophila pneumoniae J138
caagaguuucgaauucaauga

SEQ ID NO: 2547610 - RNA, 22 nt, Chlamydophila pneumoniae J138
caagaguuucgaauucaaugag

SEQ ID NO: 2547611 - RNA, 22 nt, Chlamydophila pneumoniae J138
caagauagugguagcaaucugu

SEQ ID NO: 2547612 - RNA, 14 nt, Chlamydophila pneumoniae J138
caagaucuccgccu

SEQ ID NO: 2547613 - RNA, 16 nt, Chlamydophila pneumoniae J138
caagauggcaacaacu

SEQ ID NO: 2547614 - RNA, 15 nt, Chlamydophila pneumoniae J138
caagaugucuccaaa

SEQ ID NO: 2547615 - RNA, 23 nt, Chlamydophila pneumoniae J138
caagaugucuccaaagauacauu

SEQ ID NO: 2547616 - RNA, 14 nt, Chlamydophila pneumoniae J138
caagauuaucuuua

SEQ ID NO: 2547617 - RNA, 22 nt, Chlamydophila pneumoniae J138
caagauuaucuuuacgaaucac

SEQ ID NO: 2547618 - RNA, 20 nt, Chlamydophila pneumoniae J138
caagauucccugcggacaga

SEQ ID NO: 2547619 - RNA, 23 nt, Chlamydophila pneumoniae J138
caagauucucacucuaugagaac

SEQ ID NO: 2547620 - RNA, 13 nt, Chlamydophila pneumoniae J138
caagcaacucuuc

SEQ ID NO: 2547621 - RNA, 21 nt, Chlamydophila pneumoniae J138
caagcaacugauguuuuauag

SEQ ID NO: 2547622 - RNA, 23 nt, Chlamydophila pneumoniae J138
caagcaauacuaagaagcucacu

SEQ ID NO: 2547623 - RNA, 16 nt, Chlamydophila pneumoniae J138
caagcacuuucgcaaa

SEQ ID NO: 2547624 - RNA, 21 nt, Chlamydophila pneumoniae J138
caagcagauagagcuucuuua

SEQ ID NO: 2547625 - RNA, 23 nt, Chlamydophila pneumoniae J138
caagcaguaacugcaaagagaau

SEQ ID NO: 2547626 - RNA, 23 nt, Chlamydophila pneumoniae J138
caagcauaguacgauccaucuca

SEQ ID NO: 2547627 - RNA, 18 nt, Chlamydophila pneumoniae J138
caagcauuguuuguccua

SEQ ID NO: 2547628 - RNA, 21 nt, Chlamydophila pneumoniae J138
caagcgcgcuaaaaaaaggcu

SEQ ID NO: 2547629 - RNA, 14 nt, Chlamydophila pneumoniae J138
caagcuucaucaaa

SEQ ID NO: 2547630 - RNA, 15 nt, Chlamydophila pneumoniae J138
caaggaacauuugag

SEQ ID NO: 2547631 - RNA, 12 nt, Chlamydophila pneumoniae J138
caaugcgauacg

SEQ ID NO: 2547632 - RNA, 15 nt, Chlamydophila pneumoniae J138
caaugcuucuucagc

SEQ ID NO: 2547633 - RNA, 20 nt, Chlamydophila pneumoniae J138
caaugcuugucgcgacaaga

SEQ ID NO: 2547634 - RNA, 15 nt, Chlamydophila pneumoniae J138
caauggaaauagaga

SEQ ID NO: 2547635 - RNA, 17 nt, Chlamydophila pneumoniae J138
caauggaaauagagaaa

SEQ ID NO: 2547636 - RNA, 18 nt, Chlamydophila pneumoniae J138
caauguuaaucuaauuuu

SEQ ID NO: 2547637 - RNA, 12 nt, Chlamydophila pneumoniae J138
caauuaaaaaau

SEQ ID NO: 2547638 - RNA, 16 nt, Chlamydophila pneumoniae J138
caauuaaaaaauuauc

SEQ ID NO: 2547639 - RNA, 18 nt, Chlamydophila pneumoniae J138
caauuagagauucauaaa

SEQ ID NO: 2547640 - RNA, 16 nt, Chlamydophila pneumoniae J138
caauuccgaagaagaa

SEQ ID NO: 2547641 - RNA, 20 nt, Chlamydophila pneumoniae J138
caauuccgaagaagaaagga

SEQ ID NO: 2547642 - RNA, 22 nt, Chlamydophila pneumoniae J138
caauuccguacgcuauaaauaa

SEQ ID NO: 2547643 - RNA, 18 nt, Chlamydophila pneumoniae J138
caauuccuaaaacaagaa

SEQ ID NO: 2547644 - RNA, 17 nt, Chlamydophila pneumoniae J138
caauucgagauauggaa

SEQ ID NO: 2547645 - RNA, 16 nt, Chlamydophila pneumoniae J138
caauucgguagagcua

SEQ ID NO: 2547646 - RNA, 15 nt, Chlamydophila pneumoniae J138
caauucucucucugc

SEQ ID NO: 2547647 - RNA, 18 nt, Chlamydophila pneumoniae J138
caauucuguaucgauagu

SEQ ID NO: 2547648 - RNA, 22 nt, Chlamydophila pneumoniae J138
caauucuguaucgauaguuuuu

SEQ ID NO: 2547649 - RNA, 15 nt, Chlamydophila pneumoniae J138
caauucuuaaaaagc

SEQ ID NO: 2547650 - RNA, 15 nt, Chlamydophila pneumoniae J138
caauugaaucagauu

SEQ ID NO: 2547651 - RNA, 20 nt, Chlamydophila pneumoniae J138
caauugaaucagauuagagu

SEQ ID NO: 2547652 - RNA, 22 nt, Chlamydophila pneumoniae J138
caauugaaucagauuagaguua

SEQ ID NO: 2547653 - RNA, 17 nt, Chlamydophila pneumoniae J138
caauugagccucgauuu

SEQ ID NO: 2547654 - RNA, 12 nt, Chlamydophila pneumoniae J138
caauugagcucu

SEQ ID NO: 2547655 - RNA, 16 nt, Chlamydophila pneumoniae J138
caauugagcucucuag

SEQ ID NO: 2547656 - RNA, 20 nt, Chlamydophila pneumoniae J138
caauugcucguauuagaguu

SEQ ID NO: 2547657 - RNA, 17 nt, Chlamydophila pneumoniae J138
caauuggaggauaaaug

SEQ ID NO: 2547658 - RNA, 20 nt, Chlamydophila pneumoniae J138
caauugguggagcucauuua

SEQ ID NO: 2547659 - RNA, 13 nt, Chlamydophila pneumoniae J138
caauuugcguugc

SEQ ID NO: 2547660 - RNA, 15 nt, Chlamydophila pneumoniae J138
caauuugcuccucca

SEQ ID NO: 2547661 - RNA, 23 nt, Chlamydophila pneumoniae J138
caauuuguauauccacgaucuag

SEQ ID NO: 2547662 - RNA, 14 nt, Chlamydophila pneumoniae J138
caauuuuaaaaucu

SEQ ID NO: 2547663 - RNA, 18 nt, Chlamydophila pneumoniae J138
caauuuuaccacuuccag

SEQ ID NO: 2547664 - RNA, 23 nt, Chlamydophila pneumoniae J138
caauuuucuucagcacuuuuauu

SEQ ID NO: 2547665 - RNA, 17 nt, Chlamydophila pneumoniae J138
caauuuuuauaauauuu

SEQ ID NO: 2547666 - RNA, 17 nt, Chlamydophila pneumoniae J138
caauuuuuguagacaau

SEQ ID NO: 2547667 - RNA, 21 nt, Chlamydophila pneumoniae J138
caauuuuuguagacaauacca

SEQ ID NO: 2547668 - RNA, 21 nt, Chlamydophila pneumoniae J138
cacaaaaagcuuuuuucucuu

SEQ ID NO: 2547669 - RNA, 12 nt, Chlamydophila pneumoniae J138
cacaaaauaaaa

SEQ ID NO: 2547670 - RNA, 15 nt, Chlamydophila pneumoniae J138
cacaaacaacagaaa

SEQ ID NO: 2547671 - RNA, 19 nt, Chlamydophila pneumoniae J138
cacaaagaauucagagaaa

SEQ ID NO: 2547672 - RNA, 15 nt, Chlamydophila pneumoniae J138
cacaacucauccuaa

SEQ ID NO: 2547673 - RNA, 15 nt, Chlamydophila pneumoniae J138
cacaacucuuuaauu

SEQ ID NO: 2547674 - RNA, 21 nt, Chlamydophila pneumoniae J138
cacaagcuuuucgcagauacu

SEQ ID NO: 2547675 - RNA, 24 nt, Chlamydophila pneumoniae J138
cacaaggagagaaaauaucacauu

SEQ ID NO: 2547676 - RNA, 21 nt, Chlamydophila pneumoniae J138
cacaagggauucuuguuggau

SEQ ID NO: 2547677 - RNA, 23 nt, Chlamydophila pneumoniae J138
cacaauauaaaugcuauuuuccu

SEQ ID NO: 2547678 - RNA, 22 nt, Chlamydophila pneumoniae J138
cacaaucgugauugcugucaga

SEQ ID NO: 2547679 - RNA, 16 nt, Chlamydophila pneumoniae J138
cacaaucuaaauaaga

SEQ ID NO: 2547680 - RNA, 18 nt, Chlamydophila pneumoniae J138
cacaauuguaaauacaaa

SEQ ID NO: 2547681 - RNA, 15 nt, Chlamydophila pneumoniae J138
cacacgaucuucgga

SEQ ID NO: 2547682 - RNA, 13 nt, Chlamydophila pneumoniae J138
cacacuccauuuc

SEQ ID NO: 2547683 - RNA, 19 nt, Chlamydophila pneumoniae J138
cacacuuaaagguaaaacu

SEQ ID NO: 2547684 - RNA, 16 nt, Chlamydophila pneumoniae J138
cacagaaugauaagaa

SEQ ID NO: 2547685 - RNA, 21 nt, Chlamydophila pneumoniae J138
cacagacuugaggaaucugaa

SEQ ID NO: 2547686 - RNA, 15 nt, Chlamydophila pneumoniae J138
cacagagaacaauaa

SEQ ID NO: 2547687 - RNA, 18 nt, Chlamydophila pneumoniae J138
cacagagaugcuucuaaa

SEQ ID NO: 2547688 - RNA, 23 nt, Chlamydophila pneumoniae J138
cacagagcuucuaaaaacucuuc

SEQ ID NO: 2547689 - RNA, 23 nt, Chlamydophila pneumoniae J138
cacagaucguaaucuguauaugc

SEQ ID NO: 2547690 - RNA, 13 nt, Chlamydophila pneumoniae J138
cacagcaugcacg

SEQ ID NO: 2547691 - RNA, 13 nt, Chlamydophila pneumoniae J138
cacagcauuuucu

SEQ ID NO: 2547692 - RNA, 14 nt, Chlamydophila pneumoniae J138
cacagcauuuucuc

SEQ ID NO: 2547693 - RNA, 15 nt, Chlamydophila pneumoniae J138
cacagcauuuucucu

SEQ ID NO: 2547694 - RNA, 23 nt, Chlamydophila pneumoniae J138
cacagcauuuucucugagcagcu

SEQ ID NO: 2547695 - RNA, 18 nt, Chlamydophila pneumoniae J138
cacagcuaaucaauccaa

SEQ ID NO: 2547696 - RNA, 18 nt, Chlamydophila pneumoniae J138
cacagcuaaucauagcca

SEQ ID NO: 2547697 - RNA, 19 nt, Chlamydophila pneumoniae J138
cacagcuguacagaacaau

SEQ ID NO: 2547698 - RNA, 18 nt, Chlamydophila pneumoniae J138
cacaggaaugaaaccuuc

SEQ ID NO: 2547699 - RNA, 21 nt, Chlamydophila pneumoniae J138
cacaggaaugaaaccuucaga

SEQ ID NO: 2547700 - RNA, 20 nt, Chlamydophila pneumoniae J138
cacaggggaacgcucucuag

SEQ ID NO: 2547701 - RNA, 20 nt, Chlamydophila pneumoniae J138
cacaguauuccaucacaguu

SEQ ID NO: 2547702 - RNA, 15 nt, Chlamydophila pneumoniae J138
cacagugacacgcuu

SEQ ID NO: 2547703 - RNA, 23 nt, Chlamydophila pneumoniae J138
cacaguuaagacgcagaaacacu

SEQ ID NO: 2547704 - RNA, 17 nt, Chlamydophila pneumoniae J138
cacauacaguacgcaaa

SEQ ID NO: 2547705 - RNA, 20 nt, Chlamydophila pneumoniae J138
cacauacaguacgcaaagua

SEQ ID NO: 2547706 - RNA, 17 nt, Chlamydophila pneumoniae J138
cacauagaaacagucua

SEQ ID NO: 2547707 - RNA, 13 nt, Chlamydophila pneumoniae J138
cacauaguuuaau

SEQ ID NO: 2547708 - RNA, 21 nt, Chlamydophila pneumoniae J138
cacauaguuuaauaaaucuau

SEQ ID NO: 2547709 - RNA, 14 nt, Chlamydophila pneumoniae J138
cacaucaaagcaau

SEQ ID NO: 2547710 - RNA, 17 nt, Chlamydophila pneumoniae J138
cacaucauuaucauaaa

SEQ ID NO: 2547711 - RNA, 17 nt, Chlamydophila pneumoniae J138
cacaucuccuuucaaga

SEQ ID NO: 2547712 - RNA, 16 nt, Chlamydophila pneumoniae J138
cacaucuuuagaauca

SEQ ID NO: 2547713 - RNA, 23 nt, Chlamydophila pneumoniae J138
cacaucuuucucuaaaauaugcu

SEQ ID NO: 2547714 - RNA, 15 nt, Chlamydophila pneumoniae J138
cacaugacaaauaaa

SEQ ID NO: 2547715 - RNA, 21 nt, Chlamydophila pneumoniae J138
cacaugacaaauaaacugacg

SEQ ID NO: 2547716 - RNA, 16 nt, Chlamydophila pneumoniae J138
cacaugcccaaacauc

SEQ ID NO: 2547717 - RNA, 17 nt, Chlamydophila pneumoniae J138
cacauuaagcaaucccc

SEQ ID NO: 2547718 - RNA, 17 nt, Chlamydophila pneumoniae J138
cacauucaagauucccu

SEQ ID NO: 2547719 - RNA, 19 nt, Chlamydophila pneumoniae J138
cacauugcgggcucaaaga

SEQ ID NO: 2547720 - RNA, 23 nt, Chlamydophila pneumoniae J138
cacauuguuuaaguccuucuucc

SEQ ID NO: 2547721 - RNA, 19 nt, Chlamydophila pneumoniae J138
cacauuuagaaguaauccu

SEQ ID NO: 2547722 - RNA, 21 nt, Chlamydophila pneumoniae J138
cacauuuagaaguaauccuaa

SEQ ID NO: 2547723 - RNA, 15 nt, Chlamydophila pneumoniae J138
caccaaaaauuccgu

SEQ ID NO: 2547724 - RNA, 12 nt, Chlamydophila pneumoniae J138
caccaaaagaau

SEQ ID NO: 2547725 - RNA, 15 nt, Chlamydophila pneumoniae J138
caccaaaagaauacu

SEQ ID NO: 2547726 - RNA, 12 nt, Chlamydophila pneumoniae J138
caccaagacuga

SEQ ID NO: 2547727 - RNA, 21 nt, Chlamydophila pneumoniae J138
caccaaggggcguucuugaaa

SEQ ID NO: 2547728 - RNA, 19 nt, Chlamydophila pneumoniae J138
caccaaugauaauuucauu

SEQ ID NO: 2547729 - RNA, 14 nt, Chlamydophila pneumoniae J138
caccagaagcaacu

SEQ ID NO: 2547730 - RNA, 18 nt, Chlamydophila pneumoniae J138
caccagaagcauugagga

SEQ ID NO: 2547731 - RNA, 16 nt, Chlamydophila pneumoniae J138
cagaaggcuuguuucu

SEQ ID NO: 2547732 - RNA, 22 nt, Chlamydophila pneumoniae J138
cagaagguaaauuuuuaaaacu

SEQ ID NO: 2547733 - RNA, 15 nt, Chlamydophila pneumoniae J138
cagaagguuccacag

SEQ ID NO: 2547734 - RNA, 18 nt, Chlamydophila pneumoniae J138
cagaaguuccuacuucug

SEQ ID NO: 2547735 - RNA, 21 nt, Chlamydophila pneumoniae J138
cagaauauagacuuguauucu

SEQ ID NO: 2547736 - RNA, 18 nt, Chlamydophila pneumoniae J138
cagaaucauaaucugcgu

SEQ ID NO: 2547737 - RNA, 18 nt, Chlamydophila pneumoniae J138
cagaaucuaaguaaaacu

SEQ ID NO: 2547738 - RNA, 15 nt, Chlamydophila pneumoniae J138
cagaaucuaugagag

SEQ ID NO: 2547739 - RNA, 13 nt, Chlamydophila pneumoniae J138
cagaaucuccauu

SEQ ID NO: 2547740 - RNA, 16 nt, Chlamydophila pneumoniae J138
cagaauguacauagag

SEQ ID NO: 2547741 - RNA, 17 nt, Chlamydophila pneumoniae J138
cagaauugcaaaguacu

SEQ ID NO: 2547742 - RNA, 14 nt, Chlamydophila pneumoniae J138
cagaauuguuuugu

SEQ ID NO: 2547743 - RNA, 18 nt, Chlamydophila pneumoniae J138
cagaauuuuaucagaaac

SEQ ID NO: 2547744 - RNA, 19 nt, Chlamydophila pneumoniae J138
cagaauuuuaucagaaacu

SEQ ID NO: 2547745 - RNA, 12 nt, Chlamydophila pneumoniae J138
cagaauuuucug

SEQ ID NO: 2547746 - RNA, 17 nt, Chlamydophila pneumoniae J138
cagacagucugugagaa

SEQ ID NO: 2547747 - RNA, 22 nt, Chlamydophila pneumoniae J138
cagacucgccgaaaguaucuuc

SEQ ID NO: 2547748 - RNA, 14 nt, Chlamydophila pneumoniae J138
cagacugaagagca

SEQ ID NO: 2547749 - RNA, 22 nt, Chlamydophila pneumoniae J138
cagacugaagucguuuagauuu

SEQ ID NO: 2547750 - RNA, 18 nt, Chlamydophila pneumoniae J138
cagacuucguaucuucga

SEQ ID NO: 2547751 - RNA, 16 nt, Chlamydophila pneumoniae J138
cagacuugaggaaucu

SEQ ID NO: 2547752 - RNA, 13 nt, Chlamydophila pneumoniae J138
cagagaaaaucaa

SEQ ID NO: 2547753 - RNA, 23 nt, Chlamydophila pneumoniae J138
cagagaaauuaacagagcgccuc

SEQ ID NO: 2547754 - RNA, 15 nt, Chlamydophila pneumoniae J138
cagagaaauucaugc

SEQ ID NO: 2547755 - RNA, 14 nt, Chlamydophila pneumoniae J138
cagagaacaauaaa

SEQ ID NO: 2547756 - RNA, 14 nt, Chlamydophila pneumoniae J138
cagagaacuuucgu

SEQ ID NO: 2547757 - RNA, 18 nt, Chlamydophila pneumoniae J138
cagagaauguucccaaau

SEQ ID NO: 2547758 - RNA, 22 nt, Chlamydophila pneumoniae J138
cagagaauugcauucuuaauag

SEQ ID NO: 2547759 - RNA, 14 nt, Chlamydophila pneumoniae J138
cagagaccuucucu

SEQ ID NO: 2547760 - RNA, 14 nt, Chlamydophila pneumoniae J138
cagagagaacagga

SEQ ID NO: 2547761 - RNA, 17 nt, Chlamydophila pneumoniae J138
cagagaugcuaacaacu

SEQ ID NO: 2547762 - RNA, 12 nt, Chlamydophila pneumoniae J138
cagagauggucu

SEQ ID NO: 2547763 - RNA, 15 nt, Chlamydophila pneumoniae J138
cagagauguggcaga

SEQ ID NO: 2547764 - RNA, 13 nt, Chlamydophila pneumoniae J138
cagagauucuuca

SEQ ID NO: 2547765 - RNA, 18 nt, Chlamydophila pneumoniae J138
cagagauugccaggagag

SEQ ID NO: 2547766 - RNA, 20 nt, Chlamydophila pneumoniae J138
cagagauugccaggagagcu

SEQ ID NO: 2547767 - RNA, 16 nt, Chlamydophila pneumoniae J138
cagagccgucuacuuu

SEQ ID NO: 2547768 - RNA, 20 nt, Chlamydophila pneumoniae J138
cagagcgaucgcaaucagca

SEQ ID NO: 2547769 - RNA, 13 nt, Chlamydophila pneumoniae J138
cagagcgccucca

SEQ ID NO: 2547770 - RNA, 14 nt, Chlamydophila pneumoniae J138
cagagcgccuccac

SEQ ID NO: 2547771 - RNA, 16 nt, Chlamydophila pneumoniae J138
cagagcgccuccaccu

SEQ ID NO: 2547772 - RNA, 18 nt, Chlamydophila pneumoniae J138
cagagcuucuaaaaacuc

SEQ ID NO: 2547773 - RNA, 11 nt, Chlamydophila pneumoniae J138
cagaggagccu

SEQ ID NO: 2547774 - RNA, 12 nt, Chlamydophila pneumoniae J138
cagaggagccuc

SEQ ID NO: 2547775 - RNA, 23 nt, Chlamydophila pneumoniae J138
cagaggaucuagaaaaugaagag

SEQ ID NO: 2547776 - RNA, 17 nt, Chlamydophila pneumoniae J138
cagaggcuagaaaauca

SEQ ID NO: 2547777 - RNA, 20 nt, Chlamydophila pneumoniae J138
cagagggcuucauuccuaca

SEQ ID NO: 2547778 - RNA, 16 nt, Chlamydophila pneumoniae J138
cagagguuagaaggga

SEQ ID NO: 2547779 - RNA, 20 nt, Chlamydophila pneumoniae J138
cagagucagaagcuauucca

SEQ ID NO: 2547780 - RNA, 15 nt, Chlamydophila pneumoniae J138
cagaguccuucuuuu

SEQ ID NO: 2547781 - RNA, 18 nt, Chlamydophila pneumoniae J138
cagaguccuucuuuuccg

SEQ ID NO: 2547782 - RNA, 13 nt, Chlamydophila pneumoniae J138
cagagucugggau

SEQ ID NO: 2547783 - RNA, 18 nt, Chlamydophila pneumoniae J138
cagaguggucauugccuu

SEQ ID NO: 2547784 - RNA, 16 nt, Chlamydophila pneumoniae J138
cagaguuuuucccucg

SEQ ID NO: 2547785 - RNA, 14 nt, Chlamydophila pneumoniae J138
cagauaaaaagaag

SEQ ID NO: 2547786 - RNA, 22 nt, Chlamydophila pneumoniae J138
cagauaaagcaaagauaaagaa

SEQ ID NO: 2547787 - RNA, 17 nt, Chlamydophila pneumoniae J138
cagauaccaaaauacca

SEQ ID NO: 2547788 - RNA, 15 nt, Chlamydophila pneumoniae J138
cagauacuaaacucc

SEQ ID NO: 2547789 - RNA, 20 nt, Chlamydophila pneumoniae J138
cagauacuaaacuccauugu

SEQ ID NO: 2547790 - RNA, 15 nt, Chlamydophila pneumoniae J138
cagauagcuuacaga

SEQ ID NO: 2547791 - RNA, 19 nt, Chlamydophila pneumoniae J138
cagauaucaaagcauugca

SEQ ID NO: 2547792 - RNA, 14 nt, Chlamydophila pneumoniae J138
cagaucaaugccuu

SEQ ID NO: 2547793 - RNA, 20 nt, Chlamydophila pneumoniae J138
cagaucauaucggcagcagc

SEQ ID NO: 2547794 - RNA, 20 nt, Chlamydophila pneumoniae J138
cagaucugcauaauuuuucu

SEQ ID NO: 2547795 - RNA, 12 nt, Chlamydophila pneumoniae J138
cagaugauuuua

SEQ ID NO: 2547796 - RNA, 15 nt, Chlamydophila pneumoniae J138
cagaugauuuuaucu

SEQ ID NO: 2547797 - RNA, 14 nt, Chlamydophila pneumoniae J138
cagaugcuucaagg

SEQ ID NO: 2547798 - RNA, 14 nt, Chlamydophila pneumoniae J138
cagauggucagucu

SEQ ID NO: 2547799 - RNA, 16 nt, Chlamydophila pneumoniae J138
cagauggucagucucg

SEQ ID NO: 2547800 - RNA, 20 nt, Chlamydophila pneumoniae J138
cagauuagaaaagauaaaac

SEQ ID NO: 2547801 - RNA, 23 nt, Chlamydophila pneumoniae J138
cagauuagaaaagauaaaacauu

SEQ ID NO: 2547802 - RNA, 13 nt, Chlamydophila pneumoniae J138
cagauuagaguua

SEQ ID NO: 2547803 - RNA, 18 nt, Chlamydophila pneumoniae J138
cagauuagaguuagaugu

SEQ ID NO: 2547804 - RNA, 22 nt, Chlamydophila pneumoniae J138
cagauugaugcugacagcucca

SEQ ID NO: 2547805 - RNA, 20 nt, Chlamydophila pneumoniae J138
cagauuuuuuaaccucuuuu

SEQ ID NO: 2547806 - RNA, 18 nt, Chlamydophila pneumoniae J138
cagcaaagacauccaagc

SEQ ID NO: 2547807 - RNA, 23 nt, Chlamydophila pneumoniae J138
cagcaaagcgaccugcaaaugaa

SEQ ID NO: 2547808 - RNA, 15 nt, Chlamydophila pneumoniae J138
cagcaacaaccaaaa

SEQ ID NO: 2547809 - RNA, 19 nt, Chlamydophila pneumoniae J138
cagcaacaucguuaauaua

SEQ ID NO: 2547810 - RNA, 18 nt, Chlamydophila pneumoniae J138
cagcaacccgaauuccuc

SEQ ID NO: 2547811 - RNA, 19 nt, Chlamydophila pneumoniae J138
cagcaacuaaagcauacuu

SEQ ID NO: 2547812 - RNA, 23 nt, Chlamydophila pneumoniae J138
cagcaagaacauaaccucggucu

SEQ ID NO: 2547813 - RNA, 19 nt, Chlamydophila pneumoniae J138
cagcaaucacaucaguucc

SEQ ID NO: 2547814 - RNA, 20 nt, Chlamydophila pneumoniae J138
cagcaaucacaucaguucca

SEQ ID NO: 2547815 - RNA, 21 nt, Chlamydophila pneumoniae J138
cagcaccuuuaggaagcugua

SEQ ID NO: 2547816 - RNA, 18 nt, Chlamydophila pneumoniae J138
cagcacgaauaaagcccu

SEQ ID NO: 2547817 - RNA, 15 nt, Chlamydophila pneumoniae J138
cagcacucuuuuucu

SEQ ID NO: 2547818 - RNA, 14 nt, Chlamydophila pneumoniae J138
cagcagaugaaacu

SEQ ID NO: 2547819 - RNA, 18 nt, Chlamydophila pneumoniae J138
cagcagcugucaauccaa

SEQ ID NO: 2547820 - RNA, 22 nt, Chlamydophila pneumoniae J138
cagcagcugucaauccaacaaa

SEQ ID NO: 2547821 - RNA, 22 nt, Chlamydophila pneumoniae J138
cagcagcuucccaagcagaaga

SEQ ID NO: 2547822 - RNA, 18 nt, Chlamydophila pneumoniae J138
cagcauaaguuagccugg

SEQ ID NO: 2547823 - RNA, 22 nt, Chlamydophila pneumoniae J138
cagcaucacguauaauacguac

SEQ ID NO: 2547824 - RNA, 18 nt, Chlamydophila pneumoniae J138
cagcaucaggauucucuc

SEQ ID NO: 2547825 - RNA, 20 nt, Chlamydophila pneumoniae J138
cagcaucaggauucucucug

SEQ ID NO: 2547826 - RNA, 18 nt, Chlamydophila pneumoniae J138
cagcauggacuccaagaa

SEQ ID NO: 2547827 - RNA, 16 nt, Chlamydophila pneumoniae J138
cagcauuuucuaaagu

SEQ ID NO: 2547828 - RNA, 14 nt, Chlamydophila pneumoniae J138
cagcauuuucucug

SEQ ID NO: 2547829 - RNA, 11 nt, Chlamydophila pneumoniae J138
cagccagcaga

SEQ ID NO: 2547830 - RNA, 13 nt, Chlamydophila pneumoniae J138
cagcccccaggcu

SEQ ID NO: 2547831 - RNA, 20 nt, Chlamydophila pneumoniae J138
caguagagccucuaagaaaa

SEQ ID NO: 2547832 - RNA, 15 nt, Chlamydophila pneumoniae J138
caguagccuucuucu

SEQ ID NO: 2547833 - RNA, 19 nt, Chlamydophila pneumoniae J138
caguagguaagaagcuguc

SEQ ID NO: 2547834 - RNA, 17 nt, Chlamydophila pneumoniae J138
caguauaagaugcugaa

SEQ ID NO: 2547835 - RNA, 21 nt, Chlamydophila pneumoniae J138
caguaucguaacuuccuuuuu

SEQ ID NO: 2547836 - RNA, 17 nt, Chlamydophila pneumoniae J138
caguauggcguuuuuuu

SEQ ID NO: 2547837 - RNA, 20 nt, Chlamydophila pneumoniae J138
caguauggcguuuuuuuuga

SEQ ID NO: 2547838 - RNA, 15 nt, Chlamydophila pneumoniae J138
caguauuauaaauag

SEQ ID NO: 2547839 - RNA, 23 nt, Chlamydophila pneumoniae J138
caguauuauaaauagaaaucuua

SEQ ID NO: 2547840 - RNA, 23 nt, Chlamydophila pneumoniae J138
caguauuccaucacaguuaagac

SEQ ID NO: 2547841 - RNA, 17 nt, Chlamydophila pneumoniae J138
cagucacaauauagccc

SEQ ID NO: 2547842 - RNA, 18 nt, Chlamydophila pneumoniae J138
cagucuauagccucuucu

SEQ ID NO: 2547843 - RNA, 16 nt, Chlamydophila pneumoniae J138
cagucucgaguccagu

SEQ ID NO: 2547844 - RNA, 19 nt, Chlamydophila pneumoniae J138
cagucugugagaaauaggu

SEQ ID NO: 2547845 - RNA, 18 nt, Chlamydophila pneumoniae J138
cagugaaauuuugcaaca

SEQ ID NO: 2547846 - RNA, 15 nt, Chlamydophila pneumoniae J138
cagugaauccuucca

SEQ ID NO: 2547847 - RNA, 17 nt, Chlamydophila pneumoniae J138
caguggcucuauagggg

SEQ ID NO: 2547848 - RNA, 16 nt, Chlamydophila pneumoniae J138
caguguauaacguaga

SEQ ID NO: 2547849 - RNA, 23 nt, Chlamydophila pneumoniae J138
caguguccacugcagcagguguc

SEQ ID NO: 2547850 - RNA, 15 nt, Chlamydophila pneumoniae J138
cagugugcugauuuu

SEQ ID NO: 2547851 - RNA, 16 nt, Chlamydophila pneumoniae J138
caguucaucuagauga

SEQ ID NO: 2547852 - RNA, 17 nt, Chlamydophila pneumoniae J138
caguuccgauaaagaua

SEQ ID NO: 2547853 - RNA, 15 nt, Chlamydophila pneumoniae J138
caguuccuaaauuca

SEQ ID NO: 2547854 - RNA, 22 nt, Chlamydophila pneumoniae J138
caguucuucauuccaggauucu

SEQ ID NO: 2547855 - RNA, 22 nt, Chlamydophila pneumoniae J138
caguucuuguuaaaguaaaaaa

SEQ ID NO: 2547856 - RNA, 15 nt, Chlamydophila pneumoniae J138
caguucuuucugcuu

SEQ ID NO: 2547857 - RNA, 23 nt, Chlamydophila pneumoniae J138
caguugaugagaaaaagaaucuc

SEQ ID NO: 2547858 - RNA, 18 nt, Chlamydophila pneumoniae J138
caguuggcguuuucuaga

SEQ ID NO: 2547859 - RNA, 21 nt, Chlamydophila pneumoniae J138
caguugguagagcaacacauu

SEQ ID NO: 2547860 - RNA, 22 nt, Chlamydophila pneumoniae J138
caguuguauccagcucaaggca

SEQ ID NO: 2547861 - RNA, 22 nt, Chlamydophila pneumoniae J138
caguuuuaucggcaauuguuaa

SEQ ID NO: 2547862 - RNA, 15 nt, Chlamydophila pneumoniae J138
caguuuuccauccac

SEQ ID NO: 2547863 - RNA, 18 nt, Chlamydophila pneumoniae J138
caguuuuuuucuaaauuu

SEQ ID NO: 2547864 - RNA, 14 nt, Chlamydophila pneumoniae J138
cauaaaaaaagcua

SEQ ID NO: 2547865 - RNA, 15 nt, Chlamydophila pneumoniae J138
cauaaaaauucucau

SEQ ID NO: 2547866 - RNA, 16 nt, Chlamydophila pneumoniae J138
cauaaaaauucucaua

SEQ ID NO: 2547867 - RNA, 19 nt, Chlamydophila pneumoniae J138
cauaaacuccuaggggaau

SEQ ID NO: 2547868 - RNA, 19 nt, Chlamydophila pneumoniae J138
cauaaagacccuucuuucc

SEQ ID NO: 2547869 - RNA, 23 nt, Chlamydophila pneumoniae J138
cauaaagaccgagaagcuucaau

SEQ ID NO: 2547870 - RNA, 22 nt, Chlamydophila pneumoniae J138
cauaaagaucgugaucaaagaa

SEQ ID NO: 2547871 - RNA, 22 nt, Chlamydophila pneumoniae J138
cauaaagccccacccacuccag

SEQ ID NO: 2547872 - RNA, 22 nt, Chlamydophila pneumoniae J138
cauaaaggcgucgccccaugaa

SEQ ID NO: 2547873 - RNA, 20 nt, Chlamydophila pneumoniae J138
cauaaaguauauugacaaca

SEQ ID NO: 2547874 - RNA, 21 nt, Chlamydophila pneumoniae J138
cauaaaguucggcgccuucaa

SEQ ID NO: 2547875 - RNA, 22 nt, Chlamydophila pneumoniae J138
cauaaaguucggcgccuucaaa

SEQ ID NO: 2547876 - RNA, 19 nt, Chlamydophila pneumoniae J138
cauaaauacgugcuugaau

SEQ ID NO: 2547877 - RNA, 21 nt, Chlamydophila pneumoniae J138
cauaaauguauaggcauuaau

SEQ ID NO: 2547878 - RNA, 19 nt, Chlamydophila pneumoniae J138
cauaacaagggaagagaaa

SEQ ID NO: 2547879 - RNA, 22 nt, Chlamydophila pneumoniae J138
cauaacauuuagauaaagaaag

SEQ ID NO: 2547880 - RNA, 17 nt, Chlamydophila pneumoniae J138
cauaaccaaguaaauca

SEQ ID NO: 2547881 - RNA, 12 nt, Chlamydophila pneumoniae J138
cauaacccaaag

SEQ ID NO: 2547882 - RNA, 17 nt, Chlamydophila pneumoniae J138
cauaaccuccucuucuu

SEQ ID NO: 2547883 - RNA, 19 nt, Chlamydophila pneumoniae J138
cauaaccugggcaauauuu

SEQ ID NO: 2547884 - RNA, 20 nt, Chlamydophila pneumoniae J138
cauaaccuuugacaacacca

SEQ ID NO: 2547885 - RNA, 20 nt, Chlamydophila pneumoniae J138
cauaacgacaugccuuggua

SEQ ID NO: 2547886 - RNA, 18 nt, Chlamydophila pneumoniae J138
cauaacgggguugucucu

SEQ ID NO: 2547887 - RNA, 15 nt, Chlamydophila pneumoniae J138
cauaacuugaagaag

SEQ ID NO: 2547888 - RNA, 22 nt, Chlamydophila pneumoniae J138
cauaacuugaagaaguacaagu

SEQ ID NO: 2547889 - RNA, 24 nt, Chlamydophila pneumoniae J138
cauaagaguagacaagagagagcu

SEQ ID NO: 2547890 - RNA, 19 nt, Chlamydophila pneumoniae J138
cauaagaucaauauagaga

SEQ ID NO: 2547891 - RNA, 20 nt, Chlamydophila pneumoniae J138
cauaagaucaauauagagaa

SEQ ID NO: 2547892 - RNA, 21 nt, Chlamydophila pneumoniae J138
cauaagauugccauguacaug

SEQ ID NO: 2547893 - RNA, 16 nt, Chlamydophila pneumoniae J138
cauaagauuuccccaa

SEQ ID NO: 2547894 - RNA, 15 nt, Chlamydophila pneumoniae J138
cauaagcucuauuuc

SEQ ID NO: 2547895 - RNA, 14 nt, Chlamydophila pneumoniae J138
cauaagcuuuucuu

SEQ ID NO: 2547896 - RNA, 15 nt, Chlamydophila pneumoniae J138
cauaaguauagagag

SEQ ID NO: 2547897 - RNA, 15 nt, Chlamydophila pneumoniae J138
cauaaguuagccugg

SEQ ID NO: 2547898 - RNA, 13 nt, Chlamydophila pneumoniae J138
cauaauagucucu

SEQ ID NO: 2547899 - RNA, 17 nt, Chlamydophila pneumoniae J138
cauaauagucucuguaa

SEQ ID NO: 2547900 - RNA, 12 nt, Chlamydophila pneumoniae J138
cauaauccaaga

SEQ ID NO: 2547901 - RNA, 15 nt, Chlamydophila pneumoniae J138
cauaaucucaccaga

SEQ ID NO: 2547902 - RNA, 20 nt, Chlamydophila pneumoniae J138
cauaaucucaccagaagcaa

SEQ ID NO: 2547903 - RNA, 16 nt, Chlamydophila pneumoniae J138
cauaauuagagagaau

SEQ ID NO: 2547904 - RNA, 17 nt, Chlamydophila pneumoniae J138
cauacacaaaucauuua

SEQ ID NO: 2547905 - RNA, 17 nt, Chlamydophila pneumoniae J138
cauacaccccaguuucu

SEQ ID NO: 2547906 - RNA, 21 nt, Chlamydophila pneumoniae J138
cauacaggcuccucugcuaag

SEQ ID NO: 2547907 - RNA, 16 nt, Chlamydophila pneumoniae J138
cauacaguagaaacau

SEQ ID NO: 2547908 - RNA, 18 nt, Chlamydophila pneumoniae J138
cauacaucguauccaaau

SEQ ID NO: 2547909 - RNA, 18 nt, Chlamydophila pneumoniae J138
cauacaugcuaauccagc

SEQ ID NO: 2547910 - RNA, 19 nt, Chlamydophila pneumoniae J138
cauacaugcuaauccagca

SEQ ID NO: 2547911 - RNA, 15 nt, Chlamydophila pneumoniae J138
cauacauucuauucu

SEQ ID NO: 2547912 - RNA, 16 nt, Chlamydophila pneumoniae J138
cauacgguaaggagga

SEQ ID NO: 2547913 - RNA, 23 nt, Chlamydophila pneumoniae J138
cauacucgucaaauucauuaaga

SEQ ID NO: 2547914 - RNA, 14 nt, Chlamydophila pneumoniae J138
cauacucuucaucc

SEQ ID NO: 2547915 - RNA, 18 nt, Chlamydophila pneumoniae J138
cauacucuucauccugau

SEQ ID NO: 2547916 - RNA, 13 nt, Chlamydophila pneumoniae J138
cauacugauauac

SEQ ID NO: 2547917 - RNA, 16 nt, Chlamydophila pneumoniae J138
cauacuuauccuuuuc

SEQ ID NO: 2547918 - RNA, 11 nt, Chlamydophila pneumoniae J138
cauagaauaaa

SEQ ID NO: 2547919 - RNA, 15 nt, Chlamydophila pneumoniae J138
cauagacucuuccuu

SEQ ID NO: 2547920 - RNA, 12 nt, Chlamydophila pneumoniae J138
cauagaggagau

SEQ ID NO: 2547921 - RNA, 16 nt, Chlamydophila pneumoniae J138
cauagaguaucuaaaa

SEQ ID NO: 2547922 - RNA, 14 nt, Chlamydophila pneumoniae J138
cauagcaacuacag

SEQ ID NO: 2547923 - RNA, 20 nt, Chlamydophila pneumoniae J138
cauagcaacuacagagggcu

SEQ ID NO: 2547924 - RNA, 19 nt, Chlamydophila pneumoniae J138
cauagccuuccuguuaagg

SEQ ID NO: 2547925 - RNA, 17 nt, Chlamydophila pneumoniae J138
cauagcguauuccccac

SEQ ID NO: 2547926 - RNA, 22 nt, Chlamydophila pneumoniae J138
cauagcuaaguaacaguccucu

SEQ ID NO: 2547927 - RNA, 16 nt, Chlamydophila pneumoniae J138
cauagcugaggcaucu

SEQ ID NO: 2547928 - RNA, 19 nt, Chlamydophila pneumoniae J138
cauagggaugacccaaaaa

SEQ ID NO: 2547929 - RNA, 20 nt, Chlamydophila pneumoniae J138
cauagguaaaaccagcauaa

SEQ ID NO: 2547930 - RNA, 20 nt, Chlamydophila pneumoniae J138
caugagaaauacgcuuuucu

SEQ ID NO: 2547931 - RNA, 21 nt, Chlamydophila pneumoniae J138
caugagagucgaaacacucau

SEQ ID NO: 2547932 - RNA, 17 nt, Chlamydophila pneumoniae J138
caugaggagaccuuuau

SEQ ID NO: 2547933 - RNA, 12 nt, Chlamydophila pneumoniae J138
caugaggcugcu

SEQ ID NO: 2547934 - RNA, 21 nt, Chlamydophila pneumoniae J138
caugauaaaaauuuucaggaa

SEQ ID NO: 2547935 - RNA, 14 nt, Chlamydophila pneumoniae J138
caugaugccauuga

SEQ ID NO: 2547936 - RNA, 13 nt, Chlamydophila pneumoniae J138
caugauuuuucaa

SEQ ID NO: 2547937 - RNA, 18 nt, Chlamydophila pneumoniae J138
caugcacgagagccucgg

SEQ ID NO: 2547938 - RNA, 19 nt, Chlamydophila pneumoniae J138
caugccgcauuucuucaau

SEQ ID NO: 2547939 - RNA, 22 nt, Chlamydophila pneumoniae J138
caugccuggccaucaucaccag

SEQ ID NO: 2547940 - RNA, 20 nt, Chlamydophila pneumoniae J138
caugccuuuggcaaucaucu

SEQ ID NO: 2547941 - RNA, 18 nt, Chlamydophila pneumoniae J138
caugcgcagaauaaaaug

SEQ ID NO: 2547942 - RNA, 16 nt, Chlamydophila pneumoniae J138
caugcuaauaauuccu

SEQ ID NO: 2547943 - RNA, 17 nt, Chlamydophila pneumoniae J138
caugcuaauaauuccug

SEQ ID NO: 2547944 - RNA, 12 nt, Chlamydophila pneumoniae J138
caugcucaagaa

SEQ ID NO: 2547945 - RNA, 13 nt, Chlamydophila pneumoniae J138
caugcuugaggaa

SEQ ID NO: 2547946 - RNA, 20 nt, Chlamydophila pneumoniae J138
caugcuugaggaauucuuua

SEQ ID NO: 2547947 - RNA, 19 nt, Chlamydophila pneumoniae J138
cauggacaagcaaaagcaa

SEQ ID NO: 2547948 - RNA, 14 nt, Chlamydophila pneumoniae J138
cauggagguucuca

SEQ ID NO: 2547949 - RNA, 19 nt, Chlamydophila pneumoniae J138
cauggcuggaaagccaagc

SEQ ID NO: 2547950 - RNA, 22 nt, Chlamydophila pneumoniae J138
cauggcuuugugagcugcuggu

SEQ ID NO: 2547951 - RNA, 15 nt, Chlamydophila pneumoniae J138
cauguaacugaaagu

SEQ ID NO: 2547952 - RNA, 18 nt, Chlamydophila pneumoniae J138
cauguacaguuuguaaaa

SEQ ID NO: 2547953 - RNA, 16 nt, Chlamydophila pneumoniae J138
cauguaguaaauuccu

SEQ ID NO: 2547954 - RNA, 17 nt, Chlamydophila pneumoniae J138
cauguaguaaauuccuc

SEQ ID NO: 2547955 - RNA, 20 nt, Chlamydophila pneumoniae J138
cauguauuguguucccucuu

SEQ ID NO: 2547956 - RNA, 11 nt, Chlamydophila pneumoniae J138
caugucuaagu

SEQ ID NO: 2547957 - RNA, 13 nt, Chlamydophila pneumoniae J138
caugugcugaaga

SEQ ID NO: 2547958 - RNA, 14 nt, Chlamydophila pneumoniae J138
caugugcugaagac

SEQ ID NO: 2547959 - RNA, 15 nt, Chlamydophila pneumoniae J138
caugugcugaagacc

SEQ ID NO: 2547960 - RNA, 18 nt, Chlamydophila pneumoniae J138
cauguuaagcguauagaa

SEQ ID NO: 2547961 - RNA, 20 nt, Chlamydophila pneumoniae J138
cauguuaagcguauagaaua

SEQ ID NO: 2547962 - RNA, 22 nt, Chlamydophila pneumoniae J138
cauguuaucaagacgacacuca

SEQ ID NO: 2547963 - RNA, 14 nt, Chlamydophila pneumoniae J138
cauguugcaaagca

SEQ ID NO: 2547964 - RNA, 20 nt, Chlamydophila pneumoniae J138
cauguuuaauaucagcuucu

SEQ ID NO: 2547965 - RNA, 13 nt, Chlamydophila pneumoniae J138
cauguuucacuua

SEQ ID NO: 2547966 - RNA, 13 nt, Chlamydophila pneumoniae J138
cauuaagaacauc

SEQ ID NO: 2547967 - RNA, 17 nt, Chlamydophila pneumoniae J138
cauuaagauaaacauua

SEQ ID NO: 2547968 - RNA, 20 nt, Chlamydophila pneumoniae J138
cauuaagcucaaaauuuccu

SEQ ID NO: 2547969 - RNA, 23 nt, Chlamydophila pneumoniae J138
cauuaauaacuuuagguauuuac

SEQ ID NO: 2547970 - RNA, 16 nt, Chlamydophila pneumoniae J138
cauuaauaauaucuaa

SEQ ID NO: 2547971 - RNA, 15 nt, Chlamydophila pneumoniae J138
cauuaccguucccua

SEQ ID NO: 2547972 - RNA, 20 nt, Chlamydophila pneumoniae J138
cauuaccguucccuaaagua

SEQ ID NO: 2547973 - RNA, 23 nt, Chlamydophila pneumoniae J138
cauuacggaggcauaaucuccaa

SEQ ID NO: 2547974 - RNA, 22 nt, Chlamydophila pneumoniae J138
cauuacgguuucugggaugcac

SEQ ID NO: 2547975 - RNA, 23 nt, Chlamydophila pneumoniae J138
cauuagaguuugguuuguuugau

SEQ ID NO: 2547976 - RNA, 19 nt, Chlamydophila pneumoniae J138
cauuagcaaucgaauagcu

SEQ ID NO: 2547977 - RNA, 16 nt, Chlamydophila pneumoniae J138
cauuagcuaaaucaaa

SEQ ID NO: 2547978 - RNA, 15 nt, Chlamydophila pneumoniae J138
cauuagggcauucug

SEQ ID NO: 2547979 - RNA, 17 nt, Chlamydophila pneumoniae J138
cauuagggcauucugua

SEQ ID NO: 2547980 - RNA, 19 nt, Chlamydophila pneumoniae J138
cauuagggcauucuguaau

SEQ ID NO: 2547981 - RNA, 15 nt, Chlamydophila pneumoniae J138
cauuauacuuuuuuu

SEQ ID NO: 2547982 - RNA, 19 nt, Chlamydophila pneumoniae J138
cauuauacuuuuuuuauau

SEQ ID NO: 2547983 - RNA, 17 nt, Chlamydophila pneumoniae J138
cauuauuaaacgaauac

SEQ ID NO: 2547984 - RNA, 15 nt, Chlamydophila pneumoniae J138
cauucaauaauuuca

SEQ ID NO: 2547985 - RNA, 22 nt, Chlamydophila pneumoniae J138
cauucacagcagucgugauauc

SEQ ID NO: 2547986 - RNA, 16 nt, Chlamydophila pneumoniae J138
cauuccaagaaaaauu

SEQ ID NO: 2547987 - RNA, 12 nt, Chlamydophila pneumoniae J138
cauuccaagauu

SEQ ID NO: 2547988 - RNA, 17 nt, Chlamydophila pneumoniae J138
cauuccagcaucuucuc

SEQ ID NO: 2547989 - RNA, 14 nt, Chlamydophila pneumoniae J138
cauuccaggauucu

SEQ ID NO: 2547990 - RNA, 15 nt, Chlamydophila pneumoniae J138
cauucccuaaagcug

SEQ ID NO: 2547991 - RNA, 18 nt, Chlamydophila pneumoniae J138
cauucccuaaagcugcca

SEQ ID NO: 2547992 - RNA, 19 nt, Chlamydophila pneumoniae J138
cauucccuaaagcugccag

SEQ ID NO: 2547993 - RNA, 14 nt, Chlamydophila pneumoniae J138
cauuccgagcugca

SEQ ID NO: 2547994 - RNA, 18 nt, Chlamydophila pneumoniae J138
cauucguuaggugaccca

SEQ ID NO: 2547995 - RNA, 22 nt, Chlamydophila pneumoniae J138
cauucuaacgcuuuuucaaacu

SEQ ID NO: 2547996 - RNA, 15 nt, Chlamydophila pneumoniae J138
cauucucaauucugu

SEQ ID NO: 2547997 - RNA, 15 nt, Chlamydophila pneumoniae J138
cauucucacagcaug

SEQ ID NO: 2547998 - RNA, 19 nt, Chlamydophila pneumoniae J138
cauucucaugucuaaguca

SEQ ID NO: 2547999 - RNA, 23 nt, Chlamydophila pneumoniae J138
cauucuccgccagaguuuaaagc

SEQ ID NO: 2548000 - RNA, 16 nt, Chlamydophila pneumoniae J138
cauucuuaauauaaaa

SEQ ID NO: 2548001 - RNA, 15 nt, Chlamydophila pneumoniae J138
cauugaauccuucua

SEQ ID NO: 2548002 - RNA, 18 nt, Chlamydophila pneumoniae J138
cauugaauccuucuauag

SEQ ID NO: 2548003 - RNA, 15 nt, Chlamydophila pneumoniae J138
cauugagauccauag

SEQ ID NO: 2548004 - RNA, 14 nt, Chlamydophila pneumoniae J138
cauugaucagaauc

SEQ ID NO: 2548005 - RNA, 16 nt, Chlamydophila pneumoniae J138
cauugcaaaaaugaaa

SEQ ID NO: 2548006 - RNA, 18 nt, Chlamydophila pneumoniae J138
cauugccauaauaaaggu

SEQ ID NO: 2548007 - RNA, 14 nt, Chlamydophila pneumoniae J138
cauugccuugcugc

SEQ ID NO: 2548008 - RNA, 16 nt, Chlamydophila pneumoniae J138
cauugcuauugaaaaa

SEQ ID NO: 2548009 - RNA, 17 nt, Chlamydophila pneumoniae J138
cauugucucuuuuaaag

SEQ ID NO: 2548010 - RNA, 23 nt, Chlamydophila pneumoniae J138
cauuguuuaaguccuucuuccca

SEQ ID NO: 2548011 - RNA, 21 nt, Chlamydophila pneumoniae J138
cauuguuuggcaguucacuga

SEQ ID NO: 2548012 - RNA, 22 nt, Chlamydophila pneumoniae J138
cauuguuuguccuaggagagcu

SEQ ID NO: 2548013 - RNA, 16 nt, Chlamydophila pneumoniae J138
cauuuaaacuaagaau

SEQ ID NO: 2548014 - RNA, 14 nt, Chlamydophila pneumoniae J138
cauuuaaagcugaa

SEQ ID NO: 2548015 - RNA, 16 nt, Chlamydophila pneumoniae J138
cauuuagaaguaaucc

SEQ ID NO: 2548016 - RNA, 19 nt, Chlamydophila pneumoniae J138
cauuuaucugcguuucuuu

SEQ ID NO: 2548017 - RNA, 16 nt, Chlamydophila pneumoniae J138
cauuucauguaagaau

SEQ ID NO: 2548018 - RNA, 16 nt, Chlamydophila pneumoniae J138
cauuuccccaugaaaa

SEQ ID NO: 2548019 - RNA, 20 nt, Chlamydophila pneumoniae J138
cauuucgauaacacuucuuu

SEQ ID NO: 2548020 - RNA, 13 nt, Chlamydophila pneumoniae J138
cauuucguuuuuu

SEQ ID NO: 2548021 - RNA, 22 nt, Chlamydophila pneumoniae J138
cauuucuaucaguucauuuugg

SEQ ID NO: 2548022 - RNA, 18 nt, Chlamydophila pneumoniae J138
cauuucucaccacggaag

SEQ ID NO: 2548023 - RNA, 15 nt, Chlamydophila pneumoniae J138
cauuugauucauaaa

SEQ ID NO: 2548024 - RNA, 15 nt, Chlamydophila pneumoniae J138
cauuuguuuggaaau

SEQ ID NO: 2548025 - RNA, 20 nt, Chlamydophila pneumoniae J138
cauuuucaggcugaaccaaa

SEQ ID NO: 2548026 - RNA, 21 nt, Chlamydophila pneumoniae J138
cauuuucuucuugcaaucuuu

SEQ ID NO: 2548027 - RNA, 15 nt, Chlamydophila pneumoniae J138
cauuuucuuuuaaga

SEQ ID NO: 2548028 - RNA, 14 nt, Chlamydophila pneumoniae J138
cauuuuuaaggaaa

SEQ ID NO: 2548029 - RNA, 13 nt, Chlamydophila pneumoniae J138
cauuuuuccuccu

SEQ ID NO: 2548030 - RNA, 22 nt, Chlamydophila pneumoniae J138
ccagaagcaacuaaacucucca

SEQ ID NO: 2548031 - RNA, 16 nt, Chlamydophila pneumoniae J138
ccagaagcaugaauga

SEQ ID NO: 2548032 - RNA, 20 nt, Chlamydophila pneumoniae J138
ccagaagguguggguacagg

SEQ ID NO: 2548033 - RNA, 22 nt, Chlamydophila pneumoniae J138
ccagaagucgcaguaaugccaa

SEQ ID NO: 2548034 - RNA, 19 nt, Chlamydophila pneumoniae J138
ccagaauauagacuuguau

SEQ ID NO: 2548035 - RNA, 21 nt, Chlamydophila pneumoniae J138
ccagaaucuccauuuagaaug

SEQ ID NO: 2548036 - RNA, 19 nt, Chlamydophila pneumoniae J138
ccagacuuuccucucuuua

SEQ ID NO: 2548037 - RNA, 17 nt, Chlamydophila pneumoniae J138
ccagagaauguucccaa

SEQ ID NO: 2548038 - RNA, 18 nt, Chlamydophila pneumoniae J138
ccagagacaaagccacag

SEQ ID NO: 2548039 - RNA, 14 nt, Chlamydophila pneumoniae J138
ccagagagcuuuua

SEQ ID NO: 2548040 - RNA, 22 nt, Chlamydophila pneumoniae J138
ccagagucgugccugguccaug

SEQ ID NO: 2548041 - RNA, 14 nt, Chlamydophila pneumoniae J138
ccagaugauuuuuu

SEQ ID NO: 2548042 - RNA, 16 nt, Chlamydophila pneumoniae J138
ccagaugauuuuuuga

SEQ ID NO: 2548043 - RNA, 18 nt, Chlamydophila pneumoniae J138
ccagaugauuuuuugaau

SEQ ID NO: 2548044 - RNA, 13 nt, Chlamydophila pneumoniae J138
ccagaugccuuga

SEQ ID NO: 2548045 - RNA, 15 nt, Chlamydophila pneumoniae J138
ccagaugcuaaagag

SEQ ID NO: 2548046 - RNA, 22 nt, Chlamydophila pneumoniae J138
ccagauuguucaaaaauagaua

SEQ ID NO: 2548047 - RNA, 15 nt, Chlamydophila pneumoniae J138
ccagcaucuucucga

SEQ ID NO: 2548048 - RNA, 22 nt, Chlamydophila pneumoniae J138
ccagcauuaagauaaacagcac

SEQ ID NO: 2548049 - RNA, 23 nt, Chlamydophila pneumoniae J138
ccagcauuaagauaaacagcaca

SEQ ID NO: 2548050 - RNA, 16 nt, Chlamydophila pneumoniae J138
ccagcgaugucuuuga

SEQ ID NO: 2548051 - RNA, 14 nt, Chlamydophila pneumoniae J138
ccagcuccuuuuga

SEQ ID NO: 2548052 - RNA, 18 nt, Chlamydophila pneumoniae J138
ccagcugagcuaucuuca

SEQ ID NO: 2548053 - RNA, 18 nt, Chlamydophila pneumoniae J138
ccagcugauauccuugcu

SEQ ID NO: 2548054 - RNA, 16 nt, Chlamydophila pneumoniae J138
ccagcuguggugguga

SEQ ID NO: 2548055 - RNA, 14 nt, Chlamydophila pneumoniae J138
ccagcuucuuucua

SEQ ID NO: 2548056 - RNA, 22 nt, Chlamydophila pneumoniae J138
ccagcuucuuucuaggccggga

SEQ ID NO: 2548057 - RNA, 17 nt, Chlamydophila pneumoniae J138
ccaggaaacguucuuuc

SEQ ID NO: 2548058 - RNA, 22 nt, Chlamydophila pneumoniae J138
ccaggaaacguucuuucaauaa

SEQ ID NO: 2548059 - RNA, 22 nt, Chlamydophila pneumoniae J138
ccaggaaguccgauagcaauga

SEQ ID NO: 2548060 - RNA, 15 nt, Chlamydophila pneumoniae J138
ccaggaauagaaaga

SEQ ID NO: 2548061 - RNA, 17 nt, Chlamydophila pneumoniae J138
ccaggacguaaaaagaa

SEQ ID NO: 2548062 - RNA, 19 nt, Chlamydophila pneumoniae J138
ccaggagagcuaacagcac

SEQ ID NO: 2548063 - RNA, 22 nt, Chlamydophila pneumoniae J138
ccaggagagcuaacagcacgua

SEQ ID NO: 2548064 - RNA, 15 nt, Chlamydophila pneumoniae J138
ccaggagcuccuccu

SEQ ID NO: 2548065 - RNA, 16 nt, Chlamydophila pneumoniae J138
ccagggguuucuaaau

SEQ ID NO: 2548066 - RNA, 15 nt, Chlamydophila pneumoniae J138
ccaguuacugucugc

SEQ ID NO: 2548067 - RNA, 20 nt, Chlamydophila pneumoniae J138
ccauaaaaauguaauuuuuu

SEQ ID NO: 2548068 - RNA, 22 nt, Chlamydophila pneumoniae J138
ccauaaaaauguaauuuuuuca

SEQ ID NO: 2548069 - RNA, 16 nt, Chlamydophila pneumoniae J138
ccauaaagaauucccc

SEQ ID NO: 2548070 - RNA, 20 nt, Chlamydophila pneumoniae J138
ccauaaagccccacccacuc

SEQ ID NO: 2548071 - RNA, 19 nt, Chlamydophila pneumoniae J138
ccauaacagcacucacgcu

SEQ ID NO: 2548072 - RNA, 21 nt, Chlamydophila pneumoniae J138
ccauaaccgucacuguuuucc

SEQ ID NO: 2548073 - RNA, 16 nt, Chlamydophila pneumoniae J138
ccauaaguucacgauu

SEQ ID NO: 2548074 - RNA, 20 nt, Chlamydophila pneumoniae J138
ccauaaugagacagacaguc

SEQ ID NO: 2548075 - RNA, 17 nt, Chlamydophila pneumoniae J138
ccauaauuagaacagca

SEQ ID NO: 2548076 - RNA, 13 nt, Chlamydophila pneumoniae J138
ccauaauuucuuu

SEQ ID NO: 2548077 - RNA, 18 nt, Chlamydophila pneumoniae J138
ccauaauuucuuucacau

SEQ ID NO: 2548078 - RNA, 20 nt, Chlamydophila pneumoniae J138
ccauaauuucuuucacaucu

SEQ ID NO: 2548079 - RNA, 20 nt, Chlamydophila pneumoniae J138
ccauacccaaauuucuucug

SEQ ID NO: 2548080 - RNA, 22 nt, Chlamydophila pneumoniae J138
ccauacgguaaggaggaaucuu

SEQ ID NO: 2548081 - RNA, 14 nt, Chlamydophila pneumoniae J138
ccauagagcugcca

SEQ ID NO: 2548082 - RNA, 17 nt, Chlamydophila pneumoniae J138
ccauagaguucgcacua

SEQ ID NO: 2548083 - RNA, 12 nt, Chlamydophila pneumoniae J138
ccauagcaaugc

SEQ ID NO: 2548084 - RNA, 16 nt, Chlamydophila pneumoniae J138
ccauaucaaagaucug

SEQ ID NO: 2548085 - RNA, 16 nt, Chlamydophila pneumoniae J138
ccauauccauggaaug

SEQ ID NO: 2548086 - RNA, 17 nt, Chlamydophila pneumoniae J138
ccaucacuuccuguugu

SEQ ID NO: 2548087 - RNA, 23 nt, Chlamydophila pneumoniae J138
ccaucauaaaacgugauugcugc

SEQ ID NO: 2548088 - RNA, 13 nt, Chlamydophila pneumoniae J138
ccaucaucaccag

SEQ ID NO: 2548089 - RNA, 15 nt, Chlamydophila pneumoniae J138
ccaucccauauggau

SEQ ID NO: 2548090 - RNA, 20 nt, Chlamydophila pneumoniae J138
ccaucggcauuucuccacau

SEQ ID NO: 2548091 - RNA, 15 nt, Chlamydophila pneumoniae J138
ccaugagaugggcua

SEQ ID NO: 2548092 - RNA, 15 nt, Chlamydophila pneumoniae J138
ccaugagcucaggca

SEQ ID NO: 2548093 - RNA, 22 nt, Chlamydophila pneumoniae J138
ccaugcagccugcgacuacaag

SEQ ID NO: 2548094 - RNA, 19 nt, Chlamydophila pneumoniae J138
ccaugcuaauaauuccuga

SEQ ID NO: 2548095 - RNA, 20 nt, Chlamydophila pneumoniae J138
ccauggaauggcuacuuuaa

SEQ ID NO: 2548096 - RNA, 14 nt, Chlamydophila pneumoniae J138
ccauggcuggaaag

SEQ ID NO: 2548097 - RNA, 15 nt, Chlamydophila pneumoniae J138
ccaugucuaaagauu

SEQ ID NO: 2548098 - RNA, 18 nt, Chlamydophila pneumoniae J138
ccauuaauaucccaguuu

SEQ ID NO: 2548099 - RNA, 14 nt, Chlamydophila pneumoniae J138
ccauuccauaucca

SEQ ID NO: 2548100 - RNA, 14 nt, Chlamydophila pneumoniae J138
ccauucugaccaaa

SEQ ID NO: 2548101 - RNA, 18 nt, Chlamydophila pneumoniae J138
ccauugaucagaaucuaa

SEQ ID NO: 2548102 - RNA, 16 nt, Chlamydophila pneumoniae J138
ccauuuagacaagaca

SEQ ID NO: 2548103 - RNA, 19 nt, Chlamydophila pneumoniae J138
ccauuucauguaagaaugu

SEQ ID NO: 2548104 - RNA, 14 nt, Chlamydophila pneumoniae J138
ccauuuggagagcu

SEQ ID NO: 2548105 - RNA, 12 nt, Chlamydophila pneumoniae J138
ccauuuucuaag

SEQ ID NO: 2548106 - RNA, 17 nt, Chlamydophila pneumoniae J138
ccauuuucuaagagauc

SEQ ID NO: 2548107 - RNA, 13 nt, Chlamydophila pneumoniae J138
ccauuuuuccucc

SEQ ID NO: 2548108 - RNA, 15 nt, Chlamydophila pneumoniae J138
ccauuuuuccuccuc

SEQ ID NO: 2548109 - RNA, 18 nt, Chlamydophila pneumoniae J138
ccauuuuuggaaaaccau

SEQ ID NO: 2548110 - RNA, 14 nt, Chlamydophila pneumoniae J138
cccaaacauggaca

SEQ ID NO: 2548111 - RNA, 17 nt, Chlamydophila pneumoniae J138
cccaaagaggggagcua

SEQ ID NO: 2548112 - RNA, 12 nt, Chlamydophila pneumoniae J138
cccaaagcagau

SEQ ID NO: 2548113 - RNA, 15 nt, Chlamydophila pneumoniae J138
cccaaagcuaaaaug

SEQ ID NO: 2548114 - RNA, 16 nt, Chlamydophila pneumoniae J138
cccaagcaagaagugu

SEQ ID NO: 2548115 - RNA, 13 nt, Chlamydophila pneumoniae J138
cccaagggccaga

SEQ ID NO: 2548116 - RNA, 15 nt, Chlamydophila pneumoniae J138
cccaauauccagaaa

SEQ ID NO: 2548117 - RNA, 18 nt, Chlamydophila pneumoniae J138
cccaaucaguucaucuag

SEQ ID NO: 2548118 - RNA, 23 nt, Chlamydophila pneumoniae J138
cccaauucuuaaaaagcuaaaca

SEQ ID NO: 2548119 - RNA, 20 nt, Chlamydophila pneumoniae J138
cccacggcaaguuguggcau

SEQ ID NO: 2548120 - RNA, 21 nt, Chlamydophila pneumoniae J138
cccacgggucaggagguggug

SEQ ID NO: 2548121 - RNA, 13 nt, Chlamydophila pneumoniae J138
cccacuccagaaa

SEQ ID NO: 2548122 - RNA, 12 nt, Chlamydophila pneumoniae J138
cccacuucuacc

SEQ ID NO: 2548123 - RNA, 17 nt, Chlamydophila pneumoniae J138
cccagauuuuuuugguu

SEQ ID NO: 2548124 - RNA, 11 nt, Chlamydophila pneumoniae J138
cccagccuuga

SEQ ID NO: 2548125 - RNA, 19 nt, Chlamydophila pneumoniae J138
cccaguuuuccauccacga

SEQ ID NO: 2548126 - RNA, 15 nt, Chlamydophila pneumoniae J138
cccauaaugguacaa

SEQ ID NO: 2548127 - RNA, 23 nt, Chlamydophila pneumoniae J138
cccauacauagggaaaguucagu

SEQ ID NO: 2548128 - RNA, 13 nt, Chlamydophila pneumoniae J138
cccauagcaaugc

SEQ ID NO: 2548129 - RNA, 13 nt, Chlamydophila pneumoniae J138
cccauagcaugag

SEQ ID NO: 2548130 - RNA, 21 nt, Chlamydophila pneumoniae J138
ccuauauuuuuuacauaacac

SEQ ID NO: 2548131 - RNA, 14 nt, Chlamydophila pneumoniae J138
ccuaucaaagcaaa

SEQ ID NO: 2548132 - RNA, 18 nt, Chlamydophila pneumoniae J138
ccuaucaaagcaaaaguc

SEQ ID NO: 2548133 - RNA, 12 nt, Chlamydophila pneumoniae J138
ccuaugauaaag

SEQ ID NO: 2548134 - RNA, 16 nt, Chlamydophila pneumoniae J138
ccuaugauaaagccug

SEQ ID NO: 2548135 - RNA, 18 nt, Chlamydophila pneumoniae J138
ccuaugaucagagagagg

SEQ ID NO: 2548136 - RNA, 19 nt, Chlamydophila pneumoniae J138
ccuauggcagcaggaauaa

SEQ ID NO: 2548137 - RNA, 23 nt, Chlamydophila pneumoniae J138
ccuauggcagcaggaauaaucaa

SEQ ID NO: 2548138 - RNA, 19 nt, Chlamydophila pneumoniae J138
ccuaugggaggaauuccuc

SEQ ID NO: 2548139 - RNA, 19 nt, Chlamydophila pneumoniae J138
ccucaaagaguuuuuuaga

SEQ ID NO: 2548140 - RNA, 16 nt, Chlamydophila pneumoniae J138
ccucaagauaaauccc

SEQ ID NO: 2548141 - RNA, 15 nt, Chlamydophila pneumoniae J138
ccucacaucuccuuu

SEQ ID NO: 2548142 - RNA, 19 nt, Chlamydophila pneumoniae J138
ccucacuaacggcaguaug

SEQ ID NO: 2548143 - RNA, 20 nt, Chlamydophila pneumoniae J138
ccucaucagaagccaccaaa

SEQ ID NO: 2548144 - RNA, 17 nt, Chlamydophila pneumoniae J138
ccucaucaucagaaauc

SEQ ID NO: 2548145 - RNA, 12 nt, Chlamydophila pneumoniae J138
ccuccaaaauca

SEQ ID NO: 2548146 - RNA, 21 nt, Chlamydophila pneumoniae J138
ccuccaaaaucaucagcuccg

SEQ ID NO: 2548147 - RNA, 15 nt, Chlamydophila pneumoniae J138
ccuccaaauacgaac

SEQ ID NO: 2548148 - RNA, 12 nt, Chlamydophila pneumoniae J138
ccuccaauaauc

SEQ ID NO: 2548149 - RNA, 14 nt, Chlamydophila pneumoniae J138
ccuccaccaggagc

SEQ ID NO: 2548150 - RNA, 16 nt, Chlamydophila pneumoniae J138
ccuccauggaaagaaa

SEQ ID NO: 2548151 - RNA, 12 nt, Chlamydophila pneumoniae J138
ccuccauuucua

SEQ ID NO: 2548152 - RNA, 22 nt, Chlamydophila pneumoniae J138
ccuccgaggagggaaacaccgu

SEQ ID NO: 2548153 - RNA, 18 nt, Chlamydophila pneumoniae J138
ccuccucuucuauucuga

SEQ ID NO: 2548154 - RNA, 12 nt, Chlamydophila pneumoniae J138
ccuccucuucuu

SEQ ID NO: 2548155 - RNA, 13 nt, Chlamydophila pneumoniae J138
ccuccugcagggg

SEQ ID NO: 2548156 - RNA, 22 nt, Chlamydophila pneumoniae J138
ccuccugcagggggcauucccu

SEQ ID NO: 2548157 - RNA, 17 nt, Chlamydophila pneumoniae J138
ccuccuucugcaugaau

SEQ ID NO: 2548158 - RNA, 17 nt, Chlamydophila pneumoniae J138
ccucgaauuccucccag

SEQ ID NO: 2548159 - RNA, 14 nt, Chlamydophila pneumoniae J138
ccucgacuuccucc

SEQ ID NO: 2548160 - RNA, 20 nt, Chlamydophila pneumoniae J138
ccucgagcagaaacuccaaa

SEQ ID NO: 2548161 - RNA, 21 nt, Chlamydophila pneumoniae J138
ccucgagcagaaacuccaaaa

SEQ ID NO: 2548162 - RNA, 21 nt, Chlamydophila pneumoniae J138
ccucgaguauggcaaauaaaa

SEQ ID NO: 2548163 - RNA, 17 nt, Chlamydophila pneumoniae J138
ccucgauacuguugauc

SEQ ID NO: 2548164 - RNA, 18 nt, Chlamydophila pneumoniae J138
ccucuaaggacaaaucuc

SEQ ID NO: 2548165 - RNA, 20 nt, Chlamydophila pneumoniae J138
ccucuaaggacaaaucuccc

SEQ ID NO: 2548166 - RNA, 19 nt, Chlamydophila pneumoniae J138
ccucuaaugacagcugaga

SEQ ID NO: 2548167 - RNA, 18 nt, Chlamydophila pneumoniae J138
ccucuauccaucaucgaa

SEQ ID NO: 2548168 - RNA, 19 nt, Chlamydophila pneumoniae J138
ccucucaugaaauuuucua

SEQ ID NO: 2548169 - RNA, 22 nt, Chlamydophila pneumoniae J138
ccucucaugaaauuuucuaaga

SEQ ID NO: 2548170 - RNA, 20 nt, Chlamydophila pneumoniae J138
ccucugcauguugcaaagca

SEQ ID NO: 2548171 - RNA, 20 nt, Chlamydophila pneumoniae J138
ccucugggaagacucucauc

SEQ ID NO: 2548172 - RNA, 14 nt, Chlamydophila pneumoniae J138
ccucuucaauuucu

SEQ ID NO: 2548173 - RNA, 19 nt, Chlamydophila pneumoniae J138
ccucuucaauuucuucauc

SEQ ID NO: 2548174 - RNA, 12 nt, Chlamydophila pneumoniae J138
ccucuucuucau

SEQ ID NO: 2548175 - RNA, 18 nt, Chlamydophila pneumoniae J138
ccucuucuucccuuucaa

SEQ ID NO: 2548176 - RNA, 14 nt, Chlamydophila pneumoniae J138
ccucuugcuuuucc

SEQ ID NO: 2548177 - RNA, 13 nt, Chlamydophila pneumoniae J138
ccugaaaaaacag

SEQ ID NO: 2548178 - RNA, 17 nt, Chlamydophila pneumoniae J138
ccugaaauccugggcaa

SEQ ID NO: 2548179 - RNA, 16 nt, Chlamydophila pneumoniae J138
ccugaacaucuccagc

SEQ ID NO: 2548180 - RNA, 13 nt, Chlamydophila pneumoniae J138
ccugaagcagcuu

SEQ ID NO: 2548181 - RNA, 17 nt, Chlamydophila pneumoniae J138
ccugaagccaugacaaa

SEQ ID NO: 2548182 - RNA, 20 nt, Chlamydophila pneumoniae J138
ccugacucuuuuaagacaau

SEQ ID NO: 2548183 - RNA, 21 nt, Chlamydophila pneumoniae J138
ccugacucuuuuaagacaaua

SEQ ID NO: 2548184 - RNA, 20 nt, Chlamydophila pneumoniae J138
ccugagaaaaguugccuaaa

SEQ ID NO: 2548185 - RNA, 18 nt, Chlamydophila pneumoniae J138
ccugagaccauaaaauca

SEQ ID NO: 2548186 - RNA, 23 nt, Chlamydophila pneumoniae J138
ccugagaccauaaaaucaacaag

SEQ ID NO: 2548187 - RNA, 15 nt, Chlamydophila pneumoniae J138
ccugaguauccgaau

SEQ ID NO: 2548188 - RNA, 22 nt, Chlamydophila pneumoniae J138
ccugaguauccgaaucuaucca

SEQ ID NO: 2548189 - RNA, 22 nt, Chlamydophila pneumoniae J138
ccugaguauuuugcaaaugaaa

SEQ ID NO: 2548190 - RNA, 17 nt, Chlamydophila pneumoniae J138
ccugauacgcagcuaga

SEQ ID NO: 2548191 - RNA, 21 nt, Chlamydophila pneumoniae J138
ccugaucuguagguguaauua

SEQ ID NO: 2548192 - RNA, 13 nt, Chlamydophila pneumoniae J138
ccugaugccuuuu

SEQ ID NO: 2548193 - RNA, 15 nt, Chlamydophila pneumoniae J138
ccugauguugcccua

SEQ ID NO: 2548194 - RNA, 17 nt, Chlamydophila pneumoniae J138
ccugauuccauccuguc

SEQ ID NO: 2548195 - RNA, 23 nt, Chlamydophila pneumoniae J138
ccugcaaaaaaccagccaauaac

SEQ ID NO: 2548196 - RNA, 16 nt, Chlamydophila pneumoniae J138
ccugcaaacuccccag

SEQ ID NO: 2548197 - RNA, 16 nt, Chlamydophila pneumoniae J138
ccugccucacagcuaa

SEQ ID NO: 2548198 - RNA, 21 nt, Chlamydophila pneumoniae J138
ccugcggaaggcuaaaaccua

SEQ ID NO: 2548199 - RNA, 20 nt, Chlamydophila pneumoniae J138
ccugcuaaacuuuuuuucaa

SEQ ID NO: 2548200 - RNA, 17 nt, Chlamydophila pneumoniae J138
ccugcugccaugcagcc

SEQ ID NO: 2548201 - RNA, 12 nt, Chlamydophila pneumoniae J138
ccugcugcuuca

SEQ ID NO: 2548202 - RNA, 21 nt, Chlamydophila pneumoniae J138
ccugcuucuauagagacacga

SEQ ID NO: 2548203 - RNA, 17 nt, Chlamydophila pneumoniae J138
ccugcuuuuuuucuaga

SEQ ID NO: 2548204 - RNA, 17 nt, Chlamydophila pneumoniae J138
ccuggaaagcuucugga

SEQ ID NO: 2548205 - RNA, 20 nt, Chlamydophila pneumoniae J138
ccuggaacaguauaaucaga

SEQ ID NO: 2548206 - RNA, 18 nt, Chlamydophila pneumoniae J138
ccuggacgauauaaucac

SEQ ID NO: 2548207 - RNA, 18 nt, Chlamydophila pneumoniae J138
ccuggauugauccacaga

SEQ ID NO: 2548208 - RNA, 21 nt, Chlamydophila pneumoniae J138
ccugggcuuauuauugaauaa

SEQ ID NO: 2548209 - RNA, 13 nt, Chlamydophila pneumoniae J138
ccuguaacacccu

SEQ ID NO: 2548210 - RNA, 20 nt, Chlamydophila pneumoniae J138
ccuguaauugauguuccuug

SEQ ID NO: 2548211 - RNA, 22 nt, Chlamydophila pneumoniae J138
ccuguaccacauacucuucauc

SEQ ID NO: 2548212 - RNA, 19 nt, Chlamydophila pneumoniae J138
ccuguacgguaaauccauu

SEQ ID NO: 2548213 - RNA, 13 nt, Chlamydophila pneumoniae J138
ccuguagaaacau

SEQ ID NO: 2548214 - RNA, 19 nt, Chlamydophila pneumoniae J138
ccuguaguaaaauaagaaa

SEQ ID NO: 2548215 - RNA, 22 nt, Chlamydophila pneumoniae J138
ccuguaguuucuaaaacagaaa

SEQ ID NO: 2548216 - RNA, 21 nt, Chlamydophila pneumoniae J138
ccuguauuaaagaaucuaacu

SEQ ID NO: 2548217 - RNA, 21 nt, Chlamydophila pneumoniae J138
ccuguccaacuaaaacagccu

SEQ ID NO: 2548218 - RNA, 19 nt, Chlamydophila pneumoniae J138
ccugucuuaucuaaagaaa

SEQ ID NO: 2548219 - RNA, 13 nt, Chlamydophila pneumoniae J138
ccugugauuuccu

SEQ ID NO: 2548220 - RNA, 21 nt, Chlamydophila pneumoniae J138
ccugugugguuggauccaucg

SEQ ID NO: 2548221 - RNA, 21 nt, Chlamydophila pneumoniae J138
ccuguugucacuaagauaucu

SEQ ID NO: 2548222 - RNA, 16 nt, Chlamydophila pneumoniae J138
ccuguuuuauugggaa

SEQ ID NO: 2548223 - RNA, 15 nt, Chlamydophila pneumoniae J138
ccuuaacaacaucac

SEQ ID NO: 2548224 - RNA, 18 nt, Chlamydophila pneumoniae J138
ccuuaacaaccgccuuua

SEQ ID NO: 2548225 - RNA, 17 nt, Chlamydophila pneumoniae J138
ccuuacaagcuuccuug

SEQ ID NO: 2548226 - RNA, 20 nt, Chlamydophila pneumoniae J138
ccuuacggccccuggaauuu

SEQ ID NO: 2548227 - RNA, 22 nt, Chlamydophila pneumoniae J138
ccuuacucccaugggauaggaa

SEQ ID NO: 2548228 - RNA, 22 nt, Chlamydophila pneumoniae J138
ccuuagcagcacccauaaggga

SEQ ID NO: 2548229 - RNA, 21 nt, Chlamydophila pneumoniae J138
cgacguuuugcuguggaauuu

SEQ ID NO: 2548230 - RNA, 18 nt, Chlamydophila pneumoniae J138
cgacuguacaaaugcauc

SEQ ID NO: 2548231 - RNA, 18 nt, Chlamydophila pneumoniae J138
cgacuucaccuugaaguu

SEQ ID NO: 2548232 - RNA, 13 nt, Chlamydophila pneumoniae J138
cgacuugccaauc

SEQ ID NO: 2548233 - RNA, 19 nt, Chlamydophila pneumoniae J138
cgacuugccaaucuuccuu

SEQ ID NO: 2548234 - RNA, 22 nt, Chlamydophila pneumoniae J138
cgagaaaauccguauuuggcuu

SEQ ID NO: 2548235 - RNA, 21 nt, Chlamydophila pneumoniae J138
cgagaaccuccaccaggagcu

SEQ ID NO: 2548236 - RNA, 18 nt, Chlamydophila pneumoniae J138
cgagaacguagcagaggc

SEQ ID NO: 2548237 - RNA, 17 nt, Chlamydophila pneumoniae J138
cgagacuauuuuggaaa

SEQ ID NO: 2548238 - RNA, 16 nt, Chlamydophila pneumoniae J138
cgagacugcaaaggaa

SEQ ID NO: 2548239 - RNA, 22 nt, Chlamydophila pneumoniae J138
cgagaggaaaucccgagauaug

SEQ ID NO: 2548240 - RNA, 18 nt, Chlamydophila pneumoniae J138
cgagaguugccaggaaac

SEQ ID NO: 2548241 - RNA, 15 nt, Chlamydophila pneumoniae J138
cgagauaugaagaga

SEQ ID NO: 2548242 - RNA, 20 nt, Chlamydophila pneumoniae J138
cgagaucauuagcaucaucu

SEQ ID NO: 2548243 - RNA, 18 nt, Chlamydophila pneumoniae J138
cgagauccuccuggaaga

SEQ ID NO: 2548244 - RNA, 22 nt, Chlamydophila pneumoniae J138
cgagcgggagaaucaauaaaag

SEQ ID NO: 2548245 - RNA, 10 nt, Chlamydophila pneumoniae J138
cgagcuucca

SEQ ID NO: 2548246 - RNA, 18 nt, Chlamydophila pneumoniae J138
cgagcuuuaagaagaaga

SEQ ID NO: 2548247 - RNA, 20 nt, Chlamydophila pneumoniae J138
cgagcuuuuugcuuuucccu

SEQ ID NO: 2548248 - RNA, 14 nt, Chlamydophila pneumoniae J138
cgaggaaaaaggag

SEQ ID NO: 2548249 - RNA, 19 nt, Chlamydophila pneumoniae J138
cgaggaaaaaggaggaugu

SEQ ID NO: 2548250 - RNA, 19 nt, Chlamydophila pneumoniae J138
cgaguaccucaucucugga

SEQ ID NO: 2548251 - RNA, 15 nt, Chlamydophila pneumoniae J138
cgagucccuucuuuc

SEQ ID NO: 2548252 - RNA, 15 nt, Chlamydophila pneumoniae J138
cgagugccuucuuca

SEQ ID NO: 2548253 - RNA, 22 nt, Chlamydophila pneumoniae J138
cgaguucgcggaucuucuucug

SEQ ID NO: 2548254 - RNA, 18 nt, Chlamydophila pneumoniae J138
cgaguucuuuuugcagau

SEQ ID NO: 2548255 - RNA, 13 nt, Chlamydophila pneumoniae J138
cgaguuucgauau

SEQ ID NO: 2548256 - RNA, 15 nt, Chlamydophila pneumoniae J138
cgauaacacuucuuu

SEQ ID NO: 2548257 - RNA, 19 nt, Chlamydophila pneumoniae J138
cgauaacacuucuuucuug

SEQ ID NO: 2548258 - RNA, 16 nt, Chlamydophila pneumoniae J138
cgauaacgauuucuug

SEQ ID NO: 2548259 - RNA, 21 nt, Chlamydophila pneumoniae J138
cgauaacguugccuguuuuau

SEQ ID NO: 2548260 - RNA, 20 nt, Chlamydophila pneumoniae J138
cgauacccaucuagaaacau

SEQ ID NO: 2548261 - RNA, 13 nt, Chlamydophila pneumoniae J138
cgauacgaaggau

SEQ ID NO: 2548262 - RNA, 20 nt, Chlamydophila pneumoniae J138
cgauacgaaggaucauauuu

SEQ ID NO: 2548263 - RNA, 22 nt, Chlamydophila pneumoniae J138
cgauacgguuuuuaucccagau

SEQ ID NO: 2548264 - RNA, 19 nt, Chlamydophila pneumoniae J138
cgauagagauucuuucucg

SEQ ID NO: 2548265 - RNA, 20 nt, Chlamydophila pneumoniae J138
cgauagaucacaucaagaua

SEQ ID NO: 2548266 - RNA, 17 nt, Chlamydophila pneumoniae J138
cgauaucuauaaaugua

SEQ ID NO: 2548267 - RNA, 21 nt, Chlamydophila pneumoniae J138
cgauaucucuaccgaacagag

SEQ ID NO: 2548268 - RNA, 18 nt, Chlamydophila pneumoniae J138
cgaucgcaaucagcaaca

SEQ ID NO: 2548269 - RNA, 19 nt, Chlamydophila pneumoniae J138
cgaucuaaggcuuugccuu

SEQ ID NO: 2548270 - RNA, 20 nt, Chlamydophila pneumoniae J138
cgaucucucuuccugcugcu

SEQ ID NO: 2548271 - RNA, 17 nt, Chlamydophila pneumoniae J138
cgaugacagggaaagaa

SEQ ID NO: 2548272 - RNA, 18 nt, Chlamydophila pneumoniae J138
cgaugacagggaaagaac

SEQ ID NO: 2548273 - RNA, 15 nt, Chlamydophila pneumoniae J138
cgaugacuuggcugg

SEQ ID NO: 2548274 - RNA, 14 nt, Chlamydophila pneumoniae J138
cgaugccagccaua

SEQ ID NO: 2548275 - RNA, 21 nt, Chlamydophila pneumoniae J138
cgauggcaguuuuaaugagag

SEQ ID NO: 2548276 - RNA, 14 nt, Chlamydophila pneumoniae J138
cgauuccugaggcu

SEQ ID NO: 2548277 - RNA, 21 nt, Chlamydophila pneumoniae J138
cgauucgaaaaacgguaaaua

SEQ ID NO: 2548278 - RNA, 20 nt, Chlamydophila pneumoniae J138
cgauucucguguagaauuca

SEQ ID NO: 2548279 - RNA, 22 nt, Chlamydophila pneumoniae J138
cgauuguaaaaguagcauccug

SEQ ID NO: 2548280 - RNA, 13 nt, Chlamydophila pneumoniae J138
cgauuucccagaa

SEQ ID NO: 2548281 - RNA, 18 nt, Chlamydophila pneumoniae J138
cgauuugaacaugaggau

SEQ ID NO: 2548282 - RNA, 15 nt, Chlamydophila pneumoniae J138
cgauuuggaagauug

SEQ ID NO: 2548283 - RNA, 19 nt, Chlamydophila pneumoniae J138
cgcaaaaagcuucuuucuu

SEQ ID NO: 2548284 - RNA, 17 nt, Chlamydophila pneumoniae J138
cgcaaaccaucugcguu

SEQ ID NO: 2548285 - RNA, 16 nt, Chlamydophila pneumoniae J138
cgcaaaggaaaagaua

SEQ ID NO: 2548286 - RNA, 16 nt, Chlamydophila pneumoniae J138
cgcaaaucuuacauaa

SEQ ID NO: 2548287 - RNA, 22 nt, Chlamydophila pneumoniae J138
cgcaacuuaagauacuucucca

SEQ ID NO: 2548288 - RNA, 21 nt, Chlamydophila pneumoniae J138
cgcaagagacaagaaaauauc

SEQ ID NO: 2548289 - RNA, 21 nt, Chlamydophila pneumoniae J138
cgcaagcacuuguuuuuucuu

SEQ ID NO: 2548290 - RNA, 20 nt, Chlamydophila pneumoniae J138
cgcaaguaaagaaauucugg

SEQ ID NO: 2548291 - RNA, 14 nt, Chlamydophila pneumoniae J138
cgcaaucagcaaca

SEQ ID NO: 2548292 - RNA, 21 nt, Chlamydophila pneumoniae J138
cgcaauccaggaauagaaaga

SEQ ID NO: 2548293 - RNA, 21 nt, Chlamydophila pneumoniae J138
cgcacaccagcucgagaucuu

SEQ ID NO: 2548294 - RNA, 15 nt, Chlamydophila pneumoniae J138
cgcaccauuccuuag

SEQ ID NO: 2548295 - RNA, 22 nt, Chlamydophila pneumoniae J138
cgcacuucuucaagaaaugccc

SEQ ID NO: 2548296 - RNA, 16 nt, Chlamydophila pneumoniae J138
cgcauaugcuccagaa

SEQ ID NO: 2548297 - RNA, 20 nt, Chlamydophila pneumoniae J138
cgcaucaaaaaauacauagg

SEQ ID NO: 2548298 - RNA, 18 nt, Chlamydophila pneumoniae J138
cgcauggcggucuuuguu

SEQ ID NO: 2548299 - RNA, 15 nt, Chlamydophila pneumoniae J138
cgccaaaccaugagg

SEQ ID NO: 2548300 - RNA, 23 nt, Chlamydophila pneumoniae J138
cgccaaacgaauuucuuguucca

SEQ ID NO: 2548301 - RNA, 14 nt, Chlamydophila pneumoniae J138
cgccagcaaagauu

SEQ ID NO: 2548302 - RNA, 12 nt, Chlamydophila pneumoniae J138
cgccccaugaau

SEQ ID NO: 2548303 - RNA, 15 nt, Chlamydophila pneumoniae J138
cgcccgagcuuccau

SEQ ID NO: 2548304 - RNA, 20 nt, Chlamydophila pneumoniae J138
cgcccuucaggacaugccuu

SEQ ID NO: 2548305 - RNA, 19 nt, Chlamydophila pneumoniae J138
cgccuuggguuugucucca

SEQ ID NO: 2548306 - RNA, 17 nt, Chlamydophila pneumoniae J138
cgccuuucuacccuucc

SEQ ID NO: 2548307 - RNA, 13 nt, Chlamydophila pneumoniae J138
cgcgaagcuuucc

SEQ ID NO: 2548308 - RNA, 12 nt, Chlamydophila pneumoniae J138
cgcguauuuucg

SEQ ID NO: 2548309 - RNA, 22 nt, Chlamydophila pneumoniae J138
cgcguuccuguaguuugcagag

SEQ ID NO: 2548310 - RNA, 19 nt, Chlamydophila pneumoniae J138
cgcguuggugaugauuuga

SEQ ID NO: 2548311 - RNA, 19 nt, Chlamydophila pneumoniae J138
cgcuaagcucuuaauuucu

SEQ ID NO: 2548312 - RNA, 22 nt, Chlamydophila pneumoniae J138
cgcuagagacagccuguuuucu

SEQ ID NO: 2548313 - RNA, 21 nt, Chlamydophila pneumoniae J138
cgcuagaggaucuucaaggua

SEQ ID NO: 2548314 - RNA, 15 nt, Chlamydophila pneumoniae J138
cgcuagccauagugu

SEQ ID NO: 2548315 - RNA, 21 nt, Chlamydophila pneumoniae J138
cgcuauccaugcuagaagaca

SEQ ID NO: 2548316 - RNA, 16 nt, Chlamydophila pneumoniae J138
cgcucguagguaugag

SEQ ID NO: 2548317 - RNA, 14 nt, Chlamydophila pneumoniae J138
cgcucguauugaua

SEQ ID NO: 2548318 - RNA, 19 nt, Chlamydophila pneumoniae J138
cgcucuaaacucucuuccu

SEQ ID NO: 2548319 - RNA, 14 nt, Chlamydophila pneumoniae J138
cgcucucuuuaaaa

SEQ ID NO: 2548320 - RNA, 21 nt, Chlamydophila pneumoniae J138
cgcucuugauagcuaagagca

SEQ ID NO: 2548321 - RNA, 14 nt, Chlamydophila pneumoniae J138
cgcugugaggaaaa

SEQ ID NO: 2548322 - RNA, 21 nt, Chlamydophila pneumoniae J138
cgcuguugaaaugcaguucuu

SEQ ID NO: 2548323 - RNA, 14 nt, Chlamydophila pneumoniae J138
cgcuuaaaaucagc

SEQ ID NO: 2548324 - RNA, 21 nt, Chlamydophila pneumoniae J138
cgcuuaaaaucagcacacugc

SEQ ID NO: 2548325 - RNA, 13 nt, Chlamydophila pneumoniae J138
cgcuuacaaauaa

SEQ ID NO: 2548326 - RNA, 21 nt, Chlamydophila pneumoniae J138
cgcuuagagaauuggaagcuu

SEQ ID NO: 2548327 - RNA, 20 nt, Chlamydophila pneumoniae J138
cgcuuccgacggagagagau

SEQ ID NO: 2548328 - RNA, 14 nt, Chlamydophila pneumoniae J138
cgucuccaacaguc

SEQ ID NO: 2548329 - RNA, 20 nt, Chlamydophila pneumoniae J138
cgucuuagaauccaaagacu

SEQ ID NO: 2548330 - RNA, 17 nt, Chlamydophila pneumoniae J138
cgucuuagaauccucua

SEQ ID NO: 2548331 - RNA, 17 nt, Chlamydophila pneumoniae J138
cgucuucaauagaacga

SEQ ID NO: 2548332 - RNA, 15 nt, Chlamydophila pneumoniae J138
cgucuucucugcauc

SEQ ID NO: 2548333 - RNA, 14 nt, Chlamydophila pneumoniae J138
cgucuuucaccaac

SEQ ID NO: 2548334 - RNA, 16 nt, Chlamydophila pneumoniae J138
cgucuuugcuuucuag

SEQ ID NO: 2548335 - RNA, 17 nt, Chlamydophila pneumoniae J138
cgucuuugcuuucuagg

SEQ ID NO: 2548336 - RNA, 13 nt, Chlamydophila pneumoniae J138
cgucuuuuaaaga

SEQ ID NO: 2548337 - RNA, 14 nt, Chlamydophila pneumoniae J138
cgugaacaaaaacu

SEQ ID NO: 2548338 - RNA, 14 nt, Chlamydophila pneumoniae J138
cgugaacaaaaucg

SEQ ID NO: 2548339 - RNA, 16 nt, Chlamydophila pneumoniae J138
cgugaagcagaggguu

SEQ ID NO: 2548340 - RNA, 18 nt, Chlamydophila pneumoniae J138
cgugaauaucaucacuaa

SEQ ID NO: 2548341 - RNA, 20 nt, Chlamydophila pneumoniae J138
cgugacugcguugauguauu

SEQ ID NO: 2548342 - RNA, 21 nt, Chlamydophila pneumoniae J138
cgugauugcugucagaacaag

SEQ ID NO: 2548343 - RNA, 15 nt, Chlamydophila pneumoniae J138
cgugcaaguucacac

SEQ ID NO: 2548344 - RNA, 13 nt, Chlamydophila pneumoniae J138
cgugcaggagaac

SEQ ID NO: 2548345 - RNA, 19 nt, Chlamydophila pneumoniae J138
cguggagugcucuacccca

SEQ ID NO: 2548346 - RNA, 18 nt, Chlamydophila pneumoniae J138
cguggcuuccauaacgag

SEQ ID NO: 2548347 - RNA, 17 nt, Chlamydophila pneumoniae J138
cguggcuuuguaaaaau

SEQ ID NO: 2548348 - RNA, 16 nt, Chlamydophila pneumoniae J138
cguggcuuuuguauua

SEQ ID NO: 2548349 - RNA, 18 nt, Chlamydophila pneumoniae J138
cgugguaucccugagcac

SEQ ID NO: 2548350 - RNA, 13 nt, Chlamydophila pneumoniae J138
cguguaaaagcuu

SEQ ID NO: 2548351 - RNA, 19 nt, Chlamydophila pneumoniae J138
cguguggguaaugccaaua

SEQ ID NO: 2548352 - RNA, 15 nt, Chlamydophila pneumoniae J138
cguuaauaagaaccu

SEQ ID NO: 2548353 - RNA, 15 nt, Chlamydophila pneumoniae J138
cguuaccaaaaacug

SEQ ID NO: 2548354 - RNA, 17 nt, Chlamydophila pneumoniae J138
cguuagaacucgaauug

SEQ ID NO: 2548355 - RNA, 15 nt, Chlamydophila pneumoniae J138
cguuauccucgucuu

SEQ ID NO: 2548356 - RNA, 17 nt, Chlamydophila pneumoniae J138
cguucaggauuuagagg

SEQ ID NO: 2548357 - RNA, 18 nt, Chlamydophila pneumoniae J138
cguucaucugucauuaaa

SEQ ID NO: 2548358 - RNA, 22 nt, Chlamydophila pneumoniae J138
cguucgacaacaacauaaagaa

SEQ ID NO: 2548359 - RNA, 21 nt, Chlamydophila pneumoniae J138
cguucguggagcaucauucca

SEQ ID NO: 2548360 - RNA, 11 nt, Chlamydophila pneumoniae J138
cguugccuguu

SEQ ID NO: 2548361 - RNA, 17 nt, Chlamydophila pneumoniae J138
cguuggacugcaagagc

SEQ ID NO: 2548362 - RNA, 18 nt, Chlamydophila pneumoniae J138
cguuuauaacaucaagaa

SEQ ID NO: 2548363 - RNA, 14 nt, Chlamydophila pneumoniae J138
cguuucagaaguca

SEQ ID NO: 2548364 - RNA, 18 nt, Chlamydophila pneumoniae J138
cguuucagaagucacaaa

SEQ ID NO: 2548365 - RNA, 19 nt, Chlamydophila pneumoniae J138
cguuuccgaucauuuuugc

SEQ ID NO: 2548366 - RNA, 18 nt, Chlamydophila pneumoniae J138
cguuuugcuguggaauuu

SEQ ID NO: 2548367 - RNA, 20 nt, Chlamydophila pneumoniae J138
cguuuuuaggguucaucuga

SEQ ID NO: 2548368 - RNA, 13 nt, Chlamydophila pneumoniae J138
cuaaaaacucuuc

SEQ ID NO: 2548369 - RNA, 17 nt, Chlamydophila pneumoniae J138
cuaaaaacuucccaucu

SEQ ID NO: 2548370 - RNA, 18 nt, Chlamydophila pneumoniae J138
cuaaaaaggucagcccug

SEQ ID NO: 2548371 - RNA, 23 nt, Chlamydophila pneumoniae J138
cuaaaaaggucagcccugccuca

SEQ ID NO: 2548372 - RNA, 15 nt, Chlamydophila pneumoniae J138
cuaaaaccacagaau

SEQ ID NO: 2548373 - RNA, 12 nt, Chlamydophila pneumoniae J138
cuaaaaccuaga

SEQ ID NO: 2548374 - RNA, 13 nt, Chlamydophila pneumoniae J138
cuaaaaccuagac

SEQ ID NO: 2548375 - RNA, 17 nt, Chlamydophila pneumoniae J138
cuaaaagcacuuaaaaa

SEQ ID NO: 2548376 - RNA, 14 nt, Chlamydophila pneumoniae J138
cuaaaaguuuuuua

SEQ ID NO: 2548377 - RNA, 21 nt, Chlamydophila pneumoniae J138
cuaaaaguuuuuuauuuucug

SEQ ID NO: 2548378 - RNA, 23 nt, Chlamydophila pneumoniae J138
cuaaaauaugcucgugcgacugc

SEQ ID NO: 2548379 - RNA, 20 nt, Chlamydophila pneumoniae J138
cuaaaaugcuuguauaaaug

SEQ ID NO: 2548380 - RNA, 20 nt, Chlamydophila pneumoniae J138
cuaaacaacucccguuuugu

SEQ ID NO: 2548381 - RNA, 13 nt, Chlamydophila pneumoniae J138
cuaaacaauuuca

SEQ ID NO: 2548382 - RNA, 13 nt, Chlamydophila pneumoniae J138
cuaaacagggaau

SEQ ID NO: 2548383 - RNA, 19 nt, Chlamydophila pneumoniae J138
cuaaacccuguccaacuaa

SEQ ID NO: 2548384 - RNA, 17 nt, Chlamydophila pneumoniae J138
cuaaaccuaaaauggug

SEQ ID NO: 2548385 - RNA, 22 nt, Chlamydophila pneumoniae J138
cuaaacgacguuuaauuccuug

SEQ ID NO: 2548386 - RNA, 17 nt, Chlamydophila pneumoniae J138
cuaaacgauuguaauuu

SEQ ID NO: 2548387 - RNA, 12 nt, Chlamydophila pneumoniae J138
cuaaacucucca

SEQ ID NO: 2548388 - RNA, 16 nt, Chlamydophila pneumoniae J138
cuaaacucucuuccuu

SEQ ID NO: 2548389 - RNA, 17 nt, Chlamydophila pneumoniae J138
cuaaacucucuuccuuc

SEQ ID NO: 2548390 - RNA, 21 nt, Chlamydophila pneumoniae J138
cuaaacugggaagaccacgaa

SEQ ID NO: 2548391 - RNA, 22 nt, Chlamydophila pneumoniae J138
cuaaacuuuuuuucaaaucauc

SEQ ID NO: 2548392 - RNA, 23 nt, Chlamydophila pneumoniae J138
cuaaagaaagagucucacucuuu

SEQ ID NO: 2548393 - RNA, 19 nt, Chlamydophila pneumoniae J138
cuaaagaauuuguaacucu

SEQ ID NO: 2548394 - RNA, 20 nt, Chlamydophila pneumoniae J138
cuaaagaauuuguaacucuu

SEQ ID NO: 2548395 - RNA, 22 nt, Chlamydophila pneumoniae J138
cuaaagaauuuguaacucuuaa

SEQ ID NO: 2548396 - RNA, 15 nt, Chlamydophila pneumoniae J138
cuaaagcagaauccc

SEQ ID NO: 2548397 - RNA, 20 nt, Chlamydophila pneumoniae J138
cuaaagcaggagcaucauua

SEQ ID NO: 2548398 - RNA, 16 nt, Chlamydophila pneumoniae J138
cuaaagcugcuuuuuc

SEQ ID NO: 2548399 - RNA, 14 nt, Chlamydophila pneumoniae J138
cuaaagcuuuugcu

SEQ ID NO: 2548400 - RNA, 15 nt, Chlamydophila pneumoniae J138
cuaaaguaacgauaa

SEQ ID NO: 2548401 - RNA, 13 nt, Chlamydophila pneumoniae J138
cuaaagugucaua

SEQ ID NO: 2548402 - RNA, 13 nt, Chlamydophila pneumoniae J138
cuaaauaaaccac

SEQ ID NO: 2548403 - RNA, 18 nt, Chlamydophila pneumoniae J138
cuaaauagagcggaacua

SEQ ID NO: 2548404 - RNA, 21 nt, Chlamydophila pneumoniae J138
cuaaauauaucgcguguaaaa

SEQ ID NO: 2548405 - RNA, 16 nt, Chlamydophila pneumoniae J138
cuaaaucuauacccag

SEQ ID NO: 2548406 - RNA, 14 nt, Chlamydophila pneumoniae J138
cuaaauuaaauauc

SEQ ID NO: 2548407 - RNA, 18 nt, Chlamydophila pneumoniae J138
cuaaauuaguaaaugccu

SEQ ID NO: 2548408 - RNA, 20 nt, Chlamydophila pneumoniae J138
cuaaauuaguaaaugccucu

SEQ ID NO: 2548409 - RNA, 17 nt, Chlamydophila pneumoniae J138
cuaaauucuuaacaaua

SEQ ID NO: 2548410 - RNA, 18 nt, Chlamydophila pneumoniae J138
cuaacaagauaaccugag

SEQ ID NO: 2548411 - RNA, 20 nt, Chlamydophila pneumoniae J138
cuaacgaagccucacagaau

SEQ ID NO: 2548412 - RNA, 15 nt, Chlamydophila pneumoniae J138
cuaacgacauugaag

SEQ ID NO: 2548413 - RNA, 20 nt, Chlamydophila pneumoniae J138
cuaacuaucucuguuuuuug

SEQ ID NO: 2548414 - RNA, 17 nt, Chlamydophila pneumoniae J138
cuaacuguacacuuuca

SEQ ID NO: 2548415 - RNA, 20 nt, Chlamydophila pneumoniae J138
cuaagaaaggcacuccaaaa

SEQ ID NO: 2548416 - RNA, 18 nt, Chlamydophila pneumoniae J138
cuaagaagcucacucuuu

SEQ ID NO: 2548417 - RNA, 15 nt, Chlamydophila pneumoniae J138
cuaagaaucuauaaa

SEQ ID NO: 2548418 - RNA, 14 nt, Chlamydophila pneumoniae J138
cuaagaaugagaac

SEQ ID NO: 2548419 - RNA, 19 nt, Chlamydophila pneumoniae J138
cuaagagcaucuuugggaa

SEQ ID NO: 2548420 - RNA, 17 nt, Chlamydophila pneumoniae J138
cuaagagcccuugaauc

SEQ ID NO: 2548421 - RNA, 22 nt, Chlamydophila pneumoniae J138
cuaagagcccuugaaucauaga

SEQ ID NO: 2548422 - RNA, 18 nt, Chlamydophila pneumoniae J138
cuaagagcgucuucuuuu

SEQ ID NO: 2548423 - RNA, 21 nt, Chlamydophila pneumoniae J138
cuaagaguuccaagacaauaa

SEQ ID NO: 2548424 - RNA, 16 nt, Chlamydophila pneumoniae J138
cuaagauaucuccagg

SEQ ID NO: 2548425 - RNA, 17 nt, Chlamydophila pneumoniae J138
cuaagauaucuuguaca

SEQ ID NO: 2548426 - RNA, 17 nt, Chlamydophila pneumoniae J138
cuaagcaaagcggcucu

SEQ ID NO: 2548427 - RNA, 13 nt, Chlamydophila pneumoniae J138
cuaagcaauauuu

SEQ ID NO: 2548428 - RNA, 14 nt, Chlamydophila pneumoniae J138
cuagaaacugcucc

SEQ ID NO: 2548429 - RNA, 16 nt, Chlamydophila pneumoniae J138
cuagaaacugcuccug

SEQ ID NO: 2548430 - RNA, 18 nt, Chlamydophila pneumoniae J138
cuagaaacugcuccugaa

SEQ ID NO: 2548431 - RNA, 22 nt, Chlamydophila pneumoniae J138
cuagaaacugcuccugaagcug

SEQ ID NO: 2548432 - RNA, 12 nt, Chlamydophila pneumoniae J138
cuagaaauauac

SEQ ID NO: 2548433 - RNA, 16 nt, Chlamydophila pneumoniae J138
cuagaacuugggaugc

SEQ ID NO: 2548434 - RNA, 19 nt, Chlamydophila pneumoniae J138
cuagaacuugggaugcuac

SEQ ID NO: 2548435 - RNA, 23 nt, Chlamydophila pneumoniae J138
cuagaacuugggaugcuacuuuc

SEQ ID NO: 2548436 - RNA, 18 nt, Chlamydophila pneumoniae J138
cuagaagacauucauuuu

SEQ ID NO: 2548437 - RNA, 20 nt, Chlamydophila pneumoniae J138
cuagaagacauucauuuuuu

SEQ ID NO: 2548438 - RNA, 21 nt, Chlamydophila pneumoniae J138
cuagaagacauucauuuuuua

SEQ ID NO: 2548439 - RNA, 23 nt, Chlamydophila pneumoniae J138
cuagaagagcgucguaacaauuc

SEQ ID NO: 2548440 - RNA, 20 nt, Chlamydophila pneumoniae J138
cuagaauaccguuuuaggaa

SEQ ID NO: 2548441 - RNA, 19 nt, Chlamydophila pneumoniae J138
cuagaaucacauaaaauaa

SEQ ID NO: 2548442 - RNA, 16 nt, Chlamydophila pneumoniae J138
cuagaauggcguaaua

SEQ ID NO: 2548443 - RNA, 16 nt, Chlamydophila pneumoniae J138
cuagacacgccuccuu

SEQ ID NO: 2548444 - RNA, 14 nt, Chlamydophila pneumoniae J138
cuagacagccuuga

SEQ ID NO: 2548445 - RNA, 14 nt, Chlamydophila pneumoniae J138
cuagaccaauaaau

SEQ ID NO: 2548446 - RNA, 17 nt, Chlamydophila pneumoniae J138
cuagaccugccaagaua

SEQ ID NO: 2548447 - RNA, 15 nt, Chlamydophila pneumoniae J138
cuagagauccaauga

SEQ ID NO: 2548448 - RNA, 19 nt, Chlamydophila pneumoniae J138
cuagagaucuuuuuauuaa

SEQ ID NO: 2548449 - RNA, 20 nt, Chlamydophila pneumoniae J138
cuagagaucuuuuuauuaaa

SEQ ID NO: 2548450 - RNA, 15 nt, Chlamydophila pneumoniae J138
cuagagauuuuucua

SEQ ID NO: 2548451 - RNA, 16 nt, Chlamydophila pneumoniae J138
cuagagcacauagaaa

SEQ ID NO: 2548452 - RNA, 19 nt, Chlamydophila pneumoniae J138
cuagagcacauagaaacag

SEQ ID NO: 2548453 - RNA, 18 nt, Chlamydophila pneumoniae J138
cuagagcucugaaauaaa

SEQ ID NO: 2548454 - RNA, 23 nt, Chlamydophila pneumoniae J138
cuagagcuucaaguuucuuuugc

SEQ ID NO: 2548455 - RNA, 21 nt, Chlamydophila pneumoniae J138
cuagagcuuucagaaaagaaa

SEQ ID NO: 2548456 - RNA, 12 nt, Chlamydophila pneumoniae J138
cuagaggaucuu

SEQ ID NO: 2548457 - RNA, 17 nt, Chlamydophila pneumoniae J138
cuagaggaucuucaagg

SEQ ID NO: 2548458 - RNA, 18 nt, Chlamydophila pneumoniae J138
cuagaguacccccgggcg

SEQ ID NO: 2548459 - RNA, 19 nt, Chlamydophila pneumoniae J138
cuagagucacuagcagaag

SEQ ID NO: 2548460 - RNA, 21 nt, Chlamydophila pneumoniae J138
cuagaguccaagguucuggga

SEQ ID NO: 2548461 - RNA, 22 nt, Chlamydophila pneumoniae J138
cuagaguccaagguucugggaa

SEQ ID NO: 2548462 - RNA, 14 nt, Chlamydophila pneumoniae J138
cuagagucucuuuc

SEQ ID NO: 2548463 - RNA, 21 nt, Chlamydophila pneumoniae J138
cuagaguugcuuuauggcuca

SEQ ID NO: 2548464 - RNA, 16 nt, Chlamydophila pneumoniae J138
cuagauagcaaaucaa

SEQ ID NO: 2548465 - RNA, 15 nt, Chlamydophila pneumoniae J138
cuagcaccuaauaaa

SEQ ID NO: 2548466 - RNA, 14 nt, Chlamydophila pneumoniae J138
cuagcagagaaauu

SEQ ID NO: 2548467 - RNA, 21 nt, Chlamydophila pneumoniae J138
cuagccaucgcgaagcuuucc

SEQ ID NO: 2548468 - RNA, 19 nt, Chlamydophila pneumoniae J138
cuagcuuucuuggagaaga

SEQ ID NO: 2548469 - RNA, 23 nt, Chlamydophila pneumoniae J138
cuagcuuugucucuauagugcau

SEQ ID NO: 2548470 - RNA, 14 nt, Chlamydophila pneumoniae J138
cuagcuuuuuuuau

SEQ ID NO: 2548471 - RNA, 15 nt, Chlamydophila pneumoniae J138
cuagcuuuuuuuaug

SEQ ID NO: 2548472 - RNA, 19 nt, Chlamydophila pneumoniae J138
cuaggacagcacauagagu

SEQ ID NO: 2548473 - RNA, 22 nt, Chlamydophila pneumoniae J138
cuaggccuaaagaauuuguaac

SEQ ID NO: 2548474 - RNA, 21 nt, Chlamydophila pneumoniae J138
cuaggcgcauaugcuccagaa

SEQ ID NO: 2548475 - RNA, 23 nt, Chlamydophila pneumoniae J138
cuaggcugagacauauugaagau

SEQ ID NO: 2548476 - RNA, 11 nt, Chlamydophila pneumoniae J138
cuagguucucc

SEQ ID NO: 2548477 - RNA, 20 nt, Chlamydophila pneumoniae J138
cuaguaagaaacccgcaacu

SEQ ID NO: 2548478 - RNA, 13 nt, Chlamydophila pneumoniae J138
cuagucuuucaac

SEQ ID NO: 2548479 - RNA, 21 nt, Chlamydophila pneumoniae J138
cuagucuuucaaccuccgcuc

SEQ ID NO: 2548480 - RNA, 12 nt, Chlamydophila pneumoniae J138
cuagucuuucua

SEQ ID NO: 2548481 - RNA, 20 nt, Chlamydophila pneumoniae J138
cuagugaagcugcuucuuca

SEQ ID NO: 2548482 - RNA, 16 nt, Chlamydophila pneumoniae J138
cuaguuuuucuuuaga

SEQ ID NO: 2548483 - RNA, 20 nt, Chlamydophila pneumoniae J138
cuauaagacauuauagaggu

SEQ ID NO: 2548484 - RNA, 18 nt, Chlamydophila pneumoniae J138
cuauaagagguucucuua

SEQ ID NO: 2548485 - RNA, 24 nt, Chlamydophila pneumoniae J138
cuauacucucuguagcacuucuca

SEQ ID NO: 2548486 - RNA, 19 nt, Chlamydophila pneumoniae J138
cuauagaaaaggaugcauc

SEQ ID NO: 2548487 - RNA, 16 nt, Chlamydophila pneumoniae J138
cuauagaacuaacugu

SEQ ID NO: 2548488 - RNA, 12 nt, Chlamydophila pneumoniae J138
cuauagagacac

SEQ ID NO: 2548489 - RNA, 15 nt, Chlamydophila pneumoniae J138
cuauagagacacgaa

SEQ ID NO: 2548490 - RNA, 23 nt, Chlamydophila pneumoniae J138
cuauagauacuuugcaauacacc

SEQ ID NO: 2548491 - RNA, 15 nt, Chlamydophila pneumoniae J138
cuauagaucuugaaa

SEQ ID NO: 2548492 - RNA, 19 nt, Chlamydophila pneumoniae J138
cuauagaucuugaaaagau

SEQ ID NO: 2548493 - RNA, 17 nt, Chlamydophila pneumoniae J138
cuauagauugguaagga

SEQ ID NO: 2548494 - RNA, 16 nt, Chlamydophila pneumoniae J138
cuauagcaauccauag

SEQ ID NO: 2548495 - RNA, 14 nt, Chlamydophila pneumoniae J138
cuauagcauagccu

SEQ ID NO: 2548496 - RNA, 17 nt, Chlamydophila pneumoniae J138
cuauagccucuucuaca

SEQ ID NO: 2548497 - RNA, 17 nt, Chlamydophila pneumoniae J138
cuauagcuggaucuucu

SEQ ID NO: 2548498 - RNA, 18 nt, Chlamydophila pneumoniae J138
cuauaggaagcucuucua

SEQ ID NO: 2548499 - RNA, 13 nt, Chlamydophila pneumoniae J138
cuauagggaucuc

SEQ ID NO: 2548500 - RNA, 12 nt, Chlamydophila pneumoniae J138
cuauaguagaag

SEQ ID NO: 2548501 - RNA, 14 nt, Chlamydophila pneumoniae J138
cuauaguagaagaa

SEQ ID NO: 2548502 - RNA, 21 nt, Chlamydophila pneumoniae J138
cuauagucuguuuuggaaaga

SEQ ID NO: 2548503 - RNA, 22 nt, Chlamydophila pneumoniae J138
cuauagucuguuuuggaaagaa

SEQ ID NO: 2548504 - RNA, 23 nt, Chlamydophila pneumoniae J138
cuauagucuguuuuggaaagaag

SEQ ID NO: 2548505 - RNA, 15 nt, Chlamydophila pneumoniae J138
cuauaucauuaagaa

SEQ ID NO: 2548506 - RNA, 16 nt, Chlamydophila pneumoniae J138
cuauaucauuaagaag

SEQ ID NO: 2548507 - RNA, 21 nt, Chlamydophila pneumoniae J138
cuauaucgccguuaaagacuu

SEQ ID NO: 2548508 - RNA, 19 nt, Chlamydophila pneumoniae J138
cuauaugaaugauuuccau

SEQ ID NO: 2548509 - RNA, 13 nt, Chlamydophila pneumoniae J138
cuauauuuuuucc

SEQ ID NO: 2548510 - RNA, 14 nt, Chlamydophila pneumoniae J138
cuauauuuuuuccc

SEQ ID NO: 2548511 - RNA, 22 nt, Chlamydophila pneumoniae J138
cuaucagagcgaucgcaaucag

SEQ ID NO: 2548512 - RNA, 13 nt, Chlamydophila pneumoniae J138
cuauccaucaucg

SEQ ID NO: 2548513 - RNA, 15 nt, Chlamydophila pneumoniae J138
cuauccuguuucaac

SEQ ID NO: 2548514 - RNA, 22 nt, Chlamydophila pneumoniae J138
cuauccuucgaccuauuugcaa

SEQ ID NO: 2548515 - RNA, 13 nt, Chlamydophila pneumoniae J138
cuaucgaagagcc

SEQ ID NO: 2548516 - RNA, 14 nt, Chlamydophila pneumoniae J138
cuaucgaagagccc

SEQ ID NO: 2548517 - RNA, 20 nt, Chlamydophila pneumoniae J138
cuaucgauagccauuagaau

SEQ ID NO: 2548518 - RNA, 18 nt, Chlamydophila pneumoniae J138
cuaucgguuuaaacagau

SEQ ID NO: 2548519 - RNA, 16 nt, Chlamydophila pneumoniae J138
cuaucucuguuuuuug

SEQ ID NO: 2548520 - RNA, 12 nt, Chlamydophila pneumoniae J138
cuaucuucaagu

SEQ ID NO: 2548521 - RNA, 22 nt, Chlamydophila pneumoniae J138
cuaucuuugguaugcagaguuu

SEQ ID NO: 2548522 - RNA, 13 nt, Chlamydophila pneumoniae J138
cuaugacuucuug

SEQ ID NO: 2548523 - RNA, 23 nt, Chlamydophila pneumoniae J138
cuaugaggacgacgcaucuccuc

SEQ ID NO: 2548524 - RNA, 17 nt, Chlamydophila pneumoniae J138
cuaugauccgaaaacuc

SEQ ID NO: 2548525 - RNA, 15 nt, Chlamydophila pneumoniae J138
cuaugcacaaaauaa

SEQ ID NO: 2548526 - RNA, 16 nt, Chlamydophila pneumoniae J138
cuaugcacaaaauaaa

SEQ ID NO: 2548527 - RNA, 17 nt, Chlamydophila pneumoniae J138
cuaugcacaaaauaaaa

SEQ ID NO: 2548528 - RNA, 15 nt, Chlamydophila pneumoniae J138
cuccaaaauauucuu

SEQ ID NO: 2548529 - RNA, 14 nt, Chlamydophila pneumoniae J138
cuccaaacauuuuu

SEQ ID NO: 2548530 - RNA, 21 nt, Chlamydophila pneumoniae J138
cuccaaacauuuuuaaggaaa

SEQ ID NO: 2548531 - RNA, 11 nt, Chlamydophila pneumoniae J138
cuccaaauaaa

SEQ ID NO: 2548532 - RNA, 17 nt, Chlamydophila pneumoniae J138
cuccaaauguucucucc

SEQ ID NO: 2548533 - RNA, 13 nt, Chlamydophila pneumoniae J138
cuccaacuuccau

SEQ ID NO: 2548534 - RNA, 14 nt, Chlamydophila pneumoniae J138
cuccaagaauagca

SEQ ID NO: 2548535 - RNA, 15 nt, Chlamydophila pneumoniae J138
cuccaagauaauuau

SEQ ID NO: 2548536 - RNA, 19 nt, Chlamydophila pneumoniae J138
cuccaagcuuggucgcaag

SEQ ID NO: 2548537 - RNA, 20 nt, Chlamydophila pneumoniae J138
cuccaaugagcucuauuucu

SEQ ID NO: 2548538 - RNA, 13 nt, Chlamydophila pneumoniae J138
cuccaaugggcag

SEQ ID NO: 2548539 - RNA, 20 nt, Chlamydophila pneumoniae J138
cuccaauuuucuucagcacu

SEQ ID NO: 2548540 - RNA, 15 nt, Chlamydophila pneumoniae J138
cuccacagcuucuuc

SEQ ID NO: 2548541 - RNA, 22 nt, Chlamydophila pneumoniae J138
cuccacagggucuaguucaauu

SEQ ID NO: 2548542 - RNA, 22 nt, Chlamydophila pneumoniae J138
cuccacaugcccaaacaucauu

SEQ ID NO: 2548543 - RNA, 14 nt, Chlamydophila pneumoniae J138
cuccacaugccugc

SEQ ID NO: 2548544 - RNA, 13 nt, Chlamydophila pneumoniae J138
cuccaccaggagc

SEQ ID NO: 2548545 - RNA, 19 nt, Chlamydophila pneumoniae J138
cuccaccaggagcuccucc

SEQ ID NO: 2548546 - RNA, 22 nt, Chlamydophila pneumoniae J138
cuccacgccaaaguacucgcuu

SEQ ID NO: 2548547 - RNA, 20 nt, Chlamydophila pneumoniae J138
cuccagaaacgcagcuuucc

SEQ ID NO: 2548548 - RNA, 14 nt, Chlamydophila pneumoniae J138
cuccagaaauuuuu

SEQ ID NO: 2548549 - RNA, 12 nt, Chlamydophila pneumoniae J138
cuccagaagcaa

SEQ ID NO: 2548550 - RNA, 14 nt, Chlamydophila pneumoniae J138
cuccagagcaagau

SEQ ID NO: 2548551 - RNA, 14 nt, Chlamydophila pneumoniae J138
cuccagcagcuucc

SEQ ID NO: 2548552 - RNA, 23 nt, Chlamydophila pneumoniae J138
cuccagcauaaggauucugagaa

SEQ ID NO: 2548553 - RNA, 23 nt, Chlamydophila pneumoniae J138
cuccagguagcagaguuuuuccc

SEQ ID NO: 2548554 - RNA, 17 nt, Chlamydophila pneumoniae J138
cuccaguaucuucucuu

SEQ ID NO: 2548555 - RNA, 13 nt, Chlamydophila pneumoniae J138
cuccauacagcgc

SEQ ID NO: 2548556 - RNA, 16 nt, Chlamydophila pneumoniae J138
cuccauccucagucuc

SEQ ID NO: 2548557 - RNA, 23 nt, Chlamydophila pneumoniae J138
cuccaucggaauuugccugaaau

SEQ ID NO: 2548558 - RNA, 22 nt, Chlamydophila pneumoniae J138
cuccauuggcauagagccuaga

SEQ ID NO: 2548559 - RNA, 13 nt, Chlamydophila pneumoniae J138
cuccauuuagaau

SEQ ID NO: 2548560 - RNA, 18 nt, Chlamydophila pneumoniae J138
cuccauuuagacaagaca

SEQ ID NO: 2548561 - RNA, 13 nt, Chlamydophila pneumoniae J138
cuccauuucuagg

SEQ ID NO: 2548562 - RNA, 15 nt, Chlamydophila pneumoniae J138
cuccauuucuaggaa

SEQ ID NO: 2548563 - RNA, 20 nt, Chlamydophila pneumoniae J138
cucccaacaagggaaagaaa

SEQ ID NO: 2548564 - RNA, 15 nt, Chlamydophila pneumoniae J138
cucccaauauccaga

SEQ ID NO: 2548565 - RNA, 15 nt, Chlamydophila pneumoniae J138
cucccauagcaaugc

SEQ ID NO: 2548566 - RNA, 18 nt, Chlamydophila pneumoniae J138
cucccaugggauaggaau

SEQ ID NO: 2548567 - RNA, 23 nt, Chlamydophila pneumoniae J138
cucccgugagcaugcucacggga

SEQ ID NO: 2548568 - RNA, 19 nt, Chlamydophila pneumoniae J138
cucccuagguuuuaucuuu

SEQ ID NO: 2548569 - RNA, 17 nt, Chlamydophila pneumoniae J138
cuccgaauggagaagga

SEQ ID NO: 2548570 - RNA, 20 nt, Chlamydophila pneumoniae J138
cuccgaauggagaaggacac

SEQ ID NO: 2548571 - RNA, 13 nt, Chlamydophila pneumoniae J138
cuccgagaaacaa

SEQ ID NO: 2548572 - RNA, 15 nt, Chlamydophila pneumoniae J138
cuccgaggcuucuga

SEQ ID NO: 2548573 - RNA, 21 nt, Chlamydophila pneumoniae J138
cuccgauagagauucuuucuc

SEQ ID NO: 2548574 - RNA, 16 nt, Chlamydophila pneumoniae J138
cuccgauaugggcuuu

SEQ ID NO: 2548575 - RNA, 18 nt, Chlamydophila pneumoniae J138
cuccgcccgucuuagaau

SEQ ID NO: 2548576 - RNA, 16 nt, Chlamydophila pneumoniae J138
cuccgccuacaauacu

SEQ ID NO: 2548577 - RNA, 19 nt, Chlamydophila pneumoniae J138
cuccgcuagaggaucuuca

SEQ ID NO: 2548578 - RNA, 12 nt, Chlamydophila pneumoniae J138
cuccgcucuaag

SEQ ID NO: 2548579 - RNA, 21 nt, Chlamydophila pneumoniae J138
cuccgcucuaagcugugcauu

SEQ ID NO: 2548580 - RNA, 14 nt, Chlamydophila pneumoniae J138
cuccguagucuuag

SEQ ID NO: 2548581 - RNA, 21 nt, Chlamydophila pneumoniae J138
cuccguauacugcugcuaagc

SEQ ID NO: 2548582 - RNA, 21 nt, Chlamydophila pneumoniae J138
cuccgucaagaacaagagcuu

SEQ ID NO: 2548583 - RNA, 20 nt, Chlamydophila pneumoniae J138
cuccgucauauuuaaaaggc

SEQ ID NO: 2548584 - RNA, 16 nt, Chlamydophila pneumoniae J138
cuccuaaaccaucacu

SEQ ID NO: 2548585 - RNA, 19 nt, Chlamydophila pneumoniae J138
cuccuaaaccaucacuucc

SEQ ID NO: 2548586 - RNA, 12 nt, Chlamydophila pneumoniae J138
cuccuaaagcau

SEQ ID NO: 2548587 - RNA, 12 nt, Chlamydophila pneumoniae J138
cuccuaaggaaa

SEQ ID NO: 2548588 - RNA, 21 nt, Chlamydophila pneumoniae J138
cuccuaagucguuaacaucaa

SEQ ID NO: 2548589 - RNA, 13 nt, Chlamydophila pneumoniae J138
cuccucaucagaa

SEQ ID NO: 2548590 - RNA, 22 nt, Chlamydophila pneumoniae J138
cuccucaucagaagccaccaaa

SEQ ID NO: 2548591 - RNA, 16 nt, Chlamydophila pneumoniae J138
cuccuccaaucugcug

SEQ ID NO: 2548592 - RNA, 19 nt, Chlamydophila pneumoniae J138
cuccuccaaugagcucuau

SEQ ID NO: 2548593 - RNA, 15 nt, Chlamydophila pneumoniae J138
cuccucgucuaaaga

SEQ ID NO: 2548594 - RNA, 19 nt, Chlamydophila pneumoniae J138
cuccucgucuaaagaagau

SEQ ID NO: 2548595 - RNA, 18 nt, Chlamydophila pneumoniae J138
cuccugaagccaugacaa

SEQ ID NO: 2548596 - RNA, 21 nt, Chlamydophila pneumoniae J138
cuccugaagggacaaguacga

SEQ ID NO: 2548597 - RNA, 18 nt, Chlamydophila pneumoniae J138
cuccugacucuuauugca

SEQ ID NO: 2548598 - RNA, 20 nt, Chlamydophila pneumoniae J138
cuccugacucuuauugcaga

SEQ ID NO: 2548599 - RNA, 21 nt, Chlamydophila pneumoniae J138
cuccugacucuuuuaagacaa

SEQ ID NO: 2548600 - RNA, 23 nt, Chlamydophila pneumoniae J138
cuccugcagggggcauucccuga

SEQ ID NO: 2548601 - RNA, 20 nt, Chlamydophila pneumoniae J138
cuccugcagguuugggugcu

SEQ ID NO: 2548602 - RNA, 13 nt, Chlamydophila pneumoniae J138
cuccuggaagaau

SEQ ID NO: 2548603 - RNA, 15 nt, Chlamydophila pneumoniae J138
cuccuucaaagauau

SEQ ID NO: 2548604 - RNA, 19 nt, Chlamydophila pneumoniae J138
cuccuucaauacgcuagcu

SEQ ID NO: 2548605 - RNA, 13 nt, Chlamydophila pneumoniae J138
cuccuucagaguu

SEQ ID NO: 2548606 - RNA, 13 nt, Chlamydophila pneumoniae J138
cuccuucucccug

SEQ ID NO: 2548607 - RNA, 16 nt, Chlamydophila pneumoniae J138
cuccuugauaaaacgc

SEQ ID NO: 2548608 - RNA, 14 nt, Chlamydophila pneumoniae J138
cuccuuucaagagc

SEQ ID NO: 2548609 - RNA, 17 nt, Chlamydophila pneumoniae J138
cuccuuugagucuuuuu

SEQ ID NO: 2548610 - RNA, 18 nt, Chlamydophila pneumoniae J138
cuccuuuguauucagugu

SEQ ID NO: 2548611 - RNA, 13 nt, Chlamydophila pneumoniae J138
cuccuuuuaaaau

SEQ ID NO: 2548612 - RNA, 13 nt, Chlamydophila pneumoniae J138
cucgaaacucuuu

SEQ ID NO: 2548613 - RNA, 19 nt, Chlamydophila pneumoniae J138
cucgaacaggagagagaag

SEQ ID NO: 2548614 - RNA, 16 nt, Chlamydophila pneumoniae J138
cucgaagaaaauaaag

SEQ ID NO: 2548615 - RNA, 18 nt, Chlamydophila pneumoniae J138
cucgacaccgauucgcua

SEQ ID NO: 2548616 - RNA, 22 nt, Chlamydophila pneumoniae J138
cucgacguauuugccaaaauaa

SEQ ID NO: 2548617 - RNA, 22 nt, Chlamydophila pneumoniae J138
cucgagauuuuuuauuuuuacu

SEQ ID NO: 2548618 - RNA, 21 nt, Chlamydophila pneumoniae J138
cucgauacuguugauccuucu

SEQ ID NO: 2548619 - RNA, 22 nt, Chlamydophila pneumoniae J138
cucgauuaucgggguuguauuu

SEQ ID NO: 2548620 - RNA, 14 nt, Chlamydophila pneumoniae J138
cucgcaaaagcugu

SEQ ID NO: 2548621 - RNA, 19 nt, Chlamydophila pneumoniae J138
cucgcaauccaggaauaga

SEQ ID NO: 2548622 - RNA, 22 nt, Chlamydophila pneumoniae J138
cucgcaguccuugagcuaacga

SEQ ID NO: 2548623 - RNA, 21 nt, Chlamydophila pneumoniae J138
cucgccaaaccaugaggcugc

SEQ ID NO: 2548624 - RNA, 23 nt, Chlamydophila pneumoniae J138
cucgcuaaaguagaauccuucuc

SEQ ID NO: 2548625 - RNA, 15 nt, Chlamydophila pneumoniae J138
cucggaaaucaggga

SEQ ID NO: 2548626 - RNA, 20 nt, Chlamydophila pneumoniae J138
cucggaguguuggugagacc

SEQ ID NO: 2548627 - RNA, 13 nt, Chlamydophila pneumoniae J138
cucgggagaacau

SEQ ID NO: 2548628 - RNA, 14 nt, Chlamydophila pneumoniae J138
cucuugaggaccuu

SEQ ID NO: 2548629 - RNA, 22 nt, Chlamydophila pneumoniae J138
cucuugcgucacauuuguuguc

SEQ ID NO: 2548630 - RNA, 16 nt, Chlamydophila pneumoniae J138
cucuugcucuagucuu

SEQ ID NO: 2548631 - RNA, 11 nt, Chlamydophila pneumoniae J138
cucuuuaaaaa

SEQ ID NO: 2548632 - RNA, 13 nt, Chlamydophila pneumoniae J138
cucuuuaaaaaau

SEQ ID NO: 2548633 - RNA, 21 nt, Chlamydophila pneumoniae J138
cucuuuaaaaauuaaagugaa

SEQ ID NO: 2548634 - RNA, 13 nt, Chlamydophila pneumoniae J138
cucuuuaaaaggg

SEQ ID NO: 2548635 - RNA, 22 nt, Chlamydophila pneumoniae J138
cucuuuaaaagggcgcuucccu

SEQ ID NO: 2548636 - RNA, 18 nt, Chlamydophila pneumoniae J138
cucuuuaaauguugggau

SEQ ID NO: 2548637 - RNA, 21 nt, Chlamydophila pneumoniae J138
cucuuuaacuucuaaaagcaa

SEQ ID NO: 2548638 - RNA, 14 nt, Chlamydophila pneumoniae J138
cucuuuaagaacuu

SEQ ID NO: 2548639 - RNA, 19 nt, Chlamydophila pneumoniae J138
cucuuuaagcaagagcucc

SEQ ID NO: 2548640 - RNA, 22 nt, Chlamydophila pneumoniae J138
cucuuuaauccaguuuuuuaaa

SEQ ID NO: 2548641 - RNA, 19 nt, Chlamydophila pneumoniae J138
cucuuuagcaaacauuuuu

SEQ ID NO: 2548642 - RNA, 16 nt, Chlamydophila pneumoniae J138
cucuuuauauuuuuug

SEQ ID NO: 2548643 - RNA, 23 nt, Chlamydophila pneumoniae J138
cucuuuauauuuuuugagaaaua

SEQ ID NO: 2548644 - RNA, 14 nt, Chlamydophila pneumoniae J138
cucuuucagcucaa

SEQ ID NO: 2548645 - RNA, 16 nt, Chlamydophila pneumoniae J138
cucuuuccuuagcauu

SEQ ID NO: 2548646 - RNA, 16 nt, Chlamydophila pneumoniae J138
cucuuucuaaaacauc

SEQ ID NO: 2548647 - RNA, 21 nt, Chlamydophila pneumoniae J138
cucuuucuauagcuccuuggc

SEQ ID NO: 2548648 - RNA, 23 nt, Chlamydophila pneumoniae J138
cucuuugacaucuaauuuuaaau

SEQ ID NO: 2548649 - RNA, 12 nt, Chlamydophila pneumoniae J138
cucuuugaggau

SEQ ID NO: 2548650 - RNA, 13 nt, Chlamydophila pneumoniae J138
cucuuuuaagaca

SEQ ID NO: 2548651 - RNA, 22 nt, Chlamydophila pneumoniae J138
cugaaaaugauucauaacauug

SEQ ID NO: 2548652 - RNA, 20 nt, Chlamydophila pneumoniae J138
cugaaaccuucucucuuaaa

SEQ ID NO: 2548653 - RNA, 17 nt, Chlamydophila pneumoniae J138
cugaaagaacacuccug

SEQ ID NO: 2548654 - RNA, 15 nt, Chlamydophila pneumoniae J138
cugaaaguacgcaua

SEQ ID NO: 2548655 - RNA, 13 nt, Chlamydophila pneumoniae J138
cugaaauuaaguc

SEQ ID NO: 2548656 - RNA, 16 nt, Chlamydophila pneumoniae J138
cugaaauuaagucaca

SEQ ID NO: 2548657 - RNA, 18 nt, Chlamydophila pneumoniae J138
cugaaauugucuucagug

SEQ ID NO: 2548658 - RNA, 15 nt, Chlamydophila pneumoniae J138
cugaacaucuccagc

SEQ ID NO: 2548659 - RNA, 15 nt, Chlamydophila pneumoniae J138
cugaacauucuuaau

SEQ ID NO: 2548660 - RNA, 20 nt, Chlamydophila pneumoniae J138
cugaaccaaaucuaucugca

SEQ ID NO: 2548661 - RNA, 23 nt, Chlamydophila pneumoniae J138
cugaacgagguaacccaauucuu

SEQ ID NO: 2548662 - RNA, 22 nt, Chlamydophila pneumoniae J138
cugaacuguucauaauccaaga

SEQ ID NO: 2548663 - RNA, 16 nt, Chlamydophila pneumoniae J138
cugaacuugauuuguu

SEQ ID NO: 2548664 - RNA, 21 nt, Chlamydophila pneumoniae J138
cugaagagcaauuaagaaacu

SEQ ID NO: 2548665 - RNA, 17 nt, Chlamydophila pneumoniae J138
cugaagauauauuuuua

SEQ ID NO: 2548666 - RNA, 19 nt, Chlamydophila pneumoniae J138
cugaagauggcaaggaaaa

SEQ ID NO: 2548667 - RNA, 13 nt, Chlamydophila pneumoniae J138
cugaagauuuuuu

SEQ ID NO: 2548668 - RNA, 14 nt, Chlamydophila pneumoniae J138
cugaagauuuuuua

SEQ ID NO: 2548669 - RNA, 20 nt, Chlamydophila pneumoniae J138
cugaagccaugacaaagggu

SEQ ID NO: 2548670 - RNA, 12 nt, Chlamydophila pneumoniae J138
cugaagcugcaa

SEQ ID NO: 2548671 - RNA, 17 nt, Chlamydophila pneumoniae J138
cugaagcugcaaacuga

SEQ ID NO: 2548672 - RNA, 17 nt, Chlamydophila pneumoniae J138
cugaauaccguuucagg

SEQ ID NO: 2548673 - RNA, 15 nt, Chlamydophila pneumoniae J138
cugaauagcucuuuu

SEQ ID NO: 2548674 - RNA, 17 nt, Chlamydophila pneumoniae J138
cugaauagcucuuuuca

SEQ ID NO: 2548675 - RNA, 20 nt, Chlamydophila pneumoniae J138
cugaauauaguuuaaauguc

SEQ ID NO: 2548676 - RNA, 20 nt, Chlamydophila pneumoniae J138
cugaaucagcuuaucuauag

SEQ ID NO: 2548677 - RNA, 14 nt, Chlamydophila pneumoniae J138
cugaaucuuuuguu

SEQ ID NO: 2548678 - RNA, 17 nt, Chlamydophila pneumoniae J138
cugacacuccucagaau

SEQ ID NO: 2548679 - RNA, 19 nt, Chlamydophila pneumoniae J138
cugacagcuccauuuaaau

SEQ ID NO: 2548680 - RNA, 20 nt, Chlamydophila pneumoniae J138
cugaccaucaaugagaucug

SEQ ID NO: 2548681 - RNA, 22 nt, Chlamydophila pneumoniae J138
cugacccuguagcgaagagagu

SEQ ID NO: 2548682 - RNA, 18 nt, Chlamydophila pneumoniae J138
cugacgucuccaacaguc

SEQ ID NO: 2548683 - RNA, 22 nt, Chlamydophila pneumoniae J138
cugacgugcauugaauccuucu

SEQ ID NO: 2548684 - RNA, 23 nt, Chlamydophila pneumoniae J138
cugacgugcauugaauccuucua

SEQ ID NO: 2548685 - RNA, 22 nt, Chlamydophila pneumoniae J138
cugacguuguguagcugaaauc

SEQ ID NO: 2548686 - RNA, 22 nt, Chlamydophila pneumoniae J138
cugacuauagggagacucuuga

SEQ ID NO: 2548687 - RNA, 14 nt, Chlamydophila pneumoniae J138
cugacugcauagac

SEQ ID NO: 2548688 - RNA, 15 nt, Chlamydophila pneumoniae J138
cugagaaagaagucc

SEQ ID NO: 2548689 - RNA, 13 nt, Chlamydophila pneumoniae J138
cugagaauacaac

SEQ ID NO: 2548690 - RNA, 23 nt, Chlamydophila pneumoniae J138
cugagacauauugaagauauuau

SEQ ID NO: 2548691 - RNA, 18 nt, Chlamydophila pneumoniae J138
cugagaccauaaaaucaa

SEQ ID NO: 2548692 - RNA, 17 nt, Chlamydophila pneumoniae J138
cugagaccauacacaaa

SEQ ID NO: 2548693 - RNA, 22 nt, Chlamydophila pneumoniae J138
cugagacguuguugcaauucuu

SEQ ID NO: 2548694 - RNA, 12 nt, Chlamydophila pneumoniae J138
cugagagaagca

SEQ ID NO: 2548695 - RNA, 20 nt, Chlamydophila pneumoniae J138
cugagagauagguuuuugua

SEQ ID NO: 2548696 - RNA, 23 nt, Chlamydophila pneumoniae J138
cugagaguguuguuggagcagaa

SEQ ID NO: 2548697 - RNA, 17 nt, Chlamydophila pneumoniae J138
cugagcacgaguucucc

SEQ ID NO: 2548698 - RNA, 14 nt, Chlamydophila pneumoniae J138
auaaggcuuuucug

SEQ ID NO: 2548699 - RNA, 20 nt, Chlamydophila pneumoniae J138
auaaggcuuuucugcuccug

SEQ ID NO: 2548700 - RNA, 19 nt, Chlamydophila pneumoniae J138
auaaguagauuaaaggcau

SEQ ID NO: 2548701 - RNA, 16 nt, Chlamydophila pneumoniae J138
auaagugacuuuucuu

SEQ ID NO: 2548702 - RNA, 13 nt, Chlamydophila pneumoniae J138
auaaguucuucca

SEQ ID NO: 2548703 - RNA, 20 nt, Chlamydophila pneumoniae J138
auaaguuuugauuuugcagu

SEQ ID NO: 2548704 - RNA, 13 nt, Chlamydophila pneumoniae J138
auaauaaaagcac

SEQ ID NO: 2548705 - RNA, 20 nt, Chlamydophila pneumoniae J138
auaauaagcaggaaaagcaa

SEQ ID NO: 2548706 - RNA, 14 nt, Chlamydophila pneumoniae J138
auaauagagaagaa

SEQ ID NO: 2548707 - RNA, 19 nt, Chlamydophila pneumoniae J138
auaauagagaagaagcaaa

SEQ ID NO: 2548708 - RNA, 13 nt, Chlamydophila pneumoniae J138
auaauagagccuc

SEQ ID NO: 2548709 - RNA, 14 nt, Chlamydophila pneumoniae J138
auaauagagccucc

SEQ ID NO: 2548710 - RNA, 21 nt, Chlamydophila pneumoniae J138
auaauagauauacgcccaugu

SEQ ID NO: 2548711 - RNA, 20 nt, Chlamydophila pneumoniae J138
auaauaggauaagaaauuaa

SEQ ID NO: 2548712 - RNA, 16 nt, Chlamydophila pneumoniae J138
auaauagucucuguaa

SEQ ID NO: 2548713 - RNA, 17 nt, Chlamydophila pneumoniae J138
auaauauaacugcauac

SEQ ID NO: 2548714 - RNA, 21 nt, Chlamydophila pneumoniae J138
auaauauuuuuuuaagaucuc

SEQ ID NO: 2548715 - RNA, 14 nt, Chlamydophila pneumoniae J138
auaaucaaccaaaa

SEQ ID NO: 2548716 - RNA, 13 nt, Chlamydophila pneumoniae J138
auaaucaauccac

SEQ ID NO: 2548717 - RNA, 20 nt, Chlamydophila pneumoniae J138
auaaucagaacaacgcugcu

SEQ ID NO: 2548718 - RNA, 14 nt, Chlamydophila pneumoniae J138
auaaucagaggagc

SEQ ID NO: 2548719 - RNA, 21 nt, Chlamydophila pneumoniae J138
auaaucagaggagccuccaua

SEQ ID NO: 2548720 - RNA, 23 nt, Chlamydophila pneumoniae J138
auaaucauuaagacucaauacuu

SEQ ID NO: 2548721 - RNA, 16 nt, Chlamydophila pneumoniae J138
auaaucccuacccccu

SEQ ID NO: 2548722 - RNA, 22 nt, Chlamydophila pneumoniae J138
auaaucucaccagaagcaacua

SEQ ID NO: 2548723 - RNA, 18 nt, Chlamydophila pneumoniae J138
auaaucucuuucauaaau

SEQ ID NO: 2548724 - RNA, 21 nt, Chlamydophila pneumoniae J138
auaaucugcgugucguugguu

SEQ ID NO: 2548725 - RNA, 15 nt, Chlamydophila pneumoniae J138
auaaucuguaagaaa

SEQ ID NO: 2548726 - RNA, 22 nt, Chlamydophila pneumoniae J138
auaaucuucaaaagacuuaccg

SEQ ID NO: 2548727 - RNA, 18 nt, Chlamydophila pneumoniae J138
auaaugaagcagggaaaa

SEQ ID NO: 2548728 - RNA, 16 nt, Chlamydophila pneumoniae J138
auaaugacucuagagu

SEQ ID NO: 2548729 - RNA, 15 nt, Chlamydophila pneumoniae J138
auaaugcucacuucu

SEQ ID NO: 2548730 - RNA, 19 nt, Chlamydophila pneumoniae J138
auaaugcucacuucuuugc

SEQ ID NO: 2548731 - RNA, 15 nt, Chlamydophila pneumoniae J138
auaaugguacaauac

SEQ ID NO: 2548732 - RNA, 22 nt, Chlamydophila pneumoniae J138
auaaugguacaauacuggagag

SEQ ID NO: 2548733 - RNA, 23 nt, Chlamydophila pneumoniae J138
auaauuaaaucguauugacuuug

SEQ ID NO: 2548734 - RNA, 14 nt, Chlamydophila pneumoniae J138
auaauuagaacagc

SEQ ID NO: 2548735 - RNA, 15 nt, Chlamydophila pneumoniae J138
auaauuagagagaau

SEQ ID NO: 2548736 - RNA, 14 nt, Chlamydophila pneumoniae J138
auaauucgugucau

SEQ ID NO: 2548737 - RNA, 21 nt, Chlamydophila pneumoniae J138
auaauuggcguaauaauucca

SEQ ID NO: 2548738 - RNA, 18 nt, Chlamydophila pneumoniae J138
auaauuucaaagaugcag

SEQ ID NO: 2548739 - RNA, 13 nt, Chlamydophila pneumoniae J138
auaauuuucaguc

SEQ ID NO: 2548740 - RNA, 12 nt, Chlamydophila pneumoniae J138
auacaaaaaaua

SEQ ID NO: 2548741 - RNA, 21 nt, Chlamydophila pneumoniae J138
auacaaaacaaaagccauucc

SEQ ID NO: 2548742 - RNA, 16 nt, Chlamydophila pneumoniae J138
auacaaacaucgaaac

SEQ ID NO: 2548743 - RNA, 18 nt, Chlamydophila pneumoniae J138
auacaauccagaaucucc

SEQ ID NO: 2548744 - RNA, 19 nt, Chlamydophila pneumoniae J138
auacaauccagaaucucca

SEQ ID NO: 2548745 - RNA, 22 nt, Chlamydophila pneumoniae J138
auacacaaaucauuuaaagcug

SEQ ID NO: 2548746 - RNA, 21 nt, Chlamydophila pneumoniae J138
auacacccgcaagcacuuguu

SEQ ID NO: 2548747 - RNA, 19 nt, Chlamydophila pneumoniae J138
auacagauaucaaagcauu

SEQ ID NO: 2548748 - RNA, 22 nt, Chlamydophila pneumoniae J138
auacagauguaaaugcuccuug

SEQ ID NO: 2548749 - RNA, 22 nt, Chlamydophila pneumoniae J138
auacagauguuuucguaaauau

SEQ ID NO: 2548750 - RNA, 22 nt, Chlamydophila pneumoniae J138
auacagcgcgaucacuuuccug

SEQ ID NO: 2548751 - RNA, 16 nt, Chlamydophila pneumoniae J138
auacaguacgcaaagu

SEQ ID NO: 2548752 - RNA, 14 nt, Chlamydophila pneumoniae J138
auacaguuggcguu

SEQ ID NO: 2548753 - RNA, 15 nt, Chlamydophila pneumoniae J138
auacauagguaaaac

SEQ ID NO: 2548754 - RNA, 22 nt, Chlamydophila pneumoniae J138
auacauaucuccuuuaaauaaa

SEQ ID NO: 2548755 - RNA, 16 nt, Chlamydophila pneumoniae J138
auacaucaaaaugcug

SEQ ID NO: 2548756 - RNA, 19 nt, Chlamydophila pneumoniae J138
auacaucccauucaauaau

SEQ ID NO: 2548757 - RNA, 23 nt, Chlamydophila pneumoniae J138
auacauugcugccaggcuuaaau

SEQ ID NO: 2548758 - RNA, 16 nt, Chlamydophila pneumoniae J138
auaccaagaugaagaa

SEQ ID NO: 2548759 - RNA, 23 nt, Chlamydophila pneumoniae J138
auaccaagaugucuccaaagaua

SEQ ID NO: 2548760 - RNA, 11 nt, Chlamydophila pneumoniae J138
auaccacagcu

SEQ ID NO: 2548761 - RNA, 21 nt, Chlamydophila pneumoniae J138
auaccacagcuguacagaaca

SEQ ID NO: 2548762 - RNA, 22 nt, Chlamydophila pneumoniae J138
auaccacagcuguacagaacaa

SEQ ID NO: 2548763 - RNA, 19 nt, Chlamydophila pneumoniae J138
auaccacuacugagcuucu

SEQ ID NO: 2548764 - RNA, 14 nt, Chlamydophila pneumoniae J138
auaccagaagcaaa

SEQ ID NO: 2548765 - RNA, 17 nt, Chlamydophila pneumoniae J138
auaccagaagcaaaggu

SEQ ID NO: 2548766 - RNA, 17 nt, Chlamydophila pneumoniae J138
auaccaucucuuucuau

SEQ ID NO: 2548767 - RNA, 16 nt, Chlamydophila pneumoniae J138
auacccaucuagaaac

SEQ ID NO: 2548768 - RNA, 19 nt, Chlamydophila pneumoniae J138
auaccgcuguuuuauagca

SEQ ID NO: 2548769 - RNA, 15 nt, Chlamydophila pneumoniae J138
auaccggcaaauaaa

SEQ ID NO: 2548770 - RNA, 23 nt, Chlamydophila pneumoniae J138
auaccggcaaauaaaguccucca

SEQ ID NO: 2548771 - RNA, 16 nt, Chlamydophila pneumoniae J138
auaccguuuuaggaag

SEQ ID NO: 2548772 - RNA, 22 nt, Chlamydophila pneumoniae J138
auaccuagagcucugaaauaaa

SEQ ID NO: 2548773 - RNA, 19 nt, Chlamydophila pneumoniae J138
auaccuccuccaaucugcu

SEQ ID NO: 2548774 - RNA, 20 nt, Chlamydophila pneumoniae J138
auaccuguacgguaaaucca

SEQ ID NO: 2548775 - RNA, 23 nt, Chlamydophila pneumoniae J138
auaccuuucuaagaauucuuugc

SEQ ID NO: 2548776 - RNA, 14 nt, Chlamydophila pneumoniae J138
auacgaaggaucau

SEQ ID NO: 2548777 - RNA, 19 nt, Chlamydophila pneumoniae J138
auacgccaaggucuucccg

SEQ ID NO: 2548778 - RNA, 20 nt, Chlamydophila pneumoniae J138
auacgccgggccacuucauc

SEQ ID NO: 2548779 - RNA, 16 nt, Chlamydophila pneumoniae J138
auacgcuuacaaauaa

SEQ ID NO: 2548780 - RNA, 13 nt, Chlamydophila pneumoniae J138
auacgcuuuucuu

SEQ ID NO: 2548781 - RNA, 14 nt, Chlamydophila pneumoniae J138
auacgcuuuucuuc

SEQ ID NO: 2548782 - RNA, 23 nt, Chlamydophila pneumoniae J138
auacggccgacucuacaucuucu

SEQ ID NO: 2548783 - RNA, 22 nt, Chlamydophila pneumoniae J138
auacgguauaccauguuaucaa

SEQ ID NO: 2548784 - RNA, 15 nt, Chlamydophila pneumoniae J138
auacguccagccugc

SEQ ID NO: 2548785 - RNA, 17 nt, Chlamydophila pneumoniae J138
auacgugcuugaauauu

SEQ ID NO: 2548786 - RNA, 19 nt, Chlamydophila pneumoniae J138
auacuaaaacuacaacagg

SEQ ID NO: 2548787 - RNA, 22 nt, Chlamydophila pneumoniae J138
auacuaagaagcucacucuuua

SEQ ID NO: 2548788 - RNA, 18 nt, Chlamydophila pneumoniae J138
auacucuagguuuucucu

SEQ ID NO: 2548789 - RNA, 23 nt, Chlamydophila pneumoniae J138
auacucuucauccugaucuucuu

SEQ ID NO: 2548790 - RNA, 15 nt, Chlamydophila pneumoniae J138
auacucuuugcagug

SEQ ID NO: 2548791 - RNA, 18 nt, Chlamydophila pneumoniae J138
auacuguuaacaaguacc

SEQ ID NO: 2548792 - RNA, 12 nt, Chlamydophila pneumoniae J138
auacuuauacca

SEQ ID NO: 2548793 - RNA, 17 nt, Chlamydophila pneumoniae J138
auacuucaggacgcaca

SEQ ID NO: 2548794 - RNA, 20 nt, Chlamydophila pneumoniae J138
auacuucguuaugaagcuuc

SEQ ID NO: 2548795 - RNA, 15 nt, Chlamydophila pneumoniae J138
auacuucuccacagc

SEQ ID NO: 2548796 - RNA, 12 nt, Chlamydophila pneumoniae J138
auacuucuccug

SEQ ID NO: 2548797 - RNA, 13 nt, Chlamydophila pneumoniae J138
auaucagcaaaaa

SEQ ID NO: 2548798 - RNA, 15 nt, Chlamydophila pneumoniae J138
auaucagcagcuucu

SEQ ID NO: 2548799 - RNA, 16 nt, Chlamydophila pneumoniae J138
auaucagcagcuucua

SEQ ID NO: 2548800 - RNA, 15 nt, Chlamydophila pneumoniae J138
auaucaucuuccucu

SEQ ID NO: 2548801 - RNA, 17 nt, Chlamydophila pneumoniae J138
auaucauuaagaagauu

SEQ ID NO: 2548802 - RNA, 18 nt, Chlamydophila pneumoniae J138
auaucauuaagaagauuc

SEQ ID NO: 2548803 - RNA, 17 nt, Chlamydophila pneumoniae J138
auauccaaugagagaga

SEQ ID NO: 2548804 - RNA, 15 nt, Chlamydophila pneumoniae J138
auauccaccuuacca

SEQ ID NO: 2548805 - RNA, 12 nt, Chlamydophila pneumoniae J138
auauccagaaau

SEQ ID NO: 2548806 - RNA, 22 nt, Chlamydophila pneumoniae J138
auauccauggaauggcuacuuu

SEQ ID NO: 2548807 - RNA, 13 nt, Chlamydophila pneumoniae J138
auaucccaaagcu

SEQ ID NO: 2548808 - RNA, 18 nt, Chlamydophila pneumoniae J138
auauccguagguguuaag

SEQ ID NO: 2548809 - RNA, 18 nt, Chlamydophila pneumoniae J138
auaucgaguucuuuuugc

SEQ ID NO: 2548810 - RNA, 19 nt, Chlamydophila pneumoniae J138
auaucgccguuaaagacuu

SEQ ID NO: 2548811 - RNA, 16 nt, Chlamydophila pneumoniae J138
auaucgcguguaaaag

SEQ ID NO: 2548812 - RNA, 18 nt, Chlamydophila pneumoniae J138
auaucguagacaacaagu

SEQ ID NO: 2548813 - RNA, 20 nt, Chlamydophila pneumoniae J138
auaucuaauaaaauuggcuu

SEQ ID NO: 2548814 - RNA, 17 nt, Chlamydophila pneumoniae J138
auaucuauagaaggcau

SEQ ID NO: 2548815 - RNA, 21 nt, Chlamydophila pneumoniae J138
auaucuauagaaggcaucccg

SEQ ID NO: 2548816 - RNA, 23 nt, Chlamydophila pneumoniae J138
auaucuccguuaccaaaaacugg

SEQ ID NO: 2548817 - RNA, 19 nt, Chlamydophila pneumoniae J138
auaucuccuuuaaauaaaa

SEQ ID NO: 2548818 - RNA, 21 nt, Chlamydophila pneumoniae J138
auaucucuaccgaacagagcg

SEQ ID NO: 2548819 - RNA, 20 nt, Chlamydophila pneumoniae J138
auaucucuggcauaauccug

SEQ ID NO: 2548820 - RNA, 14 nt, Chlamydophila pneumoniae J138
auaucugagcauaa

SEQ ID NO: 2548821 - RNA, 22 nt, Chlamydophila pneumoniae J138
auaucugcgccagcucucuuga

SEQ ID NO: 2548822 - RNA, 17 nt, Chlamydophila pneumoniae J138
auaugaaugacugcaga

SEQ ID NO: 2548823 - RNA, 22 nt, Chlamydophila pneumoniae J138
auaugaaugacugcagauugca

SEQ ID NO: 2548824 - RNA, 17 nt, Chlamydophila pneumoniae J138
auaugcucgugcgacug

SEQ ID NO: 2548825 - RNA, 13 nt, Chlamydophila pneumoniae J138
auaugcucucccg

SEQ ID NO: 2548826 - RNA, 19 nt, Chlamydophila pneumoniae J138
auaugcuuggcaauagcuu

SEQ ID NO: 2548827 - RNA, 13 nt, Chlamydophila pneumoniae J138
auaugcuuuucaa

SEQ ID NO: 2548828 - RNA, 21 nt, Chlamydophila pneumoniae J138
auauggaaggcggcuuuuugc

SEQ ID NO: 2548829 - RNA, 14 nt, Chlamydophila pneumoniae J138
auauggaauggcuu

SEQ ID NO: 2548830 - RNA, 21 nt, Chlamydophila pneumoniae J138
auauggcugucacggaagaac

SEQ ID NO: 2548831 - RNA, 22 nt, Chlamydophila pneumoniae J138
auaugggacuucaagccaaaac

SEQ ID NO: 2548832 - RNA, 22 nt, Chlamydophila pneumoniae J138
auauggguguaaauuuuuccuu

SEQ ID NO: 2548833 - RNA, 23 nt, Chlamydophila pneumoniae J138
auauggguguaaauuuuuccuuc

SEQ ID NO: 2548834 - RNA, 14 nt, Chlamydophila pneumoniae J138
auaugucuugcuuu

SEQ ID NO: 2548835 - RNA, 17 nt, Chlamydophila pneumoniae J138
auauuaacccaccagaa

SEQ ID NO: 2548836 - RNA, 19 nt, Chlamydophila pneumoniae J138
auauuacagauuucuucuu

SEQ ID NO: 2548837 - RNA, 20 nt, Chlamydophila pneumoniae J138
auauucaagaggaccgagau

SEQ ID NO: 2548838 - RNA, 15 nt, Chlamydophila pneumoniae J138
auauucuccuuacca

SEQ ID NO: 2548839 - RNA, 15 nt, Chlamydophila pneumoniae J138
auauucucgaaaaau

SEQ ID NO: 2548840 - RNA, 23 nt, Chlamydophila pneumoniae J138
auauucugaaauuucugaaacaa

SEQ ID NO: 2548841 - RNA, 14 nt, Chlamydophila pneumoniae J138
auauucugauucuc

SEQ ID NO: 2548842 - RNA, 12 nt, Chlamydophila pneumoniae J138
auauugcucuug

SEQ ID NO: 2548843 - RNA, 18 nt, Chlamydophila pneumoniae J138
auauugucaagaggcugu

SEQ ID NO: 2548844 - RNA, 17 nt, Chlamydophila pneumoniae J138
auauugugcauuaccuc

SEQ ID NO: 2548845 - RNA, 15 nt, Chlamydophila pneumoniae J138
auauuguucuuccaa

SEQ ID NO: 2548846 - RNA, 11 nt, Chlamydophila pneumoniae J138
auauuuaaaag

SEQ ID NO: 2548847 - RNA, 12 nt, Chlamydophila pneumoniae J138
auauuuaaaagg

SEQ ID NO: 2548848 - RNA, 16 nt, Chlamydophila pneumoniae J138
auauuuacgaaaacau

SEQ ID NO: 2548849 - RNA, 18 nt, Chlamydophila pneumoniae J138
auauuuagagagaaacau

SEQ ID NO: 2548850 - RNA, 16 nt, Chlamydophila pneumoniae J138
auauuuccaguauucu

SEQ ID NO: 2548851 - RNA, 13 nt, Chlamydophila pneumoniae J138
auauuuuaccauu

SEQ ID NO: 2548852 - RNA, 20 nt, Chlamydophila pneumoniae J138
auauuuucuugucucuugcg

SEQ ID NO: 2548853 - RNA, 13 nt, Chlamydophila pneumoniae J138
auauuuuuaaaga

SEQ ID NO: 2548854 - RNA, 15 nt, Chlamydophila pneumoniae J138
auauuuuuauuuaaa

SEQ ID NO: 2548855 - RNA, 19 nt, Chlamydophila pneumoniae J138
aucaaaaaaaacgccauac

SEQ ID NO: 2548856 - RNA, 14 nt, Chlamydophila pneumoniae J138
aucaaaaaaaagac

SEQ ID NO: 2548857 - RNA, 19 nt, Chlamydophila pneumoniae J138
aucaaaaaaaagaccaaau

SEQ ID NO: 2548858 - RNA, 22 nt, Chlamydophila pneumoniae J138
aucaaaaacacugcgcaaagaa

SEQ ID NO: 2548859 - RNA, 22 nt, Chlamydophila pneumoniae J138
aucaaaaauagcaggauagcaa

SEQ ID NO: 2548860 - RNA, 12 nt, Chlamydophila pneumoniae J138
aucaaaaaugau

SEQ ID NO: 2548861 - RNA, 16 nt, Chlamydophila pneumoniae J138
aucaaaacauaaugau

SEQ ID NO: 2548862 - RNA, 15 nt, Chlamydophila pneumoniae J138
aucaaaaugcugcuu

SEQ ID NO: 2548863 - RNA, 15 nt, Chlamydophila pneumoniae J138
aucaaagaaagugaa

SEQ ID NO: 2548864 - RNA, 16 nt, Chlamydophila pneumoniae J138
aucaaagaucugaauu

SEQ ID NO: 2548865 - RNA, 14 nt, Chlamydophila pneumoniae J138
aucaaagcaaagag

SEQ ID NO: 2548866 - RNA, 17 nt, Chlamydophila pneumoniae J138
aucaaagcaaagagcaa

SEQ ID NO: 2548867 - RNA, 21 nt, Chlamydophila pneumoniae J138
aucaaaggcaauagcagcagc

SEQ ID NO: 2548868 - RNA, 17 nt, Chlamydophila pneumoniae J138
aucaaagggucuuuacc

SEQ ID NO: 2548869 - RNA, 14 nt, Chlamydophila pneumoniae J138
aucaacauucuucu

SEQ ID NO: 2548870 - RNA, 15 nt, Chlamydophila pneumoniae J138
aucaacauucuucug

SEQ ID NO: 2548871 - RNA, 22 nt, Chlamydophila pneumoniae J138
aucaaccgaagauccuagagaa

SEQ ID NO: 2548872 - RNA, 16 nt, Chlamydophila pneumoniae J138
aucaacuacaucucca

SEQ ID NO: 2548873 - RNA, 18 nt, Chlamydophila pneumoniae J138
aucaacuacaucuccaag

SEQ ID NO: 2548874 - RNA, 14 nt, Chlamydophila pneumoniae J138
aucaacucuccauc

SEQ ID NO: 2548875 - RNA, 16 nt, Chlamydophila pneumoniae J138
aucaacucuccauccu

SEQ ID NO: 2548876 - RNA, 14 nt, Chlamydophila pneumoniae J138
aucaagaagagaaa

SEQ ID NO: 2548877 - RNA, 18 nt, Chlamydophila pneumoniae J138
aucaagaagagaaaagau

SEQ ID NO: 2548878 - RNA, 17 nt, Chlamydophila pneumoniae J138
aucaagacgacacucaa

SEQ ID NO: 2548879 - RNA, 15 nt, Chlamydophila pneumoniae J138
aucaagagcucguaa

SEQ ID NO: 2548880 - RNA, 14 nt, Chlamydophila pneumoniae J138
aucaagaggaguga

SEQ ID NO: 2548881 - RNA, 16 nt, Chlamydophila pneumoniae J138
aucaagauaaaggcau

SEQ ID NO: 2548882 - RNA, 22 nt, Chlamydophila pneumoniae J138
aucaauccuauggcagcaggaa

SEQ ID NO: 2548883 - RNA, 14 nt, Chlamydophila pneumoniae J138
aucaaugccuugcg

SEQ ID NO: 2548884 - RNA, 15 nt, Chlamydophila pneumoniae J138
aucacaagaaagaau

SEQ ID NO: 2548885 - RNA, 22 nt, Chlamydophila pneumoniae J138
aucacacuuaaagguaaaacua

SEQ ID NO: 2548886 - RNA, 16 nt, Chlamydophila pneumoniae J138
aucacagcaaucugca

SEQ ID NO: 2548887 - RNA, 13 nt, Chlamydophila pneumoniae J138
aucacaguuaaga

SEQ ID NO: 2548888 - RNA, 15 nt, Chlamydophila pneumoniae J138
aucacaucaguuaac

SEQ ID NO: 2548889 - RNA, 15 nt, Chlamydophila pneumoniae J138
aucacauuccaagaa

SEQ ID NO: 2548890 - RNA, 16 nt, Chlamydophila pneumoniae J138
aucaccagcauuaaga

SEQ ID NO: 2548891 - RNA, 15 nt, Chlamydophila pneumoniae J138
aucaccuacaucaga

SEQ ID NO: 2548892 - RNA, 15 nt, Chlamydophila pneumoniae J138
aucacgaaaaggaga

SEQ ID NO: 2548893 - RNA, 17 nt, Chlamydophila pneumoniae J138
aucacgaaaaggagaau

SEQ ID NO: 2548894 - RNA, 16 nt, Chlamydophila pneumoniae J138
aucacggaugguugcu

SEQ ID NO: 2548895 - RNA, 18 nt, Chlamydophila pneumoniae J138
aucacggaugguugcuuc

SEQ ID NO: 2548896 - RNA, 20 nt, Chlamydophila pneumoniae J138
aucacguaaggugucugcca

SEQ ID NO: 2548897 - RNA, 14 nt, Chlamydophila pneumoniae J138
auccugaaaguaca

SEQ ID NO: 2548898 - RNA, 15 nt, Chlamydophila pneumoniae J138
auccugaaaguacag

SEQ ID NO: 2548899 - RNA, 18 nt, Chlamydophila pneumoniae J138
auccugaguaaaaucaua

SEQ ID NO: 2548900 - RNA, 20 nt, Chlamydophila pneumoniae J138
auccugaguguaucuaggga

SEQ ID NO: 2548901 - RNA, 19 nt, Chlamydophila pneumoniae J138
auccugcaaagcccccucc

SEQ ID NO: 2548902 - RNA, 23 nt, Chlamydophila pneumoniae J138
auccugcaaagcccccuccccca

SEQ ID NO: 2548903 - RNA, 18 nt, Chlamydophila pneumoniae J138
auccugcauacccuucuu

SEQ ID NO: 2548904 - RNA, 20 nt, Chlamydophila pneumoniae J138
auccugcauacccuucuucu

SEQ ID NO: 2548905 - RNA, 15 nt, Chlamydophila pneumoniae J138
auccugcuccaaaau

SEQ ID NO: 2548906 - RNA, 16 nt, Chlamydophila pneumoniae J138
auccugcuccaaaaug

SEQ ID NO: 2548907 - RNA, 24 nt, Chlamydophila pneumoniae J138
auccugcucguaaaucuggaauga

SEQ ID NO: 2548908 - RNA, 11 nt, Chlamydophila pneumoniae J138
auccugggcaa

SEQ ID NO: 2548909 - RNA, 21 nt, Chlamydophila pneumoniae J138
auccuguaacacccucccuca

SEQ ID NO: 2548910 - RNA, 23 nt, Chlamydophila pneumoniae J138
auccuguaacacccucccucaua

SEQ ID NO: 2548911 - RNA, 15 nt, Chlamydophila pneumoniae J138
auccuguagagcaag

SEQ ID NO: 2548912 - RNA, 22 nt, Chlamydophila pneumoniae J138
auccuguagagcaagauucuuc

SEQ ID NO: 2548913 - RNA, 17 nt, Chlamydophila pneumoniae J138
auccuguagcuuuaugc

SEQ ID NO: 2548914 - RNA, 12 nt, Chlamydophila pneumoniae J138
auccugucuauu

SEQ ID NO: 2548915 - RNA, 15 nt, Chlamydophila pneumoniae J138
auccuuccaagugcu

SEQ ID NO: 2548916 - RNA, 11 nt, Chlamydophila pneumoniae J138
auccuuccuua

SEQ ID NO: 2548917 - RNA, 21 nt, Chlamydophila pneumoniae J138
auccuucuacaaugauauaaa

SEQ ID NO: 2548918 - RNA, 22 nt, Chlamydophila pneumoniae J138
auccuugaaagacucgcucucc

SEQ ID NO: 2548919 - RNA, 19 nt, Chlamydophila pneumoniae J138
auccuugauuuuaaaauga

SEQ ID NO: 2548920 - RNA, 14 nt, Chlamydophila pneumoniae J138
auccuugcaaaaca

SEQ ID NO: 2548921 - RNA, 15 nt, Chlamydophila pneumoniae J138
auccuugcaaaacag

SEQ ID NO: 2548922 - RNA, 16 nt, Chlamydophila pneumoniae J138
auccuugcaaaacagc

SEQ ID NO: 2548923 - RNA, 19 nt, Chlamydophila pneumoniae J138
auccuugcaaaacagcauc

SEQ ID NO: 2548924 - RNA, 16 nt, Chlamydophila pneumoniae J138
auccuuucacaaagaa

SEQ ID NO: 2548925 - RNA, 18 nt, Chlamydophila pneumoniae J138
auccuuucacaaagaauu

SEQ ID NO: 2548926 - RNA, 19 nt, Chlamydophila pneumoniae J138
auccuuucacaaagaauuc

SEQ ID NO: 2548927 - RNA, 18 nt, Chlamydophila pneumoniae J138
auccuuuccaagaaguca

SEQ ID NO: 2548928 - RNA, 20 nt, Chlamydophila pneumoniae J138
auccuuuggaagcuaucauu

SEQ ID NO: 2548929 - RNA, 19 nt, Chlamydophila pneumoniae J138
auccuuuuuguaguaagau

SEQ ID NO: 2548930 - RNA, 19 nt, Chlamydophila pneumoniae J138
aucgaaaccacagcaaaga

SEQ ID NO: 2548931 - RNA, 20 nt, Chlamydophila pneumoniae J138
aucgaagaacuuagcaauga

SEQ ID NO: 2548932 - RNA, 20 nt, Chlamydophila pneumoniae J138
aucgaagagcccucuucacu

SEQ ID NO: 2548933 - RNA, 16 nt, Chlamydophila pneumoniae J138
aucgacaaguaccuuc

SEQ ID NO: 2548934 - RNA, 21 nt, Chlamydophila pneumoniae J138
aucgacaggggaguuuucaaa

SEQ ID NO: 2548935 - RNA, 19 nt, Chlamydophila pneumoniae J138
aucgaccauccuguagcuu

SEQ ID NO: 2548936 - RNA, 15 nt, Chlamydophila pneumoniae J138
aucgaccuuaaaauu

SEQ ID NO: 2548937 - RNA, 22 nt, Chlamydophila pneumoniae J138
aucgacucuuccaauuguaaau

SEQ ID NO: 2548938 - RNA, 17 nt, Chlamydophila pneumoniae J138
aucgacucuucgcccau

SEQ ID NO: 2548939 - RNA, 15 nt, Chlamydophila pneumoniae J138
aucgcaaauuuccau

SEQ ID NO: 2548940 - RNA, 12 nt, Chlamydophila pneumoniae J138
aucgcaucaaaa

SEQ ID NO: 2548941 - RNA, 20 nt, Chlamydophila pneumoniae J138
aucgcaucaaaaaauacaua

SEQ ID NO: 2548942 - RNA, 15 nt, Chlamydophila pneumoniae J138
aucgcccaauuuuua

SEQ ID NO: 2548943 - RNA, 20 nt, Chlamydophila pneumoniae J138
aucgccgcuugaggaggauu

SEQ ID NO: 2548944 - RNA, 18 nt, Chlamydophila pneumoniae J138
aucgccuuccuuaacaac

SEQ ID NO: 2548945 - RNA, 14 nt, Chlamydophila pneumoniae J138
aucgcgaagcuuuc

SEQ ID NO: 2548946 - RNA, 15 nt, Chlamydophila pneumoniae J138
aucgcguguaaaagc

SEQ ID NO: 2548947 - RNA, 18 nt, Chlamydophila pneumoniae J138
aucgcuaucagcugggua

SEQ ID NO: 2548948 - RNA, 19 nt, Chlamydophila pneumoniae J138
aucgcucucuccaugagcu

SEQ ID NO: 2548949 - RNA, 19 nt, Chlamydophila pneumoniae J138
aucgcuguaaauucaguga

SEQ ID NO: 2548950 - RNA, 18 nt, Chlamydophila pneumoniae J138
aucggaguuaucaaaagg

SEQ ID NO: 2548951 - RNA, 15 nt, Chlamydophila pneumoniae J138
aucggaucuuuucuu

SEQ ID NO: 2548952 - RNA, 20 nt, Chlamydophila pneumoniae J138
aucggaucuuuucuuucuaa

SEQ ID NO: 2548953 - RNA, 20 nt, Chlamydophila pneumoniae J138
aucggauuuuacucccugaa

SEQ ID NO: 2548954 - RNA, 20 nt, Chlamydophila pneumoniae J138
aucggcuucuccaacuucca

SEQ ID NO: 2548955 - RNA, 18 nt, Chlamydophila pneumoniae J138
aucgggguuucagaagga

SEQ ID NO: 2548956 - RNA, 18 nt, Chlamydophila pneumoniae J138
aucguaauagcgacauga

SEQ ID NO: 2548957 - RNA, 22 nt, Chlamydophila pneumoniae J138
aucguaccugcugcuucagaaa

SEQ ID NO: 2548958 - RNA, 16 nt, Chlamydophila pneumoniae J138
aucguacuucacuucu

SEQ ID NO: 2548959 - RNA, 15 nt, Chlamydophila pneumoniae J138
aucguccucaccgau

SEQ ID NO: 2548960 - RNA, 15 nt, Chlamydophila pneumoniae J138
aucgucggaagacuu

SEQ ID NO: 2548961 - RNA, 23 nt, Chlamydophila pneumoniae J138
aucgugcuuagagccuucucauu

SEQ ID NO: 2548962 - RNA, 21 nt, Chlamydophila pneumoniae J138
aucguguuuuccugagcuuuu

SEQ ID NO: 2548963 - RNA, 15 nt, Chlamydophila pneumoniae J138
aucguuaucaaaagg

SEQ ID NO: 2548964 - RNA, 20 nt, Chlamydophila pneumoniae J138
aucuaaaaacuucccaucuu

SEQ ID NO: 2548965 - RNA, 19 nt, Chlamydophila pneumoniae J138
aucuaaaagcacuuaaaaa

SEQ ID NO: 2548966 - RNA, 13 nt, Chlamydophila pneumoniae J138
aucuaaaaucaca

SEQ ID NO: 2548967 - RNA, 14 nt, Chlamydophila pneumoniae J138
aucuaaaaucacac

SEQ ID NO: 2548968 - RNA, 14 nt, Chlamydophila pneumoniae J138
aucuaaagaaaugu

SEQ ID NO: 2548969 - RNA, 14 nt, Chlamydophila pneumoniae J138
aucuaaaggaagau

SEQ ID NO: 2548970 - RNA, 14 nt, Chlamydophila pneumoniae J138
aucuaacgcacguu

SEQ ID NO: 2548971 - RNA, 16 nt, Chlamydophila pneumoniae J138
aucuaacgucagcugu

SEQ ID NO: 2548972 - RNA, 21 nt, Chlamydophila pneumoniae J138
aucuaacuucaccauauaaua

SEQ ID NO: 2548973 - RNA, 22 nt, Chlamydophila pneumoniae J138
aucuaagaacuagaaaaaaucc

SEQ ID NO: 2548974 - RNA, 23 nt, Chlamydophila pneumoniae J138
aucuaagaugguuauuauugcuu

SEQ ID NO: 2548975 - RNA, 16 nt, Chlamydophila pneumoniae J138
aucuaaggcuuugccu

SEQ ID NO: 2548976 - RNA, 20 nt, Chlamydophila pneumoniae J138
aucuaauuuuagaacuucaa

SEQ ID NO: 2548977 - RNA, 21 nt, Chlamydophila pneumoniae J138
aucuacaaaaacuagaauaug

SEQ ID NO: 2548978 - RNA, 17 nt, Chlamydophila pneumoniae J138
aucuacaaacagauuuu

SEQ ID NO: 2548979 - RNA, 20 nt, Chlamydophila pneumoniae J138
aucuacaaacagauuuuuca

SEQ ID NO: 2548980 - RNA, 18 nt, Chlamydophila pneumoniae J138
aucuacacacacgccaau

SEQ ID NO: 2548981 - RNA, 22 nt, Chlamydophila pneumoniae J138
aucuacacacaugacaaauaaa

SEQ ID NO: 2548982 - RNA, 21 nt, Chlamydophila pneumoniae J138
aucuacacgcuauagcaacag

SEQ ID NO: 2548983 - RNA, 14 nt, Chlamydophila pneumoniae J138
aucuacagagagaa

SEQ ID NO: 2548984 - RNA, 21 nt, Chlamydophila pneumoniae J138
aucuacauauucguguaaauc

SEQ ID NO: 2548985 - RNA, 13 nt, Chlamydophila pneumoniae J138
aucuacucuuuaa

SEQ ID NO: 2548986 - RNA, 15 nt, Chlamydophila pneumoniae J138
aucuacucuuuaaaa

SEQ ID NO: 2548987 - RNA, 14 nt, Chlamydophila pneumoniae J138
aucuagaaaaugaa

SEQ ID NO: 2548988 - RNA, 14 nt, Chlamydophila pneumoniae J138
aucuagaaagauuu

SEQ ID NO: 2548989 - RNA, 16 nt, Chlamydophila pneumoniae J138
aucuagagucucuuuc

SEQ ID NO: 2548990 - RNA, 13 nt, Chlamydophila pneumoniae J138
aucuagaugauaa

SEQ ID NO: 2548991 - RNA, 20 nt, Chlamydophila pneumoniae J138
aucuagauuuugagaaugaa

SEQ ID NO: 2548992 - RNA, 13 nt, Chlamydophila pneumoniae J138
aucuagcucuuca

SEQ ID NO: 2548993 - RNA, 13 nt, Chlamydophila pneumoniae J138
aucuauaaaugua

SEQ ID NO: 2548994 - RNA, 17 nt, Chlamydophila pneumoniae J138
aucuauaaauguaggga

SEQ ID NO: 2548995 - RNA, 18 nt, Chlamydophila pneumoniae J138
aucuauacccaguuguau

SEQ ID NO: 2548996 - RNA, 19 nt, Chlamydophila pneumoniae J138
aucuauagaauuuccaauc

SEQ ID NO: 2548997 - RNA, 19 nt, Chlamydophila pneumoniae J138
aucuuuaguuuaccugaaa

SEQ ID NO: 2548998 - RNA, 13 nt, Chlamydophila pneumoniae J138
aucuuuauuuaaa

SEQ ID NO: 2548999 - RNA, 18 nt, Chlamydophila pneumoniae J138
aucuuuauuuaaauaaaa

SEQ ID NO: 2549000 - RNA, 19 nt, Chlamydophila pneumoniae J138
aucuuuauuuuuaaaaaua

SEQ ID NO: 2549001 - RNA, 15 nt, Chlamydophila pneumoniae J138
aucuuucaaaagaaa

SEQ ID NO: 2549002 - RNA, 22 nt, Chlamydophila pneumoniae J138
aucuuucaucaaugcgauuacu

SEQ ID NO: 2549003 - RNA, 16 nt, Chlamydophila pneumoniae J138
aucuuucauucccuuu

SEQ ID NO: 2549004 - RNA, 21 nt, Chlamydophila pneumoniae J138
aucuuucauucccuuuuucca

SEQ ID NO: 2549005 - RNA, 17 nt, Chlamydophila pneumoniae J138
aucuuuccucucaugaa

SEQ ID NO: 2549006 - RNA, 21 nt, Chlamydophila pneumoniae J138
aucuuuccucucaugaaauuu

SEQ ID NO: 2549007 - RNA, 15 nt, Chlamydophila pneumoniae J138
aucuuucucuaaaau

SEQ ID NO: 2549008 - RNA, 14 nt, Chlamydophila pneumoniae J138
aucuuucuucuaga

SEQ ID NO: 2549009 - RNA, 20 nt, Chlamydophila pneumoniae J138
aucuuugagaucuugaauga

SEQ ID NO: 2549010 - RNA, 21 nt, Chlamydophila pneumoniae J138
aucuuugagaucuugaaugau

SEQ ID NO: 2549011 - RNA, 20 nt, Chlamydophila pneumoniae J138
aucuuuggguucuuccauaa

SEQ ID NO: 2549012 - RNA, 15 nt, Chlamydophila pneumoniae J138
aucuuuguugagaag

SEQ ID NO: 2549013 - RNA, 12 nt, Chlamydophila pneumoniae J138
aucuuuuagagu

SEQ ID NO: 2549014 - RNA, 15 nt, Chlamydophila pneumoniae J138
aucuuuucuagaaaa

SEQ ID NO: 2549015 - RNA, 22 nt, Chlamydophila pneumoniae J138
aucuuuucuagaaaacgccaac

SEQ ID NO: 2549016 - RNA, 22 nt, Chlamydophila pneumoniae J138
aucuuuucuuguaagacuaaaa

SEQ ID NO: 2549017 - RNA, 16 nt, Chlamydophila pneumoniae J138
aucuuuucuuucuaag

SEQ ID NO: 2549018 - RNA, 23 nt, Chlamydophila pneumoniae J138
aucuuuugguugugucaacccuu

SEQ ID NO: 2549019 - RNA, 22 nt, Chlamydophila pneumoniae J138
aucuuuuucauggcccgauaca

SEQ ID NO: 2549020 - RNA, 17 nt, Chlamydophila pneumoniae J138
augaaaaggauugcacu

SEQ ID NO: 2549021 - RNA, 15 nt, Chlamydophila pneumoniae J138
augaaaccuucagau

SEQ ID NO: 2549022 - RNA, 17 nt, Chlamydophila pneumoniae J138
augaaaggcucguagau

SEQ ID NO: 2549023 - RNA, 21 nt, Chlamydophila pneumoniae J138
augaaagugcucuuuuaacuu

SEQ ID NO: 2549024 - RNA, 18 nt, Chlamydophila pneumoniae J138
augaaauuucauucucac

SEQ ID NO: 2549025 - RNA, 23 nt, Chlamydophila pneumoniae J138
augaaauuucauucucacagcau

SEQ ID NO: 2549026 - RNA, 15 nt, Chlamydophila pneumoniae J138
augaaauuuucuaag

SEQ ID NO: 2549027 - RNA, 20 nt, Chlamydophila pneumoniae J138
augaaauuuucuaagagguu

SEQ ID NO: 2549028 - RNA, 22 nt, Chlamydophila pneumoniae J138
augaacagccucugugguuuuu

SEQ ID NO: 2549029 - RNA, 12 nt, Chlamydophila pneumoniae J138
augaacgugcau

SEQ ID NO: 2549030 - RNA, 14 nt, Chlamydophila pneumoniae J138
augaagaaaaaucu

SEQ ID NO: 2549031 - RNA, 18 nt, Chlamydophila pneumoniae J138
augaagaacuacucucau

SEQ ID NO: 2549032 - RNA, 23 nt, Chlamydophila pneumoniae J138
augaagagaguucucucuucacu

SEQ ID NO: 2549033 - RNA, 19 nt, Chlamydophila pneumoniae J138
augaaguugacaucuguag

SEQ ID NO: 2549034 - RNA, 14 nt, Chlamydophila pneumoniae J138
augaauaccagaag

SEQ ID NO: 2549035 - RNA, 16 nt, Chlamydophila pneumoniae J138
augaauauaauuccaa

SEQ ID NO: 2549036 - RNA, 16 nt, Chlamydophila pneumoniae J138
augaaucugguuccuu

SEQ ID NO: 2549037 - RNA, 15 nt, Chlamydophila pneumoniae J138
augaaugauuuccau

SEQ ID NO: 2549038 - RNA, 19 nt, Chlamydophila pneumoniae J138
augaaugauuuccauagag

SEQ ID NO: 2549039 - RNA, 20 nt, Chlamydophila pneumoniae J138
augacaaaggguuucuuucc

SEQ ID NO: 2549040 - RNA, 18 nt, Chlamydophila pneumoniae J138
augacaaguaucuacaca

SEQ ID NO: 2549041 - RNA, 19 nt, Chlamydophila pneumoniae J138
augacacagagaacaauaa

SEQ ID NO: 2549042 - RNA, 17 nt, Chlamydophila pneumoniae J138
augacagggaaagaaca

SEQ ID NO: 2549043 - RNA, 17 nt, Chlamydophila pneumoniae J138
augacaguguccacugc

SEQ ID NO: 2549044 - RNA, 16 nt, Chlamydophila pneumoniae J138
augacauugcaauaca

SEQ ID NO: 2549045 - RNA, 17 nt, Chlamydophila pneumoniae J138
augacauugcaauacau

SEQ ID NO: 2549046 - RNA, 22 nt, Chlamydophila pneumoniae J138
augacauugcaauacaucuuaa

SEQ ID NO: 2549047 - RNA, 16 nt, Chlamydophila pneumoniae J138
augaccaagaacauag

SEQ ID NO: 2549048 - RNA, 14 nt, Chlamydophila pneumoniae J138
augaccgcaaggag

SEQ ID NO: 2549049 - RNA, 16 nt, Chlamydophila pneumoniae J138
augaccuuuagcugcu

SEQ ID NO: 2549050 - RNA, 15 nt, Chlamydophila pneumoniae J138
augaccuuuaggaac

SEQ ID NO: 2549051 - RNA, 22 nt, Chlamydophila pneumoniae J138
augacggauccuagaauaggaa

SEQ ID NO: 2549052 - RNA, 13 nt, Chlamydophila pneumoniae J138
augacuauuuuca

SEQ ID NO: 2549053 - RNA, 20 nt, Chlamydophila pneumoniae J138
augacugcagauugcacuug

SEQ ID NO: 2549054 - RNA, 12 nt, Chlamydophila pneumoniae J138
augagaaaaaga

SEQ ID NO: 2549055 - RNA, 14 nt, Chlamydophila pneumoniae J138
augagaaaaagaau

SEQ ID NO: 2549056 - RNA, 17 nt, Chlamydophila pneumoniae J138
augagaacguaagcuuu

SEQ ID NO: 2549057 - RNA, 13 nt, Chlamydophila pneumoniae J138
augagagagcucu

SEQ ID NO: 2549058 - RNA, 14 nt, Chlamydophila pneumoniae J138
augagaguaaguuu

SEQ ID NO: 2549059 - RNA, 17 nt, Chlamydophila pneumoniae J138
augagaguuucuaaugu

SEQ ID NO: 2549060 - RNA, 15 nt, Chlamydophila pneumoniae J138
augagauccaaagcc

SEQ ID NO: 2549061 - RNA, 19 nt, Chlamydophila pneumoniae J138
augagauccaaagccugaa

SEQ ID NO: 2549062 - RNA, 13 nt, Chlamydophila pneumoniae J138
augagaugggcua

SEQ ID NO: 2549063 - RNA, 17 nt, Chlamydophila pneumoniae J138
augagcacauucaagau

SEQ ID NO: 2549064 - RNA, 23 nt, Chlamydophila pneumoniae J138
augagcaucugagucauaagcuc

SEQ ID NO: 2549065 - RNA, 21 nt, Chlamydophila pneumoniae J138
augagcucacgcaccauuccu

SEQ ID NO: 2549066 - RNA, 18 nt, Chlamydophila pneumoniae J138
augagcucaggcaacaac

SEQ ID NO: 2549067 - RNA, 17 nt, Chlamydophila pneumoniae J138
augaggcacauguagga

SEQ ID NO: 2549068 - RNA, 20 nt, Chlamydophila pneumoniae J138
augaguggguucacuccuga

SEQ ID NO: 2549069 - RNA, 13 nt, Chlamydophila pneumoniae J138
augauaauuucau

SEQ ID NO: 2549070 - RNA, 18 nt, Chlamydophila pneumoniae J138
augauaccaccuaaaaug

SEQ ID NO: 2549071 - RNA, 18 nt, Chlamydophila pneumoniae J138
augauauuuuuauuuaaa

SEQ ID NO: 2549072 - RNA, 21 nt, Chlamydophila pneumoniae J138
augauauuuuuauuuaaaauu

SEQ ID NO: 2549073 - RNA, 13 nt, Chlamydophila pneumoniae J138
augaucagagaga

SEQ ID NO: 2549074 - RNA, 21 nt, Chlamydophila pneumoniae J138
augaucagagagaggggaguc

SEQ ID NO: 2549075 - RNA, 22 nt, Chlamydophila pneumoniae J138
augauccaauagccaaagacuc

SEQ ID NO: 2549076 - RNA, 16 nt, Chlamydophila pneumoniae J138
augauccgaaaacucu

SEQ ID NO: 2549077 - RNA, 21 nt, Chlamydophila pneumoniae J138
augaucgggguuucagaagga

SEQ ID NO: 2549078 - RNA, 16 nt, Chlamydophila pneumoniae J138
augaucuacagauagg

SEQ ID NO: 2549079 - RNA, 12 nt, Chlamydophila pneumoniae J138
augauucauaac

SEQ ID NO: 2549080 - RNA, 18 nt, Chlamydophila pneumoniae J138
augauuuucgguuacuuu

SEQ ID NO: 2549081 - RNA, 14 nt, Chlamydophila pneumoniae J138
augauuuuuugaau

SEQ ID NO: 2549082 - RNA, 15 nt, Chlamydophila pneumoniae J138
augcaaaccaaaaaa

SEQ ID NO: 2549083 - RNA, 18 nt, Chlamydophila pneumoniae J138
augcaaauccuguagaaa

SEQ ID NO: 2549084 - RNA, 14 nt, Chlamydophila pneumoniae J138
augcaaauuccaga

SEQ ID NO: 2549085 - RNA, 21 nt, Chlamydophila pneumoniae J138
augcaacagagucagaagcua

SEQ ID NO: 2549086 - RNA, 15 nt, Chlamydophila pneumoniae J138
augcaagcaacucuu

SEQ ID NO: 2549087 - RNA, 14 nt, Chlamydophila pneumoniae J138
augcaagugcuuuc

SEQ ID NO: 2549088 - RNA, 16 nt, Chlamydophila pneumoniae J138
augcaaugguugucuu

SEQ ID NO: 2549089 - RNA, 14 nt, Chlamydophila pneumoniae J138
augcacacgcuugu

SEQ ID NO: 2549090 - RNA, 17 nt, Chlamydophila pneumoniae J138
augcaccauaauauaau

SEQ ID NO: 2549091 - RNA, 22 nt, Chlamydophila pneumoniae J138
augcacgcuuucgucuaaaaua

SEQ ID NO: 2549092 - RNA, 22 nt, Chlamydophila pneumoniae J138
augcagccugcgacuacaagau

SEQ ID NO: 2549093 - RNA, 18 nt, Chlamydophila pneumoniae J138
augcauauugccuucuuc

SEQ ID NO: 2549094 - RNA, 13 nt, Chlamydophila pneumoniae J138
augcaucaagaga

SEQ ID NO: 2549095 - RNA, 16 nt, Chlamydophila pneumoniae J138
augcaucucuagccaa

SEQ ID NO: 2549096 - RNA, 12 nt, Chlamydophila pneumoniae J138
augcaucucuua

SEQ ID NO: 2549097 - RNA, 16 nt, Chlamydophila pneumoniae J138
augugaagccauuuuc

SEQ ID NO: 2549098 - RNA, 21 nt, Chlamydophila pneumoniae J138
augugcagaagguuccacaga

SEQ ID NO: 2549099 - RNA, 19 nt, Chlamydophila pneumoniae J138
augugcgcacaagggauuc

SEQ ID NO: 2549100 - RNA, 14 nt, Chlamydophila pneumoniae J138
augugcugaagacc

SEQ ID NO: 2549101 - RNA, 13 nt, Chlamydophila pneumoniae J138
auguggcagaguc

SEQ ID NO: 2549102 - RNA, 23 nt, Chlamydophila pneumoniae J138
augugucuugcugauuuuugcua

SEQ ID NO: 2549103 - RNA, 21 nt, Chlamydophila pneumoniae J138
auguguuuccuuuucuccuuc

SEQ ID NO: 2549104 - RNA, 23 nt, Chlamydophila pneumoniae J138
auguuaaaggaauaugcucuccu

SEQ ID NO: 2549105 - RNA, 21 nt, Chlamydophila pneumoniae J138
auguuaagcguauagaauaga

SEQ ID NO: 2549106 - RNA, 18 nt, Chlamydophila pneumoniae J138
auguuaugaguuuuuaau

SEQ ID NO: 2549107 - RNA, 21 nt, Chlamydophila pneumoniae J138
auguucuaugagauaggaacu

SEQ ID NO: 2549108 - RNA, 17 nt, Chlamydophila pneumoniae J138
auguucucgcaaugcuu

SEQ ID NO: 2549109 - RNA, 13 nt, Chlamydophila pneumoniae J138
auguucucuccag

SEQ ID NO: 2549110 - RNA, 15 nt, Chlamydophila pneumoniae J138
auguugucucauggg

SEQ ID NO: 2549111 - RNA, 11 nt, Chlamydophila pneumoniae J138
auguuucuaag

SEQ ID NO: 2549112 - RNA, 20 nt, Chlamydophila pneumoniae J138
auguuucuuccugaaucagc

SEQ ID NO: 2549113 - RNA, 21 nt, Chlamydophila pneumoniae J138
auguuuguaguguugaauaag

SEQ ID NO: 2549114 - RNA, 15 nt, Chlamydophila pneumoniae J138
auuaaaaauuuaaaa

SEQ ID NO: 2549115 - RNA, 23 nt, Chlamydophila pneumoniae J138
auuaaaguccaagaucaaacgaa

SEQ ID NO: 2549116 - RNA, 22 nt, Chlamydophila pneumoniae J138
auuaaaucguacuucacuucug

SEQ ID NO: 2549117 - RNA, 22 nt, Chlamydophila pneumoniae J138
auuaaaucguauugacuuuggu

SEQ ID NO: 2549118 - RNA, 19 nt, Chlamydophila pneumoniae J138
auuaaauuguauggaauuc

SEQ ID NO: 2549119 - RNA, 22 nt, Chlamydophila pneumoniae J138
auuaaauuguauggaauucaaa

SEQ ID NO: 2549120 - RNA, 20 nt, Chlamydophila pneumoniae J138
auuaacagagcgccuccacc

SEQ ID NO: 2549121 - RNA, 21 nt, Chlamydophila pneumoniae J138
auuaacagagcgccuccaccu

SEQ ID NO: 2549122 - RNA, 19 nt, Chlamydophila pneumoniae J138
auuaacuaagauauguccg

SEQ ID NO: 2549123 - RNA, 12 nt, Chlamydophila pneumoniae J138
auuaacuuuaua

SEQ ID NO: 2549124 - RNA, 18 nt, Chlamydophila pneumoniae J138
auuaagaacaucuuccca

SEQ ID NO: 2549125 - RNA, 14 nt, Chlamydophila pneumoniae J138
auuaagaagaagcu

SEQ ID NO: 2549126 - RNA, 11 nt, Chlamydophila pneumoniae J138
auuaagaagau

SEQ ID NO: 2549127 - RNA, 15 nt, Chlamydophila pneumoniae J138
auuaagaauggaugu

SEQ ID NO: 2549128 - RNA, 12 nt, Chlamydophila pneumoniae J138
auuaagaggagu

SEQ ID NO: 2549129 - RNA, 16 nt, Chlamydophila pneumoniae J138
auuaagauaaacagca

SEQ ID NO: 2549130 - RNA, 16 nt, Chlamydophila pneumoniae J138
auuaaggauuccuuga

SEQ ID NO: 2549131 - RNA, 22 nt, Chlamydophila pneumoniae J138
auuaaggcuccagcauaaggau

SEQ ID NO: 2549132 - RNA, 16 nt, Chlamydophila pneumoniae J138
auuaauaaauuuaucu

SEQ ID NO: 2549133 - RNA, 14 nt, Chlamydophila pneumoniae J138
auuaauacuuugcc

SEQ ID NO: 2549134 - RNA, 18 nt, Chlamydophila pneumoniae J138
auuaauccuugagggcua

SEQ ID NO: 2549135 - RNA, 23 nt, Chlamydophila pneumoniae J138
auuacagaucugcauaauuuuuc

SEQ ID NO: 2549136 - RNA, 22 nt, Chlamydophila pneumoniae J138
auuacagauuucuucuucagag

SEQ ID NO: 2549137 - RNA, 17 nt, Chlamydophila pneumoniae J138
auuacaucuaacucuaa

SEQ ID NO: 2549138 - RNA, 21 nt, Chlamydophila pneumoniae J138
auuaccguucccuaaaguaac

SEQ ID NO: 2549139 - RNA, 19 nt, Chlamydophila pneumoniae J138
auuaccuccuauuuucuua

SEQ ID NO: 2549140 - RNA, 23 nt, Chlamydophila pneumoniae J138
auuaccugcuaaacuuuuuuuca

SEQ ID NO: 2549141 - RNA, 23 nt, Chlamydophila pneumoniae J138
auuacggaaaauacagccagcag

SEQ ID NO: 2549142 - RNA, 17 nt, Chlamydophila pneumoniae J138
auuacuagaucccucaa

SEQ ID NO: 2549143 - RNA, 17 nt, Chlamydophila pneumoniae J138
auuacucgcucugcacg

SEQ ID NO: 2549144 - RNA, 20 nt, Chlamydophila pneumoniae J138
auuagaaaagauaaaacauu

SEQ ID NO: 2549145 - RNA, 14 nt, Chlamydophila pneumoniae J138
auuagaaguaucuu

SEQ ID NO: 2549146 - RNA, 21 nt, Chlamydophila pneumoniae J138
auuagaaguaucuugauguuu

SEQ ID NO: 2549147 - RNA, 13 nt, Chlamydophila pneumoniae J138
auuagagaauccg

SEQ ID NO: 2549148 - RNA, 17 nt, Chlamydophila pneumoniae J138
auuagagccccaacccu

SEQ ID NO: 2549149 - RNA, 20 nt, Chlamydophila pneumoniae J138
auuagcccuacgaauccaaa

SEQ ID NO: 2549150 - RNA, 22 nt, Chlamydophila pneumoniae J138
auuagcccuacgaauccaaaaa

SEQ ID NO: 2549151 - RNA, 15 nt, Chlamydophila pneumoniae J138
auuagcgaguacuuu

SEQ ID NO: 2549152 - RNA, 13 nt, Chlamydophila pneumoniae J138
auuagcuaaauca

SEQ ID NO: 2549153 - RNA, 15 nt, Chlamydophila pneumoniae J138
auuagcuaaaucaaa

SEQ ID NO: 2549154 - RNA, 19 nt, Chlamydophila pneumoniae J138
auuagcuaaaucaaaauuu

SEQ ID NO: 2549155 - RNA, 14 nt, Chlamydophila pneumoniae J138
auuaguaacuaaau

SEQ ID NO: 2549156 - RNA, 20 nt, Chlamydophila pneumoniae J138
auuaguaacuaaauucuuaa

SEQ ID NO: 2549157 - RNA, 23 nt, Chlamydophila pneumoniae J138
auuaguuucacauaguuuaauaa

SEQ ID NO: 2549158 - RNA, 12 nt, Chlamydophila pneumoniae J138
auuaguuuguuu

SEQ ID NO: 2549159 - RNA, 20 nt, Chlamydophila pneumoniae J138
auuauaaagauaaucuguaa

SEQ ID NO: 2549160 - RNA, 14 nt, Chlamydophila pneumoniae J138
auuauaaauagaaa

SEQ ID NO: 2549161 - RNA, 13 nt, Chlamydophila pneumoniae J138
auuaucaagaaau

SEQ ID NO: 2549162 - RNA, 17 nt, Chlamydophila pneumoniae J138
auuaucaagaaauucuu

SEQ ID NO: 2549163 - RNA, 14 nt, Chlamydophila pneumoniae J138
auuaucagagacaa

SEQ ID NO: 2549164 - RNA, 15 nt, Chlamydophila pneumoniae J138
auuaucauaaauacg

SEQ ID NO: 2549165 - RNA, 16 nt, Chlamydophila pneumoniae J138
auuaucccaaacuucu

SEQ ID NO: 2549166 - RNA, 17 nt, Chlamydophila pneumoniae J138
auuaucccaaacuucuu

SEQ ID NO: 2549167 - RNA, 19 nt, Chlamydophila pneumoniae J138
auuaucguuucaguuuuau

SEQ ID NO: 2549168 - RNA, 12 nt, Chlamydophila pneumoniae J138
auuaucuccaaa

SEQ ID NO: 2549169 - RNA, 15 nt, Chlamydophila pneumoniae J138
auuauguagaucaua

SEQ ID NO: 2549170 - RNA, 17 nt, Chlamydophila pneumoniae J138
auuauguauaaacucca

SEQ ID NO: 2549171 - RNA, 18 nt, Chlamydophila pneumoniae J138
auuauuaaacgaauacug

SEQ ID NO: 2549172 - RNA, 21 nt, Chlamydophila pneumoniae J138
auuauuuguuucuuccauaca

SEQ ID NO: 2549173 - RNA, 11 nt, Chlamydophila pneumoniae J138
auuauuuuaaa

SEQ ID NO: 2549174 - RNA, 12 nt, Chlamydophila pneumoniae J138
auuauuuuaaag

SEQ ID NO: 2549175 - RNA, 13 nt, Chlamydophila pneumoniae J138
auuauuuuaaagu

SEQ ID NO: 2549176 - RNA, 20 nt, Chlamydophila pneumoniae J138
auucaaacuccuuuuaaaau

SEQ ID NO: 2549177 - RNA, 21 nt, Chlamydophila pneumoniae J138
auucaaacuccuuuuaaaauu

SEQ ID NO: 2549178 - RNA, 13 nt, Chlamydophila pneumoniae J138
auucaaccaaacg

SEQ ID NO: 2549179 - RNA, 21 nt, Chlamydophila pneumoniae J138
auucaauaauuucaaagaugc

SEQ ID NO: 2549180 - RNA, 18 nt, Chlamydophila pneumoniae J138
auucaaugagcaucugag

SEQ ID NO: 2549181 - RNA, 15 nt, Chlamydophila pneumoniae J138
auucacaaaucuucc

SEQ ID NO: 2549182 - RNA, 18 nt, Chlamydophila pneumoniae J138
auucacaaaucuuccccu

SEQ ID NO: 2549183 - RNA, 15 nt, Chlamydophila pneumoniae J138
auucacaucuuaaaa

SEQ ID NO: 2549184 - RNA, 19 nt, Chlamydophila pneumoniae J138
auucacaucuuaaaaacua

SEQ ID NO: 2549185 - RNA, 18 nt, Chlamydophila pneumoniae J138
auucacguauagguugaa

SEQ ID NO: 2549186 - RNA, 12 nt, Chlamydophila pneumoniae J138
auucacuggaau

SEQ ID NO: 2549187 - RNA, 12 nt, Chlamydophila pneumoniae J138
auucagagaaag

SEQ ID NO: 2549188 - RNA, 19 nt, Chlamydophila pneumoniae J138
auucagauggucagucucg

SEQ ID NO: 2549189 - RNA, 17 nt, Chlamydophila pneumoniae J138
auucaggacccuuuucc

SEQ ID NO: 2549190 - RNA, 18 nt, Chlamydophila pneumoniae J138
auucaggauacucugaac

SEQ ID NO: 2549191 - RNA, 20 nt, Chlamydophila pneumoniae J138
auucagggggaaagccaaga

SEQ ID NO: 2549192 - RNA, 16 nt, Chlamydophila pneumoniae J138
auucagugucuugaag

SEQ ID NO: 2549193 - RNA, 23 nt, Chlamydophila pneumoniae J138
auucaucuaggggagcuauuacu

SEQ ID NO: 2549194 - RNA, 22 nt, Chlamydophila pneumoniae J138
auucaugaaaugcuuucagugc

SEQ ID NO: 2549195 - RNA, 18 nt, Chlamydophila pneumoniae J138
auucaugccgcauuucuu

SEQ ID NO: 2549196 - RNA, 15 nt, Chlamydophila pneumoniae J138
auucauuaagaacau

SEQ ID NO: 2549197 - RNA, 17 nt, Chlamydophila pneumoniae J138
auugcacucaucuugag

SEQ ID NO: 2549198 - RNA, 20 nt, Chlamydophila pneumoniae J138
auugcauuaagauaaacauu

SEQ ID NO: 2549199 - RNA, 15 nt, Chlamydophila pneumoniae J138
auugcauuuaaacua

SEQ ID NO: 2549200 - RNA, 13 nt, Chlamydophila pneumoniae J138
auugccuucuucu

SEQ ID NO: 2549201 - RNA, 21 nt, Chlamydophila pneumoniae J138
auugccuucuucuuguucuuc

SEQ ID NO: 2549202 - RNA, 18 nt, Chlamydophila pneumoniae J138
auugcgggcucaaagaaa

SEQ ID NO: 2549203 - RNA, 14 nt, Chlamydophila pneumoniae J138
auugcuaagcauuu

SEQ ID NO: 2549204 - RNA, 14 nt, Chlamydophila pneumoniae J138
auugcuaucaaaga

SEQ ID NO: 2549205 - RNA, 21 nt, Chlamydophila pneumoniae J138
auugcuaucaaagacucauga

SEQ ID NO: 2549206 - RNA, 16 nt, Chlamydophila pneumoniae J138
auugcugaaaaugauu

SEQ ID NO: 2549207 - RNA, 20 nt, Chlamydophila pneumoniae J138
auugcugccaggcuuaaaua

SEQ ID NO: 2549208 - RNA, 13 nt, Chlamydophila pneumoniae J138
auugcugcugcua

SEQ ID NO: 2549209 - RNA, 15 nt, Chlamydophila pneumoniae J138
auugcugucagaaca

SEQ ID NO: 2549210 - RNA, 15 nt, Chlamydophila pneumoniae J138
auugcuucuuccaag

SEQ ID NO: 2549211 - RNA, 17 nt, Chlamydophila pneumoniae J138
auugcuugcgcagcuuc

SEQ ID NO: 2549212 - RNA, 21 nt, Chlamydophila pneumoniae J138
auugcuugcgcaucagcagcu

SEQ ID NO: 2549213 - RNA, 13 nt, Chlamydophila pneumoniae J138
auuggaagcaaag

SEQ ID NO: 2549214 - RNA, 12 nt, Chlamydophila pneumoniae J138
auuggagucuaa

SEQ ID NO: 2549215 - RNA, 13 nt, Chlamydophila pneumoniae J138
auuggaucuugau

SEQ ID NO: 2549216 - RNA, 14 nt, Chlamydophila pneumoniae J138
auuggcauagagcc

SEQ ID NO: 2549217 - RNA, 15 nt, Chlamydophila pneumoniae J138
auuggcauagagccu

SEQ ID NO: 2549218 - RNA, 16 nt, Chlamydophila pneumoniae J138
auugggagguucgcag

SEQ ID NO: 2549219 - RNA, 13 nt, Chlamydophila pneumoniae J138
auuguagagauua

SEQ ID NO: 2549220 - RNA, 13 nt, Chlamydophila pneumoniae J138
auuguaguucuuu

SEQ ID NO: 2549221 - RNA, 15 nt, Chlamydophila pneumoniae J138
auuguauagcuuacu

SEQ ID NO: 2549222 - RNA, 12 nt, Chlamydophila pneumoniae J138
auugucuucagu

SEQ ID NO: 2549223 - RNA, 23 nt, Chlamydophila pneumoniae J138
auugugcauuaccuccuauuuuc

SEQ ID NO: 2549224 - RNA, 21 nt, Chlamydophila pneumoniae J138
auuguuagugagaucaaaaau

SEQ ID NO: 2549225 - RNA, 23 nt, Chlamydophila pneumoniae J138
auuguucuuuacuacaugaggau

SEQ ID NO: 2549226 - RNA, 13 nt, Chlamydophila pneumoniae J138
auuguuguugcau

SEQ ID NO: 2549227 - RNA, 16 nt, Chlamydophila pneumoniae J138
auuguuuguaucaaag

SEQ ID NO: 2549228 - RNA, 11 nt, Chlamydophila pneumoniae J138
auuguuuuguu

SEQ ID NO: 2549229 - RNA, 13 nt, Chlamydophila pneumoniae J138
auuuaaauaaaac

SEQ ID NO: 2549230 - RNA, 15 nt, Chlamydophila pneumoniae J138
auuuaacaacaugcg

SEQ ID NO: 2549231 - RNA, 16 nt, Chlamydophila pneumoniae J138
auuuacgaaaacaucu

SEQ ID NO: 2549232 - RNA, 19 nt, Chlamydophila pneumoniae J138
auuuacguguuucugaaag

SEQ ID NO: 2549233 - RNA, 21 nt, Chlamydophila pneumoniae J138
auuuagaaucuuuucuagaaa

SEQ ID NO: 2549234 - RNA, 15 nt, Chlamydophila pneumoniae J138
auuuagagagaaaca

SEQ ID NO: 2549235 - RNA, 21 nt, Chlamydophila pneumoniae J138
auuuagauaaagaaagcgcuc

SEQ ID NO: 2549236 - RNA, 20 nt, Chlamydophila pneumoniae J138
auuuaggagggguaaaccaa

SEQ ID NO: 2549237 - RNA, 17 nt, Chlamydophila pneumoniae J138
auuuauuuugucuuuuu

SEQ ID NO: 2549238 - RNA, 20 nt, Chlamydophila pneumoniae J138
auuuauuuugucuuuuuaag

SEQ ID NO: 2549239 - RNA, 20 nt, Chlamydophila pneumoniae J138
auuucagcguagguuugcug

SEQ ID NO: 2549240 - RNA, 17 nt, Chlamydophila pneumoniae J138
auuucauguaagaaugu

SEQ ID NO: 2549241 - RNA, 15 nt, Chlamydophila pneumoniae J138
auuucauguccucca

SEQ ID NO: 2549242 - RNA, 13 nt, Chlamydophila pneumoniae J138
auuucauuugaaa

SEQ ID NO: 2549243 - RNA, 16 nt, Chlamydophila pneumoniae J138
auuuccaaauucuugc

SEQ ID NO: 2549244 - RNA, 19 nt, Chlamydophila pneumoniae J138
auuuccaauccauucugag

SEQ ID NO: 2549245 - RNA, 14 nt, Chlamydophila pneumoniae J138
auuuccaguauucu

SEQ ID NO: 2549246 - RNA, 17 nt, Chlamydophila pneumoniae J138
auuuccaguauucugug

SEQ ID NO: 2549247 - RNA, 17 nt, Chlamydophila pneumoniae J138
auuucccauauagcucg

SEQ ID NO: 2549248 - RNA, 19 nt, Chlamydophila pneumoniae J138
auuuccuagguucuuuucg

SEQ ID NO: 2549249 - RNA, 16 nt, Chlamydophila pneumoniae J138
auuuccuuaagcuucu

SEQ ID NO: 2549250 - RNA, 13 nt, Chlamydophila pneumoniae J138
auuuccuucucca

SEQ ID NO: 2549251 - RNA, 14 nt, Chlamydophila pneumoniae J138
auuuccuucuuuua

SEQ ID NO: 2549252 - RNA, 22 nt, Chlamydophila pneumoniae J138
auuucgauaacacuucuuucuu

SEQ ID NO: 2549253 - RNA, 18 nt, Chlamydophila pneumoniae J138
auuucggacgauauuuag

SEQ ID NO: 2549254 - RNA, 14 nt, Chlamydophila pneumoniae J138
auuucuaacuuaau

SEQ ID NO: 2549255 - RNA, 19 nt, Chlamydophila pneumoniae J138
auuucuaacuuaauagauu

SEQ ID NO: 2549256 - RNA, 22 nt, Chlamydophila pneumoniae J138
auuucuaggacagcacauagag

SEQ ID NO: 2549257 - RNA, 19 nt, Chlamydophila pneumoniae J138
auuucuauagagcaucaua

SEQ ID NO: 2549258 - RNA, 13 nt, Chlamydophila pneumoniae J138
auuucuauuauuu

SEQ ID NO: 2549259 - RNA, 15 nt, Chlamydophila pneumoniae J138
auuucuccagcagcu

SEQ ID NO: 2549260 - RNA, 16 nt, Chlamydophila pneumoniae J138
auuucuccaguaucuu

SEQ ID NO: 2549261 - RNA, 18 nt, Chlamydophila pneumoniae J138
auuucuccgucaagaaca

SEQ ID NO: 2549262 - RNA, 19 nt, Chlamydophila pneumoniae J138
auuucuccgucaagaacaa

SEQ ID NO: 2549263 - RNA, 15 nt, Chlamydophila pneumoniae J138
auuucucuaucauca

SEQ ID NO: 2549264 - RNA, 16 nt, Chlamydophila pneumoniae J138
auuucucuaucaucaa

SEQ ID NO: 2549265 - RNA, 17 nt, Chlamydophila pneumoniae J138
auuucucuaucaucaau

SEQ ID NO: 2549266 - RNA, 21 nt, Chlamydophila pneumoniae J138
auuucuggagaaugccccuuc

SEQ ID NO: 2549267 - RNA, 17 nt, Chlamydophila pneumoniae J138
auuucuguaguucuugc

SEQ ID NO: 2549268 - RNA, 21 nt, Chlamydophila pneumoniae J138
auuucuuaauuuccuucucca

SEQ ID NO: 2549269 - RNA, 14 nt, Chlamydophila pneumoniae J138
auuucuucuagcuc

SEQ ID NO: 2549270 - RNA, 13 nt, Chlamydophila pneumoniae J138
auuucuucuucua

SEQ ID NO: 2549271 - RNA, 19 nt, Chlamydophila pneumoniae J138
auuucuugagucugaacau

SEQ ID NO: 2549272 - RNA, 23 nt, Chlamydophila pneumoniae J138
auuucuugagucugaacauucuu

SEQ ID NO: 2549273 - RNA, 22 nt, Chlamydophila pneumoniae J138
auuucuuucacaucuuuagaau

SEQ ID NO: 2549274 - RNA, 14 nt, Chlamydophila pneumoniae J138
auuucuuucucuuc

SEQ ID NO: 2549275 - RNA, 16 nt, Chlamydophila pneumoniae J138
auuugaacaugaggau

SEQ ID NO: 2549276 - RNA, 21 nt, Chlamydophila pneumoniae J138
auuugaauaaaggacauagac

SEQ ID NO: 2549277 - RNA, 13 nt, Chlamydophila pneumoniae J138
auuugauuuuuca

SEQ ID NO: 2549278 - RNA, 22 nt, Chlamydophila pneumoniae J138
auuugcaacaaucuuucuucua

SEQ ID NO: 2549279 - RNA, 22 nt, Chlamydophila pneumoniae J138
auuugcgaaguccuggauuuua

SEQ ID NO: 2549280 - RNA, 23 nt, Chlamydophila pneumoniae J138
auuugguaguuuuucagucucga

SEQ ID NO: 2549281 - RNA, 21 nt, Chlamydophila pneumoniae J138
auuuguagcucccauaaguuc

SEQ ID NO: 2549282 - RNA, 12 nt, Chlamydophila pneumoniae J138
auuugucaucac

SEQ ID NO: 2549283 - RNA, 17 nt, Chlamydophila pneumoniae J138
auuugucaucacaucag

SEQ ID NO: 2549284 - RNA, 23 nt, Chlamydophila pneumoniae J138
auuugucuagugaagcugcuucu

SEQ ID NO: 2549285 - RNA, 14 nt, Chlamydophila pneumoniae J138
auuuguuuagcaua

SEQ ID NO: 2549286 - RNA, 17 nt, Chlamydophila pneumoniae J138
auuuguuuagcauagag

SEQ ID NO: 2549287 - RNA, 16 nt, Chlamydophila pneumoniae J138
auuuuaaaaucuccuc

SEQ ID NO: 2549288 - RNA, 17 nt, Chlamydophila pneumoniae J138
auuuuaaagcaaaaauu

SEQ ID NO: 2549289 - RNA, 14 nt, Chlamydophila pneumoniae J138
auuuuaaagccucc

SEQ ID NO: 2549290 - RNA, 17 nt, Chlamydophila pneumoniae J138
auuuuaaagccuccuca

SEQ ID NO: 2549291 - RNA, 18 nt, Chlamydophila pneumoniae J138
auuuuaaagucacuuuca

SEQ ID NO: 2549292 - RNA, 14 nt, Chlamydophila pneumoniae J138
auuuuaauucaaaa

SEQ ID NO: 2549293 - RNA, 15 nt, Chlamydophila pneumoniae J138
auuuuacgaauuuca

SEQ ID NO: 2549294 - RNA, 22 nt, Chlamydophila pneumoniae J138
auuuuacuugcgauacaauaaa

SEQ ID NO: 2549295 - RNA, 14 nt, Chlamydophila pneumoniae J138
auuuuagcauaauc

SEQ ID NO: 2549296 - RNA, 22 nt, Chlamydophila pneumoniae J138
auuuuagcuccgaggcuucuga

SEQ ID NO: 2549297 - RNA, 20 nt, Chlamydophila pneumoniae J138
caaacccugggcucacucua

SEQ ID NO: 2549298 - RNA, 13 nt, Chlamydophila pneumoniae J138
caaaccucuaaaa

SEQ ID NO: 2549299 - RNA, 12 nt, Chlamydophila pneumoniae J138
caaacgaauuuc

SEQ ID NO: 2549300 - RNA, 20 nt, Chlamydophila pneumoniae J138
caaacgaauuucuuguucca

SEQ ID NO: 2549301 - RNA, 18 nt, Chlamydophila pneumoniae J138
caaacgcaaugauuucuc

SEQ ID NO: 2549302 - RNA, 20 nt, Chlamydophila pneumoniae J138
caaacgcaaugauuucucua

SEQ ID NO: 2549303 - RNA, 18 nt, Chlamydophila pneumoniae J138
caaacggaacuaaagaga

SEQ ID NO: 2549304 - RNA, 16 nt, Chlamydophila pneumoniae J138
caaacuaaaucaacua

SEQ ID NO: 2549305 - RNA, 22 nt, Chlamydophila pneumoniae J138
caaacuccccaguuuuccaucc

SEQ ID NO: 2549306 - RNA, 16 nt, Chlamydophila pneumoniae J138
caaacugaucugaaau

SEQ ID NO: 2549307 - RNA, 20 nt, Chlamydophila pneumoniae J138
caaacugaugccaagaaaua

SEQ ID NO: 2549308 - RNA, 23 nt, Chlamydophila pneumoniae J138
caaacuuguuuucguaagagaau

SEQ ID NO: 2549309 - RNA, 21 nt, Chlamydophila pneumoniae J138
caaacuuucuuuucuauauuc

SEQ ID NO: 2549310 - RNA, 19 nt, Chlamydophila pneumoniae J138
caaagaaaauucucagauu

SEQ ID NO: 2549311 - RNA, 13 nt, Chlamydophila pneumoniae J138
caaagaaagugaa

SEQ ID NO: 2549312 - RNA, 19 nt, Chlamydophila pneumoniae J138
caaagaacacccccgcagc

SEQ ID NO: 2549313 - RNA, 15 nt, Chlamydophila pneumoniae J138
caaagaacagcacuc

SEQ ID NO: 2549314 - RNA, 19 nt, Chlamydophila pneumoniae J138
caaagaacugcauaaucuc

SEQ ID NO: 2549315 - RNA, 23 nt, Chlamydophila pneumoniae J138
caaagaagucgcuagaucacaag

SEQ ID NO: 2549316 - RNA, 16 nt, Chlamydophila pneumoniae J138
caaagaauucagagaa

SEQ ID NO: 2549317 - RNA, 18 nt, Chlamydophila pneumoniae J138
caaagaauucagagaaag

SEQ ID NO: 2549318 - RNA, 23 nt, Chlamydophila pneumoniae J138
caaagacaggcucaugaaauuuc

SEQ ID NO: 2549319 - RNA, 14 nt, Chlamydophila pneumoniae J138
caaagacauccaag

SEQ ID NO: 2549320 - RNA, 17 nt, Chlamydophila pneumoniae J138
caaagacaucuccugca

SEQ ID NO: 2549321 - RNA, 20 nt, Chlamydophila pneumoniae J138
caaagacguaggugccugaa

SEQ ID NO: 2549322 - RNA, 18 nt, Chlamydophila pneumoniae J138
caaagacuagagucacua

SEQ ID NO: 2549323 - RNA, 16 nt, Chlamydophila pneumoniae J138
caaagacugagcuucu

SEQ ID NO: 2549324 - RNA, 15 nt, Chlamydophila pneumoniae J138
caaagagucucuugc

SEQ ID NO: 2549325 - RNA, 22 nt, Chlamydophila pneumoniae J138
caaagagucucuugcuuuugua

SEQ ID NO: 2549326 - RNA, 15 nt, Chlamydophila pneumoniae J138
caaagaguuuuuuag

SEQ ID NO: 2549327 - RNA, 23 nt, Chlamydophila pneumoniae J138
caaagaguuuuuuagaggagcuu

SEQ ID NO: 2549328 - RNA, 14 nt, Chlamydophila pneumoniae J138
caaagauaaagaag

SEQ ID NO: 2549329 - RNA, 16 nt, Chlamydophila pneumoniae J138
caaagauaaagaaguu

SEQ ID NO: 2549330 - RNA, 15 nt, Chlamydophila pneumoniae J138
caaagaucacugaga

SEQ ID NO: 2549331 - RNA, 11 nt, Chlamydophila pneumoniae J138
caaagaucagu

SEQ ID NO: 2549332 - RNA, 22 nt, Chlamydophila pneumoniae J138
caaagaugacgagcccuagaua

SEQ ID NO: 2549333 - RNA, 20 nt, Chlamydophila pneumoniae J138
caaagaugcagauacuaaac

SEQ ID NO: 2549334 - RNA, 12 nt, Chlamydophila pneumoniae J138
caaagauugcua

SEQ ID NO: 2549335 - RNA, 21 nt, Chlamydophila pneumoniae J138
caaagauuucugcuguguuau

SEQ ID NO: 2549336 - RNA, 12 nt, Chlamydophila pneumoniae J138
caaagcaaagag

SEQ ID NO: 2549337 - RNA, 14 nt, Chlamydophila pneumoniae J138
caaagcaaagagca

SEQ ID NO: 2549338 - RNA, 19 nt, Chlamydophila pneumoniae J138
caaagcaucuuguauugcu

SEQ ID NO: 2549339 - RNA, 15 nt, Chlamydophila pneumoniae J138
caaagccaaauucuc

SEQ ID NO: 2549340 - RNA, 14 nt, Chlamydophila pneumoniae J138
caaagccugaaaaa

SEQ ID NO: 2549341 - RNA, 21 nt, Chlamydophila pneumoniae J138
caaagcgaccugcaaaugaag

SEQ ID NO: 2549342 - RNA, 13 nt, Chlamydophila pneumoniae J138
agaacaccaucac

SEQ ID NO: 2549343 - RNA, 20 nt, Chlamydophila pneumoniae J138
agaacaccaucacauccugu

SEQ ID NO: 2549344 - RNA, 17 nt, Chlamydophila pneumoniae J138
agaacacgccugcgaaa

SEQ ID NO: 2549345 - RNA, 16 nt, Chlamydophila pneumoniae J138
agaacacucagagaug

SEQ ID NO: 2549346 - RNA, 21 nt, Chlamydophila pneumoniae J138
agaacacucagagauguggca

SEQ ID NO: 2549347 - RNA, 21 nt, Chlamydophila pneumoniae J138
agaacagaggaucuagaaaau

SEQ ID NO: 2549348 - RNA, 24 nt, Chlamydophila pneumoniae J138
agaacagaggaucuagaaaaugaa

SEQ ID NO: 2549349 - RNA, 13 nt, Chlamydophila pneumoniae J138
agaacagcagaaa

SEQ ID NO: 2549350 - RNA, 21 nt, Chlamydophila pneumoniae J138
agaacagcauggacuccaaga

SEQ ID NO: 2549351 - RNA, 21 nt, Chlamydophila pneumoniae J138
agaacauagucguuuucucga

SEQ ID NO: 2549352 - RNA, 21 nt, Chlamydophila pneumoniae J138
agaacaugaccuuuaggaacu

SEQ ID NO: 2549353 - RNA, 15 nt, Chlamydophila pneumoniae J138
agaacaugcccccac

SEQ ID NO: 2549354 - RNA, 22 nt, Chlamydophila pneumoniae J138
agaaccuaggaaauccuccuag

SEQ ID NO: 2549355 - RNA, 11 nt, Chlamydophila pneumoniae J138
agaaccuccac

SEQ ID NO: 2549356 - RNA, 14 nt, Chlamydophila pneumoniae J138
agaaccuguuuuuc

SEQ ID NO: 2549357 - RNA, 15 nt, Chlamydophila pneumoniae J138
agaaccuucacaaga

SEQ ID NO: 2549358 - RNA, 19 nt, Chlamydophila pneumoniae J138
agaaccuucacaagaaaac

SEQ ID NO: 2549359 - RNA, 21 nt, Chlamydophila pneumoniae J138
agaaccuucacaagaaaacaa

SEQ ID NO: 2549360 - RNA, 24 nt, Chlamydophila pneumoniae J138
agaaccuucacaagaaaacaaagu

SEQ ID NO: 2549361 - RNA, 13 nt, Chlamydophila pneumoniae J138
agaacguaagcuu

SEQ ID NO: 2549362 - RNA, 19 nt, Chlamydophila pneumoniae J138
agaacguagcagaggcagg

SEQ ID NO: 2549363 - RNA, 18 nt, Chlamydophila pneumoniae J138
agaacgucaccauuaaau

SEQ ID NO: 2549364 - RNA, 21 nt, Chlamydophila pneumoniae J138
agaacguccucaccuugugag

SEQ ID NO: 2549365 - RNA, 14 nt, Chlamydophila pneumoniae J138
agaacguggggaaa

SEQ ID NO: 2549366 - RNA, 13 nt, Chlamydophila pneumoniae J138
agaacucuccucg

SEQ ID NO: 2549367 - RNA, 22 nt, Chlamydophila pneumoniae J138
agaacucuuaaagguaaagcuu

SEQ ID NO: 2549368 - RNA, 23 nt, Chlamydophila pneumoniae J138
agaacugcauaaucucaccagaa

SEQ ID NO: 2549369 - RNA, 16 nt, Chlamydophila pneumoniae J138
agaacuucaaugaaag

SEQ ID NO: 2549370 - RNA, 21 nt, Chlamydophila pneumoniae J138
agaacuuuaacgaagaaggga

SEQ ID NO: 2549371 - RNA, 15 nt, Chlamydophila pneumoniae J138
agaacuuuacaauua

SEQ ID NO: 2549372 - RNA, 19 nt, Chlamydophila pneumoniae J138
agaacuuucgucuuugcuu

SEQ ID NO: 2549373 - RNA, 16 nt, Chlamydophila pneumoniae J138
agaagaaccucauuuu

SEQ ID NO: 2549374 - RNA, 16 nt, Chlamydophila pneumoniae J138
agaagaaggacaacua

SEQ ID NO: 2549375 - RNA, 21 nt, Chlamydophila pneumoniae J138
agaagacaggagcuacugaaa

SEQ ID NO: 2549376 - RNA, 10 nt, Chlamydophila pneumoniae J138
agaagacgcu

SEQ ID NO: 2549377 - RNA, 21 nt, Chlamydophila pneumoniae J138
agaagacgcucuuagccuagg

SEQ ID NO: 2549378 - RNA, 14 nt, Chlamydophila pneumoniae J138
agaagagaaaguag

SEQ ID NO: 2549379 - RNA, 17 nt, Chlamydophila pneumoniae J138
agaagagguaauaauag

SEQ ID NO: 2549380 - RNA, 14 nt, Chlamydophila pneumoniae J138
agaagaucaaagau

SEQ ID NO: 2549381 - RNA, 23 nt, Chlamydophila pneumoniae J138
agaagaucucgucuuggaaugcu

SEQ ID NO: 2549382 - RNA, 15 nt, Chlamydophila pneumoniae J138
agaagauucaagcaa

SEQ ID NO: 2549383 - RNA, 14 nt, Chlamydophila pneumoniae J138
agaagauucuuuaa

SEQ ID NO: 2549384 - RNA, 13 nt, Chlamydophila pneumoniae J138
agaagcaaaggua

SEQ ID NO: 2549385 - RNA, 15 nt, Chlamydophila pneumoniae J138
agaagcaacuaaacu

SEQ ID NO: 2549386 - RNA, 21 nt, Chlamydophila pneumoniae J138
agaagcacuucuuuaggagca

SEQ ID NO: 2549387 - RNA, 13 nt, Chlamydophila pneumoniae J138
agaagcaugaagc

SEQ ID NO: 2549388 - RNA, 19 nt, Chlamydophila pneumoniae J138
agaagcaugaagcagaaac

SEQ ID NO: 2549389 - RNA, 20 nt, Chlamydophila pneumoniae J138
agaagcaugaagcagaaacu

SEQ ID NO: 2549390 - RNA, 15 nt, Chlamydophila pneumoniae J138
agaagccuuccuugu

SEQ ID NO: 2549391 - RNA, 21 nt, Chlamydophila pneumoniae J138
agaagcucuaucuuugguaug

SEQ ID NO: 2549392 - RNA, 19 nt, Chlamydophila pneumoniae J138
agaaggcucucaaggucac

SEQ ID NO: 2549393 - RNA, 18 nt, Chlamydophila pneumoniae J138
agaaggcuuguuucuguu

SEQ ID NO: 2549394 - RNA, 13 nt, Chlamydophila pneumoniae J138
agaagggacuugu

SEQ ID NO: 2549395 - RNA, 13 nt, Chlamydophila pneumoniae J138
agaaggggguucu

SEQ ID NO: 2549396 - RNA, 22 nt, Chlamydophila pneumoniae J138
agaagguccaugucuaaagauu

SEQ ID NO: 2549397 - RNA, 23 nt, Chlamydophila pneumoniae J138
agaagguguuuuggcugcuuuug

SEQ ID NO: 2549398 - RNA, 12 nt, Chlamydophila pneumoniae J138
agaagguuucua

SEQ ID NO: 2549399 - RNA, 14 nt, Chlamydophila pneumoniae J138
agaagucgcaguaa

SEQ ID NO: 2549400 - RNA, 20 nt, Chlamydophila pneumoniae J138
agaagucgcuagaucacaag

SEQ ID NO: 2549401 - RNA, 23 nt, Chlamydophila pneumoniae J138
agaagucgcuagaucacaagaaa

SEQ ID NO: 2549402 - RNA, 14 nt, Chlamydophila pneumoniae J138
agaaguuccuucag

SEQ ID NO: 2549403 - RNA, 19 nt, Chlamydophila pneumoniae J138
agaaguuuacaaauaaaau

SEQ ID NO: 2549404 - RNA, 14 nt, Chlamydophila pneumoniae J138
agaauaaaauagga

SEQ ID NO: 2549405 - RNA, 21 nt, Chlamydophila pneumoniae J138
agaauaacgcaagggcggaga

SEQ ID NO: 2549406 - RNA, 13 nt, Chlamydophila pneumoniae J138
agaauaaucucuu

SEQ ID NO: 2549407 - RNA, 14 nt, Chlamydophila pneumoniae J138
agaauacaaacaag

SEQ ID NO: 2549408 - RNA, 18 nt, Chlamydophila pneumoniae J138
agaauacaaacaagaagc

SEQ ID NO: 2549409 - RNA, 15 nt, Chlamydophila pneumoniae J138
agaauacaacccuuu

SEQ ID NO: 2549410 - RNA, 16 nt, Chlamydophila pneumoniae J138
agaauaccuauagguu

SEQ ID NO: 2549411 - RNA, 22 nt, Chlamydophila pneumoniae J138
agaauacucuagguuuucucuu

SEQ ID NO: 2549412 - RNA, 13 nt, Chlamydophila pneumoniae J138
agaauagcaagca

SEQ ID NO: 2549413 - RNA, 14 nt, Chlamydophila pneumoniae J138
agaauaucuuuuga

SEQ ID NO: 2549414 - RNA, 15 nt, Chlamydophila pneumoniae J138
agaauaugaacugcc

SEQ ID NO: 2549415 - RNA, 13 nt, Chlamydophila pneumoniae J138
agaaucaauaaaa

SEQ ID NO: 2549416 - RNA, 22 nt, Chlamydophila pneumoniae J138
agaaucauaacaagucuaucga

SEQ ID NO: 2549417 - RNA, 23 nt, Chlamydophila pneumoniae J138
agaaucaucugguauucuaggua

SEQ ID NO: 2549418 - RNA, 19 nt, Chlamydophila pneumoniae J138
agaauccacuacugucaau

SEQ ID NO: 2549419 - RNA, 15 nt, Chlamydophila pneumoniae J138
agaauccauuuugcc

SEQ ID NO: 2549420 - RNA, 17 nt, Chlamydophila pneumoniae J138
agaauccauuuugccca

SEQ ID NO: 2549421 - RNA, 17 nt, Chlamydophila pneumoniae J138
agaauccugaguaaaau

SEQ ID NO: 2549422 - RNA, 18 nt, Chlamydophila pneumoniae J138
agaaucggaucuucaauu

SEQ ID NO: 2549423 - RNA, 21 nt, Chlamydophila pneumoniae J138
agaaucguucccaucacauaa

SEQ ID NO: 2549424 - RNA, 23 nt, Chlamydophila pneumoniae J138
agaaucguucuuagcgcauguau

SEQ ID NO: 2549425 - RNA, 18 nt, Chlamydophila pneumoniae J138
agaaucuccauuuagaau

SEQ ID NO: 2549426 - RNA, 14 nt, Chlamydophila pneumoniae J138
agaaucuccucauc

SEQ ID NO: 2549427 - RNA, 16 nt, Chlamydophila pneumoniae J138
agaaucuccucaucag

SEQ ID NO: 2549428 - RNA, 18 nt, Chlamydophila pneumoniae J138
agaaucucugaccaucaa

SEQ ID NO: 2549429 - RNA, 12 nt, Chlamydophila pneumoniae J138
agaaucuuugug

SEQ ID NO: 2549430 - RNA, 13 nt, Chlamydophila pneumoniae J138
agaaucuuuucua

SEQ ID NO: 2549431 - RNA, 21 nt, Chlamydophila pneumoniae J138
agaaugacacagagaacaaua

SEQ ID NO: 2549432 - RNA, 15 nt, Chlamydophila pneumoniae J138
agaaugauaagaaag

SEQ ID NO: 2549433 - RNA, 16 nt, Chlamydophila pneumoniae J138
agaaugauaagaaagc

SEQ ID NO: 2549434 - RNA, 14 nt, Chlamydophila pneumoniae J138
agaaugaugcaagc

SEQ ID NO: 2549435 - RNA, 16 nt, Chlamydophila pneumoniae J138
agaaugcaucuugagg

SEQ ID NO: 2549436 - RNA, 21 nt, Chlamydophila pneumoniae J138
agaaugcuguaaucgagagaa

SEQ ID NO: 2549437 - RNA, 19 nt, Chlamydophila pneumoniae J138
agaauguacauagaggaga

SEQ ID NO: 2549438 - RNA, 20 nt, Chlamydophila pneumoniae J138
agaauguacauagaggagau

SEQ ID NO: 2549439 - RNA, 14 nt, Chlamydophila pneumoniae J138
agaauguaugugaa

SEQ ID NO: 2549440 - RNA, 17 nt, Chlamydophila pneumoniae J138
agaauguaugugaaaga

SEQ ID NO: 2549441 - RNA, 19 nt, Chlamydophila pneumoniae J138
agaauguucccaaauagaa

SEQ ID NO: 2549442 - RNA, 20 nt, Chlamydophila pneumoniae J138
agagaguauuuacaaggauu

SEQ ID NO: 2549443 - RNA, 22 nt, Chlamydophila pneumoniae J138
agagagucggcuuuagaaaagu

SEQ ID NO: 2549444 - RNA, 23 nt, Chlamydophila pneumoniae J138
agagagucuucguuucuuugagu

SEQ ID NO: 2549445 - RNA, 18 nt, Chlamydophila pneumoniae J138
agagaguuuguaacucaa

SEQ ID NO: 2549446 - RNA, 23 nt, Chlamydophila pneumoniae J138
agagauagggggacaccugaaga

SEQ ID NO: 2549447 - RNA, 13 nt, Chlamydophila pneumoniae J138
agagaucacugua

SEQ ID NO: 2549448 - RNA, 17 nt, Chlamydophila pneumoniae J138
agagauccaaugacaau

SEQ ID NO: 2549449 - RNA, 19 nt, Chlamydophila pneumoniae J138
agagaucuuuuuauuaaaa

SEQ ID NO: 2549450 - RNA, 19 nt, Chlamydophila pneumoniae J138
agagauuaccgaagagccc

SEQ ID NO: 2549451 - RNA, 16 nt, Chlamydophila pneumoniae J138
agagauucauaaaacu

SEQ ID NO: 2549452 - RNA, 17 nt, Chlamydophila pneumoniae J138
agagauucauaaaacug

SEQ ID NO: 2549453 - RNA, 14 nt, Chlamydophila pneumoniae J138
agagauucuacaaa

SEQ ID NO: 2549454 - RNA, 21 nt, Chlamydophila pneumoniae J138
agagauuuuaaagccuccuca

SEQ ID NO: 2549455 - RNA, 21 nt, Chlamydophila pneumoniae J138
agagauuuuccauaggaacaa

SEQ ID NO: 2549456 - RNA, 12 nt, Chlamydophila pneumoniae J138
agagauuuuucu

SEQ ID NO: 2549457 - RNA, 23 nt, Chlamydophila pneumoniae J138
agagauuuuucuaggaaucuuuu

SEQ ID NO: 2549458 - RNA, 17 nt, Chlamydophila pneumoniae J138
agagcaaacaucaaaga

SEQ ID NO: 2549459 - RNA, 20 nt, Chlamydophila pneumoniae J138
agagcaagauucuucagaau

SEQ ID NO: 2549460 - RNA, 17 nt, Chlamydophila pneumoniae J138
agagcaugcuugaggaa

SEQ ID NO: 2549461 - RNA, 20 nt, Chlamydophila pneumoniae J138
agagccauuuuccaggacca

SEQ ID NO: 2549462 - RNA, 15 nt, Chlamydophila pneumoniae J138
agagcccccauagga

SEQ ID NO: 2549463 - RNA, 15 nt, Chlamydophila pneumoniae J138
agagccgucuacuuu

SEQ ID NO: 2549464 - RNA, 16 nt, Chlamydophila pneumoniae J138
agagcgaucgcaauca

SEQ ID NO: 2549465 - RNA, 23 nt, Chlamydophila pneumoniae J138
agagcgcguuucaaauaggaucu

SEQ ID NO: 2549466 - RNA, 22 nt, Chlamydophila pneumoniae J138
agagcuaaagaaacuucugacc

SEQ ID NO: 2549467 - RNA, 18 nt, Chlamydophila pneumoniae J138
agagcuaacagcacguaa

SEQ ID NO: 2549468 - RNA, 19 nt, Chlamydophila pneumoniae J138
agagcucguaauccuucuu

SEQ ID NO: 2549469 - RNA, 22 nt, Chlamydophila pneumoniae J138
agagcuggggauggucuucccc

SEQ ID NO: 2549470 - RNA, 16 nt, Chlamydophila pneumoniae J138
agagcuuccauuggaa

SEQ ID NO: 2549471 - RNA, 14 nt, Chlamydophila pneumoniae J138
agagcuucuaaaaa

SEQ ID NO: 2549472 - RNA, 18 nt, Chlamydophila pneumoniae J138
agagcuucuaaaaacucu

SEQ ID NO: 2549473 - RNA, 15 nt, Chlamydophila pneumoniae J138
agagcuucuuuaucu

SEQ ID NO: 2549474 - RNA, 16 nt, Chlamydophila pneumoniae J138
agagcuugguuuucuc

SEQ ID NO: 2549475 - RNA, 15 nt, Chlamydophila pneumoniae J138
agagcuuucagaaaa

SEQ ID NO: 2549476 - RNA, 17 nt, Chlamydophila pneumoniae J138
agagcuuucagaaaaga

SEQ ID NO: 2549477 - RNA, 18 nt, Chlamydophila pneumoniae J138
agaggaaugaagagaguu

SEQ ID NO: 2549478 - RNA, 21 nt, Chlamydophila pneumoniae J138
agaggaccgagaugaacauaa

SEQ ID NO: 2549479 - RNA, 22 nt, Chlamydophila pneumoniae J138
agaggagacucuaguuuuucuu

SEQ ID NO: 2549480 - RNA, 15 nt, Chlamydophila pneumoniae J138
agaggagagaauccu

SEQ ID NO: 2549481 - RNA, 12 nt, Chlamydophila pneumoniae J138
agaggagauccu

SEQ ID NO: 2549482 - RNA, 17 nt, Chlamydophila pneumoniae J138
agaggagauccuaagag

SEQ ID NO: 2549483 - RNA, 23 nt, Chlamydophila pneumoniae J138
agaggaucuagaaaaugaagagc

SEQ ID NO: 2549484 - RNA, 18 nt, Chlamydophila pneumoniae J138
agaggccuuuuagaguau

SEQ ID NO: 2549485 - RNA, 16 nt, Chlamydophila pneumoniae J138
agaggcuguccuugca

SEQ ID NO: 2549486 - RNA, 17 nt, Chlamydophila pneumoniae J138
agaggcuuuaaauuuuu

SEQ ID NO: 2549487 - RNA, 14 nt, Chlamydophila pneumoniae J138
agagggaaggaaua

SEQ ID NO: 2549488 - RNA, 20 nt, Chlamydophila pneumoniae J138
agaggggaaccaaggacgua

SEQ ID NO: 2549489 - RNA, 23 nt, Chlamydophila pneumoniae J138
agaggguuuuuuugcugcgaaug

SEQ ID NO: 2549490 - RNA, 16 nt, Chlamydophila pneumoniae J138
agagguaaccagagag

SEQ ID NO: 2549491 - RNA, 17 nt, Chlamydophila pneumoniae J138
agaggucacuauagauc

SEQ ID NO: 2549492 - RNA, 18 nt, Chlamydophila pneumoniae J138
agagguuagaagggaggu

SEQ ID NO: 2549493 - RNA, 13 nt, Chlamydophila pneumoniae J138
agaguaaagagua

SEQ ID NO: 2549494 - RNA, 20 nt, Chlamydophila pneumoniae J138
agaguacgugaucucacgaa

SEQ ID NO: 2549495 - RNA, 12 nt, Chlamydophila pneumoniae J138
agaguagcccca

SEQ ID NO: 2549496 - RNA, 16 nt, Chlamydophila pneumoniae J138
agaguauuagcgagua

SEQ ID NO: 2549497 - RNA, 19 nt, Chlamydophila pneumoniae J138
agaguauuagcgaguacuu

SEQ ID NO: 2549498 - RNA, 13 nt, Chlamydophila pneumoniae J138
agaguauuuacaa

SEQ ID NO: 2549499 - RNA, 14 nt, Chlamydophila pneumoniae J138
agaguccaagguuc

SEQ ID NO: 2549500 - RNA, 16 nt, Chlamydophila pneumoniae J138
agaguccgaagccuuc

SEQ ID NO: 2549501 - RNA, 16 nt, Chlamydophila pneumoniae J138
agaguccugggguucu

SEQ ID NO: 2549502 - RNA, 17 nt, Chlamydophila pneumoniae J138
agagucucuugcuuuug

SEQ ID NO: 2549503 - RNA, 21 nt, Chlamydophila pneumoniae J138
agagucucuuucagcucaagu

SEQ ID NO: 2549504 - RNA, 17 nt, Chlamydophila pneumoniae J138
agagucugcagcagaug

SEQ ID NO: 2549505 - RNA, 21 nt, Chlamydophila pneumoniae J138
agagucuguguagccguaggg

SEQ ID NO: 2549506 - RNA, 23 nt, Chlamydophila pneumoniae J138
agagucuucguuucuuugaguua

SEQ ID NO: 2549507 - RNA, 18 nt, Chlamydophila pneumoniae J138
agagucuuugaugcuaaa

SEQ ID NO: 2549508 - RNA, 16 nt, Chlamydophila pneumoniae J138
agagugacucaucagu

SEQ ID NO: 2549509 - RNA, 15 nt, Chlamydophila pneumoniae J138
agagugucuaagaua

SEQ ID NO: 2549510 - RNA, 15 nt, Chlamydophila pneumoniae J138
agagugugccagaau

SEQ ID NO: 2549511 - RNA, 20 nt, Chlamydophila pneumoniae J138
agaguguuguuggagcagaa

SEQ ID NO: 2549512 - RNA, 14 nt, Chlamydophila pneumoniae J138
agaguuagauguaa

SEQ ID NO: 2549513 - RNA, 20 nt, Chlamydophila pneumoniae J138
agaguuccaagacaauaaaa

SEQ ID NO: 2549514 - RNA, 14 nt, Chlamydophila pneumoniae J138
agaguugauaaaua

SEQ ID NO: 2549515 - RNA, 23 nt, Chlamydophila pneumoniae J138
agaguugcuuuauggcucaacuu

SEQ ID NO: 2549516 - RNA, 20 nt, Chlamydophila pneumoniae J138
agaguuucgaauucaaugag

SEQ ID NO: 2549517 - RNA, 14 nt, Chlamydophila pneumoniae J138
agaguuucuuuuga

SEQ ID NO: 2549518 - RNA, 14 nt, Chlamydophila pneumoniae J138
agaguuuuucccuc

SEQ ID NO: 2549519 - RNA, 20 nt, Chlamydophila pneumoniae J138
agaguuuuuuagaggagcuu

SEQ ID NO: 2549520 - RNA, 13 nt, Chlamydophila pneumoniae J138
agauaaacauuaa

SEQ ID NO: 2549521 - RNA, 19 nt, Chlamydophila pneumoniae J138
agauaaagacaucucuuua

SEQ ID NO: 2549522 - RNA, 12 nt, Chlamydophila pneumoniae J138
agauaaaggcau

SEQ ID NO: 2549523 - RNA, 13 nt, Chlamydophila pneumoniae J138
agauaaaucccac

SEQ ID NO: 2549524 - RNA, 14 nt, Chlamydophila pneumoniae J138
agauaauagagaag

SEQ ID NO: 2549525 - RNA, 17 nt, Chlamydophila pneumoniae J138
agauaauagagaagaag

SEQ ID NO: 2549526 - RNA, 20 nt, Chlamydophila pneumoniae J138
agauaaucuguaagaaaaug

SEQ ID NO: 2549527 - RNA, 21 nt, Chlamydophila pneumoniae J138
agauacuaucugccauaggau

SEQ ID NO: 2549528 - RNA, 14 nt, Chlamydophila pneumoniae J138
agauagagauaagu

SEQ ID NO: 2549529 - RNA, 18 nt, Chlamydophila pneumoniae J138
agauagcgacgucaucau

SEQ ID NO: 2549530 - RNA, 20 nt, Chlamydophila pneumoniae J138
agauagcuuacagagaaauu

SEQ ID NO: 2549531 - RNA, 21 nt, Chlamydophila pneumoniae J138
agauaguauuuuugaaaccaa

SEQ ID NO: 2549532 - RNA, 19 nt, Chlamydophila pneumoniae J138
agauaguucacaagugcau

SEQ ID NO: 2549533 - RNA, 21 nt, Chlamydophila pneumoniae J138
agauaguucacaagugcauua

SEQ ID NO: 2549534 - RNA, 16 nt, Chlamydophila pneumoniae J138
agauauauuuuuaaag

SEQ ID NO: 2549535 - RNA, 22 nt, Chlamydophila pneumoniae J138
agauaucgaccuuaaaauugaa

SEQ ID NO: 2549536 - RNA, 15 nt, Chlamydophila pneumoniae J138
agauaugaagagacg

SEQ ID NO: 2549537 - RNA, 19 nt, Chlamydophila pneumoniae J138
agauaugccucaggucugc

SEQ ID NO: 2549538 - RNA, 23 nt, Chlamydophila pneumoniae J138
agauaugccucaggucugcugag

SEQ ID NO: 2549539 - RNA, 19 nt, Chlamydophila pneumoniae J138
agauauucaagaggaccga

SEQ ID NO: 2549540 - RNA, 13 nt, Chlamydophila pneumoniae J138
agaucaaaaauag

SEQ ID NO: 2549541 - RNA, 14 nt, Chlamydophila pneumoniae J138
agaucaaaacuccg

SEQ ID NO: 2549542 - RNA, 16 nt, Chlamydophila pneumoniae J138
agcaacccgaauuccu

SEQ ID NO: 2549543 - RNA, 15 nt, Chlamydophila pneumoniae J138
agcaacgcaugacgc

SEQ ID NO: 2549544 - RNA, 22 nt, Chlamydophila pneumoniae J138
agcaacgcaugacgcuuuucca

SEQ ID NO: 2549545 - RNA, 20 nt, Chlamydophila pneumoniae J138
agcaacuacagagggcuuca

SEQ ID NO: 2549546 - RNA, 12 nt, Chlamydophila pneumoniae J138
agcaacucuuca

SEQ ID NO: 2549547 - RNA, 22 nt, Chlamydophila pneumoniae J138
agcaacuucccgaacagcggca

SEQ ID NO: 2549548 - RNA, 23 nt, Chlamydophila pneumoniae J138
agcaacuucuucguuagagaaga

SEQ ID NO: 2549549 - RNA, 19 nt, Chlamydophila pneumoniae J138
agcaagaaaauaggugacu

SEQ ID NO: 2549550 - RNA, 15 nt, Chlamydophila pneumoniae J138
agcaagaaucacugc

SEQ ID NO: 2549551 - RNA, 17 nt, Chlamydophila pneumoniae J138
agcaagagcucuugaga

SEQ ID NO: 2549552 - RNA, 19 nt, Chlamydophila pneumoniae J138
agcaagauaaucauuaaga

SEQ ID NO: 2549553 - RNA, 12 nt, Chlamydophila pneumoniae J138
agcaagauggca

SEQ ID NO: 2549554 - RNA, 18 nt, Chlamydophila pneumoniae J138
agcaaggggaguuuucuu

SEQ ID NO: 2549555 - RNA, 17 nt, Chlamydophila pneumoniae J138
agcaagguaacauccau

SEQ ID NO: 2549556 - RNA, 15 nt, Chlamydophila pneumoniae J138
agcaaguagcucucu

SEQ ID NO: 2549557 - RNA, 20 nt, Chlamydophila pneumoniae J138
agcaauaucuauagaaggca

SEQ ID NO: 2549558 - RNA, 22 nt, Chlamydophila pneumoniae J138
agcaaucaguaaacccucagaa

SEQ ID NO: 2549559 - RNA, 21 nt, Chlamydophila pneumoniae J138
agcaaucccccagcauucacu

SEQ ID NO: 2549560 - RNA, 15 nt, Chlamydophila pneumoniae J138
agcaaucgaauagcu

SEQ ID NO: 2549561 - RNA, 18 nt, Chlamydophila pneumoniae J138
agcaaucguguuuuccug

SEQ ID NO: 2549562 - RNA, 21 nt, Chlamydophila pneumoniae J138
agcaaucuguauccgacucug

SEQ ID NO: 2549563 - RNA, 20 nt, Chlamydophila pneumoniae J138
agcaaugccucuaauacguu

SEQ ID NO: 2549564 - RNA, 18 nt, Chlamydophila pneumoniae J138
agcaauucgguagagcua

SEQ ID NO: 2549565 - RNA, 14 nt, Chlamydophila pneumoniae J138
agcacauagagugu

SEQ ID NO: 2549566 - RNA, 14 nt, Chlamydophila pneumoniae J138
agcaccacgaccua

SEQ ID NO: 2549567 - RNA, 18 nt, Chlamydophila pneumoniae J138
agcaccuaauaaagaagg

SEQ ID NO: 2549568 - RNA, 14 nt, Chlamydophila pneumoniae J138
agcacgcacuaauc

SEQ ID NO: 2549569 - RNA, 18 nt, Chlamydophila pneumoniae J138
agcacguagguuguacuu

SEQ ID NO: 2549570 - RNA, 19 nt, Chlamydophila pneumoniae J138
agcacucacgcucucgcua

SEQ ID NO: 2549571 - RNA, 20 nt, Chlamydophila pneumoniae J138
agcacucacgcucucgcuaa

SEQ ID NO: 2549572 - RNA, 20 nt, Chlamydophila pneumoniae J138
agcacuuguuuuuucuucug

SEQ ID NO: 2549573 - RNA, 22 nt, Chlamydophila pneumoniae J138
agcacuuguuuuuucuucuguu

SEQ ID NO: 2549574 - RNA, 13 nt, Chlamydophila pneumoniae J138
agcagaaacucca

SEQ ID NO: 2549575 - RNA, 20 nt, Chlamydophila pneumoniae J138
agcagaaguccuaucaaagc

SEQ ID NO: 2549576 - RNA, 18 nt, Chlamydophila pneumoniae J138
agcagaaucauaaucugc

SEQ ID NO: 2549577 - RNA, 16 nt, Chlamydophila pneumoniae J138
agcagacgaauaacua

SEQ ID NO: 2549578 - RNA, 17 nt, Chlamydophila pneumoniae J138
agcagaguuuuucccuc

SEQ ID NO: 2549579 - RNA, 16 nt, Chlamydophila pneumoniae J138
agcagauagagcuucu

SEQ ID NO: 2549580 - RNA, 13 nt, Chlamydophila pneumoniae J138
agcagcaaaaauu

SEQ ID NO: 2549581 - RNA, 14 nt, Chlamydophila pneumoniae J138
agcagcaagaacau

SEQ ID NO: 2549582 - RNA, 18 nt, Chlamydophila pneumoniae J138
agcagcccgcacaucaug

SEQ ID NO: 2549583 - RNA, 14 nt, Chlamydophila pneumoniae J138
agcagccucuucuc

SEQ ID NO: 2549584 - RNA, 21 nt, Chlamydophila pneumoniae J138
agcaggaaggaauagagaaag

SEQ ID NO: 2549585 - RNA, 22 nt, Chlamydophila pneumoniae J138
agcaggaauaaucaaccaaaau

SEQ ID NO: 2549586 - RNA, 21 nt, Chlamydophila pneumoniae J138
agcaggaguuuucaagucugu

SEQ ID NO: 2549587 - RNA, 23 nt, Chlamydophila pneumoniae J138
agcagggaaaaugcgaucuucac

SEQ ID NO: 2549588 - RNA, 20 nt, Chlamydophila pneumoniae J138
agcaggugugugguaaaaau

SEQ ID NO: 2549589 - RNA, 19 nt, Chlamydophila pneumoniae J138
agcaguauagagaagauuu

SEQ ID NO: 2549590 - RNA, 12 nt, Chlamydophila pneumoniae J138
agcagugugcca

SEQ ID NO: 2549591 - RNA, 13 nt, Chlamydophila pneumoniae J138
agcagugugccaa

SEQ ID NO: 2549592 - RNA, 17 nt, Chlamydophila pneumoniae J138
agcaguugcaauaccaa

SEQ ID NO: 2549593 - RNA, 14 nt, Chlamydophila pneumoniae J138
agcauaaacaaagc

SEQ ID NO: 2549594 - RNA, 19 nt, Chlamydophila pneumoniae J138
agcauaaggauucugagaa

SEQ ID NO: 2549595 - RNA, 15 nt, Chlamydophila pneumoniae J138
agcauaaucuuuaac

SEQ ID NO: 2549596 - RNA, 14 nt, Chlamydophila pneumoniae J138
agcauacuuauauu

SEQ ID NO: 2549597 - RNA, 21 nt, Chlamydophila pneumoniae J138
agcauagagcucuaaaaaaga

SEQ ID NO: 2549598 - RNA, 18 nt, Chlamydophila pneumoniae J138
agcauaggcuaagacuag

SEQ ID NO: 2549599 - RNA, 22 nt, Chlamydophila pneumoniae J138
agcauaguguauaucagcaaaa

SEQ ID NO: 2549600 - RNA, 20 nt, Chlamydophila pneumoniae J138
agcauaguguuccaaaacag

SEQ ID NO: 2549601 - RNA, 18 nt, Chlamydophila pneumoniae J138
agcaucauuaauuccauc

SEQ ID NO: 2549602 - RNA, 17 nt, Chlamydophila pneumoniae J138
agcauccuguagagcaa

SEQ ID NO: 2549603 - RNA, 21 nt, Chlamydophila pneumoniae J138
agcauccuguagagcaagauu

SEQ ID NO: 2549604 - RNA, 14 nt, Chlamydophila pneumoniae J138
agcaucucucucca

SEQ ID NO: 2549605 - RNA, 22 nt, Chlamydophila pneumoniae J138
agcaucugagucauaagcucua

SEQ ID NO: 2549606 - RNA, 13 nt, Chlamydophila pneumoniae J138
agcaugaagcaga

SEQ ID NO: 2549607 - RNA, 15 nt, Chlamydophila pneumoniae J138
agcaugaagcagaaa

SEQ ID NO: 2549608 - RNA, 15 nt, Chlamydophila pneumoniae J138
agcaugaugccauug

SEQ ID NO: 2549609 - RNA, 17 nt, Chlamydophila pneumoniae J138
agcaugcuaagcaucag

SEQ ID NO: 2549610 - RNA, 15 nt, Chlamydophila pneumoniae J138
agcauggacuccaag

SEQ ID NO: 2549611 - RNA, 17 nt, Chlamydophila pneumoniae J138
agcauggacuccaagaa

SEQ ID NO: 2549612 - RNA, 22 nt, Chlamydophila pneumoniae J138
agcauguuauauagacaaugca

SEQ ID NO: 2549613 - RNA, 23 nt, Chlamydophila pneumoniae J138
agcauucccgacucaaucaaauu

SEQ ID NO: 2549614 - RNA, 16 nt, Chlamydophila pneumoniae J138
agcauucugcuagagc

SEQ ID NO: 2549615 - RNA, 22 nt, Chlamydophila pneumoniae J138
agcauugucgaguauaauugac

SEQ ID NO: 2549616 - RNA, 22 nt, Chlamydophila pneumoniae J138
agcauuguuuguccuaggagag

SEQ ID NO: 2549617 - RNA, 21 nt, Chlamydophila pneumoniae J138
agcauuucucuaugagaacgu

SEQ ID NO: 2549618 - RNA, 22 nt, Chlamydophila pneumoniae J138
agcauuuuacgaaucuuuuuca

SEQ ID NO: 2549619 - RNA, 23 nt, Chlamydophila pneumoniae J138
agcauuuuacgaaucuuuuucau

SEQ ID NO: 2549620 - RNA, 13 nt, Chlamydophila pneumoniae J138
agcauuuucucug

SEQ ID NO: 2549621 - RNA, 23 nt, Chlamydophila pneumoniae J138
agcauuuucucugagcagcuucg

SEQ ID NO: 2549622 - RNA, 20 nt, Chlamydophila pneumoniae J138
agccaaaaccaauuucuccg

SEQ ID NO: 2549623 - RNA, 21 nt, Chlamydophila pneumoniae J138
agccaaaaggcacagcaauga

SEQ ID NO: 2549624 - RNA, 23 nt, Chlamydophila pneumoniae J138
agccaagaaaacauaaaguuaua

SEQ ID NO: 2549625 - RNA, 21 nt, Chlamydophila pneumoniae J138
agccaagaagauguagagucg

SEQ ID NO: 2549626 - RNA, 17 nt, Chlamydophila pneumoniae J138
agccacagagaauugca

SEQ ID NO: 2549627 - RNA, 18 nt, Chlamydophila pneumoniae J138
agccacauucuucugaua

SEQ ID NO: 2549628 - RNA, 15 nt, Chlamydophila pneumoniae J138
agccaccaucuguug

SEQ ID NO: 2549629 - RNA, 17 nt, Chlamydophila pneumoniae J138
agccagcagaaggcugc

SEQ ID NO: 2549630 - RNA, 23 nt, Chlamydophila pneumoniae J138
agccaguacuaaauuaguaaaug

SEQ ID NO: 2549631 - RNA, 16 nt, Chlamydophila pneumoniae J138
agccauagaggaauga

SEQ ID NO: 2549632 - RNA, 15 nt, Chlamydophila pneumoniae J138
agccaucauagcaaa

SEQ ID NO: 2549633 - RNA, 18 nt, Chlamydophila pneumoniae J138
agccaucgcgaagcuuuc

SEQ ID NO: 2549634 - RNA, 23 nt, Chlamydophila pneumoniae J138
agccaucgguucggucucuucuc

SEQ ID NO: 2549635 - RNA, 14 nt, Chlamydophila pneumoniae J138
agccauuuuccagg

SEQ ID NO: 2549636 - RNA, 12 nt, Chlamydophila pneumoniae J138
agccauuuucua

SEQ ID NO: 2549637 - RNA, 20 nt, Chlamydophila pneumoniae J138
agccauuuucuaagagaucu

SEQ ID NO: 2549638 - RNA, 14 nt, Chlamydophila pneumoniae J138
agcccgaaauucau

SEQ ID NO: 2549639 - RNA, 18 nt, Chlamydophila pneumoniae J138
agcccuaauucauauuua

SEQ ID NO: 2549640 - RNA, 16 nt, Chlamydophila pneumoniae J138
agcccuacgaauccaa

SEQ ID NO: 2549641 - RNA, 16 nt, Chlamydophila pneumoniae J138
agcucgagaucuuuuu

SEQ ID NO: 2549642 - RNA, 21 nt, Chlamydophila pneumoniae J138
agcucgaggucuuuucuuuuu

SEQ ID NO: 2549643 - RNA, 22 nt, Chlamydophila pneumoniae J138
agcucggauggacuacugaaac

SEQ ID NO: 2549644 - RNA, 18 nt, Chlamydophila pneumoniae J138
agcucuaaaaaagauaaa

SEQ ID NO: 2549645 - RNA, 23 nt, Chlamydophila pneumoniae J138
agcucuaaaaaagauaaagcuac

SEQ ID NO: 2549646 - RNA, 17 nt, Chlamydophila pneumoniae J138
agcucuaaguccaacau

SEQ ID NO: 2549647 - RNA, 18 nt, Chlamydophila pneumoniae J138
agcucuagggguuucccu

SEQ ID NO: 2549648 - RNA, 15 nt, Chlamydophila pneumoniae J138
agcucuauuucugcc

SEQ ID NO: 2549649 - RNA, 15 nt, Chlamydophila pneumoniae J138
agcucucgacgaaca

SEQ ID NO: 2549650 - RNA, 18 nt, Chlamydophila pneumoniae J138
agcucuggauugaaagag

SEQ ID NO: 2549651 - RNA, 16 nt, Chlamydophila pneumoniae J138
agcucuugagaaagcu

SEQ ID NO: 2549652 - RNA, 15 nt, Chlamydophila pneumoniae J138
agcucuuucauaaga

SEQ ID NO: 2549653 - RNA, 20 nt, Chlamydophila pneumoniae J138
agcucuuugggauaaaaagu

SEQ ID NO: 2549654 - RNA, 16 nt, Chlamydophila pneumoniae J138
agcugaaaucauggaa

SEQ ID NO: 2549655 - RNA, 14 nt, Chlamydophila pneumoniae J138
agcugaauccaggu

SEQ ID NO: 2549656 - RNA, 19 nt, Chlamydophila pneumoniae J138
agcugacaacaaaugugac

SEQ ID NO: 2549657 - RNA, 15 nt, Chlamydophila pneumoniae J138
agcugacuccuugua

SEQ ID NO: 2549658 - RNA, 23 nt, Chlamydophila pneumoniae J138
agcugagguagcaucucucucca

SEQ ID NO: 2549659 - RNA, 15 nt, Chlamydophila pneumoniae J138
agcugcaaucucaaa

SEQ ID NO: 2549660 - RNA, 19 nt, Chlamydophila pneumoniae J138
agcugcaaucucaaaauca

SEQ ID NO: 2549661 - RNA, 18 nt, Chlamydophila pneumoniae J138
agcugccagugacauaau

SEQ ID NO: 2549662 - RNA, 15 nt, Chlamydophila pneumoniae J138
agcugcgucaauaag

SEQ ID NO: 2549663 - RNA, 19 nt, Chlamydophila pneumoniae J138
agcugcucuuuuagaaugu

SEQ ID NO: 2549664 - RNA, 18 nt, Chlamydophila pneumoniae J138
agcugcugagcagcaaaa

SEQ ID NO: 2549665 - RNA, 20 nt, Chlamydophila pneumoniae J138
agcugcugguccuaaaaaaa

SEQ ID NO: 2549666 - RNA, 16 nt, Chlamydophila pneumoniae J138
agcugcuuuuucuacu

SEQ ID NO: 2549667 - RNA, 15 nt, Chlamydophila pneumoniae J138
agcuggaucuucuga

SEQ ID NO: 2549668 - RNA, 13 nt, Chlamydophila pneumoniae J138
agcuggcaaugau

SEQ ID NO: 2549669 - RNA, 20 nt, Chlamydophila pneumoniae J138
agcuggggauggucuucccc

SEQ ID NO: 2549670 - RNA, 22 nt, Chlamydophila pneumoniae J138
agcuguaaccaacaucaaagaa

SEQ ID NO: 2549671 - RNA, 16 nt, Chlamydophila pneumoniae J138
agcuguacagaacaau

SEQ ID NO: 2549672 - RNA, 21 nt, Chlamydophila pneumoniae J138
agcuguagugauacuuuagaa

SEQ ID NO: 2549673 - RNA, 14 nt, Chlamydophila pneumoniae J138
agcugucaauccaa

SEQ ID NO: 2549674 - RNA, 15 nt, Chlamydophila pneumoniae J138
agcuguccagucuau

SEQ ID NO: 2549675 - RNA, 12 nt, Chlamydophila pneumoniae J138
agcugugcauuu

SEQ ID NO: 2549676 - RNA, 18 nt, Chlamydophila pneumoniae J138
agcuguggcgauuuuacu

SEQ ID NO: 2549677 - RNA, 13 nt, Chlamydophila pneumoniae J138
agcuguuguucug

SEQ ID NO: 2549678 - RNA, 16 nt, Chlamydophila pneumoniae J138
agcuguuucucuguau

SEQ ID NO: 2549679 - RNA, 14 nt, Chlamydophila pneumoniae J138
agcuuacuuagaac

SEQ ID NO: 2549680 - RNA, 22 nt, Chlamydophila pneumoniae J138
agcuucaaaggcaaccucugca

SEQ ID NO: 2549681 - RNA, 12 nt, Chlamydophila pneumoniae J138
agcuucaucaaa

SEQ ID NO: 2549682 - RNA, 20 nt, Chlamydophila pneumoniae J138
agcuucaucagaagguaaau

SEQ ID NO: 2549683 - RNA, 16 nt, Chlamydophila pneumoniae J138
agcuucccaauuguau

SEQ ID NO: 2549684 - RNA, 23 nt, Chlamydophila pneumoniae J138
agcuuccggcuuguaggaucuga

SEQ ID NO: 2549685 - RNA, 15 nt, Chlamydophila pneumoniae J138
agcuuccugcuccuc

SEQ ID NO: 2549686 - RNA, 17 nt, Chlamydophila pneumoniae J138
agcuuccugcuccucuu

SEQ ID NO: 2549687 - RNA, 20 nt, Chlamydophila pneumoniae J138
agcuucggggaagcguagca

SEQ ID NO: 2549688 - RNA, 12 nt, Chlamydophila pneumoniae J138
agcuucuaaaaa

SEQ ID NO: 2549689 - RNA, 13 nt, Chlamydophila pneumoniae J138
agcuucuaaaaac

SEQ ID NO: 2549690 - RNA, 13 nt, Chlamydophila pneumoniae J138
agcuucuugaugu

SEQ ID NO: 2549691 - RNA, 19 nt, Chlamydophila pneumoniae J138
agcuucuuuaucuagcucu

SEQ ID NO: 2549692 - RNA, 17 nt, Chlamydophila pneumoniae J138
agcuucuuucuaggccg

SEQ ID NO: 2549693 - RNA, 19 nt, Chlamydophila pneumoniae J138
agcuucuuucuuacuaaag

SEQ ID NO: 2549694 - RNA, 22 nt, Chlamydophila pneumoniae J138
agcuucuuuuccagcaaagcga

SEQ ID NO: 2549695 - RNA, 22 nt, Chlamydophila pneumoniae J138
agcuugcccuucguaacgcuuu

SEQ ID NO: 2549696 - RNA, 13 nt, Chlamydophila pneumoniae J138
agcuugguuuucu

SEQ ID NO: 2549697 - RNA, 19 nt, Chlamydophila pneumoniae J138
agcuugguuuucuccuucu

SEQ ID NO: 2549698 - RNA, 20 nt, Chlamydophila pneumoniae J138
agcuuguuuuugcaaggcaa

SEQ ID NO: 2549699 - RNA, 17 nt, Chlamydophila pneumoniae J138
agcuuuaacaugccaaa

SEQ ID NO: 2549700 - RNA, 18 nt, Chlamydophila pneumoniae J138
agcuuuaacaugccaaaa

SEQ ID NO: 2549701 - RNA, 15 nt, Chlamydophila pneumoniae J138
agcuuuaagaagaag

SEQ ID NO: 2549702 - RNA, 12 nt, Chlamydophila pneumoniae J138
agcuuuaaucag

SEQ ID NO: 2549703 - RNA, 18 nt, Chlamydophila pneumoniae J138
agcuuuauugauagcuga

SEQ ID NO: 2549704 - RNA, 17 nt, Chlamydophila pneumoniae J138
agcuuucguuuucuagc

SEQ ID NO: 2549705 - RNA, 21 nt, Chlamydophila pneumoniae J138
agcuuucuuggagaagaggua

SEQ ID NO: 2549706 - RNA, 23 nt, Chlamydophila pneumoniae J138
agcuuugcuuaaaaagucugaau

SEQ ID NO: 2549707 - RNA, 18 nt, Chlamydophila pneumoniae J138
agcuuuggcgucugcccu

SEQ ID NO: 2549708 - RNA, 22 nt, Chlamydophila pneumoniae J138
agcuuuggcgucugcccuuucu

SEQ ID NO: 2549709 - RNA, 23 nt, Chlamydophila pneumoniae J138
agcuuuuccguaaguaaccaaua

SEQ ID NO: 2549710 - RNA, 16 nt, Chlamydophila pneumoniae J138
agcuuuucguauagag

SEQ ID NO: 2549711 - RNA, 13 nt, Chlamydophila pneumoniae J138
agcuuuugugaua

SEQ ID NO: 2549712 - RNA, 18 nt, Chlamydophila pneumoniae J138
agcuuuuugcuuuucccu

SEQ ID NO: 2549713 - RNA, 12 nt, Chlamydophila pneumoniae J138
agcuuuuuucuc

SEQ ID NO: 2549714 - RNA, 14 nt, Chlamydophila pneumoniae J138
agcuuuuuucucuu

SEQ ID NO: 2549715 - RNA, 22 nt, Chlamydophila pneumoniae J138
agcuuuuuucucuugcuucaga

SEQ ID NO: 2549716 - RNA, 14 nt, Chlamydophila pneumoniae J138
aggaaaagcaaaau

SEQ ID NO: 2549717 - RNA, 16 nt, Chlamydophila pneumoniae J138
aggaaaauucuuaaaa

SEQ ID NO: 2549718 - RNA, 21 nt, Chlamydophila pneumoniae J138
aggaaacgauuucuucuucua

SEQ ID NO: 2549719 - RNA, 21 nt, Chlamydophila pneumoniae J138
aggaaaguugcaacucucuuu

SEQ ID NO: 2549720 - RNA, 21 nt, Chlamydophila pneumoniae J138
aggaaauaccacagcuguaca

SEQ ID NO: 2549721 - RNA, 22 nt, Chlamydophila pneumoniae J138
aggaaaucccgagauaugaaga

SEQ ID NO: 2549722 - RNA, 18 nt, Chlamydophila pneumoniae J138
aggaaaucgcauuacaaa

SEQ ID NO: 2549723 - RNA, 14 nt, Chlamydophila pneumoniae J138
aggaacaaagccaa

SEQ ID NO: 2549724 - RNA, 20 nt, Chlamydophila pneumoniae J138
aggaacaaagcucuccuuca

SEQ ID NO: 2549725 - RNA, 14 nt, Chlamydophila pneumoniae J138
aggaacaauguaaa

SEQ ID NO: 2549726 - RNA, 15 nt, Chlamydophila pneumoniae J138
aggaacuugaauacc

SEQ ID NO: 2549727 - RNA, 19 nt, Chlamydophila pneumoniae J138
aggaagaucuugaacagag

SEQ ID NO: 2549728 - RNA, 22 nt, Chlamydophila pneumoniae J138
aggaagaugaauaccagaagca

SEQ ID NO: 2549729 - RNA, 14 nt, Chlamydophila pneumoniae J138
aggaagccugcggc

SEQ ID NO: 2549730 - RNA, 14 nt, Chlamydophila pneumoniae J138
aggaagcucuucua

SEQ ID NO: 2549731 - RNA, 14 nt, Chlamydophila pneumoniae J138
aggaaggaauagag

SEQ ID NO: 2549732 - RNA, 15 nt, Chlamydophila pneumoniae J138
aggaaggaauagaga

SEQ ID NO: 2549733 - RNA, 18 nt, Chlamydophila pneumoniae J138
aggaagguucucaaagcu

SEQ ID NO: 2549734 - RNA, 19 nt, Chlamydophila pneumoniae J138
aggaagguucucaaagcua

SEQ ID NO: 2549735 - RNA, 21 nt, Chlamydophila pneumoniae J138
aggaaguccgauagcaaugau

SEQ ID NO: 2549736 - RNA, 19 nt, Chlamydophila pneumoniae J138
aggaauaacaccaaaagaa

SEQ ID NO: 2549737 - RNA, 21 nt, Chlamydophila pneumoniae J138
aggaauaacaccaaaagaaua

SEQ ID NO: 2549738 - RNA, 19 nt, Chlamydophila pneumoniae J138
aggaauaaucaaccaaaau

SEQ ID NO: 2549739 - RNA, 14 nt, Chlamydophila pneumoniae J138
aggaauagaaagac

SEQ ID NO: 2549740 - RNA, 15 nt, Chlamydophila pneumoniae J138
aggaauagagaaaga

SEQ ID NO: 2549741 - RNA, 17 nt, Chlamydophila pneumoniae J138
aggaauagagaaagagu

SEQ ID NO: 2549742 - RNA, 11 nt, Chlamydophila pneumoniae J138
aggaaucacug

SEQ ID NO: 2549743 - RNA, 21 nt, Chlamydophila pneumoniae J138
aggaaucauaaccaaaagaau

SEQ ID NO: 2549744 - RNA, 20 nt, Chlamydophila pneumoniae J138
aggaaucuugaugaccucua

SEQ ID NO: 2549745 - RNA, 14 nt, Chlamydophila pneumoniae J138
aggaaugaagagag

SEQ ID NO: 2549746 - RNA, 14 nt, Chlamydophila pneumoniae J138
aggaauuaaaauau

SEQ ID NO: 2549747 - RNA, 16 nt, Chlamydophila pneumoniae J138
aggaauuccucucaca

SEQ ID NO: 2549748 - RNA, 20 nt, Chlamydophila pneumoniae J138
aggaauucuuuaugagagag

SEQ ID NO: 2549749 - RNA, 21 nt, Chlamydophila pneumoniae J138
aggacaaucaacauucuucug

SEQ ID NO: 2549750 - RNA, 16 nt, Chlamydophila pneumoniae J138
aggaccacaauuccua

SEQ ID NO: 2549751 - RNA, 17 nt, Chlamydophila pneumoniae J138
aggaccacaauuccuaa

SEQ ID NO: 2549752 - RNA, 16 nt, Chlamydophila pneumoniae J138
aggaccuguaguaaaa

SEQ ID NO: 2549753 - RNA, 16 nt, Chlamydophila pneumoniae J138
aggacguaaaaagaaa

SEQ ID NO: 2549754 - RNA, 14 nt, Chlamydophila pneumoniae J138
aggacucuuucuau

SEQ ID NO: 2549755 - RNA, 22 nt, Chlamydophila pneumoniae J138
aggacuguuuguuuauuaucua

SEQ ID NO: 2549756 - RNA, 23 nt, Chlamydophila pneumoniae J138
aggacuguuuguuuauuaucuac

SEQ ID NO: 2549757 - RNA, 22 nt, Chlamydophila pneumoniae J138
aggagaacaauaucagcagcuu

SEQ ID NO: 2549758 - RNA, 19 nt, Chlamydophila pneumoniae J138
aggagaauacaaacaagaa

SEQ ID NO: 2549759 - RNA, 17 nt, Chlamydophila pneumoniae J138
aggagacuaaaagaaua

SEQ ID NO: 2549760 - RNA, 21 nt, Chlamydophila pneumoniae J138
aggagacucuaguuuuucuuu

SEQ ID NO: 2549761 - RNA, 16 nt, Chlamydophila pneumoniae J138
aggagagaauccuuuu

SEQ ID NO: 2549762 - RNA, 12 nt, Chlamydophila pneumoniae J138
aggagagagaag

SEQ ID NO: 2549763 - RNA, 20 nt, Chlamydophila pneumoniae J138
aggagagcuucuucuguaaa

SEQ ID NO: 2549764 - RNA, 21 nt, Chlamydophila pneumoniae J138
aggagagcuugguuuucuccu

SEQ ID NO: 2549765 - RNA, 22 nt, Chlamydophila pneumoniae J138
aggagagcuugguuuucuccuu

SEQ ID NO: 2549766 - RNA, 21 nt, Chlamydophila pneumoniae J138
aggagauaaagauguagaaua

SEQ ID NO: 2549767 - RNA, 20 nt, Chlamydophila pneumoniae J138
aggagcaucauuaauuccau

SEQ ID NO: 2549768 - RNA, 16 nt, Chlamydophila pneumoniae J138
aggagccuccauaaug

SEQ ID NO: 2549769 - RNA, 16 nt, Chlamydophila pneumoniae J138
aggagcuccuccuuga

SEQ ID NO: 2549770 - RNA, 10 nt, Chlamydophila pneumoniae J138
aggaggagca

SEQ ID NO: 2549771 - RNA, 16 nt, Chlamydophila pneumoniae J138
aggaggauuuccuagg

SEQ ID NO: 2549772 - RNA, 13 nt, Chlamydophila pneumoniae J138
aggagguggugga

SEQ ID NO: 2549773 - RNA, 23 nt, Chlamydophila pneumoniae J138
aggaguccccuggcguucaggau

SEQ ID NO: 2549774 - RNA, 23 nt, Chlamydophila pneumoniae J138
aggagucgugcaggagaacaaua

SEQ ID NO: 2549775 - RNA, 18 nt, Chlamydophila pneumoniae J138
aggaguuuucaagucugu

SEQ ID NO: 2549776 - RNA, 12 nt, Chlamydophila pneumoniae J138
aggaguuuucca

SEQ ID NO: 2549777 - RNA, 18 nt, Chlamydophila pneumoniae J138
aggauaaguucuuccaaa

SEQ ID NO: 2549778 - RNA, 16 nt, Chlamydophila pneumoniae J138
aggauacgaauaaguu

SEQ ID NO: 2549779 - RNA, 20 nt, Chlamydophila pneumoniae J138
aggauagaccccccauucca

SEQ ID NO: 2549780 - RNA, 21 nt, Chlamydophila pneumoniae J138
aggauagcaauucgguagagc

SEQ ID NO: 2549781 - RNA, 22 nt, Chlamydophila pneumoniae J138
aggauagcaauucgguagagcu

SEQ ID NO: 2549782 - RNA, 19 nt, Chlamydophila pneumoniae J138
aggauagugacuccugguu

SEQ ID NO: 2549783 - RNA, 15 nt, Chlamydophila pneumoniae J138
aggauaucauauuuu

SEQ ID NO: 2549784 - RNA, 22 nt, Chlamydophila pneumoniae J138
aggaucauaccgacaagcauca

SEQ ID NO: 2549785 - RNA, 22 nt, Chlamydophila pneumoniae J138
aggaucccugauuccuuggcau

SEQ ID NO: 2549786 - RNA, 15 nt, Chlamydophila pneumoniae J138
aggaucugguugagg

SEQ ID NO: 2549787 - RNA, 14 nt, Chlamydophila pneumoniae J138
aggaucuucuauuu

SEQ ID NO: 2549788 - RNA, 20 nt, Chlamydophila pneumoniae J138
aggaucuuuggguucuucca

SEQ ID NO: 2549789 - RNA, 23 nt, Chlamydophila pneumoniae J138
aggaugacacucacuauccggaa

SEQ ID NO: 2549790 - RNA, 16 nt, Chlamydophila pneumoniae J138
aggaugcuuagcaaag

SEQ ID NO: 2549791 - RNA, 16 nt, Chlamydophila pneumoniae J138
aggauggaaucaggga

SEQ ID NO: 2549792 - RNA, 17 nt, Chlamydophila pneumoniae J138
aggaugucgcuuuugcu

SEQ ID NO: 2549793 - RNA, 14 nt, Chlamydophila pneumoniae J138
aggauguuccuugu

SEQ ID NO: 2549794 - RNA, 17 nt, Chlamydophila pneumoniae J138
aggauguuguggaucag

SEQ ID NO: 2549795 - RNA, 14 nt, Chlamydophila pneumoniae J138
aggauuaguaacua

SEQ ID NO: 2549796 - RNA, 12 nt, Chlamydophila pneumoniae J138
aggauuccuuga

SEQ ID NO: 2549797 - RNA, 16 nt, Chlamydophila pneumoniae J138
aggauuccuugacuau

SEQ ID NO: 2549798 - RNA, 18 nt, Chlamydophila pneumoniae J138
aggauucuauaacuacaa

SEQ ID NO: 2549799 - RNA, 13 nt, Chlamydophila pneumoniae J138
aggauucucucug

SEQ ID NO: 2549800 - RNA, 14 nt, Chlamydophila pneumoniae J138
aggauugauaaaua

SEQ ID NO: 2549801 - RNA, 17 nt, Chlamydophila pneumoniae J138
aggauugcacucaucuu

SEQ ID NO: 2549802 - RNA, 13 nt, Chlamydophila pneumoniae J138
aggauuuagacua

SEQ ID NO: 2549803 - RNA, 21 nt, Chlamydophila pneumoniae J138
aggauuucuugcaaggagcuu

SEQ ID NO: 2549804 - RNA, 17 nt, Chlamydophila pneumoniae J138
aggauuuuccauuaggg

SEQ ID NO: 2549805 - RNA, 12 nt, Chlamydophila pneumoniae J138
aggcaaagauca

SEQ ID NO: 2549806 - RNA, 16 nt, Chlamydophila pneumoniae J138
aggcaaagaucaguuu

SEQ ID NO: 2549807 - RNA, 14 nt, Chlamydophila pneumoniae J138
aggcaaagauuucc

SEQ ID NO: 2549808 - RNA, 19 nt, Chlamydophila pneumoniae J138
aggcaacgcgauuuucaac

SEQ ID NO: 2549809 - RNA, 16 nt, Chlamydophila pneumoniae J138
aggcaaggagagcuuc

SEQ ID NO: 2549810 - RNA, 17 nt, Chlamydophila pneumoniae J138
aggcaaggagagcuucu

SEQ ID NO: 2549811 - RNA, 18 nt, Chlamydophila pneumoniae J138
aggcaauuuuuauaauau

SEQ ID NO: 2549812 - RNA, 19 nt, Chlamydophila pneumoniae J138
aggcaauuuuuauaauauu

SEQ ID NO: 2549813 - RNA, 18 nt, Chlamydophila pneumoniae J138
aggcacuccaaaacucaa

SEQ ID NO: 2549814 - RNA, 21 nt, Chlamydophila pneumoniae J138
aggcagauagacaaccuagaa

SEQ ID NO: 2549815 - RNA, 20 nt, Chlamydophila pneumoniae J138
aggcaggccacuuccuauaa

SEQ ID NO: 2549816 - RNA, 16 nt, Chlamydophila pneumoniae J138
aggcauaacugugcuc

SEQ ID NO: 2549817 - RNA, 15 nt, Chlamydophila pneumoniae J138
aggcauaaucuccaa

SEQ ID NO: 2549818 - RNA, 19 nt, Chlamydophila pneumoniae J138
aggcauacaguagaaacau

SEQ ID NO: 2549819 - RNA, 13 nt, Chlamydophila pneumoniae J138
aggcaucacuaau

SEQ ID NO: 2549820 - RNA, 15 nt, Chlamydophila pneumoniae J138
aggcaucuagagucu

SEQ ID NO: 2549821 - RNA, 20 nt, Chlamydophila pneumoniae J138
aggcaucuagagucucuuuc

SEQ ID NO: 2549822 - RNA, 17 nt, Chlamydophila pneumoniae J138
aggcauggcacaguccu

SEQ ID NO: 2549823 - RNA, 19 nt, Chlamydophila pneumoniae J138
aggcauuacacaacucuuu

SEQ ID NO: 2549824 - RNA, 16 nt, Chlamydophila pneumoniae J138
aggcauuggaaaucuu

SEQ ID NO: 2549825 - RNA, 18 nt, Chlamydophila pneumoniae J138
aggccaaagaacagcacu

SEQ ID NO: 2549826 - RNA, 14 nt, Chlamydophila pneumoniae J138
aggccaggagacua

SEQ ID NO: 2549827 - RNA, 17 nt, Chlamydophila pneumoniae J138
aggcccccuacagcaga

SEQ ID NO: 2549828 - RNA, 23 nt, Chlamydophila pneumoniae J138
aggccgggauuuuaauucaaaaa

SEQ ID NO: 2549829 - RNA, 23 nt, Chlamydophila pneumoniae J138
aggccuaaaaucaccauauccau

SEQ ID NO: 2549830 - RNA, 18 nt, Chlamydophila pneumoniae J138
aggcgcauaugcuccaga

SEQ ID NO: 2549831 - RNA, 20 nt, Chlamydophila pneumoniae J138
aggcgcauaugcuccagaaa

SEQ ID NO: 2549832 - RNA, 14 nt, Chlamydophila pneumoniae J138
aggcggaaaggaag

SEQ ID NO: 2549833 - RNA, 21 nt, Chlamydophila pneumoniae J138
aggcuaaaaccuagacucugc

SEQ ID NO: 2549834 - RNA, 15 nt, Chlamydophila pneumoniae J138
aggcuacugaagagg

SEQ ID NO: 2549835 - RNA, 21 nt, Chlamydophila pneumoniae J138
aggcuauaauuaacguuucuu

SEQ ID NO: 2549836 - RNA, 14 nt, Chlamydophila pneumoniae J138
aggcuauuguguuu

SEQ ID NO: 2549837 - RNA, 20 nt, Chlamydophila pneumoniae J138
aggcuccucugcuaagcaca

SEQ ID NO: 2549838 - RNA, 22 nt, Chlamydophila pneumoniae J138
aggcucuacaggagaagcggaa

SEQ ID NO: 2549839 - RNA, 14 nt, Chlamydophila pneumoniae J138
aggcucuuuuagag

SEQ ID NO: 2549840 - RNA, 16 nt, Chlamydophila pneumoniae J138
aggcugcacacauccu

SEQ ID NO: 2549841 - RNA, 13 nt, Chlamydophila pneumoniae J138
aguaaggagagac

SEQ ID NO: 2549842 - RNA, 13 nt, Chlamydophila pneumoniae J138
aguaagucuucga

SEQ ID NO: 2549843 - RNA, 17 nt, Chlamydophila pneumoniae J138
aguaaucacuucagcac

SEQ ID NO: 2549844 - RNA, 16 nt, Chlamydophila pneumoniae J138
aguaauccuaauuccu

SEQ ID NO: 2549845 - RNA, 23 nt, Chlamydophila pneumoniae J138
aguaaucuggaagcaaucuguau

SEQ ID NO: 2549846 - RNA, 13 nt, Chlamydophila pneumoniae J138
aguaauuucuccg

SEQ ID NO: 2549847 - RNA, 21 nt, Chlamydophila pneumoniae J138
aguacagauuucagauaaucu

SEQ ID NO: 2549848 - RNA, 15 nt, Chlamydophila pneumoniae J138
aguacaggcuccauc

SEQ ID NO: 2549849 - RNA, 18 nt, Chlamydophila pneumoniae J138
aguacauuaucacagcaa

SEQ ID NO: 2549850 - RNA, 21 nt, Chlamydophila pneumoniae J138
aguacauuaucacagcaaucu

SEQ ID NO: 2549851 - RNA, 14 nt, Chlamydophila pneumoniae J138
aguaccaagaaaau

SEQ ID NO: 2549852 - RNA, 18 nt, Chlamydophila pneumoniae J138
aguaccaagaaaauagua

SEQ ID NO: 2549853 - RNA, 18 nt, Chlamydophila pneumoniae J138
aguaccuaggaucuacau

SEQ ID NO: 2549854 - RNA, 23 nt, Chlamydophila pneumoniae J138
aguacgaccaacuccucaaaaga

SEQ ID NO: 2549855 - RNA, 16 nt, Chlamydophila pneumoniae J138
aguacgauccaucuca

SEQ ID NO: 2549856 - RNA, 17 nt, Chlamydophila pneumoniae J138
aguacgcaaaguacuaa

SEQ ID NO: 2549857 - RNA, 17 nt, Chlamydophila pneumoniae J138
aguacgugaucucacga

SEQ ID NO: 2549858 - RNA, 15 nt, Chlamydophila pneumoniae J138
aguacuacaauaacc

SEQ ID NO: 2549859 - RNA, 21 nt, Chlamydophila pneumoniae J138
aguacuucuuacccuaauuug

SEQ ID NO: 2549860 - RNA, 19 nt, Chlamydophila pneumoniae J138
aguagaauccuucucccuc

SEQ ID NO: 2549861 - RNA, 21 nt, Chlamydophila pneumoniae J138
aguagauuaaaggcauagaua

SEQ ID NO: 2549862 - RNA, 18 nt, Chlamydophila pneumoniae J138
aguagcuauucucaaauu

SEQ ID NO: 2549863 - RNA, 20 nt, Chlamydophila pneumoniae J138
aguagcuugugcuaaagcag

SEQ ID NO: 2549864 - RNA, 13 nt, Chlamydophila pneumoniae J138
aguaggagcagcg

SEQ ID NO: 2549865 - RNA, 18 nt, Chlamydophila pneumoniae J138
aguaggguguauucugaa

SEQ ID NO: 2549866 - RNA, 14 nt, Chlamydophila pneumoniae J138
aguagguaagaagc

SEQ ID NO: 2549867 - RNA, 13 nt, Chlamydophila pneumoniae J138
aguauaagaugcu

SEQ ID NO: 2549868 - RNA, 22 nt, Chlamydophila pneumoniae J138
aguauaauagugagcucccuga

SEQ ID NO: 2549869 - RNA, 20 nt, Chlamydophila pneumoniae J138
aguauagcuuuuaguuuccc

SEQ ID NO: 2549870 - RNA, 23 nt, Chlamydophila pneumoniae J138
aguauccuccuucugcaugaaua

SEQ ID NO: 2549871 - RNA, 17 nt, Chlamydophila pneumoniae J138
aguaucuaaaacuucuu

SEQ ID NO: 2549872 - RNA, 12 nt, Chlamydophila pneumoniae J138
aguaucuagcuu

SEQ ID NO: 2549873 - RNA, 17 nt, Chlamydophila pneumoniae J138
aguaucuagcuuugucu

SEQ ID NO: 2549874 - RNA, 15 nt, Chlamydophila pneumoniae J138
aguauuaaucuuauu

SEQ ID NO: 2549875 - RNA, 20 nt, Chlamydophila pneumoniae J138
aguauucccuccgcaguugu

SEQ ID NO: 2549876 - RNA, 22 nt, Chlamydophila pneumoniae J138
aguauucuguggaauaucagga

SEQ ID NO: 2549877 - RNA, 16 nt, Chlamydophila pneumoniae J138
agucaaaaauucuucg

SEQ ID NO: 2549878 - RNA, 11 nt, Chlamydophila pneumoniae J138
agucaaagggc

SEQ ID NO: 2549879 - RNA, 15 nt, Chlamydophila pneumoniae J138
agucacacuuuccgu

SEQ ID NO: 2549880 - RNA, 22 nt, Chlamydophila pneumoniae J138
agucacuaaagauacuuaucuu

SEQ ID NO: 2549881 - RNA, 19 nt, Chlamydophila pneumoniae J138
agucacuuucagccuguaa

SEQ ID NO: 2549882 - RNA, 16 nt, Chlamydophila pneumoniae J138
agucagccaagacaaa

SEQ ID NO: 2549883 - RNA, 18 nt, Chlamydophila pneumoniae J138
agucagccaagacaaaaa

SEQ ID NO: 2549884 - RNA, 18 nt, Chlamydophila pneumoniae J138
agucauacauuugauuca

SEQ ID NO: 2549885 - RNA, 22 nt, Chlamydophila pneumoniae J138
agucaugauuuuucaaucaaua

SEQ ID NO: 2549886 - RNA, 16 nt, Chlamydophila pneumoniae J138
agucauuagcaagagc

SEQ ID NO: 2549887 - RNA, 16 nt, Chlamydophila pneumoniae J138
agucauuaucacagau

SEQ ID NO: 2549888 - RNA, 14 nt, Chlamydophila pneumoniae J138
aguccaagaucaaa

SEQ ID NO: 2549889 - RNA, 13 nt, Chlamydophila pneumoniae J138
aguccaagguucu

SEQ ID NO: 2549890 - RNA, 15 nt, Chlamydophila pneumoniae J138
aguccagacuuuccu

SEQ ID NO: 2549891 - RNA, 23 nt, Chlamydophila pneumoniae J138
aguccaucggggcggacuauguu

SEQ ID NO: 2549892 - RNA, 18 nt, Chlamydophila pneumoniae J138
aguccaugaaucugguuc

SEQ ID NO: 2549893 - RNA, 16 nt, Chlamydophila pneumoniae J138
aguccauguacagaaa

SEQ ID NO: 2549894 - RNA, 18 nt, Chlamydophila pneumoniae J138
aguccauguacagaaaau

SEQ ID NO: 2549895 - RNA, 19 nt, Chlamydophila pneumoniae J138
agucccuugcgggagaagu

SEQ ID NO: 2549896 - RNA, 17 nt, Chlamydophila pneumoniae J138
aguccgauagcaaugau

SEQ ID NO: 2549897 - RNA, 23 nt, Chlamydophila pneumoniae J138
aguccgcaugaacgugcaucucu

SEQ ID NO: 2549898 - RNA, 13 nt, Chlamydophila pneumoniae J138
aguccuaaaauuu

SEQ ID NO: 2549899 - RNA, 20 nt, Chlamydophila pneumoniae J138
aguccucucccuuaaggaaa

SEQ ID NO: 2549900 - RNA, 15 nt, Chlamydophila pneumoniae J138
aguccugauuuuuca

SEQ ID NO: 2549901 - RNA, 21 nt, Chlamydophila pneumoniae J138
aguccuggauuuuaaagcaaa

SEQ ID NO: 2549902 - RNA, 16 nt, Chlamydophila pneumoniae J138
aguccugggguucucu

SEQ ID NO: 2549903 - RNA, 18 nt, Chlamydophila pneumoniae J138
aguccuguuugaaaauau

SEQ ID NO: 2549904 - RNA, 20 nt, Chlamydophila pneumoniae J138
aguccuucuagguauuuguu

SEQ ID NO: 2549905 - RNA, 13 nt, Chlamydophila pneumoniae J138
aguccuucuuccc

SEQ ID NO: 2549906 - RNA, 22 nt, Chlamydophila pneumoniae J138
aguccuucuucccagccuugau

SEQ ID NO: 2549907 - RNA, 13 nt, Chlamydophila pneumoniae J138
aguccuucuuuuc

SEQ ID NO: 2549908 - RNA, 14 nt, Chlamydophila pneumoniae J138
aguccuugaauuag

SEQ ID NO: 2549909 - RNA, 17 nt, Chlamydophila pneumoniae J138
aguccuugaauuaguuu

SEQ ID NO: 2549910 - RNA, 23 nt, Chlamydophila pneumoniae J138
aguccuuuuuguucaaagauugc

SEQ ID NO: 2549911 - RNA, 16 nt, Chlamydophila pneumoniae J138
agucgaaucuaaaaac

SEQ ID NO: 2549912 - RNA, 22 nt, Chlamydophila pneumoniae J138
agucgauacccaaagaggggag

SEQ ID NO: 2549913 - RNA, 18 nt, Chlamydophila pneumoniae J138
agucgauuucccagaagg

SEQ ID NO: 2549914 - RNA, 20 nt, Chlamydophila pneumoniae J138
agucguauucagguucugaa

SEQ ID NO: 2549915 - RNA, 15 nt, Chlamydophila pneumoniae J138
agucguuaacaucaa

SEQ ID NO: 2549916 - RNA, 20 nt, Chlamydophila pneumoniae J138
agucguuuagcuauuugaaa

SEQ ID NO: 2549917 - RNA, 13 nt, Chlamydophila pneumoniae J138
agucuauuugaaa

SEQ ID NO: 2549918 - RNA, 12 nt, Chlamydophila pneumoniae J138
agucucauggau

SEQ ID NO: 2549919 - RNA, 18 nt, Chlamydophila pneumoniae J138
agucuccauaauucugca

SEQ ID NO: 2549920 - RNA, 19 nt, Chlamydophila pneumoniae J138
agucuccauaauucugcac

SEQ ID NO: 2549921 - RNA, 18 nt, Chlamydophila pneumoniae J138
agucucuuucagcucaag

SEQ ID NO: 2549922 - RNA, 23 nt, Chlamydophila pneumoniae J138
agucucuuucagcucaaguuggc

SEQ ID NO: 2549923 - RNA, 12 nt, Chlamydophila pneumoniae J138
agucugaacauu

SEQ ID NO: 2549924 - RNA, 15 nt, Chlamydophila pneumoniae J138
agucugauguaggug

SEQ ID NO: 2549925 - RNA, 14 nt, Chlamydophila pneumoniae J138
agucugcagcagau

SEQ ID NO: 2549926 - RNA, 21 nt, Chlamydophila pneumoniae J138
agucugguuuuucuccugacu

SEQ ID NO: 2549927 - RNA, 15 nt, Chlamydophila pneumoniae J138
agucuguuuuggaaa

SEQ ID NO: 2549928 - RNA, 23 nt, Chlamydophila pneumoniae J138
agucuucccucuccuugaagcaa

SEQ ID NO: 2549929 - RNA, 15 nt, Chlamydophila pneumoniae J138
agucuucgacaagga

SEQ ID NO: 2549930 - RNA, 20 nt, Chlamydophila pneumoniae J138
agucuugaguucuuuuguuu

SEQ ID NO: 2549931 - RNA, 18 nt, Chlamydophila pneumoniae J138
agucuugcgccagcaaag

SEQ ID NO: 2549932 - RNA, 21 nt, Chlamydophila pneumoniae J138
agucuugcgccagcaaagauu

SEQ ID NO: 2549933 - RNA, 23 nt, Chlamydophila pneumoniae J138
agucuugcgccagcaaagauuaa

SEQ ID NO: 2549934 - RNA, 16 nt, Chlamydophila pneumoniae J138
agucuuggacguuccu

SEQ ID NO: 2549935 - RNA, 22 nt, Chlamydophila pneumoniae J138
agugaaauuuugcaacaaaagg

SEQ ID NO: 2549936 - RNA, 17 nt, Chlamydophila pneumoniae J138
agugaacacucucuacc

SEQ ID NO: 2549937 - RNA, 20 nt, Chlamydophila pneumoniae J138
agugaacucuucaagagcuu

SEQ ID NO: 2549938 - RNA, 15 nt, Chlamydophila pneumoniae J138
agugaacuuuuguac

SEQ ID NO: 2549939 - RNA, 14 nt, Chlamydophila pneumoniae J138
agugaaugagcuuc

SEQ ID NO: 2549940 - RNA, 17 nt, Chlamydophila pneumoniae J138
agugaccauagcauaga

SEQ ID NO: 2549941 - RNA, 17 nt, Chlamydophila pneumoniae J138
aguuuuaaugagagcau

SEQ ID NO: 2549942 - RNA, 13 nt, Chlamydophila pneumoniae J138
aguuuucaaaaau

SEQ ID NO: 2549943 - RNA, 16 nt, Chlamydophila pneumoniae J138
aguuuucaaacugauu

SEQ ID NO: 2549944 - RNA, 19 nt, Chlamydophila pneumoniae J138
aguuuucauaauccaagaa

SEQ ID NO: 2549945 - RNA, 14 nt, Chlamydophila pneumoniae J138
aguuuuccauccac

SEQ ID NO: 2549946 - RNA, 20 nt, Chlamydophila pneumoniae J138
aguuuucuuaacuccagcga

SEQ ID NO: 2549947 - RNA, 15 nt, Chlamydophila pneumoniae J138
aguuuugaaaucaaa

SEQ ID NO: 2549948 - RNA, 12 nt, Chlamydophila pneumoniae J138
aguuuuuuagag

SEQ ID NO: 2549949 - RNA, 16 nt, Chlamydophila pneumoniae J138
aguuuuuucaauccuu

SEQ ID NO: 2549950 - RNA, 20 nt, Chlamydophila pneumoniae J138
aguuuuuucaauccuuccuu

SEQ ID NO: 2549951 - RNA, 13 nt, Chlamydophila pneumoniae J138
aguuuuuuucuaa

SEQ ID NO: 2549952 - RNA, 16 nt, Chlamydophila pneumoniae J138
auaaaaaguuuuuguu

SEQ ID NO: 2549953 - RNA, 15 nt, Chlamydophila pneumoniae J138
auaaaaauguaauuu

SEQ ID NO: 2549954 - RNA, 16 nt, Chlamydophila pneumoniae J138
auaaaaauuaagaacc

SEQ ID NO: 2549955 - RNA, 16 nt, Chlamydophila pneumoniae J138
auaaaaauucucauaa

SEQ ID NO: 2549956 - RNA, 21 nt, Chlamydophila pneumoniae J138
auaaaaauuuucaggaacuuu

SEQ ID NO: 2549957 - RNA, 14 nt, Chlamydophila pneumoniae J138
auaaaacauaggcu

SEQ ID NO: 2549958 - RNA, 22 nt, Chlamydophila pneumoniae J138
auaaaacgugauugcugcugcu

SEQ ID NO: 2549959 - RNA, 16 nt, Chlamydophila pneumoniae J138
auaaaagaggaagaug

SEQ ID NO: 2549960 - RNA, 16 nt, Chlamydophila pneumoniae J138
auaaaaucaagccaca

SEQ ID NO: 2549961 - RNA, 21 nt, Chlamydophila pneumoniae J138
auaaaaucaagccacagagaa

SEQ ID NO: 2549962 - RNA, 20 nt, Chlamydophila pneumoniae J138
auaaaaucguuuuauuuuag

SEQ ID NO: 2549963 - RNA, 13 nt, Chlamydophila pneumoniae J138
auaaaauggccuc

SEQ ID NO: 2549964 - RNA, 14 nt, Chlamydophila pneumoniae J138
auaaaauuggcuuu

SEQ ID NO: 2549965 - RNA, 24 nt, Chlamydophila pneumoniae J138
auaaacagcgguugccuuucucuu

SEQ ID NO: 2549966 - RNA, 15 nt, Chlamydophila pneumoniae J138
auaaacauacaugcu

SEQ ID NO: 2549967 - RNA, 21 nt, Chlamydophila pneumoniae J138
auaaacauauucuccuuacca

SEQ ID NO: 2549968 - RNA, 11 nt, Chlamydophila pneumoniae J138
auaaagaagaa

SEQ ID NO: 2549969 - RNA, 13 nt, Chlamydophila pneumoniae J138
auaaagaagaaac

SEQ ID NO: 2549970 - RNA, 16 nt, Chlamydophila pneumoniae J138
cuuuccguugaugaca

SEQ ID NO: 2549971 - RNA, 11 nt, Chlamydophila pneumoniae J138
cuuuccucucu

SEQ ID NO: 2549972 - RNA, 14 nt, Chlamydophila pneumoniae J138
cuuuccuuagcauu

SEQ ID NO: 2549973 - RNA, 23 nt, Chlamydophila pneumoniae J138
cuuucuagaaugaugcaagcaga

SEQ ID NO: 2549974 - RNA, 17 nt, Chlamydophila pneumoniae J138
cuuucuaggaucucuag

SEQ ID NO: 2549975 - RNA, 20 nt, Chlamydophila pneumoniae J138
cuuucuauuucgucgucauc

SEQ ID NO: 2549976 - RNA, 22 nt, Chlamydophila pneumoniae J138
cuuucuauuucgucgucauccc

SEQ ID NO: 2549977 - RNA, 19 nt, Chlamydophila pneumoniae J138
cuuucugauuuaaaagguu

SEQ ID NO: 2549978 - RNA, 17 nt, Chlamydophila pneumoniae J138
cuuucuuauuacagaaa

SEQ ID NO: 2549979 - RNA, 21 nt, Chlamydophila pneumoniae J138
cuuucuucuagagcuucaagu

SEQ ID NO: 2549980 - RNA, 12 nt, Chlamydophila pneumoniae J138
cuuucuuuuagc

SEQ ID NO: 2549981 - RNA, 21 nt, Chlamydophila pneumoniae J138
cuuucuuuuuuaaucuagaac

SEQ ID NO: 2549982 - RNA, 23 nt, Chlamydophila pneumoniae J138
cuuugaagcucgaccucuagcuc

SEQ ID NO: 2549983 - RNA, 16 nt, Chlamydophila pneumoniae J138
cuuugaauaaugcauc

SEQ ID NO: 2549984 - RNA, 19 nt, Chlamydophila pneumoniae J138
cuuugaauuuccaaaggaa

SEQ ID NO: 2549985 - RNA, 15 nt, Chlamydophila pneumoniae J138
cuuugacauugaauc

SEQ ID NO: 2549986 - RNA, 17 nt, Chlamydophila pneumoniae J138
cuuugagaucuugaaug

SEQ ID NO: 2549987 - RNA, 19 nt, Chlamydophila pneumoniae J138
cuuugaguaggguguauuc

SEQ ID NO: 2549988 - RNA, 14 nt, Chlamydophila pneumoniae J138
cuuugagucuuuuu

SEQ ID NO: 2549989 - RNA, 16 nt, Chlamydophila pneumoniae J138
cuuugagucuuuuuca

SEQ ID NO: 2549990 - RNA, 17 nt, Chlamydophila pneumoniae J138
cuuugauuuucaggaga

SEQ ID NO: 2549991 - RNA, 13 nt, Chlamydophila pneumoniae J138
cuuugcaugagga

SEQ ID NO: 2549992 - RNA, 16 nt, Chlamydophila pneumoniae J138
cuuugccaacagcugg

SEQ ID NO: 2549993 - RNA, 17 nt, Chlamydophila pneumoniae J138
cuuugccaacagcuggg

SEQ ID NO: 2549994 - RNA, 15 nt, Chlamydophila pneumoniae J138
cuuugccaaggaccu

SEQ ID NO: 2549995 - RNA, 23 nt, Chlamydophila pneumoniae J138
cuuugcgaacgaagacuuguucu

SEQ ID NO: 2549996 - RNA, 19 nt, Chlamydophila pneumoniae J138
cuuugcuggagacaacuau

SEQ ID NO: 2549997 - RNA, 13 nt, Chlamydophila pneumoniae J138
cuuugcuuaaaaa

SEQ ID NO: 2549998 - RNA, 15 nt, Chlamydophila pneumoniae J138
cuuugcuuaaaaagu

SEQ ID NO: 2549999 - RNA, 14 nt, Chlamydophila pneumoniae J138
cuuugcuuauuucc

SEQ ID NO: 2550000 - RNA, 23 nt, Chlamydophila pneumoniae J138
cuuugcuuauuuccccgaacaaa

SEQ ID NO: 2550001 - RNA, 19 nt, Chlamydophila pneumoniae J138
cuuugugaguucuuccuuc

SEQ ID NO: 2550002 - RNA, 18 nt, Chlamydophila pneumoniae J138
cuuuguugggauuuucag

SEQ ID NO: 2550003 - RNA, 18 nt, Chlamydophila pneumoniae J138
cuuuuaaaaacucuuuca

SEQ ID NO: 2550004 - RNA, 22 nt, Chlamydophila pneumoniae J138
cuuuuaaagagcgcguuucaaa

SEQ ID NO: 2550005 - RNA, 14 nt, Chlamydophila pneumoniae J138
cuuuuaagacaaua

SEQ ID NO: 2550006 - RNA, 23 nt, Chlamydophila pneumoniae J138
cuuuuaagacaauauaagcacca

SEQ ID NO: 2550007 - RNA, 16 nt, Chlamydophila pneumoniae J138
cuuuuaauguguucuu

SEQ ID NO: 2550008 - RNA, 19 nt, Chlamydophila pneumoniae J138
cuuuuaauguguucuuauc

SEQ ID NO: 2550009 - RNA, 14 nt, Chlamydophila pneumoniae J138
cuuuuacugaaauu

SEQ ID NO: 2550010 - RNA, 20 nt, Chlamydophila pneumoniae J138
cuuuuacuguacuugcuaug

SEQ ID NO: 2550011 - RNA, 22 nt, Chlamydophila pneumoniae J138
cuuuuagacgugcucucuucuu

SEQ ID NO: 2550012 - RNA, 20 nt, Chlamydophila pneumoniae J138
cuuuuagagccuuuucagau

SEQ ID NO: 2550013 - RNA, 16 nt, Chlamydophila pneumoniae J138
cuuuuauauuaagaau

SEQ ID NO: 2550014 - RNA, 16 nt, Chlamydophila pneumoniae J138
cuuuuaucuguuaaaa

SEQ ID NO: 2550015 - RNA, 15 nt, Chlamydophila pneumoniae J138
cuuuucagauuuuuu

SEQ ID NO: 2550016 - RNA, 23 nt, Chlamydophila pneumoniae J138
cuuuucagcaaacggagagcauu

SEQ ID NO: 2550017 - RNA, 17 nt, Chlamydophila pneumoniae J138
cuuuucauuuuuaggau

SEQ ID NO: 2550018 - RNA, 20 nt, Chlamydophila pneumoniae J138
cuuuuccaaauuccuucaua

SEQ ID NO: 2550019 - RNA, 21 nt, Chlamydophila pneumoniae J138
cuuuuccggggagaacuucaa

SEQ ID NO: 2550020 - RNA, 18 nt, Chlamydophila pneumoniae J138
cuuuuccguuucagaagu

SEQ ID NO: 2550021 - RNA, 15 nt, Chlamydophila pneumoniae J138
cuuuuccugcagcag

SEQ ID NO: 2550022 - RNA, 19 nt, Chlamydophila pneumoniae J138
cuuuuccuucuguagauuu

SEQ ID NO: 2550023 - RNA, 15 nt, Chlamydophila pneumoniae J138
cuuuucgcagauacu

SEQ ID NO: 2550024 - RNA, 15 nt, Chlamydophila pneumoniae J138
cuuuucuacaugcuc

SEQ ID NO: 2550025 - RNA, 19 nt, Chlamydophila pneumoniae J138
cuuuucuacaugcucaaga

SEQ ID NO: 2550026 - RNA, 23 nt, Chlamydophila pneumoniae J138
cuuuucuagaaacugcuccugaa

SEQ ID NO: 2550027 - RNA, 19 nt, Chlamydophila pneumoniae J138
cuuuucuccuucuggaugc

SEQ ID NO: 2550028 - RNA, 14 nt, Chlamydophila pneumoniae J138
cuuuucugaagauu

SEQ ID NO: 2550029 - RNA, 17 nt, Chlamydophila pneumoniae J138
cuuuucugaagauuuuu

SEQ ID NO: 2550030 - RNA, 18 nt, Chlamydophila pneumoniae J138
cuuuucugaagauuuuuu

SEQ ID NO: 2550031 - RNA, 19 nt, Chlamydophila pneumoniae J138
cuuuucugaagauuuuuua

SEQ ID NO: 2550032 - RNA, 15 nt, Chlamydophila pneumoniae J138
cuuuucugcuccuga

SEQ ID NO: 2550033 - RNA, 18 nt, Chlamydophila pneumoniae J138
cuuuucuuccaaagacug

SEQ ID NO: 2550034 - RNA, 21 nt, Chlamydophila pneumoniae J138
cuuuucuuuuuagaauccuga

SEQ ID NO: 2550035 - RNA, 17 nt, Chlamydophila pneumoniae J138
cuuuucuuuuucuaggg

SEQ ID NO: 2550036 - RNA, 18 nt, Chlamydophila pneumoniae J138
cuuuucuuuuucuaggga

SEQ ID NO: 2550037 - RNA, 13 nt, Chlamydophila pneumoniae J138
cuuuugcuacagc

SEQ ID NO: 2550038 - RNA, 11 nt, Chlamydophila pneumoniae J138
cuuuugcuaga

SEQ ID NO: 2550039 - RNA, 14 nt, Chlamydophila pneumoniae J138
cuuuugcugcagca

SEQ ID NO: 2550040 - RNA, 23 nt, Chlamydophila pneumoniae J138
cuuuugcugcagcaaaacuagga

SEQ ID NO: 2550041 - RNA, 14 nt, Chlamydophila pneumoniae J138
cuuuuguagauuag

SEQ ID NO: 2550042 - RNA, 15 nt, Chlamydophila pneumoniae J138
cuuuugugauaccuc

SEQ ID NO: 2550043 - RNA, 18 nt, Chlamydophila pneumoniae J138
cuuuuguuguuuuugcug

SEQ ID NO: 2550044 - RNA, 16 nt, Chlamydophila pneumoniae J138
cuuuuucaauagcagu

SEQ ID NO: 2550045 - RNA, 19 nt, Chlamydophila pneumoniae J138
cuuuuucagcuucuacagc

SEQ ID NO: 2550046 - RNA, 12 nt, Chlamydophila pneumoniae J138
cuuuuuccaaaa

SEQ ID NO: 2550047 - RNA, 11 nt, Chlamydophila pneumoniae J138
cuuuuucuagg

SEQ ID NO: 2550048 - RNA, 20 nt, Chlamydophila pneumoniae J138
cuuuuucuugaaaaauccug

SEQ ID NO: 2550049 - RNA, 20 nt, Chlamydophila pneumoniae J138
cuuuuucuugauuagagaau

SEQ ID NO: 2550050 - RNA, 22 nt, Chlamydophila pneumoniae J138
cuuuuugcauagccuuccuguu

SEQ ID NO: 2550051 - RNA, 15 nt, Chlamydophila pneumoniae J138
cuuuuugccacaacu

SEQ ID NO: 2550052 - RNA, 18 nt, Chlamydophila pneumoniae J138
cuuuuuuuauauaaagau

SEQ ID NO: 2550053 - RNA, 15 nt, Chlamydophila pneumoniae J138
cuuuuuuucuagagu

SEQ ID NO: 2550054 - RNA, 12 nt, Chlamydophila pneumoniae J138
gaaaaaauagau

SEQ ID NO: 2550055 - RNA, 15 nt, Chlamydophila pneumoniae J138
gaaaaaauagauccu

SEQ ID NO: 2550056 - RNA, 11 nt, Chlamydophila pneumoniae J138
gaaaaaauucu

SEQ ID NO: 2550057 - RNA, 16 nt, Chlamydophila pneumoniae J138
gaaaaaccuucuccaa

SEQ ID NO: 2550058 - RNA, 20 nt, Chlamydophila pneumoniae J138
gaaaaagaucuaagucgaau

SEQ ID NO: 2550059 - RNA, 16 nt, Chlamydophila pneumoniae J138
gaaaaagcccauuccu

SEQ ID NO: 2550060 - RNA, 18 nt, Chlamydophila pneumoniae J138
gaaaaagccuuucuuauu

SEQ ID NO: 2550061 - RNA, 19 nt, Chlamydophila pneumoniae J138
gaaaaaguaguuuuaagaa

SEQ ID NO: 2550062 - RNA, 18 nt, Chlamydophila pneumoniae J138
gaaaaaucuacauguaaa

SEQ ID NO: 2550063 - RNA, 23 nt, Chlamydophila pneumoniae J138
gaaaaaucuacauguaaagcaag

SEQ ID NO: 2550064 - RNA, 19 nt, Chlamydophila pneumoniae J138
gaaaaccaugaguuuuuca

SEQ ID NO: 2550065 - RNA, 19 nt, Chlamydophila pneumoniae J138
gaaaacucuuagagucgau

SEQ ID NO: 2550066 - RNA, 11 nt, Chlamydophila pneumoniae J138
gaaaacuucaa

SEQ ID NO: 2550067 - RNA, 13 nt, Chlamydophila pneumoniae J138
gaaaacuucaaaa

SEQ ID NO: 2550068 - RNA, 13 nt, Chlamydophila pneumoniae J138
gaaaagaaagaau

SEQ ID NO: 2550069 - RNA, 14 nt, Chlamydophila pneumoniae J138
gaaaagaaagaaua

SEQ ID NO: 2550070 - RNA, 14 nt, Chlamydophila pneumoniae J138
gaaaagaaccuagg

SEQ ID NO: 2550071 - RNA, 15 nt, Chlamydophila pneumoniae J138
auagaggaaugaucc

SEQ ID NO: 2550072 - RNA, 17 nt, Chlamydophila pneumoniae J138
auagaggaccgaaaaac

SEQ ID NO: 2550073 - RNA, 20 nt, Chlamydophila pneumoniae J138
auagaggagauccuaagaga

SEQ ID NO: 2550074 - RNA, 14 nt, Chlamydophila pneumoniae J138
auagaggucuuuga

SEQ ID NO: 2550075 - RNA, 21 nt, Chlamydophila pneumoniae J138
auagaguagcucaucuagaaa

SEQ ID NO: 2550076 - RNA, 21 nt, Chlamydophila pneumoniae J138
auagaguaucuaaaacuucuu

SEQ ID NO: 2550077 - RNA, 13 nt, Chlamydophila pneumoniae J138
auagagucucuug

SEQ ID NO: 2550078 - RNA, 14 nt, Chlamydophila pneumoniae J138
auagagucucuuga

SEQ ID NO: 2550079 - RNA, 15 nt, Chlamydophila pneumoniae J138
auagauacaaacauc

SEQ ID NO: 2550080 - RNA, 23 nt, Chlamydophila pneumoniae J138
auagauauacgcccaugucuuca

SEQ ID NO: 2550081 - RNA, 13 nt, Chlamydophila pneumoniae J138
auagauaugccuc

SEQ ID NO: 2550082 - RNA, 18 nt, Chlamydophila pneumoniae J138
auagauccaagaaugaau

SEQ ID NO: 2550083 - RNA, 21 nt, Chlamydophila pneumoniae J138
auagauccugaaaguacagaa

SEQ ID NO: 2550084 - RNA, 12 nt, Chlamydophila pneumoniae J138
auagaucucuug

SEQ ID NO: 2550085 - RNA, 16 nt, Chlamydophila pneumoniae J138
auagauucaugaaaug

SEQ ID NO: 2550086 - RNA, 18 nt, Chlamydophila pneumoniae J138
auagcaaacggaacuaaa

SEQ ID NO: 2550087 - RNA, 13 nt, Chlamydophila pneumoniae J138
auagcaaaucaau

SEQ ID NO: 2550088 - RNA, 16 nt, Chlamydophila pneumoniae J138
auagcaagcacuuucg

SEQ ID NO: 2550089 - RNA, 17 nt, Chlamydophila pneumoniae J138
auagcaauggcuuuuuu

SEQ ID NO: 2550090 - RNA, 23 nt, Chlamydophila pneumoniae J138
auagcaggaaggaauagagaaag

SEQ ID NO: 2550091 - RNA, 13 nt, Chlamydophila pneumoniae J138
auagcagucuugc

SEQ ID NO: 2550092 - RNA, 18 nt, Chlamydophila pneumoniae J138
auagcaucccuucuucuu

SEQ ID NO: 2550093 - RNA, 18 nt, Chlamydophila pneumoniae J138
auagcauguucgauuuuc

SEQ ID NO: 2550094 - RNA, 20 nt, Chlamydophila pneumoniae J138
auagcauguucgauuuucuc

SEQ ID NO: 2550095 - RNA, 21 nt, Chlamydophila pneumoniae J138
cugauuucuuuuucagcuucu

SEQ ID NO: 2550096 - RNA, 19 nt, Chlamydophila pneumoniae J138
cugcaaaaaguuucaaucu

SEQ ID NO: 2550097 - RNA, 22 nt, Chlamydophila pneumoniae J138
cugcaaacuccccaguuuucca

SEQ ID NO: 2550098 - RNA, 12 nt, Chlamydophila pneumoniae J138
cugcaaucagug

SEQ ID NO: 2550099 - RNA, 23 nt, Chlamydophila pneumoniae J138
cugcaaucagugcugccaugaca

SEQ ID NO: 2550100 - RNA, 20 nt, Chlamydophila pneumoniae J138
cugcacgaucgcgauaagaa

SEQ ID NO: 2550101 - RNA, 16 nt, Chlamydophila pneumoniae J138
cugcacuuucuuuuuu

SEQ ID NO: 2550102 - RNA, 18 nt, Chlamydophila pneumoniae J138
cugcacuuucuuuuuuaa

SEQ ID NO: 2550103 - RNA, 20 nt, Chlamydophila pneumoniae J138
cugcagcaaaacuaggaaaa

SEQ ID NO: 2550104 - RNA, 19 nt, Chlamydophila pneumoniae J138
cugcagcguuucuagggac

SEQ ID NO: 2550105 - RNA, 19 nt, Chlamydophila pneumoniae J138
cugcaguauuauaaauaga

SEQ ID NO: 2550106 - RNA, 20 nt, Chlamydophila pneumoniae J138
cugcaguauuauaaauagaa

SEQ ID NO: 2550107 - RNA, 13 nt, Chlamydophila pneumoniae J138
cugcaugaauaua

SEQ ID NO: 2550108 - RNA, 18 nt, Chlamydophila pneumoniae J138
cugcauggcuuugugagc

SEQ ID NO: 2550109 - RNA, 21 nt, Chlamydophila pneumoniae J138
cugccagagauucuucacaau

SEQ ID NO: 2550110 - RNA, 23 nt, Chlamydophila pneumoniae J138
cugcccauuuuuggaaaaccaug

SEQ ID NO: 2550111 - RNA, 16 nt, Chlamydophila pneumoniae J138
cugcccccuguuugaa

SEQ ID NO: 2550112 - RNA, 15 nt, Chlamydophila pneumoniae J138
cugcccuuucugcaa

SEQ ID NO: 2550113 - RNA, 15 nt, Chlamydophila pneumoniae J138
cugccuuaugcucau

SEQ ID NO: 2550114 - RNA, 22 nt, Chlamydophila pneumoniae J138
cugcgacacgaauuucuaacuu

SEQ ID NO: 2550115 - RNA, 19 nt, Chlamydophila pneumoniae J138
cugcgacuacaagauagug

SEQ ID NO: 2550116 - RNA, 18 nt, Chlamydophila pneumoniae J138
cugcgauaggaucuucua

SEQ ID NO: 2550117 - RNA, 16 nt, Chlamydophila pneumoniae J138
cugcgcuaucaucauu

SEQ ID NO: 2550118 - RNA, 21 nt, Chlamydophila pneumoniae J138
cugcggccacauuaagcaauc

SEQ ID NO: 2550119 - RNA, 16 nt, Chlamydophila pneumoniae J138
cugcgguagccuggag

SEQ ID NO: 2550120 - RNA, 13 nt, Chlamydophila pneumoniae J138
cugcgucaauaag

SEQ ID NO: 2550121 - RNA, 19 nt, Chlamydophila pneumoniae J138
cugcgucaauaagcuugcc

SEQ ID NO: 2550122 - RNA, 20 nt, Chlamydophila pneumoniae J138
cugcgucaauaagcuugcca

SEQ ID NO: 2550123 - RNA, 17 nt, Chlamydophila pneumoniae J138
cugcgugauuauuuaag

SEQ ID NO: 2550124 - RNA, 15 nt, Chlamydophila pneumoniae J138
cugcguuucuuucug

SEQ ID NO: 2550125 - RNA, 16 nt, Chlamydophila pneumoniae J138
cugcguuucuuucuga

SEQ ID NO: 2550126 - RNA, 15 nt, Chlamydophila pneumoniae J138
cugcuaaacagggaa

SEQ ID NO: 2550127 - RNA, 18 nt, Chlamydophila pneumoniae J138
cugcuaaacuuuuuuuca

SEQ ID NO: 2550128 - RNA, 23 nt, Chlamydophila pneumoniae J138
cugcuagagcuuucagaaaagaa

SEQ ID NO: 2550129 - RNA, 19 nt, Chlamydophila pneumoniae J138
cugcuauacaaccacuucc

SEQ ID NO: 2550130 - RNA, 14 nt, Chlamydophila pneumoniae J138
cugcucaaugacac

SEQ ID NO: 2550131 - RNA, 12 nt, Chlamydophila pneumoniae J138
cugcuccaaaau

SEQ ID NO: 2550132 - RNA, 14 nt, Chlamydophila pneumoniae J138
cugcuccaaaaugg

SEQ ID NO: 2550133 - RNA, 11 nt, Chlamydophila pneumoniae J138
cugcuccugaa

SEQ ID NO: 2550134 - RNA, 13 nt, Chlamydophila pneumoniae J138
cugcugaaaucau

SEQ ID NO: 2550135 - RNA, 16 nt, Chlamydophila pneumoniae J138
cugcugacaucuccaa

SEQ ID NO: 2550136 - RNA, 13 nt, Chlamydophila pneumoniae J138
cugcugaggagag

SEQ ID NO: 2550137 - RNA, 20 nt, Chlamydophila pneumoniae J138
cugcugaggagaguaagguc

SEQ ID NO: 2550138 - RNA, 23 nt, Chlamydophila pneumoniae J138
cugcugaggagaguaaggucauu

SEQ ID NO: 2550139 - RNA, 15 nt, Chlamydophila pneumoniae J138
cugcugauccaaaag

SEQ ID NO: 2550140 - RNA, 16 nt, Chlamydophila pneumoniae J138
cugcugcuaagccaaa

SEQ ID NO: 2550141 - RNA, 14 nt, Chlamydophila pneumoniae J138
cugcugcuuugaca

SEQ ID NO: 2550142 - RNA, 21 nt, Chlamydophila pneumoniae J138
cugcuguguuauggaaaucac

SEQ ID NO: 2550143 - RNA, 22 nt, Chlamydophila pneumoniae J138
cugcuucaaaacauaaccuccu

SEQ ID NO: 2550144 - RNA, 17 nt, Chlamydophila pneumoniae J138
cugcuucuauagagaca

SEQ ID NO: 2550145 - RNA, 12 nt, Chlamydophila pneumoniae J138
cugcuucuccaa

SEQ ID NO: 2550146 - RNA, 15 nt, Chlamydophila pneumoniae J138
cugcuugucuacaga

SEQ ID NO: 2550147 - RNA, 22 nt, Chlamydophila pneumoniae J138
cugcuugugaggcuauagcaua

SEQ ID NO: 2550148 - RNA, 24 nt, Chlamydophila pneumoniae J138
cugcuuugacgacucugccauguc

SEQ ID NO: 2550149 - RNA, 21 nt, Chlamydophila pneumoniae J138
cugcuuuuguuguuuuugcug

SEQ ID NO: 2550150 - RNA, 19 nt, Chlamydophila pneumoniae J138
cugcuuuuuugaucugaag

SEQ ID NO: 2550151 - RNA, 15 nt, Chlamydophila pneumoniae J138
cugcuuuuuuucuag

SEQ ID NO: 2550152 - RNA, 12 nt, Chlamydophila pneumoniae J138
cuggaaagccaa

SEQ ID NO: 2550153 - RNA, 14 nt, Chlamydophila pneumoniae J138
cuggaaagccaagc

SEQ ID NO: 2550154 - RNA, 13 nt, Chlamydophila pneumoniae J138
cuggaauuuccca

SEQ ID NO: 2550155 - RNA, 17 nt, Chlamydophila pneumoniae J138
cuggaggcuguguaaaa

SEQ ID NO: 2550156 - RNA, 20 nt, Chlamydophila pneumoniae J138
cuggagggucgcugauaaaa

SEQ ID NO: 2550157 - RNA, 16 nt, Chlamydophila pneumoniae J138
cuggaguggaggauac

SEQ ID NO: 2550158 - RNA, 17 nt, Chlamydophila pneumoniae J138
cuggauacguuuuuccc

SEQ ID NO: 2550159 - RNA, 16 nt, Chlamydophila pneumoniae J138
cuggauuuuaaagcaa

SEQ ID NO: 2550160 - RNA, 13 nt, Chlamydophila pneumoniae J138
cuggccaucauca

SEQ ID NO: 2550161 - RNA, 14 nt, Chlamydophila pneumoniae J138
cuggcgacuugcca

SEQ ID NO: 2550162 - RNA, 20 nt, Chlamydophila pneumoniae J138
cuggcuaaaggaucauuaaa

SEQ ID NO: 2550163 - RNA, 14 nt, Chlamydophila pneumoniae J138
cuggcugagagaag

SEQ ID NO: 2550164 - RNA, 15 nt, Chlamydophila pneumoniae J138
cugggaaaucuaaac

SEQ ID NO: 2550165 - RNA, 23 nt, Chlamydophila pneumoniae J138
cugggaagaccacgaaauguuaa

SEQ ID NO: 2550166 - RNA, 18 nt, Chlamydophila pneumoniae J138
cugggauguucaaagcca

SEQ ID NO: 2550167 - RNA, 23 nt, Chlamydophila pneumoniae J138
cugggcauaguggcucaguguau

SEQ ID NO: 2550168 - RNA, 15 nt, Chlamydophila pneumoniae J138
cugggcgucuucuuc

SEQ ID NO: 2550169 - RNA, 16 nt, Chlamydophila pneumoniae J138
cugggcgucuucuucg

SEQ ID NO: 2550170 - RNA, 19 nt, Chlamydophila pneumoniae J138
cugggcuuauuauugaaua

SEQ ID NO: 2550171 - RNA, 16 nt, Chlamydophila pneumoniae J138
cuggggcuuccagaaa

SEQ ID NO: 2550172 - RNA, 22 nt, Chlamydophila pneumoniae J138
cugggggacuucaaaugaaauu

SEQ ID NO: 2550173 - RNA, 21 nt, Chlamydophila pneumoniae J138
cuggguaaguccacaagccuc

SEQ ID NO: 2550174 - RNA, 19 nt, Chlamydophila pneumoniae J138
cugguaaaggauauugaua

SEQ ID NO: 2550175 - RNA, 17 nt, Chlamydophila pneumoniae J138
cugguauagacuccuua

SEQ ID NO: 2550176 - RNA, 16 nt, Chlamydophila pneumoniae J138
cuggucucaugaccuu

SEQ ID NO: 2550177 - RNA, 16 nt, Chlamydophila pneumoniae J138
cuggucuccagaagca

SEQ ID NO: 2550178 - RNA, 17 nt, Chlamydophila pneumoniae J138
cuggucuguauuuucuu

SEQ ID NO: 2550179 - RNA, 21 nt, Chlamydophila pneumoniae J138
cugguuaagcaccauaaugga

SEQ ID NO: 2550180 - RNA, 16 nt, Chlamydophila pneumoniae J138
cugguuccuuaaagag

SEQ ID NO: 2550181 - RNA, 18 nt, Chlamydophila pneumoniae J138
cugguuuuucuccugacu

SEQ ID NO: 2550182 - RNA, 15 nt, Chlamydophila pneumoniae J138
cuguaaagaccaaau

SEQ ID NO: 2550183 - RNA, 21 nt, Chlamydophila pneumoniae J138
cuguaaagaccaaauagagag

SEQ ID NO: 2550184 - RNA, 16 nt, Chlamydophila pneumoniae J138
cuguaaauuucauuug

SEQ ID NO: 2550185 - RNA, 21 nt, Chlamydophila pneumoniae J138
cuguaacacccucccucauaa

SEQ ID NO: 2550186 - RNA, 15 nt, Chlamydophila pneumoniae J138
cuguaacacuuccua

SEQ ID NO: 2550187 - RNA, 12 nt, Chlamydophila pneumoniae J138
cuguaagaaaau

SEQ ID NO: 2550188 - RNA, 21 nt, Chlamydophila pneumoniae J138
cuguaauuuuuuucaaaggag

SEQ ID NO: 2550189 - RNA, 13 nt, Chlamydophila pneumoniae J138
cuguacagaacaa

SEQ ID NO: 2550190 - RNA, 21 nt, Chlamydophila pneumoniae J138
cuguaccacauacucuucauc

SEQ ID NO: 2550191 - RNA, 16 nt, Chlamydophila pneumoniae J138
cuguacgguaaaucca

SEQ ID NO: 2550192 - RNA, 14 nt, Chlamydophila pneumoniae J138
cuguacuuccccaa

SEQ ID NO: 2550193 - RNA, 13 nt, Chlamydophila pneumoniae J138
cuguagauuuucc

SEQ ID NO: 2550194 - RNA, 14 nt, Chlamydophila pneumoniae J138
cuguagccuuugau

SEQ ID NO: 2550195 - RNA, 20 nt, Chlamydophila pneumoniae J138
gcaucuuauggaagagagca

SEQ ID NO: 2550196 - RNA, 15 nt, Chlamydophila pneumoniae J138
gcaucuuucaucaau

SEQ ID NO: 2550197 - RNA, 21 nt, Chlamydophila pneumoniae J138
gcaucuuuggcacaauccuca

SEQ ID NO: 2550198 - RNA, 16 nt, Chlamydophila pneumoniae J138
gcaucuuuucaaaaga

SEQ ID NO: 2550199 - RNA, 18 nt, Chlamydophila pneumoniae J138
gcaugaacgugcaucucu

SEQ ID NO: 2550200 - RNA, 12 nt, Chlamydophila pneumoniae J138
gcaugaggagac

SEQ ID NO: 2550201 - RNA, 16 nt, Chlamydophila pneumoniae J138
gcaugcacgagagccu

SEQ ID NO: 2550202 - RNA, 23 nt, Chlamydophila pneumoniae J138
gcaugccuacaggcaaggagagc

SEQ ID NO: 2550203 - RNA, 22 nt, Chlamydophila pneumoniae J138
gcauggagaauaaucucuuuca

SEQ ID NO: 2550204 - RNA, 23 nt, Chlamydophila pneumoniae J138
gcauggauccuucaucagcuucc

SEQ ID NO: 2550205 - RNA, 23 nt, Chlamydophila pneumoniae J138
gcauggcguaaugcuccacggaa

SEQ ID NO: 2550206 - RNA, 15 nt, Chlamydophila pneumoniae J138
gcaugguaggagccg

SEQ ID NO: 2550207 - RNA, 13 nt, Chlamydophila pneumoniae J138
gcauggucuccca

SEQ ID NO: 2550208 - RNA, 13 nt, Chlamydophila pneumoniae J138
gcauuaacgucau

SEQ ID NO: 2550209 - RNA, 19 nt, Chlamydophila pneumoniae J138
gcauuaagauaaacagcac

SEQ ID NO: 2550210 - RNA, 12 nt, Chlamydophila pneumoniae J138
gcauuaauaacu

SEQ ID NO: 2550211 - RNA, 14 nt, Chlamydophila pneumoniae J138
gcauuaccuuaucg

SEQ ID NO: 2550212 - RNA, 18 nt, Chlamydophila pneumoniae J138
gcauuacgguuucuggga

SEQ ID NO: 2550213 - RNA, 19 nt, Chlamydophila pneumoniae J138
gcauuacgguuucugggau

SEQ ID NO: 2550214 - RNA, 22 nt, Chlamydophila pneumoniae J138
gcauuacgguuucugggaugca

SEQ ID NO: 2550215 - RNA, 22 nt, Chlamydophila pneumoniae J138
gcauuccgagcugcaaacacaa

SEQ ID NO: 2550216 - RNA, 15 nt, Chlamydophila pneumoniae J138
gcauucucaauucug

SEQ ID NO: 2550217 - RNA, 16 nt, Chlamydophila pneumoniae J138
gcauucuguaauuuug

SEQ ID NO: 2550218 - RNA, 22 nt, Chlamydophila pneumoniae J138
gcauucuguaauuuugagaagu

SEQ ID NO: 2550219 - RNA, 22 nt, Chlamydophila pneumoniae J138
gcauugaauccuucuauagcaa

SEQ ID NO: 2550220 - RNA, 13 nt, Chlamydophila pneumoniae J138
gcauugcaaauaa

SEQ ID NO: 2550221 - RNA, 22 nt, Chlamydophila pneumoniae J138
gcauugcuugcgcagcuucugg

SEQ ID NO: 2550222 - RNA, 18 nt, Chlamydophila pneumoniae J138
gcauuggaaaucuuauaa

SEQ ID NO: 2550223 - RNA, 22 nt, Chlamydophila pneumoniae J138
gcauuggacaacgcuucuuuuu

SEQ ID NO: 2550224 - RNA, 15 nt, Chlamydophila pneumoniae J138
gcauugggaaggauc

SEQ ID NO: 2550225 - RNA, 23 nt, Chlamydophila pneumoniae J138
gcauuuaaaacggcuguacuucc

SEQ ID NO: 2550226 - RNA, 16 nt, Chlamydophila pneumoniae J138
gcauuuaaacuaagaa

SEQ ID NO: 2550227 - RNA, 22 nt, Chlamydophila pneumoniae J138
gcauuuaaacuaagaauaccua

SEQ ID NO: 2550228 - RNA, 12 nt, Chlamydophila pneumoniae J138
gcauuuucucug

SEQ ID NO: 2550229 - RNA, 19 nt, Chlamydophila pneumoniae J138
gcauuuucucugagcagcu

SEQ ID NO: 2550230 - RNA, 17 nt, Chlamydophila pneumoniae J138
gcauuuucuucuugcaa

SEQ ID NO: 2550231 - RNA, 17 nt, Chlamydophila pneumoniae J138
gccaaaaggcacagcaa

SEQ ID NO: 2550232 - RNA, 19 nt, Chlamydophila pneumoniae J138
gccaaaccaugaggcugcu

SEQ ID NO: 2550233 - RNA, 16 nt, Chlamydophila pneumoniae J138
gccaaacgaauuucuu

SEQ ID NO: 2550234 - RNA, 18 nt, Chlamydophila pneumoniae J138
gccaaacgaauuucuugu

SEQ ID NO: 2550235 - RNA, 16 nt, Chlamydophila pneumoniae J138
gccaaagaacagcacu

SEQ ID NO: 2550236 - RNA, 17 nt, Chlamydophila pneumoniae J138
gccaaagaacagcacuc

SEQ ID NO: 2550237 - RNA, 20 nt, Chlamydophila pneumoniae J138
gccaaagucacucaaacccu

SEQ ID NO: 2550238 - RNA, 14 nt, Chlamydophila pneumoniae J138
gccaaauaccaagg

SEQ ID NO: 2550239 - RNA, 15 nt, Chlamydophila pneumoniae J138
gccaagaagauguag

SEQ ID NO: 2550240 - RNA, 15 nt, Chlamydophila pneumoniae J138
gccaagagagcuugu

SEQ ID NO: 2550241 - RNA, 16 nt, Chlamydophila pneumoniae J138
gccaaggucuucccga

SEQ ID NO: 2550242 - RNA, 18 nt, Chlamydophila pneumoniae J138
gccaaucccuaagguuuc

SEQ ID NO: 2550243 - RNA, 22 nt, Chlamydophila pneumoniae J138
gccaaucccuaagguuuccaug

SEQ ID NO: 2550244 - RNA, 17 nt, Chlamydophila pneumoniae J138
gccaaucuuccuuaacc

SEQ ID NO: 2550245 - RNA, 12 nt, Chlamydophila pneumoniae J138
gccacagagaau

SEQ ID NO: 2550246 - RNA, 24 nt, Chlamydophila pneumoniae J138
gccacaucaaagcaauuucuccua

SEQ ID NO: 2550247 - RNA, 15 nt, Chlamydophila pneumoniae J138
gccacaugaaguccu

SEQ ID NO: 2550248 - RNA, 22 nt, Chlamydophila pneumoniae J138
gccacuaaguuuaggcaggaag

SEQ ID NO: 2550249 - RNA, 12 nt, Chlamydophila pneumoniae J138
gccagcagaagg

SEQ ID NO: 2550250 - RNA, 20 nt, Chlamydophila pneumoniae J138
gccagcagaaguuccuucag

SEQ ID NO: 2550251 - RNA, 23 nt, Chlamydophila pneumoniae J138
gccagcagcgaggaguuuuccaa

SEQ ID NO: 2550252 - RNA, 16 nt, Chlamydophila pneumoniae J138
gccagcccaugucuuu

SEQ ID NO: 2550253 - RNA, 18 nt, Chlamydophila pneumoniae J138
gccaguucuugaaacucu

SEQ ID NO: 2550254 - RNA, 21 nt, Chlamydophila pneumoniae J138
gccaguucuugaaacucuauc

SEQ ID NO: 2550255 - RNA, 18 nt, Chlamydophila pneumoniae J138
gccauaaauacaggccug

SEQ ID NO: 2550256 - RNA, 13 nt, Chlamydophila pneumoniae J138
gccauaacacuuu

SEQ ID NO: 2550257 - RNA, 18 nt, Chlamydophila pneumoniae J138
gccaucuucuucuaggau

SEQ ID NO: 2550258 - RNA, 17 nt, Chlamydophila pneumoniae J138
gccaugucuaaaggagu

SEQ ID NO: 2550259 - RNA, 20 nt, Chlamydophila pneumoniae J138
gccauuccauggauauggaa

SEQ ID NO: 2550260 - RNA, 15 nt, Chlamydophila pneumoniae J138
gccauugaucagaau

SEQ ID NO: 2550261 - RNA, 20 nt, Chlamydophila pneumoniae J138
gccauuugguaguuuuucag

SEQ ID NO: 2550262 - RNA, 15 nt, Chlamydophila pneumoniae J138
gccauuuucuaagag

SEQ ID NO: 2550263 - RNA, 22 nt, Chlamydophila pneumoniae J138
gcccaaaaacacucaaauucaa

SEQ ID NO: 2550264 - RNA, 23 nt, Chlamydophila pneumoniae J138
gcccaaguuguagugaaugagcu

SEQ ID NO: 2550265 - RNA, 16 nt, Chlamydophila pneumoniae J138
gcccagauucugaaga

SEQ ID NO: 2550266 - RNA, 17 nt, Chlamydophila pneumoniae J138
gcccauuaacuaagaua

SEQ ID NO: 2550267 - RNA, 14 nt, Chlamydophila pneumoniae J138
gcccccaggcugca

SEQ ID NO: 2550268 - RNA, 17 nt, Chlamydophila pneumoniae J138
gccccgaauuguauucg

SEQ ID NO: 2550269 - RNA, 18 nt, Chlamydophila pneumoniae J138
gccccuggaauuucucca

SEQ ID NO: 2550270 - RNA, 22 nt, Chlamydophila pneumoniae J138
gccccuuccaauacuaaaacua

SEQ ID NO: 2550271 - RNA, 17 nt, Chlamydophila pneumoniae J138
gcccgaaauucauuaaa

SEQ ID NO: 2550272 - RNA, 24 nt, Chlamydophila pneumoniae J138
gcccgacucaucuaacgucagcug

SEQ ID NO: 2550273 - RNA, 23 nt, Chlamydophila pneumoniae J138
gcccgucuuagaauccaaagacu

SEQ ID NO: 2550274 - RNA, 19 nt, Chlamydophila pneumoniae J138
gcccuagauagcaaaucaa

SEQ ID NO: 2550275 - RNA, 21 nt, Chlamydophila pneumoniae J138
gcccuauaguauaauagugag

SEQ ID NO: 2550276 - RNA, 23 nt, Chlamydophila pneumoniae J138
gcccucgguuauuuuuccagaaa

SEQ ID NO: 2550277 - RNA, 14 nt, Chlamydophila pneumoniae J138
gcccuguucuaugc

SEQ ID NO: 2550278 - RNA, 19 nt, Chlamydophila pneumoniae J138
gcccuugcagcgacaacac

SEQ ID NO: 2550279 - RNA, 22 nt, Chlamydophila pneumoniae J138
gcccuuucugcaaucugaaugc

SEQ ID NO: 2550280 - RNA, 15 nt, Chlamydophila pneumoniae J138
gccgaccaucauaau

SEQ ID NO: 2550281 - RNA, 20 nt, Chlamydophila pneumoniae J138
gccgacucuacaucuucuug

SEQ ID NO: 2550282 - RNA, 14 nt, Chlamydophila pneumoniae J138
gccgcauuucuuca

SEQ ID NO: 2550283 - RNA, 17 nt, Chlamydophila pneumoniae J138
gccgcauuucuucaaua

SEQ ID NO: 2550284 - RNA, 23 nt, Chlamydophila pneumoniae J138
gccggcccacucaaaagaagagu

SEQ ID NO: 2550285 - RNA, 17 nt, Chlamydophila pneumoniae J138
gccggcgguggaaaagg

SEQ ID NO: 2550286 - RNA, 14 nt, Chlamydophila pneumoniae J138
gccgugaagcagag

SEQ ID NO: 2550287 - RNA, 14 nt, Chlamydophila pneumoniae J138
gccuaaucuuguag

SEQ ID NO: 2550288 - RNA, 20 nt, Chlamydophila pneumoniae J138
gccuacaggcaaggagagcu

SEQ ID NO: 2550289 - RNA, 23 nt, Chlamydophila pneumoniae J138
gccuaugggaggaauuccucuca

SEQ ID NO: 2550290 - RNA, 12 nt, Chlamydophila pneumoniae J138
gccucacagaau

SEQ ID NO: 2550291 - RNA, 15 nt, Chlamydophila pneumoniae J138
gccuccaccugcagc

SEQ ID NO: 2550292 - RNA, 20 nt, Chlamydophila pneumoniae J138
gccuccaccugcagcgcagc

SEQ ID NO: 2550293 - RNA, 15 nt, Chlamydophila pneumoniae J138
gccucccgaagacaa

SEQ ID NO: 2550294 - RNA, 16 nt, Chlamydophila pneumoniae J138
gccucgagcagaaacu

SEQ ID NO: 2550295 - RNA, 13 nt, Chlamydophila pneumoniae J138
gccucuccuugag

SEQ ID NO: 2550296 - RNA, 23 nt, Chlamydophila pneumoniae J138
gccugaaaacaaggcaaaaaguu

SEQ ID NO: 2550297 - RNA, 19 nt, Chlamydophila pneumoniae J138
gccugaaauccugggcaau

SEQ ID NO: 2550298 - RNA, 15 nt, Chlamydophila pneumoniae J138
gccuggcuaaaggau

SEQ ID NO: 2550299 - RNA, 23 nt, Chlamydophila pneumoniae J138
gccugucacaauaccaucucuuu

SEQ ID NO: 2550300 - RNA, 15 nt, Chlamydophila pneumoniae J138
gccugugauaguaga

SEQ ID NO: 2550301 - RNA, 23 nt, Chlamydophila pneumoniae J138
gccuguuuucuucuaccuguagc

SEQ ID NO: 2550302 - RNA, 13 nt, Chlamydophila pneumoniae J138
gccuuaaauguau

SEQ ID NO: 2550303 - RNA, 12 nt, Chlamydophila pneumoniae J138
gccuucauucca

SEQ ID NO: 2550304 - RNA, 17 nt, Chlamydophila pneumoniae J138
gccuuccauaucuagaa

SEQ ID NO: 2550305 - RNA, 23 nt, Chlamydophila pneumoniae J138
gccuuccauaucuagaaguuuaa

SEQ ID NO: 2550306 - RNA, 17 nt, Chlamydophila pneumoniae J138
gccuuccuguuaaggga

SEQ ID NO: 2550307 - RNA, 20 nt, Chlamydophila pneumoniae J138
gccuuccuuaacaacaucac

SEQ ID NO: 2550308 - RNA, 19 nt, Chlamydophila pneumoniae J138
gccuucucauugcggcacc

SEQ ID NO: 2550309 - RNA, 20 nt, Chlamydophila pneumoniae J138
gccuugauccuuuccaagaa

SEQ ID NO: 2550310 - RNA, 13 nt, Chlamydophila pneumoniae J138
gccuugcugcaua

SEQ ID NO: 2550311 - RNA, 19 nt, Chlamydophila pneumoniae J138
gccuuggguuugucuccaa

SEQ ID NO: 2550312 - RNA, 13 nt, Chlamydophila pneumoniae J138
gccuuuagggaaa

SEQ ID NO: 2550313 - RNA, 11 nt, Chlamydophila pneumoniae J138
gccuuucucuu

SEQ ID NO: 2550314 - RNA, 14 nt, Chlamydophila pneumoniae J138
gccuuuuucuugau

SEQ ID NO: 2550315 - RNA, 22 nt, Chlamydophila pneumoniae J138
gccuuuuucuugauuagagaau

SEQ ID NO: 2550316 - RNA, 13 nt, Chlamydophila pneumoniae J138
gccuuuuuuucua

SEQ ID NO: 2550317 - RNA, 21 nt, Chlamydophila pneumoniae J138
gcgaaacauuagucaauguau

SEQ ID NO: 2550318 - RNA, 16 nt, Chlamydophila pneumoniae J138
gcgaaagucaaagggc

SEQ ID NO: 2550319 - RNA, 13 nt, Chlamydophila pneumoniae J138
gcgaaccaaaguc

SEQ ID NO: 2550320 - RNA, 16 nt, Chlamydophila pneumoniae J138
gcgaagggaggagaac

SEQ ID NO: 2550321 - RNA, 18 nt, Chlamydophila pneumoniae J138
gcgaagggaggagaacuu

SEQ ID NO: 2550322 - RNA, 16 nt, Chlamydophila pneumoniae J138
gcgaauccuagagaac

SEQ ID NO: 2550323 - RNA, 16 nt, Chlamydophila pneumoniae J138
gcgacaugagaaaucu

SEQ ID NO: 2550324 - RNA, 17 nt, Chlamydophila pneumoniae J138
gcgacaugagaaaucuu

SEQ ID NO: 2550325 - RNA, 15 nt, Chlamydophila pneumoniae J138
gcgaccuaggagaaa

SEQ ID NO: 2550326 - RNA, 14 nt, Chlamydophila pneumoniae J138
gcgaccugcaaaug

SEQ ID NO: 2550327 - RNA, 14 nt, Chlamydophila pneumoniae J138
gcgacgucaucaua

SEQ ID NO: 2550328 - RNA, 20 nt, Chlamydophila pneumoniae J138
gcgacuugccaaucuuccuu

SEQ ID NO: 2550329 - RNA, 18 nt, Chlamydophila pneumoniae J138
gcgagaggggaaccaagg

SEQ ID NO: 2550330 - RNA, 17 nt, Chlamydophila pneumoniae J138
gcgauacaauaaacaac

SEQ ID NO: 2550331 - RNA, 15 nt, Chlamydophila pneumoniae J138
gcgauaguaaacaga

SEQ ID NO: 2550332 - RNA, 16 nt, Chlamydophila pneumoniae J138
gcgauaguaaacagaa

SEQ ID NO: 2550333 - RNA, 16 nt, Chlamydophila pneumoniae J138
gcgauaucuauaaaug

SEQ ID NO: 2550334 - RNA, 11 nt, Chlamydophila pneumoniae J138
gcgcaaagaac

SEQ ID NO: 2550335 - RNA, 22 nt, Chlamydophila pneumoniae J138
gcgcaaaucuuacauaaaccuu

SEQ ID NO: 2550336 - RNA, 17 nt, Chlamydophila pneumoniae J138
gcgcacaccagcucgag

SEQ ID NO: 2550337 - RNA, 11 nt, Chlamydophila pneumoniae J138
gcgcagcuucu

SEQ ID NO: 2550338 - RNA, 21 nt, Chlamydophila pneumoniae J138
gcgcagcuucuggagaaaaaa

SEQ ID NO: 2550339 - RNA, 18 nt, Chlamydophila pneumoniae J138
gcgcaguggacggggaga

SEQ ID NO: 2550340 - RNA, 16 nt, Chlamydophila pneumoniae J138
gcgcauaugcuccaga

SEQ ID NO: 2550341 - RNA, 12 nt, Chlamydophila pneumoniae J138
gcgcauuuuuuc

SEQ ID NO: 2550342 - RNA, 23 nt, Chlamydophila pneumoniae J138
gcgcccgaaucuuucaaaagaaa

SEQ ID NO: 2550343 - RNA, 14 nt, Chlamydophila pneumoniae J138
gcgcccgagcuucc

SEQ ID NO: 2550344 - RNA, 17 nt, Chlamydophila pneumoniae J138
gcgccgcauuacaggga

SEQ ID NO: 2550345 - RNA, 15 nt, Chlamydophila pneumoniae J138
gcgccuccaccugca

SEQ ID NO: 2550346 - RNA, 14 nt, Chlamydophila pneumoniae J138
gcgcuagcuccagc

SEQ ID NO: 2550347 - RNA, 18 nt, Chlamydophila pneumoniae J138
gcgcucuaagagcccuug

SEQ ID NO: 2550348 - RNA, 15 nt, Chlamydophila pneumoniae J138
gcgcuuccagcuucu

SEQ ID NO: 2550349 - RNA, 20 nt, Chlamydophila pneumoniae J138
gcggagaauaucaucuuccu

SEQ ID NO: 2550350 - RNA, 21 nt, Chlamydophila pneumoniae J138
gcggagaauaucaucuuccuc

SEQ ID NO: 2550351 - RNA, 17 nt, Chlamydophila pneumoniae J138
gcggaguccuucuugca

SEQ ID NO: 2550352 - RNA, 15 nt, Chlamydophila pneumoniae J138
gcggaucuucuucug

SEQ ID NO: 2550353 - RNA, 22 nt, Chlamydophila pneumoniae J138
gcggcaacaagagcgcauuuua

SEQ ID NO: 2550354 - RNA, 12 nt, Chlamydophila pneumoniae J138
gcggcuaauuuc

SEQ ID NO: 2550355 - RNA, 14 nt, Chlamydophila pneumoniae J138
gcggcuuuuugcaa

SEQ ID NO: 2550356 - RNA, 12 nt, Chlamydophila pneumoniae J138
gcgggcucaaag

SEQ ID NO: 2550357 - RNA, 21 nt, Chlamydophila pneumoniae J138
gcgguagcgucuagcuagugu

SEQ ID NO: 2550358 - RNA, 17 nt, Chlamydophila pneumoniae J138
gcggucucauguaacug

SEQ ID NO: 2550359 - RNA, 14 nt, Chlamydophila pneumoniae J138
gcguacguuuucuc

SEQ ID NO: 2550360 - RNA, 23 nt, Chlamydophila pneumoniae J138
gcguacucuucuuuggaugcuaa

SEQ ID NO: 2550361 - RNA, 20 nt, Chlamydophila pneumoniae J138
gcgucaauaagcuugccagc

SEQ ID NO: 2550362 - RNA, 23 nt, Chlamydophila pneumoniae J138
gcgucaauaagcuugccagcaga

SEQ ID NO: 2550363 - RNA, 14 nt, Chlamydophila pneumoniae J138
gcgucacauuuguu

SEQ ID NO: 2550364 - RNA, 17 nt, Chlamydophila pneumoniae J138
gcgucaugcauagaaua

SEQ ID NO: 2550365 - RNA, 19 nt, Chlamydophila pneumoniae J138
gcgucuccuugauuuggga

SEQ ID NO: 2550366 - RNA, 17 nt, Chlamydophila pneumoniae J138
gcgucugcccuuucugc

SEQ ID NO: 2550367 - RNA, 22 nt, Chlamydophila pneumoniae J138
gcguucauacaccccauagagc

SEQ ID NO: 2550368 - RNA, 13 nt, Chlamydophila pneumoniae J138
gcguuucuuucug

SEQ ID NO: 2550369 - RNA, 17 nt, Chlamydophila pneumoniae J138
gcuaaaggaucauuaaa

SEQ ID NO: 2550370 - RNA, 21 nt, Chlamydophila pneumoniae J138
gcuaaaggaucauuaaagucc

SEQ ID NO: 2550371 - RNA, 17 nt, Chlamydophila pneumoniae J138
gcuaaaguagaauccuu

SEQ ID NO: 2550372 - RNA, 19 nt, Chlamydophila pneumoniae J138
gcuaaaguagaauccuucu

SEQ ID NO: 2550373 - RNA, 15 nt, Chlamydophila pneumoniae J138
gcuaaauuugucauc

SEQ ID NO: 2550374 - RNA, 15 nt, Chlamydophila pneumoniae J138
gcuaacgaagccuca

SEQ ID NO: 2550375 - RNA, 15 nt, Chlamydophila pneumoniae J138
gcuaacgacauugaa

SEQ ID NO: 2550376 - RNA, 17 nt, Chlamydophila pneumoniae J138
gcuaagagcaucuuugg

SEQ ID NO: 2550377 - RNA, 14 nt, Chlamydophila pneumoniae J138
gcuaagaucuuuag

SEQ ID NO: 2550378 - RNA, 19 nt, Chlamydophila pneumoniae J138
gcuaagcauuuuacgaauu

SEQ ID NO: 2550379 - RNA, 15 nt, Chlamydophila pneumoniae J138
gcuaaggauucccgg

SEQ ID NO: 2550380 - RNA, 15 nt, Chlamydophila pneumoniae J138
gcuaauaagauccaa

SEQ ID NO: 2550381 - RNA, 21 nt, Chlamydophila pneumoniae J138
gcuaauaauuccugagguugg

SEQ ID NO: 2550382 - RNA, 23 nt, Chlamydophila pneumoniae J138
gcuaauacaucaccacugcucca

SEQ ID NO: 2550383 - RNA, 18 nt, Chlamydophila pneumoniae J138
gcuaaucaauccaagaau

SEQ ID NO: 2550384 - RNA, 19 nt, Chlamydophila pneumoniae J138
gcuaauguugucucauggg

SEQ ID NO: 2550385 - RNA, 16 nt, Chlamydophila pneumoniae J138
gcuacaaaauuauuaa

SEQ ID NO: 2550386 - RNA, 17 nt, Chlamydophila pneumoniae J138
gcuacaaaauuauuaaa

SEQ ID NO: 2550387 - RNA, 21 nt, Chlamydophila pneumoniae J138
gcuacaaaauuauuaaacucg

SEQ ID NO: 2550388 - RNA, 16 nt, Chlamydophila pneumoniae J138
gcuacaaacucuucca

SEQ ID NO: 2550389 - RNA, 17 nt, Chlamydophila pneumoniae J138
gcuacagauucuuguau

SEQ ID NO: 2550390 - RNA, 17 nt, Chlamydophila pneumoniae J138
gcuacagcuucuuuucc

SEQ ID NO: 2550391 - RNA, 17 nt, Chlamydophila pneumoniae J138
gcuacauaaaaugagcu

SEQ ID NO: 2550392 - RNA, 15 nt, Chlamydophila pneumoniae J138
gcuacauaguuuuua

SEQ ID NO: 2550393 - RNA, 20 nt, Chlamydophila pneumoniae J138
gcuaccuuaguuuuuucuaa

SEQ ID NO: 2550394 - RNA, 21 nt, Chlamydophila pneumoniae J138
gcuacgacuacaucuuguucu

SEQ ID NO: 2550395 - RNA, 17 nt, Chlamydophila pneumoniae J138
gcuacuucuucuuuucg

SEQ ID NO: 2550396 - RNA, 18 nt, Chlamydophila pneumoniae J138
gaccugcuuuuuuucuag

SEQ ID NO: 2550397 - RNA, 15 nt, Chlamydophila pneumoniae J138
gaccuguaguaaaau

SEQ ID NO: 2550398 - RNA, 13 nt, Chlamydophila pneumoniae J138
gaccuguuuucuu

SEQ ID NO: 2550399 - RNA, 14 nt, Chlamydophila pneumoniae J138
gaccuguuuucuuu

SEQ ID NO: 2550400 - RNA, 15 nt, Chlamydophila pneumoniae J138
gaccuucagguugau

SEQ ID NO: 2550401 - RNA, 17 nt, Chlamydophila pneumoniae J138
gaccuuccuuaucuuca

SEQ ID NO: 2550402 - RNA, 17 nt, Chlamydophila pneumoniae J138
gaccuuuagcugcugaa

SEQ ID NO: 2550403 - RNA, 22 nt, Chlamydophila pneumoniae J138
gaccuuuaggaacuugaauacc

SEQ ID NO: 2550404 - RNA, 23 nt, Chlamydophila pneumoniae J138
gacgaaagcacauaagaugaagu

SEQ ID NO: 2550405 - RNA, 14 nt, Chlamydophila pneumoniae J138
gacgacaaaucacg

SEQ ID NO: 2550406 - RNA, 23 nt, Chlamydophila pneumoniae J138
gacgacguuuugcuguggaauuu

SEQ ID NO: 2550407 - RNA, 10 nt, Chlamydophila pneumoniae J138
gacgacucug

SEQ ID NO: 2550408 - RNA, 18 nt, Chlamydophila pneumoniae J138
gacgaguugaaguuuugc

SEQ ID NO: 2550409 - RNA, 23 nt, Chlamydophila pneumoniae J138
gacgaguugaaguuuugcucucu

SEQ ID NO: 2550410 - RNA, 18 nt, Chlamydophila pneumoniae J138
gacgauauuuagagagaa

SEQ ID NO: 2550411 - RNA, 18 nt, Chlamydophila pneumoniae J138
gacgcaagagacaagaaa

SEQ ID NO: 2550412 - RNA, 15 nt, Chlamydophila pneumoniae J138
gacgcacauuuagaa

SEQ ID NO: 2550413 - RNA, 15 nt, Chlamydophila pneumoniae J138
gacgcuuuuaucugu

SEQ ID NO: 2550414 - RNA, 14 nt, Chlamydophila pneumoniae J138
gacggaaaaucaca

SEQ ID NO: 2550415 - RNA, 12 nt, Chlamydophila pneumoniae J138
gacggauaaaug

SEQ ID NO: 2550416 - RNA, 13 nt, Chlamydophila pneumoniae J138
gacggauaggauc

SEQ ID NO: 2550417 - RNA, 14 nt, Chlamydophila pneumoniae J138
gacggauccuagaa

SEQ ID NO: 2550418 - RNA, 15 nt, Chlamydophila pneumoniae J138
gacguaaaaagaaag

SEQ ID NO: 2550419 - RNA, 17 nt, Chlamydophila pneumoniae J138
gacguacuaagauacgu

SEQ ID NO: 2550420 - RNA, 21 nt, Chlamydophila pneumoniae J138
gacgucaucauaggaaacgcc

SEQ ID NO: 2550421 - RNA, 16 nt, Chlamydophila pneumoniae J138
gacgucuccaacaguc

SEQ ID NO: 2550422 - RNA, 20 nt, Chlamydophila pneumoniae J138
gacgucuucuuagaagagaa

SEQ ID NO: 2550423 - RNA, 14 nt, Chlamydophila pneumoniae J138
gacgugguuuuugc

SEQ ID NO: 2550424 - RNA, 14 nt, Chlamydophila pneumoniae J138
gacguuccuuucuc

SEQ ID NO: 2550425 - RNA, 14 nt, Chlamydophila pneumoniae J138
gacuaaaaaagaga

SEQ ID NO: 2550426 - RNA, 14 nt, Chlamydophila pneumoniae J138
gacuaaaagaauaa

SEQ ID NO: 2550427 - RNA, 22 nt, Chlamydophila pneumoniae J138
gcuagaguccaagguucuggga

SEQ ID NO: 2550428 - RNA, 16 nt, Chlamydophila pneumoniae J138
gcuagaucacaagaaa

SEQ ID NO: 2550429 - RNA, 17 nt, Chlamydophila pneumoniae J138
gcuagcucuuaaaugug

SEQ ID NO: 2550430 - RNA, 15 nt, Chlamydophila pneumoniae J138
gcuaggaagaugaau

SEQ ID NO: 2550431 - RNA, 14 nt, Chlamydophila pneumoniae J138
gcuagucuucuuag

SEQ ID NO: 2550432 - RNA, 12 nt, Chlamydophila pneumoniae J138
gcuagucuuucu

SEQ ID NO: 2550433 - RNA, 14 nt, Chlamydophila pneumoniae J138
gcuauaaauaauua

SEQ ID NO: 2550434 - RNA, 18 nt, Chlamydophila pneumoniae J138
gcuauacaaccacuuccu

SEQ ID NO: 2550435 - RNA, 20 nt, Chlamydophila pneumoniae J138
gcuauacagaaaagaaugug

SEQ ID NO: 2550436 - RNA, 18 nt, Chlamydophila pneumoniae J138
gcuauaccuauauagaga

SEQ ID NO: 2550437 - RNA, 21 nt, Chlamydophila pneumoniae J138
gcuauagauacuuugcaauac

SEQ ID NO: 2550438 - RNA, 18 nt, Chlamydophila pneumoniae J138
gcuauagccuuguaaaua

SEQ ID NO: 2550439 - RNA, 20 nt, Chlamydophila pneumoniae J138
gcuaucaaagacucaugaaa

SEQ ID NO: 2550440 - RNA, 16 nt, Chlamydophila pneumoniae J138
gcuaucaacauccccc

SEQ ID NO: 2550441 - RNA, 22 nt, Chlamydophila pneumoniae J138
gcuaucaacaucccccgggaag

SEQ ID NO: 2550442 - RNA, 19 nt, Chlamydophila pneumoniae J138
gcuaucaaccauaaagaau

SEQ ID NO: 2550443 - RNA, 22 nt, Chlamydophila pneumoniae J138
gcuaucagcuggguaaguccac

SEQ ID NO: 2550444 - RNA, 20 nt, Chlamydophila pneumoniae J138
gcuaucccacuaacaagaua

SEQ ID NO: 2550445 - RNA, 21 nt, Chlamydophila pneumoniae J138
gcuaucccacuaacaagauaa

SEQ ID NO: 2550446 - RNA, 23 nt, Chlamydophila pneumoniae J138
gcuaugaggaacugggcauagug

SEQ ID NO: 2550447 - RNA, 14 nt, Chlamydophila pneumoniae J138
gcuaugaugagaac

SEQ ID NO: 2550448 - RNA, 20 nt, Chlamydophila pneumoniae J138
gcuauguaggcagauagaca

SEQ ID NO: 2550449 - RNA, 16 nt, Chlamydophila pneumoniae J138
gcuaugucuguuccca

SEQ ID NO: 2550450 - RNA, 14 nt, Chlamydophila pneumoniae J138
gcuauugaaaaauc

SEQ ID NO: 2550451 - RNA, 16 nt, Chlamydophila pneumoniae J138
gcuauuuuacuuacua

SEQ ID NO: 2550452 - RNA, 19 nt, Chlamydophila pneumoniae J138
gcucaaaauuuccucgacu

SEQ ID NO: 2550453 - RNA, 18 nt, Chlamydophila pneumoniae J138
gcucaagagcaugcuuga

SEQ ID NO: 2550454 - RNA, 15 nt, Chlamydophila pneumoniae J138
gcucacucuuuaaaa

SEQ ID NO: 2550455 - RNA, 16 nt, Chlamydophila pneumoniae J138
gcucacucuuuaaaaa

SEQ ID NO: 2550456 - RNA, 16 nt, Chlamydophila pneumoniae J138
gcucacuuacgaaucu

SEQ ID NO: 2550457 - RNA, 13 nt, Chlamydophila pneumoniae J138
gcucaggaaaacu

SEQ ID NO: 2550458 - RNA, 17 nt, Chlamydophila pneumoniae J138
gcucaguguauuguuug

SEQ ID NO: 2550459 - RNA, 13 nt, Chlamydophila pneumoniae J138
gcucaucuagaaa

SEQ ID NO: 2550460 - RNA, 20 nt, Chlamydophila pneumoniae J138
gcucaugaaauuucauucuc

SEQ ID NO: 2550461 - RNA, 21 nt, Chlamydophila pneumoniae J138
gcuccaaaaugggauccugca

SEQ ID NO: 2550462 - RNA, 17 nt, Chlamydophila pneumoniae J138
gcuccacggaaauauuc

SEQ ID NO: 2550463 - RNA, 18 nt, Chlamydophila pneumoniae J138
gcuccagaaacgcagcuu

SEQ ID NO: 2550464 - RNA, 20 nt, Chlamydophila pneumoniae J138
gcuccagaaacgcagcuuuc

SEQ ID NO: 2550465 - RNA, 21 nt, Chlamydophila pneumoniae J138
gcuccagaaacgcagcuuucc

SEQ ID NO: 2550466 - RNA, 23 nt, Chlamydophila pneumoniae J138
gcucccaacaagggaaagaaacu

SEQ ID NO: 2550467 - RNA, 17 nt, Chlamydophila pneumoniae J138
gcucccguuccuuuagc

SEQ ID NO: 2550468 - RNA, 23 nt, Chlamydophila pneumoniae J138
gcuccgacccgaccuaccugcua

SEQ ID NO: 2550469 - RNA, 17 nt, Chlamydophila pneumoniae J138
gcuccuaagugauaagg

SEQ ID NO: 2550470 - RNA, 13 nt, Chlamydophila pneumoniae J138
gcuccugaagcug

SEQ ID NO: 2550471 - RNA, 12 nt, Chlamydophila pneumoniae J138
gcuccugcaaaa

SEQ ID NO: 2550472 - RNA, 21 nt, Chlamydophila pneumoniae J138
gcuccuuggcuauggaaagag

SEQ ID NO: 2550473 - RNA, 15 nt, Chlamydophila pneumoniae J138
gcucgagaucuuuuu

SEQ ID NO: 2550474 - RNA, 20 nt, Chlamydophila pneumoniae J138
gcucgagaucuuuuugccag

SEQ ID NO: 2550475 - RNA, 20 nt, Chlamydophila pneumoniae J138
gcucgaggucuuuucuuuuu

SEQ ID NO: 2550476 - RNA, 19 nt, Chlamydophila pneumoniae J138
gcucguacuguuccuacag

SEQ ID NO: 2550477 - RNA, 15 nt, Chlamydophila pneumoniae J138
gcucguauugauauu

SEQ ID NO: 2550478 - RNA, 18 nt, Chlamydophila pneumoniae J138
gcucuaaacucucuuccu

SEQ ID NO: 2550479 - RNA, 20 nt, Chlamydophila pneumoniae J138
gcucuaaacucucuuccuuc

SEQ ID NO: 2550480 - RNA, 15 nt, Chlamydophila pneumoniae J138
gcucuaagagcccuu

SEQ ID NO: 2550481 - RNA, 22 nt, Chlamydophila pneumoniae J138
gcucuaagcugugcauuuucuu

SEQ ID NO: 2550482 - RNA, 15 nt, Chlamydophila pneumoniae J138
gcucuacaggagaag

SEQ ID NO: 2550483 - RNA, 17 nt, Chlamydophila pneumoniae J138
gcucuaccaacugagcu

SEQ ID NO: 2550484 - RNA, 21 nt, Chlamydophila pneumoniae J138
gcucuaccccacgcuaaacua

SEQ ID NO: 2550485 - RNA, 23 nt, Chlamydophila pneumoniae J138
gcucuaccccacgcuaaacuaaa

SEQ ID NO: 2550486 - RNA, 15 nt, Chlamydophila pneumoniae J138
gcucuagucuuucaa

SEQ ID NO: 2550487 - RNA, 22 nt, Chlamydophila pneumoniae J138
gcucucaaggucacagcauuuu

SEQ ID NO: 2550488 - RNA, 14 nt, Chlamydophila pneumoniae J138
gcucuccaaaggga

SEQ ID NO: 2550489 - RNA, 14 nt, Chlamydophila pneumoniae J138
gcucuccauggcuu

SEQ ID NO: 2550490 - RNA, 21 nt, Chlamydophila pneumoniae J138
gcucuccuagacgaucuucag

SEQ ID NO: 2550491 - RNA, 16 nt, Chlamydophila pneumoniae J138
gcucuccugcaaaaag

SEQ ID NO: 2550492 - RNA, 14 nt, Chlamydophila pneumoniae J138
gcucucgacacuau

SEQ ID NO: 2550493 - RNA, 16 nt, Chlamydophila pneumoniae J138
gcucucgcuaagcaaa

SEQ ID NO: 2550494 - RNA, 22 nt, Chlamydophila pneumoniae J138
gcucucgcuaagcaaagcggcu

SEQ ID NO: 2550495 - RNA, 13 nt, Chlamydophila pneumoniae J138
gcucucuucuucu

SEQ ID NO: 2550496 - RNA, 23 nt, Chlamydophila pneumoniae J138
gcucucuucuucucaggauccca

SEQ ID NO: 2550497 - RNA, 18 nt, Chlamydophila pneumoniae J138
gcucucuuuaaaaaauuc

SEQ ID NO: 2550498 - RNA, 12 nt, Chlamydophila pneumoniae J138
gcucuggagauu

SEQ ID NO: 2550499 - RNA, 15 nt, Chlamydophila pneumoniae J138
gcucuggagauugcu

SEQ ID NO: 2550500 - RNA, 14 nt, Chlamydophila pneumoniae J138
gcucuuaauuucug

SEQ ID NO: 2550501 - RNA, 17 nt, Chlamydophila pneumoniae J138
gcucuuacuucuggucc

SEQ ID NO: 2550502 - RNA, 19 nt, Chlamydophila pneumoniae J138
gcucuucuauguguucucg

SEQ ID NO: 2550503 - RNA, 19 nt, Chlamydophila pneumoniae J138
gcucuugagaaagcuucua

SEQ ID NO: 2550504 - RNA, 21 nt, Chlamydophila pneumoniae J138
gcucuuuaauaaggcuuuucu

SEQ ID NO: 2550505 - RNA, 21 nt, Chlamydophila pneumoniae J138
gcucuuuagcaaacauuuuua

SEQ ID NO: 2550506 - RNA, 17 nt, Chlamydophila pneumoniae J138
gcucuuuaggauagagg

SEQ ID NO: 2550507 - RNA, 16 nt, Chlamydophila pneumoniae J138
gcucuuuuaacuuaaa

SEQ ID NO: 2550508 - RNA, 22 nt, Chlamydophila pneumoniae J138
gcugaaagaaugccauucuuau

SEQ ID NO: 2550509 - RNA, 22 nt, Chlamydophila pneumoniae J138
gcugaaaucaugccgagauuuu

SEQ ID NO: 2550510 - RNA, 22 nt, Chlamydophila pneumoniae J138
gcugaaccuuugguagaaagac

SEQ ID NO: 2550511 - RNA, 11 nt, Chlamydophila pneumoniae J138
gcugaagauuu

SEQ ID NO: 2550512 - RNA, 16 nt, Chlamydophila pneumoniae J138
gcugaagauuuuuucu

SEQ ID NO: 2550513 - RNA, 17 nt, Chlamydophila pneumoniae J138
gcugacacucagcuccc

SEQ ID NO: 2550514 - RNA, 17 nt, Chlamydophila pneumoniae J138
gcugacaucuccaagau

SEQ ID NO: 2550515 - RNA, 13 nt, Chlamydophila pneumoniae J138
gcugagagaagca

SEQ ID NO: 2550516 - RNA, 17 nt, Chlamydophila pneumoniae J138
gcugagauggucgagaa

SEQ ID NO: 2550517 - RNA, 12 nt, Chlamydophila pneumoniae J138
gcugauaaaaua

SEQ ID NO: 2550518 - RNA, 21 nt, Chlamydophila pneumoniae J138
gcugauccucggcaucuuugg

SEQ ID NO: 2550519 - RNA, 16 nt, Chlamydophila pneumoniae J138
gcugauuucuuuuuca

SEQ ID NO: 2550520 - RNA, 14 nt, Chlamydophila pneumoniae J138
gcugcuagagcagc

SEQ ID NO: 2550521 - RNA, 15 nt, Chlamydophila pneumoniae J138
gcugcuagagcagcu

SEQ ID NO: 2550522 - RNA, 16 nt, Chlamydophila pneumoniae J138
gcugcucuuuuagaau

SEQ ID NO: 2550523 - RNA, 17 nt, Chlamydophila pneumoniae J138
gcugcucuuuuagaaug

SEQ ID NO: 2550524 - RNA, 18 nt, Chlamydophila pneumoniae J138
gcugcugauccaaaagcg

SEQ ID NO: 2550525 - RNA, 16 nt, Chlamydophila pneumoniae J138
gcugcugcuaaacagg

SEQ ID NO: 2550526 - RNA, 14 nt, Chlamydophila pneumoniae J138
gcugcuucucuacu

SEQ ID NO: 2550527 - RNA, 15 nt, Chlamydophila pneumoniae J138
gcuggaagacuugcu

SEQ ID NO: 2550528 - RNA, 18 nt, Chlamydophila pneumoniae J138
gaucccgggaguuuucag

SEQ ID NO: 2550529 - RNA, 15 nt, Chlamydophila pneumoniae J138
gauccgaaaagaacc

SEQ ID NO: 2550530 - RNA, 14 nt, Chlamydophila pneumoniae J138
gauccuagaauagg

SEQ ID NO: 2550531 - RNA, 15 nt, Chlamydophila pneumoniae J138
gauccuagaauagga

SEQ ID NO: 2550532 - RNA, 21 nt, Chlamydophila pneumoniae J138
gauccuucaucagcuucccaa

SEQ ID NO: 2550533 - RNA, 19 nt, Chlamydophila pneumoniae J138
gaucgaaucuuuauuucug

SEQ ID NO: 2550534 - RNA, 21 nt, Chlamydophila pneumoniae J138
gaucggaguuaucaaaaggau

SEQ ID NO: 2550535 - RNA, 19 nt, Chlamydophila pneumoniae J138
gaucgucaagcucugagaa

SEQ ID NO: 2550536 - RNA, 15 nt, Chlamydophila pneumoniae J138
gaucguuagagaccc

SEQ ID NO: 2550537 - RNA, 15 nt, Chlamydophila pneumoniae J138
gaucuaaagcaucac

SEQ ID NO: 2550538 - RNA, 14 nt, Chlamydophila pneumoniae J138
gaucuacaaaaacu

SEQ ID NO: 2550539 - RNA, 17 nt, Chlamydophila pneumoniae J138
gaucuacaaaaacuaga

SEQ ID NO: 2550540 - RNA, 17 nt, Chlamydophila pneumoniae J138
gaucuacaaacagauuu

SEQ ID NO: 2550541 - RNA, 17 nt, Chlamydophila pneumoniae J138
gaucuacagauagggua

SEQ ID NO: 2550542 - RNA, 21 nt, Chlamydophila pneumoniae J138
gaucuacagauaggguaagau

SEQ ID NO: 2550543 - RNA, 22 nt, Chlamydophila pneumoniae J138
gaucuagaaaaugaagagcuuc

SEQ ID NO: 2550544 - RNA, 18 nt, Chlamydophila pneumoniae J138
gaucucaguaggagcagc

SEQ ID NO: 2550545 - RNA, 22 nt, Chlamydophila pneumoniae J138
gaucucaguaggagcagcggca

SEQ ID NO: 2550546 - RNA, 14 nt, Chlamydophila pneumoniae J138
gaucucaucauaaa

SEQ ID NO: 2550547 - RNA, 14 nt, Chlamydophila pneumoniae J138
gaucucccgugagc

SEQ ID NO: 2550548 - RNA, 23 nt, Chlamydophila pneumoniae J138
gaucuccgauagagauucuuucu

SEQ ID NO: 2550549 - RNA, 19 nt, Chlamydophila pneumoniae J138
gaucucucuuccugcugcu

SEQ ID NO: 2550550 - RNA, 14 nt, Chlamydophila pneumoniae J138
gaucucucuuuccu

SEQ ID NO: 2550551 - RNA, 19 nt, Chlamydophila pneumoniae J138
gaucucucuuuccuuagca

SEQ ID NO: 2550552 - RNA, 14 nt, Chlamydophila pneumoniae J138
gaucugauagaaca

SEQ ID NO: 2550553 - RNA, 22 nt, Chlamydophila pneumoniae J138
gaucugcaaacgcaaugauuuc

SEQ ID NO: 2550554 - RNA, 19 nt, Chlamydophila pneumoniae J138
gaucugcagcguuucuagg

SEQ ID NO: 2550555 - RNA, 17 nt, Chlamydophila pneumoniae J138
gaucuguaauagcagga

SEQ ID NO: 2550556 - RNA, 21 nt, Chlamydophila pneumoniae J138
gaucuucauaaccaaguaaau

SEQ ID NO: 2550557 - RNA, 12 nt, Chlamydophila pneumoniae J138
gaucuucauccc

SEQ ID NO: 2550558 - RNA, 16 nt, Chlamydophila pneumoniae J138
gaucuucuaaaacacc

SEQ ID NO: 2550559 - RNA, 18 nt, Chlamydophila pneumoniae J138
gaucuucuauuuuuuugg

SEQ ID NO: 2550560 - RNA, 17 nt, Chlamydophila pneumoniae J138
gaucuucugaaaucaaa

SEQ ID NO: 2550561 - RNA, 23 nt, Chlamydophila pneumoniae J138
gaucuugcucaggagauacaagu

SEQ ID NO: 2550562 - RNA, 20 nt, Chlamydophila pneumoniae J138
gaucuuuauuuuuaaaaaua

SEQ ID NO: 2550563 - RNA, 16 nt, Chlamydophila pneumoniae J138
gaucuuuguugagaag

SEQ ID NO: 2550564 - RNA, 22 nt, Chlamydophila pneumoniae J138
gaucuuuugauaacuuugcaug

SEQ ID NO: 2550565 - RNA, 20 nt, Chlamydophila pneumoniae J138
gaucuuuuugccaguucuug

SEQ ID NO: 2550566 - RNA, 17 nt, Chlamydophila pneumoniae J138
gaugaaacuuuaggauu

SEQ ID NO: 2550567 - RNA, 12 nt, Chlamydophila pneumoniae J138
gaugaacauaau

SEQ ID NO: 2550568 - RNA, 17 nt, Chlamydophila pneumoniae J138
gaugacagggaaagaac

SEQ ID NO: 2550569 - RNA, 16 nt, Chlamydophila pneumoniae J138
gaugacuuucagagca

SEQ ID NO: 2550570 - RNA, 16 nt, Chlamydophila pneumoniae J138
gaugagguaucccacg

SEQ ID NO: 2550571 - RNA, 18 nt, Chlamydophila pneumoniae J138
gaugagguugagcaagaa

SEQ ID NO: 2550572 - RNA, 21 nt, Chlamydophila pneumoniae J138
gaugauccacugcuuuaggcc

SEQ ID NO: 2550573 - RNA, 22 nt, Chlamydophila pneumoniae J138
gaugaugcccugacguuuugau

SEQ ID NO: 2550574 - RNA, 18 nt, Chlamydophila pneumoniae J138
gaugcaaauccuguagaa

SEQ ID NO: 2550575 - RNA, 22 nt, Chlamydophila pneumoniae J138
gaugcagcauuuguaagaauca

SEQ ID NO: 2550576 - RNA, 16 nt, Chlamydophila pneumoniae J138
gaugcaggccaggaga

SEQ ID NO: 2550577 - RNA, 21 nt, Chlamydophila pneumoniae J138
gaugcauauugccuucuucuu

SEQ ID NO: 2550578 - RNA, 19 nt, Chlamydophila pneumoniae J138
gaugcaucucuuaaaacau

SEQ ID NO: 2550579 - RNA, 20 nt, Chlamydophila pneumoniae J138
gaugccauugaucagaaucu

SEQ ID NO: 2550580 - RNA, 18 nt, Chlamydophila pneumoniae J138
gaugccauuguagagauu

SEQ ID NO: 2550581 - RNA, 19 nt, Chlamydophila pneumoniae J138
gaugcuaaagagucuuccu

SEQ ID NO: 2550582 - RNA, 13 nt, Chlamydophila pneumoniae J138
gaugcuaauaaaa

SEQ ID NO: 2550583 - RNA, 20 nt, Chlamydophila pneumoniae J138
gaugcuccgggaaacaucag

SEQ ID NO: 2550584 - RNA, 19 nt, Chlamydophila pneumoniae J138
gaugcuuagcaaaggcaac

SEQ ID NO: 2550585 - RNA, 14 nt, Chlamydophila pneumoniae J138
gaugcuucuuucaa

SEQ ID NO: 2550586 - RNA, 21 nt, Chlamydophila pneumoniae J138
gauggaguuucuuauucacug

SEQ ID NO: 2550587 - RNA, 14 nt, Chlamydophila pneumoniae J138
gauggcaaggaaaa

SEQ ID NO: 2550588 - RNA, 18 nt, Chlamydophila pneumoniae J138
gauggcauagcgaaaguc

SEQ ID NO: 2550589 - RNA, 17 nt, Chlamydophila pneumoniae J138
gauggucauaccaaccu

SEQ ID NO: 2550590 - RNA, 21 nt, Chlamydophila pneumoniae J138
gaugguugcuucuaagaaacu

SEQ ID NO: 2550591 - RNA, 12 nt, Chlamydophila pneumoniae J138
gauguagagucg

SEQ ID NO: 2550592 - RNA, 15 nt, Chlamydophila pneumoniae J138
gauguaggugauauu

SEQ ID NO: 2550593 - RNA, 22 nt, Chlamydophila pneumoniae J138
gaugucaccacgaacuucagca

SEQ ID NO: 2550594 - RNA, 15 nt, Chlamydophila pneumoniae J138
gaugucgcuuuugcu

SEQ ID NO: 2550595 - RNA, 20 nt, Chlamydophila pneumoniae J138
gaugugccgugacuccagaa

SEQ ID NO: 2550596 - RNA, 21 nt, Chlamydophila pneumoniae J138
gaugugcggcgagcucuagga

SEQ ID NO: 2550597 - RNA, 21 nt, Chlamydophila pneumoniae J138
gauguucucgcaaugcuucuu

SEQ ID NO: 2550598 - RNA, 15 nt, Chlamydophila pneumoniae J138
gauguugcccuacaa

SEQ ID NO: 2550599 - RNA, 15 nt, Chlamydophila pneumoniae J138
gauguuuaauacaaa

SEQ ID NO: 2550600 - RNA, 16 nt, Chlamydophila pneumoniae J138
gauguuuaauacaaaa

SEQ ID NO: 2550601 - RNA, 20 nt, Chlamydophila pneumoniae J138
gauguuuaauacaaaaaaua

SEQ ID NO: 2550602 - RNA, 22 nt, Chlamydophila pneumoniae J138
gauuacagcaucuauagaauuu

SEQ ID NO: 2550603 - RNA, 19 nt, Chlamydophila pneumoniae J138
gauuaggaacaagucggca

SEQ ID NO: 2550604 - RNA, 13 nt, Chlamydophila pneumoniae J138
gauuaguaaugau

SEQ ID NO: 2550605 - RNA, 15 nt, Chlamydophila pneumoniae J138
gauuaguucucuaag

SEQ ID NO: 2550606 - RNA, 14 nt, Chlamydophila pneumoniae J138
gauuauucuagagu

SEQ ID NO: 2550607 - RNA, 19 nt, Chlamydophila pneumoniae J138
gauuauuuguuucuuccau

SEQ ID NO: 2550608 - RNA, 17 nt, Chlamydophila pneumoniae J138
gauucaaugcagcuaac

SEQ ID NO: 2550609 - RNA, 19 nt, Chlamydophila pneumoniae J138
gauucacaucuuaaaaacu

SEQ ID NO: 2550610 - RNA, 19 nt, Chlamydophila pneumoniae J138
gauucagauccaaagacgu

SEQ ID NO: 2550611 - RNA, 23 nt, Chlamydophila pneumoniae J138
gauuccaaugacgggagcucuuu

SEQ ID NO: 2550612 - RNA, 19 nt, Chlamydophila pneumoniae J138
gauuccaguagagccucua

SEQ ID NO: 2550613 - RNA, 14 nt, Chlamydophila pneumoniae J138
gauuccuagaaucu

SEQ ID NO: 2550614 - RNA, 19 nt, Chlamydophila pneumoniae J138
gauuccugucauuccuaag

SEQ ID NO: 2550615 - RNA, 13 nt, Chlamydophila pneumoniae J138
gauucuaaaagag

SEQ ID NO: 2550616 - RNA, 13 nt, Chlamydophila pneumoniae J138
gauucuacaaauu

SEQ ID NO: 2550617 - RNA, 20 nt, Chlamydophila pneumoniae J138
gauucucacucuaugagaac

SEQ ID NO: 2550618 - RNA, 22 nt, Chlamydophila pneumoniae J138
gauucucauaaaggcucuuuua

SEQ ID NO: 2550619 - RNA, 21 nt, Chlamydophila pneumoniae J138
gauucuccagcuucuuucuag

SEQ ID NO: 2550620 - RNA, 20 nt, Chlamydophila pneumoniae J138
gauucucccaauauccagaa

SEQ ID NO: 2550621 - RNA, 16 nt, Chlamydophila pneumoniae J138
gauucucguguagaau

SEQ ID NO: 2550622 - RNA, 18 nt, Chlamydophila pneumoniae J138
gauucucguguagaauuc

SEQ ID NO: 2550623 - RNA, 20 nt, Chlamydophila pneumoniae J138
gauucucucugccuaccaaa

SEQ ID NO: 2550624 - RNA, 21 nt, Chlamydophila pneumoniae J138
gauucucucugccuaccaaag

SEQ ID NO: 2550625 - RNA, 15 nt, Chlamydophila pneumoniae J138
gauucugaagagaga

SEQ ID NO: 2550626 - RNA, 16 nt, Chlamydophila pneumoniae J138
gauucugcccaaagcu

SEQ ID NO: 2550627 - RNA, 21 nt, Chlamydophila pneumoniae J138
gauucuguauaaacaauaaga

SEQ ID NO: 2550628 - RNA, 15 nt, Chlamydophila pneumoniae J138
gcaauuuucucaaua

SEQ ID NO: 2550629 - RNA, 12 nt, Chlamydophila pneumoniae J138
gcacaaaauaaa

SEQ ID NO: 2550630 - RNA, 21 nt, Chlamydophila pneumoniae J138
gcacaagaaccuguuuuucua

SEQ ID NO: 2550631 - RNA, 21 nt, Chlamydophila pneumoniae J138
gcacauaagaugaaguuuaau

SEQ ID NO: 2550632 - RNA, 23 nt, Chlamydophila pneumoniae J138
gcacauucaagauucccugcgga

SEQ ID NO: 2550633 - RNA, 17 nt, Chlamydophila pneumoniae J138
gcaccaaagaugcgcuc

SEQ ID NO: 2550634 - RNA, 18 nt, Chlamydophila pneumoniae J138
gcaccaauugcagucacu

SEQ ID NO: 2550635 - RNA, 17 nt, Chlamydophila pneumoniae J138
gcaccauaauggauacc

SEQ ID NO: 2550636 - RNA, 13 nt, Chlamydophila pneumoniae J138
gcaccgccugacc

SEQ ID NO: 2550637 - RNA, 16 nt, Chlamydophila pneumoniae J138
gcaccuaauaaagaag

SEQ ID NO: 2550638 - RNA, 15 nt, Chlamydophila pneumoniae J138
gcacgcuuucgucua

SEQ ID NO: 2550639 - RNA, 19 nt, Chlamydophila pneumoniae J138
gcacggauucuaaaagagc

SEQ ID NO: 2550640 - RNA, 15 nt, Chlamydophila pneumoniae J138
gcacuaaaagggaag

SEQ ID NO: 2550641 - RNA, 17 nt, Chlamydophila pneumoniae J138
gcacucucugcagggaa

SEQ ID NO: 2550642 - RNA, 14 nt, Chlamydophila pneumoniae J138
gcacugaugaaaaa

SEQ ID NO: 2550643 - RNA, 22 nt, Chlamydophila pneumoniae J138
gcacuggcauggaaugccaaau

SEQ ID NO: 2550644 - RNA, 13 nt, Chlamydophila pneumoniae J138
gcacuuacuucaa

SEQ ID NO: 2550645 - RNA, 21 nt, Chlamydophila pneumoniae J138
gcacuugcucuuuaauaaggc

SEQ ID NO: 2550646 - RNA, 10 nt, Chlamydophila pneumoniae J138
gcacuuuccg

SEQ ID NO: 2550647 - RNA, 23 nt, Chlamydophila pneumoniae J138
gcacuuucuuuuuuaaucuagaa

SEQ ID NO: 2550648 - RNA, 19 nt, Chlamydophila pneumoniae J138
gcagaagguuccacagaga

SEQ ID NO: 2550649 - RNA, 17 nt, Chlamydophila pneumoniae J138
gcagaaguaaccgccug

SEQ ID NO: 2550650 - RNA, 17 nt, Chlamydophila pneumoniae J138
gcagaaguccuaucaaa

SEQ ID NO: 2550651 - RNA, 22 nt, Chlamydophila pneumoniae J138
gcagagaacuuucgucuuugcu

SEQ ID NO: 2550652 - RNA, 19 nt, Chlamydophila pneumoniae J138
gcagagccgucuacuuuug

SEQ ID NO: 2550653 - RNA, 23 nt, Chlamydophila pneumoniae J138
gcagagucucaguugagaaccuu

SEQ ID NO: 2550654 - RNA, 15 nt, Chlamydophila pneumoniae J138
gcagauacuaaacuc

SEQ ID NO: 2550655 - RNA, 16 nt, Chlamydophila pneumoniae J138
gcagauacuaaacucc

SEQ ID NO: 2550656 - RNA, 17 nt, Chlamydophila pneumoniae J138
gcagauagacaaccuag

SEQ ID NO: 2550657 - RNA, 19 nt, Chlamydophila pneumoniae J138
gcagauagacaaccuagaa

SEQ ID NO: 2550658 - RNA, 21 nt, Chlamydophila pneumoniae J138
gcagaucauaucggcagcagc

SEQ ID NO: 2550659 - RNA, 13 nt, Chlamydophila pneumoniae J138
gcagauccugcuu

SEQ ID NO: 2550660 - RNA, 13 nt, Chlamydophila pneumoniae J138
gcagaucuuuuau

SEQ ID NO: 2550661 - RNA, 16 nt, Chlamydophila pneumoniae J138
gcagcaaauacuccag

SEQ ID NO: 2550662 - RNA, 23 nt, Chlamydophila pneumoniae J138
gcagcaaauccuuuauguauaac

SEQ ID NO: 2550663 - RNA, 17 nt, Chlamydophila pneumoniae J138
gcagcacucuuuuucua

SEQ ID NO: 2550664 - RNA, 13 nt, Chlamydophila pneumoniae J138
gcagcagccuugg

SEQ ID NO: 2550665 - RNA, 15 nt, Chlamydophila pneumoniae J138
gcagccucuucucua

SEQ ID NO: 2550666 - RNA, 22 nt, Chlamydophila pneumoniae J138
gcagcgugaauaucaucacuaa

SEQ ID NO: 2550667 - RNA, 18 nt, Chlamydophila pneumoniae J138
gcagcuucuggagaaaaa

SEQ ID NO: 2550668 - RNA, 15 nt, Chlamydophila pneumoniae J138
gcaggaaaagcaaaa

SEQ ID NO: 2550669 - RNA, 22 nt, Chlamydophila pneumoniae J138
gcaggaagucaccuuacaucca

SEQ ID NO: 2550670 - RNA, 15 nt, Chlamydophila pneumoniae J138
gcaggaguuuucaag

SEQ ID NO: 2550671 - RNA, 14 nt, Chlamydophila pneumoniae J138
gcaggccaacucuc

SEQ ID NO: 2550672 - RNA, 14 nt, Chlamydophila pneumoniae J138
gcaggccaggagac

SEQ ID NO: 2550673 - RNA, 15 nt, Chlamydophila pneumoniae J138
gcagggggccugcca

SEQ ID NO: 2550674 - RNA, 20 nt, Chlamydophila pneumoniae J138
gcaggugugugguaaaaaua

SEQ ID NO: 2550675 - RNA, 14 nt, Chlamydophila pneumoniae J138
gcagguucuugaau

SEQ ID NO: 2550676 - RNA, 21 nt, Chlamydophila pneumoniae J138
gcaguaacugcaaagagaauu

SEQ ID NO: 2550677 - RNA, 16 nt, Chlamydophila pneumoniae J138
gcaguaaugccaauau

SEQ ID NO: 2550678 - RNA, 23 nt, Chlamydophila pneumoniae J138
gcaguauagagaagauuucuaua

SEQ ID NO: 2550679 - RNA, 22 nt, Chlamydophila pneumoniae J138
gcagucguauucagguucugaa

SEQ ID NO: 2550680 - RNA, 14 nt, Chlamydophila pneumoniae J138
gcagucucaggaaa

SEQ ID NO: 2550681 - RNA, 21 nt, Chlamydophila pneumoniae J138
gcagugaaauuuugcaacaaa

SEQ ID NO: 2550682 - RNA, 15 nt, Chlamydophila pneumoniae J138
gcaguggcuuauaga

SEQ ID NO: 2550683 - RNA, 20 nt, Chlamydophila pneumoniae J138
gcaguggcuuauagagagaa

SEQ ID NO: 2550684 - RNA, 21 nt, Chlamydophila pneumoniae J138
gcaguggcuuauagagagaau

SEQ ID NO: 2550685 - RNA, 14 nt, Chlamydophila pneumoniae J138
gcagugugcugauu

SEQ ID NO: 2550686 - RNA, 16 nt, Chlamydophila pneumoniae J138
gcaguuccgauaaaga

SEQ ID NO: 2550687 - RNA, 14 nt, Chlamydophila pneumoniae J138
gcaguuguacaauu

SEQ ID NO: 2550688 - RNA, 19 nt, Chlamydophila pneumoniae J138
gcauaaccuuugacaacac

SEQ ID NO: 2550689 - RNA, 21 nt, Chlamydophila pneumoniae J138
gcauaacugugcuccauagca

SEQ ID NO: 2550690 - RNA, 17 nt, Chlamydophila pneumoniae J138
gcauaacuuuaucauag

SEQ ID NO: 2550691 - RNA, 21 nt, Chlamydophila pneumoniae J138
gcauaaggauucugagaaguu

SEQ ID NO: 2550692 - RNA, 15 nt, Chlamydophila pneumoniae J138
gcauaaguuagccug

SEQ ID NO: 2550693 - RNA, 13 nt, Chlamydophila pneumoniae J138
gcauaauccugaa

SEQ ID NO: 2550694 - RNA, 21 nt, Chlamydophila pneumoniae J138
gcauaauccugaauggcucug

SEQ ID NO: 2550695 - RNA, 17 nt, Chlamydophila pneumoniae J138
gcauaaucucaccagaa

SEQ ID NO: 2550696 - RNA, 16 nt, Chlamydophila pneumoniae J138
gcauaaucuuuaacaa

SEQ ID NO: 2550697 - RNA, 13 nt, Chlamydophila pneumoniae J138
gcauaauuuuucu

SEQ ID NO: 2550698 - RNA, 14 nt, Chlamydophila pneumoniae J138
gcauaauuuuucuu

SEQ ID NO: 2550699 - RNA, 18 nt, Chlamydophila pneumoniae J138
gcauacccuucuucuuca

SEQ ID NO: 2550700 - RNA, 17 nt, Chlamydophila pneumoniae J138
gcauacucuauuaagga

SEQ ID NO: 2550701 - RNA, 15 nt, Chlamydophila pneumoniae J138
gcauagagcucuaaa

SEQ ID NO: 2550702 - RNA, 17 nt, Chlamydophila pneumoniae J138
gcauagauacaaacauc

SEQ ID NO: 2550703 - RNA, 21 nt, Chlamydophila pneumoniae J138
gcauagcaacuacagagggcu

SEQ ID NO: 2550704 - RNA, 22 nt, Chlamydophila pneumoniae J138
gcauagcccgaaauucauuaaa

SEQ ID NO: 2550705 - RNA, 22 nt, Chlamydophila pneumoniae J138
gcauagccuuccauaucuagaa

SEQ ID NO: 2550706 - RNA, 18 nt, Chlamydophila pneumoniae J138
gcauagcgagaacaccau

SEQ ID NO: 2550707 - RNA, 21 nt, Chlamydophila pneumoniae J138
gcauagcgagaacaccauaaa

SEQ ID NO: 2550708 - RNA, 16 nt, Chlamydophila pneumoniae J138
gcauaggccaaucccu

SEQ ID NO: 2550709 - RNA, 16 nt, Chlamydophila pneumoniae J138
gcauaggcuaagacua

SEQ ID NO: 2550710 - RNA, 21 nt, Chlamydophila pneumoniae J138
gcauaguauggcauucuuuuu

SEQ ID NO: 2550711 - RNA, 22 nt, Chlamydophila pneumoniae J138
gcauaguggcucaguguauugu

SEQ ID NO: 2550712 - RNA, 15 nt, Chlamydophila pneumoniae J138
gcauaguguuccaaa

SEQ ID NO: 2550713 - RNA, 20 nt, Chlamydophila pneumoniae J138
gcauaguguuccaaaacagg

SEQ ID NO: 2550714 - RNA, 14 nt, Chlamydophila pneumoniae J138
gcauauaaagacuc

SEQ ID NO: 2550715 - RNA, 23 nt, Chlamydophila pneumoniae J138
gcauauaaagacucucuuccaaa

SEQ ID NO: 2550716 - RNA, 15 nt, Chlamydophila pneumoniae J138
gcauaugcuccagaa

SEQ ID NO: 2550717 - RNA, 22 nt, Chlamydophila pneumoniae J138
gcauauucuaagcuuauuucug

SEQ ID NO: 2550718 - RNA, 17 nt, Chlamydophila pneumoniae J138
gcaucacgaaaaggaga

SEQ ID NO: 2550719 - RNA, 23 nt, Chlamydophila pneumoniae J138
gcaucacggaguguuugaagaug

SEQ ID NO: 2550720 - RNA, 19 nt, Chlamydophila pneumoniae J138
gcaucagaaucguucccau

SEQ ID NO: 2550721 - RNA, 13 nt, Chlamydophila pneumoniae J138
gcaucauugaaac

SEQ ID NO: 2550722 - RNA, 21 nt, Chlamydophila pneumoniae J138
gcaucccccgcgccacaucaa

SEQ ID NO: 2550723 - RNA, 14 nt, Chlamydophila pneumoniae J138
gcaucccuucuucu

SEQ ID NO: 2550724 - RNA, 19 nt, Chlamydophila pneumoniae J138
gcaucccuucuucuuuuag

SEQ ID NO: 2550725 - RNA, 13 nt, Chlamydophila pneumoniae J138
gcaucuaagccag

SEQ ID NO: 2550726 - RNA, 13 nt, Chlamydophila pneumoniae J138
gcaucuagagucu

SEQ ID NO: 2550727 - RNA, 13 nt, Chlamydophila pneumoniae J138
gcaucucucucca

SEQ ID NO: 2550728 - RNA, 15 nt, Chlamydophila pneumoniae J138
gcaucuuauggaaga

SEQ ID NO: 2550729 - RNA, 15 nt, Chlamydophila pneumoniae J138
gaguaucuagcuuug

SEQ ID NO: 2550730 - RNA, 16 nt, Chlamydophila pneumoniae J138
gaguauggcaaauaaa

SEQ ID NO: 2550731 - RNA, 19 nt, Chlamydophila pneumoniae J138
gagucacggcaaugauagg

SEQ ID NO: 2550732 - RNA, 18 nt, Chlamydophila pneumoniae J138
gaguccaagguucuggga

SEQ ID NO: 2550733 - RNA, 19 nt, Chlamydophila pneumoniae J138
gagucccuugucaacaaaa

SEQ ID NO: 2550734 - RNA, 23 nt, Chlamydophila pneumoniae J138
gagucccuugucaacaaaagcua

SEQ ID NO: 2550735 - RNA, 14 nt, Chlamydophila pneumoniae J138
gaguccuaaaauuu

SEQ ID NO: 2550736 - RNA, 14 nt, Chlamydophila pneumoniae J138
gaguccuucuuuuc

SEQ ID NO: 2550737 - RNA, 23 nt, Chlamydophila pneumoniae J138
gaguccuuuuuguucaaagauug

SEQ ID NO: 2550738 - RNA, 22 nt, Chlamydophila pneumoniae J138
gagucgaaacacucaugaaagu

SEQ ID NO: 2550739 - RNA, 15 nt, Chlamydophila pneumoniae J138
gagucgauuucccag

SEQ ID NO: 2550740 - RNA, 16 nt, Chlamydophila pneumoniae J138
gagucgugcaggagaa

SEQ ID NO: 2550741 - RNA, 21 nt, Chlamydophila pneumoniae J138
gagucucacucuuuucuagaa

SEQ ID NO: 2550742 - RNA, 14 nt, Chlamydophila pneumoniae J138
gagucucuugauuc

SEQ ID NO: 2550743 - RNA, 13 nt, Chlamydophila pneumoniae J138
gagucucuuucag

SEQ ID NO: 2550744 - RNA, 19 nt, Chlamydophila pneumoniae J138
gagucucuuucagcucaag

SEQ ID NO: 2550745 - RNA, 22 nt, Chlamydophila pneumoniae J138
gagucugaacauucuuaauauc

SEQ ID NO: 2550746 - RNA, 21 nt, Chlamydophila pneumoniae J138
gagucugcagcagaugaaacu

SEQ ID NO: 2550747 - RNA, 21 nt, Chlamydophila pneumoniae J138
gagugacaccaacaacaauaa

SEQ ID NO: 2550748 - RNA, 15 nt, Chlamydophila pneumoniae J138
gagugccuucuucaa

SEQ ID NO: 2550749 - RNA, 15 nt, Chlamydophila pneumoniae J138
gaguguauuguaaag

SEQ ID NO: 2550750 - RNA, 20 nt, Chlamydophila pneumoniae J138
gaguguuguuggagcagaaa

SEQ ID NO: 2550751 - RNA, 20 nt, Chlamydophila pneumoniae J138
gaguuccgcaaauacagaca

SEQ ID NO: 2550752 - RNA, 20 nt, Chlamydophila pneumoniae J138
gaguucgcgaccugugauuu

SEQ ID NO: 2550753 - RNA, 18 nt, Chlamydophila pneumoniae J138
gaguucgcggaucuucuu

SEQ ID NO: 2550754 - RNA, 17 nt, Chlamydophila pneumoniae J138
gaguucucucuucacuc

SEQ ID NO: 2550755 - RNA, 23 nt, Chlamydophila pneumoniae J138
gaguucuuccuucuucuucaaag

SEQ ID NO: 2550756 - RNA, 14 nt, Chlamydophila pneumoniae J138
gaguucuugauucu

SEQ ID NO: 2550757 - RNA, 17 nt, Chlamydophila pneumoniae J138
gaguucuuguaauaaaa

SEQ ID NO: 2550758 - RNA, 16 nt, Chlamydophila pneumoniae J138
gaguucuuuuguuugu

SEQ ID NO: 2550759 - RNA, 22 nt, Chlamydophila pneumoniae J138
gaguugccaggaaacguucuuu

SEQ ID NO: 2550760 - RNA, 19 nt, Chlamydophila pneumoniae J138
gaguuggagaauugaaaau

SEQ ID NO: 2550761 - RNA, 13 nt, Chlamydophila pneumoniae J138
gaguuucuaaugu

SEQ ID NO: 2550762 - RNA, 19 nt, Chlamydophila pneumoniae J138
gaguuucuuauucacugga

SEQ ID NO: 2550763 - RNA, 12 nt, Chlamydophila pneumoniae J138
gaguuuuccuaa

SEQ ID NO: 2550764 - RNA, 13 nt, Chlamydophila pneumoniae J138
gaguuuuuuucuu

SEQ ID NO: 2550765 - RNA, 19 nt, Chlamydophila pneumoniae J138
gauaaaacgcuauuguuug

SEQ ID NO: 2550766 - RNA, 13 nt, Chlamydophila pneumoniae J138
gauaaaacuauaa

SEQ ID NO: 2550767 - RNA, 16 nt, Chlamydophila pneumoniae J138
gauaaaagguauuucu

SEQ ID NO: 2550768 - RNA, 17 nt, Chlamydophila pneumoniae J138
gauaaacauuaagugau

SEQ ID NO: 2550769 - RNA, 21 nt, Chlamydophila pneumoniae J138
gauaaagaaguuuacaaauaa

SEQ ID NO: 2550770 - RNA, 16 nt, Chlamydophila pneumoniae J138
gauaaagccugcacga

SEQ ID NO: 2550771 - RNA, 14 nt, Chlamydophila pneumoniae J138
gauaacacuucuuu

SEQ ID NO: 2550772 - RNA, 16 nt, Chlamydophila pneumoniae J138
gauaacguugccuguu

SEQ ID NO: 2550773 - RNA, 22 nt, Chlamydophila pneumoniae J138
gauaagaagcucguacuguucc

SEQ ID NO: 2550774 - RNA, 16 nt, Chlamydophila pneumoniae J138
gauaagaccagaaagg

SEQ ID NO: 2550775 - RNA, 15 nt, Chlamydophila pneumoniae J138
gauaagaucucuccg

SEQ ID NO: 2550776 - RNA, 15 nt, Chlamydophila pneumoniae J138
gauaaguucuuccaa

SEQ ID NO: 2550777 - RNA, 12 nt, Chlamydophila pneumoniae J138
gauaauagagaa

SEQ ID NO: 2550778 - RNA, 12 nt, Chlamydophila pneumoniae J138
gauaaucagagg

SEQ ID NO: 2550779 - RNA, 19 nt, Chlamydophila pneumoniae J138
gauaaucagaggagccucc

SEQ ID NO: 2550780 - RNA, 20 nt, Chlamydophila pneumoniae J138
gauaaugaaguuugcaugca

SEQ ID NO: 2550781 - RNA, 19 nt, Chlamydophila pneumoniae J138
gauaaugucuccaucggaa

SEQ ID NO: 2550782 - RNA, 15 nt, Chlamydophila pneumoniae J138
gauacaucaucagaa

SEQ ID NO: 2550783 - RNA, 16 nt, Chlamydophila pneumoniae J138
gauaccaccuaaaaug

SEQ ID NO: 2550784 - RNA, 16 nt, Chlamydophila pneumoniae J138
gauacccaucuagaaa

SEQ ID NO: 2550785 - RNA, 21 nt, Chlamydophila pneumoniae J138
gauaccucuccgucauauuua

SEQ ID NO: 2550786 - RNA, 16 nt, Chlamydophila pneumoniae J138
gauacgaauaaguuuu

SEQ ID NO: 2550787 - RNA, 23 nt, Chlamydophila pneumoniae J138
gauacgugcagugaauccuucca

SEQ ID NO: 2550788 - RNA, 17 nt, Chlamydophila pneumoniae J138
gauacguuuuucccuuu

SEQ ID NO: 2550789 - RNA, 20 nt, Chlamydophila pneumoniae J138
gauacuguuuuuuaucuccu

SEQ ID NO: 2550790 - RNA, 22 nt, Chlamydophila pneumoniae J138
gauagaucacaucaagauagag

SEQ ID NO: 2550791 - RNA, 13 nt, Chlamydophila pneumoniae J138
gauagcaaaucaa

SEQ ID NO: 2550792 - RNA, 18 nt, Chlamydophila pneumoniae J138
gauagcuaaaccuucaga

SEQ ID NO: 2550793 - RNA, 20 nt, Chlamydophila pneumoniae J138
gauaggaucuucuauuuuuu

SEQ ID NO: 2550794 - RNA, 17 nt, Chlamydophila pneumoniae J138
gauaggcuggaacuguu

SEQ ID NO: 2550795 - RNA, 13 nt, Chlamydophila pneumoniae J138
gauagggaauuuc

SEQ ID NO: 2550796 - RNA, 16 nt, Chlamydophila pneumoniae J138
gauaguaucguaagcc

SEQ ID NO: 2550797 - RNA, 20 nt, Chlamydophila pneumoniae J138
gauagugguagcaaucugua

SEQ ID NO: 2550798 - RNA, 22 nt, Chlamydophila pneumoniae J138
gauaguguucgagcaucucaag

SEQ ID NO: 2550799 - RNA, 21 nt, Chlamydophila pneumoniae J138
gauaguucacaagugcauuau

SEQ ID NO: 2550800 - RNA, 19 nt, Chlamydophila pneumoniae J138
gauauaagacuccaaguca

SEQ ID NO: 2550801 - RNA, 20 nt, Chlamydophila pneumoniae J138
gauauagcguacaggaaguc

SEQ ID NO: 2550802 - RNA, 11 nt, Chlamydophila pneumoniae J138
gauauauagag

SEQ ID NO: 2550803 - RNA, 15 nt, Chlamydophila pneumoniae J138
gauauauuuuuaaag

SEQ ID NO: 2550804 - RNA, 16 nt, Chlamydophila pneumoniae J138
gauauccaccuuacca

SEQ ID NO: 2550805 - RNA, 16 nt, Chlamydophila pneumoniae J138
gauaucccacagaaau

SEQ ID NO: 2550806 - RNA, 19 nt, Chlamydophila pneumoniae J138
gauaucccacagaaauguc

SEQ ID NO: 2550807 - RNA, 17 nt, Chlamydophila pneumoniae J138
gauaucuauaaauguag

SEQ ID NO: 2550808 - RNA, 21 nt, Chlamydophila pneumoniae J138
gauaucugcucccuccuccuc

SEQ ID NO: 2550809 - RNA, 13 nt, Chlamydophila pneumoniae J138
gauaucuuguaca

SEQ ID NO: 2550810 - RNA, 15 nt, Chlamydophila pneumoniae J138
gauaugaagagacgu

SEQ ID NO: 2550811 - RNA, 15 nt, Chlamydophila pneumoniae J138
gauaugcugaauucc

SEQ ID NO: 2550812 - RNA, 20 nt, Chlamydophila pneumoniae J138
gauauuacagauuucuucuu

SEQ ID NO: 2550813 - RNA, 23 nt, Chlamydophila pneumoniae J138
gauauucugauucuccguccccc

SEQ ID NO: 2550814 - RNA, 14 nt, Chlamydophila pneumoniae J138
gauauugcggaaau

SEQ ID NO: 2550815 - RNA, 19 nt, Chlamydophila pneumoniae J138
gauauuuuuauuuaaaauu

SEQ ID NO: 2550816 - RNA, 17 nt, Chlamydophila pneumoniae J138
gaucaaagauuccuaag

SEQ ID NO: 2550817 - RNA, 17 nt, Chlamydophila pneumoniae J138
gaucaaauuccuucuca

SEQ ID NO: 2550818 - RNA, 19 nt, Chlamydophila pneumoniae J138
gaucaaauuccuucucaga

SEQ ID NO: 2550819 - RNA, 16 nt, Chlamydophila pneumoniae J138
gaucacaagaaagaau

SEQ ID NO: 2550820 - RNA, 17 nt, Chlamydophila pneumoniae J138
gaucagaaaaaaugcgu

SEQ ID NO: 2550821 - RNA, 16 nt, Chlamydophila pneumoniae J138
gaucaucuucacuaaa

SEQ ID NO: 2550822 - RNA, 23 nt, Chlamydophila pneumoniae J138
gaucauggauucacaucuuaaaa

SEQ ID NO: 2550823 - RNA, 23 nt, Chlamydophila pneumoniae J138
gaucauuagcaucaucuccugaa

SEQ ID NO: 2550824 - RNA, 16 nt, Chlamydophila pneumoniae J138
gaucauucuuuauaaa

SEQ ID NO: 2550825 - RNA, 20 nt, Chlamydophila pneumoniae J138
gauccagcccccaggcugca

SEQ ID NO: 2550826 - RNA, 14 nt, Chlamydophila pneumoniae J138
gauccauaaccuuu

SEQ ID NO: 2550827 - RNA, 13 nt, Chlamydophila pneumoniae J138
gauccaucugcuc

SEQ ID NO: 2550828 - RNA, 20 nt, Chlamydophila pneumoniae J138
gaucccaucaucgagcugau

SEQ ID NO: 2550829 - RNA, 17 nt, Chlamydophila pneumoniae J138
gaucccgaagcaaucca

SEQ ID NO: 2550830 - RNA, 17 nt, Chlamydophila pneumoniae J138
gauucuuaucacaaauu

SEQ ID NO: 2550831 - RNA, 13 nt, Chlamydophila pneumoniae J138
gauugaaacuuuu

SEQ ID NO: 2550832 - RNA, 21 nt, Chlamydophila pneumoniae J138
gauugaggauaaguucuucca

SEQ ID NO: 2550833 - RNA, 13 nt, Chlamydophila pneumoniae J138
gauugauaacaau

SEQ ID NO: 2550834 - RNA, 21 nt, Chlamydophila pneumoniae J138
gauugcaguugcuguggcaua

SEQ ID NO: 2550835 - RNA, 14 nt, Chlamydophila pneumoniae J138
gauuggaugagaau

SEQ ID NO: 2550836 - RNA, 15 nt, Chlamydophila pneumoniae J138
gauuggaugagaauu

SEQ ID NO: 2550837 - RNA, 20 nt, Chlamydophila pneumoniae J138
gauuggaugauagcuaugag

SEQ ID NO: 2550838 - RNA, 14 nt, Chlamydophila pneumoniae J138
gauugguaaggaga

SEQ ID NO: 2550839 - RNA, 15 nt, Chlamydophila pneumoniae J138
gauugugcucaauac

SEQ ID NO: 2550840 - RNA, 17 nt, Chlamydophila pneumoniae J138
gauuguuauugaguguu

SEQ ID NO: 2550841 - RNA, 22 nt, Chlamydophila pneumoniae J138
gauuuaaaagguuuugaagcuc

SEQ ID NO: 2550842 - RNA, 20 nt, Chlamydophila pneumoniae J138
gauuuagaaucuuuucuaga

SEQ ID NO: 2550843 - RNA, 23 nt, Chlamydophila pneumoniae J138
gauuuccaauccauucugagaaa

SEQ ID NO: 2550844 - RNA, 20 nt, Chlamydophila pneumoniae J138
gauuuccccuucagaggcua

SEQ ID NO: 2550845 - RNA, 17 nt, Chlamydophila pneumoniae J138
gauuuccuagguucuuu

SEQ ID NO: 2550846 - RNA, 15 nt, Chlamydophila pneumoniae J138
gauuuccuuuuggga

SEQ ID NO: 2550847 - RNA, 16 nt, Chlamydophila pneumoniae J138
gauuucuccagcagcu

SEQ ID NO: 2550848 - RNA, 19 nt, Chlamydophila pneumoniae J138
gauuucuucuucagagcuc

SEQ ID NO: 2550849 - RNA, 13 nt, Chlamydophila pneumoniae J138
gauuucuucuucu

SEQ ID NO: 2550850 - RNA, 16 nt, Chlamydophila pneumoniae J138
gauuucuucuucuaaa

SEQ ID NO: 2550851 - RNA, 18 nt, Chlamydophila pneumoniae J138
gauuucuuuauucccuuu

SEQ ID NO: 2550852 - RNA, 14 nt, Chlamydophila pneumoniae J138
gauuucuuuuucag

SEQ ID NO: 2550853 - RNA, 14 nt, Chlamydophila pneumoniae J138
gauuugcauuaccu

SEQ ID NO: 2550854 - RNA, 18 nt, Chlamydophila pneumoniae J138
gauuuggaagauugaagg

SEQ ID NO: 2550855 - RNA, 13 nt, Chlamydophila pneumoniae J138
gauuuuaaagccu

SEQ ID NO: 2550856 - RNA, 19 nt, Chlamydophila pneumoniae J138
gauuuucgguuacuuuaau

SEQ ID NO: 2550857 - RNA, 21 nt, Chlamydophila pneumoniae J138
gauuuucuagaaacaacugaa

SEQ ID NO: 2550858 - RNA, 21 nt, Chlamydophila pneumoniae J138
gauuuugcagugauaaaccaa

SEQ ID NO: 2550859 - RNA, 11 nt, Chlamydophila pneumoniae J138
gauuuugugag

SEQ ID NO: 2550860 - RNA, 16 nt, Chlamydophila pneumoniae J138
gauuuuuagaauagaa

SEQ ID NO: 2550861 - RNA, 14 nt, Chlamydophila pneumoniae J138
gauuuuucuuuuag

SEQ ID NO: 2550862 - RNA, 21 nt, Chlamydophila pneumoniae J138
gauuuuugcuaagagcucuuu

SEQ ID NO: 2550863 - RNA, 13 nt, Chlamydophila pneumoniae J138
gauuuuuucuugg

SEQ ID NO: 2550864 - RNA, 19 nt, Chlamydophila pneumoniae J138
gauuuuuuugguugcuucu

SEQ ID NO: 2550865 - RNA, 16 nt, Chlamydophila pneumoniae J138
gcaaaaaacugcaaaa

SEQ ID NO: 2550866 - RNA, 15 nt, Chlamydophila pneumoniae J138
gcaaaaauucuaggu

SEQ ID NO: 2550867 - RNA, 17 nt, Chlamydophila pneumoniae J138
gcaaaagcaaggcugcc

SEQ ID NO: 2550868 - RNA, 17 nt, Chlamydophila pneumoniae J138
gcaaacacaauuguaaa

SEQ ID NO: 2550869 - RNA, 14 nt, Chlamydophila pneumoniae J138
gcaaacagguauuu

SEQ ID NO: 2550870 - RNA, 12 nt, Chlamydophila pneumoniae J138
gcaaacgcaaug

SEQ ID NO: 2550871 - RNA, 15 nt, Chlamydophila pneumoniae J138
gcaaacggaacuaaa

SEQ ID NO: 2550872 - RNA, 17 nt, Chlamydophila pneumoniae J138
gcaaacggagagcauuu

SEQ ID NO: 2550873 - RNA, 14 nt, Chlamydophila pneumoniae J138
gcaaacuccccagu

SEQ ID NO: 2550874 - RNA, 15 nt, Chlamydophila pneumoniae J138
gcaaacuccccaguu

SEQ ID NO: 2550875 - RNA, 12 nt, Chlamydophila pneumoniae J138
gcaaagaaaauu

SEQ ID NO: 2550876 - RNA, 15 nt, Chlamydophila pneumoniae J138
gcaaagauaaagaag

SEQ ID NO: 2550877 - RNA, 15 nt, Chlamydophila pneumoniae J138
gcaaagcccccuccc

SEQ ID NO: 2550878 - RNA, 18 nt, Chlamydophila pneumoniae J138
gcaaagcccccuccccca

SEQ ID NO: 2550879 - RNA, 23 nt, Chlamydophila pneumoniae J138
gcaaagcugacaacaaaugugac

SEQ ID NO: 2550880 - RNA, 18 nt, Chlamydophila pneumoniae J138
gcaaaguacuacaauaac

SEQ ID NO: 2550881 - RNA, 17 nt, Chlamydophila pneumoniae J138
gcaaauaaaguccucca

SEQ ID NO: 2550882 - RNA, 18 nt, Chlamydophila pneumoniae J138
gcaaauaagccaguacua

SEQ ID NO: 2550883 - RNA, 11 nt, Chlamydophila pneumoniae J138
gcaaauauagu

SEQ ID NO: 2550884 - RNA, 23 nt, Chlamydophila pneumoniae J138
gcaaauccugcucguaaaucugg

SEQ ID NO: 2550885 - RNA, 18 nt, Chlamydophila pneumoniae J138
gcaaaucuaaaaccugac

SEQ ID NO: 2550886 - RNA, 21 nt, Chlamydophila pneumoniae J138
gcaaaucuuacauaaaccuuu

SEQ ID NO: 2550887 - RNA, 22 nt, Chlamydophila pneumoniae J138
gcaacaguaauuauuuucuaca

SEQ ID NO: 2550888 - RNA, 23 nt, Chlamydophila pneumoniae J138
gcaacauccauucuuaauauaaa

SEQ ID NO: 2550889 - RNA, 21 nt, Chlamydophila pneumoniae J138
gcaaccuguaaagaccaaaua

SEQ ID NO: 2550890 - RNA, 16 nt, Chlamydophila pneumoniae J138
gcaacgcgauuuucaa

SEQ ID NO: 2550891 - RNA, 22 nt, Chlamydophila pneumoniae J138
gcaacuaaacugggaagaccac

SEQ ID NO: 2550892 - RNA, 16 nt, Chlamydophila pneumoniae J138
gcaacucuuuaggucu

SEQ ID NO: 2550893 - RNA, 18 nt, Chlamydophila pneumoniae J138
gcaacucuuuaggucuug

SEQ ID NO: 2550894 - RNA, 21 nt, Chlamydophila pneumoniae J138
gcaacucuuuaggucuugucu

SEQ ID NO: 2550895 - RNA, 18 nt, Chlamydophila pneumoniae J138
gcaagagacaagaaaaua

SEQ ID NO: 2550896 - RNA, 20 nt, Chlamydophila pneumoniae J138
gcaagagcucuugagaaagc

SEQ ID NO: 2550897 - RNA, 18 nt, Chlamydophila pneumoniae J138
gcaagaucuaacuucacc

SEQ ID NO: 2550898 - RNA, 16 nt, Chlamydophila pneumoniae J138
gcaagccgcaaaccau

SEQ ID NO: 2550899 - RNA, 17 nt, Chlamydophila pneumoniae J138
gcaagccgcaaaccauc

SEQ ID NO: 2550900 - RNA, 18 nt, Chlamydophila pneumoniae J138
gcaagcucgcguauuuuc

SEQ ID NO: 2550901 - RNA, 19 nt, Chlamydophila pneumoniae J138
gcaagcuguggcgauuuua

SEQ ID NO: 2550902 - RNA, 19 nt, Chlamydophila pneumoniae J138
gcaagcuucuuguuuuugu

SEQ ID NO: 2550903 - RNA, 14 nt, Chlamydophila pneumoniae J138
gcaaggagcucccu

SEQ ID NO: 2550904 - RNA, 13 nt, Chlamydophila pneumoniae J138
gcaaggagcuuuu

SEQ ID NO: 2550905 - RNA, 13 nt, Chlamydophila pneumoniae J138
gcaaggcaaugau

SEQ ID NO: 2550906 - RNA, 14 nt, Chlamydophila pneumoniae J138
gcaaggcaaugaua

SEQ ID NO: 2550907 - RNA, 15 nt, Chlamydophila pneumoniae J138
gcaagggcggagaau

SEQ ID NO: 2550908 - RNA, 21 nt, Chlamydophila pneumoniae J138
gcaagguaacauccauagaga

SEQ ID NO: 2550909 - RNA, 13 nt, Chlamydophila pneumoniae J138
gcaaguaaagaaa

SEQ ID NO: 2550910 - RNA, 14 nt, Chlamydophila pneumoniae J138
gcaaguaaagaaau

SEQ ID NO: 2550911 - RNA, 15 nt, Chlamydophila pneumoniae J138
gcaaguaaagaaauu

SEQ ID NO: 2550912 - RNA, 22 nt, Chlamydophila pneumoniae J138
gcaaguuguugauaauuacaga

SEQ ID NO: 2550913 - RNA, 15 nt, Chlamydophila pneumoniae J138
gcaauacuaagaagc

SEQ ID NO: 2550914 - RNA, 19 nt, Chlamydophila pneumoniae J138
gcaauagacacuugcuuaa

SEQ ID NO: 2550915 - RNA, 21 nt, Chlamydophila pneumoniae J138
gcaauaggacucgaugaaacu

SEQ ID NO: 2550916 - RNA, 15 nt, Chlamydophila pneumoniae J138
gcaauaucuauagaa

SEQ ID NO: 2550917 - RNA, 17 nt, Chlamydophila pneumoniae J138
gcaauaucuauagaagg

SEQ ID NO: 2550918 - RNA, 14 nt, Chlamydophila pneumoniae J138
gcaaucagcaacau

SEQ ID NO: 2550919 - RNA, 17 nt, Chlamydophila pneumoniae J138
gcaauccaggaauagaa

SEQ ID NO: 2550920 - RNA, 18 nt, Chlamydophila pneumoniae J138
gcaauccaggaauagaaa

SEQ ID NO: 2550921 - RNA, 17 nt, Chlamydophila pneumoniae J138
gcaauccaguagaucuu

SEQ ID NO: 2550922 - RNA, 23 nt, Chlamydophila pneumoniae J138
gcaauccauaguccuagcagaga

SEQ ID NO: 2550923 - RNA, 23 nt, Chlamydophila pneumoniae J138
gcaaucguguuuuccugagcuuu

SEQ ID NO: 2550924 - RNA, 16 nt, Chlamydophila pneumoniae J138
gcaaucugaaugccug

SEQ ID NO: 2550925 - RNA, 21 nt, Chlamydophila pneumoniae J138
gcaaugauagauaaaucccca

SEQ ID NO: 2550926 - RNA, 15 nt, Chlamydophila pneumoniae J138
gcaaugauauccuca

SEQ ID NO: 2550927 - RNA, 16 nt, Chlamydophila pneumoniae J138
gcaaugcuucuucagc

SEQ ID NO: 2550928 - RNA, 16 nt, Chlamydophila pneumoniae J138
gcaauuccgaagaaga

SEQ ID NO: 2550929 - RNA, 20 nt, Chlamydophila pneumoniae J138
gcaauucgguagagcuagaa

SEQ ID NO: 2550930 - RNA, 16 nt, Chlamydophila pneumoniae J138
gcaauuguuaaaagaa

SEQ ID NO: 2550931 - RNA, 20 nt, Chlamydophila pneumoniae J138
ggaagacucucaucagcaaa

SEQ ID NO: 2550932 - RNA, 20 nt, Chlamydophila pneumoniae J138
ggaagaugaauaccagaagc

SEQ ID NO: 2550933 - RNA, 21 nt, Chlamydophila pneumoniae J138
ggaagaugaauaccagaagca

SEQ ID NO: 2550934 - RNA, 14 nt, Chlamydophila pneumoniae J138
ggaagcaaagaaaa

SEQ ID NO: 2550935 - RNA, 16 nt, Chlamydophila pneumoniae J138
ggaagcaaagaaaauu

SEQ ID NO: 2550936 - RNA, 15 nt, Chlamydophila pneumoniae J138
ggaagccagucuuca

SEQ ID NO: 2550937 - RNA, 16 nt, Chlamydophila pneumoniae J138
ggaagcuuaucaagaa

SEQ ID NO: 2550938 - RNA, 20 nt, Chlamydophila pneumoniae J138
ggaaguccauguacagaaaa

SEQ ID NO: 2550939 - RNA, 19 nt, Chlamydophila pneumoniae J138
ggaauaacaccaaaagaau

SEQ ID NO: 2550940 - RNA, 18 nt, Chlamydophila pneumoniae J138
ggaauaauaggauaagaa

SEQ ID NO: 2550941 - RNA, 15 nt, Chlamydophila pneumoniae J138
ggaauacauuccuag

SEQ ID NO: 2550942 - RNA, 22 nt, Chlamydophila pneumoniae J138
ggaauaucaggacaaugaagaa

SEQ ID NO: 2550943 - RNA, 20 nt, Chlamydophila pneumoniae J138
ggaauccccaauguuuuccu

SEQ ID NO: 2550944 - RNA, 22 nt, Chlamydophila pneumoniae J138
ggaaucccugcacucuuucaga

SEQ ID NO: 2550945 - RNA, 22 nt, Chlamydophila pneumoniae J138
ggaauccuuuggaagcuaucau

SEQ ID NO: 2550946 - RNA, 20 nt, Chlamydophila pneumoniae J138
ggaaucuaagaacuagaaaa

SEQ ID NO: 2550947 - RNA, 12 nt, Chlamydophila pneumoniae J138
ggaaugaucccu

SEQ ID NO: 2550948 - RNA, 19 nt, Chlamydophila pneumoniae J138
ggaauggcuuuuguuuugu

SEQ ID NO: 2550949 - RNA, 22 nt, Chlamydophila pneumoniae J138
ggaauuagagaaauuuuuaauu

SEQ ID NO: 2550950 - RNA, 14 nt, Chlamydophila pneumoniae J138
ggacaaaucuccca

SEQ ID NO: 2550951 - RNA, 14 nt, Chlamydophila pneumoniae J138
ggacaauauagaga

SEQ ID NO: 2550952 - RNA, 14 nt, Chlamydophila pneumoniae J138
ggacaaucaacauu

SEQ ID NO: 2550953 - RNA, 15 nt, Chlamydophila pneumoniae J138
ggacaaugaagaacu

SEQ ID NO: 2550954 - RNA, 17 nt, Chlamydophila pneumoniae J138
ggacacaacucuuuaau

SEQ ID NO: 2550955 - RNA, 18 nt, Chlamydophila pneumoniae J138
ggacaccagcuucccaag

SEQ ID NO: 2550956 - RNA, 14 nt, Chlamydophila pneumoniae J138
ggacacuagaauac

SEQ ID NO: 2550957 - RNA, 19 nt, Chlamydophila pneumoniae J138
ggacacuauuaucugcaga

SEQ ID NO: 2550958 - RNA, 12 nt, Chlamydophila pneumoniae J138
ggacagaaagau

SEQ ID NO: 2550959 - RNA, 19 nt, Chlamydophila pneumoniae J138
ggacagcacauagagugug

SEQ ID NO: 2550960 - RNA, 13 nt, Chlamydophila pneumoniae J138
ggacaugccuuag

SEQ ID NO: 2550961 - RNA, 23 nt, Chlamydophila pneumoniae J138
ggaccuccucacauguuucacuu

SEQ ID NO: 2550962 - RNA, 17 nt, Chlamydophila pneumoniae J138
ggaccuguuuucuuuuc

SEQ ID NO: 2550963 - RNA, 17 nt, Chlamydophila pneumoniae J138
ggaccuuaagaugaggu

SEQ ID NO: 2550964 - RNA, 19 nt, Chlamydophila pneumoniae J138
ggaccuuggacucuagggu

SEQ ID NO: 2550965 - RNA, 21 nt, Chlamydophila pneumoniae J138
ggacgagaaccaaagcagugu

SEQ ID NO: 2550966 - RNA, 12 nt, Chlamydophila pneumoniae J138
ggacgugggaga

SEQ ID NO: 2550967 - RNA, 16 nt, Chlamydophila pneumoniae J138
ggacuaaacaagaaaa

SEQ ID NO: 2550968 - RNA, 20 nt, Chlamydophila pneumoniae J138
ggacuaaacaagaaaaagca

SEQ ID NO: 2550969 - RNA, 13 nt, Chlamydophila pneumoniae J138
ggacuacugaaac

SEQ ID NO: 2550970 - RNA, 14 nt, Chlamydophila pneumoniae J138
ggacuacugaaaca

SEQ ID NO: 2550971 - RNA, 22 nt, Chlamydophila pneumoniae J138
ggacuccaagaauagcaggaag

SEQ ID NO: 2550972 - RNA, 13 nt, Chlamydophila pneumoniae J138
ggacugcugacau

SEQ ID NO: 2550973 - RNA, 11 nt, Chlamydophila pneumoniae J138
ggacuucaaau

SEQ ID NO: 2550974 - RNA, 16 nt, Chlamydophila pneumoniae J138
ggacuuguguauuugc

SEQ ID NO: 2550975 - RNA, 23 nt, Chlamydophila pneumoniae J138
ggagaacaauaucagcagcuucu

SEQ ID NO: 2550976 - RNA, 10 nt, Chlamydophila pneumoniae J138
ggagaagccc

SEQ ID NO: 2550977 - RNA, 22 nt, Chlamydophila pneumoniae J138
ggagaagcuaagggaaauccac

SEQ ID NO: 2550978 - RNA, 18 nt, Chlamydophila pneumoniae J138
ggagaagucgaaagauca

SEQ ID NO: 2550979 - RNA, 23 nt, Chlamydophila pneumoniae J138
ggagaaguuguuuauuuagcauu

SEQ ID NO: 2550980 - RNA, 15 nt, Chlamydophila pneumoniae J138
ggagaauagcaagca

SEQ ID NO: 2550981 - RNA, 13 nt, Chlamydophila pneumoniae J138
ggagaauugaaaa

SEQ ID NO: 2550982 - RNA, 19 nt, Chlamydophila pneumoniae J138
ggagaccuuuauagauaug

SEQ ID NO: 2550983 - RNA, 15 nt, Chlamydophila pneumoniae J138
ggagagcgaaauaga

SEQ ID NO: 2550984 - RNA, 13 nt, Chlamydophila pneumoniae J138
ggagagggaagga

SEQ ID NO: 2550985 - RNA, 19 nt, Chlamydophila pneumoniae J138
ggagagguaaccagagagc

SEQ ID NO: 2550986 - RNA, 22 nt, Chlamydophila pneumoniae J138
ggagaugcuauuuacugaaaca

SEQ ID NO: 2550987 - RNA, 13 nt, Chlamydophila pneumoniae J138
ggagauuccuaaa

SEQ ID NO: 2550988 - RNA, 13 nt, Chlamydophila pneumoniae J138
ggagcuaaagcug

SEQ ID NO: 2550989 - RNA, 16 nt, Chlamydophila pneumoniae J138
ggagcuacugaaagau

SEQ ID NO: 2550990 - RNA, 19 nt, Chlamydophila pneumoniae J138
ggagcucuuucuuggauug

SEQ ID NO: 2550991 - RNA, 12 nt, Chlamydophila pneumoniae J138
ggagcuucuaag

SEQ ID NO: 2550992 - RNA, 17 nt, Chlamydophila pneumoniae J138
ggagcuugucuaggagc

SEQ ID NO: 2550993 - RNA, 13 nt, Chlamydophila pneumoniae J138
ggagggaaacacc

SEQ ID NO: 2550994 - RNA, 14 nt, Chlamydophila pneumoniae J138
ggagucacuggcau

SEQ ID NO: 2550995 - RNA, 20 nt, Chlamydophila pneumoniae J138
ggaguccuucuugcaaagau

SEQ ID NO: 2550996 - RNA, 14 nt, Chlamydophila pneumoniae J138
ggagucgugcagga

SEQ ID NO: 2550997 - RNA, 20 nt, Chlamydophila pneumoniae J138
ggagugaggaaucauaacca

SEQ ID NO: 2550998 - RNA, 22 nt, Chlamydophila pneumoniae J138
ggaguuucuuauucacuggaau

SEQ ID NO: 2550999 - RNA, 15 nt, Chlamydophila pneumoniae J138
ggauaaguucuucca

SEQ ID NO: 2551000 - RNA, 13 nt, Chlamydophila pneumoniae J138
ggauaauuaaacu

SEQ ID NO: 2551001 - RNA, 17 nt, Chlamydophila pneumoniae J138
ggauaggcaagauuaug

SEQ ID NO: 2551002 - RNA, 18 nt, Chlamydophila pneumoniae J138
ggauauacaauccagaau

SEQ ID NO: 2551003 - RNA, 20 nt, Chlamydophila pneumoniae J138
ggauauugucaagaggcugu

SEQ ID NO: 2551004 - RNA, 17 nt, Chlamydophila pneumoniae J138
ggaucacagucuuaaau

SEQ ID NO: 2551005 - RNA, 20 nt, Chlamydophila pneumoniae J138
ggaucauauuuauuuaaacc

SEQ ID NO: 2551006 - RNA, 17 nt, Chlamydophila pneumoniae J138
ggaucauguagcagagc

SEQ ID NO: 2551007 - RNA, 14 nt, Chlamydophila pneumoniae J138
ggaucauugaguuc

SEQ ID NO: 2551008 - RNA, 15 nt, Chlamydophila pneumoniae J138
ggauccaucggcauu

SEQ ID NO: 2551009 - RNA, 13 nt, Chlamydophila pneumoniae J138
ggaucccaucauc

SEQ ID NO: 2551010 - RNA, 15 nt, Chlamydophila pneumoniae J138
ggaucccguaaaaga

SEQ ID NO: 2551011 - RNA, 20 nt, Chlamydophila pneumoniae J138
ggaucgcucucuccaugagc

SEQ ID NO: 2551012 - RNA, 20 nt, Chlamydophila pneumoniae J138
ggaucucaucauaaauaggc

SEQ ID NO: 2551013 - RNA, 18 nt, Chlamydophila pneumoniae J138
ggaucucucuuuccuuag

SEQ ID NO: 2551014 - RNA, 23 nt, Chlamydophila pneumoniae J138
ggaucuucuucuggcugagagaa

SEQ ID NO: 2551015 - RNA, 16 nt, Chlamydophila pneumoniae J138
ggaucuugauaaaaga

SEQ ID NO: 2551016 - RNA, 19 nt, Chlamydophila pneumoniae J138
ggaucuuuucuuucuaaga

SEQ ID NO: 2551017 - RNA, 20 nt, Chlamydophila pneumoniae J138
ggaucuuuucuuucuaagau

SEQ ID NO: 2551018 - RNA, 18 nt, Chlamydophila pneumoniae J138
ggauggacuacugaaaca

SEQ ID NO: 2551019 - RNA, 17 nt, Chlamydophila pneumoniae J138
ggaugucuuguugcaug

SEQ ID NO: 2551020 - RNA, 11 nt, Chlamydophila pneumoniae J138
ggaugugaugu

SEQ ID NO: 2551021 - RNA, 13 nt, Chlamydophila pneumoniae J138
ggauguucaaagc

SEQ ID NO: 2551022 - RNA, 14 nt, Chlamydophila pneumoniae J138
ggauguugcguuag

SEQ ID NO: 2551023 - RNA, 15 nt, Chlamydophila pneumoniae J138
ggauuaguaacuaaa

SEQ ID NO: 2551024 - RNA, 18 nt, Chlamydophila pneumoniae J138
ggauuaucccaaacuucu

SEQ ID NO: 2551025 - RNA, 22 nt, Chlamydophila pneumoniae J138
ggauuaucccaaacuucuucuc

SEQ ID NO: 2551026 - RNA, 20 nt, Chlamydophila pneumoniae J138
ggauucaaauuugcucuccu

SEQ ID NO: 2551027 - RNA, 15 nt, Chlamydophila pneumoniae J138
ggauucacaucuuaa

SEQ ID NO: 2551028 - RNA, 16 nt, Chlamydophila pneumoniae J138
ggauucugucuauaag

SEQ ID NO: 2551029 - RNA, 19 nt, Chlamydophila pneumoniae J138
ggauugcuucgggaucuaa

SEQ ID NO: 2551030 - RNA, 16 nt, Chlamydophila pneumoniae J138
ggauuucuucuucuaa

SEQ ID NO: 2551031 - RNA, 20 nt, Chlamydophila pneumoniae J138
ggcaacaacgccuacaugga

SEQ ID NO: 2551032 - RNA, 15 nt, Chlamydophila pneumoniae J138
ggcaacaagagcgca

SEQ ID NO: 2551033 - RNA, 22 nt, Chlamydophila pneumoniae J138
ggcaacaagagcgcauuuuaca

SEQ ID NO: 2551034 - RNA, 16 nt, Chlamydophila pneumoniae J138
ggcaaguguuuuucug

SEQ ID NO: 2551035 - RNA, 13 nt, Chlamydophila pneumoniae J138
ggcaauagcuuug

SEQ ID NO: 2551036 - RNA, 15 nt, Chlamydophila pneumoniae J138
ggcaauagcuuugaa

SEQ ID NO: 2551037 - RNA, 15 nt, Chlamydophila pneumoniae J138
ggcaaucuaaaauca

SEQ ID NO: 2551038 - RNA, 19 nt, Chlamydophila pneumoniae J138
ggcaaugauagauaaaucc

SEQ ID NO: 2551039 - RNA, 13 nt, Chlamydophila pneumoniae J138
ggcaaugauaggg

SEQ ID NO: 2551040 - RNA, 19 nt, Chlamydophila pneumoniae J138
ggcaccaacacuuuuaaag

SEQ ID NO: 2551041 - RNA, 17 nt, Chlamydophila pneumoniae J138
ggcaggaaugagcggca

SEQ ID NO: 2551042 - RNA, 21 nt, Chlamydophila pneumoniae J138
ggcagugugggcaaugcuugu

SEQ ID NO: 2551043 - RNA, 13 nt, Chlamydophila pneumoniae J138
ggcaucuaagcca

SEQ ID NO: 2551044 - RNA, 14 nt, Chlamydophila pneumoniae J138
ggcaucuagagucu

SEQ ID NO: 2551045 - RNA, 12 nt, Chlamydophila pneumoniae J138
ggcaucuuuuac

SEQ ID NO: 2551046 - RNA, 16 nt, Chlamydophila pneumoniae J138
ggcaugaaagauaaug

SEQ ID NO: 2551047 - RNA, 23 nt, Chlamydophila pneumoniae J138
ggccaguuacugucugcaaagag

SEQ ID NO: 2551048 - RNA, 17 nt, Chlamydophila pneumoniae J138
ggccaucauuaaguacu

SEQ ID NO: 2551049 - RNA, 14 nt, Chlamydophila pneumoniae J138
ggccccuggaauuu

SEQ ID NO: 2551050 - RNA, 14 nt, Chlamydophila pneumoniae J138
ggccucaacacgcu

SEQ ID NO: 2551051 - RNA, 12 nt, Chlamydophila pneumoniae J138
ggcguuuuugca

SEQ ID NO: 2551052 - RNA, 13 nt, Chlamydophila pneumoniae J138
ggcuaaagaaaag

SEQ ID NO: 2551053 - RNA, 14 nt, Chlamydophila pneumoniae J138
ggcuaaauaaacca

SEQ ID NO: 2551054 - RNA, 14 nt, Chlamydophila pneumoniae J138
ggcuauagaauaca

SEQ ID NO: 2551055 - RNA, 18 nt, Chlamydophila pneumoniae J138
ggcuauagaauacacagc

SEQ ID NO: 2551056 - RNA, 11 nt, Chlamydophila pneumoniae J138
ggcucaaagaa

SEQ ID NO: 2551057 - RNA, 12 nt, Chlamydophila pneumoniae J138
ggcuccagcaua

SEQ ID NO: 2551058 - RNA, 23 nt, Chlamydophila pneumoniae J138
ggcuccucguuaauaagaaccuc

SEQ ID NO: 2551059 - RNA, 22 nt, Chlamydophila pneumoniae J138
ggcucuaggacccguagccccu

SEQ ID NO: 2551060 - RNA, 18 nt, Chlamydophila pneumoniae J138
ggcucuccuaaaccauca

SEQ ID NO: 2551061 - RNA, 23 nt, Chlamydophila pneumoniae J138
ggcucucgacacuauguguuucc

SEQ ID NO: 2551062 - RNA, 19 nt, Chlamydophila pneumoniae J138
ggcugagacauauugaaga

SEQ ID NO: 2551063 - RNA, 14 nt, Chlamydophila pneumoniae J138
ggcugagagaagca

SEQ ID NO: 2551064 - RNA, 24 nt, Chlamydophila pneumoniae J138
ggcugauucucccaauauccagaa

SEQ ID NO: 2551065 - RNA, 22 nt, Chlamydophila pneumoniae J138
ggcugcuuuuguuguuuuugcu

SEQ ID NO: 2551066 - RNA, 22 nt, Chlamydophila pneumoniae J138
ggcuucagagauuuuaaagccu

SEQ ID NO: 2551067 - RNA, 18 nt, Chlamydophila pneumoniae J138
ggcuucauuccuacaucu

SEQ ID NO: 2551068 - RNA, 20 nt, Chlamydophila pneumoniae J138
ggcuuuaaguguuucuucau

SEQ ID NO: 2551069 - RNA, 20 nt, Chlamydophila pneumoniae J138
ggcuuugggcaucucucuuu

SEQ ID NO: 2551070 - RNA, 18 nt, Chlamydophila pneumoniae J138
ggcuuuucuuuuucuagg

SEQ ID NO: 2551071 - RNA, 17 nt, Chlamydophila pneumoniae J138
gggaaaguaccuuuaac

SEQ ID NO: 2551072 - RNA, 11 nt, Chlamydophila pneumoniae J138
gggaaaucuaa

SEQ ID NO: 2551073 - RNA, 21 nt, Chlamydophila pneumoniae J138
gggaacaacugugguuuuaaa

SEQ ID NO: 2551074 - RNA, 19 nt, Chlamydophila pneumoniae J138
gggaagaaacuucucuagg

SEQ ID NO: 2551075 - RNA, 16 nt, Chlamydophila pneumoniae J138
gggaaggggagauucc

SEQ ID NO: 2551076 - RNA, 15 nt, Chlamydophila pneumoniae J138
gggaauuaaacuuuc

SEQ ID NO: 2551077 - RNA, 18 nt, Chlamydophila pneumoniae J138
gggaauucuuuuccugca

SEQ ID NO: 2551078 - RNA, 14 nt, Chlamydophila pneumoniae J138
gggagagccauuuu

SEQ ID NO: 2551079 - RNA, 12 nt, Chlamydophila pneumoniae J138
gggagaugcuau

SEQ ID NO: 2551080 - RNA, 15 nt, Chlamydophila pneumoniae J138
gggagcuagaaaguc

SEQ ID NO: 2551081 - RNA, 10 nt, Chlamydophila pneumoniae J138
gggagcuucc

SEQ ID NO: 2551082 - RNA, 16 nt, Chlamydophila pneumoniae J138
gggaggaauuccucuc

SEQ ID NO: 2551083 - RNA, 21 nt, Chlamydophila pneumoniae J138
gggauaaaacuauaaaagcca

SEQ ID NO: 2551084 - RNA, 20 nt, Chlamydophila pneumoniae J138
gggauaaugcucacuucuuu

SEQ ID NO: 2551085 - RNA, 19 nt, Chlamydophila pneumoniae J138
gggauaggcaagauuauga

SEQ ID NO: 2551086 - RNA, 20 nt, Chlamydophila pneumoniae J138
gggaucacagucuuaaaucc

SEQ ID NO: 2551087 - RNA, 14 nt, Chlamydophila pneumoniae J138
gggauggucaggaa

SEQ ID NO: 2551088 - RNA, 15 nt, Chlamydophila pneumoniae J138
gggauugauaacaau

SEQ ID NO: 2551089 - RNA, 20 nt, Chlamydophila pneumoniae J138
gggauuguucuuuacuacau

SEQ ID NO: 2551090 - RNA, 18 nt, Chlamydophila pneumoniae J138
gggcaauauauccaggau

SEQ ID NO: 2551091 - RNA, 22 nt, Chlamydophila pneumoniae J138
gggcacucuuccacaauguuua

SEQ ID NO: 2551092 - RNA, 15 nt, Chlamydophila pneumoniae J138
gggcaggggauaggc

SEQ ID NO: 2551093 - RNA, 14 nt, Chlamydophila pneumoniae J138
gggccucuucccaa

SEQ ID NO: 2551094 - RNA, 21 nt, Chlamydophila pneumoniae J138
gggccugccaugaauccaugg

SEQ ID NO: 2551095 - RNA, 21 nt, Chlamydophila pneumoniae J138
ggggaucuucagagagaacag

SEQ ID NO: 2551096 - RNA, 15 nt, Chlamydophila pneumoniae J138
ggggauuaucccaaa

SEQ ID NO: 2551097 - RNA, 12 nt, Chlamydophila pneumoniae J138
ggguaagauugc

SEQ ID NO: 2551098 - RNA, 12 nt, Chlamydophila pneumoniae J138
ggguuucccugu

SEQ ID NO: 2551099 - RNA, 14 nt, Chlamydophila pneumoniae J138
gguaaaacuacagg

SEQ ID NO: 2551100 - RNA, 15 nt, Chlamydophila pneumoniae J138
gguaaauuuuuaaaa

SEQ ID NO: 2551101 - RNA, 19 nt, Chlamydophila pneumoniae J138
gguacgcuuuuucuugaaa

SEQ ID NO: 2551102 - RNA, 15 nt, Chlamydophila pneumoniae J138
gguagagcuagaaug

SEQ ID NO: 2551103 - RNA, 18 nt, Chlamydophila pneumoniae J138
gguagcagaguuuuuccc

SEQ ID NO: 2551104 - RNA, 19 nt, Chlamydophila pneumoniae J138
gguagcagaguuuuucccu

SEQ ID NO: 2551105 - RNA, 20 nt, Chlamydophila pneumoniae J138
gguagcagaguuuuucccuc

SEQ ID NO: 2551106 - RNA, 22 nt, Chlamydophila pneumoniae J138
gguagcgucucuucuuccucua

SEQ ID NO: 2551107 - RNA, 19 nt, Chlamydophila pneumoniae J138
gguagcuaaauuuagagaa

SEQ ID NO: 2551108 - RNA, 14 nt, Chlamydophila pneumoniae J138
gguagcuuaagaau

SEQ ID NO: 2551109 - RNA, 12 nt, Chlamydophila pneumoniae J138
gguagugaucug

SEQ ID NO: 2551110 - RNA, 20 nt, Chlamydophila pneumoniae J138
gguaucuccuugauaaaacg

SEQ ID NO: 2551111 - RNA, 22 nt, Chlamydophila pneumoniae J138
gguauuaggaaguaguggacua

SEQ ID NO: 2551112 - RNA, 15 nt, Chlamydophila pneumoniae J138
gguauuucucuccac

SEQ ID NO: 2551113 - RNA, 21 nt, Chlamydophila pneumoniae J138
ggucacuucaauuacaggagc

SEQ ID NO: 2551114 - RNA, 17 nt, Chlamydophila pneumoniae J138
ggucaggagguggugga

SEQ ID NO: 2551115 - RNA, 18 nt, Chlamydophila pneumoniae J138
ggucgauaucccacagaa

SEQ ID NO: 2551116 - RNA, 22 nt, Chlamydophila pneumoniae J138
ggucgauugagauugaggauaa

SEQ ID NO: 2551117 - RNA, 18 nt, Chlamydophila pneumoniae J138
ggucgcaucaaugacugu

SEQ ID NO: 2551118 - RNA, 18 nt, Chlamydophila pneumoniae J138
ggucucccucacaagaag

SEQ ID NO: 2551119 - RNA, 14 nt, Chlamydophila pneumoniae J138
ggucuguauuuucu

SEQ ID NO: 2551120 - RNA, 19 nt, Chlamydophila pneumoniae J138
ggucuuuguucgcuccuaa

SEQ ID NO: 2551121 - RNA, 13 nt, Chlamydophila pneumoniae J138
ggugccaaaaaau

SEQ ID NO: 2551122 - RNA, 17 nt, Chlamydophila pneumoniae J138
ggugccuaggcuaagag

SEQ ID NO: 2551123 - RNA, 18 nt, Chlamydophila pneumoniae J138
ggugcuguuguaauaaaa

SEQ ID NO: 2551124 - RNA, 18 nt, Chlamydophila pneumoniae J138
ggugggaagccuggaaau

SEQ ID NO: 2551125 - RNA, 17 nt, Chlamydophila pneumoniae J138
gguggguagccaggaug

SEQ ID NO: 2551126 - RNA, 17 nt, Chlamydophila pneumoniae J138
gguguauaguauuuuua

SEQ ID NO: 2551127 - RNA, 13 nt, Chlamydophila pneumoniae J138
gguuaaaauagac

SEQ ID NO: 2551128 - RNA, 22 nt, Chlamydophila pneumoniae J138
gguuccacagagaccuucucuu

SEQ ID NO: 2551129 - RNA, 17 nt, Chlamydophila pneumoniae J138
gguucggucucuucucu

SEQ ID NO: 2551130 - RNA, 15 nt, Chlamydophila pneumoniae J138
gguucuaagaaaucc

SEQ ID NO: 2551131 - RNA, 21 nt, Chlamydophila pneumoniae J138
gguucugaaauugucuucagu

SEQ ID NO: 2551132 - RNA, 18 nt, Chlamydophila pneumoniae J138
gguuggcagcaaauccuu

SEQ ID NO: 2551133 - RNA, 15 nt, Chlamydophila pneumoniae J138
guauagagaagauuu

SEQ ID NO: 2551134 - RNA, 17 nt, Chlamydophila pneumoniae J138
guauagcuggcaaugau

SEQ ID NO: 2551135 - RNA, 18 nt, Chlamydophila pneumoniae J138
guauagcuggcaaugaua

SEQ ID NO: 2551136 - RNA, 13 nt, Chlamydophila pneumoniae J138
guauaguauuuuu

SEQ ID NO: 2551137 - RNA, 14 nt, Chlamydophila pneumoniae J138
guauaguauuuuua

SEQ ID NO: 2551138 - RNA, 21 nt, Chlamydophila pneumoniae J138
guauauaaaagaggaagauga

SEQ ID NO: 2551139 - RNA, 23 nt, Chlamydophila pneumoniae J138
guauauaagauaauagagaagaa

SEQ ID NO: 2551140 - RNA, 18 nt, Chlamydophila pneumoniae J138
guauauccacgaucuaga

SEQ ID NO: 2551141 - RNA, 18 nt, Chlamydophila pneumoniae J138
guauauucugaaauuucu

SEQ ID NO: 2551142 - RNA, 19 nt, Chlamydophila pneumoniae J138
guaucaagaauaugggugu

SEQ ID NO: 2551143 - RNA, 19 nt, Chlamydophila pneumoniae J138
guauccuccuucugcauga

SEQ ID NO: 2551144 - RNA, 23 nt, Chlamydophila pneumoniae J138
guauccuucuacaaugauauaaa

SEQ ID NO: 2551145 - RNA, 13 nt, Chlamydophila pneumoniae J138
guauccuugauuu

SEQ ID NO: 2551146 - RNA, 21 nt, Chlamydophila pneumoniae J138
guaucgagcucuuuaagaacu

SEQ ID NO: 2551147 - RNA, 13 nt, Chlamydophila pneumoniae J138
guaucuaaaacuu

SEQ ID NO: 2551148 - RNA, 17 nt, Chlamydophila pneumoniae J138
guaucuagcuuugucuc

SEQ ID NO: 2551149 - RNA, 14 nt, Chlamydophila pneumoniae J138
guaucuagggacuu

SEQ ID NO: 2551150 - RNA, 22 nt, Chlamydophila pneumoniae J138
guaucuucuucgguguagaucu

SEQ ID NO: 2551151 - RNA, 13 nt, Chlamydophila pneumoniae J138
guaucuuuuugca

SEQ ID NO: 2551152 - RNA, 19 nt, Chlamydophila pneumoniae J138
guaucuuuuugcagauccc

SEQ ID NO: 2551153 - RNA, 19 nt, Chlamydophila pneumoniae J138
guauggaauucaaacuccu

SEQ ID NO: 2551154 - RNA, 19 nt, Chlamydophila pneumoniae J138
guauucaacacggacacua

SEQ ID NO: 2551155 - RNA, 15 nt, Chlamydophila pneumoniae J138
guauuccuuggauuu

SEQ ID NO: 2551156 - RNA, 13 nt, Chlamydophila pneumoniae J138
guauucuguaaga

SEQ ID NO: 2551157 - RNA, 17 nt, Chlamydophila pneumoniae J138
guauucuguaagaaucc

SEQ ID NO: 2551158 - RNA, 16 nt, Chlamydophila pneumoniae J138
guauucuugagagucc

SEQ ID NO: 2551159 - RNA, 22 nt, Chlamydophila pneumoniae J138
guauugcaaauacguccuguga

SEQ ID NO: 2551160 - RNA, 17 nt, Chlamydophila pneumoniae J138
guauugcaaauuucauu

SEQ ID NO: 2551161 - RNA, 20 nt, Chlamydophila pneumoniae J138
guauuguguucccucuucuu

SEQ ID NO: 2551162 - RNA, 14 nt, Chlamydophila pneumoniae J138
guauuuaaauucug

SEQ ID NO: 2551163 - RNA, 18 nt, Chlamydophila pneumoniae J138
guauuuaccuacagauau

SEQ ID NO: 2551164 - RNA, 13 nt, Chlamydophila pneumoniae J138
guauuuucuucaa

SEQ ID NO: 2551165 - RNA, 19 nt, Chlamydophila pneumoniae J138
guauuuucuucaacauaca

SEQ ID NO: 2551166 - RNA, 15 nt, Chlamydophila pneumoniae J138
guauuuuuaaauaca

SEQ ID NO: 2551167 - RNA, 21 nt, Chlamydophila pneumoniae J138
gucaaacuuauacacuccaau

SEQ ID NO: 2551168 - RNA, 17 nt, Chlamydophila pneumoniae J138
gucaaauacuucuccug

SEQ ID NO: 2551169 - RNA, 21 nt, Chlamydophila pneumoniae J138
gucaaauucauuaagaacauc

SEQ ID NO: 2551170 - RNA, 21 nt, Chlamydophila pneumoniae J138
gucaagcucugagaaagaaua

SEQ ID NO: 2551171 - RNA, 16 nt, Chlamydophila pneumoniae J138
gucacagcauuuucuc

SEQ ID NO: 2551172 - RNA, 17 nt, Chlamydophila pneumoniae J138
gucacagcauuuucucu

SEQ ID NO: 2551173 - RNA, 22 nt, Chlamydophila pneumoniae J138
gucacauuuguugucagcuuug

SEQ ID NO: 2551174 - RNA, 12 nt, Chlamydophila pneumoniae J138
gucacguucuua

SEQ ID NO: 2551175 - RNA, 19 nt, Chlamydophila pneumoniae J138
gucacguucuuagaaagcg

SEQ ID NO: 2551176 - RNA, 19 nt, Chlamydophila pneumoniae J138
gucacuguuuuccagaaau

SEQ ID NO: 2551177 - RNA, 11 nt, Chlamydophila pneumoniae J138
gucacuucaau

SEQ ID NO: 2551178 - RNA, 18 nt, Chlamydophila pneumoniae J138
gucaggaacccuggauga

SEQ ID NO: 2551179 - RNA, 15 nt, Chlamydophila pneumoniae J138
gucaggagguggugg

SEQ ID NO: 2551180 - RNA, 19 nt, Chlamydophila pneumoniae J138
gucaggaggugguggagcu

SEQ ID NO: 2551181 - RNA, 13 nt, Chlamydophila pneumoniae J138
gucaguaaaacac

SEQ ID NO: 2551182 - RNA, 16 nt, Chlamydophila pneumoniae J138
gucauaaaaauuucau

SEQ ID NO: 2551183 - RNA, 17 nt, Chlamydophila pneumoniae J138
gucauacuacucucauc

SEQ ID NO: 2551184 - RNA, 13 nt, Chlamydophila pneumoniae J138
gucauauuuaaaa

SEQ ID NO: 2551185 - RNA, 22 nt, Chlamydophila pneumoniae J138
gucaucccacgggucaggaggu

SEQ ID NO: 2551186 - RNA, 15 nt, Chlamydophila pneumoniae J138
gucaugauuuuucaa

SEQ ID NO: 2551187 - RNA, 16 nt, Chlamydophila pneumoniae J138
gucaugauuuuucaau

SEQ ID NO: 2551188 - RNA, 17 nt, Chlamydophila pneumoniae J138
gucaugcauagaauaaa

SEQ ID NO: 2551189 - RNA, 12 nt, Chlamydophila pneumoniae J138
gucauuaaaaau

SEQ ID NO: 2551190 - RNA, 16 nt, Chlamydophila pneumoniae J138
gucauuaccugcuaaa

SEQ ID NO: 2551191 - RNA, 21 nt, Chlamydophila pneumoniae J138
gucauucugcaaggcaaugau

SEQ ID NO: 2551192 - RNA, 21 nt, Chlamydophila pneumoniae J138
gucauugccuugcugcauacu

SEQ ID NO: 2551193 - RNA, 12 nt, Chlamydophila pneumoniae J138
guccaaacccug

SEQ ID NO: 2551194 - RNA, 16 nt, Chlamydophila pneumoniae J138
guccacaagccucccu

SEQ ID NO: 2551195 - RNA, 18 nt, Chlamydophila pneumoniae J138
guccacagucauaaaaau

SEQ ID NO: 2551196 - RNA, 21 nt, Chlamydophila pneumoniae J138
guccauuucauguaagaaugu

SEQ ID NO: 2551197 - RNA, 22 nt, Chlamydophila pneumoniae J138
gucccucuaaugacagcugaga

SEQ ID NO: 2551198 - RNA, 24 nt, Chlamydophila pneumoniae J138
gucccugauuccauccugucuauu

SEQ ID NO: 2551199 - RNA, 14 nt, Chlamydophila pneumoniae J138
guccgaagccuuca

SEQ ID NO: 2551200 - RNA, 16 nt, Chlamydophila pneumoniae J138
guccuaauuuuccucc

SEQ ID NO: 2551201 - RNA, 14 nt, Chlamydophila pneumoniae J138
guccuaggcugaga

SEQ ID NO: 2551202 - RNA, 15 nt, Chlamydophila pneumoniae J138
guccucuaugguuuu

SEQ ID NO: 2551203 - RNA, 11 nt, Chlamydophila pneumoniae J138
guccucucccu

SEQ ID NO: 2551204 - RNA, 15 nt, Chlamydophila pneumoniae J138
guccuggcgaugcca

SEQ ID NO: 2551205 - RNA, 22 nt, Chlamydophila pneumoniae J138
guccugggggaaauaccccauc

SEQ ID NO: 2551206 - RNA, 22 nt, Chlamydophila pneumoniae J138
guccugggguucucuaauggac

SEQ ID NO: 2551207 - RNA, 15 nt, Chlamydophila pneumoniae J138
guccuguuaagaugu

SEQ ID NO: 2551208 - RNA, 12 nt, Chlamydophila pneumoniae J138
guccuucuuccc

SEQ ID NO: 2551209 - RNA, 20 nt, Chlamydophila pneumoniae J138
guccuuuauaauggugucuu

SEQ ID NO: 2551210 - RNA, 14 nt, Chlamydophila pneumoniae J138
gucgaaagaucaga

SEQ ID NO: 2551211 - RNA, 14 nt, Chlamydophila pneumoniae J138
gucgagaaccucca

SEQ ID NO: 2551212 - RNA, 17 nt, Chlamydophila pneumoniae J138
gucgagcuuuaagaaga

SEQ ID NO: 2551213 - RNA, 23 nt, Chlamydophila pneumoniae J138
gucgagcuuuaagaagaagaaaa

SEQ ID NO: 2551214 - RNA, 17 nt, Chlamydophila pneumoniae J138
gucgcaguaaugccaau

SEQ ID NO: 2551215 - RNA, 15 nt, Chlamydophila pneumoniae J138
gucgcaucaaugacu

SEQ ID NO: 2551216 - RNA, 21 nt, Chlamydophila pneumoniae J138
gucgcgaaaguaaaauuucug

SEQ ID NO: 2551217 - RNA, 16 nt, Chlamydophila pneumoniae J138
gucgcgacaagacaau

SEQ ID NO: 2551218 - RNA, 20 nt, Chlamydophila pneumoniae J138
gucgcgacaagacaaugacu

SEQ ID NO: 2551219 - RNA, 17 nt, Chlamydophila pneumoniae J138
gucgcgaccgaaagucc

SEQ ID NO: 2551220 - RNA, 16 nt, Chlamydophila pneumoniae J138
gucggagauuguuuca

SEQ ID NO: 2551221 - RNA, 14 nt, Chlamydophila pneumoniae J138
gucggcuuuagaaa

SEQ ID NO: 2551222 - RNA, 19 nt, Chlamydophila pneumoniae J138
gucguaaucuuuuuuaaag

SEQ ID NO: 2551223 - RNA, 14 nt, Chlamydophila pneumoniae J138
gucgucuuuuaaag

SEQ ID NO: 2551224 - RNA, 21 nt, Chlamydophila pneumoniae J138
gucuacagaggaaucuauccu

SEQ ID NO: 2551225 - RNA, 16 nt, Chlamydophila pneumoniae J138
gucuagaacacucaga

SEQ ID NO: 2551226 - RNA, 20 nt, Chlamydophila pneumoniae J138
gucuauucucuucauuuucu

SEQ ID NO: 2551227 - RNA, 17 nt, Chlamydophila pneumoniae J138
gucuccaaaaauuccca

SEQ ID NO: 2551228 - RNA, 20 nt, Chlamydophila pneumoniae J138
gucuccaaauguucucucca

SEQ ID NO: 2551229 - RNA, 18 nt, Chlamydophila pneumoniae J138
gucuccagaagcaagaau

SEQ ID NO: 2551230 - RNA, 17 nt, Chlamydophila pneumoniae J138
gucuccauaauucugca

SEQ ID NO: 2551231 - RNA, 21 nt, Chlamydophila pneumoniae J138
gucucccuggucuguauuuuc

SEQ ID NO: 2551232 - RNA, 19 nt, Chlamydophila pneumoniae J138
gucuccuggaacaguauaa

SEQ ID NO: 2551233 - RNA, 13 nt, Chlamydophila pneumoniae J138
gucuccuugauuu

SEQ ID NO: 2551234 - RNA, 21 nt, Chlamydophila pneumoniae J138
gucucgaaacucuuugaggau

SEQ ID NO: 2551235 - RNA, 13 nt, Chlamydophila pneumoniae J138
gucucugaagacc

SEQ ID NO: 2551236 - RNA, 22 nt, Chlamydophila pneumoniae J138
gucucuugcgucacauuuguug

SEQ ID NO: 2551237 - RNA, 14 nt, Chlamydophila pneumoniae J138
gucucuuucagcuc

SEQ ID NO: 2551238 - RNA, 16 nt, Chlamydophila pneumoniae J138
gucucuuucagcucaa

SEQ ID NO: 2551239 - RNA, 17 nt, Chlamydophila pneumoniae J138
gucugaguuagcuuuug

SEQ ID NO: 2551240 - RNA, 19 nt, Chlamydophila pneumoniae J138
gucugauguaggugauauu

SEQ ID NO: 2551241 - RNA, 23 nt, Chlamydophila pneumoniae J138
gucugcaaagagcaaaggagcgg

SEQ ID NO: 2551242 - RNA, 21 nt, Chlamydophila pneumoniae J138
gucugccaucgcccaauuuuu

SEQ ID NO: 2551243 - RNA, 23 nt, Chlamydophila pneumoniae J138
gucugcgauaggaucuucuauuu

SEQ ID NO: 2551244 - RNA, 13 nt, Chlamydophila pneumoniae J138
gucuguaaggaca

SEQ ID NO: 2551245 - RNA, 21 nt, Chlamydophila pneumoniae J138
gucuguauuuucuucaacaua

SEQ ID NO: 2551246 - RNA, 23 nt, Chlamydophila pneumoniae J138
gucuguuuuggaaagaagagaau

SEQ ID NO: 2551247 - RNA, 15 nt, Chlamydophila pneumoniae J138
gucuuaaaauuccug

SEQ ID NO: 2551248 - RNA, 16 nt, Chlamydophila pneumoniae J138
gucuuagaauccucua

SEQ ID NO: 2551249 - RNA, 19 nt, Chlamydophila pneumoniae J138
gucuuauugaagucuucuu

SEQ ID NO: 2551250 - RNA, 19 nt, Chlamydophila pneumoniae J138
gucuucauaugcucucccg

SEQ ID NO: 2551251 - RNA, 13 nt, Chlamydophila pneumoniae J138
gucuuccaucucu

SEQ ID NO: 2551252 - RNA, 16 nt, Chlamydophila pneumoniae J138
gucuuccuagaccuau

SEQ ID NO: 2551253 - RNA, 20 nt, Chlamydophila pneumoniae J138
gucuucuguaauuuuuuuca

SEQ ID NO: 2551254 - RNA, 18 nt, Chlamydophila pneumoniae J138
gucuugcugauuuuugcu

SEQ ID NO: 2551255 - RNA, 23 nt, Chlamydophila pneumoniae J138
gucuugcuuugugaguucuuccu

SEQ ID NO: 2551256 - RNA, 21 nt, Chlamydophila pneumoniae J138
gucuuuaauuaaaaguucagc

SEQ ID NO: 2551257 - RNA, 18 nt, Chlamydophila pneumoniae J138
gucuuugauuuucaggag

SEQ ID NO: 2551258 - RNA, 16 nt, Chlamydophila pneumoniae J138
gucuuugcuuucuagg

SEQ ID NO: 2551259 - RNA, 16 nt, Chlamydophila pneumoniae J138
gugaaauauugaucuu

SEQ ID NO: 2551260 - RNA, 19 nt, Chlamydophila pneumoniae J138
gugaagauaagaccagaaa

SEQ ID NO: 2551261 - RNA, 19 nt, Chlamydophila pneumoniae J138
gugaagccauuuucuaaga

SEQ ID NO: 2551262 - RNA, 19 nt, Chlamydophila pneumoniae J138
gugaagcugcuucuucaga

SEQ ID NO: 2551263 - RNA, 21 nt, Chlamydophila pneumoniae J138
gugaauauguacugaugugaa

SEQ ID NO: 2551264 - RNA, 18 nt, Chlamydophila pneumoniae J138
gugacgacaaaucacgac

SEQ ID NO: 2551265 - RNA, 12 nt, Chlamydophila pneumoniae J138
gugacuccuggu

SEQ ID NO: 2551266 - RNA, 14 nt, Chlamydophila pneumoniae J138
gugacuuuucuucu

SEQ ID NO: 2551267 - RNA, 14 nt, Chlamydophila pneumoniae J138
gugauacuuuagaa

SEQ ID NO: 2551268 - RNA, 16 nt, Chlamydophila pneumoniae J138
gugaucaaagaacaau

SEQ ID NO: 2551269 - RNA, 14 nt, Chlamydophila pneumoniae J138
gugaucuugagaaa

SEQ ID NO: 2551270 - RNA, 16 nt, Chlamydophila pneumoniae J138
gugauugcguauagau

SEQ ID NO: 2551271 - RNA, 12 nt, Chlamydophila pneumoniae J138
gugauugcugcu

SEQ ID NO: 2551272 - RNA, 17 nt, Chlamydophila pneumoniae J138
gugcaaggccuaaucuu

SEQ ID NO: 2551273 - RNA, 17 nt, Chlamydophila pneumoniae J138
gugcaggagaacaauau

SEQ ID NO: 2551274 - RNA, 14 nt, Chlamydophila pneumoniae J138
gugcaucauuuuca

SEQ ID NO: 2551275 - RNA, 19 nt, Chlamydophila pneumoniae J138
gugcaucuauaauuaaucc

SEQ ID NO: 2551276 - RNA, 13 nt, Chlamydophila pneumoniae J138
gugcaugcaucuu

SEQ ID NO: 2551277 - RNA, 14 nt, Chlamydophila pneumoniae J138
gugcaugcaucuua

SEQ ID NO: 2551278 - RNA, 19 nt, Chlamydophila pneumoniae J138
gugcauuaucuaagaauau

SEQ ID NO: 2551279 - RNA, 14 nt, Chlamydophila pneumoniae J138
gugcauuuucuucu

SEQ ID NO: 2551280 - RNA, 15 nt, Chlamydophila pneumoniae J138
gugccaaaaaauuuu

SEQ ID NO: 2551281 - RNA, 19 nt, Chlamydophila pneumoniae J138
gugccacccuuggcagagc

SEQ ID NO: 2551282 - RNA, 19 nt, Chlamydophila pneumoniae J138
gugccugguaaaggauauu

SEQ ID NO: 2551283 - RNA, 21 nt, Chlamydophila pneumoniae J138
gugccuguaauugauguuccu

SEQ ID NO: 2551284 - RNA, 20 nt, Chlamydophila pneumoniae J138
gugcgcgucuccuugauuug

SEQ ID NO: 2551285 - RNA, 19 nt, Chlamydophila pneumoniae J138
gugcucaguaaauauuuua

SEQ ID NO: 2551286 - RNA, 12 nt, Chlamydophila pneumoniae J138
gugcucucuaaa

SEQ ID NO: 2551287 - RNA, 21 nt, Chlamydophila pneumoniae J138
guggaaauugugaaaaaaaac

SEQ ID NO: 2551288 - RNA, 16 nt, Chlamydophila pneumoniae J138
guggacggggagagcc

SEQ ID NO: 2551289 - RNA, 20 nt, Chlamydophila pneumoniae J138
guggagcuugucuaggagcu

SEQ ID NO: 2551290 - RNA, 13 nt, Chlamydophila pneumoniae J138
guggagguuagua

SEQ ID NO: 2551291 - RNA, 14 nt, Chlamydophila pneumoniae J138
gugggaggaauccu

SEQ ID NO: 2551292 - RNA, 16 nt, Chlamydophila pneumoniae J138
guggguagccaggaug

SEQ ID NO: 2551293 - RNA, 13 nt, Chlamydophila pneumoniae J138
guggucggcagaa

SEQ ID NO: 2551294 - RNA, 22 nt, Chlamydophila pneumoniae J138
gugguuagagcagcagaaucau

SEQ ID NO: 2551295 - RNA, 15 nt, Chlamydophila pneumoniae J138
guguauaguauuuuu

SEQ ID NO: 2551296 - RNA, 23 nt, Chlamydophila pneumoniae J138
gugucccauggcuggaaagccaa

SEQ ID NO: 2551297 - RNA, 22 nt, Chlamydophila pneumoniae J138
gugucuuccuugggaggaggag

SEQ ID NO: 2551298 - RNA, 16 nt, Chlamydophila pneumoniae J138
guguggguacaggggg

SEQ ID NO: 2551299 - RNA, 23 nt, Chlamydophila pneumoniae J138
guguuaaguucauaaccugggca

SEQ ID NO: 2551300 - RNA, 23 nt, Chlamydophila pneumoniae J138
guguuccagaucaaugccuugcg

SEQ ID NO: 2551301 - RNA, 13 nt, Chlamydophila pneumoniae J138
guguugaauaaga

SEQ ID NO: 2551302 - RNA, 13 nt, Chlamydophila pneumoniae J138
guguuuccuuuuc

SEQ ID NO: 2551303 - RNA, 21 nt, Chlamydophila pneumoniae J138
guguuuccuuuucuccuucug

SEQ ID NO: 2551304 - RNA, 12 nt, Chlamydophila pneumoniae J138
guguuuucuagu

SEQ ID NO: 2551305 - RNA, 19 nt, Chlamydophila pneumoniae J138
guguuuuuggcauaaagac

SEQ ID NO: 2551306 - RNA, 15 nt, Chlamydophila pneumoniae J138
guuaaucuaauuuua

SEQ ID NO: 2551307 - RNA, 17 nt, Chlamydophila pneumoniae J138
guuacaagcaauacuaa

SEQ ID NO: 2551308 - RNA, 17 nt, Chlamydophila pneumoniae J138
guuacagcguugcuaag

SEQ ID NO: 2551309 - RNA, 22 nt, Chlamydophila pneumoniae J138
guuacagcguugcuaagcauag

SEQ ID NO: 2551310 - RNA, 21 nt, Chlamydophila pneumoniae J138
guuacggaacucauuaagaag

SEQ ID NO: 2551311 - RNA, 22 nt, Chlamydophila pneumoniae J138
guuacggaacucauuaagaaga

SEQ ID NO: 2551312 - RNA, 16 nt, Chlamydophila pneumoniae J138
guuacgugagaacuca

SEQ ID NO: 2551313 - RNA, 13 nt, Chlamydophila pneumoniae J138
guuagagaagagg

SEQ ID NO: 2551314 - RNA, 15 nt, Chlamydophila pneumoniae J138
guuaggauauggugu

SEQ ID NO: 2551315 - RNA, 15 nt, Chlamydophila pneumoniae J138
guuaggucuuaaagu

SEQ ID NO: 2551316 - RNA, 13 nt, Chlamydophila pneumoniae J138
guuauaagugacu

SEQ ID NO: 2551317 - RNA, 20 nt, Chlamydophila pneumoniae J138
guuauaagugacuuuucuuc

SEQ ID NO: 2551318 - RNA, 14 nt, Chlamydophila pneumoniae J138
guuauauuuuucug

SEQ ID NO: 2551319 - RNA, 13 nt, Chlamydophila pneumoniae J138
guuaucaggaacu

SEQ ID NO: 2551320 - RNA, 17 nt, Chlamydophila pneumoniae J138
guuaucucccaagacga

SEQ ID NO: 2551321 - RNA, 14 nt, Chlamydophila pneumoniae J138
guuaugaagcuucu

SEQ ID NO: 2551322 - RNA, 19 nt, Chlamydophila pneumoniae J138
guuauuaauaaauuuaucu

SEQ ID NO: 2551323 - RNA, 20 nt, Chlamydophila pneumoniae J138
guuauuaauaaauuuaucug

SEQ ID NO: 2551324 - RNA, 22 nt, Chlamydophila pneumoniae J138
guucaccacuaccgaauuuuca

SEQ ID NO: 2551325 - RNA, 15 nt, Chlamydophila pneumoniae J138
guucacuucaucgac

SEQ ID NO: 2551326 - RNA, 13 nt, Chlamydophila pneumoniae J138
guucagcuagagc

SEQ ID NO: 2551327 - RNA, 14 nt, Chlamydophila pneumoniae J138
guucauaauccaag

SEQ ID NO: 2551328 - RNA, 16 nt, Chlamydophila pneumoniae J138
guucauaauccaagau

SEQ ID NO: 2551329 - RNA, 20 nt, Chlamydophila pneumoniae J138
guucauaauccaagauacca

SEQ ID NO: 2551330 - RNA, 22 nt, Chlamydophila pneumoniae J138
guucauacaccccauagagcug

SEQ ID NO: 2551331 - RNA, 22 nt, Chlamydophila pneumoniae J138
guucaucuagaugauaacguuu

SEQ ID NO: 2551332 - RNA, 19 nt, Chlamydophila pneumoniae J138
guucauuagcuaaaucaaa

SEQ ID NO: 2551333 - RNA, 21 nt, Chlamydophila pneumoniae J138
guucauucucaugucuaaguc

SEQ ID NO: 2551334 - RNA, 24 nt, Chlamydophila pneumoniae J138
guucauucucaugucuaagucaga

SEQ ID NO: 2551335 - RNA, 13 nt, Chlamydophila pneumoniae J138
guuuucacauggc

SEQ ID NO: 2551336 - RNA, 21 nt, Chlamydophila pneumoniae J138
guuuucagcuuguuuuugcaa

SEQ ID NO: 2551337 - RNA, 22 nt, Chlamydophila pneumoniae J138
guuuuccccuuggaaaucagaa

SEQ ID NO: 2551338 - RNA, 17 nt, Chlamydophila pneumoniae J138
guuuucguaagagaauu

SEQ ID NO: 2551339 - RNA, 15 nt, Chlamydophila pneumoniae J138
guuuucuaugauccg

SEQ ID NO: 2551340 - RNA, 21 nt, Chlamydophila pneumoniae J138
guuuucuguugcacuuuccgu

SEQ ID NO: 2551341 - RNA, 12 nt, Chlamydophila pneumoniae J138
guuuucuuaucc

SEQ ID NO: 2551342 - RNA, 23 nt, Chlamydophila pneumoniae J138
guuuucuucuuuaagauuuccuu

SEQ ID NO: 2551343 - RNA, 17 nt, Chlamydophila pneumoniae J138
guuuucuuuucugaaga

SEQ ID NO: 2551344 - RNA, 15 nt, Chlamydophila pneumoniae J138
guuuugaaaucaaaa

SEQ ID NO: 2551345 - RNA, 23 nt, Chlamydophila pneumoniae J138
guuuugauucccuccuuccuuaa

SEQ ID NO: 2551346 - RNA, 22 nt, Chlamydophila pneumoniae J138
guuuugauuuugcagugauaaa

SEQ ID NO: 2551347 - RNA, 15 nt, Chlamydophila pneumoniae J138
guuuugcucucuaga

SEQ ID NO: 2551348 - RNA, 19 nt, Chlamydophila pneumoniae J138
guuuuggaaagaagagaau

SEQ ID NO: 2551349 - RNA, 15 nt, Chlamydophila pneumoniae J138
guuuuguuucaucuu

SEQ ID NO: 2551350 - RNA, 15 nt, Chlamydophila pneumoniae J138
guuuuuaauuuucug

SEQ ID NO: 2551351 - RNA, 20 nt, Chlamydophila pneumoniae J138
guuuuuacauguaaacaaaa

SEQ ID NO: 2551352 - RNA, 15 nt, Chlamydophila pneumoniae J138
guuuuuaucccagau

SEQ ID NO: 2551353 - RNA, 16 nt, Chlamydophila pneumoniae J138
guuuuuauuuuuaaau

SEQ ID NO: 2551354 - RNA, 16 nt, Chlamydophila pneumoniae J138
guuuuuccaacuucaa

SEQ ID NO: 2551355 - RNA, 20 nt, Chlamydophila pneumoniae J138
guuuuucgaaucguuuuugg

SEQ ID NO: 2551356 - RNA, 18 nt, Chlamydophila pneumoniae J138
guuuuucuccucuuucuu

SEQ ID NO: 2551357 - RNA, 22 nt, Chlamydophila pneumoniae J138
guuuuuggaaaaagccuuucuu

SEQ ID NO: 2551358 - RNA, 14 nt, Chlamydophila pneumoniae J138
guuuuuucaauccu

SEQ ID NO: 2551359 - RNA, 17 nt, Chlamydophila pneumoniae J138
guuuuuugaaaacuuca

SEQ ID NO: 2551360 - RNA, 16 nt, Chlamydophila pneumoniae J138
uaaaaaaacccucaaa

SEQ ID NO: 2551361 - RNA, 19 nt, Chlamydophila pneumoniae J138
uaaaaaaacccucaaagaa

SEQ ID NO: 2551362 - RNA, 17 nt, Chlamydophila pneumoniae J138
uaaaaaaagacaagaga

SEQ ID NO: 2551363 - RNA, 18 nt, Chlamydophila pneumoniae J138
uaaaaaaagcuagucuuu

SEQ ID NO: 2551364 - RNA, 19 nt, Chlamydophila pneumoniae J138
uaaaaaacuuccuaacuau

SEQ ID NO: 2551365 - RNA, 22 nt, Chlamydophila pneumoniae J138
uaaaaaacuuccuaacuaucuc

SEQ ID NO: 2551366 - RNA, 19 nt, Chlamydophila pneumoniae J138
uaaaaaauacaggaaucuc

SEQ ID NO: 2551367 - RNA, 13 nt, Chlamydophila pneumoniae J138
uaaaaaauaccua

SEQ ID NO: 2551368 - RNA, 21 nt, Chlamydophila pneumoniae J138
uaaaaaauuaucuccaaagau

SEQ ID NO: 2551369 - RNA, 21 nt, Chlamydophila pneumoniae J138
uaaaaauaccaagaugucucc

SEQ ID NO: 2551370 - RNA, 18 nt, Chlamydophila pneumoniae J138
uaaaaauagaaauaagca

SEQ ID NO: 2551371 - RNA, 16 nt, Chlamydophila pneumoniae J138
uaaaaauaggagaagc

SEQ ID NO: 2551372 - RNA, 13 nt, Chlamydophila pneumoniae J138
uaaaaauauaucu

SEQ ID NO: 2551373 - RNA, 14 nt, Chlamydophila pneumoniae J138
uaaaaauauaucuu

SEQ ID NO: 2551374 - RNA, 19 nt, Chlamydophila pneumoniae J138
uaaaaauuaaagugaaagc

SEQ ID NO: 2551375 - RNA, 21 nt, Chlamydophila pneumoniae J138
uaaaacaagaagaucaaagau

SEQ ID NO: 2551376 - RNA, 16 nt, Chlamydophila pneumoniae J138
uaaaacaauuuccugc

SEQ ID NO: 2551377 - RNA, 13 nt, Chlamydophila pneumoniae J138
uaaaacagaaauu

SEQ ID NO: 2551378 - RNA, 23 nt, Chlamydophila pneumoniae J138
uaaaaccacagaaugauaagaaa

SEQ ID NO: 2551379 - RNA, 21 nt, Chlamydophila pneumoniae J138
uaaaacccauguuucuuccug

SEQ ID NO: 2551380 - RNA, 13 nt, Chlamydophila pneumoniae J138
uaaaaccuagacu

SEQ ID NO: 2551381 - RNA, 20 nt, Chlamydophila pneumoniae J138
uaaaacgagcaggguaauuu

SEQ ID NO: 2551382 - RNA, 17 nt, Chlamydophila pneumoniae J138
uaaaacuacaggaaaac

SEQ ID NO: 2551383 - RNA, 13 nt, Chlamydophila pneumoniae J138
uaaaacuccacgc

SEQ ID NO: 2551384 - RNA, 23 nt, Chlamydophila pneumoniae J138
uaaaacuucaguuguugcuuucu

SEQ ID NO: 2551385 - RNA, 21 nt, Chlamydophila pneumoniae J138
uaaaagaacauuaagaggaaa

SEQ ID NO: 2551386 - RNA, 14 nt, Chlamydophila pneumoniae J138
uaaaagaauaauag

SEQ ID NO: 2551387 - RNA, 13 nt, Chlamydophila pneumoniae J138
uaaaagacugaaa

SEQ ID NO: 2551388 - RNA, 16 nt, Chlamydophila pneumoniae J138
uaaaagagcucaaaaa

SEQ ID NO: 2551389 - RNA, 14 nt, Chlamydophila pneumoniae J138
uaaaagaggaagau

SEQ ID NO: 2551390 - RNA, 14 nt, Chlamydophila pneumoniae J138
uaaaagauuccuua

SEQ ID NO: 2551391 - RNA, 21 nt, Chlamydophila pneumoniae J138
uaaaagcaaguuguugauaau

SEQ ID NO: 2551392 - RNA, 18 nt, Chlamydophila pneumoniae J138
uaaaagcacuuaaaaaac

SEQ ID NO: 2551393 - RNA, 22 nt, Chlamydophila pneumoniae J138
uaaaagcauuuuugggaaaaga

SEQ ID NO: 2551394 - RNA, 23 nt, Chlamydophila pneumoniae J138
uaaaagcauuuuugggaaaagaa

SEQ ID NO: 2551395 - RNA, 17 nt, Chlamydophila pneumoniae J138
uaaaagcccuaauucau

SEQ ID NO: 2551396 - RNA, 16 nt, Chlamydophila pneumoniae J138
uaaaaguuagguagau

SEQ ID NO: 2551397 - RNA, 23 nt, Chlamydophila pneumoniae J138
uaaaaguuagguagauagaaauu

SEQ ID NO: 2551398 - RNA, 16 nt, Chlamydophila pneumoniae J138
uaaaaguuuuuuauuu

SEQ ID NO: 2551399 - RNA, 23 nt, Chlamydophila pneumoniae J138
uaaaaguuuuuuauuuucuggug

SEQ ID NO: 2551400 - RNA, 21 nt, Chlamydophila pneumoniae J138
uaaaauaaccccuccaaaauc

SEQ ID NO: 2551401 - RNA, 13 nt, Chlamydophila pneumoniae J138
uaaaauagacauu

SEQ ID NO: 2551402 - RNA, 15 nt, Chlamydophila pneumoniae J138
uaaaauagcccuaga

SEQ ID NO: 2551403 - RNA, 18 nt, Chlamydophila pneumoniae J138
uaaaaucaagccacagag

SEQ ID NO: 2551404 - RNA, 20 nt, Chlamydophila pneumoniae J138
uaaaaucaagccacagagaa

SEQ ID NO: 2551405 - RNA, 17 nt, Chlamydophila pneumoniae J138
uaaaaucauaggcuaua

SEQ ID NO: 2551406 - RNA, 14 nt, Chlamydophila pneumoniae J138
uaaaaucuccucuc

SEQ ID NO: 2551407 - RNA, 21 nt, Chlamydophila pneumoniae J138
uaaaaucuccucucucaauaa

SEQ ID NO: 2551408 - RNA, 19 nt, Chlamydophila pneumoniae J138
uaaaaucuucuggagggag

SEQ ID NO: 2551409 - RNA, 14 nt, Chlamydophila pneumoniae J138
uaaaaucuuucaau

SEQ ID NO: 2551410 - RNA, 22 nt, Chlamydophila pneumoniae J138
uaaaaugauuuggccaacagug

SEQ ID NO: 2551411 - RNA, 21 nt, Chlamydophila pneumoniae J138
uaaaaugcgcacggauucuaa

SEQ ID NO: 2551412 - RNA, 20 nt, Chlamydophila pneumoniae J138
uaaaaugcgguaauagguuu

SEQ ID NO: 2551413 - RNA, 19 nt, Chlamydophila pneumoniae J138
uaaaaugggaucagaaaau

SEQ ID NO: 2551414 - RNA, 19 nt, Chlamydophila pneumoniae J138
uaaaauggugaagaauaau

SEQ ID NO: 2551415 - RNA, 21 nt, Chlamydophila pneumoniae J138
uaaaauggugaagaauaauag

SEQ ID NO: 2551416 - RNA, 18 nt, Chlamydophila pneumoniae J138
uaaaaugugucuugcuga

SEQ ID NO: 2551417 - RNA, 18 nt, Chlamydophila pneumoniae J138
uaaaauucaaaucccuga

SEQ ID NO: 2551418 - RNA, 20 nt, Chlamydophila pneumoniae J138
uaaaauucugaagauauauu

SEQ ID NO: 2551419 - RNA, 16 nt, Chlamydophila pneumoniae J138
uaaaauuuaaaaaaau

SEQ ID NO: 2551420 - RNA, 18 nt, Chlamydophila pneumoniae J138
uaaaauuuaaaaaaaucu

SEQ ID NO: 2551421 - RNA, 20 nt, Chlamydophila pneumoniae J138
uaaacaaagcgucuaucuag

SEQ ID NO: 2551422 - RNA, 13 nt, Chlamydophila pneumoniae J138
uaaacaauaagag

SEQ ID NO: 2551423 - RNA, 14 nt, Chlamydophila pneumoniae J138
uaaacaauuucaau

SEQ ID NO: 2551424 - RNA, 15 nt, Chlamydophila pneumoniae J138
uaaacagcaaaguaa

SEQ ID NO: 2551425 - RNA, 12 nt, Chlamydophila pneumoniae J138
uaaacagcacag

SEQ ID NO: 2551426 - RNA, 23 nt, Chlamydophila pneumoniae J138
uaaacagcacaggcauggucucc

SEQ ID NO: 2551427 - RNA, 22 nt, Chlamydophila pneumoniae J138
uaaacagcaguguuauuuggac

SEQ ID NO: 2551428 - RNA, 14 nt, Chlamydophila pneumoniae J138
uaaacauaaagacc

SEQ ID NO: 2551429 - RNA, 17 nt, Chlamydophila pneumoniae J138
uaaacaucgcagcagga

SEQ ID NO: 2551430 - RNA, 17 nt, Chlamydophila pneumoniae J138
uaaaccaucacuuccug

SEQ ID NO: 2551431 - RNA, 17 nt, Chlamydophila pneumoniae J138
uaaacccucagaacacg

SEQ ID NO: 2551432 - RNA, 23 nt, Chlamydophila pneumoniae J138
uaaaccuaccucugggaagacuc

SEQ ID NO: 2551433 - RNA, 13 nt, Chlamydophila pneumoniae J138
uaaacgagacugc

SEQ ID NO: 2551434 - RNA, 18 nt, Chlamydophila pneumoniae J138
uaaacucuccaaaagcuc

SEQ ID NO: 2551435 - RNA, 22 nt, Chlamydophila pneumoniae J138
gguuguacuuuuacugaaauua

SEQ ID NO: 2551436 - RNA, 11 nt, Chlamydophila pneumoniae J138
gguuucuaggu

SEQ ID NO: 2551437 - RNA, 17 nt, Chlamydophila pneumoniae J138
gguuucuuuccaucaua

SEQ ID NO: 2551438 - RNA, 19 nt, Chlamydophila pneumoniae J138
gguuucuuuuuuuauaaag

SEQ ID NO: 2551439 - RNA, 16 nt, Chlamydophila pneumoniae J138
gguuucuuuuuuuuga

SEQ ID NO: 2551440 - RNA, 15 nt, Chlamydophila pneumoniae J138
gguuuucuccuucuc

SEQ ID NO: 2551441 - RNA, 13 nt, Chlamydophila pneumoniae J138
gguuuuuccaacu

SEQ ID NO: 2551442 - RNA, 18 nt, Chlamydophila pneumoniae J138
guaaaaaauacaggaauc

SEQ ID NO: 2551443 - RNA, 16 nt, Chlamydophila pneumoniae J138
guaaaaagccuaugau

SEQ ID NO: 2551444 - RNA, 11 nt, Chlamydophila pneumoniae J138
guaaaacacaa

SEQ ID NO: 2551445 - RNA, 15 nt, Chlamydophila pneumoniae J138
guaaaacacaaauag

SEQ ID NO: 2551446 - RNA, 11 nt, Chlamydophila pneumoniae J138
guaaacaacaa

SEQ ID NO: 2551447 - RNA, 20 nt, Chlamydophila pneumoniae J138
guaaaccaauugagcucucu

SEQ ID NO: 2551448 - RNA, 16 nt, Chlamydophila pneumoniae J138
guaaagagcuucuucu

SEQ ID NO: 2551449 - RNA, 14 nt, Chlamydophila pneumoniae J138
guaaagauucuauu

SEQ ID NO: 2551450 - RNA, 17 nt, Chlamydophila pneumoniae J138
guaaagguuguaaggac

SEQ ID NO: 2551451 - RNA, 18 nt, Chlamydophila pneumoniae J138
guaaaguaggcacaucau

SEQ ID NO: 2551452 - RNA, 20 nt, Chlamydophila pneumoniae J138
guaaaguaugcauagccucg

SEQ ID NO: 2551453 - RNA, 21 nt, Chlamydophila pneumoniae J138
guaaauacaaaacaaaagcca

SEQ ID NO: 2551454 - RNA, 12 nt, Chlamydophila pneumoniae J138
guaaauaucuua

SEQ ID NO: 2551455 - RNA, 19 nt, Chlamydophila pneumoniae J138
guaaauuuuuccuucaaca

SEQ ID NO: 2551456 - RNA, 16 nt, Chlamydophila pneumoniae J138
guaacauccauagaga

SEQ ID NO: 2551457 - RNA, 19 nt, Chlamydophila pneumoniae J138
guaacauugaccuaaagga

SEQ ID NO: 2551458 - RNA, 20 nt, Chlamydophila pneumoniae J138
guaacauugaccuaaaggaa

SEQ ID NO: 2551459 - RNA, 18 nt, Chlamydophila pneumoniae J138
guaaccaacaucaaagaa

SEQ ID NO: 2551460 - RNA, 19 nt, Chlamydophila pneumoniae J138
guaaccaauacagcauaaa

SEQ ID NO: 2551461 - RNA, 14 nt, Chlamydophila pneumoniae J138
guaaccacaggauc

SEQ ID NO: 2551462 - RNA, 19 nt, Chlamydophila pneumoniae J138
guaaccagagagcuuuuag

SEQ ID NO: 2551463 - RNA, 14 nt, Chlamydophila pneumoniae J138
guaaccugaaagcg

SEQ ID NO: 2551464 - RNA, 17 nt, Chlamydophila pneumoniae J138
guaacgcugcuaauguu

SEQ ID NO: 2551465 - RNA, 16 nt, Chlamydophila pneumoniae J138
guaacuaguaacuuaa

SEQ ID NO: 2551466 - RNA, 22 nt, Chlamydophila pneumoniae J138
guaagaacguauacgucccaca

SEQ ID NO: 2551467 - RNA, 17 nt, Chlamydophila pneumoniae J138
guaagaauccuugcuaa

SEQ ID NO: 2551468 - RNA, 16 nt, Chlamydophila pneumoniae J138
guaagacuaaaaaaga

SEQ ID NO: 2551469 - RNA, 12 nt, Chlamydophila pneumoniae J138
guaagggaugcu

SEQ ID NO: 2551470 - RNA, 17 nt, Chlamydophila pneumoniae J138
guaagguuaucuuuuug

SEQ ID NO: 2551471 - RNA, 22 nt, Chlamydophila pneumoniae J138
guaaguaaccaauacagcauaa

SEQ ID NO: 2551472 - RNA, 15 nt, Chlamydophila pneumoniae J138
guaaguacacauugu

SEQ ID NO: 2551473 - RNA, 22 nt, Chlamydophila pneumoniae J138
guaauaacuauaauauaacugc

SEQ ID NO: 2551474 - RNA, 18 nt, Chlamydophila pneumoniae J138
guaauccagauuguucaa

SEQ ID NO: 2551475 - RNA, 21 nt, Chlamydophila pneumoniae J138
guaauccuaauuccuucaaag

SEQ ID NO: 2551476 - RNA, 22 nt, Chlamydophila pneumoniae J138
guaauccuaauuccuucaaagc

SEQ ID NO: 2551477 - RNA, 18 nt, Chlamydophila pneumoniae J138
guaauccuucuuucugcu

SEQ ID NO: 2551478 - RNA, 23 nt, Chlamydophila pneumoniae J138
guaauccuucuuucugcucuucu

SEQ ID NO: 2551479 - RNA, 12 nt, Chlamydophila pneumoniae J138
guaaucuaagaa

SEQ ID NO: 2551480 - RNA, 14 nt, Chlamydophila pneumoniae J138
guaaugccagcagc

SEQ ID NO: 2551481 - RNA, 20 nt, Chlamydophila pneumoniae J138
guaauuccaaaauaaaagga

SEQ ID NO: 2551482 - RNA, 22 nt, Chlamydophila pneumoniae J138
guaauuucuaaauagaaaacau

SEQ ID NO: 2551483 - RNA, 17 nt, Chlamydophila pneumoniae J138
guacaagcuucaucaaa

SEQ ID NO: 2551484 - RNA, 18 nt, Chlamydophila pneumoniae J138
guacaauuugcuccucca

SEQ ID NO: 2551485 - RNA, 20 nt, Chlamydophila pneumoniae J138
guacacauugucucuuuuaa

SEQ ID NO: 2551486 - RNA, 18 nt, Chlamydophila pneumoniae J138
guacaggaaguccaugua

SEQ ID NO: 2551487 - RNA, 16 nt, Chlamydophila pneumoniae J138
guacaguuuuuuucua

SEQ ID NO: 2551488 - RNA, 12 nt, Chlamydophila pneumoniae J138
guaccaagaaaa

SEQ ID NO: 2551489 - RNA, 15 nt, Chlamydophila pneumoniae J138
guaccacauacucuu

SEQ ID NO: 2551490 - RNA, 16 nt, Chlamydophila pneumoniae J138
guaccacauacucuuc

SEQ ID NO: 2551491 - RNA, 17 nt, Chlamydophila pneumoniae J138
guaccacauacucuuca

SEQ ID NO: 2551492 - RNA, 13 nt, Chlamydophila pneumoniae J138
guaccuaggaucu

SEQ ID NO: 2551493 - RNA, 21 nt, Chlamydophila pneumoniae J138
guaccuucucgucauucugca

SEQ ID NO: 2551494 - RNA, 14 nt, Chlamydophila pneumoniae J138
guacgaaaaucuac

SEQ ID NO: 2551495 - RNA, 18 nt, Chlamydophila pneumoniae J138
guacgcaaguaaagaaau

SEQ ID NO: 2551496 - RNA, 19 nt, Chlamydophila pneumoniae J138
guacgcaaguaaagaaauu

SEQ ID NO: 2551497 - RNA, 21 nt, Chlamydophila pneumoniae J138
guacgucuuucaccaacuccu

SEQ ID NO: 2551498 - RNA, 13 nt, Chlamydophila pneumoniae J138
guacuaagauacg

SEQ ID NO: 2551499 - RNA, 19 nt, Chlamydophila pneumoniae J138
guacuuccccaaacaugga

SEQ ID NO: 2551500 - RNA, 17 nt, Chlamydophila pneumoniae J138
guagaacuucucaagaa

SEQ ID NO: 2551501 - RNA, 16 nt, Chlamydophila pneumoniae J138
guagaauaacgcaagg

SEQ ID NO: 2551502 - RNA, 13 nt, Chlamydophila pneumoniae J138
guagaauccuucu

SEQ ID NO: 2551503 - RNA, 19 nt, Chlamydophila pneumoniae J138
guagaauccuucucccucu

SEQ ID NO: 2551504 - RNA, 20 nt, Chlamydophila pneumoniae J138
guagacaacaagucuucccu

SEQ ID NO: 2551505 - RNA, 14 nt, Chlamydophila pneumoniae J138
guagagagaaucga

SEQ ID NO: 2551506 - RNA, 12 nt, Chlamydophila pneumoniae J138
guagagcaagau

SEQ ID NO: 2551507 - RNA, 19 nt, Chlamydophila pneumoniae J138
guagagccucuaagaaaau

SEQ ID NO: 2551508 - RNA, 17 nt, Chlamydophila pneumoniae J138
guagaggacgugcuccc

SEQ ID NO: 2551509 - RNA, 14 nt, Chlamydophila pneumoniae J138
guagaguccacagu

SEQ ID NO: 2551510 - RNA, 12 nt, Chlamydophila pneumoniae J138
guagauccauga

SEQ ID NO: 2551511 - RNA, 20 nt, Chlamydophila pneumoniae J138
guagaucuucugaaaucaaa

SEQ ID NO: 2551512 - RNA, 16 nt, Chlamydophila pneumoniae J138
guagcagagccucacu

SEQ ID NO: 2551513 - RNA, 23 nt, Chlamydophila pneumoniae J138
guagccgaggcgauuuucaugga

SEQ ID NO: 2551514 - RNA, 21 nt, Chlamydophila pneumoniae J138
guagccguaggguagccaucc

SEQ ID NO: 2551515 - RNA, 24 nt, Chlamydophila pneumoniae J138
guagccuggaggcgguggcaugcc

SEQ ID NO: 2551516 - RNA, 19 nt, Chlamydophila pneumoniae J138
guagcgcuuccagcuucuc

SEQ ID NO: 2551517 - RNA, 19 nt, Chlamydophila pneumoniae J138
guagcgucucuucuuccuc

SEQ ID NO: 2551518 - RNA, 22 nt, Chlamydophila pneumoniae J138
guagcuacaaaauuauuaaacu

SEQ ID NO: 2551519 - RNA, 15 nt, Chlamydophila pneumoniae J138
guagcuauucucaaa

SEQ ID NO: 2551520 - RNA, 17 nt, Chlamydophila pneumoniae J138
guagcuauuuuugagga

SEQ ID NO: 2551521 - RNA, 18 nt, Chlamydophila pneumoniae J138
guagcucaggaaaacuua

SEQ ID NO: 2551522 - RNA, 12 nt, Chlamydophila pneumoniae J138
guaggagcagcg

SEQ ID NO: 2551523 - RNA, 18 nt, Chlamydophila pneumoniae J138
guaggaugugaaggauca

SEQ ID NO: 2551524 - RNA, 16 nt, Chlamydophila pneumoniae J138
guagucaaaaauucuu

SEQ ID NO: 2551525 - RNA, 15 nt, Chlamydophila pneumoniae J138
guagucaugauuuuu

SEQ ID NO: 2551526 - RNA, 20 nt, Chlamydophila pneumoniae J138
guagugauacuuuagaaucc

SEQ ID NO: 2551527 - RNA, 16 nt, Chlamydophila pneumoniae J138
guagugcuaucauaac

SEQ ID NO: 2551528 - RNA, 14 nt, Chlamydophila pneumoniae J138
guaguuugccuucu

SEQ ID NO: 2551529 - RNA, 22 nt, Chlamydophila pneumoniae J138
guauaaaguuuguaaaaacugu

SEQ ID NO: 2551530 - RNA, 22 nt, Chlamydophila pneumoniae J138
guauaacaucuaaaaaugcacu

SEQ ID NO: 2551531 - RNA, 22 nt, Chlamydophila pneumoniae J138
guauaauuggcguaauaauucc

SEQ ID NO: 2551532 - RNA, 15 nt, Chlamydophila pneumoniae J138
guauacaucccauuc

SEQ ID NO: 2551533 - RNA, 16 nt, Chlamydophila pneumoniae J138
guauacgguaaugcca

SEQ ID NO: 2551534 - RNA, 15 nt, Chlamydophila pneumoniae J138
guauacuaagacugu

SEQ ID NO: 2551535 - RNA, 22 nt, Chlamydophila pneumoniae J138
guauagacuccuuaacaaccgc

SEQ ID NO: 2551536 - RNA, 23 nt, Chlamydophila pneumoniae J138
guuccagccugugagcucucgac

SEQ ID NO: 2551537 - RNA, 22 nt, Chlamydophila pneumoniae J138
guuccauagaguaucuaaaacu

SEQ ID NO: 2551538 - RNA, 13 nt, Chlamydophila pneumoniae J138
guuccauuuucag

SEQ ID NO: 2551539 - RNA, 17 nt, Chlamydophila pneumoniae J138
guucccaaauagaaaau

SEQ ID NO: 2551540 - RNA, 19 nt, Chlamydophila pneumoniae J138
guucccaucacauaaauca

SEQ ID NO: 2551541 - RNA, 19 nt, Chlamydophila pneumoniae J138
guucccuaaaguaacgaua

SEQ ID NO: 2551542 - RNA, 17 nt, Chlamydophila pneumoniae J138
guucccuggaugaacuc

SEQ ID NO: 2551543 - RNA, 20 nt, Chlamydophila pneumoniae J138
guuccuacuucugcaggacu

SEQ ID NO: 2551544 - RNA, 12 nt, Chlamydophila pneumoniae J138
guuccucauccu

SEQ ID NO: 2551545 - RNA, 18 nt, Chlamydophila pneumoniae J138
guuccucauccucaucau

SEQ ID NO: 2551546 - RNA, 21 nt, Chlamydophila pneumoniae J138
guuccuguaguuugcagagag

SEQ ID NO: 2551547 - RNA, 22 nt, Chlamydophila pneumoniae J138
guuccuguaguuugcagagagu

SEQ ID NO: 2551548 - RNA, 14 nt, Chlamydophila pneumoniae J138
guucgaauccuucu

SEQ ID NO: 2551549 - RNA, 14 nt, Chlamydophila pneumoniae J138
guucgcacuaauuu

SEQ ID NO: 2551550 - RNA, 16 nt, Chlamydophila pneumoniae J138
guucggucucuucucu

SEQ ID NO: 2551551 - RNA, 13 nt, Chlamydophila pneumoniae J138
guucuaagaaauc

SEQ ID NO: 2551552 - RNA, 17 nt, Chlamydophila pneumoniae J138
guucuagcaaaucuaaa

SEQ ID NO: 2551553 - RNA, 19 nt, Chlamydophila pneumoniae J138
guucucaaagaucaucuac

SEQ ID NO: 2551554 - RNA, 15 nt, Chlamydophila pneumoniae J138
guucucaauaauaga

SEQ ID NO: 2551555 - RNA, 16 nt, Chlamydophila pneumoniae J138
guucuccacaugccca

SEQ ID NO: 2551556 - RNA, 17 nt, Chlamydophila pneumoniae J138
guucucccgugaacaaa

SEQ ID NO: 2551557 - RNA, 20 nt, Chlamydophila pneumoniae J138
guucucccgugaacaaaaac

SEQ ID NO: 2551558 - RNA, 17 nt, Chlamydophila pneumoniae J138
guucucuaagacugugu

SEQ ID NO: 2551559 - RNA, 22 nt, Chlamydophila pneumoniae J138
guucuuaucgggggugccaaaa

SEQ ID NO: 2551560 - RNA, 12 nt, Chlamydophila pneumoniae J138
guucuucauucc

SEQ ID NO: 2551561 - RNA, 16 nt, Chlamydophila pneumoniae J138
guucuugaaguucuuc

SEQ ID NO: 2551562 - RNA, 14 nt, Chlamydophila pneumoniae J138
guucuuguaauaaa

SEQ ID NO: 2551563 - RNA, 17 nt, Chlamydophila pneumoniae J138
guucuuguaauaaaaga

SEQ ID NO: 2551564 - RNA, 10 nt, Chlamydophila pneumoniae J138
guucuuucug

SEQ ID NO: 2551565 - RNA, 17 nt, Chlamydophila pneumoniae J138
guucuuugaauuuccaa

SEQ ID NO: 2551566 - RNA, 20 nt, Chlamydophila pneumoniae J138
guucuuuuguuugucuucca

SEQ ID NO: 2551567 - RNA, 17 nt, Chlamydophila pneumoniae J138
guugaaaugagugagaa

SEQ ID NO: 2551568 - RNA, 15 nt, Chlamydophila pneumoniae J138
guugaccuuuuucau

SEQ ID NO: 2551569 - RNA, 19 nt, Chlamydophila pneumoniae J138
guugagaaccuucacaaga

SEQ ID NO: 2551570 - RNA, 16 nt, Chlamydophila pneumoniae J138
guugaggaaaggaggg

SEQ ID NO: 2551571 - RNA, 21 nt, Chlamydophila pneumoniae J138
guugauuucgugaacaaaauc

SEQ ID NO: 2551572 - RNA, 23 nt, Chlamydophila pneumoniae J138
guugcaucgccuuaagcucuaag

SEQ ID NO: 2551573 - RNA, 22 nt, Chlamydophila pneumoniae J138
guugcaugcuugaaguucucaa

SEQ ID NO: 2551574 - RNA, 16 nt, Chlamydophila pneumoniae J138
guugccaaucuuucau

SEQ ID NO: 2551575 - RNA, 19 nt, Chlamydophila pneumoniae J138
guugcgcaguggacgggga

SEQ ID NO: 2551576 - RNA, 14 nt, Chlamydophila pneumoniae J138
guugcuaagaucuu

SEQ ID NO: 2551577 - RNA, 20 nt, Chlamydophila pneumoniae J138
guugcuaagaucuuuagaau

SEQ ID NO: 2551578 - RNA, 17 nt, Chlamydophila pneumoniae J138
guugcuaagcgaaccaa

SEQ ID NO: 2551579 - RNA, 16 nt, Chlamydophila pneumoniae J138
guugcucauccuuuag

SEQ ID NO: 2551580 - RNA, 19 nt, Chlamydophila pneumoniae J138
guugcuucuaagaaacuuc

SEQ ID NO: 2551581 - RNA, 20 nt, Chlamydophila pneumoniae J138
guuggauccaucggcauuuc

SEQ ID NO: 2551582 - RNA, 23 nt, Chlamydophila pneumoniae J138
guuggauccaucggcauuucucc

SEQ ID NO: 2551583 - RNA, 18 nt, Chlamydophila pneumoniae J138
guugggagcuuccuccaa

SEQ ID NO: 2551584 - RNA, 16 nt, Chlamydophila pneumoniae J138
guugggcucauaaccc

SEQ ID NO: 2551585 - RNA, 14 nt, Chlamydophila pneumoniae J138
guuguaauaaaaga

SEQ ID NO: 2551586 - RNA, 18 nt, Chlamydophila pneumoniae J138
guuguagugaaugagcuu

SEQ ID NO: 2551587 - RNA, 21 nt, Chlamydophila pneumoniae J138
guuguagugaaugagcuucac

SEQ ID NO: 2551588 - RNA, 14 nt, Chlamydophila pneumoniae J138
guuguauccagcuc

SEQ ID NO: 2551589 - RNA, 22 nt, Chlamydophila pneumoniae J138
guugucacuaagauaucuccag

SEQ ID NO: 2551590 - RNA, 19 nt, Chlamydophila pneumoniae J138
guugucagcuuugcuuauu

SEQ ID NO: 2551591 - RNA, 15 nt, Chlamydophila pneumoniae J138
guuguccuuuauaau

SEQ ID NO: 2551592 - RNA, 18 nt, Chlamydophila pneumoniae J138
guuguugauaauuacaga

SEQ ID NO: 2551593 - RNA, 18 nt, Chlamydophila pneumoniae J138
guuguugcaauucuucau

SEQ ID NO: 2551594 - RNA, 15 nt, Chlamydophila pneumoniae J138
guuguuggagcagaa

SEQ ID NO: 2551595 - RNA, 15 nt, Chlamydophila pneumoniae J138
guuguuuuugcugaa

SEQ ID NO: 2551596 - RNA, 14 nt, Chlamydophila pneumoniae J138
guuguuuuuugaga

SEQ ID NO: 2551597 - RNA, 21 nt, Chlamydophila pneumoniae J138
guuuacagaugcaugauccua

SEQ ID NO: 2551598 - RNA, 16 nt, Chlamydophila pneumoniae J138
guuuaccugaaaaaac

SEQ ID NO: 2551599 - RNA, 17 nt, Chlamydophila pneumoniae J138
guuuaccugaaaaaaca

SEQ ID NO: 2551600 - RNA, 16 nt, Chlamydophila pneumoniae J138
guuuagaaaaagaucu

SEQ ID NO: 2551601 - RNA, 20 nt, Chlamydophila pneumoniae J138
guuuagacgaggagaagucg

SEQ ID NO: 2551602 - RNA, 12 nt, Chlamydophila pneumoniae J138
guuuagguaggc

SEQ ID NO: 2551603 - RNA, 22 nt, Chlamydophila pneumoniae J138
guuucaaacaauaguaaagcau

SEQ ID NO: 2551604 - RNA, 14 nt, Chlamydophila pneumoniae J138
guuucaacauaaca

SEQ ID NO: 2551605 - RNA, 15 nt, Chlamydophila pneumoniae J138
guuucaaucucuccu

SEQ ID NO: 2551606 - RNA, 17 nt, Chlamydophila pneumoniae J138
guuucaaucucuccuug

SEQ ID NO: 2551607 - RNA, 23 nt, Chlamydophila pneumoniae J138
guuucacaggcuacauaguuuuu

SEQ ID NO: 2551608 - RNA, 15 nt, Chlamydophila pneumoniae J138
guuucagaaggaucu

SEQ ID NO: 2551609 - RNA, 21 nt, Chlamydophila pneumoniae J138
guuuccaagacaacaccuccc

SEQ ID NO: 2551610 - RNA, 14 nt, Chlamydophila pneumoniae J138
guuucccccauaaa

SEQ ID NO: 2551611 - RNA, 19 nt, Chlamydophila pneumoniae J138
guuuccgaucauuuuugcu

SEQ ID NO: 2551612 - RNA, 21 nt, Chlamydophila pneumoniae J138
guuucuaaaacagaaauugcu

SEQ ID NO: 2551613 - RNA, 13 nt, Chlamydophila pneumoniae J138
guuucuagguucu

SEQ ID NO: 2551614 - RNA, 16 nt, Chlamydophila pneumoniae J138
guuucucuggcaauga

SEQ ID NO: 2551615 - RNA, 22 nt, Chlamydophila pneumoniae J138
guuucuuccugaaucagcuuau

SEQ ID NO: 2551616 - RNA, 21 nt, Chlamydophila pneumoniae J138
guuucuucugugcaucaguca

SEQ ID NO: 2551617 - RNA, 11 nt, Chlamydophila pneumoniae J138
guuucuuucca

SEQ ID NO: 2551618 - RNA, 21 nt, Chlamydophila pneumoniae J138
guuucuuuugauugaaacuuu

SEQ ID NO: 2551619 - RNA, 22 nt, Chlamydophila pneumoniae J138
guuucuuuugauugaaacuuuu

SEQ ID NO: 2551620 - RNA, 14 nt, Chlamydophila pneumoniae J138
guuucuuuugcaaa

SEQ ID NO: 2551621 - RNA, 18 nt, Chlamydophila pneumoniae J138
guuuggcaguucacugag

SEQ ID NO: 2551622 - RNA, 13 nt, Chlamydophila pneumoniae J138
guuuguagaggua

SEQ ID NO: 2551623 - RNA, 23 nt, Chlamydophila pneumoniae J138
guuuguaguaaggagagacugug

SEQ ID NO: 2551624 - RNA, 18 nt, Chlamydophila pneumoniae J138
guuuguaguguugaauaa

SEQ ID NO: 2551625 - RNA, 21 nt, Chlamydophila pneumoniae J138
guuuguaguguugaauaagau

SEQ ID NO: 2551626 - RNA, 13 nt, Chlamydophila pneumoniae J138
guuugucgagcuu

SEQ ID NO: 2551627 - RNA, 13 nt, Chlamydophila pneumoniae J138
guuugucuuccau

SEQ ID NO: 2551628 - RNA, 15 nt, Chlamydophila pneumoniae J138
guuugugggcauuua

SEQ ID NO: 2551629 - RNA, 16 nt, Chlamydophila pneumoniae J138
guuuguucuaaagcug

SEQ ID NO: 2551630 - RNA, 14 nt, Chlamydophila pneumoniae J138
guuuguuuucuauc

SEQ ID NO: 2551631 - RNA, 14 nt, Chlamydophila pneumoniae J138
guuuuaacucuaga

SEQ ID NO: 2551632 - RNA, 22 nt, Chlamydophila pneumoniae J138
guuuuaagaagguuuauuagaa

SEQ ID NO: 2551633 - RNA, 16 nt, Chlamydophila pneumoniae J138
guuuuaauuguagaga

SEQ ID NO: 2551634 - RNA, 22 nt, Chlamydophila pneumoniae J138
guuuuauccaccaagacugaau

SEQ ID NO: 2551635 - RNA, 21 nt, Chlamydophila pneumoniae J138
guuuuaucggcaauuguuaaa

SEQ ID NO: 2551636 - RNA, 21 nt, Chlamydophila pneumoniae J138
guuuuaucuuuagagucugca

SEQ ID NO: 2551637 - RNA, 19 nt, Chlamydophila pneumoniae J138
uaaacucuccaaaagcucu

SEQ ID NO: 2551638 - RNA, 21 nt, Chlamydophila pneumoniae J138
uaaacucucuuccuucuccug

SEQ ID NO: 2551639 - RNA, 23 nt, Chlamydophila pneumoniae J138
uaaacucucuuccuucuccugua

SEQ ID NO: 2551640 - RNA, 19 nt, Chlamydophila pneumoniae J138
uaaacugacguuuuucccu

SEQ ID NO: 2551641 - RNA, 22 nt, Chlamydophila pneumoniae J138
uaaacugggaagaccacgaaau

SEQ ID NO: 2551642 - RNA, 13 nt, Chlamydophila pneumoniae J138
uaaacuuucuucu

SEQ ID NO: 2551643 - RNA, 19 nt, Chlamydophila pneumoniae J138
uaaacuuuuuuucaaauca

SEQ ID NO: 2551644 - RNA, 18 nt, Chlamydophila pneumoniae J138
uaaagaaagagucucacu

SEQ ID NO: 2551645 - RNA, 14 nt, Chlamydophila pneumoniae J138
uaaagaaauucugg

SEQ ID NO: 2551646 - RNA, 23 nt, Chlamydophila pneumoniae J138
uaaagaagaaaccccaugucuga

SEQ ID NO: 2551647 - RNA, 21 nt, Chlamydophila pneumoniae J138
uaaagaaggagguccuuggca

SEQ ID NO: 2551648 - RNA, 21 nt, Chlamydophila pneumoniae J138
uaaagaagguuucuagguucu

SEQ ID NO: 2551649 - RNA, 19 nt, Chlamydophila pneumoniae J138
uaaagaaguuuacaaauaa

SEQ ID NO: 2551650 - RNA, 14 nt, Chlamydophila pneumoniae J138
uaaagaaucacucu

SEQ ID NO: 2551651 - RNA, 13 nt, Chlamydophila pneumoniae J138
uaaagaauucucc

SEQ ID NO: 2551652 - RNA, 18 nt, Chlamydophila pneumoniae J138
uaaagacccuucuuucca

SEQ ID NO: 2551653 - RNA, 16 nt, Chlamydophila pneumoniae J138
uaaagacucucuucca

SEQ ID NO: 2551654 - RNA, 18 nt, Chlamydophila pneumoniae J138
uaaagagaaucuccucau

SEQ ID NO: 2551655 - RNA, 15 nt, Chlamydophila pneumoniae J138
uaaagagcauccugu

SEQ ID NO: 2551656 - RNA, 21 nt, Chlamydophila pneumoniae J138
uaaagagcugauccagcucca

SEQ ID NO: 2551657 - RNA, 15 nt, Chlamydophila pneumoniae J138
uaaagaguagcccca

SEQ ID NO: 2551658 - RNA, 17 nt, Chlamydophila pneumoniae J138
uaaagauacuuaucuuu

SEQ ID NO: 2551659 - RNA, 20 nt, Chlamydophila pneumoniae J138
uaaagauacuuaucuuuaaa

SEQ ID NO: 2551660 - RNA, 21 nt, Chlamydophila pneumoniae J138
uaaagauagcgacgucaucau

SEQ ID NO: 2551661 - RNA, 14 nt, Chlamydophila pneumoniae J138
uaaagaucuucaua

SEQ ID NO: 2551662 - RNA, 15 nt, Chlamydophila pneumoniae J138
uaaagaucuucauaa

SEQ ID NO: 2551663 - RNA, 19 nt, Chlamydophila pneumoniae J138
uaaagaucuucauaaccaa

SEQ ID NO: 2551664 - RNA, 23 nt, Chlamydophila pneumoniae J138
uaaagaucuuuuaugauguauaa

SEQ ID NO: 2551665 - RNA, 19 nt, Chlamydophila pneumoniae J138
uaaagauguagaauaacgc

SEQ ID NO: 2551666 - RNA, 23 nt, Chlamydophila pneumoniae J138
uaaagauuccccauaaccaauaa

SEQ ID NO: 2551667 - RNA, 20 nt, Chlamydophila pneumoniae J138
uaaagauuucguauagcugg

SEQ ID NO: 2551668 - RNA, 15 nt, Chlamydophila pneumoniae J138
uaaagauuuucauaa

SEQ ID NO: 2551669 - RNA, 20 nt, Chlamydophila pneumoniae J138
uaaagcaaagauaaagaagu

SEQ ID NO: 2551670 - RNA, 21 nt, Chlamydophila pneumoniae J138
uaaagcaaagauaaagaaguu

SEQ ID NO: 2551671 - RNA, 23 nt, Chlamydophila pneumoniae J138
uaaagcauacuuauauuggcuuu

SEQ ID NO: 2551672 - RNA, 15 nt, Chlamydophila pneumoniae J138
uaaagcaucacggac

SEQ ID NO: 2551673 - RNA, 17 nt, Chlamydophila pneumoniae J138
uaaagcauuggacaacg

SEQ ID NO: 2551674 - RNA, 19 nt, Chlamydophila pneumoniae J138
uaaagccacauucuucuga

SEQ ID NO: 2551675 - RNA, 22 nt, Chlamydophila pneumoniae J138
uaaagccccacccacuccagaa

SEQ ID NO: 2551676 - RNA, 23 nt, Chlamydophila pneumoniae J138
uaaagccccacccacuccagaaa

SEQ ID NO: 2551677 - RNA, 15 nt, Chlamydophila pneumoniae J138
uaaagcuauuguuuu

SEQ ID NO: 2551678 - RNA, 19 nt, Chlamydophila pneumoniae J138
uaaagcuauuguuuuucaa

SEQ ID NO: 2551679 - RNA, 14 nt, Chlamydophila pneumoniae J138
uaaagcuccgagaa

SEQ ID NO: 2551680 - RNA, 14 nt, Chlamydophila pneumoniae J138
uaaagcugcuuuuu

SEQ ID NO: 2551681 - RNA, 22 nt, Chlamydophila pneumoniae J138
uaaagcuguaaccaacaucaaa

SEQ ID NO: 2551682 - RNA, 15 nt, Chlamydophila pneumoniae J138
uaaaggaacugugcc

SEQ ID NO: 2551683 - RNA, 19 nt, Chlamydophila pneumoniae J138
uaaaggaaucucgggagaa

SEQ ID NO: 2551684 - RNA, 15 nt, Chlamydophila pneumoniae J138
uaaaggacauagacu

SEQ ID NO: 2551685 - RNA, 22 nt, Chlamydophila pneumoniae J138
uaaaggaccuguuuucuuuucu

SEQ ID NO: 2551686 - RNA, 18 nt, Chlamydophila pneumoniae J138
uaaaggcauaacugugcu

SEQ ID NO: 2551687 - RNA, 23 nt, Chlamydophila pneumoniae J138
uaaaggcauagauacaaacaucg

SEQ ID NO: 2551688 - RNA, 18 nt, Chlamydophila pneumoniae J138
uaaagguuguaaggacga

SEQ ID NO: 2551689 - RNA, 12 nt, Chlamydophila pneumoniae J138
uaaagguuuuaa

SEQ ID NO: 2551690 - RNA, 14 nt, Chlamydophila pneumoniae J138
uaaaguaaaaaaua

SEQ ID NO: 2551691 - RNA, 21 nt, Chlamydophila pneumoniae J138
uaaaguaauaucgguuucuuu

SEQ ID NO: 2551692 - RNA, 17 nt, Chlamydophila pneumoniae J138
uaaaguagaauccuucu

SEQ ID NO: 2551693 - RNA, 13 nt, Chlamydophila pneumoniae J138
uaaaguccaagau

SEQ ID NO: 2551694 - RNA, 20 nt, Chlamydophila pneumoniae J138
uaaagugaaagcaacuccau

SEQ ID NO: 2551695 - RNA, 19 nt, Chlamydophila pneumoniae J138
uaaagugucauacgcagca

SEQ ID NO: 2551696 - RNA, 17 nt, Chlamydophila pneumoniae J138
uaaaguguguaaauguu

SEQ ID NO: 2551697 - RNA, 13 nt, Chlamydophila pneumoniae J138
uaaauaaaaccac

SEQ ID NO: 2551698 - RNA, 20 nt, Chlamydophila pneumoniae J138
uaaauaaaaccacuucucug

SEQ ID NO: 2551699 - RNA, 11 nt, Chlamydophila pneumoniae J138
uaaauaaaauc

SEQ ID NO: 2551700 - RNA, 23 nt, Chlamydophila pneumoniae J138
uaaauagaaaacauagagauucu

SEQ ID NO: 2551701 - RNA, 18 nt, Chlamydophila pneumoniae J138
uaaauagaaaucuuaguc

SEQ ID NO: 2551702 - RNA, 18 nt, Chlamydophila pneumoniae J138
uaaauagcaucccuucuu

SEQ ID NO: 2551703 - RNA, 17 nt, Chlamydophila pneumoniae J138
uaaauagcucaguuggu

SEQ ID NO: 2551704 - RNA, 20 nt, Chlamydophila pneumoniae J138
uaaauaugaauuagggcuuu

SEQ ID NO: 2551705 - RNA, 21 nt, Chlamydophila pneumoniae J138
uaaauauuuuaccauugagau

SEQ ID NO: 2551706 - RNA, 12 nt, Chlamydophila pneumoniae J138
uaaaucaaaauu

SEQ ID NO: 2551707 - RNA, 22 nt, Chlamydophila pneumoniae J138
uaaaucaaaauuuuuaguaauu

SEQ ID NO: 2551708 - RNA, 20 nt, Chlamydophila pneumoniae J138
uaaaucaacuacaucuccaa

SEQ ID NO: 2551709 - RNA, 19 nt, Chlamydophila pneumoniae J138
uaaauccaccaaugauaau

SEQ ID NO: 2551710 - RNA, 20 nt, Chlamydophila pneumoniae J138
uaaaucccacuaucuguaau

SEQ ID NO: 2551711 - RNA, 20 nt, Chlamydophila pneumoniae J138
uaaauccccaccaacaaugc

SEQ ID NO: 2551712 - RNA, 17 nt, Chlamydophila pneumoniae J138
uaaaucuauacccaguu

SEQ ID NO: 2551713 - RNA, 21 nt, Chlamydophila pneumoniae J138
uaaaucuauacccaguuguau

SEQ ID NO: 2551714 - RNA, 14 nt, Chlamydophila pneumoniae J138
uaaaucuauaucca

SEQ ID NO: 2551715 - RNA, 17 nt, Chlamydophila pneumoniae J138
uaaaugccuuaaaugua

SEQ ID NO: 2551716 - RNA, 18 nt, Chlamydophila pneumoniae J138
uaaaugccuuaaauguau

SEQ ID NO: 2551717 - RNA, 19 nt, Chlamydophila pneumoniae J138
uaaaugcuauuuuccucua

SEQ ID NO: 2551718 - RNA, 20 nt, Chlamydophila pneumoniae J138
uaaauguauaggcauuaaua

SEQ ID NO: 2551719 - RNA, 17 nt, Chlamydophila pneumoniae J138
uaaaugugaaaucguau

SEQ ID NO: 2551720 - RNA, 21 nt, Chlamydophila pneumoniae J138
uaaauguugggaugaucucgu

SEQ ID NO: 2551721 - RNA, 19 nt, Chlamydophila pneumoniae J138
uaaauguuuucuaugaucc

SEQ ID NO: 2551722 - RNA, 21 nt, Chlamydophila pneumoniae J138
uaaauguuuugcgauaucuau

SEQ ID NO: 2551723 - RNA, 14 nt, Chlamydophila pneumoniae J138
uaaauuaaauaucu

SEQ ID NO: 2551724 - RNA, 15 nt, Chlamydophila pneumoniae J138
uaaauuaaauaucua

SEQ ID NO: 2551725 - RNA, 14 nt, Chlamydophila pneumoniae J138
uaaauuaguaaaug

SEQ ID NO: 2551726 - RNA, 23 nt, Chlamydophila pneumoniae J138
uaaauuguauggaauucaaacuc

SEQ ID NO: 2551727 - RNA, 14 nt, Chlamydophila pneumoniae J138
uaaauuuaagucac

SEQ ID NO: 2551728 - RNA, 17 nt, Chlamydophila pneumoniae J138
uaaauuuaagucacuaa

SEQ ID NO: 2551729 - RNA, 12 nt, Chlamydophila pneumoniae J138
uaaauuugucau

SEQ ID NO: 2551730 - RNA, 21 nt, Chlamydophila pneumoniae J138
uaaauuugucaucacaucagu

SEQ ID NO: 2551731 - RNA, 20 nt, Chlamydophila pneumoniae J138
uaaauuuuguuuuuccauuu

SEQ ID NO: 2551732 - RNA, 14 nt, Chlamydophila pneumoniae J138
uaaauuuuuccuuc

SEQ ID NO: 2551733 - RNA, 23 nt, Chlamydophila pneumoniae J138
uaacaaaaggauucuaugaggac

SEQ ID NO: 2551734 - RNA, 14 nt, Chlamydophila pneumoniae J138
uaacaaaguuuaug

SEQ ID NO: 2551735 - RNA, 20 nt, Chlamydophila pneumoniae J138
uaacaaccgccuuuauauaa

SEQ ID NO: 2551736 - RNA, 22 nt, Chlamydophila pneumoniae J138
uaacaacuagguuauuaucaaa

SEQ ID NO: 2551737 - RNA, 15 nt, Chlamydophila pneumoniae J138
uaacaagauucucag

SEQ ID NO: 2551738 - RNA, 19 nt, Chlamydophila pneumoniae J138
uaacaaguaccaagaaaau

SEQ ID NO: 2551739 - RNA, 22 nt, Chlamydophila pneumoniae J138
uaacaaguaccaagaaaauagu

SEQ ID NO: 2551740 - RNA, 15 nt, Chlamydophila pneumoniae J138
uaacaauauaugcua

SEQ ID NO: 2551741 - RNA, 14 nt, Chlamydophila pneumoniae J138
uaacaccucuucaa

SEQ ID NO: 2551742 - RNA, 21 nt, Chlamydophila pneumoniae J138
uaacacuuccuacggcaagaa

SEQ ID NO: 2551743 - RNA, 22 nt, Chlamydophila pneumoniae J138
uaacacuuccuacggcaagaau

SEQ ID NO: 2551744 - RNA, 15 nt, Chlamydophila pneumoniae J138
uaacacuucuuucuu

SEQ ID NO: 2551745 - RNA, 13 nt, Chlamydophila pneumoniae J138
uaacauaaaguca

SEQ ID NO: 2551746 - RNA, 13 nt, Chlamydophila pneumoniae J138
uaacauagauaag

SEQ ID NO: 2551747 - RNA, 14 nt, Chlamydophila pneumoniae J138
uaacaucaagaauu

SEQ ID NO: 2551748 - RNA, 19 nt, Chlamydophila pneumoniae J138
uaacaucuaaaaaugcacu

SEQ ID NO: 2551749 - RNA, 18 nt, Chlamydophila pneumoniae J138
uaacaugcgcagaauaaa

SEQ ID NO: 2551750 - RNA, 20 nt, Chlamydophila pneumoniae J138
uaacaugcgcagaauaaaau

SEQ ID NO: 2551751 - RNA, 19 nt, Chlamydophila pneumoniae J138
uaacauuucguuuuuucuu

SEQ ID NO: 2551752 - RNA, 20 nt, Chlamydophila pneumoniae J138
uaaccaaaagaauuaagaag

SEQ ID NO: 2551753 - RNA, 17 nt, Chlamydophila pneumoniae J138
uaaccaacaucaaagaa

SEQ ID NO: 2551754 - RNA, 15 nt, Chlamydophila pneumoniae J138
uaaccaaguaaauca

SEQ ID NO: 2551755 - RNA, 14 nt, Chlamydophila pneumoniae J138
uaaccaauaaacuu

SEQ ID NO: 2551756 - RNA, 12 nt, Chlamydophila pneumoniae J138
uaaccagagagc

SEQ ID NO: 2551757 - RNA, 13 nt, Chlamydophila pneumoniae J138
uaacccaccagaa

SEQ ID NO: 2551758 - RNA, 19 nt, Chlamydophila pneumoniae J138
uaacccaccagaaggaagg

SEQ ID NO: 2551759 - RNA, 21 nt, Chlamydophila pneumoniae J138
uaaccgucacuguuuuccaga

SEQ ID NO: 2551760 - RNA, 24 nt, Chlamydophila pneumoniae J138
uaaccuaauacaggagcuaaagcu

SEQ ID NO: 2551761 - RNA, 13 nt, Chlamydophila pneumoniae J138
uaaccuccucuuc

SEQ ID NO: 2551762 - RNA, 14 nt, Chlamydophila pneumoniae J138
uaaccucuuuucuu

SEQ ID NO: 2551763 - RNA, 20 nt, Chlamydophila pneumoniae J138
uaacgaagugaggagaauag

SEQ ID NO: 2551764 - RNA, 22 nt, Chlamydophila pneumoniae J138
uaacgaagugaggagaauagca

SEQ ID NO: 2551765 - RNA, 13 nt, Chlamydophila pneumoniae J138
uaacgcugcuaau

SEQ ID NO: 2551766 - RNA, 13 nt, Chlamydophila pneumoniae J138
uaacgcuuuucua

SEQ ID NO: 2551767 - RNA, 19 nt, Chlamydophila pneumoniae J138
uaacgcuuuuucaaacugu

SEQ ID NO: 2551768 - RNA, 16 nt, Chlamydophila pneumoniae J138
uaacguagucaaaaau

SEQ ID NO: 2551769 - RNA, 15 nt, Chlamydophila pneumoniae J138
uaacguauuucacaa

SEQ ID NO: 2551770 - RNA, 21 nt, Chlamydophila pneumoniae J138
uaacguuucaggucagcaagg

SEQ ID NO: 2551771 - RNA, 20 nt, Chlamydophila pneumoniae J138
uaacguuucuucgcaaauau

SEQ ID NO: 2551772 - RNA, 18 nt, Chlamydophila pneumoniae J138
uaacuaaauucuuaacaa

SEQ ID NO: 2551773 - RNA, 14 nt, Chlamydophila pneumoniae J138
uaacuaagauaugu

SEQ ID NO: 2551774 - RNA, 13 nt, Chlamydophila pneumoniae J138
uaacuaguaacuu

SEQ ID NO: 2551775 - RNA, 18 nt, Chlamydophila pneumoniae J138
uaacucagagauugccag

SEQ ID NO: 2551776 - RNA, 21 nt, Chlamydophila pneumoniae J138
uaacuccaggggauaaaacua

SEQ ID NO: 2551777 - RNA, 22 nt, Chlamydophila pneumoniae J138
uaacuccaggggauaaaacuau

SEQ ID NO: 2551778 - RNA, 21 nt, Chlamydophila pneumoniae J138
uaacucggaaaaaauagaucc

SEQ ID NO: 2551779 - RNA, 17 nt, Chlamydophila pneumoniae J138
uaacucuagaucuucaa

SEQ ID NO: 2551780 - RNA, 21 nt, Chlamydophila pneumoniae J138
uaacucuagaucuucaauccc

SEQ ID NO: 2551781 - RNA, 20 nt, Chlamydophila pneumoniae J138
uaacucuuaagaauaaaaua

SEQ ID NO: 2551782 - RNA, 15 nt, Chlamydophila pneumoniae J138
uaacugaaaguacgc

SEQ ID NO: 2551783 - RNA, 22 nt, Chlamydophila pneumoniae J138
uaacugaggcaaagauuuccaa

SEQ ID NO: 2551784 - RNA, 16 nt, Chlamydophila pneumoniae J138
uaacugcaaagagaau

SEQ ID NO: 2551785 - RNA, 20 nt, Chlamydophila pneumoniae J138
uaacuggcaaucuaaaauca

SEQ ID NO: 2551786 - RNA, 20 nt, Chlamydophila pneumoniae J138
uaacuuaaagacuugcuucc

SEQ ID NO: 2551787 - RNA, 18 nt, Chlamydophila pneumoniae J138
uaacuuaauagauucguu

SEQ ID NO: 2551788 - RNA, 22 nt, Chlamydophila pneumoniae J138
uaacuucuaaaagcaaguuguu

SEQ ID NO: 2551789 - RNA, 17 nt, Chlamydophila pneumoniae J138
uaacuugaagaaguaca

SEQ ID NO: 2551790 - RNA, 18 nt, Chlamydophila pneumoniae J138
uaacuuggugagcagcuu

SEQ ID NO: 2551791 - RNA, 24 nt, Chlamydophila pneumoniae J138
uaagaaaggcacuccaaaacucaa

SEQ ID NO: 2551792 - RNA, 15 nt, Chlamydophila pneumoniae J138
uaagaaaucaguccu

SEQ ID NO: 2551793 - RNA, 14 nt, Chlamydophila pneumoniae J138
uaagaaaucccagu

SEQ ID NO: 2551794 - RNA, 16 nt, Chlamydophila pneumoniae J138
uaagaacaucuuccca

SEQ ID NO: 2551795 - RNA, 15 nt, Chlamydophila pneumoniae J138
uaagaacuuuaggga

SEQ ID NO: 2551796 - RNA, 21 nt, Chlamydophila pneumoniae J138
uaagaacuuuagggaagaaau

SEQ ID NO: 2551797 - RNA, 19 nt, Chlamydophila pneumoniae J138
uaagaagacuagcuuuuca

SEQ ID NO: 2551798 - RNA, 15 nt, Chlamydophila pneumoniae J138
uaagaagcagcacuc

SEQ ID NO: 2551799 - RNA, 19 nt, Chlamydophila pneumoniae J138
uaagaagguuuauuagaag

SEQ ID NO: 2551800 - RNA, 15 nt, Chlamydophila pneumoniae J138
uaagaauaaaauagg

SEQ ID NO: 2551801 - RNA, 20 nt, Chlamydophila pneumoniae J138
uaagaauguagcuguuccaa

SEQ ID NO: 2551802 - RNA, 22 nt, Chlamydophila pneumoniae J138
uaagacaagguggguagccagg

SEQ ID NO: 2551803 - RNA, 19 nt, Chlamydophila pneumoniae J138
uaagacaauaaaauagccc

SEQ ID NO: 2551804 - RNA, 15 nt, Chlamydophila pneumoniae J138
uaagacaauauaagc

SEQ ID NO: 2551805 - RNA, 19 nt, Chlamydophila pneumoniae J138
uaagacaauauaagcacca

SEQ ID NO: 2551806 - RNA, 18 nt, Chlamydophila pneumoniae J138
uaagacgcagaaacacug

SEQ ID NO: 2551807 - RNA, 13 nt, Chlamydophila pneumoniae J138
uaagacuaaaaaa

SEQ ID NO: 2551808 - RNA, 16 nt, Chlamydophila pneumoniae J138
uaagacuaaaaaagag

SEQ ID NO: 2551809 - RNA, 16 nt, Chlamydophila pneumoniae J138
uaagacuguguuuuau

SEQ ID NO: 2551810 - RNA, 16 nt, Chlamydophila pneumoniae J138
uaagacuucuggaagc

SEQ ID NO: 2551811 - RNA, 15 nt, Chlamydophila pneumoniae J138
uaagagaacuuuaac

SEQ ID NO: 2551812 - RNA, 23 nt, Chlamydophila pneumoniae J138
uaagagauuuuccauaggaacaa

SEQ ID NO: 2551813 - RNA, 20 nt, Chlamydophila pneumoniae J138
uaagagcuacaaucccgagu

SEQ ID NO: 2551814 - RNA, 17 nt, Chlamydophila pneumoniae J138
uaagaguuccaagacaa

SEQ ID NO: 2551815 - RNA, 15 nt, Chlamydophila pneumoniae J138
uaagauaaacagcac

SEQ ID NO: 2551816 - RNA, 20 nt, Chlamydophila pneumoniae J138
uaagauaaacagcacaggca

SEQ ID NO: 2551817 - RNA, 13 nt, Chlamydophila pneumoniae J138
uaagauaaacauu

SEQ ID NO: 2551818 - RNA, 13 nt, Chlamydophila pneumoniae J138
uaagauaauagag

SEQ ID NO: 2551819 - RNA, 14 nt, Chlamydophila pneumoniae J138
uaagauaauagaga

SEQ ID NO: 2551820 - RNA, 15 nt, Chlamydophila pneumoniae J138
uaagauacuucucca

SEQ ID NO: 2551821 - RNA, 20 nt, Chlamydophila pneumoniae J138
uaagauacuucuccacagcu

SEQ ID NO: 2551822 - RNA, 20 nt, Chlamydophila pneumoniae J138
uaagauagacucucacugag

SEQ ID NO: 2551823 - RNA, 21 nt, Chlamydophila pneumoniae J138
uaagauagacucucacugagu

SEQ ID NO: 2551824 - RNA, 18 nt, Chlamydophila pneumoniae J138
uaagaucaauauagagaa

SEQ ID NO: 2551825 - RNA, 14 nt, Chlamydophila pneumoniae J138
uaagauccaaaaau

SEQ ID NO: 2551826 - RNA, 18 nt, Chlamydophila pneumoniae J138
uaagauccaaaaauucua

SEQ ID NO: 2551827 - RNA, 16 nt, Chlamydophila pneumoniae J138
uaagauccucuauaga

SEQ ID NO: 2551828 - RNA, 22 nt, Chlamydophila pneumoniae J138
uaagauccugagaccauacaca

SEQ ID NO: 2551829 - RNA, 17 nt, Chlamydophila pneumoniae J138
uaagauccuuuaaagau

SEQ ID NO: 2551830 - RNA, 19 nt, Chlamydophila pneumoniae J138
uaagauccuuuaaagauuc

SEQ ID NO: 2551831 - RNA, 23 nt, Chlamydophila pneumoniae J138
uaagaucuuuagaauaagagcua

SEQ ID NO: 2551832 - RNA, 12 nt, Chlamydophila pneumoniae J138
uaagauuccuaa

SEQ ID NO: 2551833 - RNA, 18 nt, Chlamydophila pneumoniae J138
uaagcaaagcggcucuua

SEQ ID NO: 2551834 - RNA, 21 nt, Chlamydophila pneumoniae J138
uaagcaagagcuccgcuagag

SEQ ID NO: 2551835 - RNA, 20 nt, Chlamydophila pneumoniae J138
uaagcaagcaacugauguuu

SEQ ID NO: 2551836 - RNA, 22 nt, Chlamydophila pneumoniae J138
uaagcaagcaacugauguuuua

SEQ ID NO: 2551837 - RNA, 15 nt, Chlamydophila pneumoniae J138
uaagcacugaugaaa

SEQ ID NO: 2551838 - RNA, 19 nt, Chlamydophila pneumoniae J138
uaagcaggaaaagcaaaau

SEQ ID NO: 2551839 - RNA, 22 nt, Chlamydophila pneumoniae J138
uaagcauagcccgaaauucauu

SEQ ID NO: 2551840 - RNA, 14 nt, Chlamydophila pneumoniae J138
uaagccaaauacca

SEQ ID NO: 2551841 - RNA, 15 nt, Chlamydophila pneumoniae J138
uaagccaaauaccaa

SEQ ID NO: 2551842 - RNA, 15 nt, Chlamydophila pneumoniae J138
uaagccaguacuaaa

SEQ ID NO: 2551843 - RNA, 15 nt, Chlamydophila pneumoniae J138
uaagcgauggcaguu

SEQ ID NO: 2551844 - RNA, 21 nt, Chlamydophila pneumoniae J138
uaagcgauuucgacagcagca

SEQ ID NO: 2551845 - RNA, 15 nt, Chlamydophila pneumoniae J138
uaagcgcucuucaau

SEQ ID NO: 2551846 - RNA, 20 nt, Chlamydophila pneumoniae J138
uaagcuaauaagauccaaaa

SEQ ID NO: 2551847 - RNA, 21 nt, Chlamydophila pneumoniae J138
uaagcuaauaagauccaaaaa

SEQ ID NO: 2551848 - RNA, 14 nt, Chlamydophila pneumoniae J138
uaagcuauaucuca

SEQ ID NO: 2551849 - RNA, 12 nt, Chlamydophila pneumoniae J138
uaagcucaaaau

SEQ ID NO: 2551850 - RNA, 15 nt, Chlamydophila pneumoniae J138
uaagcugaaagaaca

SEQ ID NO: 2551851 - RNA, 17 nt, Chlamydophila pneumoniae J138
uaagcugcaaucucaaa

SEQ ID NO: 2551852 - RNA, 19 nt, Chlamydophila pneumoniae J138
uaagcuggauucugucuau

SEQ ID NO: 2551853 - RNA, 20 nt, Chlamydophila pneumoniae J138
uaagcuggauucugucuaua

SEQ ID NO: 2551854 - RNA, 17 nt, Chlamydophila pneumoniae J138
uaagcugugcauuuucu

SEQ ID NO: 2551855 - RNA, 15 nt, Chlamydophila pneumoniae J138
uaagcuuauuucugu

SEQ ID NO: 2551856 - RNA, 16 nt, Chlamydophila pneumoniae J138
uaagcuuuauguggag

SEQ ID NO: 2551857 - RNA, 18 nt, Chlamydophila pneumoniae J138
uaaggacaaaucucccaa

SEQ ID NO: 2551858 - RNA, 19 nt, Chlamydophila pneumoniae J138
uaaggacaaaucucccaaa

SEQ ID NO: 2551859 - RNA, 22 nt, Chlamydophila pneumoniae J138
uaaggagagggguucccucucc

SEQ ID NO: 2551860 - RNA, 13 nt, Chlamydophila pneumoniae J138
uaaggcuccagca

SEQ ID NO: 2551861 - RNA, 17 nt, Chlamydophila pneumoniae J138
uaaggcuuccaaugcua

SEQ ID NO: 2551862 - RNA, 20 nt, Chlamydophila pneumoniae J138
uaaggcuuccaaugcuauug

SEQ ID NO: 2551863 - RNA, 15 nt, Chlamydophila pneumoniae J138
uaaggcuuugccuuu

SEQ ID NO: 2551864 - RNA, 18 nt, Chlamydophila pneumoniae J138
uaaggcuuuucugcuccu

SEQ ID NO: 2551865 - RNA, 22 nt, Chlamydophila pneumoniae J138
uaagggggaucuucagagagaa

SEQ ID NO: 2551866 - RNA, 18 nt, Chlamydophila pneumoniae J138
uaagguuaucuuuuugga

SEQ ID NO: 2551867 - RNA, 19 nt, Chlamydophila pneumoniae J138
uaaguacacauugucucuu

SEQ ID NO: 2551868 - RNA, 23 nt, Chlamydophila pneumoniae J138
uaaguaggccuccuucauucaca

SEQ ID NO: 2551869 - RNA, 15 nt, Chlamydophila pneumoniae J138
uaaguccuguuugaa

SEQ ID NO: 2551870 - RNA, 16 nt, Chlamydophila pneumoniae J138
uaaguccuucuuccca

SEQ ID NO: 2551871 - RNA, 23 nt, Chlamydophila pneumoniae J138
uaaguccuucuucccagccuuga

SEQ ID NO: 2551872 - RNA, 17 nt, Chlamydophila pneumoniae J138
uaagucgaauucauuaa

SEQ ID NO: 2551873 - RNA, 19 nt, Chlamydophila pneumoniae J138
uaagucuugaguucuuuug

SEQ ID NO: 2551874 - RNA, 17 nt, Chlamydophila pneumoniae J138
uaagugauaaggaagaa

SEQ ID NO: 2551875 - RNA, 12 nt, Chlamydophila pneumoniae J138
uaagugcuuuua

SEQ ID NO: 2551876 - RNA, 18 nt, Chlamydophila pneumoniae J138
uaaguuacggaacucauu

SEQ ID NO: 2551877 - RNA, 21 nt, Chlamydophila pneumoniae J138
uaaguuagagacacagaagga

SEQ ID NO: 2551878 - RNA, 17 nt, Chlamydophila pneumoniae J138
uaaguugguccaucgag

SEQ ID NO: 2551879 - RNA, 18 nt, Chlamydophila pneumoniae J138
uaaguuuguagcagcaag

SEQ ID NO: 2551880 - RNA, 22 nt, Chlamydophila pneumoniae J138
uaauaaaauuuaaaaaaaucuu

SEQ ID NO: 2551881 - RNA, 17 nt, Chlamydophila pneumoniae J138
uaauaacuauaauauaa

SEQ ID NO: 2551882 - RNA, 18 nt, Chlamydophila pneumoniae J138
uaauaagcaggaaaagca

SEQ ID NO: 2551883 - RNA, 22 nt, Chlamydophila pneumoniae J138
uaauaaugaagcagggaaaaug

SEQ ID NO: 2551884 - RNA, 20 nt, Chlamydophila pneumoniae J138
uaauaauguuuuaauagcua

SEQ ID NO: 2551885 - RNA, 14 nt, Chlamydophila pneumoniae J138
uaauaccuuucuaa

SEQ ID NO: 2551886 - RNA, 23 nt, Chlamydophila pneumoniae J138
uaauacggacuucacaaagaacc

SEQ ID NO: 2551887 - RNA, 14 nt, Chlamydophila pneumoniae J138
uaauacguuuuuag

SEQ ID NO: 2551888 - RNA, 13 nt, Chlamydophila pneumoniae J138
uaauacuuaaucc

SEQ ID NO: 2551889 - RNA, 14 nt, Chlamydophila pneumoniae J138
uaauagaagaucau

SEQ ID NO: 2551890 - RNA, 12 nt, Chlamydophila pneumoniae J138
uaauagagaaga

SEQ ID NO: 2551891 - RNA, 13 nt, Chlamydophila pneumoniae J138
uaauagagaagaa

SEQ ID NO: 2551892 - RNA, 14 nt, Chlamydophila pneumoniae J138
uaauagcaggaguu

SEQ ID NO: 2551893 - RNA, 16 nt, Chlamydophila pneumoniae J138
uaauagcuaaagugau

SEQ ID NO: 2551894 - RNA, 14 nt, Chlamydophila pneumoniae J138
uaauaggauaagaa

SEQ ID NO: 2551895 - RNA, 16 nt, Chlamydophila pneumoniae J138
uaauaggauaagaaau

SEQ ID NO: 2551896 - RNA, 19 nt, Chlamydophila pneumoniae J138
uaauaggauaagaaauuaa

SEQ ID NO: 2551897 - RNA, 21 nt, Chlamydophila pneumoniae J138
uaauagucucuguaagaacgu

SEQ ID NO: 2551898 - RNA, 17 nt, Chlamydophila pneumoniae J138
uaauaucgguuccuaua

SEQ ID NO: 2551899 - RNA, 19 nt, Chlamydophila pneumoniae J138
uaauaucgguuucuuuuuu

SEQ ID NO: 2551900 - RNA, 16 nt, Chlamydophila pneumoniae J138
uaauauuugagaagau

SEQ ID NO: 2551901 - RNA, 12 nt, Chlamydophila pneumoniae J138
uaaucaaccaaa

SEQ ID NO: 2551902 - RNA, 17 nt, Chlamydophila pneumoniae J138
uaaucaaccaaaaugca

SEQ ID NO: 2551903 - RNA, 17 nt, Chlamydophila pneumoniae J138
uaaucaagccuaaaucu

SEQ ID NO: 2551904 - RNA, 12 nt, Chlamydophila pneumoniae J138
uaaucaccuuag

SEQ ID NO: 2551905 - RNA, 14 nt, Chlamydophila pneumoniae J138
uaaucagaggagcc

SEQ ID NO: 2551906 - RNA, 15 nt, Chlamydophila pneumoniae J138
uaaucagaggagccu

SEQ ID NO: 2551907 - RNA, 21 nt, Chlamydophila pneumoniae J138
uaaucagaggagccuccauaa

SEQ ID NO: 2551908 - RNA, 14 nt, Chlamydophila pneumoniae J138
uaaucauaaaaaaa

SEQ ID NO: 2551909 - RNA, 16 nt, Chlamydophila pneumoniae J138
uaaucauuaagacuca

SEQ ID NO: 2551910 - RNA, 21 nt, Chlamydophila pneumoniae J138
uaauccugaauggcucuguca

SEQ ID NO: 2551911 - RNA, 10 nt, Chlamydophila pneumoniae J138
uaauccugca

SEQ ID NO: 2551912 - RNA, 19 nt, Chlamydophila pneumoniae J138
uaauccuguugucacuaag

SEQ ID NO: 2551913 - RNA, 14 nt, Chlamydophila pneumoniae J138
uaauccuucuuucu

SEQ ID NO: 2551914 - RNA, 15 nt, Chlamydophila pneumoniae J138
uaauccuugagggcu

SEQ ID NO: 2551915 - RNA, 19 nt, Chlamydophila pneumoniae J138
uaaucuauaggauuugcau

SEQ ID NO: 2551916 - RNA, 12 nt, Chlamydophila pneumoniae J138
uaaucucaccag

SEQ ID NO: 2551917 - RNA, 14 nt, Chlamydophila pneumoniae J138
uaaucucaccagaa

SEQ ID NO: 2551918 - RNA, 20 nt, Chlamydophila pneumoniae J138
uaaucuggaagcaaucugua

SEQ ID NO: 2551919 - RNA, 16 nt, Chlamydophila pneumoniae J138
uaaucuuuuuuaaagc

SEQ ID NO: 2551920 - RNA, 18 nt, Chlamydophila pneumoniae J138
uaaucuuuuuuaaagcua

SEQ ID NO: 2551921 - RNA, 21 nt, Chlamydophila pneumoniae J138
uaaugaagcagggaaaaugcg

SEQ ID NO: 2551922 - RNA, 20 nt, Chlamydophila pneumoniae J138
uaaugauacgugcagugaau

SEQ ID NO: 2551923 - RNA, 23 nt, Chlamydophila pneumoniae J138
uaaugcagauagcuuacagagaa

SEQ ID NO: 2551924 - RNA, 23 nt, Chlamydophila pneumoniae J138
uaaugccgagaauacagagucug

SEQ ID NO: 2551925 - RNA, 17 nt, Chlamydophila pneumoniae J138
uaaugcucacuucuuug

SEQ ID NO: 2551926 - RNA, 18 nt, Chlamydophila pneumoniae J138
uaaugguacaauacugga

SEQ ID NO: 2551927 - RNA, 18 nt, Chlamydophila pneumoniae J138
uaauguugaguagagaag

SEQ ID NO: 2551928 - RNA, 23 nt, Chlamydophila pneumoniae J138
uaauguuuggccaacagcuaaua

SEQ ID NO: 2551929 - RNA, 12 nt, Chlamydophila pneumoniae J138
uaauuaaaaacu

SEQ ID NO: 2551930 - RNA, 14 nt, Chlamydophila pneumoniae J138
uaauuaaauauaua

SEQ ID NO: 2551931 - RNA, 19 nt, Chlamydophila pneumoniae J138
uaauuaaauauauaaagaa

SEQ ID NO: 2551932 - RNA, 15 nt, Chlamydophila pneumoniae J138
uaauuaacguuucuu

SEQ ID NO: 2551933 - RNA, 17 nt, Chlamydophila pneumoniae J138
uaauuaacguuucuucg

SEQ ID NO: 2551934 - RNA, 12 nt, Chlamydophila pneumoniae J138
uaauuacaauuu

SEQ ID NO: 2551935 - RNA, 14 nt, Chlamydophila pneumoniae J138
uaauuacagaaucc

SEQ ID NO: 2551936 - RNA, 18 nt, Chlamydophila pneumoniae J138
uaauuacagaucugcaua

SEQ ID NO: 2551937 - RNA, 22 nt, Chlamydophila pneumoniae J138
uaauucauauuuacgaaaacau

SEQ ID NO: 2551938 - RNA, 14 nt, Chlamydophila pneumoniae J138
uaauuccaaaauaa

SEQ ID NO: 2551939 - RNA, 21 nt, Chlamydophila pneumoniae J138
uaauuccaacagggaugaggu

SEQ ID NO: 2551940 - RNA, 14 nt, Chlamydophila pneumoniae J138
uaauuccuuggauu

SEQ ID NO: 2551941 - RNA, 22 nt, Chlamydophila pneumoniae J138
uaauugacguagacgauuuucu

SEQ ID NO: 2551942 - RNA, 21 nt, Chlamydophila pneumoniae J138
uaauugcuggaggccaaagaa

SEQ ID NO: 2551943 - RNA, 15 nt, Chlamydophila pneumoniae J138
uaauuucaaagaugc

SEQ ID NO: 2551944 - RNA, 21 nt, Chlamydophila pneumoniae J138
uaauuuccuucaggauuuucc

SEQ ID NO: 2551945 - RNA, 17 nt, Chlamydophila pneumoniae J138
uaauuuccuucuccaga

SEQ ID NO: 2551946 - RNA, 22 nt, Chlamydophila pneumoniae J138
uaauuucuaaauagaaaacaua

SEQ ID NO: 2551947 - RNA, 17 nt, Chlamydophila pneumoniae J138
uaauuucuccgucaaga

SEQ ID NO: 2551948 - RNA, 19 nt, Chlamydophila pneumoniae J138
uaauuucuccgucaagaac

SEQ ID NO: 2551949 - RNA, 21 nt, Chlamydophila pneumoniae J138
uaauuucuccgucaagaacaa

SEQ ID NO: 2551950 - RNA, 19 nt, Chlamydophila pneumoniae J138
uaauuuuagaacuucaaug

SEQ ID NO: 2551951 - RNA, 15 nt, Chlamydophila pneumoniae J138
uaauuuucuguuaau

SEQ ID NO: 2551952 - RNA, 19 nt, Chlamydophila pneumoniae J138
uaauuuuugcuaaacaaug

SEQ ID NO: 2551953 - RNA, 20 nt, Chlamydophila pneumoniae J138
uaauuuuugcuaaacaaugc

SEQ ID NO: 2551954 - RNA, 13 nt, Chlamydophila pneumoniae J138
uacaaaaaauaaa

SEQ ID NO: 2551955 - RNA, 15 nt, Chlamydophila pneumoniae J138
uacaaaauuauuaaa

SEQ ID NO: 2551956 - RNA, 11 nt, Chlamydophila pneumoniae J138
uacaaacccau

SEQ ID NO: 2551957 - RNA, 21 nt, Chlamydophila pneumoniae J138
uacaaacccauauuugaauaa

SEQ ID NO: 2551958 - RNA, 23 nt, Chlamydophila pneumoniae J138
uacaaacccauauuugaauaaag

SEQ ID NO: 2551959 - RNA, 24 nt, Chlamydophila pneumoniae J138
uacaaauuaccuugagacaaagaa

SEQ ID NO: 2551960 - RNA, 12 nt, Chlamydophila pneumoniae J138
uacaacccuuua

SEQ ID NO: 2551961 - RNA, 20 nt, Chlamydophila pneumoniae J138
uacaagacaaaguuguuucu

SEQ ID NO: 2551962 - RNA, 20 nt, Chlamydophila pneumoniae J138
uacaagacuacgacagaagu

SEQ ID NO: 2551963 - RNA, 18 nt, Chlamydophila pneumoniae J138
uacaagcaauacuaagaa

SEQ ID NO: 2551964 - RNA, 19 nt, Chlamydophila pneumoniae J138
uacaagcaauacuaagaag

SEQ ID NO: 2551965 - RNA, 20 nt, Chlamydophila pneumoniae J138
uacaagcuucaucaaaacau

SEQ ID NO: 2551966 - RNA, 16 nt, Chlamydophila pneumoniae J138
uacaaggucuuuuccu

SEQ ID NO: 2551967 - RNA, 18 nt, Chlamydophila pneumoniae J138
uacaagugaagacaagua

SEQ ID NO: 2551968 - RNA, 22 nt, Chlamydophila pneumoniae J138
uacaagugucugaguuagcuuu

SEQ ID NO: 2551969 - RNA, 18 nt, Chlamydophila pneumoniae J138
uacaaucccgaguccuaa

SEQ ID NO: 2551970 - RNA, 20 nt, Chlamydophila pneumoniae J138
uacaaucccgaguccuaaaa

SEQ ID NO: 2551971 - RNA, 18 nt, Chlamydophila pneumoniae J138
uacaaucucgcuauucca

SEQ ID NO: 2551972 - RNA, 17 nt, Chlamydophila pneumoniae J138
uacaaucucuagggaua

SEQ ID NO: 2551973 - RNA, 22 nt, Chlamydophila pneumoniae J138
uacaaucucuagggauaauuaa

SEQ ID NO: 2551974 - RNA, 22 nt, Chlamydophila pneumoniae J138
uacaauuagagauucauaaaac

SEQ ID NO: 2551975 - RNA, 12 nt, Chlamydophila pneumoniae J138
uacaauuugcuc

SEQ ID NO: 2551976 - RNA, 17 nt, Chlamydophila pneumoniae J138
uacaauuugcuccucca

SEQ ID NO: 2551977 - RNA, 20 nt, Chlamydophila pneumoniae J138
uacacacacgccaaugggaa

SEQ ID NO: 2551978 - RNA, 15 nt, Chlamydophila pneumoniae J138
uacacagcacaagaa

SEQ ID NO: 2551979 - RNA, 19 nt, Chlamydophila pneumoniae J138
uacacauugucucuuuuaa

SEQ ID NO: 2551980 - RNA, 15 nt, Chlamydophila pneumoniae J138
uacaccauagaacug

SEQ ID NO: 2551981 - RNA, 21 nt, Chlamydophila pneumoniae J138
uacacugguagcuaaauuuag

SEQ ID NO: 2551982 - RNA, 20 nt, Chlamydophila pneumoniae J138
uacagaaaggaccuccucac

SEQ ID NO: 2551983 - RNA, 21 nt, Chlamydophila pneumoniae J138
uacagaaaggaccuccucaca

SEQ ID NO: 2551984 - RNA, 18 nt, Chlamydophila pneumoniae J138
uacagaaaggcuuuucuu

SEQ ID NO: 2551985 - RNA, 22 nt, Chlamydophila pneumoniae J138
uacagacugaagucguuuagau

SEQ ID NO: 2551986 - RNA, 17 nt, Chlamydophila pneumoniae J138
uacagagggaauuucau

SEQ ID NO: 2551987 - RNA, 22 nt, Chlamydophila pneumoniae J138
uacagagggaauuucauguccu

SEQ ID NO: 2551988 - RNA, 23 nt, Chlamydophila pneumoniae J138
uacagagggcuucauuccuacau

SEQ ID NO: 2551989 - RNA, 17 nt, Chlamydophila pneumoniae J138
uacagauaggguaagau

SEQ ID NO: 2551990 - RNA, 14 nt, Chlamydophila pneumoniae J138
uacagauaucaaag

SEQ ID NO: 2551991 - RNA, 17 nt, Chlamydophila pneumoniae J138
uacagauaucaaagcau

SEQ ID NO: 2551992 - RNA, 20 nt, Chlamydophila pneumoniae J138
uacagaucaggauucuaaaa

SEQ ID NO: 2551993 - RNA, 21 nt, Chlamydophila pneumoniae J138
uacagaucaggauucuaaaaa

SEQ ID NO: 2551994 - RNA, 19 nt, Chlamydophila pneumoniae J138
uacagauguaaaugcuccu

SEQ ID NO: 2551995 - RNA, 13 nt, Chlamydophila pneumoniae J138
uacagauguuuuc

SEQ ID NO: 2551996 - RNA, 14 nt, Chlamydophila pneumoniae J138
uacagcauaaaaau

SEQ ID NO: 2551997 - RNA, 22 nt, Chlamydophila pneumoniae J138
uacagcauaaaaauucucauaa

SEQ ID NO: 2551998 - RNA, 18 nt, Chlamydophila pneumoniae J138
uacagcaucggcaaccag

SEQ ID NO: 2551999 - RNA, 15 nt, Chlamydophila pneumoniae J138
uacaggacuguuugu

SEQ ID NO: 2552000 - RNA, 13 nt, Chlamydophila pneumoniae J138
uacaggagaaucc

SEQ ID NO: 2552001 - RNA, 13 nt, Chlamydophila pneumoniae J138
uacaggccugaug

SEQ ID NO: 2552002 - RNA, 18 nt, Chlamydophila pneumoniae J138
uacaguaguaaauaauaa

SEQ ID NO: 2552003 - RNA, 20 nt, Chlamydophila pneumoniae J138
uacaguuuguaaaaagccua

SEQ ID NO: 2552004 - RNA, 12 nt, Chlamydophila pneumoniae J138
uacauaaaauga

SEQ ID NO: 2552005 - RNA, 18 nt, Chlamydophila pneumoniae J138
uacauaacacuuuguuuu

SEQ ID NO: 2552006 - RNA, 13 nt, Chlamydophila pneumoniae J138
uacauagaggaga

SEQ ID NO: 2552007 - RNA, 15 nt, Chlamydophila pneumoniae J138
uacaucaaaaugcug

SEQ ID NO: 2552008 - RNA, 20 nt, Chlamydophila pneumoniae J138
uacaucaaugauaucgccuu

SEQ ID NO: 2552009 - RNA, 15 nt, Chlamydophila pneumoniae J138
uacaucagacugaag

SEQ ID NO: 2552010 - RNA, 16 nt, Chlamydophila pneumoniae J138
uacaucagacugaaga

SEQ ID NO: 2552011 - RNA, 13 nt, Chlamydophila pneumoniae J138
uacaucuaacucu

SEQ ID NO: 2552012 - RNA, 15 nt, Chlamydophila pneumoniae J138
uacaucuuaagagca

SEQ ID NO: 2552013 - RNA, 17 nt, Chlamydophila pneumoniae J138
uacaucuuaagagcaaa

SEQ ID NO: 2552014 - RNA, 17 nt, Chlamydophila pneumoniae J138
uacaucuucuuggcuuu

SEQ ID NO: 2552015 - RNA, 15 nt, Chlamydophila pneumoniae J138
uacaugcucaagaag

SEQ ID NO: 2552016 - RNA, 15 nt, Chlamydophila pneumoniae J138
uacauucgcaagaau

SEQ ID NO: 2552017 - RNA, 23 nt, Chlamydophila pneumoniae J138
uacauucgcaagaaugaugcaua

SEQ ID NO: 2552018 - RNA, 22 nt, Chlamydophila pneumoniae J138
uacauuugauucauaaagagga

SEQ ID NO: 2552019 - RNA, 13 nt, Chlamydophila pneumoniae J138
uaccaaaauacca

SEQ ID NO: 2552020 - RNA, 23 nt, Chlamydophila pneumoniae J138
uaccaaagucgauacccaaagag

SEQ ID NO: 2552021 - RNA, 14 nt, Chlamydophila pneumoniae J138
uaccaacugagcua

SEQ ID NO: 2552022 - RNA, 18 nt, Chlamydophila pneumoniae J138
uaccaagaugaagaaacu

SEQ ID NO: 2552023 - RNA, 21 nt, Chlamydophila pneumoniae J138
uaccaagaugaagaaacuugu

SEQ ID NO: 2552024 - RNA, 20 nt, Chlamydophila pneumoniae J138
uaccaaggcagguaucuccu

SEQ ID NO: 2552025 - RNA, 14 nt, Chlamydophila pneumoniae J138
uaccaauucucucu

SEQ ID NO: 2552026 - RNA, 14 nt, Chlamydophila pneumoniae J138
uaccaccuaaaaug

SEQ ID NO: 2552027 - RNA, 16 nt, Chlamydophila pneumoniae J138
uaccaccuaaaaugca

SEQ ID NO: 2552028 - RNA, 16 nt, Chlamydophila pneumoniae J138
uacccaaagaggggag

SEQ ID NO: 2552029 - RNA, 12 nt, Chlamydophila pneumoniae J138
uacccaucuaga

SEQ ID NO: 2552030 - RNA, 17 nt, Chlamydophila pneumoniae J138
uacccuccgagucgaca

SEQ ID NO: 2552031 - RNA, 22 nt, Chlamydophila pneumoniae J138
uacccucggagacucagagaaa

SEQ ID NO: 2552032 - RNA, 19 nt, Chlamydophila pneumoniae J138
uacccuuccggggugcgac

SEQ ID NO: 2552033 - RNA, 13 nt, Chlamydophila pneumoniae J138
uacccuucuucuu

SEQ ID NO: 2552034 - RNA, 17 nt, Chlamydophila pneumoniae J138
uaccgacaagcaucauu

SEQ ID NO: 2552035 - RNA, 16 nt, Chlamydophila pneumoniae J138
uaccgaccgaaucucu

SEQ ID NO: 2552036 - RNA, 14 nt, Chlamydophila pneumoniae J138
uaccgcuguuuuau

SEQ ID NO: 2552037 - RNA, 21 nt, Chlamydophila pneumoniae J138
uaccguagcguacguuuucuc

SEQ ID NO: 2552038 - RNA, 14 nt, Chlamydophila pneumoniae J138
uaccguuuccuccu

SEQ ID NO: 2552039 - RNA, 23 nt, Chlamydophila pneumoniae J138
uagaagcauucucaauucuguau

SEQ ID NO: 2552040 - RNA, 18 nt, Chlamydophila pneumoniae J138
uagaagguguuuuggcug

SEQ ID NO: 2552041 - RNA, 21 nt, Chlamydophila pneumoniae J138
uagaagguguuuuggcugcuu

SEQ ID NO: 2552042 - RNA, 14 nt, Chlamydophila pneumoniae J138
uagaauaaagauuu

SEQ ID NO: 2552043 - RNA, 16 nt, Chlamydophila pneumoniae J138
uagaauacacagcuau

SEQ ID NO: 2552044 - RNA, 16 nt, Chlamydophila pneumoniae J138
uagaaucacauaaaau

SEQ ID NO: 2552045 - RNA, 12 nt, Chlamydophila pneumoniae J138
uagaaucaccaa

SEQ ID NO: 2552046 - RNA, 16 nt, Chlamydophila pneumoniae J138
uagaaucaccaauuuu

SEQ ID NO: 2552047 - RNA, 23 nt, Chlamydophila pneumoniae J138
uagaaucagagggacuccuguga

SEQ ID NO: 2552048 - RNA, 14 nt, Chlamydophila pneumoniae J138
uagaauccaaagac

SEQ ID NO: 2552049 - RNA, 15 nt, Chlamydophila pneumoniae J138
uagaauccaaagacu

SEQ ID NO: 2552050 - RNA, 18 nt, Chlamydophila pneumoniae J138
uagaauccaaagacuuuu

SEQ ID NO: 2552051 - RNA, 14 nt, Chlamydophila pneumoniae J138
uagaauccuucucc

SEQ ID NO: 2552052 - RNA, 21 nt, Chlamydophila pneumoniae J138
uagaaucucugcccccuguuu

SEQ ID NO: 2552053 - RNA, 16 nt, Chlamydophila pneumoniae J138
uagaaucucugugcca

SEQ ID NO: 2552054 - RNA, 22 nt, Chlamydophila pneumoniae J138
uagaaucucugugccaucugua

SEQ ID NO: 2552055 - RNA, 13 nt, Chlamydophila pneumoniae J138
uagaaugaugcaa

SEQ ID NO: 2552056 - RNA, 15 nt, Chlamydophila pneumoniae J138
uagaaugaugcaagc

SEQ ID NO: 2552057 - RNA, 12 nt, Chlamydophila pneumoniae J138
uagaauuuucuu

SEQ ID NO: 2552058 - RNA, 13 nt, Chlamydophila pneumoniae J138
uagacaagacacc

SEQ ID NO: 2552059 - RNA, 17 nt, Chlamydophila pneumoniae J138
uagacaagacaccgaaa

SEQ ID NO: 2552060 - RNA, 14 nt, Chlamydophila pneumoniae J138
uagacaagagagag

SEQ ID NO: 2552061 - RNA, 19 nt, Chlamydophila pneumoniae J138
uagacaauaccagauaaag

SEQ ID NO: 2552062 - RNA, 21 nt, Chlamydophila pneumoniae J138
uagacaauaccagauaaagca

SEQ ID NO: 2552063 - RNA, 19 nt, Chlamydophila pneumoniae J138
uagaccaauaaauccaaaa

SEQ ID NO: 2552064 - RNA, 23 nt, Chlamydophila pneumoniae J138
uagacgauucuaggccuaaagaa

SEQ ID NO: 2552065 - RNA, 13 nt, Chlamydophila pneumoniae J138
uagacgauuuucu

SEQ ID NO: 2552066 - RNA, 22 nt, Chlamydophila pneumoniae J138
uagacgggcuuauaaacuucaa

SEQ ID NO: 2552067 - RNA, 17 nt, Chlamydophila pneumoniae J138
uagacgucguccuacag

SEQ ID NO: 2552068 - RNA, 14 nt, Chlamydophila pneumoniae J138
uagacgugcucucu

SEQ ID NO: 2552069 - RNA, 18 nt, Chlamydophila pneumoniae J138
uagacgugcucucuucuu

SEQ ID NO: 2552070 - RNA, 16 nt, Chlamydophila pneumoniae J138
uagacuuguauucuug

SEQ ID NO: 2552071 - RNA, 14 nt, Chlamydophila pneumoniae J138
uagagaaacuuuug

SEQ ID NO: 2552072 - RNA, 21 nt, Chlamydophila pneumoniae J138
uagagaaagagugccaagagc

SEQ ID NO: 2552073 - RNA, 23 nt, Chlamydophila pneumoniae J138
uagagaaagagugccaagagcau

SEQ ID NO: 2552074 - RNA, 12 nt, Chlamydophila pneumoniae J138
uagagaaauuuu

SEQ ID NO: 2552075 - RNA, 15 nt, Chlamydophila pneumoniae J138
uagagaagaagcaaa

SEQ ID NO: 2552076 - RNA, 16 nt, Chlamydophila pneumoniae J138
uagagaagauuucuau

SEQ ID NO: 2552077 - RNA, 13 nt, Chlamydophila pneumoniae J138
uagagagaaugcc

SEQ ID NO: 2552078 - RNA, 23 nt, Chlamydophila pneumoniae J138
uagagagagucggcuuuagaaaa

SEQ ID NO: 2552079 - RNA, 15 nt, Chlamydophila pneumoniae J138
uagagagccuuuccu

SEQ ID NO: 2552080 - RNA, 16 nt, Chlamydophila pneumoniae J138
uagagauaucaucaaa

SEQ ID NO: 2552081 - RNA, 18 nt, Chlamydophila pneumoniae J138
uagagauaucaucaaaag

SEQ ID NO: 2552082 - RNA, 20 nt, Chlamydophila pneumoniae J138
uagagaucuuuuuauuaaaa

SEQ ID NO: 2552083 - RNA, 20 nt, Chlamydophila pneumoniae J138
uagagauuaccgaagagccc

SEQ ID NO: 2552084 - RNA, 18 nt, Chlamydophila pneumoniae J138
uagagauucuacaaauua

SEQ ID NO: 2552085 - RNA, 19 nt, Chlamydophila pneumoniae J138
uagagauuuuucuaggaau

SEQ ID NO: 2552086 - RNA, 23 nt, Chlamydophila pneumoniae J138
uagagauuuuucuaggaaucuuu

SEQ ID NO: 2552087 - RNA, 19 nt, Chlamydophila pneumoniae J138
uagagcaagauucuucaga

SEQ ID NO: 2552088 - RNA, 18 nt, Chlamydophila pneumoniae J138
uagagcacauagaaacag

SEQ ID NO: 2552089 - RNA, 22 nt, Chlamydophila pneumoniae J138
uagagcaucauaaagugcgagg

SEQ ID NO: 2552090 - RNA, 14 nt, Chlamydophila pneumoniae J138
uagagccuugcagc

SEQ ID NO: 2552091 - RNA, 12 nt, Chlamydophila pneumoniae J138
uagagcuagaau

SEQ ID NO: 2552092 - RNA, 19 nt, Chlamydophila pneumoniae J138
uagagcuucaaguuucuuu

SEQ ID NO: 2552093 - RNA, 15 nt, Chlamydophila pneumoniae J138
uagagcuucuuuauc

SEQ ID NO: 2552094 - RNA, 19 nt, Chlamydophila pneumoniae J138
uagagcuuucagaaaagaa

SEQ ID NO: 2552095 - RNA, 18 nt, Chlamydophila pneumoniae J138
uagaggaaguguuucuuu

SEQ ID NO: 2552096 - RNA, 23 nt, Chlamydophila pneumoniae J138
uagaggagacucuaguuuuucuu

SEQ ID NO: 2552097 - RNA, 14 nt, Chlamydophila pneumoniae J138
uagaggaucuucaa

SEQ ID NO: 2552098 - RNA, 16 nt, Chlamydophila pneumoniae J138
uagagggauuuguagg

SEQ ID NO: 2552099 - RNA, 21 nt, Chlamydophila pneumoniae J138
uagaguauuagcgaguacuuu

SEQ ID NO: 2552100 - RNA, 20 nt, Chlamydophila pneumoniae J138
uagaguccaagguucuggga

SEQ ID NO: 2552101 - RNA, 15 nt, Chlamydophila pneumoniae J138
uagaguccacaguca

SEQ ID NO: 2552102 - RNA, 19 nt, Chlamydophila pneumoniae J138
uagaguccacagucauaaa

SEQ ID NO: 2552103 - RNA, 16 nt, Chlamydophila pneumoniae J138
uagagucgauaaaaac

SEQ ID NO: 2552104 - RNA, 14 nt, Chlamydophila pneumoniae J138
uagagucucuuuca

SEQ ID NO: 2552105 - RNA, 14 nt, Chlamydophila pneumoniae J138
uagagucugcagca

SEQ ID NO: 2552106 - RNA, 21 nt, Chlamydophila pneumoniae J138
uagagucuucgacaaggaagc

SEQ ID NO: 2552107 - RNA, 22 nt, Chlamydophila pneumoniae J138
uagagucuucgacaaggaagcc

SEQ ID NO: 2552108 - RNA, 16 nt, Chlamydophila pneumoniae J138
uagagugacucaucag

SEQ ID NO: 2552109 - RNA, 16 nt, Chlamydophila pneumoniae J138
uagaguucauuuuagu

SEQ ID NO: 2552110 - RNA, 20 nt, Chlamydophila pneumoniae J138
uagaguucgcacuaauuucc

SEQ ID NO: 2552111 - RNA, 16 nt, Chlamydophila pneumoniae J138
uagaguugacaauagg

SEQ ID NO: 2552112 - RNA, 14 nt, Chlamydophila pneumoniae J138
uagauaagaucucu

SEQ ID NO: 2552113 - RNA, 21 nt, Chlamydophila pneumoniae J138
uagauacuuugcaauacacca

SEQ ID NO: 2552114 - RNA, 13 nt, Chlamydophila pneumoniae J138
uagauaugccuca

SEQ ID NO: 2552115 - RNA, 18 nt, Chlamydophila pneumoniae J138
uagauaugccucaggucu

SEQ ID NO: 2552116 - RNA, 14 nt, Chlamydophila pneumoniae J138
uagaucacaagaaa

SEQ ID NO: 2552117 - RNA, 13 nt, Chlamydophila pneumoniae J138
uagaucacaucaa

SEQ ID NO: 2552118 - RNA, 18 nt, Chlamydophila pneumoniae J138
uagaucauaaacagcagu

SEQ ID NO: 2552119 - RNA, 15 nt, Chlamydophila pneumoniae J138
uagaucccagaagaa

SEQ ID NO: 2552120 - RNA, 17 nt, Chlamydophila pneumoniae J138
uagauccccuucauucu

SEQ ID NO: 2552121 - RNA, 18 nt, Chlamydophila pneumoniae J138
uagaucccucaagcgauu

SEQ ID NO: 2552122 - RNA, 19 nt, Chlamydophila pneumoniae J138
uagauccuauaguaauuuc

SEQ ID NO: 2552123 - RNA, 20 nt, Chlamydophila pneumoniae J138
uagaucgucaagcucugaga

SEQ ID NO: 2552124 - RNA, 19 nt, Chlamydophila pneumoniae J138
uagaucuucugaaaucaaa

SEQ ID NO: 2552125 - RNA, 14 nt, Chlamydophila pneumoniae J138
uagaucuugaaaag

SEQ ID NO: 2552126 - RNA, 23 nt, Chlamydophila pneumoniae J138
uagaucuuuucuacuucaggaaa

SEQ ID NO: 2552127 - RNA, 14 nt, Chlamydophila pneumoniae J138
uagaugaucacagg

SEQ ID NO: 2552128 - RNA, 13 nt, Chlamydophila pneumoniae J138
uagaugucaguau

SEQ ID NO: 2552129 - RNA, 18 nt, Chlamydophila pneumoniae J138
uagauucaugaaaugcuu

SEQ ID NO: 2552130 - RNA, 24 nt, Chlamydophila pneumoniae J138
uagauugccuuugaucaggagucu

SEQ ID NO: 2552131 - RNA, 14 nt, Chlamydophila pneumoniae J138
uagauuguuaguga

SEQ ID NO: 2552132 - RNA, 13 nt, Chlamydophila pneumoniae J138
uagauuuccuccg

SEQ ID NO: 2552133 - RNA, 14 nt, Chlamydophila pneumoniae J138
uagauuuucccuaa

SEQ ID NO: 2552134 - RNA, 15 nt, Chlamydophila pneumoniae J138
uagauuuuucuuuua

SEQ ID NO: 2552135 - RNA, 18 nt, Chlamydophila pneumoniae J138
uagauuuuucuuuuagag

SEQ ID NO: 2552136 - RNA, 23 nt, Chlamydophila pneumoniae J138
uagcaaagcgauggcuauagaua

SEQ ID NO: 2552137 - RNA, 11 nt, Chlamydophila pneumoniae J138
uagcaaaggca

SEQ ID NO: 2552138 - RNA, 18 nt, Chlamydophila pneumoniae J138
uagcaaaggcaacaacgc

SEQ ID NO: 2552139 - RNA, 16 nt, Chlamydophila pneumoniae J138
uagcaaguagcucucu

SEQ ID NO: 2552140 - RNA, 15 nt, Chlamydophila pneumoniae J138
uaccguuuccuccuc

SEQ ID NO: 2552141 - RNA, 19 nt, Chlamydophila pneumoniae J138
uaccuagggucuucucgag

SEQ ID NO: 2552142 - RNA, 21 nt, Chlamydophila pneumoniae J138
uaccucaucucuggaauacau

SEQ ID NO: 2552143 - RNA, 23 nt, Chlamydophila pneumoniae J138
uaccucuccgucauauuuaaaag

SEQ ID NO: 2552144 - RNA, 19 nt, Chlamydophila pneumoniae J138
uaccuguacgguaaaucca

SEQ ID NO: 2552145 - RNA, 14 nt, Chlamydophila pneumoniae J138
uaccuguagcuaca

SEQ ID NO: 2552146 - RNA, 16 nt, Chlamydophila pneumoniae J138
uaccuguagcuacaga

SEQ ID NO: 2552147 - RNA, 19 nt, Chlamydophila pneumoniae J138
uaccuuaguuuuuucuaag

SEQ ID NO: 2552148 - RNA, 16 nt, Chlamydophila pneumoniae J138
uaccuucgacuauaag

SEQ ID NO: 2552149 - RNA, 14 nt, Chlamydophila pneumoniae J138
uaccuugagacaaa

SEQ ID NO: 2552150 - RNA, 12 nt, Chlamydophila pneumoniae J138
uaccuuucuaag

SEQ ID NO: 2552151 - RNA, 13 nt, Chlamydophila pneumoniae J138
uacgacagaagua

SEQ ID NO: 2552152 - RNA, 19 nt, Chlamydophila pneumoniae J138
uacgaccaacuccucaaaa

SEQ ID NO: 2552153 - RNA, 18 nt, Chlamydophila pneumoniae J138
uacgacgaaguuagcuaa

SEQ ID NO: 2552154 - RNA, 18 nt, Chlamydophila pneumoniae J138
uacgagaucagauguaaa

SEQ ID NO: 2552155 - RNA, 20 nt, Chlamydophila pneumoniae J138
uacgauagccaucauaaaac

SEQ ID NO: 2552156 - RNA, 17 nt, Chlamydophila pneumoniae J138
uacgaucugcuuugcau

SEQ ID NO: 2552157 - RNA, 22 nt, Chlamydophila pneumoniae J138
uacgaugagguugagcaagaau

SEQ ID NO: 2552158 - RNA, 13 nt, Chlamydophila pneumoniae J138
uacgauguuuucu

SEQ ID NO: 2552159 - RNA, 15 nt, Chlamydophila pneumoniae J138
uacgcaaaguacuaa

SEQ ID NO: 2552160 - RNA, 16 nt, Chlamydophila pneumoniae J138
uacgcaaguaaagaaa

SEQ ID NO: 2552161 - RNA, 18 nt, Chlamydophila pneumoniae J138
uacgcaaguaaagaaauu

SEQ ID NO: 2552162 - RNA, 19 nt, Chlamydophila pneumoniae J138
uacgccgugccuauagaaa

SEQ ID NO: 2552163 - RNA, 20 nt, Chlamydophila pneumoniae J138
uacgcuauucuuaagcuacc

SEQ ID NO: 2552164 - RNA, 16 nt, Chlamydophila pneumoniae J138
uacgcuuuucuucuuu

SEQ ID NO: 2552165 - RNA, 14 nt, Chlamydophila pneumoniae J138
uacgcuuuuuacug

SEQ ID NO: 2552166 - RNA, 18 nt, Chlamydophila pneumoniae J138
uacggguaaccugaaagc

SEQ ID NO: 2552167 - RNA, 18 nt, Chlamydophila pneumoniae J138
uacguaaacuauacucuc

SEQ ID NO: 2552168 - RNA, 18 nt, Chlamydophila pneumoniae J138
uacguaccguauccucua

SEQ ID NO: 2552169 - RNA, 22 nt, Chlamydophila pneumoniae J138
uacguccugaugccuuuuucuu

SEQ ID NO: 2552170 - RNA, 15 nt, Chlamydophila pneumoniae J138
uacgugaucaaaauu

SEQ ID NO: 2552171 - RNA, 17 nt, Chlamydophila pneumoniae J138
uacguuggacugcaaga

SEQ ID NO: 2552172 - RNA, 20 nt, Chlamydophila pneumoniae J138
uacguuggacugcaagagcc

SEQ ID NO: 2552173 - RNA, 13 nt, Chlamydophila pneumoniae J138
uacguuuucucua

SEQ ID NO: 2552174 - RNA, 23 nt, Chlamydophila pneumoniae J138
uacguuuuucccuuuaaaaguac

SEQ ID NO: 2552175 - RNA, 15 nt, Chlamydophila pneumoniae J138
uacguuuuuuuccuu

SEQ ID NO: 2552176 - RNA, 13 nt, Chlamydophila pneumoniae J138
uacuaaaaucuca

SEQ ID NO: 2552177 - RNA, 16 nt, Chlamydophila pneumoniae J138
uacuaaaggugaaagu

SEQ ID NO: 2552178 - RNA, 20 nt, Chlamydophila pneumoniae J138
uacuaaaggugaaaguacag

SEQ ID NO: 2552179 - RNA, 19 nt, Chlamydophila pneumoniae J138
uacuaaauuaguaaaugcc

SEQ ID NO: 2552180 - RNA, 11 nt, Chlamydophila pneumoniae J138
uacuacaugag

SEQ ID NO: 2552181 - RNA, 13 nt, Chlamydophila pneumoniae J138
uacuacucucauc

SEQ ID NO: 2552182 - RNA, 15 nt, Chlamydophila pneumoniae J138
uacuacucucaucaa

SEQ ID NO: 2552183 - RNA, 15 nt, Chlamydophila pneumoniae J138
uacuacuuacaagaa

SEQ ID NO: 2552184 - RNA, 17 nt, Chlamydophila pneumoniae J138
uacuacuuacaagaaca

SEQ ID NO: 2552185 - RNA, 18 nt, Chlamydophila pneumoniae J138
uacuacuuacaagaacaa

SEQ ID NO: 2552186 - RNA, 14 nt, Chlamydophila pneumoniae J138
uacuagauaguuca

SEQ ID NO: 2552187 - RNA, 13 nt, Chlamydophila pneumoniae J138
uacucgcuuccga

SEQ ID NO: 2552188 - RNA, 19 nt, Chlamydophila pneumoniae J138
uacucgucaaauucauuaa

SEQ ID NO: 2552189 - RNA, 23 nt, Chlamydophila pneumoniae J138
uacucuacaguaguaaauaauaa

SEQ ID NO: 2552190 - RNA, 19 nt, Chlamydophila pneumoniae J138
uacucucagcaaagacauc

SEQ ID NO: 2552191 - RNA, 12 nt, Chlamydophila pneumoniae J138
uacucucugcuu

SEQ ID NO: 2552192 - RNA, 13 nt, Chlamydophila pneumoniae J138
uacucucugcuuc

SEQ ID NO: 2552193 - RNA, 19 nt, Chlamydophila pneumoniae J138
uacugagcuucuauuucua

SEQ ID NO: 2552194 - RNA, 17 nt, Chlamydophila pneumoniae J138
uacugccagcgaucaca

SEQ ID NO: 2552195 - RNA, 19 nt, Chlamydophila pneumoniae J138
uacugcugcuaagccaaau

SEQ ID NO: 2552196 - RNA, 23 nt, Chlamydophila pneumoniae J138
uacuggagagguaaccagagagc

SEQ ID NO: 2552197 - RNA, 21 nt, Chlamydophila pneumoniae J138
uacuguagaguuuucuuucac

SEQ ID NO: 2552198 - RNA, 13 nt, Chlamydophila pneumoniae J138
uacuguuuuucuu

SEQ ID NO: 2552199 - RNA, 15 nt, Chlamydophila pneumoniae J138
uacuguuuuucuucc

SEQ ID NO: 2552200 - RNA, 19 nt, Chlamydophila pneumoniae J138
uacuuaagcacugaugaaa

SEQ ID NO: 2552201 - RNA, 15 nt, Chlamydophila pneumoniae J138
uacuuacaagaacaa

SEQ ID NO: 2552202 - RNA, 20 nt, Chlamydophila pneumoniae J138
uacuuacaagaacaaggcuc

SEQ ID NO: 2552203 - RNA, 18 nt, Chlamydophila pneumoniae J138
uacuuaggaauuuuucua

SEQ ID NO: 2552204 - RNA, 19 nt, Chlamydophila pneumoniae J138
uacuucaagaaaaaccccu

SEQ ID NO: 2552205 - RNA, 19 nt, Chlamydophila pneumoniae J138
uacuucacucuuucuguag

SEQ ID NO: 2552206 - RNA, 23 nt, Chlamydophila pneumoniae J138
uacuucggaugagauccaaagcc

SEQ ID NO: 2552207 - RNA, 18 nt, Chlamydophila pneumoniae J138
uacuucguuaugaagcuu

SEQ ID NO: 2552208 - RNA, 24 nt, Chlamydophila pneumoniae J138
uacuucuccacagcuucuucguaa

SEQ ID NO: 2552209 - RNA, 15 nt, Chlamydophila pneumoniae J138
uacuugggagaugcu

SEQ ID NO: 2552210 - RNA, 16 nt, Chlamydophila pneumoniae J138
uacuugggagaugcua

SEQ ID NO: 2552211 - RNA, 16 nt, Chlamydophila pneumoniae J138
uacuuuaaucaagccu

SEQ ID NO: 2552212 - RNA, 16 nt, Chlamydophila pneumoniae J138
uacuuuacacuauaag

SEQ ID NO: 2552213 - RNA, 23 nt, Chlamydophila pneumoniae J138
uacuuuaggaggggggauucugu

SEQ ID NO: 2552214 - RNA, 12 nt, Chlamydophila pneumoniae J138
uagaaaaagauc

SEQ ID NO: 2552215 - RNA, 18 nt, Chlamydophila pneumoniae J138
uagaaaacgccaacugua

SEQ ID NO: 2552216 - RNA, 21 nt, Chlamydophila pneumoniae J138
uagaaaagauucuaaaucaac

SEQ ID NO: 2552217 - RNA, 21 nt, Chlamydophila pneumoniae J138
uagaaaagguauuaggaagua

SEQ ID NO: 2552218 - RNA, 18 nt, Chlamydophila pneumoniae J138
uagaaacaacugaaaaac

SEQ ID NO: 2552219 - RNA, 21 nt, Chlamydophila pneumoniae J138
uagaaacaacugaaaaaccau

SEQ ID NO: 2552220 - RNA, 18 nt, Chlamydophila pneumoniae J138
uagaaaccaugaugcaau

SEQ ID NO: 2552221 - RNA, 14 nt, Chlamydophila pneumoniae J138
uagaaacugcuccu

SEQ ID NO: 2552222 - RNA, 13 nt, Chlamydophila pneumoniae J138
uagaaagacaaaa

SEQ ID NO: 2552223 - RNA, 16 nt, Chlamydophila pneumoniae J138
uagaaagacaaaaaau

SEQ ID NO: 2552224 - RNA, 23 nt, Chlamydophila pneumoniae J138
uagaaagacauccuucuuuaccu

SEQ ID NO: 2552225 - RNA, 12 nt, Chlamydophila pneumoniae J138
uagaaagaccau

SEQ ID NO: 2552226 - RNA, 14 nt, Chlamydophila pneumoniae J138
uagaaagaguccuu

SEQ ID NO: 2552227 - RNA, 13 nt, Chlamydophila pneumoniae J138
uagaaaggaaucc

SEQ ID NO: 2552228 - RNA, 15 nt, Chlamydophila pneumoniae J138
uagaaauauacucuu

SEQ ID NO: 2552229 - RNA, 21 nt, Chlamydophila pneumoniae J138
uagaaauauacucuugcuugc

SEQ ID NO: 2552230 - RNA, 19 nt, Chlamydophila pneumoniae J138
uagaaaugaaacgaaagca

SEQ ID NO: 2552231 - RNA, 15 nt, Chlamydophila pneumoniae J138
uagaacacucagaga

SEQ ID NO: 2552232 - RNA, 16 nt, Chlamydophila pneumoniae J138
uagaacacucagagau

SEQ ID NO: 2552233 - RNA, 20 nt, Chlamydophila pneumoniae J138
uagaacagcauggacuccaa

SEQ ID NO: 2552234 - RNA, 20 nt, Chlamydophila pneumoniae J138
uagaacauacacgucuaaga

SEQ ID NO: 2552235 - RNA, 23 nt, Chlamydophila pneumoniae J138
uagaacugcgaaggguuguugcc

SEQ ID NO: 2552236 - RNA, 15 nt, Chlamydophila pneumoniae J138
uagaacuugggaugc

SEQ ID NO: 2552237 - RNA, 12 nt, Chlamydophila pneumoniae J138
uagaagacauuc

SEQ ID NO: 2552238 - RNA, 12 nt, Chlamydophila pneumoniae J138
uagaagagaaag

SEQ ID NO: 2552239 - RNA, 22 nt, Chlamydophila pneumoniae J138
uagaagauccucaaagaguuuu

SEQ ID NO: 2552240 - RNA, 21 nt, Chlamydophila pneumoniae J138
uagaagcaugaagcagaaacu

SEQ ID NO: 2552241 - RNA, 21 nt, Chlamydophila pneumoniae J138
uauaguagcgaauccagaauu

SEQ ID NO: 2552242 - RNA, 14 nt, Chlamydophila pneumoniae J138
uauaguauuuuuaa

SEQ ID NO: 2552243 - RNA, 16 nt, Chlamydophila pneumoniae J138
uauaguauuuuuaaau

SEQ ID NO: 2552244 - RNA, 23 nt, Chlamydophila pneumoniae J138
uauagucuguuuuggaaagaaga

SEQ ID NO: 2552245 - RNA, 18 nt, Chlamydophila pneumoniae J138
uauaguuuucaaaaaucg

SEQ ID NO: 2552246 - RNA, 14 nt, Chlamydophila pneumoniae J138
uauauaaaacauag

SEQ ID NO: 2552247 - RNA, 11 nt, Chlamydophila pneumoniae J138
uauauaaaggu

SEQ ID NO: 2552248 - RNA, 19 nt, Chlamydophila pneumoniae J138
uauauaagauaauagagaa

SEQ ID NO: 2552249 - RNA, 14 nt, Chlamydophila pneumoniae J138
uauauagagcagac

SEQ ID NO: 2552250 - RNA, 18 nt, Chlamydophila pneumoniae J138
uauaucagcaaaaaacug

SEQ ID NO: 2552251 - RNA, 14 nt, Chlamydophila pneumoniae J138
uauaucauuaagaa

SEQ ID NO: 2552252 - RNA, 23 nt, Chlamydophila pneumoniae J138
uauauccacaaucucuuuaaaaa

SEQ ID NO: 2552253 - RNA, 14 nt, Chlamydophila pneumoniae J138
uauauccugaguga

SEQ ID NO: 2552254 - RNA, 22 nt, Chlamydophila pneumoniae J138
uauauguaauuucccuaauucu

SEQ ID NO: 2552255 - RNA, 16 nt, Chlamydophila pneumoniae J138
uauauuuuuuacauaa

SEQ ID NO: 2552256 - RNA, 15 nt, Chlamydophila pneumoniae J138
uaucaaaagguuuua

SEQ ID NO: 2552257 - RNA, 19 nt, Chlamydophila pneumoniae J138
uaucaaaagguuuuauaaa

SEQ ID NO: 2552258 - RNA, 19 nt, Chlamydophila pneumoniae J138
uaucaaagacucaugaaau

SEQ ID NO: 2552259 - RNA, 15 nt, Chlamydophila pneumoniae J138
uaucaaagcauugca

SEQ ID NO: 2552260 - RNA, 23 nt, Chlamydophila pneumoniae J138
uaucaaagcauugcaaauaagcc

SEQ ID NO: 2552261 - RNA, 16 nt, Chlamydophila pneumoniae J138
uaucaaccauaaagaa

SEQ ID NO: 2552262 - RNA, 20 nt, Chlamydophila pneumoniae J138
uaucagggagcggaauuucu

SEQ ID NO: 2552263 - RNA, 21 nt, Chlamydophila pneumoniae J138
uaucaucaaaagauaugucuu

SEQ ID NO: 2552264 - RNA, 22 nt, Chlamydophila pneumoniae J138
uaucauggacaagcaaaagcaa

SEQ ID NO: 2552265 - RNA, 18 nt, Chlamydophila pneumoniae J138
uaucauuaagaagauucu

SEQ ID NO: 2552266 - RNA, 23 nt, Chlamydophila pneumoniae J138
uauccaaagccggcccacucaaa

SEQ ID NO: 2552267 - RNA, 20 nt, Chlamydophila pneumoniae J138
uauccaaguccgugagagga

SEQ ID NO: 2552268 - RNA, 21 nt, Chlamydophila pneumoniae J138
uauccacaaucucuuuaaaaa

SEQ ID NO: 2552269 - RNA, 16 nt, Chlamydophila pneumoniae J138
uauccagaaagauucu

SEQ ID NO: 2552270 - RNA, 21 nt, Chlamydophila pneumoniae J138
uauccagaaagauucugccca

SEQ ID NO: 2552271 - RNA, 18 nt, Chlamydophila pneumoniae J138
uauccagaaauacgucca

SEQ ID NO: 2552272 - RNA, 23 nt, Chlamydophila pneumoniae J138
uauccagcucaaggcaucuagag

SEQ ID NO: 2552273 - RNA, 19 nt, Chlamydophila pneumoniae J138
uauccaugacuuuuguugc

SEQ ID NO: 2552274 - RNA, 19 nt, Chlamydophila pneumoniae J138
uauccuauuggaaggucua

SEQ ID NO: 2552275 - RNA, 15 nt, Chlamydophila pneumoniae J138
uauccucgucuucaa

SEQ ID NO: 2552276 - RNA, 18 nt, Chlamydophila pneumoniae J138
uauccugaacaucuccag

SEQ ID NO: 2552277 - RNA, 14 nt, Chlamydophila pneumoniae J138
uauccugcuccaaa

SEQ ID NO: 2552278 - RNA, 17 nt, Chlamydophila pneumoniae J138
uauccuguuucaacaua

SEQ ID NO: 2552279 - RNA, 15 nt, Chlamydophila pneumoniae J138
uauccuuaucuugcu

SEQ ID NO: 2552280 - RNA, 18 nt, Chlamydophila pneumoniae J138
uauccuugaaauugcucu

SEQ ID NO: 2552281 - RNA, 19 nt, Chlamydophila pneumoniae J138
uauccuugauuuuaaaaug

SEQ ID NO: 2552282 - RNA, 16 nt, Chlamydophila pneumoniae J138
uaucgaccuuaaaauu

SEQ ID NO: 2552283 - RNA, 14 nt, Chlamydophila pneumoniae J138
uaucgaguucuuuu

SEQ ID NO: 2552284 - RNA, 19 nt, Chlamydophila pneumoniae J138
uaucgggggugccaaaaaa

SEQ ID NO: 2552285 - RNA, 16 nt, Chlamydophila pneumoniae J138
uaucgguuuaaacaga

SEQ ID NO: 2552286 - RNA, 14 nt, Chlamydophila pneumoniae J138
uaucuaaagaaaug

SEQ ID NO: 2552287 - RNA, 17 nt, Chlamydophila pneumoniae J138
uaucuaaagaaauguaa

SEQ ID NO: 2552288 - RNA, 14 nt, Chlamydophila pneumoniae J138
uaucuaagacuucu

SEQ ID NO: 2552289 - RNA, 13 nt, Chlamydophila pneumoniae J138
uaucuaauaaaau

SEQ ID NO: 2552290 - RNA, 23 nt, Chlamydophila pneumoniae J138
uaucuacacaguagccuucuucu

SEQ ID NO: 2552291 - RNA, 12 nt, Chlamydophila pneumoniae J138
uaucuacagaga

SEQ ID NO: 2552292 - RNA, 13 nt, Chlamydophila pneumoniae J138
uaucuacgagcau

SEQ ID NO: 2552293 - RNA, 16 nt, Chlamydophila pneumoniae J138
uaucuauagaaggcau

SEQ ID NO: 2552294 - RNA, 15 nt, Chlamydophila pneumoniae J138
uaucuauuaagccgc

SEQ ID NO: 2552295 - RNA, 20 nt, Chlamydophila pneumoniae J138
uaucuccgccauaacacuuu

SEQ ID NO: 2552296 - RNA, 20 nt, Chlamydophila pneumoniae J138
uaucuccggaacgcagaguu

SEQ ID NO: 2552297 - RNA, 19 nt, Chlamydophila pneumoniae J138
uaucuccgggaacaacugu

SEQ ID NO: 2552298 - RNA, 19 nt, Chlamydophila pneumoniae J138
uaucuccguuaccaaaaac

SEQ ID NO: 2552299 - RNA, 18 nt, Chlamydophila pneumoniae J138
uaucucuaccgaacagag

SEQ ID NO: 2552300 - RNA, 20 nt, Chlamydophila pneumoniae J138
uaucucuggcauaauccuga

SEQ ID NO: 2552301 - RNA, 14 nt, Chlamydophila pneumoniae J138
uaucucuguuuuuu

SEQ ID NO: 2552302 - RNA, 22 nt, Chlamydophila pneumoniae J138
uaucucuguuuuuugaaaacuu

SEQ ID NO: 2552303 - RNA, 23 nt, Chlamydophila pneumoniae J138
uaucugagcauaacuugaagaag

SEQ ID NO: 2552304 - RNA, 16 nt, Chlamydophila pneumoniae J138
uaucugcguuucuuuc

SEQ ID NO: 2552305 - RNA, 18 nt, Chlamydophila pneumoniae J138
uaucugcguuucuuucug

SEQ ID NO: 2552306 - RNA, 10 nt, Chlamydophila pneumoniae J138
uaucugcuau

SEQ ID NO: 2552307 - RNA, 14 nt, Chlamydophila pneumoniae J138
uaucugcuucuacg

SEQ ID NO: 2552308 - RNA, 14 nt, Chlamydophila pneumoniae J138
uaucuguuaaaaac

SEQ ID NO: 2552309 - RNA, 19 nt, Chlamydophila pneumoniae J138
uaucuguuaaaaacaagau

SEQ ID NO: 2552310 - RNA, 13 nt, Chlamydophila pneumoniae J138
uaucuuagggaau

SEQ ID NO: 2552311 - RNA, 17 nt, Chlamydophila pneumoniae J138
uaucuucaaaaguaauc

SEQ ID NO: 2552312 - RNA, 20 nt, Chlamydophila pneumoniae J138
uaucuucaaaaguaaucacu

SEQ ID NO: 2552313 - RNA, 18 nt, Chlamydophila pneumoniae J138
uaucuucucuuaugaagu

SEQ ID NO: 2552314 - RNA, 22 nt, Chlamydophila pneumoniae J138
uaucuuuauuuaaauaaaacca

SEQ ID NO: 2552315 - RNA, 14 nt, Chlamydophila pneumoniae J138
uaucuuugguaugc

SEQ ID NO: 2552316 - RNA, 15 nt, Chlamydophila pneumoniae J138
uaugaaacccauaau

SEQ ID NO: 2552317 - RNA, 19 nt, Chlamydophila pneumoniae J138
uaugaacgauuucuuuuag

SEQ ID NO: 2552318 - RNA, 18 nt, Chlamydophila pneumoniae J138
uaugaacugccugagaaa

SEQ ID NO: 2552319 - RNA, 16 nt, Chlamydophila pneumoniae J138
uaugaaugauuuccau

SEQ ID NO: 2552320 - RNA, 17 nt, Chlamydophila pneumoniae J138
uaugaaugauuuccaua

SEQ ID NO: 2552321 - RNA, 21 nt, Chlamydophila pneumoniae J138
uaugaaugauuuccauagagu

SEQ ID NO: 2552322 - RNA, 19 nt, Chlamydophila pneumoniae J138
uaugaauuagggcuuuuac

SEQ ID NO: 2552323 - RNA, 19 nt, Chlamydophila pneumoniae J138
uaugacacagcuaaucaau

SEQ ID NO: 2552324 - RNA, 21 nt, Chlamydophila pneumoniae J138
uaugacacagcuaaucaaucc

SEQ ID NO: 2552325 - RNA, 19 nt, Chlamydophila pneumoniae J138
uaugacggauccuagaaua

SEQ ID NO: 2552326 - RNA, 20 nt, Chlamydophila pneumoniae J138
uaugacuucuuguccuguua

SEQ ID NO: 2552327 - RNA, 18 nt, Chlamydophila pneumoniae J138
uaugauagaacucuccuc

SEQ ID NO: 2552328 - RNA, 15 nt, Chlamydophila pneumoniae J138
uaugaugccucauug

SEQ ID NO: 2552329 - RNA, 17 nt, Chlamydophila pneumoniae J138
uaugaugccucauugcc

SEQ ID NO: 2552330 - RNA, 16 nt, Chlamydophila pneumoniae J138
uaugauguauaaaguu

SEQ ID NO: 2552331 - RNA, 15 nt, Chlamydophila pneumoniae J138
uaugauuacaucuaa

SEQ ID NO: 2552332 - RNA, 14 nt, Chlamydophila pneumoniae J138
uaugcacaaaauaa

SEQ ID NO: 2552333 - RNA, 16 nt, Chlamydophila pneumoniae J138
uaugcacaaaauaaaa

SEQ ID NO: 2552334 - RNA, 17 nt, Chlamydophila pneumoniae J138
uaugcacaaaauaaaac

SEQ ID NO: 2552335 - RNA, 23 nt, Chlamydophila pneumoniae J138
uaugcacgcuuucgucuaaaaua

SEQ ID NO: 2552336 - RNA, 17 nt, Chlamydophila pneumoniae J138
uaugccauaaauacagg

SEQ ID NO: 2552337 - RNA, 23 nt, Chlamydophila pneumoniae J138
uaugccucaggucugcugaggag

SEQ ID NO: 2552338 - RNA, 23 nt, Chlamydophila pneumoniae J138
uaugcuauagcuggaucuucuga

SEQ ID NO: 2552339 - RNA, 22 nt, Chlamydophila pneumoniae J138
uaugcucauuaauaauaucuaa

SEQ ID NO: 2552340 - RNA, 18 nt, Chlamydophila pneumoniae J138
uaugcugaauuccucuga

SEQ ID NO: 2552341 - RNA, 23 nt, Chlamydophila pneumoniae J138
uaugcuguugcuccaagaguucu

SEQ ID NO: 2552342 - RNA, 15 nt, Chlamydophila pneumoniae J138
uauggaagauaaaca

SEQ ID NO: 2552343 - RNA, 17 nt, Chlamydophila pneumoniae J138
uauggaagauaaacaua

SEQ ID NO: 2552344 - RNA, 22 nt, Chlamydophila pneumoniae J138
uauggaaggcggcuuuuugcaa

SEQ ID NO: 2552345 - RNA, 15 nt, Chlamydophila pneumoniae J138
uauggcaaauaaaac

SEQ ID NO: 2552346 - RNA, 19 nt, Chlamydophila pneumoniae J138
uauggcagccuggaaagcu

SEQ ID NO: 2552347 - RNA, 20 nt, Chlamydophila pneumoniae J138
uaugggaggaauuccucuca

SEQ ID NO: 2552348 - RNA, 15 nt, Chlamydophila pneumoniae J138
uaugguaguuugccu

SEQ ID NO: 2552349 - RNA, 17 nt, Chlamydophila pneumoniae J138
uaugguccauaauuucu

SEQ ID NO: 2552350 - RNA, 15 nt, Chlamydophila pneumoniae J138
uauguacuagauagu

SEQ ID NO: 2552351 - RNA, 18 nt, Chlamydophila pneumoniae J138
uauguacugaugugaagc

SEQ ID NO: 2552352 - RNA, 19 nt, Chlamydophila pneumoniae J138
uauguauaacaucuaaaaa

SEQ ID NO: 2552353 - RNA, 15 nt, Chlamydophila pneumoniae J138
uauguccguauuuuu

SEQ ID NO: 2552354 - RNA, 18 nt, Chlamydophila pneumoniae J138
uaugugaugucgcgaaag

SEQ ID NO: 2552355 - RNA, 13 nt, Chlamydophila pneumoniae J138
uauuaaaaauagc

SEQ ID NO: 2552356 - RNA, 19 nt, Chlamydophila pneumoniae J138
uauuaaaccguaggauucu

SEQ ID NO: 2552357 - RNA, 13 nt, Chlamydophila pneumoniae J138
uauuaaagaaucu

SEQ ID NO: 2552358 - RNA, 17 nt, Chlamydophila pneumoniae J138
uauuaaggauuccuuga

SEQ ID NO: 2552359 - RNA, 18 nt, Chlamydophila pneumoniae J138
uauuaauaaauuuaucug

SEQ ID NO: 2552360 - RNA, 14 nt, Chlamydophila pneumoniae J138
uauuaaucuuauug

SEQ ID NO: 2552361 - RNA, 21 nt, Chlamydophila pneumoniae J138
uauuacagaaaggcuuuucuu

SEQ ID NO: 2552362 - RNA, 14 nt, Chlamydophila pneumoniae J138
uauuacagauuucu

SEQ ID NO: 2552363 - RNA, 18 nt, Chlamydophila pneumoniae J138
uauuacagauuucuucuu

SEQ ID NO: 2552364 - RNA, 17 nt, Chlamydophila pneumoniae J138
uauuaggcuuuuuucua

SEQ ID NO: 2552365 - RNA, 19 nt, Chlamydophila pneumoniae J138
uauuaggcuuuuuucuauu

SEQ ID NO: 2552366 - RNA, 17 nt, Chlamydophila pneumoniae J138
uauuaguuuugaaauca

SEQ ID NO: 2552367 - RNA, 15 nt, Chlamydophila pneumoniae J138
uauuauaaauagaaa

SEQ ID NO: 2552368 - RNA, 17 nt, Chlamydophila pneumoniae J138
uauuauaaauagaaauc

SEQ ID NO: 2552369 - RNA, 18 nt, Chlamydophila pneumoniae J138
uauuaucuacagagagaa

SEQ ID NO: 2552370 - RNA, 14 nt, Chlamydophila pneumoniae J138
uauuauuuuaaagu

SEQ ID NO: 2552371 - RNA, 14 nt, Chlamydophila pneumoniae J138
uauuccaucacagu

SEQ ID NO: 2552372 - RNA, 15 nt, Chlamydophila pneumoniae J138
uauuccaucacaguu

SEQ ID NO: 2552373 - RNA, 17 nt, Chlamydophila pneumoniae J138
uauuccaucacaguuaa

SEQ ID NO: 2552374 - RNA, 19 nt, Chlamydophila pneumoniae J138
uauuccucuuaggagagcu

SEQ ID NO: 2552375 - RNA, 19 nt, Chlamydophila pneumoniae J138
uauuccuuggauuucuucu

SEQ ID NO: 2552376 - RNA, 15 nt, Chlamydophila pneumoniae J138
uauucuagaguugcu

SEQ ID NO: 2552377 - RNA, 14 nt, Chlamydophila pneumoniae J138
uauucucgaaaaau

SEQ ID NO: 2552378 - RNA, 17 nt, Chlamydophila pneumoniae J138
uauucucgaaaaauuug

SEQ ID NO: 2552379 - RNA, 18 nt, Chlamydophila pneumoniae J138
uauucucuucauuuucuu

SEQ ID NO: 2552380 - RNA, 15 nt, Chlamydophila pneumoniae J138
uauucugaaauuucu

SEQ ID NO: 2552381 - RNA, 16 nt, Chlamydophila pneumoniae J138
uauucugaaauuucug

SEQ ID NO: 2552382 - RNA, 15 nt, Chlamydophila pneumoniae J138
uauucugaagcugca

SEQ ID NO: 2552383 - RNA, 17 nt, Chlamydophila pneumoniae J138
uauucugauaaucagag

SEQ ID NO: 2552384 - RNA, 17 nt, Chlamydophila pneumoniae J138
uauucuguggaauauca

SEQ ID NO: 2552385 - RNA, 17 nt, Chlamydophila pneumoniae J138
uauucuuaaugcgaugc

SEQ ID NO: 2552386 - RNA, 13 nt, Chlamydophila pneumoniae J138
uauucuuggaaua

SEQ ID NO: 2552387 - RNA, 18 nt, Chlamydophila pneumoniae J138
uauugaaaaaucccuguu

SEQ ID NO: 2552388 - RNA, 16 nt, Chlamydophila pneumoniae J138
uauugaagucuucuug

SEQ ID NO: 2552389 - RNA, 18 nt, Chlamydophila pneumoniae J138
uauugacuagcucucuug

SEQ ID NO: 2552390 - RNA, 20 nt, Chlamydophila pneumoniae J138
uauugauaaugauuccuaga

SEQ ID NO: 2552391 - RNA, 13 nt, Chlamydophila pneumoniae J138
uauugauagcuga

SEQ ID NO: 2552392 - RNA, 13 nt, Chlamydophila pneumoniae J138
uauugcucuugua

SEQ ID NO: 2552393 - RNA, 23 nt, Chlamydophila pneumoniae J138
uauuguguucccucuucuuccaa

SEQ ID NO: 2552394 - RNA, 20 nt, Chlamydophila pneumoniae J138
uauuguucuugguguauagu

SEQ ID NO: 2552395 - RNA, 15 nt, Chlamydophila pneumoniae J138
uauuuaagaaaugca

SEQ ID NO: 2552396 - RNA, 12 nt, Chlamydophila pneumoniae J138
uauuuaauccaa

SEQ ID NO: 2552397 - RNA, 20 nt, Chlamydophila pneumoniae J138
uauuuaccuacagauaugcu

SEQ ID NO: 2552398 - RNA, 17 nt, Chlamydophila pneumoniae J138
uauuuacgaaaacaucu

SEQ ID NO: 2552399 - RNA, 13 nt, Chlamydophila pneumoniae J138
uauuuagagagaa

SEQ ID NO: 2552400 - RNA, 17 nt, Chlamydophila pneumoniae J138
uauuuagagagaaacau

SEQ ID NO: 2552401 - RNA, 20 nt, Chlamydophila pneumoniae J138
uauuuagcauuucucuauga

SEQ ID NO: 2552402 - RNA, 18 nt, Chlamydophila pneumoniae J138
uauuuauuuuauuaguuu

SEQ ID NO: 2552403 - RNA, 21 nt, Chlamydophila pneumoniae J138
uauuucauauaaaguuuccaa

SEQ ID NO: 2552404 - RNA, 15 nt, Chlamydophila pneumoniae J138
uauuucuaaaaaaua

SEQ ID NO: 2552405 - RNA, 12 nt, Chlamydophila pneumoniae J138
uauuucuuaauu

SEQ ID NO: 2552406 - RNA, 19 nt, Chlamydophila pneumoniae J138
uauuugcaacaaucuuucu

SEQ ID NO: 2552407 - RNA, 22 nt, Chlamydophila pneumoniae J138
uauuugcaacaaucuuucuucu

SEQ ID NO: 2552408 - RNA, 23 nt, Chlamydophila pneumoniae J138
uauuugcaacaaucuuucuucua

SEQ ID NO: 2552409 - RNA, 20 nt, Chlamydophila pneumoniae J138
uauuugcagaagcauuguau

SEQ ID NO: 2552410 - RNA, 15 nt, Chlamydophila pneumoniae J138
uauuugccaaaauaa

SEQ ID NO: 2552411 - RNA, 21 nt, Chlamydophila pneumoniae J138
uauuuggacguacuaagauac

SEQ ID NO: 2552412 - RNA, 19 nt, Chlamydophila pneumoniae J138
uauuuugcaaaugaaaaga

SEQ ID NO: 2552413 - RNA, 23 nt, Chlamydophila pneumoniae J138
uauuuugcaaaugaaaagagacu

SEQ ID NO: 2552414 - RNA, 15 nt, Chlamydophila pneumoniae J138
uauuuugucuuuuua

SEQ ID NO: 2552415 - RNA, 12 nt, Chlamydophila pneumoniae J138
uauuuuuaaaua

SEQ ID NO: 2552416 - RNA, 14 nt, Chlamydophila pneumoniae J138
uauuuuuaaauaaa

SEQ ID NO: 2552417 - RNA, 20 nt, Chlamydophila pneumoniae J138
uauuuuuacuucacucuuuc

SEQ ID NO: 2552418 - RNA, 19 nt, Chlamydophila pneumoniae J138
uauuuuuccagaaauggca

SEQ ID NO: 2552419 - RNA, 20 nt, Chlamydophila pneumoniae J138
uauuuuuuaagcuaauaaga

SEQ ID NO: 2552420 - RNA, 21 nt, Chlamydophila pneumoniae J138
ucaaaaaaaacgccauacuga

SEQ ID NO: 2552421 - RNA, 15 nt, Chlamydophila pneumoniae J138
ucaaaaaacaacgau

SEQ ID NO: 2552422 - RNA, 13 nt, Chlamydophila pneumoniae J138
ucaaaaaauacau

SEQ ID NO: 2552423 - RNA, 14 nt, Chlamydophila pneumoniae J138
ucaaaaagagagcc

SEQ ID NO: 2552424 - RNA, 13 nt, Chlamydophila pneumoniae J138
ucaaaaagcuccc

SEQ ID NO: 2552425 - RNA, 11 nt, Chlamydophila pneumoniae J138
ucaaaaaguuc

SEQ ID NO: 2552426 - RNA, 13 nt, Chlamydophila pneumoniae J138
ucaaaaauucuuc

SEQ ID NO: 2552427 - RNA, 11 nt, Chlamydophila pneumoniae J138
ucaaaagaaga

SEQ ID NO: 2552428 - RNA, 17 nt, Chlamydophila pneumoniae J138
ucaaaagguuuuauaaa

SEQ ID NO: 2552429 - RNA, 22 nt, Chlamydophila pneumoniae J138
ucaaaagucaugaggacugugg

SEQ ID NO: 2552430 - RNA, 20 nt, Chlamydophila pneumoniae J138
ucaaaaguuccccaauuucu

SEQ ID NO: 2552431 - RNA, 16 nt, Chlamydophila pneumoniae J138
ucaaaauuauccagaa

SEQ ID NO: 2552432 - RNA, 13 nt, Chlamydophila pneumoniae J138
ucaaaauuuccuc

SEQ ID NO: 2552433 - RNA, 18 nt, Chlamydophila pneumoniae J138
ucaaaauuuuuaguaauu

SEQ ID NO: 2552434 - RNA, 11 nt, Chlamydophila pneumoniae J138
ucaaacauuac

SEQ ID NO: 2552435 - RNA, 20 nt, Chlamydophila pneumoniae J138
ucaaaccacggauuuucucu

SEQ ID NO: 2552436 - RNA, 21 nt, Chlamydophila pneumoniae J138
ucaaaccacggauuuucucua

SEQ ID NO: 2552437 - RNA, 17 nt, Chlamydophila pneumoniae J138
ucaaacccucuccagaa

SEQ ID NO: 2552438 - RNA, 18 nt, Chlamydophila pneumoniae J138
ucaaacccucuccagaag

SEQ ID NO: 2552439 - RNA, 21 nt, Chlamydophila pneumoniae J138
ucaaacugauuaguuuguuuu

SEQ ID NO: 2552440 - RNA, 14 nt, Chlamydophila pneumoniae J138
ucaaagaaagugaa

SEQ ID NO: 2552441 - RNA, 11 nt, Chlamydophila pneumoniae J138
ucaaagaacaa

SEQ ID NO: 2552442 - RNA, 14 nt, Chlamydophila pneumoniae J138
ucaaagacaggcuc

SEQ ID NO: 2552443 - RNA, 19 nt, Chlamydophila pneumoniae J138
ucaaagacaggcucaugaa

SEQ ID NO: 2552444 - RNA, 18 nt, Chlamydophila pneumoniae J138
ucaaagacucaugaaaua

SEQ ID NO: 2552445 - RNA, 15 nt, Chlamydophila pneumoniae J138
ucaaagauuccuaag

SEQ ID NO: 2552446 - RNA, 12 nt, Chlamydophila pneumoniae J138
ucaaagcaaaga

SEQ ID NO: 2552447 - RNA, 15 nt, Chlamydophila pneumoniae J138
ucaaagcauugcaaa

SEQ ID NO: 2552448 - RNA, 17 nt, Chlamydophila pneumoniae J138
ucaaaggauccauaacc

SEQ ID NO: 2552449 - RNA, 23 nt, Chlamydophila pneumoniae J138
ucaaaggcaacgcgauuuucaac

SEQ ID NO: 2552450 - RNA, 21 nt, Chlamydophila pneumoniae J138
ucaaaggcaauagcagcagcg

SEQ ID NO: 2552451 - RNA, 22 nt, Chlamydophila pneumoniae J138
ucaaagucaaauacuucuccug

SEQ ID NO: 2552452 - RNA, 18 nt, Chlamydophila pneumoniae J138
ucaaauagauuuuuacuu

SEQ ID NO: 2552453 - RNA, 20 nt, Chlamydophila pneumoniae J138
ucaaauaggaucucucuuuc

SEQ ID NO: 2552454 - RNA, 22 nt, Chlamydophila pneumoniae J138
ucaaauaggaucucucuuuccu

SEQ ID NO: 2552455 - RNA, 13 nt, Chlamydophila pneumoniae J138
ucaaauaguucau

SEQ ID NO: 2552456 - RNA, 22 nt, Chlamydophila pneumoniae J138
ucaaaucucauuccagcaucuu

SEQ ID NO: 2552457 - RNA, 18 nt, Chlamydophila pneumoniae J138
ucaaaucuuucaaggaac

SEQ ID NO: 2552458 - RNA, 22 nt, Chlamydophila pneumoniae J138
ucaaaucuuucaaggaacauuu

SEQ ID NO: 2552459 - RNA, 15 nt, Chlamydophila pneumoniae J138
ucaaauuccuucuca

SEQ ID NO: 2552460 - RNA, 18 nt, Chlamydophila pneumoniae J138
ucaaauuccuucucagaa

SEQ ID NO: 2552461 - RNA, 12 nt, Chlamydophila pneumoniae J138
ucaaauucugaa

SEQ ID NO: 2552462 - RNA, 17 nt, Chlamydophila pneumoniae J138
ucaaauuugcucuccug

SEQ ID NO: 2552463 - RNA, 22 nt, Chlamydophila pneumoniae J138
ucaacaaguucuuggaaaaaag

SEQ ID NO: 2552464 - RNA, 21 nt, Chlamydophila pneumoniae J138
ucaacacccggcuuuuccaga

SEQ ID NO: 2552465 - RNA, 19 nt, Chlamydophila pneumoniae J138
ucaacaccucaauacggac

SEQ ID NO: 2552466 - RNA, 21 nt, Chlamydophila pneumoniae J138
ucaacauucuucugucuguau

SEQ ID NO: 2552467 - RNA, 23 nt, Chlamydophila pneumoniae J138
ucaacauucuucugucuguauuu

SEQ ID NO: 2552468 - RNA, 23 nt, Chlamydophila pneumoniae J138
ucaacauuuugccuuuagggaaa

SEQ ID NO: 2552469 - RNA, 15 nt, Chlamydophila pneumoniae J138
ucaaccauaaagaau

SEQ ID NO: 2552470 - RNA, 16 nt, Chlamydophila pneumoniae J138
ucaacguuuguaguaa

SEQ ID NO: 2552471 - RNA, 21 nt, Chlamydophila pneumoniae J138
ucaacguuuguaguaaggaga

SEQ ID NO: 2552472 - RNA, 13 nt, Chlamydophila pneumoniae J138
ucaacuacaucuc

SEQ ID NO: 2552473 - RNA, 15 nt, Chlamydophila pneumoniae J138
ucaacuacaucucca

SEQ ID NO: 2552474 - RNA, 16 nt, Chlamydophila pneumoniae J138
ucaacuacaucuccaa

SEQ ID NO: 2552475 - RNA, 19 nt, Chlamydophila pneumoniae J138
ucaacuacaucuccaagcc

SEQ ID NO: 2552476 - RNA, 14 nt, Chlamydophila pneumoniae J138
ucaacuuuguuaau

SEQ ID NO: 2552477 - RNA, 15 nt, Chlamydophila pneumoniae J138
ucaagaaaaaccccu

SEQ ID NO: 2552478 - RNA, 14 nt, Chlamydophila pneumoniae J138
ucaagaaauucuuc

SEQ ID NO: 2552479 - RNA, 18 nt, Chlamydophila pneumoniae J138
ucaagaacaguuugcucu

SEQ ID NO: 2552480 - RNA, 21 nt, Chlamydophila pneumoniae J138
ucaagaacaguuugcucugga

SEQ ID NO: 2552481 - RNA, 15 nt, Chlamydophila pneumoniae J138
ucaagaacuccuuug

SEQ ID NO: 2552482 - RNA, 19 nt, Chlamydophila pneumoniae J138
ucaagaauaugaacugccu

SEQ ID NO: 2552483 - RNA, 22 nt, Chlamydophila pneumoniae J138
ucaagaauuucuucuuuccaua

SEQ ID NO: 2552484 - RNA, 20 nt, Chlamydophila pneumoniae J138
ucaagagcucguaauccuuc

SEQ ID NO: 2552485 - RNA, 18 nt, Chlamydophila pneumoniae J138
ucaagaguaggcaauaca

SEQ ID NO: 2552486 - RNA, 17 nt, Chlamydophila pneumoniae J138
ucaagcaaaucuccguu

SEQ ID NO: 2552487 - RNA, 15 nt, Chlamydophila pneumoniae J138
ucaagccacagagaa

SEQ ID NO: 2552488 - RNA, 14 nt, Chlamydophila pneumoniae J138
ucaaggaguuuuaa

SEQ ID NO: 2552489 - RNA, 20 nt, Chlamydophila pneumoniae J138
ucaaggcaucuucuuugcca

SEQ ID NO: 2552490 - RNA, 21 nt, Chlamydophila pneumoniae J138
ucaagguacuuuauagaaagu

SEQ ID NO: 2552491 - RNA, 14 nt, Chlamydophila pneumoniae J138
ucaaguaagaaguc

SEQ ID NO: 2552492 - RNA, 18 nt, Chlamydophila pneumoniae J138
ucaagucgagaaacaaaa

SEQ ID NO: 2552493 - RNA, 16 nt, Chlamydophila pneumoniae J138
ucaagucuauuugaaa

SEQ ID NO: 2552494 - RNA, 14 nt, Chlamydophila pneumoniae J138
ucaaguuucuuuug

SEQ ID NO: 2552495 - RNA, 16 nt, Chlamydophila pneumoniae J138
ucaaguuucuuuugca

SEQ ID NO: 2552496 - RNA, 14 nt, Chlamydophila pneumoniae J138
ucaauaagaucucg

SEQ ID NO: 2552497 - RNA, 21 nt, Chlamydophila pneumoniae J138
ucaauaagcuugccagcagaa

SEQ ID NO: 2552498 - RNA, 21 nt, Chlamydophila pneumoniae J138
ucaauaaguagauuaaaggca

SEQ ID NO: 2552499 - RNA, 13 nt, Chlamydophila pneumoniae J138
ucaauaauuucaa

SEQ ID NO: 2552500 - RNA, 16 nt, Chlamydophila pneumoniae J138
ucaauacgaucuuuug

SEQ ID NO: 2552501 - RNA, 13 nt, Chlamydophila pneumoniae J138
ucaauagcaaaga

SEQ ID NO: 2552502 - RNA, 14 nt, Chlamydophila pneumoniae J138
ucaaucaaauucaa

SEQ ID NO: 2552503 - RNA, 14 nt, Chlamydophila pneumoniae J138
ucaaucaauaaaau

SEQ ID NO: 2552504 - RNA, 15 nt, Chlamydophila pneumoniae J138
ucaauccaacaaaga

SEQ ID NO: 2552505 - RNA, 20 nt, Chlamydophila pneumoniae J138
ucaauccccugcaucucugc

SEQ ID NO: 2552506 - RNA, 18 nt, Chlamydophila pneumoniae J138
ucaaucucuuugacaucu

SEQ ID NO: 2552507 - RNA, 15 nt, Chlamydophila pneumoniae J138
ucaaugaagaaaaau

SEQ ID NO: 2552508 - RNA, 15 nt, Chlamydophila pneumoniae J138
ucaaugacuguaucu

SEQ ID NO: 2552509 - RNA, 16 nt, Chlamydophila pneumoniae J138
ucaaugagaucugcaa

SEQ ID NO: 2552510 - RNA, 22 nt, Chlamydophila pneumoniae J138
ucaaugagcaucugagucauaa

SEQ ID NO: 2552511 - RNA, 19 nt, Chlamydophila pneumoniae J138
ucaauuuuaccacuuccag

SEQ ID NO: 2552512 - RNA, 15 nt, Chlamydophila pneumoniae J138
ucacaaacaacagaa

SEQ ID NO: 2552513 - RNA, 19 nt, Chlamydophila pneumoniae J138
ucacaaacaacagaaaugu

SEQ ID NO: 2552514 - RNA, 11 nt, Chlamydophila pneumoniae J138
ucacaaagaau

SEQ ID NO: 2552515 - RNA, 12 nt, Chlamydophila pneumoniae J138
ucacaaagaauu

SEQ ID NO: 2552516 - RNA, 19 nt, Chlamydophila pneumoniae J138
ucacaaagaauucagagaa

SEQ ID NO: 2552517 - RNA, 21 nt, Chlamydophila pneumoniae J138
ucacaaagaauucagagaaag

SEQ ID NO: 2552518 - RNA, 23 nt, Chlamydophila pneumoniae J138
ucacaaaucuuccccuaaaaauu

SEQ ID NO: 2552519 - RNA, 17 nt, Chlamydophila pneumoniae J138
ucacaagcaguaacugc

SEQ ID NO: 2552520 - RNA, 16 nt, Chlamydophila pneumoniae J138
ucacaauauaaaugcu

SEQ ID NO: 2552521 - RNA, 17 nt, Chlamydophila pneumoniae J138
ucacaauauaaaugcua

SEQ ID NO: 2552522 - RNA, 20 nt, Chlamydophila pneumoniae J138
ucacaauuuuaaaaucuccu

SEQ ID NO: 2552523 - RNA, 23 nt, Chlamydophila pneumoniae J138
ucacaauuuuaaaaucuccucuc

SEQ ID NO: 2552524 - RNA, 17 nt, Chlamydophila pneumoniae J138
ucacaccaaauccugca

SEQ ID NO: 2552525 - RNA, 22 nt, Chlamydophila pneumoniae J138
ucacacgaauaauuaaaucgua

SEQ ID NO: 2552526 - RNA, 16 nt, Chlamydophila pneumoniae J138
ucacacugcgagagaa

SEQ ID NO: 2552527 - RNA, 20 nt, Chlamydophila pneumoniae J138
ucacacuuaaagguaaaacu

SEQ ID NO: 2552528 - RNA, 16 nt, Chlamydophila pneumoniae J138
ucacagagucugggau

SEQ ID NO: 2552529 - RNA, 15 nt, Chlamydophila pneumoniae J138
ucacagcaaucugca

SEQ ID NO: 2552530 - RNA, 16 nt, Chlamydophila pneumoniae J138
ucacagcauuuucucu

SEQ ID NO: 2552531 - RNA, 17 nt, Chlamydophila pneumoniae J138
ucacagcgcugugagga

SEQ ID NO: 2552532 - RNA, 14 nt, Chlamydophila pneumoniae J138
ucacagucuuaaau

SEQ ID NO: 2552533 - RNA, 19 nt, Chlamydophila pneumoniae J138
ucacaguuaagacgcagaa

SEQ ID NO: 2552534 - RNA, 14 nt, Chlamydophila pneumoniae J138
ucacauaaaauaau

SEQ ID NO: 2552535 - RNA, 21 nt, Chlamydophila pneumoniae J138
ucacauaguuuaauaaaucua

SEQ ID NO: 2552536 - RNA, 14 nt, Chlamydophila pneumoniae J138
ucacaucaguucca

SEQ ID NO: 2552537 - RNA, 14 nt, Chlamydophila pneumoniae J138
ucacaucuaaagau

SEQ ID NO: 2552538 - RNA, 13 nt, Chlamydophila pneumoniae J138
ucacaucuuucuc

SEQ ID NO: 2552539 - RNA, 15 nt, Chlamydophila pneumoniae J138
ucacaucuuucucua

SEQ ID NO: 2552540 - RNA, 21 nt, Chlamydophila pneumoniae J138
ucacaucuuucucuaaaauau

SEQ ID NO: 2552541 - RNA, 13 nt, Chlamydophila pneumoniae J138
ucacauuuucaug

SEQ ID NO: 2552542 - RNA, 18 nt, Chlamydophila pneumoniae J138
ucaccacaaaccucuaaa

SEQ ID NO: 2552543 - RNA, 16 nt, Chlamydophila pneumoniae J138
ucaccagaagcauuga

SEQ ID NO: 2552544 - RNA, 20 nt, Chlamydophila pneumoniae J138
ucaccauauaauagauauac

SEQ ID NO: 2552545 - RNA, 18 nt, Chlamydophila pneumoniae J138
ucaccauccaaagcuauu

SEQ ID NO: 2552546 - RNA, 13 nt, Chlamydophila pneumoniae J138
ucaccauuaaauu

SEQ ID NO: 2552547 - RNA, 15 nt, Chlamydophila pneumoniae J138
ucaccuacaucagac

SEQ ID NO: 2552548 - RNA, 16 nt, Chlamydophila pneumoniae J138
ucaccuacaucagacu

SEQ ID NO: 2552549 - RNA, 18 nt, Chlamydophila pneumoniae J138
ucaccuacaucagacuga

SEQ ID NO: 2552550 - RNA, 14 nt, Chlamydophila pneumoniae J138
ucaccugagcuaua

SEQ ID NO: 2552551 - RNA, 19 nt, Chlamydophila pneumoniae J138
ucaccugagcuauaaucua

SEQ ID NO: 2552552 - RNA, 22 nt, Chlamydophila pneumoniae J138
ucaccuuacauccaauuuuguu

SEQ ID NO: 2552553 - RNA, 15 nt, Chlamydophila pneumoniae J138
ucaccuuagagugac

SEQ ID NO: 2552554 - RNA, 13 nt, Chlamydophila pneumoniae J138
ucaccuuaggcuu

SEQ ID NO: 2552555 - RNA, 13 nt, Chlamydophila pneumoniae J138
ucacgaaaaggag

SEQ ID NO: 2552556 - RNA, 17 nt, Chlamydophila pneumoniae J138
ucacgaaaaggagaaua

SEQ ID NO: 2552557 - RNA, 20 nt, Chlamydophila pneumoniae J138
ucacgaggagcuuuuaccuu

SEQ ID NO: 2552558 - RNA, 21 nt, Chlamydophila pneumoniae J138
ucacgagucccuucuuucaau

SEQ ID NO: 2552559 - RNA, 15 nt, Chlamydophila pneumoniae J138
ucacgcucucgcuaa

SEQ ID NO: 2552560 - RNA, 16 nt, Chlamydophila pneumoniae J138
ucacguccacaagcuu

SEQ ID NO: 2552561 - RNA, 13 nt, Chlamydophila pneumoniae J138
ucacuaucaugga

SEQ ID NO: 2552562 - RNA, 19 nt, Chlamydophila pneumoniae J138
ucacucguugccaaucuuu

SEQ ID NO: 2552563 - RNA, 13 nt, Chlamydophila pneumoniae J138
ucacucuaugaga

SEQ ID NO: 2552564 - RNA, 13 nt, Chlamydophila pneumoniae J138
ucacucuuuaaaa

SEQ ID NO: 2552565 - RNA, 23 nt, Chlamydophila pneumoniae J138
ucacugucggaaguuucagagcc

SEQ ID NO: 2552566 - RNA, 18 nt, Chlamydophila pneumoniae J138
ucacuguuuuucguaagc

SEQ ID NO: 2552567 - RNA, 18 nt, Chlamydophila pneumoniae J138
ucacuuaauaauguuuua

SEQ ID NO: 2552568 - RNA, 17 nt, Chlamydophila pneumoniae J138
ucacuuauaagcugcuu

SEQ ID NO: 2552569 - RNA, 14 nt, Chlamydophila pneumoniae J138
ucacuucaauuaca

SEQ ID NO: 2552570 - RNA, 16 nt, Chlamydophila pneumoniae J138
ucacuucaucgacagu

SEQ ID NO: 2552571 - RNA, 20 nt, Chlamydophila pneumoniae J138
ucacuucgacacgaacuuug

SEQ ID NO: 2552572 - RNA, 16 nt, Chlamydophila pneumoniae J138
ucagaaacaugaaguu

SEQ ID NO: 2552573 - RNA, 14 nt, Chlamydophila pneumoniae J138
ucagaaauuccuaa

SEQ ID NO: 2552574 - RNA, 21 nt, Chlamydophila pneumoniae J138
ucagaacaacgcugcuucucu

SEQ ID NO: 2552575 - RNA, 23 nt, Chlamydophila pneumoniae J138
ucagaacaacgcugcuucucuac

SEQ ID NO: 2552576 - RNA, 19 nt, Chlamydophila pneumoniae J138
ucagaacaagaaguaggaa

SEQ ID NO: 2552577 - RNA, 13 nt, Chlamydophila pneumoniae J138
ucagaagcuauuc

SEQ ID NO: 2552578 - RNA, 15 nt, Chlamydophila pneumoniae J138
ucagaagcuccugag

SEQ ID NO: 2552579 - RNA, 21 nt, Chlamydophila pneumoniae J138
ucagaagugaucuugagaaaa

SEQ ID NO: 2552580 - RNA, 19 nt, Chlamydophila pneumoniae J138
ucagaauccauuuugccca

SEQ ID NO: 2552581 - RNA, 21 nt, Chlamydophila pneumoniae J138
ucagaaugcccuuuagggaau

SEQ ID NO: 2552582 - RNA, 17 nt, Chlamydophila pneumoniae J138
ucagagacaaguucauc

SEQ ID NO: 2552583 - RNA, 13 nt, Chlamydophila pneumoniae J138
ucagagagaacag

SEQ ID NO: 2552584 - RNA, 17 nt, Chlamydophila pneumoniae J138
ucagaggagccuccaua

SEQ ID NO: 2552585 - RNA, 19 nt, Chlamydophila pneumoniae J138
ucagaguugucaaguaagu

SEQ ID NO: 2552586 - RNA, 16 nt, Chlamydophila pneumoniae J138
ucagauaaaaagaagu

SEQ ID NO: 2552587 - RNA, 15 nt, Chlamydophila pneumoniae J138
ucagauccaugaaca

SEQ ID NO: 2552588 - RNA, 18 nt, Chlamydophila pneumoniae J138
ucagcaaaaaacugcaaa

SEQ ID NO: 2552589 - RNA, 20 nt, Chlamydophila pneumoniae J138
ucagcaaagacauccaagcc

SEQ ID NO: 2552590 - RNA, 13 nt, Chlamydophila pneumoniae J138
ucagcaacauaaa

SEQ ID NO: 2552591 - RNA, 21 nt, Chlamydophila pneumoniae J138
ucagcaaccuuuccuaaaaua

SEQ ID NO: 2552592 - RNA, 18 nt, Chlamydophila pneumoniae J138
ucagcaagaaaauaggug

SEQ ID NO: 2552593 - RNA, 19 nt, Chlamydophila pneumoniae J138
ucagcaagaucuaacuuca

SEQ ID NO: 2552594 - RNA, 13 nt, Chlamydophila pneumoniae J138
ucagcaaggaagu

SEQ ID NO: 2552595 - RNA, 19 nt, Chlamydophila pneumoniae J138
ucagcagcugucaauccaa

SEQ ID NO: 2552596 - RNA, 12 nt, Chlamydophila pneumoniae J138
ucagcagcuucu

SEQ ID NO: 2552597 - RNA, 21 nt, Chlamydophila pneumoniae J138
ucagcagcuucuauugcugua

SEQ ID NO: 2552598 - RNA, 17 nt, Chlamydophila pneumoniae J138
ucagccaagacaaaaaa

SEQ ID NO: 2552599 - RNA, 20 nt, Chlamydophila pneumoniae J138
ucagcccacuguuuugcuuc

SEQ ID NO: 2552600 - RNA, 21 nt, Chlamydophila pneumoniae J138
ucagcgcaucacgaaaaggag

SEQ ID NO: 2552601 - RNA, 22 nt, Chlamydophila pneumoniae J138
ucagcgcaucacgaaaaggaga

SEQ ID NO: 2552602 - RNA, 16 nt, Chlamydophila pneumoniae J138
ucagcucaaguuggca

SEQ ID NO: 2552603 - RNA, 16 nt, Chlamydophila pneumoniae J138
ucagcuggguaagucc

SEQ ID NO: 2552604 - RNA, 15 nt, Chlamydophila pneumoniae J138
ucagcuuaucuauag

SEQ ID NO: 2552605 - RNA, 15 nt, Chlamydophila pneumoniae J138
ucagcuucuacagca

SEQ ID NO: 2552606 - RNA, 18 nt, Chlamydophila pneumoniae J138
ucagcuucuacagcaucg

SEQ ID NO: 2552607 - RNA, 14 nt, Chlamydophila pneumoniae J138
ucagcuucuugaug

SEQ ID NO: 2552608 - RNA, 19 nt, Chlamydophila pneumoniae J138
ucagcuucuugauguacag

SEQ ID NO: 2552609 - RNA, 16 nt, Chlamydophila pneumoniae J138
ucagcuuguuuuugca

SEQ ID NO: 2552610 - RNA, 19 nt, Chlamydophila pneumoniae J138
ucagcuuugcuuaaaaagu

SEQ ID NO: 2552611 - RNA, 19 nt, Chlamydophila pneumoniae J138
ucaggaaagguaguuuucu

SEQ ID NO: 2552612 - RNA, 23 nt, Chlamydophila pneumoniae J138
ucaggaaagguaguuuucuucuu

SEQ ID NO: 2552613 - RNA, 15 nt, Chlamydophila pneumoniae J138
ucaggacaaugaaga

SEQ ID NO: 2552614 - RNA, 17 nt, Chlamydophila pneumoniae J138
ucaggacaaugaagaac

SEQ ID NO: 2552615 - RNA, 15 nt, Chlamydophila pneumoniae J138
ucaggacaugccuua

SEQ ID NO: 2552616 - RNA, 22 nt, Chlamydophila pneumoniae J138
ucaggaccuaagggcucuccua

SEQ ID NO: 2552617 - RNA, 20 nt, Chlamydophila pneumoniae J138
ucaggagaccagggaucuuc

SEQ ID NO: 2552618 - RNA, 17 nt, Chlamydophila pneumoniae J138
ucaggagauacaaguaa

SEQ ID NO: 2552619 - RNA, 23 nt, Chlamydophila pneumoniae J138
ucaggauacucugaacaggaaua

SEQ ID NO: 2552620 - RNA, 21 nt, Chlamydophila pneumoniae J138
ucagggagcggaauuucucau

SEQ ID NO: 2552621 - RNA, 16 nt, Chlamydophila pneumoniae J138
ucagguaaagagcuuc

SEQ ID NO: 2552622 - RNA, 15 nt, Chlamydophila pneumoniae J138
ucaguaaaacacaaa

SEQ ID NO: 2552623 - RNA, 21 nt, Chlamydophila pneumoniae J138
ucaguaaacccucagaacacg

SEQ ID NO: 2552624 - RNA, 16 nt, Chlamydophila pneumoniae J138
ucaguaucaauaaucg

SEQ ID NO: 2552625 - RNA, 16 nt, Chlamydophila pneumoniae J138
ucaguauggcguuuuu

SEQ ID NO: 2552626 - RNA, 20 nt, Chlamydophila pneumoniae J138
ucagucucgugcauaaugau

SEQ ID NO: 2552627 - RNA, 15 nt, Chlamydophila pneumoniae J138
ucagucucucuaucu

SEQ ID NO: 2552628 - RNA, 16 nt, Chlamydophila pneumoniae J138
ucagucuuccuuuaua

SEQ ID NO: 2552629 - RNA, 15 nt, Chlamydophila pneumoniae J138
ucaguggauucgugc

SEQ ID NO: 2552630 - RNA, 19 nt, Chlamydophila pneumoniae J138
ucagugucuugaagagauu

SEQ ID NO: 2552631 - RNA, 15 nt, Chlamydophila pneumoniae J138
ucaguuaaagagcau

SEQ ID NO: 2552632 - RNA, 20 nt, Chlamydophila pneumoniae J138
ucaguuccucauccucauca

SEQ ID NO: 2552633 - RNA, 19 nt, Chlamydophila pneumoniae J138
ucaguuuuuucuucugaca

SEQ ID NO: 2552634 - RNA, 10 nt, Chlamydophila pneumoniae J138
ucauaaacaa

SEQ ID NO: 2552635 - RNA, 15 nt, Chlamydophila pneumoniae J138
ucauaaacagcagug

SEQ ID NO: 2552636 - RNA, 13 nt, Chlamydophila pneumoniae J138
ucauaaagaggaa

SEQ ID NO: 2552637 - RNA, 19 nt, Chlamydophila pneumoniae J138
ucauaaaguauauugacaa

SEQ ID NO: 2552638 - RNA, 20 nt, Chlamydophila pneumoniae J138
ucauaaauacgugcuugaau

SEQ ID NO: 2552639 - RNA, 15 nt, Chlamydophila pneumoniae J138
ucauaaccaaaagaa

SEQ ID NO: 2552640 - RNA, 14 nt, Chlamydophila pneumoniae J138
ucauaaccugggca

SEQ ID NO: 2552641 - RNA, 12 nt, Chlamydophila pneumoniae J138
ucauaagaaauu

SEQ ID NO: 2552642 - RNA, 17 nt, Chlamydophila pneumoniae J138
ucauaagaguagacaag

SEQ ID NO: 2552643 - RNA, 18 nt, Chlamydophila pneumoniae J138
ucauaagcucuauuucug

SEQ ID NO: 2552644 - RNA, 21 nt, Chlamydophila pneumoniae J138
ucauaagcucuauuucugccu

SEQ ID NO: 2552645 - RNA, 23 nt, Chlamydophila pneumoniae J138
acuucaccuugaaguuuuuucuc

SEQ ID NO: 2552646 - RNA, 16 nt, Chlamydophila pneumoniae J138
acuucagcaagaaaau

SEQ ID NO: 2552647 - RNA, 15 nt, Chlamydophila pneumoniae J138
acuucagcuuugcuu

SEQ ID NO: 2552648 - RNA, 23 nt, Chlamydophila pneumoniae J138
acuucaggaaauaauuuguuuag

SEQ ID NO: 2552649 - RNA, 17 nt, Chlamydophila pneumoniae J138
acuucaguuguugcuuu

SEQ ID NO: 2552650 - RNA, 17 nt, Chlamydophila pneumoniae J138
acuucaucgacaguauu

SEQ ID NO: 2552651 - RNA, 17 nt, Chlamydophila pneumoniae J138
acuucccaucuuguucu

SEQ ID NO: 2552652 - RNA, 17 nt, Chlamydophila pneumoniae J138
acuuccccaaacaugga

SEQ ID NO: 2552653 - RNA, 19 nt, Chlamydophila pneumoniae J138
acuucccgaacagcggcaa

SEQ ID NO: 2552654 - RNA, 15 nt, Chlamydophila pneumoniae J138
acuucccucaugaag

SEQ ID NO: 2552655 - RNA, 22 nt, Chlamydophila pneumoniae J138
acuuccuacgacaugccuaaau

SEQ ID NO: 2552656 - RNA, 20 nt, Chlamydophila pneumoniae J138
acuuccuacggcaagaaucg

SEQ ID NO: 2552657 - RNA, 18 nt, Chlamydophila pneumoniae J138
acuuccucuucaauuucu

SEQ ID NO: 2552658 - RNA, 20 nt, Chlamydophila pneumoniae J138
acuucgacacgaacuuugac

SEQ ID NO: 2552659 - RNA, 16 nt, Chlamydophila pneumoniae J138
acuucgcaaauuuuuc

SEQ ID NO: 2552660 - RNA, 15 nt, Chlamydophila pneumoniae J138
acuucggaugagauc

SEQ ID NO: 2552661 - RNA, 23 nt, Chlamydophila pneumoniae J138
acuucguuagaaaccaugaugca

SEQ ID NO: 2552662 - RNA, 15 nt, Chlamydophila pneumoniae J138
acuucuaaaagcaag

SEQ ID NO: 2552663 - RNA, 14 nt, Chlamydophila pneumoniae J138
acuucuaacuguac

SEQ ID NO: 2552664 - RNA, 18 nt, Chlamydophila pneumoniae J138
acuucuaugauaucacca

SEQ ID NO: 2552665 - RNA, 14 nt, Chlamydophila pneumoniae J138
acuucucaaagaca

SEQ ID NO: 2552666 - RNA, 16 nt, Chlamydophila pneumoniae J138
acuucucaaagacaau

SEQ ID NO: 2552667 - RNA, 23 nt, Chlamydophila pneumoniae J138
acuucuccacagcuucuucguaa

SEQ ID NO: 2552668 - RNA, 19 nt, Chlamydophila pneumoniae J138
acuucugguccaaacccug

SEQ ID NO: 2552669 - RNA, 21 nt, Chlamydophila pneumoniae J138
acuucuguaguuuguucacuu

SEQ ID NO: 2552670 - RNA, 13 nt, Chlamydophila pneumoniae J138
acuucuucaagaa

SEQ ID NO: 2552671 - RNA, 15 nt, Chlamydophila pneumoniae J138
acuucuucaagaaau

SEQ ID NO: 2552672 - RNA, 23 nt, Chlamydophila pneumoniae J138
acuucuucucgguuuaaggcaau

SEQ ID NO: 2552673 - RNA, 22 nt, Chlamydophila pneumoniae J138
acuucuuguccuguuaagaugu

SEQ ID NO: 2552674 - RNA, 21 nt, Chlamydophila pneumoniae J138
acuucuugugauccuugcaaa

SEQ ID NO: 2552675 - RNA, 15 nt, Chlamydophila pneumoniae J138
acuucuuucuugcuc

SEQ ID NO: 2552676 - RNA, 22 nt, Chlamydophila pneumoniae J138
acuucuuugccguauagauuuu

SEQ ID NO: 2552677 - RNA, 18 nt, Chlamydophila pneumoniae J138
acuugcaagcuucuuguu

SEQ ID NO: 2552678 - RNA, 19 nt, Chlamydophila pneumoniae J138
acuugcauggauccuucau

SEQ ID NO: 2552679 - RNA, 17 nt, Chlamydophila pneumoniae J138
acuugcauuuuuuggaa

SEQ ID NO: 2552680 - RNA, 17 nt, Chlamydophila pneumoniae J138
acuugcgauacaauaaa

SEQ ID NO: 2552681 - RNA, 17 nt, Chlamydophila pneumoniae J138
acuugcucuuuaauaag

SEQ ID NO: 2552682 - RNA, 14 nt, Chlamydophila pneumoniae J138
acuugcuuauccaa

SEQ ID NO: 2552683 - RNA, 21 nt, Chlamydophila pneumoniae J138
acuugcuuuuuugaaagcugg

SEQ ID NO: 2552684 - RNA, 13 nt, Chlamydophila pneumoniae J138
acuugggaugcua

SEQ ID NO: 2552685 - RNA, 16 nt, Chlamydophila pneumoniae J138
acuuggucauuauagu

SEQ ID NO: 2552686 - RNA, 14 nt, Chlamydophila pneumoniae J138
acuuuaacgaagaa

SEQ ID NO: 2552687 - RNA, 12 nt, Chlamydophila pneumoniae J138
acuuuaagaagc

SEQ ID NO: 2552688 - RNA, 22 nt, Chlamydophila pneumoniae J138
acuuuaagaagcacuucuuuag

SEQ ID NO: 2552689 - RNA, 21 nt, Chlamydophila pneumoniae J138
acuuuaaucaagccuaaaucu

SEQ ID NO: 2552690 - RNA, 22 nt, Chlamydophila pneumoniae J138
acuuuaaucaagccuaaaucua

SEQ ID NO: 2552691 - RNA, 22 nt, Chlamydophila pneumoniae J138
acuuuagaaauuccaauuuuug

SEQ ID NO: 2552692 - RNA, 23 nt, Chlamydophila pneumoniae J138
acuuuagaaauuccaauuuuugc

SEQ ID NO: 2552693 - RNA, 22 nt, Chlamydophila pneumoniae J138
acuuuaggcccugacuuagagu

SEQ ID NO: 2552694 - RNA, 14 nt, Chlamydophila pneumoniae J138
acuuuauucucuuc

SEQ ID NO: 2552695 - RNA, 20 nt, Chlamydophila pneumoniae J138
acuuuauucucuucacuauu

SEQ ID NO: 2552696 - RNA, 18 nt, Chlamydophila pneumoniae J138
acuuucccuucuaaggaa

SEQ ID NO: 2552697 - RNA, 17 nt, Chlamydophila pneumoniae J138
acuuuccguagccuuac

SEQ ID NO: 2552698 - RNA, 12 nt, Chlamydophila pneumoniae J138
acuuuccucucu

SEQ ID NO: 2552699 - RNA, 15 nt, Chlamydophila pneumoniae J138
acuuuccucucuuua

SEQ ID NO: 2552700 - RNA, 21 nt, Chlamydophila pneumoniae J138
acuuucugagccccuugcaaa

SEQ ID NO: 2552701 - RNA, 14 nt, Chlamydophila pneumoniae J138
acuuucuucucuag

SEQ ID NO: 2552702 - RNA, 22 nt, Chlamydophila pneumoniae J138
acuuucuucucuaggaagauuu

SEQ ID NO: 2552703 - RNA, 16 nt, Chlamydophila pneumoniae J138
acuuugaccagaugau

SEQ ID NO: 2552704 - RNA, 21 nt, Chlamydophila pneumoniae J138
acuuugaccagaugauuuuuu

SEQ ID NO: 2552705 - RNA, 22 nt, Chlamydophila pneumoniae J138
acuuugaggcaagucucaaagg

SEQ ID NO: 2552706 - RNA, 18 nt, Chlamydophila pneumoniae J138
acuuugauuguauagcuu

SEQ ID NO: 2552707 - RNA, 24 nt, Chlamydophila pneumoniae J138
acuuugauuguauagcuuacuuag

SEQ ID NO: 2552708 - RNA, 17 nt, Chlamydophila pneumoniae J138
acuuugcaauacaccaa

SEQ ID NO: 2552709 - RNA, 15 nt, Chlamydophila pneumoniae J138
acuuugccauuucua

SEQ ID NO: 2552710 - RNA, 18 nt, Chlamydophila pneumoniae J138
acuuuggucuucuguaau

SEQ ID NO: 2552711 - RNA, 22 nt, Chlamydophila pneumoniae J138
acuuuguuaauagaagaucauu

SEQ ID NO: 2552712 - RNA, 13 nt, Chlamydophila pneumoniae J138
acuuuguuuuuca

SEQ ID NO: 2552713 - RNA, 21 nt, Chlamydophila pneumoniae J138
acuuuuaauauuugagaagau

SEQ ID NO: 2552714 - RNA, 17 nt, Chlamydophila pneumoniae J138
acuuuuaauccuuucac

SEQ ID NO: 2552715 - RNA, 16 nt, Chlamydophila pneumoniae J138
acuuuuacugaaauua

SEQ ID NO: 2552716 - RNA, 20 nt, Chlamydophila pneumoniae J138
acuuuucucuuuaauccagu

SEQ ID NO: 2552717 - RNA, 22 nt, Chlamydophila pneumoniae J138
acuuuuguacacagagaugcuu

SEQ ID NO: 2552718 - RNA, 18 nt, Chlamydophila pneumoniae J138
acuuuuguugcaauucca

SEQ ID NO: 2552719 - RNA, 14 nt, Chlamydophila pneumoniae J138
acuuuuuuguuaau

SEQ ID NO: 2552720 - RNA, 14 nt, Chlamydophila pneumoniae J138
acuuuuuuucaaau

SEQ ID NO: 2552721 - RNA, 13 nt, Chlamydophila pneumoniae J138
agaaaaagaacau

SEQ ID NO: 2552722 - RNA, 21 nt, Chlamydophila pneumoniae J138
agaaaaauucuucgagagcau

SEQ ID NO: 2552723 - RNA, 22 nt, Chlamydophila pneumoniae J138
agaaaaauucuucgagagcaug

SEQ ID NO: 2552724 - RNA, 21 nt, Chlamydophila pneumoniae J138
agaaaaauucuuuagggaggc

SEQ ID NO: 2552725 - RNA, 14 nt, Chlamydophila pneumoniae J138
agaaaacauagaga

SEQ ID NO: 2552726 - RNA, 18 nt, Chlamydophila pneumoniae J138
agaaaacgccaacuguau

SEQ ID NO: 2552727 - RNA, 14 nt, Chlamydophila pneumoniae J138
agaaaagaaaagug

SEQ ID NO: 2552728 - RNA, 14 nt, Chlamydophila pneumoniae J138
agaaaagaaagaag

SEQ ID NO: 2552729 - RNA, 15 nt, Chlamydophila pneumoniae J138
agaaaagaacagggg

SEQ ID NO: 2552730 - RNA, 13 nt, Chlamydophila pneumoniae J138
agaaaauaagaag

SEQ ID NO: 2552731 - RNA, 20 nt, Chlamydophila pneumoniae J138
agaaaauaguacgcuuuuua

SEQ ID NO: 2552732 - RNA, 20 nt, Chlamydophila pneumoniae J138
agaaaauaucacauuccaau

SEQ ID NO: 2552733 - RNA, 14 nt, Chlamydophila pneumoniae J138
agaaaauaucaccu

SEQ ID NO: 2552734 - RNA, 23 nt, Chlamydophila pneumoniae J138
agaaaaucaacucuccauccuca

SEQ ID NO: 2552735 - RNA, 18 nt, Chlamydophila pneumoniae J138
agaaaaucugcagcagau

SEQ ID NO: 2552736 - RNA, 12 nt, Chlamydophila pneumoniae J138
agaaacaacuug

SEQ ID NO: 2552737 - RNA, 13 nt, Chlamydophila pneumoniae J138
agaaacacugaac

SEQ ID NO: 2552738 - RNA, 17 nt, Chlamydophila pneumoniae J138
agaaacccgcaacucuu

SEQ ID NO: 2552739 - RNA, 19 nt, Chlamydophila pneumoniae J138
agaaacccgcaacucuuua

SEQ ID NO: 2552740 - RNA, 23 nt, Chlamydophila pneumoniae J138
agaaacuagggagaucuuauaga

SEQ ID NO: 2552741 - RNA, 14 nt, Chlamydophila pneumoniae J138
agaaacuccaaaau

SEQ ID NO: 2552742 - RNA, 16 nt, Chlamydophila pneumoniae J138
agaaacuccaaaauau

SEQ ID NO: 2552743 - RNA, 17 nt, Chlamydophila pneumoniae J138
agaaacuccaaaauauu

SEQ ID NO: 2552744 - RNA, 12 nt, Chlamydophila pneumoniae J138
agaaacugcucc

SEQ ID NO: 2552745 - RNA, 14 nt, Chlamydophila pneumoniae J138
agaaacugcuccug

SEQ ID NO: 2552746 - RNA, 21 nt, Chlamydophila pneumoniae J138
agaaacugcuccugaagcuga

SEQ ID NO: 2552747 - RNA, 17 nt, Chlamydophila pneumoniae J138
agaaacuuaguuuugaa

SEQ ID NO: 2552748 - RNA, 22 nt, Chlamydophila pneumoniae J138
agaaacuuaguuuugaaaagau

SEQ ID NO: 2552749 - RNA, 23 nt, Chlamydophila pneumoniae J138
agaaacuuaguuuugaaaagauu

SEQ ID NO: 2552750 - RNA, 14 nt, Chlamydophila pneumoniae J138
agaaacuucugacc

SEQ ID NO: 2552751 - RNA, 13 nt, Chlamydophila pneumoniae J138
agaaacuuuaaaa

SEQ ID NO: 2552752 - RNA, 17 nt, Chlamydophila pneumoniae J138
agaaagaagccuuccuu

SEQ ID NO: 2552753 - RNA, 20 nt, Chlamydophila pneumoniae J138
agaaagaaugacacagagaa

SEQ ID NO: 2552754 - RNA, 18 nt, Chlamydophila pneumoniae J138
agaaagacaaaaaaucug

SEQ ID NO: 2552755 - RNA, 22 nt, Chlamydophila pneumoniae J138
agaaagagucucacucuuuucu

SEQ ID NO: 2552756 - RNA, 13 nt, Chlamydophila pneumoniae J138
agaaagauauccc

SEQ ID NO: 2552757 - RNA, 15 nt, Chlamydophila pneumoniae J138
agaaaguagagacau

SEQ ID NO: 2552758 - RNA, 18 nt, Chlamydophila pneumoniae J138
agaaauacgcuuuucuuc

SEQ ID NO: 2552759 - RNA, 19 nt, Chlamydophila pneumoniae J138
agaaauaggucucuugcca

SEQ ID NO: 2552760 - RNA, 14 nt, Chlamydophila pneumoniae J138
agaaauauaacucu

SEQ ID NO: 2552761 - RNA, 17 nt, Chlamydophila pneumoniae J138
agaaauauaacucucua

SEQ ID NO: 2552762 - RNA, 18 nt, Chlamydophila pneumoniae J138
agaaauauacucuugcuu

SEQ ID NO: 2552763 - RNA, 22 nt, Chlamydophila pneumoniae J138
agaaauauacucuugcuugcua

SEQ ID NO: 2552764 - RNA, 15 nt, Chlamydophila pneumoniae J138
agaaaucaaacauua

SEQ ID NO: 2552765 - RNA, 14 nt, Chlamydophila pneumoniae J138
agaaaucacacuua

SEQ ID NO: 2552766 - RNA, 15 nt, Chlamydophila pneumoniae J138
agaaaucaguccuaa

SEQ ID NO: 2552767 - RNA, 16 nt, Chlamydophila pneumoniae J138
agaaaucgacagggga

SEQ ID NO: 2552768 - RNA, 21 nt, Chlamydophila pneumoniae J138
agaaaucuacucuuuaaaaau

SEQ ID NO: 2552769 - RNA, 17 nt, Chlamydophila pneumoniae J138
agaaaucugcauuccag

SEQ ID NO: 2552770 - RNA, 20 nt, Chlamydophila pneumoniae J138
agaaaucuuuugauuaggcu

SEQ ID NO: 2552771 - RNA, 21 nt, Chlamydophila pneumoniae J138
agaaaugcaaaccaaaaaagu

SEQ ID NO: 2552772 - RNA, 21 nt, Chlamydophila pneumoniae J138
agaaaugcucuucugcagcgu

SEQ ID NO: 2552773 - RNA, 17 nt, Chlamydophila pneumoniae J138
agaaauguaagaaggca

SEQ ID NO: 2552774 - RNA, 20 nt, Chlamydophila pneumoniae J138
agaaauuccaauuuuugcau

SEQ ID NO: 2552775 - RNA, 13 nt, Chlamydophila pneumoniae J138
agaaauucuaaga

SEQ ID NO: 2552776 - RNA, 21 nt, Chlamydophila pneumoniae J138
agaaauucuaagcgcucuuca

SEQ ID NO: 2552777 - RNA, 13 nt, Chlamydophila pneumoniae J138
agaaauucugacu

SEQ ID NO: 2552778 - RNA, 13 nt, Chlamydophila pneumoniae J138
agaaauucuuccc

SEQ ID NO: 2552779 - RNA, 13 nt, Chlamydophila pneumoniae J138
agaacaacgcugc

SEQ ID NO: 2552780 - RNA, 21 nt, Chlamydophila pneumoniae J138
agaacaacgcugcuucucuac

SEQ ID NO: 2552781 - RNA, 11 nt, Chlamydophila pneumoniae J138
agaacaagaag

SEQ ID NO: 2552782 - RNA, 18 nt, Chlamydophila pneumoniae J138
agaacaagaaguaggaaa

SEQ ID NO: 2552783 - RNA, 22 nt, Chlamydophila pneumoniae J138
agaacaaggcuccguugaauua

SEQ ID NO: 2552784 - RNA, 16 nt, Chlamydophila pneumoniae J138
agaacaauaucagcag

SEQ ID NO: 2552785 - RNA, 18 nt, Chlamydophila pneumoniae J138
agaacaauaucagcagcu

SEQ ID NO: 2552786 - RNA, 17 nt, Chlamydophila pneumoniae J138
agaacacucagagaugu

SEQ ID NO: 2552787 - RNA, 18 nt, Chlamydophila pneumoniae J138
agaacagaggaucuagaa

SEQ ID NO: 2552788 - RNA, 22 nt, Chlamydophila pneumoniae J138
agaacagaggaucuagaaaaug

SEQ ID NO: 2552789 - RNA, 22 nt, Chlamydophila pneumoniae J138
agaacagcacucucugcaggga

SEQ ID NO: 2552790 - RNA, 16 nt, Chlamydophila pneumoniae J138
agaacauaaccucggu

SEQ ID NO: 2552791 - RNA, 20 nt, Chlamydophila pneumoniae J138
agaacaucuucccaccccug

SEQ ID NO: 2552792 - RNA, 20 nt, Chlamydophila pneumoniae J138
agaacauguuucuaagcuga

SEQ ID NO: 2552793 - RNA, 12 nt, Chlamydophila pneumoniae J138
agaaccuccacc

SEQ ID NO: 2552794 - RNA, 16 nt, Chlamydophila pneumoniae J138
agaaccuguuuuucua

SEQ ID NO: 2552795 - RNA, 17 nt, Chlamydophila pneumoniae J138
agaaccuguuuuucuaa

SEQ ID NO: 2552796 - RNA, 20 nt, Chlamydophila pneumoniae J138
agaaccuucacaagaaaaca

SEQ ID NO: 2552797 - RNA, 19 nt, Chlamydophila pneumoniae J138
agaacgaacaguucauguu

SEQ ID NO: 2552798 - RNA, 12 nt, Chlamydophila pneumoniae J138
agaacgaauuuc

SEQ ID NO: 2552799 - RNA, 19 nt, Chlamydophila pneumoniae J138
agaacgaauuucaacagcu

SEQ ID NO: 2552800 - RNA, 20 nt, Chlamydophila pneumoniae J138
agaacguauacgucccacaa

SEQ ID NO: 2552801 - RNA, 18 nt, Chlamydophila pneumoniae J138
agaacgucuaaagacgaa

SEQ ID NO: 2552802 - RNA, 18 nt, Chlamydophila pneumoniae J138
agaacguggggaaauuaa

SEQ ID NO: 2552803 - RNA, 15 nt, Chlamydophila pneumoniae J138
agaacuacucucauu

SEQ ID NO: 2552804 - RNA, 17 nt, Chlamydophila pneumoniae J138
agaacucaacuuuuuua

SEQ ID NO: 2552805 - RNA, 16 nt, Chlamydophila pneumoniae J138
agaacuccauucagau

SEQ ID NO: 2552806 - RNA, 14 nt, Chlamydophila pneumoniae J138
agaacuccuuugag

SEQ ID NO: 2552807 - RNA, 15 nt, Chlamydophila pneumoniae J138
agaacuccuuugagu

SEQ ID NO: 2552808 - RNA, 20 nt, Chlamydophila pneumoniae J138
agaacucuauuuggcucgcu

SEQ ID NO: 2552809 - RNA, 18 nt, Chlamydophila pneumoniae J138
agaacucuuaaagguaaa

SEQ ID NO: 2552810 - RNA, 19 nt, Chlamydophila pneumoniae J138
agaacugcuuggucacacc

SEQ ID NO: 2552811 - RNA, 14 nt, Chlamydophila pneumoniae J138
agaacuuagcaaug

SEQ ID NO: 2552812 - RNA, 12 nt, Chlamydophila pneumoniae J138
agaacuucaaca

SEQ ID NO: 2552813 - RNA, 16 nt, Chlamydophila pneumoniae J138
agaacuuccugauucu

SEQ ID NO: 2552814 - RNA, 13 nt, Chlamydophila pneumoniae J138
agaacuucuccaa

SEQ ID NO: 2552815 - RNA, 15 nt, Chlamydophila pneumoniae J138
agaacuuuagggaag

SEQ ID NO: 2552816 - RNA, 16 nt, Chlamydophila pneumoniae J138
agaacuuuagggaaga

SEQ ID NO: 2552817 - RNA, 20 nt, Chlamydophila pneumoniae J138
agaacuuucgucuuugcuuu

SEQ ID NO: 2552818 - RNA, 24 nt, Chlamydophila pneumoniae J138
agaacuuucgucuuugcuuucuag

SEQ ID NO: 2552819 - RNA, 17 nt, Chlamydophila pneumoniae J138
agaagaaauuagaggga

SEQ ID NO: 2552820 - RNA, 16 nt, Chlamydophila pneumoniae J138
agaagaagcaaaagau

SEQ ID NO: 2552821 - RNA, 18 nt, Chlamydophila pneumoniae J138
agaagacuagcuuuucau

SEQ ID NO: 2552822 - RNA, 19 nt, Chlamydophila pneumoniae J138
agaagacucccaaggaaau

SEQ ID NO: 2552823 - RNA, 14 nt, Chlamydophila pneumoniae J138
agaagagaaaagau

SEQ ID NO: 2552824 - RNA, 15 nt, Chlamydophila pneumoniae J138
agaagagaaaagaua

SEQ ID NO: 2552825 - RNA, 14 nt, Chlamydophila pneumoniae J138
agaagagucauuau

SEQ ID NO: 2552826 - RNA, 19 nt, Chlamydophila pneumoniae J138
agaagaugauuggacaagu

SEQ ID NO: 2552827 - RNA, 17 nt, Chlamydophila pneumoniae J138
agaagcaacuaaacucu

SEQ ID NO: 2552828 - RNA, 14 nt, Chlamydophila pneumoniae J138
agaagcaagaauca

SEQ ID NO: 2552829 - RNA, 22 nt, Chlamydophila pneumoniae J138
agaagcacuucuuuaggagcau

SEQ ID NO: 2552830 - RNA, 21 nt, Chlamydophila pneumoniae J138
agaagcaugaagcagaaacuu

SEQ ID NO: 2552831 - RNA, 14 nt, Chlamydophila pneumoniae J138
agaagcauugagga

SEQ ID NO: 2552832 - RNA, 13 nt, Chlamydophila pneumoniae J138
agaagccaccaaa

SEQ ID NO: 2552833 - RNA, 15 nt, Chlamydophila pneumoniae J138
agaagccaccaaaaa

SEQ ID NO: 2552834 - RNA, 16 nt, Chlamydophila pneumoniae J138
agaagcggaagcaccg

SEQ ID NO: 2552835 - RNA, 19 nt, Chlamydophila pneumoniae J138
agaagcucacucuuuaaaa

SEQ ID NO: 2552836 - RNA, 20 nt, Chlamydophila pneumoniae J138
agaagcucacucuuuaaaaa

SEQ ID NO: 2552837 - RNA, 22 nt, Chlamydophila pneumoniae J138
agaagcuccugaguauccgaau

SEQ ID NO: 2552838 - RNA, 22 nt, Chlamydophila pneumoniae J138
agaagcugacaaauagaaagga

SEQ ID NO: 2552839 - RNA, 15 nt, Chlamydophila pneumoniae J138
agaagcuucaaugau

SEQ ID NO: 2552840 - RNA, 16 nt, Chlamydophila pneumoniae J138
agaaggaggaguccuu

SEQ ID NO: 2552841 - RNA, 11 nt, Chlamydophila pneumoniae J138
agaaggaucug

SEQ ID NO: 2552842 - RNA, 15 nt, Chlamydophila pneumoniae J138
agaaggcaucccgaa

SEQ ID NO: 2552843 - RNA, 16 nt, Chlamydophila pneumoniae J138
agaaggccaguuacug

SEQ ID NO: 2552844 - RNA, 23 nt, Chlamydophila pneumoniae J138
agaagguccaugucuaaagauug

SEQ ID NO: 2552845 - RNA, 16 nt, Chlamydophila pneumoniae J138
agaagguuuauuagaa

SEQ ID NO: 2552846 - RNA, 20 nt, Chlamydophila pneumoniae J138
agaagguuuauuagaaguau

SEQ ID NO: 2552847 - RNA, 19 nt, Chlamydophila pneumoniae J138
agaaguaauccuaauuccu

SEQ ID NO: 2552848 - RNA, 18 nt, Chlamydophila pneumoniae J138
agaaguagggucccuuga

SEQ ID NO: 2552849 - RNA, 20 nt, Chlamydophila pneumoniae J138
agaaguauucgauuccugag

SEQ ID NO: 2552850 - RNA, 22 nt, Chlamydophila pneumoniae J138
agaaguauucgauuccugaggc

SEQ ID NO: 2552851 - RNA, 14 nt, Chlamydophila pneumoniae J138
agaagucacaaauu

SEQ ID NO: 2552852 - RNA, 22 nt, Chlamydophila pneumoniae J138
agaaguccuaucaaagcaaaag

SEQ ID NO: 2552853 - RNA, 19 nt, Chlamydophila pneumoniae J138
agaagugaucuugagaaaa

SEQ ID NO: 2552854 - RNA, 15 nt, Chlamydophila pneumoniae J138
agaaguggccuugcc

SEQ ID NO: 2552855 - RNA, 23 nt, Chlamydophila pneumoniae J138
agaaguguauuuaaauucuggaa

SEQ ID NO: 2552856 - RNA, 17 nt, Chlamydophila pneumoniae J138
agaaguuuacaaauaaa

SEQ ID NO: 2552857 - RNA, 20 nt, Chlamydophila pneumoniae J138
agaaguuugauaagcuaaca

SEQ ID NO: 2552858 - RNA, 15 nt, Chlamydophila pneumoniae J138
agaauaaaauggccu

SEQ ID NO: 2552859 - RNA, 12 nt, Chlamydophila pneumoniae J138
agaauaaagauu

SEQ ID NO: 2552860 - RNA, 15 nt, Chlamydophila pneumoniae J138
agaauacaaacaaga

SEQ ID NO: 2552861 - RNA, 20 nt, Chlamydophila pneumoniae J138
agaauacaacccuuuauacu

SEQ ID NO: 2552862 - RNA, 23 nt, Chlamydophila pneumoniae J138
agaauaccguuuuaggaagguca

SEQ ID NO: 2552863 - RNA, 21 nt, Chlamydophila pneumoniae J138
agaauacucauauuuugucuu

SEQ ID NO: 2552864 - RNA, 17 nt, Chlamydophila pneumoniae J138
agaauacucuagguuuu

SEQ ID NO: 2552865 - RNA, 16 nt, Chlamydophila pneumoniae J138
agaauagcaggaagga

SEQ ID NO: 2552866 - RNA, 18 nt, Chlamydophila pneumoniae J138
agaauagccauaauuaga

SEQ ID NO: 2552867 - RNA, 24 nt, Chlamydophila pneumoniae J138
agaauagccauaauuagaacagca

SEQ ID NO: 2552868 - RNA, 19 nt, Chlamydophila pneumoniae J138
agaauaggaacaaagcucu

SEQ ID NO: 2552869 - RNA, 21 nt, Chlamydophila pneumoniae J138
agaauagggguagugaucugc

SEQ ID NO: 2552870 - RNA, 13 nt, Chlamydophila pneumoniae J138
agaauauagacuu

SEQ ID NO: 2552871 - RNA, 13 nt, Chlamydophila pneumoniae J138
agaauaucaucuu

SEQ ID NO: 2552872 - RNA, 14 nt, Chlamydophila pneumoniae J138
agaauaucaucuuc

SEQ ID NO: 2552873 - RNA, 21 nt, Chlamydophila pneumoniae J138
agaauauggccuagcuuucuu

SEQ ID NO: 2552874 - RNA, 13 nt, Chlamydophila pneumoniae J138
agaaucauaacaa

SEQ ID NO: 2552875 - RNA, 15 nt, Chlamydophila pneumoniae J138
agaaucaucugguau

SEQ ID NO: 2552876 - RNA, 18 nt, Chlamydophila pneumoniae J138
agaaucauugagaugaaa

SEQ ID NO: 2552877 - RNA, 16 nt, Chlamydophila pneumoniae J138
agaauccauuuugccc

SEQ ID NO: 2552878 - RNA, 23 nt, Chlamydophila pneumoniae J138
agaauccauuuugcccacuucua

SEQ ID NO: 2552879 - RNA, 19 nt, Chlamydophila pneumoniae J138
agaauccucuauccaucau

SEQ ID NO: 2552880 - RNA, 21 nt, Chlamydophila pneumoniae J138
agaauccucuauccaucaucg

SEQ ID NO: 2552881 - RNA, 20 nt, Chlamydophila pneumoniae J138
agaauccugaguaaaaucau

SEQ ID NO: 2552882 - RNA, 21 nt, Chlamydophila pneumoniae J138
agaauccugaguaaaaucaua

SEQ ID NO: 2552883 - RNA, 22 nt, Chlamydophila pneumoniae J138
agaauccugaguaaaaucauag

SEQ ID NO: 2552884 - RNA, 12 nt, Chlamydophila pneumoniae J138
agaauccuuuuu

SEQ ID NO: 2552885 - RNA, 18 nt, Chlamydophila pneumoniae J138
agaauccuuuuuaggaaa

SEQ ID NO: 2552886 - RNA, 15 nt, Chlamydophila pneumoniae J138
agaaucuaaguaaaa

SEQ ID NO: 2552887 - RNA, 16 nt, Chlamydophila pneumoniae J138
agaaucuauagaacua

SEQ ID NO: 2552888 - RNA, 17 nt, Chlamydophila pneumoniae J138
agaaucuccauuuagaa

SEQ ID NO: 2552889 - RNA, 20 nt, Chlamydophila pneumoniae J138
agaaucucugaccaucaaug

SEQ ID NO: 2552890 - RNA, 12 nt, Chlamydophila pneumoniae J138
agaaucucugcc

SEQ ID NO: 2552891 - RNA, 12 nt, Chlamydophila pneumoniae J138
agaaucuuuucu

SEQ ID NO: 2552892 - RNA, 14 nt, Chlamydophila pneumoniae J138
agaaucuuuucuag

SEQ ID NO: 2552893 - RNA, 17 nt, Chlamydophila pneumoniae J138
agaaucuuuucuagaaa

SEQ ID NO: 2552894 - RNA, 19 nt, Chlamydophila pneumoniae J138
agaaucuuuucuagaaaac

SEQ ID NO: 2552895 - RNA, 17 nt, Chlamydophila pneumoniae J138
agaaugaacaauagaaa

SEQ ID NO: 2552896 - RNA, 16 nt, Chlamydophila pneumoniae J138
agaaugacacagagaa

SEQ ID NO: 2552897 - RNA, 20 nt, Chlamydophila pneumoniae J138
agaaugacacagagaacaau

SEQ ID NO: 2552898 - RNA, 23 nt, Chlamydophila pneumoniae J138
agaaugacacagagaacaauaaa

SEQ ID NO: 2552899 - RNA, 11 nt, Chlamydophila pneumoniae J138
agaaugaugca

SEQ ID NO: 2552900 - RNA, 15 nt, Chlamydophila pneumoniae J138
agaaugcccuguucu

SEQ ID NO: 2552901 - RNA, 18 nt, Chlamydophila pneumoniae J138
agaaugcccuuuagggaa

SEQ ID NO: 2552902 - RNA, 13 nt, Chlamydophila pneumoniae J138
agaauucagagaa

SEQ ID NO: 2552903 - RNA, 15 nt, Chlamydophila pneumoniae J138
agaauugcaaaguac

SEQ ID NO: 2552904 - RNA, 13 nt, Chlamydophila pneumoniae J138
agaauuucuucuu

SEQ ID NO: 2552905 - RNA, 15 nt, Chlamydophila pneumoniae J138
agaauuuguccuuug

SEQ ID NO: 2552906 - RNA, 14 nt, Chlamydophila pneumoniae J138
agaauuuucaugau

SEQ ID NO: 2552907 - RNA, 14 nt, Chlamydophila pneumoniae J138
agaauuuucugcga

SEQ ID NO: 2552908 - RNA, 22 nt, Chlamydophila pneumoniae J138
agacaaagaauccccccuucua

SEQ ID NO: 2552909 - RNA, 13 nt, Chlamydophila pneumoniae J138
agacaaagccaca

SEQ ID NO: 2552910 - RNA, 16 nt, Chlamydophila pneumoniae J138
agacaaagccacagcc

SEQ ID NO: 2552911 - RNA, 19 nt, Chlamydophila pneumoniae J138
agacaacgcaggaagaaca

SEQ ID NO: 2552912 - RNA, 14 nt, Chlamydophila pneumoniae J138
agacaauaaaaaag

SEQ ID NO: 2552913 - RNA, 20 nt, Chlamydophila pneumoniae J138
agacaauaccagauaaagca

SEQ ID NO: 2552914 - RNA, 22 nt, Chlamydophila pneumoniae J138
agacaaugcaaccuguaaagac

SEQ ID NO: 2552915 - RNA, 22 nt, Chlamydophila pneumoniae J138
agacacaggggaacgcucucua

SEQ ID NO: 2552916 - RNA, 15 nt, Chlamydophila pneumoniae J138
agacaccgaaagaaa

SEQ ID NO: 2552917 - RNA, 20 nt, Chlamydophila pneumoniae J138
agacacuugcuuaaggaaac

SEQ ID NO: 2552918 - RNA, 22 nt, Chlamydophila pneumoniae J138
agacaggagcuacugaaagaug

SEQ ID NO: 2552919 - RNA, 17 nt, Chlamydophila pneumoniae J138
agacauucauuuuuuaa

SEQ ID NO: 2552920 - RNA, 21 nt, Chlamydophila pneumoniae J138
agacauuucuugauccaucug

SEQ ID NO: 2552921 - RNA, 16 nt, Chlamydophila pneumoniae J138
agaccaaacuuucuuu

SEQ ID NO: 2552922 - RNA, 21 nt, Chlamydophila pneumoniae J138
agaccaaacuuucuuuucuau

SEQ ID NO: 2552923 - RNA, 21 nt, Chlamydophila pneumoniae J138
agaccaaaucaucgcaaucaa

SEQ ID NO: 2552924 - RNA, 15 nt, Chlamydophila pneumoniae J138
agaccaauaaaucca

SEQ ID NO: 2552925 - RNA, 20 nt, Chlamydophila pneumoniae J138
agaccaauaaauccaaaaaa

SEQ ID NO: 2552926 - RNA, 19 nt, Chlamydophila pneumoniae J138
agaccaauugguggagcuc

SEQ ID NO: 2552927 - RNA, 22 nt, Chlamydophila pneumoniae J138
agaccacgaaauguuaaaggaa

SEQ ID NO: 2552928 - RNA, 14 nt, Chlamydophila pneumoniae J138
agaccauaaaauca

SEQ ID NO: 2552929 - RNA, 19 nt, Chlamydophila pneumoniae J138
agaccauaaaaucaacaag

SEQ ID NO: 2552930 - RNA, 15 nt, Chlamydophila pneumoniae J138
agaccauacacaaau

SEQ ID NO: 2552931 - RNA, 18 nt, Chlamydophila pneumoniae J138
agacccaacaguucuuuc

SEQ ID NO: 2552932 - RNA, 13 nt, Chlamydophila pneumoniae J138
agacccuucuuuc

SEQ ID NO: 2552933 - RNA, 21 nt, Chlamydophila pneumoniae J138
agaccgagaagcuucaaugau

SEQ ID NO: 2552934 - RNA, 22 nt, Chlamydophila pneumoniae J138
agaccggaucccguaaaagaac

SEQ ID NO: 2552935 - RNA, 23 nt, Chlamydophila pneumoniae J138
agaccggaucccguaaaagaacg

SEQ ID NO: 2552936 - RNA, 17 nt, Chlamydophila pneumoniae J138
agaccguccuccccaua

SEQ ID NO: 2552937 - RNA, 18 nt, Chlamydophila pneumoniae J138
agaccuaacgcaacaucc

SEQ ID NO: 2552938 - RNA, 21 nt, Chlamydophila pneumoniae J138
agaccuaacgcaacauccauu

SEQ ID NO: 2552939 - RNA, 15 nt, Chlamydophila pneumoniae J138
agaccugccaagaua

SEQ ID NO: 2552940 - RNA, 13 nt, Chlamydophila pneumoniae J138
agaccuucugacg

SEQ ID NO: 2552941 - RNA, 14 nt, Chlamydophila pneumoniae J138
agacgaaagagauu

SEQ ID NO: 2552942 - RNA, 16 nt, Chlamydophila pneumoniae J138
agacgaccuuuaagau

SEQ ID NO: 2552943 - RNA, 16 nt, Chlamydophila pneumoniae J138
agacgaggagaagucg

SEQ ID NO: 2552944 - RNA, 22 nt, Chlamydophila pneumoniae J138
agacgcuuuuaucuguuaaaaa

SEQ ID NO: 2552945 - RNA, 13 nt, Chlamydophila pneumoniae J138
agacguaaccaca

SEQ ID NO: 2552946 - RNA, 21 nt, Chlamydophila pneumoniae J138
agacgugcucucuacuucugu

SEQ ID NO: 2552947 - RNA, 23 nt, Chlamydophila pneumoniae J138
agacgugcucucuacuucuguag

SEQ ID NO: 2552948 - RNA, 21 nt, Chlamydophila pneumoniae J138
agacguucgacaacaacauaa

SEQ ID NO: 2552949 - RNA, 15 nt, Chlamydophila pneumoniae J138
agacuaaaagaauaa

SEQ ID NO: 2552950 - RNA, 21 nt, Chlamydophila pneumoniae J138
agacuaaaugacgaguugaag

SEQ ID NO: 2552951 - RNA, 17 nt, Chlamydophila pneumoniae J138
agacuagcuuuuuuuau

SEQ ID NO: 2552952 - RNA, 13 nt, Chlamydophila pneumoniae J138
agacucagagaaa

SEQ ID NO: 2552953 - RNA, 21 nt, Chlamydophila pneumoniae J138
agacucaucuuugaacaacuc

SEQ ID NO: 2552954 - RNA, 22 nt, Chlamydophila pneumoniae J138
agacucccaaggaaauuaugga

SEQ ID NO: 2552955 - RNA, 19 nt, Chlamydophila pneumoniae J138
agacucuaguuuuucuuua

SEQ ID NO: 2552956 - RNA, 16 nt, Chlamydophila pneumoniae J138
agacugcaaaggaagg

SEQ ID NO: 2552957 - RNA, 18 nt, Chlamydophila pneumoniae J138
agacugcaaaggaaggga

SEQ ID NO: 2552958 - RNA, 21 nt, Chlamydophila pneumoniae J138
agacuuaaaguacguccugau

SEQ ID NO: 2552959 - RNA, 17 nt, Chlamydophila pneumoniae J138
agacuuugccauuucua

SEQ ID NO: 2552960 - RNA, 18 nt, Chlamydophila pneumoniae J138
agacuuugccauuucuau

SEQ ID NO: 2552961 - RNA, 17 nt, Chlamydophila pneumoniae J138
agagaaauuaacagagc

SEQ ID NO: 2552962 - RNA, 14 nt, Chlamydophila pneumoniae J138
agagaacaggaggu

SEQ ID NO: 2552963 - RNA, 14 nt, Chlamydophila pneumoniae J138
agagaacuccauuc

SEQ ID NO: 2552964 - RNA, 17 nt, Chlamydophila pneumoniae J138
agagaacuccauucaga

SEQ ID NO: 2552965 - RNA, 22 nt, Chlamydophila pneumoniae J138
agagaacucuuaaagguaaagc

SEQ ID NO: 2552966 - RNA, 20 nt, Chlamydophila pneumoniae J138
agagaacuuuaacgaagaag

SEQ ID NO: 2552967 - RNA, 15 nt, Chlamydophila pneumoniae J138
agagaagaagcaaaa

SEQ ID NO: 2552968 - RNA, 17 nt, Chlamydophila pneumoniae J138
agagaagacaggagcua

SEQ ID NO: 2552969 - RNA, 20 nt, Chlamydophila pneumoniae J138
agagaagagguguccauaau

SEQ ID NO: 2552970 - RNA, 22 nt, Chlamydophila pneumoniae J138
agagaauacucuagguuuucuc

SEQ ID NO: 2552971 - RNA, 22 nt, Chlamydophila pneumoniae J138
agagaauccguuagaacucgaa

SEQ ID NO: 2552972 - RNA, 21 nt, Chlamydophila pneumoniae J138
agagaauccuuuuuaggaaag

SEQ ID NO: 2552973 - RNA, 22 nt, Chlamydophila pneumoniae J138
agagaauccuuuuuaggaaagg

SEQ ID NO: 2552974 - RNA, 18 nt, Chlamydophila pneumoniae J138
agagaaucgagaacaguu

SEQ ID NO: 2552975 - RNA, 18 nt, Chlamydophila pneumoniae J138
agagaaucuccucaucag

SEQ ID NO: 2552976 - RNA, 13 nt, Chlamydophila pneumoniae J138
agagaaugcccug

SEQ ID NO: 2552977 - RNA, 15 nt, Chlamydophila pneumoniae J138
agagaauguucccaa

SEQ ID NO: 2552978 - RNA, 21 nt, Chlamydophila pneumoniae J138
agagaauuugauauccagggu

SEQ ID NO: 2552979 - RNA, 13 nt, Chlamydophila pneumoniae J138
agagacaagaaaa

SEQ ID NO: 2552980 - RNA, 20 nt, Chlamydophila pneumoniae J138
agagacaucguauauaagau

SEQ ID NO: 2552981 - RNA, 20 nt, Chlamydophila pneumoniae J138
agagacccaacaguucuuuc

SEQ ID NO: 2552982 - RNA, 15 nt, Chlamydophila pneumoniae J138
agagaccuucucuuc

SEQ ID NO: 2552983 - RNA, 18 nt, Chlamydophila pneumoniae J138
agagaccuucucuucaga

SEQ ID NO: 2552984 - RNA, 16 nt, Chlamydophila pneumoniae J138
agagacuguagccuuu

SEQ ID NO: 2552985 - RNA, 13 nt, Chlamydophila pneumoniae J138
agagagaacagga

SEQ ID NO: 2552986 - RNA, 15 nt, Chlamydophila pneumoniae J138
agagagccuuuccua

SEQ ID NO: 2552987 - RNA, 15 nt, Chlamydophila pneumoniae J138
agagaggguaagcug

SEQ ID NO: 2552988 - RNA, 17 nt, Chlamydophila pneumoniae J138
agagagucggcuuuaga

SEQ ID NO: 2552989 - RNA, 20 nt, Chlamydophila pneumoniae J138
agagagugcguacucuucuu

SEQ ID NO: 2552990 - RNA, 17 nt, Chlamydophila pneumoniae J138
agagaguucucucuuca

SEQ ID NO: 2552991 - RNA, 23 nt, Chlamydophila pneumoniae J138
agagaguucuuguaauaaaagaa

SEQ ID NO: 2552992 - RNA, 14 nt, Chlamydophila pneumoniae J138
agagaucacaggga

SEQ ID NO: 2552993 - RNA, 22 nt, Chlamydophila pneumoniae J138
agagaugcaaauccuguagaaa

SEQ ID NO: 2552994 - RNA, 15 nt, Chlamydophila pneumoniae J138
agagaugcuaacaac

SEQ ID NO: 2552995 - RNA, 21 nt, Chlamydophila pneumoniae J138
agagauugccaggagagcuaa

SEQ ID NO: 2552996 - RNA, 18 nt, Chlamydophila pneumoniae J138
agagauuguaauuuccuu

SEQ ID NO: 2552997 - RNA, 22 nt, Chlamydophila pneumoniae J138
agagauuuuccauaggaacaaa

SEQ ID NO: 2552998 - RNA, 14 nt, Chlamydophila pneumoniae J138
agagauuuuucuag

SEQ ID NO: 2552999 - RNA, 19 nt, Chlamydophila pneumoniae J138
agagauuuuucuaggaauc

SEQ ID NO: 2553000 - RNA, 16 nt, Chlamydophila pneumoniae J138
agagauuuuuucauac

SEQ ID NO: 2553001 - RNA, 17 nt, Chlamydophila pneumoniae J138
agagcaauuaagaaacu

SEQ ID NO: 2553002 - RNA, 14 nt, Chlamydophila pneumoniae J138
agagcacauagaaa

SEQ ID NO: 2553003 - RNA, 22 nt, Chlamydophila pneumoniae J138
agagcacuuuuaauauuugaga

SEQ ID NO: 2553004 - RNA, 13 nt, Chlamydophila pneumoniae J138
agagcagaccucu

SEQ ID NO: 2553005 - RNA, 23 nt, Chlamydophila pneumoniae J138
agagcagcuuccugcuccucuuc

SEQ ID NO: 2553006 - RNA, 19 nt, Chlamydophila pneumoniae J138
agagcccuugugcaucuau

SEQ ID NO: 2553007 - RNA, 15 nt, Chlamydophila pneumoniae J138
agagccggaacuuca

SEQ ID NO: 2553008 - RNA, 15 nt, Chlamydophila pneumoniae J138
agagccucuaagaaa

SEQ ID NO: 2553009 - RNA, 15 nt, Chlamydophila pneumoniae J138
agagccuuuucagau

SEQ ID NO: 2553010 - RNA, 18 nt, Chlamydophila pneumoniae J138
agagccuuuucagauuuu

SEQ ID NO: 2553011 - RNA, 22 nt, Chlamydophila pneumoniae J138
agagccuuuucagauuuuuuaa

SEQ ID NO: 2553012 - RNA, 16 nt, Chlamydophila pneumoniae J138
agagcgcguuucaaau

SEQ ID NO: 2553013 - RNA, 17 nt, Chlamydophila pneumoniae J138
agagcgcguuucaaaua

SEQ ID NO: 2553014 - RNA, 21 nt, Chlamydophila pneumoniae J138
agagcuaaagaaacuucugac

SEQ ID NO: 2553015 - RNA, 12 nt, Chlamydophila pneumoniae J138
agagcuagaaug

SEQ ID NO: 2553016 - RNA, 13 nt, Chlamydophila pneumoniae J138
agagcuaugauga

SEQ ID NO: 2553017 - RNA, 15 nt, Chlamydophila pneumoniae J138
agagcuaugaugaga

SEQ ID NO: 2553018 - RNA, 18 nt, Chlamydophila pneumoniae J138
agagcugauccagcucca

SEQ ID NO: 2553019 - RNA, 20 nt, Chlamydophila pneumoniae J138
agagcuuccauuggaauccu

SEQ ID NO: 2553020 - RNA, 19 nt, Chlamydophila pneumoniae J138
agagcuugguuuucuccuu

SEQ ID NO: 2553021 - RNA, 21 nt, Chlamydophila pneumoniae J138
agagcuugguuuucuccuucu

SEQ ID NO: 2553022 - RNA, 20 nt, Chlamydophila pneumoniae J138
agagcuugucacacugcgag

SEQ ID NO: 2553023 - RNA, 14 nt, Chlamydophila pneumoniae J138
agagcuuucagaaa

SEQ ID NO: 2553024 - RNA, 19 nt, Chlamydophila pneumoniae J138
agagcuuuuagguagagaa

SEQ ID NO: 2553025 - RNA, 18 nt, Chlamydophila pneumoniae J138
agaggaagcacaccaagu

SEQ ID NO: 2553026 - RNA, 13 nt, Chlamydophila pneumoniae J138
agaggaaugaaga

SEQ ID NO: 2553027 - RNA, 14 nt, Chlamydophila pneumoniae J138
agaggagccuccau

SEQ ID NO: 2553028 - RNA, 16 nt, Chlamydophila pneumoniae J138
agaggaucuagaaaau

SEQ ID NO: 2553029 - RNA, 13 nt, Chlamydophila pneumoniae J138
agaggcaauugag

SEQ ID NO: 2553030 - RNA, 23 nt, Chlamydophila pneumoniae J138
agaggcagguagucccuuucuau

SEQ ID NO: 2553031 - RNA, 20 nt, Chlamydophila pneumoniae J138
agagggaucauguagcagag

SEQ ID NO: 2553032 - RNA, 21 nt, Chlamydophila pneumoniae J138
agagggaucauguagcagagc

SEQ ID NO: 2553033 - RNA, 16 nt, Chlamydophila pneumoniae J138
agagggauuuguagga

SEQ ID NO: 2553034 - RNA, 20 nt, Chlamydophila pneumoniae J138
agaggguuuuuuugcugcga

SEQ ID NO: 2553035 - RNA, 17 nt, Chlamydophila pneumoniae J138
agaggucuuugaguagc

SEQ ID NO: 2553036 - RNA, 14 nt, Chlamydophila pneumoniae J138
agagguucccucaa

SEQ ID NO: 2553037 - RNA, 22 nt, Chlamydophila pneumoniae J138
agagguucuugcuuauugucuu

SEQ ID NO: 2553038 - RNA, 17 nt, Chlamydophila pneumoniae J138
agaguagacaagagaga

SEQ ID NO: 2553039 - RNA, 17 nt, Chlamydophila pneumoniae J138
agagucaaacuuauaca

SEQ ID NO: 2553040 - RNA, 14 nt, Chlamydophila pneumoniae J138
agagucacuagcag

SEQ ID NO: 2553041 - RNA, 16 nt, Chlamydophila pneumoniae J138
agaguccuucuuuucc

SEQ ID NO: 2553042 - RNA, 15 nt, Chlamydophila pneumoniae J138
agaguccuuuuuguu

SEQ ID NO: 2553043 - RNA, 20 nt, Chlamydophila pneumoniae J138
agagucucacucuuuucuag

SEQ ID NO: 2553044 - RNA, 23 nt, Chlamydophila pneumoniae J138
agagucucacucuuuucuagaaa

SEQ ID NO: 2553045 - RNA, 14 nt, Chlamydophila pneumoniae J138
agagucugcagcag

SEQ ID NO: 2553046 - RNA, 23 nt, Chlamydophila pneumoniae J138
agagucuugcagacggggaucua

SEQ ID NO: 2553047 - RNA, 20 nt, Chlamydophila pneumoniae J138
agauuauuuguuucuuccau

SEQ ID NO: 2553048 - RNA, 17 nt, Chlamydophila pneumoniae J138
agauucaagcaaugccu

SEQ ID NO: 2553049 - RNA, 15 nt, Chlamydophila pneumoniae J138
agauucauaaaacug

SEQ ID NO: 2553050 - RNA, 16 nt, Chlamydophila pneumoniae J138
agauucauaaaacugu

SEQ ID NO: 2553051 - RNA, 21 nt, Chlamydophila pneumoniae J138
agauucaugaaaugcuuucag

SEQ ID NO: 2553052 - RNA, 15 nt, Chlamydophila pneumoniae J138
agauucauuaauguu

SEQ ID NO: 2553053 - RNA, 20 nt, Chlamydophila pneumoniae J138
agauucuaaaucaacuacac

SEQ ID NO: 2553054 - RNA, 14 nt, Chlamydophila pneumoniae J138
agauucugaagaga

SEQ ID NO: 2553055 - RNA, 21 nt, Chlamydophila pneumoniae J138
agauucugcccaaagcuaaaa

SEQ ID NO: 2553056 - RNA, 15 nt, Chlamydophila pneumoniae J138
agauugaaucccauc

SEQ ID NO: 2553057 - RNA, 17 nt, Chlamydophila pneumoniae J138
agauugaggauaaguuc

SEQ ID NO: 2553058 - RNA, 22 nt, Chlamydophila pneumoniae J138
agauugaggauaaguucuucca

SEQ ID NO: 2553059 - RNA, 23 nt, Chlamydophila pneumoniae J138
agauugaugcugacagcuccauu

SEQ ID NO: 2553060 - RNA, 23 nt, Chlamydophila pneumoniae J138
agauugcacuugcgguuuuggau

SEQ ID NO: 2553061 - RNA, 21 nt, Chlamydophila pneumoniae J138
agauugcagguagauccuaua

SEQ ID NO: 2553062 - RNA, 19 nt, Chlamydophila pneumoniae J138
agauugccaggagagcuaa

SEQ ID NO: 2553063 - RNA, 17 nt, Chlamydophila pneumoniae J138
agauugguaaggagagu

SEQ ID NO: 2553064 - RNA, 16 nt, Chlamydophila pneumoniae J138
agauuguaauuuccuu

SEQ ID NO: 2553065 - RNA, 16 nt, Chlamydophila pneumoniae J138
agauuguuagugagau

SEQ ID NO: 2553066 - RNA, 18 nt, Chlamydophila pneumoniae J138
agauuguucaaaaauaga

SEQ ID NO: 2553067 - RNA, 23 nt, Chlamydophila pneumoniae J138
agauuguucaaaaauagauaaga

SEQ ID NO: 2553068 - RNA, 13 nt, Chlamydophila pneumoniae J138
agauuuagggaag

SEQ ID NO: 2553069 - RNA, 16 nt, Chlamydophila pneumoniae J138
agauuuaguucaccac

SEQ ID NO: 2553070 - RNA, 20 nt, Chlamydophila pneumoniae J138
agauuuccuuaagcuucuga

SEQ ID NO: 2553071 - RNA, 14 nt, Chlamydophila pneumoniae J138
agauuucuaauccu

SEQ ID NO: 2553072 - RNA, 17 nt, Chlamydophila pneumoniae J138
agauuucuaauccucca

SEQ ID NO: 2553073 - RNA, 19 nt, Chlamydophila pneumoniae J138
agauuucuaauccuccaaa

SEQ ID NO: 2553074 - RNA, 13 nt, Chlamydophila pneumoniae J138
agauuucuuguug

SEQ ID NO: 2553075 - RNA, 16 nt, Chlamydophila pneumoniae J138
agauuuguuagagcuu

SEQ ID NO: 2553076 - RNA, 22 nt, Chlamydophila pneumoniae J138
agauuuuaaagccuccucaaga

SEQ ID NO: 2553077 - RNA, 18 nt, Chlamydophila pneumoniae J138
agauuuuaagaccuucug

SEQ ID NO: 2553078 - RNA, 22 nt, Chlamydophila pneumoniae J138
agauuuuaggggguuuuucuau

SEQ ID NO: 2553079 - RNA, 19 nt, Chlamydophila pneumoniae J138
agauuuugagaaugaacaa

SEQ ID NO: 2553080 - RNA, 23 nt, Chlamydophila pneumoniae J138
agauuuuguaggaacaugccaaa

SEQ ID NO: 2553081 - RNA, 14 nt, Chlamydophila pneumoniae J138
agauuuuuagaaua

SEQ ID NO: 2553082 - RNA, 21 nt, Chlamydophila pneumoniae J138
agauuuuucaagaacuccuuu

SEQ ID NO: 2553083 - RNA, 21 nt, Chlamydophila pneumoniae J138
agauuuuucuuuuagagaaau

SEQ ID NO: 2553084 - RNA, 22 nt, Chlamydophila pneumoniae J138
agauuuuuuaaccucuuuucuu

SEQ ID NO: 2553085 - RNA, 14 nt, Chlamydophila pneumoniae J138
agauuuuuucuugg

SEQ ID NO: 2553086 - RNA, 15 nt, Chlamydophila pneumoniae J138
agcaaaaauucuagg

SEQ ID NO: 2553087 - RNA, 17 nt, Chlamydophila pneumoniae J138
agcaaaaauuguuuuug

SEQ ID NO: 2553088 - RNA, 23 nt, Chlamydophila pneumoniae J138
agcaaaacuguguucaauagcaa

SEQ ID NO: 2553089 - RNA, 17 nt, Chlamydophila pneumoniae J138
agcaaacaucaaagaga

SEQ ID NO: 2553090 - RNA, 15 nt, Chlamydophila pneumoniae J138
agcaaacggagagca

SEQ ID NO: 2553091 - RNA, 19 nt, Chlamydophila pneumoniae J138
agcaaagaaaauucucaga

SEQ ID NO: 2553092 - RNA, 21 nt, Chlamydophila pneumoniae J138
agcaaagaaaauucucagauu

SEQ ID NO: 2553093 - RNA, 21 nt, Chlamydophila pneumoniae J138
agcaaagaacacccccgcagc

SEQ ID NO: 2553094 - RNA, 16 nt, Chlamydophila pneumoniae J138
agcaaagagcaaggaa

SEQ ID NO: 2553095 - RNA, 15 nt, Chlamydophila pneumoniae J138
agcaaagauaaagaa

SEQ ID NO: 2553096 - RNA, 16 nt, Chlamydophila pneumoniae J138
agcaaagauaaagaag

SEQ ID NO: 2553097 - RNA, 19 nt, Chlamydophila pneumoniae J138
agcaaaucuaaaaccugac

SEQ ID NO: 2553098 - RNA, 18 nt, Chlamydophila pneumoniae J138
agcaacaucguuaauaua

SEQ ID NO: 2553099 - RNA, 22 nt, Chlamydophila pneumoniae J138
agcaacaucguuaauauaauug

SEQ ID NO: 2553100 - RNA, 14 nt, Chlamydophila pneumoniae J138
agcaaccuuuccua

SEQ ID NO: 2553101 - RNA, 19 nt, Chlamydophila pneumoniae J138
agcaaccuuuccuaaaaua

SEQ ID NO: 2553102 - RNA, 19 nt, Chlamydophila pneumoniae J138
agcaacgcaugacgcuuuu

SEQ ID NO: 2553103 - RNA, 14 nt, Chlamydophila pneumoniae J138
agcaacuaaacucu

SEQ ID NO: 2553104 - RNA, 14 nt, Chlamydophila pneumoniae J138
agcaacuaaagcau

SEQ ID NO: 2553105 - RNA, 14 nt, Chlamydophila pneumoniae J138
agcaagaacauaac

SEQ ID NO: 2553106 - RNA, 17 nt, Chlamydophila pneumoniae J138
agcaagaauuucuucua

SEQ ID NO: 2553107 - RNA, 18 nt, Chlamydophila pneumoniae J138
agcaagagcuauaccuau

SEQ ID NO: 2553108 - RNA, 13 nt, Chlamydophila pneumoniae J138
agcaagagcucuu

SEQ ID NO: 2553109 - RNA, 19 nt, Chlamydophila pneumoniae J138
agcaagagcucuugagaaa

SEQ ID NO: 2553110 - RNA, 17 nt, Chlamydophila pneumoniae J138
agcaagauuuuguagga

SEQ ID NO: 2553111 - RNA, 19 nt, Chlamydophila pneumoniae J138
agcaaggggaguuuucuua

SEQ ID NO: 2553112 - RNA, 18 nt, Chlamydophila pneumoniae J138
agcaagguaacauccaua

SEQ ID NO: 2553113 - RNA, 23 nt, Chlamydophila pneumoniae J138
agcaagguaacauccauagagaa

SEQ ID NO: 2553114 - RNA, 23 nt, Chlamydophila pneumoniae J138
agcaaguuguugauaauuacaga

SEQ ID NO: 2553115 - RNA, 13 nt, Chlamydophila pneumoniae J138
agcaauaucugug

SEQ ID NO: 2553116 - RNA, 22 nt, Chlamydophila pneumoniae J138
agcaauccauaguccuagcaga

SEQ ID NO: 2553117 - RNA, 19 nt, Chlamydophila pneumoniae J138
agcaaucccccagcauuca

SEQ ID NO: 2553118 - RNA, 16 nt, Chlamydophila pneumoniae J138
agcaaugauguuuuuu

SEQ ID NO: 2553119 - RNA, 19 nt, Chlamydophila pneumoniae J138
agcaauggcuuuuuuuguc

SEQ ID NO: 2553120 - RNA, 18 nt, Chlamydophila pneumoniae J138
agcaauuaccugcccuug

SEQ ID NO: 2553121 - RNA, 22 nt, Chlamydophila pneumoniae J138
agcacauacaguacgcaaagua

SEQ ID NO: 2553122 - RNA, 19 nt, Chlamydophila pneumoniae J138
agcaccacgaccuacacca

SEQ ID NO: 2553123 - RNA, 14 nt, Chlamydophila pneumoniae J138
agcaccauaaugga

SEQ ID NO: 2553124 - RNA, 21 nt, Chlamydophila pneumoniae J138
agcaccuaauaaagaagguug

SEQ ID NO: 2553125 - RNA, 19 nt, Chlamydophila pneumoniae J138
agcacgagcgggagaauca

SEQ ID NO: 2553126 - RNA, 17 nt, Chlamydophila pneumoniae J138
agcacgcacuaaucuau

SEQ ID NO: 2553127 - RNA, 23 nt, Chlamydophila pneumoniae J138
agcacuaaaagggaagcuuccau

SEQ ID NO: 2553128 - RNA, 19 nt, Chlamydophila pneumoniae J138
agcacucuuaauuaaaaac

SEQ ID NO: 2553129 - RNA, 18 nt, Chlamydophila pneumoniae J138
agcacucuuuuucuaaga

SEQ ID NO: 2553130 - RNA, 12 nt, Chlamydophila pneumoniae J138
agcacugaugaa

SEQ ID NO: 2553131 - RNA, 13 nt, Chlamydophila pneumoniae J138
agcacuuaaaaaa

SEQ ID NO: 2553132 - RNA, 22 nt, Chlamydophila pneumoniae J138
agcacuuaaaaaacuuccuaac

SEQ ID NO: 2553133 - RNA, 15 nt, Chlamydophila pneumoniae J138
agcacuucuuuagga

SEQ ID NO: 2553134 - RNA, 17 nt, Chlamydophila pneumoniae J138
agcacuucuuuaggagc

SEQ ID NO: 2553135 - RNA, 15 nt, Chlamydophila pneumoniae J138
agcagaaacuccaaa

SEQ ID NO: 2553136 - RNA, 18 nt, Chlamydophila pneumoniae J138
agcagaaacuccaaaaua

SEQ ID NO: 2553137 - RNA, 21 nt, Chlamydophila pneumoniae J138
agcagaaguccuaucaaagca

SEQ ID NO: 2553138 - RNA, 18 nt, Chlamydophila pneumoniae J138
agcagaccucucccuugg

SEQ ID NO: 2553139 - RNA, 23 nt, Chlamydophila pneumoniae J138
agcagaccucucccuugggauuc

SEQ ID NO: 2553140 - RNA, 21 nt, Chlamydophila pneumoniae J138
agcagauccugcuucuauaga

SEQ ID NO: 2553141 - RNA, 23 nt, Chlamydophila pneumoniae J138
agcagauccugcuucuauagaga

SEQ ID NO: 2553142 - RNA, 18 nt, Chlamydophila pneumoniae J138
agcagcaaauacuccagg

SEQ ID NO: 2553143 - RNA, 13 nt, Chlamydophila pneumoniae J138
agcagcaagaaca

SEQ ID NO: 2553144 - RNA, 13 nt, Chlamydophila pneumoniae J138
agcagcagaauca

SEQ ID NO: 2553145 - RNA, 15 nt, Chlamydophila pneumoniae J138
agcagccucuucucu

SEQ ID NO: 2553146 - RNA, 22 nt, Chlamydophila pneumoniae J138
agcagcugucaauccaacaaag

SEQ ID NO: 2553147 - RNA, 17 nt, Chlamydophila pneumoniae J138
agcagcuucgcaaucuu

SEQ ID NO: 2553148 - RNA, 15 nt, Chlamydophila pneumoniae J138
agcaggaaaagcaaa

SEQ ID NO: 2553149 - RNA, 18 nt, Chlamydophila pneumoniae J138
agcaggaaaagcaaaaug

SEQ ID NO: 2553150 - RNA, 20 nt, Chlamydophila pneumoniae J138
agcaggaauaaucaaccaaa

SEQ ID NO: 2553151 - RNA, 13 nt, Chlamydophila pneumoniae J138
agcaggagcauca

SEQ ID NO: 2553152 - RNA, 22 nt, Chlamydophila pneumoniae J138
agcaggauaaccaucaaucacu

SEQ ID NO: 2553153 - RNA, 12 nt, Chlamydophila pneumoniae J138
agcauaaaaauu

SEQ ID NO: 2553154 - RNA, 13 nt, Chlamydophila pneumoniae J138
agcauaacuugaa

SEQ ID NO: 2553155 - RNA, 17 nt, Chlamydophila pneumoniae J138
agcauaacuugaagaag

SEQ ID NO: 2553156 - RNA, 21 nt, Chlamydophila pneumoniae J138
agcauaacuugaagaaguaca

SEQ ID NO: 2553157 - RNA, 18 nt, Chlamydophila pneumoniae J138
agcauaaggggagucuug

SEQ ID NO: 2553158 - RNA, 20 nt, Chlamydophila pneumoniae J138
agcauaaguuagccuggcua

SEQ ID NO: 2553159 - RNA, 20 nt, Chlamydophila pneumoniae J138
agcauagacucuuccuucua

SEQ ID NO: 2553160 - RNA, 13 nt, Chlamydophila pneumoniae J138
agcauagagagaa

SEQ ID NO: 2553161 - RNA, 14 nt, Chlamydophila pneumoniae J138
agcauagagagaag

SEQ ID NO: 2553162 - RNA, 23 nt, Chlamydophila pneumoniae J138
agcauagcccgaaauucauuaaa

SEQ ID NO: 2553163 - RNA, 23 nt, Chlamydophila pneumoniae J138
agcaucacggaguguuugaagau

SEQ ID NO: 2553164 - RNA, 19 nt, Chlamydophila pneumoniae J138
agcaucaggauucucucug

SEQ ID NO: 2553165 - RNA, 22 nt, Chlamydophila pneumoniae J138
agcauccaaaaugucuuuuuca

SEQ ID NO: 2553166 - RNA, 23 nt, Chlamydophila pneumoniae J138
agcauccugaacggcucuuucua

SEQ ID NO: 2553167 - RNA, 19 nt, Chlamydophila pneumoniae J138
agcaucgcuuaacaaacuu

SEQ ID NO: 2553168 - RNA, 15 nt, Chlamydophila pneumoniae J138
agcaucguauuuucc

SEQ ID NO: 2553169 - RNA, 13 nt, Chlamydophila pneumoniae J138
agcaucucaagag

SEQ ID NO: 2553170 - RNA, 21 nt, Chlamydophila pneumoniae J138
agcaucugagucauaagcucu

SEQ ID NO: 2553171 - RNA, 23 nt, Chlamydophila pneumoniae J138
agcaucugagucauaagcucuau

SEQ ID NO: 2553172 - RNA, 12 nt, Chlamydophila pneumoniae J138
agcaucuucucg

SEQ ID NO: 2553173 - RNA, 17 nt, Chlamydophila pneumoniae J138
agcaucuuucaucaaug

SEQ ID NO: 2553174 - RNA, 16 nt, Chlamydophila pneumoniae J138
agcaugcuaagcauca

SEQ ID NO: 2553175 - RNA, 21 nt, Chlamydophila pneumoniae J138
agcaugcuaagcaucagaauc

SEQ ID NO: 2553176 - RNA, 19 nt, Chlamydophila pneumoniae J138
agcauggacuccaagaaua

SEQ ID NO: 2553177 - RNA, 15 nt, Chlamydophila pneumoniae J138
agcauggagaauaau

SEQ ID NO: 2553178 - RNA, 20 nt, Chlamydophila pneumoniae J138
agcauggagaauaaucucuu

SEQ ID NO: 2553179 - RNA, 23 nt, Chlamydophila pneumoniae J138
agcauggagaauaaucucuuuca

SEQ ID NO: 2553180 - RNA, 14 nt, Chlamydophila pneumoniae J138
agcaugugcagaag

SEQ ID NO: 2553181 - RNA, 15 nt, Chlamydophila pneumoniae J138
agcaugugcagaagg

SEQ ID NO: 2553182 - RNA, 18 nt, Chlamydophila pneumoniae J138
agcauguucgauuuucuc

SEQ ID NO: 2553183 - RNA, 20 nt, Chlamydophila pneumoniae J138
agcauguucgauuuucucuu

SEQ ID NO: 2553184 - RNA, 13 nt, Chlamydophila pneumoniae J138
agcauuaggaaag

SEQ ID NO: 2553185 - RNA, 17 nt, Chlamydophila pneumoniae J138
agcauucugcuagagcu

SEQ ID NO: 2553186 - RNA, 18 nt, Chlamydophila pneumoniae J138
agcauucugcuagagcuu

SEQ ID NO: 2553187 - RNA, 18 nt, Chlamydophila pneumoniae J138
agcauuggacaacgcuuc

SEQ ID NO: 2553188 - RNA, 16 nt, Chlamydophila pneumoniae J138
agcauuguuuguccua

SEQ ID NO: 2553189 - RNA, 16 nt, Chlamydophila pneumoniae J138
agcauuucuuucucuu

SEQ ID NO: 2553190 - RNA, 16 nt, Chlamydophila pneumoniae J138
agcauuuucucugagc

SEQ ID NO: 2553191 - RNA, 21 nt, Chlamydophila pneumoniae J138
agcauuuucucugagcagcuu

SEQ ID NO: 2553192 - RNA, 17 nt, Chlamydophila pneumoniae J138
agccaaagucacucaaa

SEQ ID NO: 2553193 - RNA, 19 nt, Chlamydophila pneumoniae J138
agccaaauaccaaggcugc

SEQ ID NO: 2553194 - RNA, 15 nt, Chlamydophila pneumoniae J138
agccaagaaaacaua

SEQ ID NO: 2553195 - RNA, 13 nt, Chlamydophila pneumoniae J138
agccacagagaau

SEQ ID NO: 2553196 - RNA, 15 nt, Chlamydophila pneumoniae J138
agccacuaaguuuag

SEQ ID NO: 2553197 - RNA, 22 nt, Chlamydophila pneumoniae J138
agccagacuggucuaacuuaga

SEQ ID NO: 2553198 - RNA, 14 nt, Chlamydophila pneumoniae J138
agccaguacuaaau

SEQ ID NO: 2553199 - RNA, 20 nt, Chlamydophila pneumoniae J138
agccauaauuagaacagcau

SEQ ID NO: 2553200 - RNA, 21 nt, Chlamydophila pneumoniae J138
agccauaauuagaacagcaug

SEQ ID NO: 2553201 - RNA, 16 nt, Chlamydophila pneumoniae J138
agccaugacaaagggu

SEQ ID NO: 2553202 - RNA, 15 nt, Chlamydophila pneumoniae J138
agccauuuuccagga

SEQ ID NO: 2553203 - RNA, 15 nt, Chlamydophila pneumoniae J138
agccauuuucuaaga

SEQ ID NO: 2553204 - RNA, 13 nt, Chlamydophila pneumoniae J138
agcccauuccugc

SEQ ID NO: 2553205 - RNA, 12 nt, Chlamydophila pneumoniae J138
agccccacccac

SEQ ID NO: 2553206 - RNA, 13 nt, Chlamydophila pneumoniae J138
agccccagcaacc

SEQ ID NO: 2553207 - RNA, 23 nt, Chlamydophila pneumoniae J138
agcccuagaguaaagaguagccc

SEQ ID NO: 2553208 - RNA, 14 nt, Chlamydophila pneumoniae J138
agcccuagauagca

SEQ ID NO: 2553209 - RNA, 17 nt, Chlamydophila pneumoniae J138
agcccuagauagcaaau

SEQ ID NO: 2553210 - RNA, 16 nt, Chlamydophila pneumoniae J138
agcccucgguuauuuu

SEQ ID NO: 2553211 - RNA, 18 nt, Chlamydophila pneumoniae J138
agccgauguugcagaaug

SEQ ID NO: 2553212 - RNA, 21 nt, Chlamydophila pneumoniae J138
agccguaggguagccauccac

SEQ ID NO: 2553213 - RNA, 20 nt, Chlamydophila pneumoniae J138
agccguaggguauccugcuc

SEQ ID NO: 2553214 - RNA, 12 nt, Chlamydophila pneumoniae J138
agccuagcaaaa

SEQ ID NO: 2553215 - RNA, 22 nt, Chlamydophila pneumoniae J138
agccuagcaaaacuguguucaa

SEQ ID NO: 2553216 - RNA, 20 nt, Chlamydophila pneumoniae J138
agccuaugggaggaauuccu

SEQ ID NO: 2553217 - RNA, 12 nt, Chlamydophila pneumoniae J138
agccucacagaa

SEQ ID NO: 2553218 - RNA, 22 nt, Chlamydophila pneumoniae J138
agccucacagaauuguuuuguu

SEQ ID NO: 2553219 - RNA, 19 nt, Chlamydophila pneumoniae J138
agccucccgaagacaaugu

SEQ ID NO: 2553220 - RNA, 20 nt, Chlamydophila pneumoniae J138
agccucccgaagacaauguc

SEQ ID NO: 2553221 - RNA, 18 nt, Chlamydophila pneumoniae J138
agccucugugguuuuuau

SEQ ID NO: 2553222 - RNA, 14 nt, Chlamydophila pneumoniae J138
agccugcaccagac

SEQ ID NO: 2553223 - RNA, 14 nt, Chlamydophila pneumoniae J138
agccugcgacuaca

SEQ ID NO: 2553224 - RNA, 18 nt, Chlamydophila pneumoniae J138
agccugcgacuacaagau

SEQ ID NO: 2553225 - RNA, 14 nt, Chlamydophila pneumoniae J138
agccuggaaaugaa

SEQ ID NO: 2553226 - RNA, 16 nt, Chlamydophila pneumoniae J138
agccuggcuaaaggau

SEQ ID NO: 2553227 - RNA, 19 nt, Chlamydophila pneumoniae J138
agccugucuuaucuaaaga

SEQ ID NO: 2553228 - RNA, 21 nt, Chlamydophila pneumoniae J138
agccugucuuaucuaaagaaa

SEQ ID NO: 2553229 - RNA, 23 nt, Chlamydophila pneumoniae J138
agccuuacggccccuggaauuuc

SEQ ID NO: 2553230 - RNA, 13 nt, Chlamydophila pneumoniae J138
agccuucauucca

SEQ ID NO: 2553231 - RNA, 12 nt, Chlamydophila pneumoniae J138
agccuuccuugu

SEQ ID NO: 2553232 - RNA, 15 nt, Chlamydophila pneumoniae J138
agccuuggcucuaga

SEQ ID NO: 2553233 - RNA, 17 nt, Chlamydophila pneumoniae J138
agccuuggcucuagaaa

SEQ ID NO: 2553234 - RNA, 22 nt, Chlamydophila pneumoniae J138
agccuuucuuauuacagaaagg

SEQ ID NO: 2553235 - RNA, 13 nt, Chlamydophila pneumoniae J138
agccuuuucagau

SEQ ID NO: 2553236 - RNA, 19 nt, Chlamydophila pneumoniae J138
agccuuuucagauuuuuua

SEQ ID NO: 2553237 - RNA, 17 nt, Chlamydophila pneumoniae J138
agcgaaagucaaagggc

SEQ ID NO: 2553238 - RNA, 15 nt, Chlamydophila pneumoniae J138
agcgaaccaaaguca

SEQ ID NO: 2553239 - RNA, 20 nt, Chlamydophila pneumoniae J138
agcgaccugcaaaugaaggg

SEQ ID NO: 2553240 - RNA, 20 nt, Chlamydophila pneumoniae J138
agcgaucgcaaucagcaaca

SEQ ID NO: 2553241 - RNA, 21 nt, Chlamydophila pneumoniae J138
agcgaucgcaaucagcaacau

SEQ ID NO: 2553242 - RNA, 19 nt, Chlamydophila pneumoniae J138
agcgaucucucuuccugcu

SEQ ID NO: 2553243 - RNA, 22 nt, Chlamydophila pneumoniae J138
agcgaucucucuuccugcugcu

SEQ ID NO: 2553244 - RNA, 14 nt, Chlamydophila pneumoniae J138
agcgcccgaaucuu

SEQ ID NO: 2553245 - RNA, 15 nt, Chlamydophila pneumoniae J138
agcgcguuucaaaua

SEQ ID NO: 2553246 - RNA, 22 nt, Chlamydophila pneumoniae J138
agcgcuacuguauucuguaaga

SEQ ID NO: 2553247 - RNA, 23 nt, Chlamydophila pneumoniae J138
agcgcuagugcaagguucugcga

SEQ ID NO: 2553248 - RNA, 22 nt, Chlamydophila pneumoniae J138
agcuucuuguuuuuguggacaa

SEQ ID NO: 2553249 - RNA, 20 nt, Chlamydophila pneumoniae J138
agcuucuuuaucuagcucuu

SEQ ID NO: 2553250 - RNA, 15 nt, Chlamydophila pneumoniae J138
agcuucuuucuuacu

SEQ ID NO: 2553251 - RNA, 17 nt, Chlamydophila pneumoniae J138
agcuucuuuuccagcaa

SEQ ID NO: 2553252 - RNA, 22 nt, Chlamydophila pneumoniae J138
agcuugccagcagaaguuccuu

SEQ ID NO: 2553253 - RNA, 14 nt, Chlamydophila pneumoniae J138
agcuugcguuuccu

SEQ ID NO: 2553254 - RNA, 17 nt, Chlamydophila pneumoniae J138
agcuugcuguacgauag

SEQ ID NO: 2553255 - RNA, 21 nt, Chlamydophila pneumoniae J138
agcuuggggguggucuagaga

SEQ ID NO: 2553256 - RNA, 20 nt, Chlamydophila pneumoniae J138
agcuugguuuucuccuucuc

SEQ ID NO: 2553257 - RNA, 13 nt, Chlamydophila pneumoniae J138
agcuugucacacu

SEQ ID NO: 2553258 - RNA, 23 nt, Chlamydophila pneumoniae J138
agcuugucacacugcgagagaaa

SEQ ID NO: 2553259 - RNA, 19 nt, Chlamydophila pneumoniae J138
agcuuguucuguaacacuu

SEQ ID NO: 2553260 - RNA, 13 nt, Chlamydophila pneumoniae J138
agcuuguuuuugc

SEQ ID NO: 2553261 - RNA, 14 nt, Chlamydophila pneumoniae J138
agcuuuaagaagaa

SEQ ID NO: 2553262 - RNA, 16 nt, Chlamydophila pneumoniae J138
agcuuucagaaaagaa

SEQ ID NO: 2553263 - RNA, 23 nt, Chlamydophila pneumoniae J138
agcuuucguuuucuagcauagug

SEQ ID NO: 2553264 - RNA, 15 nt, Chlamydophila pneumoniae J138
agcuuucuuggagaa

SEQ ID NO: 2553265 - RNA, 21 nt, Chlamydophila pneumoniae J138
agcuuugucucuauagugcau

SEQ ID NO: 2553266 - RNA, 17 nt, Chlamydophila pneumoniae J138
agcuuuuaguuucccac

SEQ ID NO: 2553267 - RNA, 20 nt, Chlamydophila pneumoniae J138
agcuuuugcuacagcuucuu

SEQ ID NO: 2553268 - RNA, 12 nt, Chlamydophila pneumoniae J138
agcuuuuugcuu

SEQ ID NO: 2553269 - RNA, 24 nt, Chlamydophila pneumoniae J138
aggaaaauucaguauaagaugcug

SEQ ID NO: 2553270 - RNA, 15 nt, Chlamydophila pneumoniae J138
aggaaacagugguau

SEQ ID NO: 2553271 - RNA, 21 nt, Chlamydophila pneumoniae J138
aggaaacagugguaugcuuuu

SEQ ID NO: 2553272 - RNA, 15 nt, Chlamydophila pneumoniae J138
aggaaacguucuuuc

SEQ ID NO: 2553273 - RNA, 18 nt, Chlamydophila pneumoniae J138
aggaaaguucacaagcag

SEQ ID NO: 2553274 - RNA, 19 nt, Chlamydophila pneumoniae J138
aggaaaucacagagucugg

SEQ ID NO: 2553275 - RNA, 21 nt, Chlamydophila pneumoniae J138
aggaaaucccgagauaugaag

SEQ ID NO: 2553276 - RNA, 19 nt, Chlamydophila pneumoniae J138
aggaaauuacaaucucuag

SEQ ID NO: 2553277 - RNA, 11 nt, Chlamydophila pneumoniae J138
aggaaauuccg

SEQ ID NO: 2553278 - RNA, 14 nt, Chlamydophila pneumoniae J138
aggaacaugccaaa

SEQ ID NO: 2553279 - RNA, 17 nt, Chlamydophila pneumoniae J138
aggaacgcacgccaaga

SEQ ID NO: 2553280 - RNA, 19 nt, Chlamydophila pneumoniae J138
aggaacucuuuaaaagggc

SEQ ID NO: 2553281 - RNA, 17 nt, Chlamydophila pneumoniae J138
aggaacuugaauaccaa

SEQ ID NO: 2553282 - RNA, 15 nt, Chlamydophila pneumoniae J138
aggaagauaguauuu

SEQ ID NO: 2553283 - RNA, 19 nt, Chlamydophila pneumoniae J138
aggaagauauccuuuugaa

SEQ ID NO: 2553284 - RNA, 12 nt, Chlamydophila pneumoniae J138
aggaagcucuuc

SEQ ID NO: 2553285 - RNA, 16 nt, Chlamydophila pneumoniae J138
aggaagcucuucuacu

SEQ ID NO: 2553286 - RNA, 16 nt, Chlamydophila pneumoniae J138
aggaaggaaaucacag

SEQ ID NO: 2553287 - RNA, 19 nt, Chlamydophila pneumoniae J138
aggaaguaguggacuauag

SEQ ID NO: 2553288 - RNA, 17 nt, Chlamydophila pneumoniae J138
aggaauaaucaaccaaa

SEQ ID NO: 2553289 - RNA, 14 nt, Chlamydophila pneumoniae J138
aggaaucauaacca

SEQ ID NO: 2553290 - RNA, 14 nt, Chlamydophila pneumoniae J138
aggaaucccaaggg

SEQ ID NO: 2553291 - RNA, 19 nt, Chlamydophila pneumoniae J138
aggaaucccugcacucuuu

SEQ ID NO: 2553292 - RNA, 13 nt, Chlamydophila pneumoniae J138
aggaaucuaagaa

SEQ ID NO: 2553293 - RNA, 23 nt, Chlamydophila pneumoniae J138
aggaaucuugaugaccucuauac

SEQ ID NO: 2553294 - RNA, 14 nt, Chlamydophila pneumoniae J138
aggaaugagcggca

SEQ ID NO: 2553295 - RNA, 15 nt, Chlamydophila pneumoniae J138
aggaauuagagaaau

SEQ ID NO: 2553296 - RNA, 20 nt, Chlamydophila pneumoniae J138
aggaauuagagaaauuuuua

SEQ ID NO: 2553297 - RNA, 17 nt, Chlamydophila pneumoniae J138
aggaauucuuuaugaga

SEQ ID NO: 2553298 - RNA, 15 nt, Chlamydophila pneumoniae J138
aggaauuuucagccu

SEQ ID NO: 2553299 - RNA, 14 nt, Chlamydophila pneumoniae J138
aggaauuuuucuag

SEQ ID NO: 2553300 - RNA, 13 nt, Chlamydophila pneumoniae J138
aggacaaaucucc

SEQ ID NO: 2553301 - RNA, 15 nt, Chlamydophila pneumoniae J138
aggacagcacauaga

SEQ ID NO: 2553302 - RNA, 16 nt, Chlamydophila pneumoniae J138
aggacaguauucccuc

SEQ ID NO: 2553303 - RNA, 13 nt, Chlamydophila pneumoniae J138
aggaccaggugua

SEQ ID NO: 2553304 - RNA, 20 nt, Chlamydophila pneumoniae J138
aggaccagguguagguuccu

SEQ ID NO: 2553305 - RNA, 23 nt, Chlamydophila pneumoniae J138
aggaccagguguagguuccugcu

SEQ ID NO: 2553306 - RNA, 21 nt, Chlamydophila pneumoniae J138
aggaccgugguaucccugagc

SEQ ID NO: 2553307 - RNA, 16 nt, Chlamydophila pneumoniae J138
aggaccuaagggcucu

SEQ ID NO: 2553308 - RNA, 16 nt, Chlamydophila pneumoniae J138
aggaccuacugggaaa

SEQ ID NO: 2553309 - RNA, 15 nt, Chlamydophila pneumoniae J138
aggaccugugaguaa

SEQ ID NO: 2553310 - RNA, 18 nt, Chlamydophila pneumoniae J138
aggaccuguuuucuuuuc

SEQ ID NO: 2553311 - RNA, 19 nt, Chlamydophila pneumoniae J138
aggaccuuggacucuaggg

SEQ ID NO: 2553312 - RNA, 19 nt, Chlamydophila pneumoniae J138
aggacgcacauuuagaagu

SEQ ID NO: 2553313 - RNA, 21 nt, Chlamydophila pneumoniae J138
aggacguaacguagucaaaaa

SEQ ID NO: 2553314 - RNA, 17 nt, Chlamydophila pneumoniae J138
aggacuucgcaaauuuu

SEQ ID NO: 2553315 - RNA, 12 nt, Chlamydophila pneumoniae J138
aggagaacaaua

SEQ ID NO: 2553316 - RNA, 21 nt, Chlamydophila pneumoniae J138
aggagaacaauaucagcagcu

SEQ ID NO: 2553317 - RNA, 14 nt, Chlamydophila pneumoniae J138
aggagaagucgaaa

SEQ ID NO: 2553318 - RNA, 20 nt, Chlamydophila pneumoniae J138
aggagaccuuuauagauaug

SEQ ID NO: 2553319 - RNA, 16 nt, Chlamydophila pneumoniae J138
aggagacuaaaagaau

SEQ ID NO: 2553320 - RNA, 20 nt, Chlamydophila pneumoniae J138
aggagacuaaaagaauaaua

SEQ ID NO: 2553321 - RNA, 12 nt, Chlamydophila pneumoniae J138
aggagagcacuu

SEQ ID NO: 2553322 - RNA, 20 nt, Chlamydophila pneumoniae J138
aggagagcacuuuuaauauu

SEQ ID NO: 2553323 - RNA, 17 nt, Chlamydophila pneumoniae J138
aggagagcuagugguau

SEQ ID NO: 2553324 - RNA, 17 nt, Chlamydophila pneumoniae J138
aggagaguaaggucauu

SEQ ID NO: 2553325 - RNA, 16 nt, Chlamydophila pneumoniae J138
aggagauccacagacu

SEQ ID NO: 2553326 - RNA, 15 nt, Chlamydophila pneumoniae J138
aggagcauagacucu

SEQ ID NO: 2553327 - RNA, 15 nt, Chlamydophila pneumoniae J138
aggagcgauagcuca

SEQ ID NO: 2553328 - RNA, 13 nt, Chlamydophila pneumoniae J138
aggagcuaaagcu

SEQ ID NO: 2553329 - RNA, 17 nt, Chlamydophila pneumoniae J138
aggagcucccuaagauu

SEQ ID NO: 2553330 - RNA, 13 nt, Chlamydophila pneumoniae J138
aggagcuccuccu

SEQ ID NO: 2553331 - RNA, 15 nt, Chlamydophila pneumoniae J138
aggagcuuuuaccuu

SEQ ID NO: 2553332 - RNA, 13 nt, Chlamydophila pneumoniae J138
aggaggaggagca

SEQ ID NO: 2553333 - RNA, 21 nt, Chlamydophila pneumoniae J138
aggaggauuuccuagguucuu

SEQ ID NO: 2553334 - RNA, 19 nt, Chlamydophila pneumoniae J138
aggagguccuuggcauuca

SEQ ID NO: 2553335 - RNA, 18 nt, Chlamydophila pneumoniae J138
aggaguauagcaugaucu

SEQ ID NO: 2553336 - RNA, 20 nt, Chlamydophila pneumoniae J138
aggagucgugcaggagaaca

SEQ ID NO: 2553337 - RNA, 20 nt, Chlamydophila pneumoniae J138
aggaguuccgcggccaucau

SEQ ID NO: 2553338 - RNA, 20 nt, Chlamydophila pneumoniae J138
aggaguuuucaagucuguaa

SEQ ID NO: 2553339 - RNA, 13 nt, Chlamydophila pneumoniae J138
aggaguuuuccaa

SEQ ID NO: 2553340 - RNA, 20 nt, Chlamydophila pneumoniae J138
aggauaaccaucaaucacuc

SEQ ID NO: 2553341 - RNA, 17 nt, Chlamydophila pneumoniae J138
aggauacgaauaaguuu

SEQ ID NO: 2553342 - RNA, 16 nt, Chlamydophila pneumoniae J138
aggauacucacagagu

SEQ ID NO: 2553343 - RNA, 21 nt, Chlamydophila pneumoniae J138
aggauagaccccccauuccaa

SEQ ID NO: 2553344 - RNA, 22 nt, Chlamydophila pneumoniae J138
aggauagaccccccauuccaaa

SEQ ID NO: 2553345 - RNA, 22 nt, Chlamydophila pneumoniae J138
aggauagguccguuuuuucaga

SEQ ID NO: 2553346 - RNA, 16 nt, Chlamydophila pneumoniae J138
aggauauauagagcag

SEQ ID NO: 2553347 - RNA, 17 nt, Chlamydophila pneumoniae J138
aggaucauuaaagucca

SEQ ID NO: 2553348 - RNA, 15 nt, Chlamydophila pneumoniae J138
aggaucugcauggau

SEQ ID NO: 2553349 - RNA, 22 nt, Chlamydophila pneumoniae J138
agcgcuuucuuuuauuaaggga

SEQ ID NO: 2553350 - RNA, 19 nt, Chlamydophila pneumoniae J138
agcggaacaacuuugaggc

SEQ ID NO: 2553351 - RNA, 21 nt, Chlamydophila pneumoniae J138
agcggaagcaccgccugaccu

SEQ ID NO: 2553352 - RNA, 18 nt, Chlamydophila pneumoniae J138
agcgguagcgucuagcua

SEQ ID NO: 2553353 - RNA, 20 nt, Chlamydophila pneumoniae J138
agcguauaggaaacugucau

SEQ ID NO: 2553354 - RNA, 16 nt, Chlamydophila pneumoniae J138
agcguauuccccacug

SEQ ID NO: 2553355 - RNA, 23 nt, Chlamydophila pneumoniae J138
agcgucaauguuaaucuaauuuu

SEQ ID NO: 2553356 - RNA, 15 nt, Chlamydophila pneumoniae J138
agcgugaauaucauc

SEQ ID NO: 2553357 - RNA, 19 nt, Chlamydophila pneumoniae J138
agcuaaagaaacuucugac

SEQ ID NO: 2553358 - RNA, 22 nt, Chlamydophila pneumoniae J138
agcuaaauuguuaucaggaacu

SEQ ID NO: 2553359 - RNA, 12 nt, Chlamydophila pneumoniae J138
agcuaagagcau

SEQ ID NO: 2553360 - RNA, 20 nt, Chlamydophila pneumoniae J138
agcuaagggaaauccacaga

SEQ ID NO: 2553361 - RNA, 18 nt, Chlamydophila pneumoniae J138
agcuaaucaauccaagaa

SEQ ID NO: 2553362 - RNA, 17 nt, Chlamydophila pneumoniae J138
agcuaauuuaaaugccu

SEQ ID NO: 2553363 - RNA, 20 nt, Chlamydophila pneumoniae J138
agcuacaagaacugaagagu

SEQ ID NO: 2553364 - RNA, 15 nt, Chlamydophila pneumoniae J138
agcuacaaguccccc

SEQ ID NO: 2553365 - RNA, 19 nt, Chlamydophila pneumoniae J138
agcuacagaaagagcuaaa

SEQ ID NO: 2553366 - RNA, 17 nt, Chlamydophila pneumoniae J138
agcuacuaaucaccuua

SEQ ID NO: 2553367 - RNA, 13 nt, Chlamydophila pneumoniae J138
agcuagaaagucc

SEQ ID NO: 2553368 - RNA, 15 nt, Chlamydophila pneumoniae J138
agcuagagcauuccg

SEQ ID NO: 2553369 - RNA, 17 nt, Chlamydophila pneumoniae J138
agcuagucuucuuagaa

SEQ ID NO: 2553370 - RNA, 17 nt, Chlamydophila pneumoniae J138
agcuagucuuucuaaga

SEQ ID NO: 2553371 - RNA, 18 nt, Chlamydophila pneumoniae J138
agcuagucuuucuaagaa

SEQ ID NO: 2553372 - RNA, 23 nt, Chlamydophila pneumoniae J138
agcuauauaggguugugucucug

SEQ ID NO: 2553373 - RNA, 19 nt, Chlamydophila pneumoniae J138
agcuaucgagauaucgaua

SEQ ID NO: 2553374 - RNA, 22 nt, Chlamydophila pneumoniae J138
agcuaucuugagcaucacggag

SEQ ID NO: 2553375 - RNA, 17 nt, Chlamydophila pneumoniae J138
agcuaugaugagaacgu

SEQ ID NO: 2553376 - RNA, 15 nt, Chlamydophila pneumoniae J138
agcuauuucucuauc

SEQ ID NO: 2553377 - RNA, 20 nt, Chlamydophila pneumoniae J138
agcuauuucucuaucaucaa

SEQ ID NO: 2553378 - RNA, 19 nt, Chlamydophila pneumoniae J138
agcuauuuuacuuacuaaa

SEQ ID NO: 2553379 - RNA, 20 nt, Chlamydophila pneumoniae J138
agcuauuuuacuuacuaaag

SEQ ID NO: 2553380 - RNA, 12 nt, Chlamydophila pneumoniae J138
agcuauuuuuga

SEQ ID NO: 2553381 - RNA, 23 nt, Chlamydophila pneumoniae J138
agcuauuuuugaggaacgcacgc

SEQ ID NO: 2553382 - RNA, 12 nt, Chlamydophila pneumoniae J138
agcucaaaaagu

SEQ ID NO: 2553383 - RNA, 12 nt, Chlamydophila pneumoniae J138
agcucaaggcau

SEQ ID NO: 2553384 - RNA, 18 nt, Chlamydophila pneumoniae J138
agcucacucuuuaaaaac

SEQ ID NO: 2553385 - RNA, 21 nt, Chlamydophila pneumoniae J138
agcucaggaaaacuuaauaag

SEQ ID NO: 2553386 - RNA, 12 nt, Chlamydophila pneumoniae J138
agcucauaagaa

SEQ ID NO: 2553387 - RNA, 17 nt, Chlamydophila pneumoniae J138
agcucaucagcaaccuu

SEQ ID NO: 2553388 - RNA, 19 nt, Chlamydophila pneumoniae J138
agcucaucuagaaagauuu

SEQ ID NO: 2553389 - RNA, 21 nt, Chlamydophila pneumoniae J138
agcucauuaucaagaaauucu

SEQ ID NO: 2553390 - RNA, 13 nt, Chlamydophila pneumoniae J138
agcuccaaaauaa

SEQ ID NO: 2553391 - RNA, 17 nt, Chlamydophila pneumoniae J138
agcuccauaagcuuuuc

SEQ ID NO: 2553392 - RNA, 14 nt, Chlamydophila pneumoniae J138
agcuccauuuaaau

SEQ ID NO: 2553393 - RNA, 21 nt, Chlamydophila pneumoniae J138
agcucccaacaagggaaagaa

SEQ ID NO: 2553394 - RNA, 13 nt, Chlamydophila pneumoniae J138
agcucccucuaga

SEQ ID NO: 2553395 - RNA, 17 nt, Chlamydophila pneumoniae J138
agcucccucuagagcuu

SEQ ID NO: 2553396 - RNA, 15 nt, Chlamydophila pneumoniae J138
agcuccguaauggag

SEQ ID NO: 2553397 - RNA, 20 nt, Chlamydophila pneumoniae J138
agcuccguaauggagagcuu

SEQ ID NO: 2553398 - RNA, 14 nt, Chlamydophila pneumoniae J138
agcuccuuggcuau

SEQ ID NO: 2553399 - RNA, 21 nt, Chlamydophila pneumoniae J138
agcucgaaucacgaauaaggc

SEQ ID NO: 2553400 - RNA, 19 nt, Chlamydophila pneumoniae J138
agcucgagaucuuuuugcc

SEQ ID NO: 2553401 - RNA, 17 nt, Chlamydophila pneumoniae J138
agcucguaauccuucuu

SEQ ID NO: 2553402 - RNA, 22 nt, Chlamydophila pneumoniae J138
agcucuaaaaaagauaaagcua

SEQ ID NO: 2553403 - RNA, 19 nt, Chlamydophila pneumoniae J138
agcucuaaguccaacauca

SEQ ID NO: 2553404 - RNA, 23 nt, Chlamydophila pneumoniae J138
agcucuaauucuucuacagaaua

SEQ ID NO: 2553405 - RNA, 20 nt, Chlamydophila pneumoniae J138
agcucuaggauaucauauuu

SEQ ID NO: 2553406 - RNA, 16 nt, Chlamydophila pneumoniae J138
agcucuauuucugccu

SEQ ID NO: 2553407 - RNA, 18 nt, Chlamydophila pneumoniae J138
agcucucgacgaacaugc

SEQ ID NO: 2553408 - RNA, 17 nt, Chlamydophila pneumoniae J138
agcucucuugcuauacc

SEQ ID NO: 2553409 - RNA, 12 nt, Chlamydophila pneumoniae J138
agcucuggagau

SEQ ID NO: 2553410 - RNA, 23 nt, Chlamydophila pneumoniae J138
agcucuggagauugcuaagcauu

SEQ ID NO: 2553411 - RNA, 22 nt, Chlamydophila pneumoniae J138
agcucuucagcaagucgguaau

SEQ ID NO: 2553412 - RNA, 22 nt, Chlamydophila pneumoniae J138
agcucuuucauaagauugccau

SEQ ID NO: 2553413 - RNA, 24 nt, Chlamydophila pneumoniae J138
agcucuuucccucguugcuuagcg

SEQ ID NO: 2553414 - RNA, 14 nt, Chlamydophila pneumoniae J138
agcucuuucuugga

SEQ ID NO: 2553415 - RNA, 16 nt, Chlamydophila pneumoniae J138
agcucuuucuuggauu

SEQ ID NO: 2553416 - RNA, 14 nt, Chlamydophila pneumoniae J138
agcugagagauuuu

SEQ ID NO: 2553417 - RNA, 19 nt, Chlamydophila pneumoniae J138
agcugagagauuuuuucau

SEQ ID NO: 2553418 - RNA, 20 nt, Chlamydophila pneumoniae J138
agcugagcuaucuucaaguu

SEQ ID NO: 2553419 - RNA, 15 nt, Chlamydophila pneumoniae J138
agcugaggcaucuau

SEQ ID NO: 2553420 - RNA, 15 nt, Chlamydophila pneumoniae J138
agcugaucuucuaaa

SEQ ID NO: 2553421 - RNA, 15 nt, Chlamydophila pneumoniae J138
agcugcaaacacaau

SEQ ID NO: 2553422 - RNA, 22 nt, Chlamydophila pneumoniae J138
agcugccagugacauaaucaca

SEQ ID NO: 2553423 - RNA, 13 nt, Chlamydophila pneumoniae J138
agcugcugcuacg

SEQ ID NO: 2553424 - RNA, 15 nt, Chlamydophila pneumoniae J138
agcugcuucuucaga

SEQ ID NO: 2553425 - RNA, 15 nt, Chlamydophila pneumoniae J138
agcugcuuuuucuac

SEQ ID NO: 2553426 - RNA, 15 nt, Chlamydophila pneumoniae J138
agcuguacagaacaa

SEQ ID NO: 2553427 - RNA, 16 nt, Chlamydophila pneumoniae J138
agcuguauugggaaug

SEQ ID NO: 2553428 - RNA, 20 nt, Chlamydophila pneumoniae J138
agcugucaauccaacaaaga

SEQ ID NO: 2553429 - RNA, 20 nt, Chlamydophila pneumoniae J138
agcuguccagucuauagccu

SEQ ID NO: 2553430 - RNA, 14 nt, Chlamydophila pneumoniae J138
agcuguccuccgag

SEQ ID NO: 2553431 - RNA, 14 nt, Chlamydophila pneumoniae J138
agcugugcauuuuc

SEQ ID NO: 2553432 - RNA, 12 nt, Chlamydophila pneumoniae J138
agcugugguggu

SEQ ID NO: 2553433 - RNA, 21 nt, Chlamydophila pneumoniae J138
agcuguugcguuugagcuaag

SEQ ID NO: 2553434 - RNA, 17 nt, Chlamydophila pneumoniae J138
agcuguuuacuuuucuc

SEQ ID NO: 2553435 - RNA, 20 nt, Chlamydophila pneumoniae J138
agcuguuuacuuuucucuuu

SEQ ID NO: 2553436 - RNA, 18 nt, Chlamydophila pneumoniae J138
agcuuacguguugcauga

SEQ ID NO: 2553437 - RNA, 21 nt, Chlamydophila pneumoniae J138
agcuuacuuagaacuauagga

SEQ ID NO: 2553438 - RNA, 18 nt, Chlamydophila pneumoniae J138
agcuuacuuucuuuuagc

SEQ ID NO: 2553439 - RNA, 13 nt, Chlamydophila pneumoniae J138
agcuuauuucugu

SEQ ID NO: 2553440 - RNA, 17 nt, Chlamydophila pneumoniae J138
agcuucaaaaagcuccc

SEQ ID NO: 2553441 - RNA, 22 nt, Chlamydophila pneumoniae J138
agcuucaaguuucuuuugcaaa

SEQ ID NO: 2553442 - RNA, 15 nt, Chlamydophila pneumoniae J138
agcuucccaauugua

SEQ ID NO: 2553443 - RNA, 20 nt, Chlamydophila pneumoniae J138
agcuuccucacguucugcaa

SEQ ID NO: 2553444 - RNA, 23 nt, Chlamydophila pneumoniae J138
agcuuccucacguucugcaacaa

SEQ ID NO: 2553445 - RNA, 23 nt, Chlamydophila pneumoniae J138
agcuuccugcuccucuucuuccc

SEQ ID NO: 2553446 - RNA, 15 nt, Chlamydophila pneumoniae J138
agcuucuacagcauc

SEQ ID NO: 2553447 - RNA, 16 nt, Chlamydophila pneumoniae J138
agcuucugaacuguuc

SEQ ID NO: 2553448 - RNA, 18 nt, Chlamydophila pneumoniae J138
agcuucuucaacgaggaa

SEQ ID NO: 2553449 - RNA, 16 nt, Chlamydophila pneumoniae J138
agagugaccauagcau

SEQ ID NO: 2553450 - RNA, 18 nt, Chlamydophila pneumoniae J138
agaguggucauugccuug

SEQ ID NO: 2553451 - RNA, 20 nt, Chlamydophila pneumoniae J138
agaguggucauugccuugcu

SEQ ID NO: 2553452 - RNA, 21 nt, Chlamydophila pneumoniae J138
agaguguuguuggagcagaaa

SEQ ID NO: 2553453 - RNA, 17 nt, Chlamydophila pneumoniae J138
agaguuccgcaaauaca

SEQ ID NO: 2553454 - RNA, 21 nt, Chlamydophila pneumoniae J138
agaguucgcacuaauuuccuu

SEQ ID NO: 2553455 - RNA, 23 nt, Chlamydophila pneumoniae J138
agaguucgcacuaauuuccuuca

SEQ ID NO: 2553456 - RNA, 12 nt, Chlamydophila pneumoniae J138
agaguugauugu

SEQ ID NO: 2553457 - RNA, 15 nt, Chlamydophila pneumoniae J138
agaguugcuuuaugg

SEQ ID NO: 2553458 - RNA, 21 nt, Chlamydophila pneumoniae J138
agaguuggaucauucuuuaua

SEQ ID NO: 2553459 - RNA, 21 nt, Chlamydophila pneumoniae J138
agaguuucuuuugauugaaac

SEQ ID NO: 2553460 - RNA, 19 nt, Chlamydophila pneumoniae J138
agaguuuuacaucaaugau

SEQ ID NO: 2553461 - RNA, 20 nt, Chlamydophila pneumoniae J138
agaguuuuuguguuugacug

SEQ ID NO: 2553462 - RNA, 18 nt, Chlamydophila pneumoniae J138
agaguuuuuuagaggagc

SEQ ID NO: 2553463 - RNA, 18 nt, Chlamydophila pneumoniae J138
agauaaacagcacaggca

SEQ ID NO: 2553464 - RNA, 13 nt, Chlamydophila pneumoniae J138
agauaaacauaca

SEQ ID NO: 2553465 - RNA, 13 nt, Chlamydophila pneumoniae J138
agauaaagaauuc

SEQ ID NO: 2553466 - RNA, 17 nt, Chlamydophila pneumoniae J138
agauaaagcaaagauaa

SEQ ID NO: 2553467 - RNA, 14 nt, Chlamydophila pneumoniae J138
agauaaaggcauaa

SEQ ID NO: 2553468 - RNA, 23 nt, Chlamydophila pneumoniae J138
agauaaaggcauaacugugcucc

SEQ ID NO: 2553469 - RNA, 23 nt, Chlamydophila pneumoniae J138
agauaaauccccaccaacaaugc

SEQ ID NO: 2553470 - RNA, 13 nt, Chlamydophila pneumoniae J138
agauaagauaaac

SEQ ID NO: 2553471 - RNA, 19 nt, Chlamydophila pneumoniae J138
agauaauagagaagaagca

SEQ ID NO: 2553472 - RNA, 13 nt, Chlamydophila pneumoniae J138
agauaauuaugua

SEQ ID NO: 2553473 - RNA, 15 nt, Chlamydophila pneumoniae J138
agauacgaaguccca

SEQ ID NO: 2553474 - RNA, 15 nt, Chlamydophila pneumoniae J138
agauacgcuuacaaa

SEQ ID NO: 2553475 - RNA, 19 nt, Chlamydophila pneumoniae J138
agauacgcuuacaaauaac

SEQ ID NO: 2553476 - RNA, 15 nt, Chlamydophila pneumoniae J138
agauacggaggauua

SEQ ID NO: 2553477 - RNA, 17 nt, Chlamydophila pneumoniae J138
agauacggguucguuuc

SEQ ID NO: 2553478 - RNA, 15 nt, Chlamydophila pneumoniae J138
agauacguuuccccc

SEQ ID NO: 2553479 - RNA, 22 nt, Chlamydophila pneumoniae J138
agauacuaucugccauaggauc

SEQ ID NO: 2553480 - RNA, 16 nt, Chlamydophila pneumoniae J138
agauacuuaucuuuaa

SEQ ID NO: 2553481 - RNA, 18 nt, Chlamydophila pneumoniae J138
agauacuucuccacagcu

SEQ ID NO: 2553482 - RNA, 18 nt, Chlamydophila pneumoniae J138
agauacuuugcaauacac

SEQ ID NO: 2553483 - RNA, 12 nt, Chlamydophila pneumoniae J138
agauagagcgac

SEQ ID NO: 2553484 - RNA, 14 nt, Chlamydophila pneumoniae J138
agauagcaaaucaa

SEQ ID NO: 2553485 - RNA, 16 nt, Chlamydophila pneumoniae J138
agauagcaaaucaaua

SEQ ID NO: 2553486 - RNA, 14 nt, Chlamydophila pneumoniae J138
agauagcucuugcg

SEQ ID NO: 2553487 - RNA, 22 nt, Chlamydophila pneumoniae J138
agauaggaacucacaaacaaca

SEQ ID NO: 2553488 - RNA, 23 nt, Chlamydophila pneumoniae J138
agauaggaacucacaaacaacag

SEQ ID NO: 2553489 - RNA, 18 nt, Chlamydophila pneumoniae J138
agauaggauggaguacuu

SEQ ID NO: 2553490 - RNA, 16 nt, Chlamydophila pneumoniae J138
agauagguuuuuguaa

SEQ ID NO: 2553491 - RNA, 11 nt, Chlamydophila pneumoniae J138
agauagucuug

SEQ ID NO: 2553492 - RNA, 15 nt, Chlamydophila pneumoniae J138
agauaguuauuaaua

SEQ ID NO: 2553493 - RNA, 12 nt, Chlamydophila pneumoniae J138
agauauagagag

SEQ ID NO: 2553494 - RNA, 19 nt, Chlamydophila pneumoniae J138
agauauagcguacaggaag

SEQ ID NO: 2553495 - RNA, 12 nt, Chlamydophila pneumoniae J138
agauaucuugua

SEQ ID NO: 2553496 - RNA, 13 nt, Chlamydophila pneumoniae J138
agauaugaagaga

SEQ ID NO: 2553497 - RNA, 23 nt, Chlamydophila pneumoniae J138
agauauuaucgauaggaagccag

SEQ ID NO: 2553498 - RNA, 23 nt, Chlamydophila pneumoniae J138
agaucaaguccucgccgcugccc

SEQ ID NO: 2553499 - RNA, 12 nt, Chlamydophila pneumoniae J138
agaucaauauag

SEQ ID NO: 2553500 - RNA, 14 nt, Chlamydophila pneumoniae J138
agaucacaagaaag

SEQ ID NO: 2553501 - RNA, 17 nt, Chlamydophila pneumoniae J138
agaucacaucaagauag

SEQ ID NO: 2553502 - RNA, 12 nt, Chlamydophila pneumoniae J138
agaucagcuccc

SEQ ID NO: 2553503 - RNA, 14 nt, Chlamydophila pneumoniae J138
agaucauaaacagc

SEQ ID NO: 2553504 - RNA, 13 nt, Chlamydophila pneumoniae J138
agaucauaucuua

SEQ ID NO: 2553505 - RNA, 20 nt, Chlamydophila pneumoniae J138
agaucaucucccaaauagcu

SEQ ID NO: 2553506 - RNA, 13 nt, Chlamydophila pneumoniae J138
agauccaaaaauu

SEQ ID NO: 2553507 - RNA, 15 nt, Chlamydophila pneumoniae J138
agauccaaagacgua

SEQ ID NO: 2553508 - RNA, 13 nt, Chlamydophila pneumoniae J138
agauccaugaaca

SEQ ID NO: 2553509 - RNA, 13 nt, Chlamydophila pneumoniae J138
agaucccagaaga

SEQ ID NO: 2553510 - RNA, 19 nt, Chlamydophila pneumoniae J138
agaucccgggaguuuucag

SEQ ID NO: 2553511 - RNA, 15 nt, Chlamydophila pneumoniae J138
agauccgauauacuu

SEQ ID NO: 2553512 - RNA, 16 nt, Chlamydophila pneumoniae J138
agauccuagagaaugu

SEQ ID NO: 2553513 - RNA, 20 nt, Chlamydophila pneumoniae J138
agauccucaaagaguuuuuu

SEQ ID NO: 2553514 - RNA, 15 nt, Chlamydophila pneumoniae J138
agauccugaaaguac

SEQ ID NO: 2553515 - RNA, 17 nt, Chlamydophila pneumoniae J138
agauccuuuaaagauuc

SEQ ID NO: 2553516 - RNA, 21 nt, Chlamydophila pneumoniae J138
agauccuuuaaagauucccca

SEQ ID NO: 2553517 - RNA, 15 nt, Chlamydophila pneumoniae J138
agaucgaucucugug

SEQ ID NO: 2553518 - RNA, 13 nt, Chlamydophila pneumoniae J138
agaucguuaucaa

SEQ ID NO: 2553519 - RNA, 23 nt, Chlamydophila pneumoniae J138
agaucuacaagacuacgacagaa

SEQ ID NO: 2553520 - RNA, 14 nt, Chlamydophila pneumoniae J138
agaucuacaucaaa

SEQ ID NO: 2553521 - RNA, 15 nt, Chlamydophila pneumoniae J138
agaucuacaucaaau

SEQ ID NO: 2553522 - RNA, 18 nt, Chlamydophila pneumoniae J138
agaucuccgaagacuacc

SEQ ID NO: 2553523 - RNA, 20 nt, Chlamydophila pneumoniae J138
agaucucgucuuggaaugcu

SEQ ID NO: 2553524 - RNA, 19 nt, Chlamydophila pneumoniae J138
agaucucuugaagcacuuu

SEQ ID NO: 2553525 - RNA, 17 nt, Chlamydophila pneumoniae J138
agaucucuuuagcaauc

SEQ ID NO: 2553526 - RNA, 20 nt, Chlamydophila pneumoniae J138
agaucugcaaacgcaaugau

SEQ ID NO: 2553527 - RNA, 17 nt, Chlamydophila pneumoniae J138
agaucugcauaauuuuu

SEQ ID NO: 2553528 - RNA, 23 nt, Chlamydophila pneumoniae J138
agaucuggagagggaaggaauaa

SEQ ID NO: 2553529 - RNA, 13 nt, Chlamydophila pneumoniae J138
agaucuucauaac

SEQ ID NO: 2553530 - RNA, 13 nt, Chlamydophila pneumoniae J138
agaucuucaucac

SEQ ID NO: 2553531 - RNA, 16 nt, Chlamydophila pneumoniae J138
agaucuucugaaauca

SEQ ID NO: 2553532 - RNA, 20 nt, Chlamydophila pneumoniae J138
agaucuucugaaaucaaaaa

SEQ ID NO: 2553533 - RNA, 16 nt, Chlamydophila pneumoniae J138
agaucuuuagaauaag

SEQ ID NO: 2553534 - RNA, 16 nt, Chlamydophila pneumoniae J138
agaucuuuauuuuuaa

SEQ ID NO: 2553535 - RNA, 23 nt, Chlamydophila pneumoniae J138
agaucuuuucuacuucaggaaau

SEQ ID NO: 2553536 - RNA, 15 nt, Chlamydophila pneumoniae J138
agaucuuuuugccag

SEQ ID NO: 2553537 - RNA, 13 nt, Chlamydophila pneumoniae J138
agaugaagaaacu

SEQ ID NO: 2553538 - RNA, 14 nt, Chlamydophila pneumoniae J138
agaugaaguuccca

SEQ ID NO: 2553539 - RNA, 15 nt, Chlamydophila pneumoniae J138
agaugaaguucccac

SEQ ID NO: 2553540 - RNA, 22 nt, Chlamydophila pneumoniae J138
agaugcgcucggauuucaugau

SEQ ID NO: 2553541 - RNA, 15 nt, Chlamydophila pneumoniae J138
agaugcuaacaacuc

SEQ ID NO: 2553542 - RNA, 20 nt, Chlamydophila pneumoniae J138
agaugcuauuuacugaaaca

SEQ ID NO: 2553543 - RNA, 17 nt, Chlamydophila pneumoniae J138
agaugcuucuaaacaau

SEQ ID NO: 2553544 - RNA, 23 nt, Chlamydophila pneumoniae J138
agaugcuucuaaacaauuucaau

SEQ ID NO: 2553545 - RNA, 16 nt, Chlamydophila pneumoniae J138
agaugggcuaacuuau

SEQ ID NO: 2553546 - RNA, 13 nt, Chlamydophila pneumoniae J138
agaugucuugguu

SEQ ID NO: 2553547 - RNA, 22 nt, Chlamydophila pneumoniae J138
agauguggcagaguccuucuuu

SEQ ID NO: 2553548 - RNA, 15 nt, Chlamydophila pneumoniae J138
agauguuuucguaaa

SEQ ID NO: 2553549 - RNA, 24 nt, Chlamydophila pneumoniae J138
agauguuuucguaaauaugaauua

SEQ ID NO: 2553550 - RNA, 16 nt, Chlamydophila pneumoniae J138
aggaugcuugugagau

SEQ ID NO: 2553551 - RNA, 18 nt, Chlamydophila pneumoniae J138
aggaugcuugugagauga

SEQ ID NO: 2553552 - RNA, 18 nt, Chlamydophila pneumoniae J138
aggauucuaaaaagaaaa

SEQ ID NO: 2553553 - RNA, 19 nt, Chlamydophila pneumoniae J138
aggauucuaaaaagaaaag

SEQ ID NO: 2553554 - RNA, 17 nt, Chlamydophila pneumoniae J138
aggauucucucugccua

SEQ ID NO: 2553555 - RNA, 23 nt, Chlamydophila pneumoniae J138
aggauucugagaaguuaagacaa

SEQ ID NO: 2553556 - RNA, 17 nt, Chlamydophila pneumoniae J138
aggauucuuuugcaaug

SEQ ID NO: 2553557 - RNA, 15 nt, Chlamydophila pneumoniae J138
aggauucuuuuugau

SEQ ID NO: 2553558 - RNA, 13 nt, Chlamydophila pneumoniae J138
aggauuuuccauu

SEQ ID NO: 2553559 - RNA, 16 nt, Chlamydophila pneumoniae J138
aggcaagauuaugaug

SEQ ID NO: 2553560 - RNA, 23 nt, Chlamydophila pneumoniae J138
aggcaagauuaugaugccucauu

SEQ ID NO: 2553561 - RNA, 14 nt, Chlamydophila pneumoniae J138
aggcacauguagga

SEQ ID NO: 2553562 - RNA, 23 nt, Chlamydophila pneumoniae J138
aggcacccaaacugaugccaaga

SEQ ID NO: 2553563 - RNA, 14 nt, Chlamydophila pneumoniae J138
aggcauaagaucau

SEQ ID NO: 2553564 - RNA, 23 nt, Chlamydophila pneumoniae J138
aggcaucuagagucucuuucagc

SEQ ID NO: 2553565 - RNA, 17 nt, Chlamydophila pneumoniae J138
aggcaucuucuuugcca

SEQ ID NO: 2553566 - RNA, 16 nt, Chlamydophila pneumoniae J138
aggcaugccuacaggc

SEQ ID NO: 2553567 - RNA, 12 nt, Chlamydophila pneumoniae J138
aggcauuaauaa

SEQ ID NO: 2553568 - RNA, 16 nt, Chlamydophila pneumoniae J138
aggcauuaauaacuuu

SEQ ID NO: 2553569 - RNA, 17 nt, Chlamydophila pneumoniae J138
aggcauuacacaacucu

SEQ ID NO: 2553570 - RNA, 13 nt, Chlamydophila pneumoniae J138
aggccaaagaaca

SEQ ID NO: 2553571 - RNA, 14 nt, Chlamydophila pneumoniae J138
aggccaaagaacag

SEQ ID NO: 2553572 - RNA, 17 nt, Chlamydophila pneumoniae J138
aggccaaagaacagcac

SEQ ID NO: 2553573 - RNA, 22 nt, Chlamydophila pneumoniae J138
aggcccaccagggguuucuaaa

SEQ ID NO: 2553574 - RNA, 18 nt, Chlamydophila pneumoniae J138
aggccuccauuucuagga

SEQ ID NO: 2553575 - RNA, 23 nt, Chlamydophila pneumoniae J138
aggccuccauuucuaggaauugc

SEQ ID NO: 2553576 - RNA, 16 nt, Chlamydophila pneumoniae J138
aggccuccuucauuca

SEQ ID NO: 2553577 - RNA, 17 nt, Chlamydophila pneumoniae J138
aggcgauaguaaacaga

SEQ ID NO: 2553578 - RNA, 18 nt, Chlamydophila pneumoniae J138
aggcgaugcaaauuccag

SEQ ID NO: 2553579 - RNA, 17 nt, Chlamydophila pneumoniae J138
aggcggaugaccuucuc

SEQ ID NO: 2553580 - RNA, 13 nt, Chlamydophila pneumoniae J138
aggcuccagcaua

SEQ ID NO: 2553581 - RNA, 13 nt, Chlamydophila pneumoniae J138
aggcucucgacac

SEQ ID NO: 2553582 - RNA, 22 nt, Chlamydophila pneumoniae J138
aggcucucgacacuauguguuu

SEQ ID NO: 2553583 - RNA, 21 nt, Chlamydophila pneumoniae J138
aggcucuuaucgugacucuua

SEQ ID NO: 2553584 - RNA, 14 nt, Chlamydophila pneumoniae J138
aggcugcacacauc

SEQ ID NO: 2553585 - RNA, 23 nt, Chlamydophila pneumoniae J138
aggcugcuacgugaucaaaauua

SEQ ID NO: 2553586 - RNA, 13 nt, Chlamydophila pneumoniae J138
aggcugcuaucaa

SEQ ID NO: 2553587 - RNA, 21 nt, Chlamydophila pneumoniae J138
aggcuguccuugcagcccugc

SEQ ID NO: 2553588 - RNA, 19 nt, Chlamydophila pneumoniae J138
aggcugucguuaccguuuc

SEQ ID NO: 2553589 - RNA, 15 nt, Chlamydophila pneumoniae J138
aggcuguguaaaagu

SEQ ID NO: 2553590 - RNA, 17 nt, Chlamydophila pneumoniae J138
aggcuguguaaaaguua

SEQ ID NO: 2553591 - RNA, 17 nt, Chlamydophila pneumoniae J138
aggcuuaauaaacauca

SEQ ID NO: 2553592 - RNA, 20 nt, Chlamydophila pneumoniae J138
aggcuuuaaguguuucuuca

SEQ ID NO: 2553593 - RNA, 14 nt, Chlamydophila pneumoniae J138
aggcuuuuuucuau

SEQ ID NO: 2553594 - RNA, 18 nt, Chlamydophila pneumoniae J138
agggaaaguucaguaaaa

SEQ ID NO: 2553595 - RNA, 22 nt, Chlamydophila pneumoniae J138
agggaaauccacagauacguuu

SEQ ID NO: 2553596 - RNA, 15 nt, Chlamydophila pneumoniae J138
agggaagaaauuaac

SEQ ID NO: 2553597 - RNA, 13 nt, Chlamydophila pneumoniae J138
agggaagagaaaa

SEQ ID NO: 2553598 - RNA, 23 nt, Chlamydophila pneumoniae J138
agggaauuucggacgauauuuag

SEQ ID NO: 2553599 - RNA, 14 nt, Chlamydophila pneumoniae J138
agggacaaguacga

SEQ ID NO: 2553600 - RNA, 17 nt, Chlamydophila pneumoniae J138
agggacagucuccugga

SEQ ID NO: 2553601 - RNA, 23 nt, Chlamydophila pneumoniae J138
agggacagucuccuggaacagua

SEQ ID NO: 2553602 - RNA, 19 nt, Chlamydophila pneumoniae J138
agggacguuguaucccugu

SEQ ID NO: 2553603 - RNA, 17 nt, Chlamydophila pneumoniae J138
agggagacucuugaggc

SEQ ID NO: 2553604 - RNA, 12 nt, Chlamydophila pneumoniae J138
agggaucccaaa

SEQ ID NO: 2553605 - RNA, 18 nt, Chlamydophila pneumoniae J138
agggaugaggucguacaa

SEQ ID NO: 2553606 - RNA, 13 nt, Chlamydophila pneumoniae J138
agggaugguuucc

SEQ ID NO: 2553607 - RNA, 22 nt, Chlamydophila pneumoniae J138
agggauucuuguuggauugaaa

SEQ ID NO: 2553608 - RNA, 12 nt, Chlamydophila pneumoniae J138
agggcaucuuuu

SEQ ID NO: 2553609 - RNA, 20 nt, Chlamydophila pneumoniae J138
agggcaucuuuuacagacug

SEQ ID NO: 2553610 - RNA, 19 nt, Chlamydophila pneumoniae J138
agggcuauccacaacuaaa

SEQ ID NO: 2553611 - RNA, 14 nt, Chlamydophila pneumoniae J138
agggcuucaacauu

SEQ ID NO: 2553612 - RNA, 18 nt, Chlamydophila pneumoniae J138
agggcuucguggaacuuu

SEQ ID NO: 2553613 - RNA, 14 nt, Chlamydophila pneumoniae J138
aggggaagaggaau

SEQ ID NO: 2553614 - RNA, 15 nt, Chlamydophila pneumoniae J138
aggggaagaggaaug

SEQ ID NO: 2553615 - RNA, 14 nt, Chlamydophila pneumoniae J138
aggggcaguuccua

SEQ ID NO: 2553616 - RNA, 17 nt, Chlamydophila pneumoniae J138
agggggaucuucagaga

SEQ ID NO: 2553617 - RNA, 18 nt, Chlamydophila pneumoniae J138
agggguuucuaaauacuu

SEQ ID NO: 2553618 - RNA, 18 nt, Chlamydophila pneumoniae J138
aggguaaagaaauauuaa

SEQ ID NO: 2553619 - RNA, 18 nt, Chlamydophila pneumoniae J138
aggguaagauugcaggua

SEQ ID NO: 2553620 - RNA, 23 nt, Chlamydophila pneumoniae J138
aggguagccauccacgaccugca

SEQ ID NO: 2553621 - RNA, 20 nt, Chlamydophila pneumoniae J138
aggguauccugcuccaaaau

SEQ ID NO: 2553622 - RNA, 21 nt, Chlamydophila pneumoniae J138
aggguauccugcuccaaaaug

SEQ ID NO: 2553623 - RNA, 17 nt, Chlamydophila pneumoniae J138
agggucgcugauaaaau

SEQ ID NO: 2553624 - RNA, 23 nt, Chlamydophila pneumoniae J138
agggucggauuuagauuaaagag

SEQ ID NO: 2553625 - RNA, 22 nt, Chlamydophila pneumoniae J138
agggucuaguucaauuucuaua

SEQ ID NO: 2553626 - RNA, 15 nt, Chlamydophila pneumoniae J138
aggguguuugcauag

SEQ ID NO: 2553627 - RNA, 21 nt, Chlamydophila pneumoniae J138
aggguugugucucugaagacc

SEQ ID NO: 2553628 - RNA, 12 nt, Chlamydophila pneumoniae J138
aggguuugcaug

SEQ ID NO: 2553629 - RNA, 19 nt, Chlamydophila pneumoniae J138
aggguuuugaaauaauuuu

SEQ ID NO: 2553630 - RNA, 21 nt, Chlamydophila pneumoniae J138
aggguuuugaaauaauuuuca

SEQ ID NO: 2553631 - RNA, 17 nt, Chlamydophila pneumoniae J138
agguaaaacuacaggaa

SEQ ID NO: 2553632 - RNA, 19 nt, Chlamydophila pneumoniae J138
agguaacauccauagagaa

SEQ ID NO: 2553633 - RNA, 15 nt, Chlamydophila pneumoniae J138
agguaaccagagagc

SEQ ID NO: 2553634 - RNA, 22 nt, Chlamydophila pneumoniae J138
agguaagggaugcucuagaaaa

SEQ ID NO: 2553635 - RNA, 16 nt, Chlamydophila pneumoniae J138
agguaauccucgauac

SEQ ID NO: 2553636 - RNA, 18 nt, Chlamydophila pneumoniae J138
agguaaugucguaccccg

SEQ ID NO: 2553637 - RNA, 13 nt, Chlamydophila pneumoniae J138
agguacuuuauag

SEQ ID NO: 2553638 - RNA, 14 nt, Chlamydophila pneumoniae J138
agguagaguccaca

SEQ ID NO: 2553639 - RNA, 16 nt, Chlamydophila pneumoniae J138
agguagaguccacagu

SEQ ID NO: 2553640 - RNA, 23 nt, Chlamydophila pneumoniae J138
agguagaguccacagucauaaaa

SEQ ID NO: 2553641 - RNA, 17 nt, Chlamydophila pneumoniae J138
agguagagugucuuccu

SEQ ID NO: 2553642 - RNA, 15 nt, Chlamydophila pneumoniae J138
agguagauagaaauu

SEQ ID NO: 2553643 - RNA, 20 nt, Chlamydophila pneumoniae J138
agguagcauaggcuaagacu

SEQ ID NO: 2553644 - RNA, 22 nt, Chlamydophila pneumoniae J138
agguaucaauaaugacucuaga

SEQ ID NO: 2553645 - RNA, 14 nt, Chlamydophila pneumoniae J138
agguaucuccuuga

SEQ ID NO: 2553646 - RNA, 12 nt, Chlamydophila pneumoniae J138
agguauuucucu

SEQ ID NO: 2553647 - RNA, 15 nt, Chlamydophila pneumoniae J138
aggucagcccugccu

SEQ ID NO: 2553648 - RNA, 19 nt, Chlamydophila pneumoniae J138
aggucgaagauucaaagaa

SEQ ID NO: 2553649 - RNA, 16 nt, Chlamydophila pneumoniae J138
aggucgcaucaaugac

SEQ ID NO: 2553650 - RNA, 18 nt, Chlamydophila pneumoniae J138
aggucugcucuauauauc

SEQ ID NO: 2553651 - RNA, 16 nt, Chlamydophila pneumoniae J138
caguugaugagaaaaa

SEQ ID NO: 2553652 - RNA, 20 nt, Chlamydophila pneumoniae J138
caguugaugagaaaaagaau

SEQ ID NO: 2553653 - RNA, 20 nt, Chlamydophila pneumoniae J138
caguugcgcgcccucuucua

SEQ ID NO: 2553654 - RNA, 13 nt, Chlamydophila pneumoniae J138
caguugcggagau

SEQ ID NO: 2553655 - RNA, 17 nt, Chlamydophila pneumoniae J138
caguuggcguuuucuag

SEQ ID NO: 2553656 - RNA, 17 nt, Chlamydophila pneumoniae J138
caguuguacaauuugcu

SEQ ID NO: 2553657 - RNA, 12 nt, Chlamydophila pneumoniae J138
caguuguuucua

SEQ ID NO: 2553658 - RNA, 21 nt, Chlamydophila pneumoniae J138
caguuuuaucggcaauuguua

SEQ ID NO: 2553659 - RNA, 14 nt, Chlamydophila pneumoniae J138
cauaaaaauuucau

SEQ ID NO: 2553660 - RNA, 15 nt, Chlamydophila pneumoniae J138
cauaaacaauucaug

SEQ ID NO: 2553661 - RNA, 20 nt, Chlamydophila pneumoniae J138
cauaaacaucgcagcaggau

SEQ ID NO: 2553662 - RNA, 16 nt, Chlamydophila pneumoniae J138
cauaaagacccuucuu

SEQ ID NO: 2553663 - RNA, 21 nt, Chlamydophila pneumoniae J138
cauaaagaucuuuauuuuuaa

SEQ ID NO: 2553664 - RNA, 23 nt, Chlamydophila pneumoniae J138
cauaaagccccacccacuccaga

SEQ ID NO: 2553665 - RNA, 15 nt, Chlamydophila pneumoniae J138
cauaaaggcucuuuu

SEQ ID NO: 2553666 - RNA, 19 nt, Chlamydophila pneumoniae J138
cauaaaggcucuuuuagag

SEQ ID NO: 2553667 - RNA, 21 nt, Chlamydophila pneumoniae J138
cauaaauacgugcuugaauau

SEQ ID NO: 2553668 - RNA, 20 nt, Chlamydophila pneumoniae J138
cauaaauaggcucuacagga

SEQ ID NO: 2553669 - RNA, 21 nt, Chlamydophila pneumoniae J138
cauaaauaggcucuacaggag

SEQ ID NO: 2553670 - RNA, 13 nt, Chlamydophila pneumoniae J138
cauaacauugcuu

SEQ ID NO: 2553671 - RNA, 15 nt, Chlamydophila pneumoniae J138
cauaacauugcuugc

SEQ ID NO: 2553672 - RNA, 18 nt, Chlamydophila pneumoniae J138
cauaacauuuagauaaag

SEQ ID NO: 2553673 - RNA, 18 nt, Chlamydophila pneumoniae J138
cauaaccucggucucgcu

SEQ ID NO: 2553674 - RNA, 13 nt, Chlamydophila pneumoniae J138
cauaaccugggca

SEQ ID NO: 2553675 - RNA, 11 nt, Chlamydophila pneumoniae J138
cauaacugugc

SEQ ID NO: 2553676 - RNA, 14 nt, Chlamydophila pneumoniae J138
cauaacuugaagaa

SEQ ID NO: 2553677 - RNA, 11 nt, Chlamydophila pneumoniae J138
cauaagaacuc

SEQ ID NO: 2553678 - RNA, 17 nt, Chlamydophila pneumoniae J138
cauaagaacucuauuug

SEQ ID NO: 2553679 - RNA, 19 nt, Chlamydophila pneumoniae J138
cauaagaacucuauuuggc

SEQ ID NO: 2553680 - RNA, 14 nt, Chlamydophila pneumoniae J138
cauaagagaacuuu

SEQ ID NO: 2553681 - RNA, 19 nt, Chlamydophila pneumoniae J138
cauaagagacauuucuuga

SEQ ID NO: 2553682 - RNA, 20 nt, Chlamydophila pneumoniae J138
cauaagauugccauguacau

SEQ ID NO: 2553683 - RNA, 17 nt, Chlamydophila pneumoniae J138
cauaagcuuuucuucca

SEQ ID NO: 2553684 - RNA, 20 nt, Chlamydophila pneumoniae J138
cauaauaagcaggaaaagca

SEQ ID NO: 2553685 - RNA, 21 nt, Chlamydophila pneumoniae J138
cauaauaagcaggaaaagcaa

SEQ ID NO: 2553686 - RNA, 20 nt, Chlamydophila pneumoniae J138
cauaauauaauaguggcuau

SEQ ID NO: 2553687 - RNA, 21 nt, Chlamydophila pneumoniae J138
cauaaucacacucguagccuu

SEQ ID NO: 2553688 - RNA, 13 nt, Chlamydophila pneumoniae J138
cauaauccaagau

SEQ ID NO: 2553689 - RNA, 20 nt, Chlamydophila pneumoniae J138
cauaauccugaauggcucug

SEQ ID NO: 2553690 - RNA, 16 nt, Chlamydophila pneumoniae J138
cauaaucucaccagaa

SEQ ID NO: 2553691 - RNA, 12 nt, Chlamydophila pneumoniae J138
cauaaucuccaa

SEQ ID NO: 2553692 - RNA, 22 nt, Chlamydophila pneumoniae J138
cauaaucuccaaacauuuuuaa

SEQ ID NO: 2553693 - RNA, 16 nt, Chlamydophila pneumoniae J138
cauaaugagacagaca

SEQ ID NO: 2553694 - RNA, 17 nt, Chlamydophila pneumoniae J138
cauaaugagacagacag

SEQ ID NO: 2553695 - RNA, 14 nt, Chlamydophila pneumoniae J138
cauaauuagaacag

SEQ ID NO: 2553696 - RNA, 13 nt, Chlamydophila pneumoniae J138
cauaauucugcac

SEQ ID NO: 2553697 - RNA, 14 nt, Chlamydophila pneumoniae J138
cauaauuuuucuua

SEQ ID NO: 2553698 - RNA, 19 nt, Chlamydophila pneumoniae J138
cauacaccccaguuucuug

SEQ ID NO: 2553699 - RNA, 23 nt, Chlamydophila pneumoniae J138
cauacaggcuccucugcuaagca

SEQ ID NO: 2553700 - RNA, 13 nt, Chlamydophila pneumoniae J138
cauacccaaauuu

SEQ ID NO: 2553701 - RNA, 17 nt, Chlamydophila pneumoniae J138
cauacccuucuucuuca

SEQ ID NO: 2553702 - RNA, 18 nt, Chlamydophila pneumoniae J138
cauacccuucuucuucag

SEQ ID NO: 2553703 - RNA, 13 nt, Chlamydophila pneumoniae J138
cauacgacaguaa

SEQ ID NO: 2553704 - RNA, 21 nt, Chlamydophila pneumoniae J138
cauacgccgugccuauagaaa

SEQ ID NO: 2553705 - RNA, 23 nt, Chlamydophila pneumoniae J138
cauacgccgugccuauagaaauu

SEQ ID NO: 2553706 - RNA, 12 nt, Chlamydophila pneumoniae J138
cauacgguauac

SEQ ID NO: 2553707 - RNA, 14 nt, Chlamydophila pneumoniae J138
cauacgguauacca

SEQ ID NO: 2553708 - RNA, 16 nt, Chlamydophila pneumoniae J138
cauacuacucucauca

SEQ ID NO: 2553709 - RNA, 14 nt, Chlamydophila pneumoniae J138
cauacucgucaaau

SEQ ID NO: 2553710 - RNA, 15 nt, Chlamydophila pneumoniae J138
cauacucgucaaauu

SEQ ID NO: 2553711 - RNA, 15 nt, Chlamydophila pneumoniae J138
cauacucuauuaagg

SEQ ID NO: 2553712 - RNA, 14 nt, Chlamydophila pneumoniae J138
cauacugauauaca

SEQ ID NO: 2553713 - RNA, 20 nt, Chlamydophila pneumoniae J138
cauacugauauacaguuggc

SEQ ID NO: 2553714 - RNA, 15 nt, Chlamydophila pneumoniae J138
cauacuuauccuuuu

SEQ ID NO: 2553715 - RNA, 20 nt, Chlamydophila pneumoniae J138
cauagaauaaagauuuuagg

SEQ ID NO: 2553716 - RNA, 23 nt, Chlamydophila pneumoniae J138
cauagagagaaggaauuaaaaua

SEQ ID NO: 2553717 - RNA, 18 nt, Chlamydophila pneumoniae J138
cauagagagccuuuccua

SEQ ID NO: 2553718 - RNA, 15 nt, Chlamydophila pneumoniae J138
cauagagauaucauc

SEQ ID NO: 2553719 - RNA, 18 nt, Chlamydophila pneumoniae J138
cauagagauaucaucaaa

SEQ ID NO: 2553720 - RNA, 21 nt, Chlamydophila pneumoniae J138
cauagagauaucaucaaaaga

SEQ ID NO: 2553721 - RNA, 15 nt, Chlamydophila pneumoniae J138
cauagagauucuaca

SEQ ID NO: 2553722 - RNA, 18 nt, Chlamydophila pneumoniae J138
cauagagugugccagaau

SEQ ID NO: 2553723 - RNA, 20 nt, Chlamydophila pneumoniae J138
cauagaguucgcacuaauuu

SEQ ID NO: 2553724 - RNA, 15 nt, Chlamydophila pneumoniae J138
cauagauacaaacau

SEQ ID NO: 2553725 - RNA, 16 nt, Chlamydophila pneumoniae J138
cauagcagcuauacgu

SEQ ID NO: 2553726 - RNA, 16 nt, Chlamydophila pneumoniae J138
cauagccaucauagca

SEQ ID NO: 2553727 - RNA, 17 nt, Chlamydophila pneumoniae J138
cauagccaucauagcaa

SEQ ID NO: 2553728 - RNA, 18 nt, Chlamydophila pneumoniae J138
cauagccaucauagcaaa

SEQ ID NO: 2553729 - RNA, 23 nt, Chlamydophila pneumoniae J138
cauagccaucauagcaaacggaa

SEQ ID NO: 2553730 - RNA, 14 nt, Chlamydophila pneumoniae J138
cauagcgaaaguca

SEQ ID NO: 2553731 - RNA, 20 nt, Chlamydophila pneumoniae J138
cauagcgaaagucaaagggc

SEQ ID NO: 2553732 - RNA, 14 nt, Chlamydophila pneumoniae J138
cauagcgagaacac

SEQ ID NO: 2553733 - RNA, 17 nt, Chlamydophila pneumoniae J138
cauagcuuuagaagccc

SEQ ID NO: 2553734 - RNA, 21 nt, Chlamydophila pneumoniae J138
cauaggaaugccaaaccucuu

SEQ ID NO: 2553735 - RNA, 17 nt, Chlamydophila pneumoniae J138
cauaggauccaggaguu

SEQ ID NO: 2553736 - RNA, 18 nt, Chlamydophila pneumoniae J138
cauagggaugacccaaaa

SEQ ID NO: 2553737 - RNA, 15 nt, Chlamydophila pneumoniae J138
cauaggggaugauuu

SEQ ID NO: 2553738 - RNA, 19 nt, Chlamydophila pneumoniae J138
cauagguaauacgagagga

SEQ ID NO: 2553739 - RNA, 16 nt, Chlamydophila pneumoniae J138
caucuuuucaaaagaa

SEQ ID NO: 2553740 - RNA, 19 nt, Chlamydophila pneumoniae J138
caucuuuucaaaagaaaag

SEQ ID NO: 2553741 - RNA, 21 nt, Chlamydophila pneumoniae J138
caugaaaagcuagucuucuua

SEQ ID NO: 2553742 - RNA, 18 nt, Chlamydophila pneumoniae J138
caugaaaauacaacggau

SEQ ID NO: 2553743 - RNA, 14 nt, Chlamydophila pneumoniae J138
caugaaagauaaug

SEQ ID NO: 2553744 - RNA, 16 nt, Chlamydophila pneumoniae J138
caugaaauuucauucu

SEQ ID NO: 2553745 - RNA, 17 nt, Chlamydophila pneumoniae J138
caugaagcagaaacuuu

SEQ ID NO: 2553746 - RNA, 15 nt, Chlamydophila pneumoniae J138
caugaaucugguucc

SEQ ID NO: 2553747 - RNA, 22 nt, Chlamydophila pneumoniae J138
caugaaucuuaugggagaagcu

SEQ ID NO: 2553748 - RNA, 15 nt, Chlamydophila pneumoniae J138
caugacauaggcaaa

SEQ ID NO: 2553749 - RNA, 22 nt, Chlamydophila pneumoniae J138
caugaccuuuaggaacuugaau

SEQ ID NO: 2553750 - RNA, 15 nt, Chlamydophila pneumoniae J138
caugacgcuuuucca

SEQ ID NO: 2553751 - RNA, 19 nt, Chlamydophila pneumoniae J138
caugacgcuuuuccaaagc

SEQ ID NO: 2553752 - RNA, 15 nt, Chlamydophila pneumoniae J138
caugacuauuuucau

SEQ ID NO: 2553753 - RNA, 23 nt, Chlamydophila pneumoniae J138
caugagagucgaaacacucauga

SEQ ID NO: 2553754 - RNA, 21 nt, Chlamydophila pneumoniae J138
caugagccgauguugcagaau

SEQ ID NO: 2553755 - RNA, 17 nt, Chlamydophila pneumoniae J138
caugagcucaggcaaca

SEQ ID NO: 2553756 - RNA, 23 nt, Chlamydophila pneumoniae J138
caugaggcugcuacgugaucaaa

SEQ ID NO: 2553757 - RNA, 23 nt, Chlamydophila pneumoniae J138
caugagggcaugccuaucuaucu

SEQ ID NO: 2553758 - RNA, 14 nt, Chlamydophila pneumoniae J138
caugaguuuuucag

SEQ ID NO: 2553759 - RNA, 20 nt, Chlamydophila pneumoniae J138
caugaguuuuucagauguac

SEQ ID NO: 2553760 - RNA, 20 nt, Chlamydophila pneumoniae J138
caugauauuuuuauuuaaaa

SEQ ID NO: 2553761 - RNA, 15 nt, Chlamydophila pneumoniae J138
caugaucuuuaggaa

SEQ ID NO: 2553762 - RNA, 22 nt, Chlamydophila pneumoniae J138
caugcacgagagccucggaagu

SEQ ID NO: 2553763 - RNA, 16 nt, Chlamydophila pneumoniae J138
caugcauagaauaaag

SEQ ID NO: 2553764 - RNA, 17 nt, Chlamydophila pneumoniae J138
caugcauagaauaaaga

SEQ ID NO: 2553765 - RNA, 13 nt, Chlamydophila pneumoniae J138
caugcauagcuga

SEQ ID NO: 2553766 - RNA, 12 nt, Chlamydophila pneumoniae J138
caugccaaauau

SEQ ID NO: 2553767 - RNA, 19 nt, Chlamydophila pneumoniae J138
caugccaaauaucucuggc

SEQ ID NO: 2553768 - RNA, 20 nt, Chlamydophila pneumoniae J138
caugccaaauaucucuggca

SEQ ID NO: 2553769 - RNA, 22 nt, Chlamydophila pneumoniae J138
caugcccccacaaaaccuggau

SEQ ID NO: 2553770 - RNA, 19 nt, Chlamydophila pneumoniae J138
caugccuaaauagcucagu

SEQ ID NO: 2553771 - RNA, 16 nt, Chlamydophila pneumoniae J138
caugccugaaaacaag

SEQ ID NO: 2553772 - RNA, 17 nt, Chlamydophila pneumoniae J138
caugcgaagggaggaga

SEQ ID NO: 2553773 - RNA, 19 nt, Chlamydophila pneumoniae J138
caugcgcagaauaaaaugg

SEQ ID NO: 2553774 - RNA, 16 nt, Chlamydophila pneumoniae J138
caugcggacuuuauuc

SEQ ID NO: 2553775 - RNA, 23 nt, Chlamydophila pneumoniae J138
caugcuaauccagcaacaaccaa

SEQ ID NO: 2553776 - RNA, 17 nt, Chlamydophila pneumoniae J138
caugcucaagaagauga

SEQ ID NO: 2553777 - RNA, 15 nt, Chlamydophila pneumoniae J138
caugcuuuccuucca

SEQ ID NO: 2553778 - RNA, 22 nt, Chlamydophila pneumoniae J138
cauggaagugcggcucucuuca

SEQ ID NO: 2553779 - RNA, 16 nt, Chlamydophila pneumoniae J138
cauggacaauauagag

SEQ ID NO: 2553780 - RNA, 15 nt, Chlamydophila pneumoniae J138
cauggacuccaagaa

SEQ ID NO: 2553781 - RNA, 15 nt, Chlamydophila pneumoniae J138
cauggauauggaaug

SEQ ID NO: 2553782 - RNA, 17 nt, Chlamydophila pneumoniae J138
cauggauauggaauggc

SEQ ID NO: 2553783 - RNA, 15 nt, Chlamydophila pneumoniae J138
cauggauucacaucu

SEQ ID NO: 2553784 - RNA, 20 nt, Chlamydophila pneumoniae J138
cauggauucacaucuuaaaa

SEQ ID NO: 2553785 - RNA, 17 nt, Chlamydophila pneumoniae J138
cauggcccgauacaaau

SEQ ID NO: 2553786 - RNA, 14 nt, Chlamydophila pneumoniae J138
cauggcgaggggcc

SEQ ID NO: 2553787 - RNA, 15 nt, Chlamydophila pneumoniae J138
cauggcguaaugcuc

SEQ ID NO: 2553788 - RNA, 15 nt, Chlamydophila pneumoniae J138
cauggcuggaaagcc

SEQ ID NO: 2553789 - RNA, 17 nt, Chlamydophila pneumoniae J138
cauggcuggaaagccaa

SEQ ID NO: 2553790 - RNA, 12 nt, Chlamydophila pneumoniae J138
cauguaaacaaa

SEQ ID NO: 2553791 - RNA, 16 nt, Chlamydophila pneumoniae J138
cauguaacugaaagua

SEQ ID NO: 2553792 - RNA, 19 nt, Chlamydophila pneumoniae J138
cauguacaguuuguaaaaa

SEQ ID NO: 2553793 - RNA, 20 nt, Chlamydophila pneumoniae J138
cauguaggaugugaaggauc

SEQ ID NO: 2553794 - RNA, 19 nt, Chlamydophila pneumoniae J138
cauguauccgaaaucugac

SEQ ID NO: 2553795 - RNA, 21 nt, Chlamydophila pneumoniae J138
cauguccuccauggaaagaaa

SEQ ID NO: 2553796 - RNA, 18 nt, Chlamydophila pneumoniae J138
caugucuaagucagaggu

SEQ ID NO: 2553797 - RNA, 17 nt, Chlamydophila pneumoniae J138
caugucuucauaugcuc

SEQ ID NO: 2553798 - RNA, 14 nt, Chlamydophila pneumoniae J138
cauguuucuuccug

SEQ ID NO: 2553799 - RNA, 12 nt, Chlamydophila pneumoniae J138
cauuaagcaauc

SEQ ID NO: 2553800 - RNA, 13 nt, Chlamydophila pneumoniae J138
cauuaaggaaucc

SEQ ID NO: 2553801 - RNA, 12 nt, Chlamydophila pneumoniae J138
cauuaaggugug

SEQ ID NO: 2553802 - RNA, 12 nt, Chlamydophila pneumoniae J138
cauuaaguacug

SEQ ID NO: 2553803 - RNA, 15 nt, Chlamydophila pneumoniae J138
cauuaauaucccagu

SEQ ID NO: 2553804 - RNA, 21 nt, Chlamydophila pneumoniae J138
cauuacacaacucuuucccua

SEQ ID NO: 2553805 - RNA, 22 nt, Chlamydophila pneumoniae J138
cauuaccugcuaaacuuuuuuu

SEQ ID NO: 2553806 - RNA, 21 nt, Chlamydophila pneumoniae J138
cauuagcaagagcucuugaga

SEQ ID NO: 2553807 - RNA, 22 nt, Chlamydophila pneumoniae J138
cauuagcccuacgaauccaaaa

SEQ ID NO: 2553808 - RNA, 19 nt, Chlamydophila pneumoniae J138
cauuaucaagaaauucuuc

SEQ ID NO: 2553809 - RNA, 16 nt, Chlamydophila pneumoniae J138
cauuaucacagaugua

SEQ ID NO: 2553810 - RNA, 15 nt, Chlamydophila pneumoniae J138
cauuaucacagcaau

SEQ ID NO: 2553811 - RNA, 21 nt, Chlamydophila pneumoniae J138
cauuaucuucguaauaacuau

SEQ ID NO: 2553812 - RNA, 15 nt, Chlamydophila pneumoniae J138
cauuauuaaacgaau

SEQ ID NO: 2553813 - RNA, 13 nt, Chlamydophila pneumoniae J138
cauuauucccuaa

SEQ ID NO: 2553814 - RNA, 13 nt, Chlamydophila pneumoniae J138
cauucacuaaaua

SEQ ID NO: 2553815 - RNA, 12 nt, Chlamydophila pneumoniae J138
cauucauuuuuu

SEQ ID NO: 2553816 - RNA, 13 nt, Chlamydophila pneumoniae J138
cauucauuuuuua

SEQ ID NO: 2553817 - RNA, 19 nt, Chlamydophila pneumoniae J138
cauucauuuuuuaauaaaa

SEQ ID NO: 2553818 - RNA, 20 nt, Chlamydophila pneumoniae J138
cauuccaagauugaauucau

SEQ ID NO: 2553819 - RNA, 15 nt, Chlamydophila pneumoniae J138
cauuccagcaucuuc

SEQ ID NO: 2553820 - RNA, 20 nt, Chlamydophila pneumoniae J138
cauuccaggacguaaaaaga

SEQ ID NO: 2553821 - RNA, 17 nt, Chlamydophila pneumoniae J138
cauuccgagcugcaaac

SEQ ID NO: 2553822 - RNA, 12 nt, Chlamydophila pneumoniae J138
cauuccugcagu

SEQ ID NO: 2553823 - RNA, 13 nt, Chlamydophila pneumoniae J138
cauucuauucuau

SEQ ID NO: 2553824 - RNA, 15 nt, Chlamydophila pneumoniae J138
cauucucaugucuaa

SEQ ID NO: 2553825 - RNA, 17 nt, Chlamydophila pneumoniae J138
cauucuugaagaucucc

SEQ ID NO: 2553826 - RNA, 14 nt, Chlamydophila pneumoniae J138
cauucuuucgauau

SEQ ID NO: 2553827 - RNA, 22 nt, Chlamydophila pneumoniae J138
cauugaagagcuugcuguacga

SEQ ID NO: 2553828 - RNA, 17 nt, Chlamydophila pneumoniae J138
cauugaccugcuuuuuu

SEQ ID NO: 2553829 - RNA, 22 nt, Chlamydophila pneumoniae J138
cauugacgcuuaaaaucagcac

SEQ ID NO: 2553830 - RNA, 17 nt, Chlamydophila pneumoniae J138
cauugaugcuuaagagu

SEQ ID NO: 2553831 - RNA, 23 nt, Chlamydophila pneumoniae J138
cauugcaaauaagccaguacuaa

SEQ ID NO: 2553832 - RNA, 23 nt, Chlamydophila pneumoniae J138
cauugcuauugaaaaaucccugu

SEQ ID NO: 2553833 - RNA, 19 nt, Chlamydophila pneumoniae J138
cauuggcuccuaaggaaac

SEQ ID NO: 2553834 - RNA, 20 nt, Chlamydophila pneumoniae J138
cauuguggaacgcauaagag

SEQ ID NO: 2553835 - RNA, 13 nt, Chlamydophila pneumoniae J138
cauuguuuaaguc

SEQ ID NO: 2553836 - RNA, 23 nt, Chlamydophila pneumoniae J138
cauuguuuguccuaggagagcua

SEQ ID NO: 2553837 - RNA, 18 nt, Chlamydophila pneumoniae J138
cauuuaaacuaagaauac

SEQ ID NO: 2553838 - RNA, 20 nt, Chlamydophila pneumoniae J138
cauuuaaagcugaaauucuu

SEQ ID NO: 2553839 - RNA, 23 nt, Chlamydophila pneumoniae J138
ccacuccagaaaguauuccucuu

SEQ ID NO: 2553840 - RNA, 15 nt, Chlamydophila pneumoniae J138
ccacugaccugauac

SEQ ID NO: 2553841 - RNA, 15 nt, Chlamydophila pneumoniae J138
ccacuggacuucguu

SEQ ID NO: 2553842 - RNA, 15 nt, Chlamydophila pneumoniae J138
ccacuugcauggauc

SEQ ID NO: 2553843 - RNA, 21 nt, Chlamydophila pneumoniae J138
ccacuugcauggauccuucau

SEQ ID NO: 2553844 - RNA, 22 nt, Chlamydophila pneumoniae J138
ccacuuuuaauuucuuacaaga

SEQ ID NO: 2553845 - RNA, 22 nt, Chlamydophila pneumoniae J138
ccacuuuuuucccuccaccaga

SEQ ID NO: 2553846 - RNA, 21 nt, Chlamydophila pneumoniae J138
ccagaaacgcagcuuuccuuu

SEQ ID NO: 2553847 - RNA, 12 nt, Chlamydophila pneumoniae J138
ccagaaaguauu

SEQ ID NO: 2553848 - RNA, 14 nt, Chlamydophila pneumoniae J138
ccagaaauuacugu

SEQ ID NO: 2553849 - RNA, 14 nt, Chlamydophila pneumoniae J138
ccagaaauuuuuac

SEQ ID NO: 2553850 - RNA, 16 nt, Chlamydophila pneumoniae J138
ccagaaauuuuuacaa

SEQ ID NO: 2553851 - RNA, 21 nt, Chlamydophila pneumoniae J138
ccagaacaccaucacauccug

SEQ ID NO: 2553852 - RNA, 12 nt, Chlamydophila pneumoniae J138
ccagaaggaagg

SEQ ID NO: 2553853 - RNA, 16 nt, Chlamydophila pneumoniae J138
ccagacuuuccucucu

SEQ ID NO: 2553854 - RNA, 23 nt, Chlamydophila pneumoniae J138
ccagagagcuuuuagguagagaa

SEQ ID NO: 2553855 - RNA, 14 nt, Chlamydophila pneumoniae J138
ccagagauucuuca

SEQ ID NO: 2553856 - RNA, 18 nt, Chlamydophila pneumoniae J138
ccagauaaagcaaagaua

SEQ ID NO: 2553857 - RNA, 18 nt, Chlamydophila pneumoniae J138
ccagauucugaagagaga

SEQ ID NO: 2553858 - RNA, 19 nt, Chlamydophila pneumoniae J138
ccagauuguucaaaaauag

SEQ ID NO: 2553859 - RNA, 22 nt, Chlamydophila pneumoniae J138
ccagauuuuuuugguugcuucu

SEQ ID NO: 2553860 - RNA, 20 nt, Chlamydophila pneumoniae J138
ccagcaccuuuaggaagcug

SEQ ID NO: 2553861 - RNA, 23 nt, Chlamydophila pneumoniae J138
ccagcaccuuuaggaagcuguac

SEQ ID NO: 2553862 - RNA, 14 nt, Chlamydophila pneumoniae J138
ccagcaucuucucg

SEQ ID NO: 2553863 - RNA, 17 nt, Chlamydophila pneumoniae J138
ccagcucgagaucuuuu

SEQ ID NO: 2553864 - RNA, 15 nt, Chlamydophila pneumoniae J138
ccagcugugguggug

SEQ ID NO: 2553865 - RNA, 17 nt, Chlamydophila pneumoniae J138
ccaggaauagaaagaca

SEQ ID NO: 2553866 - RNA, 22 nt, Chlamydophila pneumoniae J138
ccaggaauagaaagacauccuu

SEQ ID NO: 2553867 - RNA, 22 nt, Chlamydophila pneumoniae J138
ccaggagacuaaaagaauaaua

SEQ ID NO: 2553868 - RNA, 18 nt, Chlamydophila pneumoniae J138
ccaggagagcuaacagca

SEQ ID NO: 2553869 - RNA, 14 nt, Chlamydophila pneumoniae J138
ccaggauggcuccu

SEQ ID NO: 2553870 - RNA, 15 nt, Chlamydophila pneumoniae J138
ccagggaucuucauc

SEQ ID NO: 2553871 - RNA, 23 nt, Chlamydophila pneumoniae J138
ccagggaucuucaucccuacccu

SEQ ID NO: 2553872 - RNA, 20 nt, Chlamydophila pneumoniae J138
ccaggguguuugcauaguau

SEQ ID NO: 2553873 - RNA, 19 nt, Chlamydophila pneumoniae J138
ccagguguagguuccugcu

SEQ ID NO: 2553874 - RNA, 23 nt, Chlamydophila pneumoniae J138
ccaguagaucuucugaaaucaaa

SEQ ID NO: 2553875 - RNA, 16 nt, Chlamydophila pneumoniae J138
ccaguucuugaaacuc

SEQ ID NO: 2553876 - RNA, 19 nt, Chlamydophila pneumoniae J138
ccaguuguauccagcucaa

SEQ ID NO: 2553877 - RNA, 17 nt, Chlamydophila pneumoniae J138
ccaguuucuugauauuu

SEQ ID NO: 2553878 - RNA, 18 nt, Chlamydophila pneumoniae J138
ccaguuuuccauccacga

SEQ ID NO: 2553879 - RNA, 21 nt, Chlamydophila pneumoniae J138
ccauaaaaauguaauuuuuuc

SEQ ID NO: 2553880 - RNA, 21 nt, Chlamydophila pneumoniae J138
ccauaaauacaggccugaugu

SEQ ID NO: 2553881 - RNA, 12 nt, Chlamydophila pneumoniae J138
ccauaaauguau

SEQ ID NO: 2553882 - RNA, 10 nt, Chlamydophila pneumoniae J138
ccauaacagu

SEQ ID NO: 2553883 - RNA, 22 nt, Chlamydophila pneumoniae J138
ccauaagaaugguuauuucuug

SEQ ID NO: 2553884 - RNA, 15 nt, Chlamydophila pneumoniae J138
ccauaagaucaauau

SEQ ID NO: 2553885 - RNA, 19 nt, Chlamydophila pneumoniae J138
ccauaagaucaauauagag

SEQ ID NO: 2553886 - RNA, 17 nt, Chlamydophila pneumoniae J138
ccauaagcuuuucuucc

SEQ ID NO: 2553887 - RNA, 20 nt, Chlamydophila pneumoniae J138
ccauaagcuuuucuuccaaa

SEQ ID NO: 2553888 - RNA, 19 nt, Chlamydophila pneumoniae J138
ccauaaggagauuccuaaa

SEQ ID NO: 2553889 - RNA, 13 nt, Chlamydophila pneumoniae J138
ccauaauaaaggu

SEQ ID NO: 2553890 - RNA, 22 nt, Chlamydophila pneumoniae J138
ccauaaugagacagacagucug

SEQ ID NO: 2553891 - RNA, 22 nt, Chlamydophila pneumoniae J138
ccauaauuagaacagcauggac

SEQ ID NO: 2553892 - RNA, 19 nt, Chlamydophila pneumoniae J138
ccauaauuuuagcuucuuu

SEQ ID NO: 2553893 - RNA, 15 nt, Chlamydophila pneumoniae J138
ccauacauagggaaa

SEQ ID NO: 2553894 - RNA, 12 nt, Chlamydophila pneumoniae J138
ccauacccaaau

SEQ ID NO: 2553895 - RNA, 16 nt, Chlamydophila pneumoniae J138
ccauacugauauacag

SEQ ID NO: 2553896 - RNA, 18 nt, Chlamydophila pneumoniae J138
ccauacugauauacaguu

SEQ ID NO: 2553897 - RNA, 16 nt, Chlamydophila pneumoniae J138
ccauagaguaucuaaa

SEQ ID NO: 2553898 - RNA, 19 nt, Chlamydophila pneumoniae J138
ccauagcgauagcuaaacc

SEQ ID NO: 2553899 - RNA, 15 nt, Chlamydophila pneumoniae J138
ccauaggaucugcau

SEQ ID NO: 2553900 - RNA, 15 nt, Chlamydophila pneumoniae J138
ccauauaauagauau

SEQ ID NO: 2553901 - RNA, 17 nt, Chlamydophila pneumoniae J138
ccauauuugaauaaagg

SEQ ID NO: 2553902 - RNA, 18 nt, Chlamydophila pneumoniae J138
ccauauuugaauaaagga

SEQ ID NO: 2553903 - RNA, 14 nt, Chlamydophila pneumoniae J138
ccaucaagguauug

SEQ ID NO: 2553904 - RNA, 17 nt, Chlamydophila pneumoniae J138
ccaucacauaaaucaac

SEQ ID NO: 2553905 - RNA, 14 nt, Chlamydophila pneumoniae J138
ccaucacuuccugu

SEQ ID NO: 2553906 - RNA, 15 nt, Chlamydophila pneumoniae J138
ccaucauaauuugac

SEQ ID NO: 2553907 - RNA, 17 nt, Chlamydophila pneumoniae J138
ccaucaucgaagaacuu

SEQ ID NO: 2553908 - RNA, 18 nt, Chlamydophila pneumoniae J138
ccaucaucgaagaacuua

SEQ ID NO: 2553909 - RNA, 13 nt, Chlamydophila pneumoniae J138
ccauccacgaccu

SEQ ID NO: 2553910 - RNA, 17 nt, Chlamydophila pneumoniae J138
ccauccacgaccucgaa

SEQ ID NO: 2553911 - RNA, 17 nt, Chlamydophila pneumoniae J138
ccauccacgaccugcaa

SEQ ID NO: 2553912 - RNA, 18 nt, Chlamydophila pneumoniae J138
ccauccacgaccugcaaa

SEQ ID NO: 2553913 - RNA, 14 nt, Chlamydophila pneumoniae J138
ccauccucagucuc

SEQ ID NO: 2553914 - RNA, 22 nt, Chlamydophila pneumoniae J138
ccauccugucuauuucuuaauu

SEQ ID NO: 2553915 - RNA, 22 nt, Chlamydophila pneumoniae J138
ccaucggaauuugccugaaauc

SEQ ID NO: 2553916 - RNA, 14 nt, Chlamydophila pneumoniae J138
ccaucuaauccugu

SEQ ID NO: 2553917 - RNA, 15 nt, Chlamydophila pneumoniae J138
ccaucuaauccuguu

SEQ ID NO: 2553918 - RNA, 20 nt, Chlamydophila pneumoniae J138
ccaucucaugcggacuuuau

SEQ ID NO: 2553919 - RNA, 20 nt, Chlamydophila pneumoniae J138
ccaucucuuucuauuucguc

SEQ ID NO: 2553920 - RNA, 16 nt, Chlamydophila pneumoniae J138
ccaucuuguucuaaaa

SEQ ID NO: 2553921 - RNA, 19 nt, Chlamydophila pneumoniae J138
ccaugacuugacacaggag

SEQ ID NO: 2553922 - RNA, 17 nt, Chlamydophila pneumoniae J138
ccaugaguuuuucagau

SEQ ID NO: 2553923 - RNA, 14 nt, Chlamydophila pneumoniae J138
ccaugcuuaucuau

SEQ ID NO: 2553924 - RNA, 16 nt, Chlamydophila pneumoniae J138
ccauggauauggaaug

SEQ ID NO: 2553925 - RNA, 17 nt, Chlamydophila pneumoniae J138
ccauggcuggaaagcca

SEQ ID NO: 2553926 - RNA, 18 nt, Chlamydophila pneumoniae J138
ccauguacaugcaggcga

SEQ ID NO: 2553927 - RNA, 19 nt, Chlamydophila pneumoniae J138
ccaugucuaaagauuggaa

SEQ ID NO: 2553928 - RNA, 21 nt, Chlamydophila pneumoniae J138
ccaugucuaaagauuggaaua

SEQ ID NO: 2553929 - RNA, 15 nt, Chlamydophila pneumoniae J138
ccaugucuaaaggag

SEQ ID NO: 2553930 - RNA, 17 nt, Chlamydophila pneumoniae J138
ccaugucuaaaggagug

SEQ ID NO: 2553931 - RNA, 16 nt, Chlamydophila pneumoniae J138
ccauguuucuuccuga

SEQ ID NO: 2553932 - RNA, 23 nt, Chlamydophila pneumoniae J138
ccauuaaauuguauggaauucaa

SEQ ID NO: 2553933 - RNA, 12 nt, Chlamydophila pneumoniae J138
ccauuaaggaau

SEQ ID NO: 2553934 - RNA, 13 nt, Chlamydophila pneumoniae J138
ccauuaaggaauc

SEQ ID NO: 2553935 - RNA, 17 nt, Chlamydophila pneumoniae J138
ccauuaauaucccaguu

SEQ ID NO: 2553936 - RNA, 17 nt, Chlamydophila pneumoniae J138
ccauuagggcauucugu

SEQ ID NO: 2553937 - RNA, 14 nt, Chlamydophila pneumoniae J138
ccauuauacuuuuu

SEQ ID NO: 2553938 - RNA, 21 nt, Chlamydophila pneumoniae J138
ccauucaauaauuucaaagau

SEQ ID NO: 2553939 - RNA, 14 nt, Chlamydophila pneumoniae J138
ccauucacaaaucu

SEQ ID NO: 2553940 - RNA, 18 nt, Chlamydophila pneumoniae J138
ccauucacaaaucuuccc

SEQ ID NO: 2553941 - RNA, 20 nt, Chlamydophila pneumoniae J138
ccauucagauggucagucuc

SEQ ID NO: 2553942 - RNA, 15 nt, Chlamydophila pneumoniae J138
ccauuccuuaggaug

SEQ ID NO: 2553943 - RNA, 14 nt, Chlamydophila pneumoniae J138
ccauucuuaucugc

SEQ ID NO: 2553944 - RNA, 14 nt, Chlamydophila pneumoniae J138
ccauucuugaagau

SEQ ID NO: 2553945 - RNA, 22 nt, Chlamydophila pneumoniae J138
ccauugaucagaaucuaaguaa

SEQ ID NO: 2553946 - RNA, 15 nt, Chlamydophila pneumoniae J138
ccauuguuguugcau

SEQ ID NO: 2553947 - RNA, 13 nt, Chlamydophila pneumoniae J138
ccauuucauguaa

SEQ ID NO: 2553948 - RNA, 18 nt, Chlamydophila pneumoniae J138
ccauuucauguaagaaug

SEQ ID NO: 2553949 - RNA, 20 nt, Chlamydophila pneumoniae J138
ccauuucuaggaauugcugu

SEQ ID NO: 2553950 - RNA, 13 nt, Chlamydophila pneumoniae J138
ccauuuucuaaga

SEQ ID NO: 2553951 - RNA, 22 nt, Chlamydophila pneumoniae J138
ccauuuuugaauaugauuucca

SEQ ID NO: 2553952 - RNA, 19 nt, Chlamydophila pneumoniae J138
cccaaacugaugccaagaa

SEQ ID NO: 2553953 - RNA, 19 nt, Chlamydophila pneumoniae J138
cccaaauagcuacagcgcu

SEQ ID NO: 2553954 - RNA, 20 nt, Chlamydophila pneumoniae J138
cccaagggccgaaccaaaau

SEQ ID NO: 2553955 - RNA, 22 nt, Chlamydophila pneumoniae J138
cccaaguuguagugaaugagcu

SEQ ID NO: 2553956 - RNA, 16 nt, Chlamydophila pneumoniae J138
cccaauauccagaaau

SEQ ID NO: 2553957 - RNA, 21 nt, Chlamydophila pneumoniae J138
aggucugcucuauauauccug

SEQ ID NO: 2553958 - RNA, 17 nt, Chlamydophila pneumoniae J138
aggucugcugaggagag

SEQ ID NO: 2553959 - RNA, 17 nt, Chlamydophila pneumoniae J138
aggucuuccaucucuuu

SEQ ID NO: 2553960 - RNA, 16 nt, Chlamydophila pneumoniae J138
aggucuuuuccuguag

SEQ ID NO: 2553961 - RNA, 15 nt, Chlamydophila pneumoniae J138
aggucuuuucuuuuu

SEQ ID NO: 2553962 - RNA, 15 nt, Chlamydophila pneumoniae J138
aggugauauuuucuu

SEQ ID NO: 2553963 - RNA, 17 nt, Chlamydophila pneumoniae J138
aggugcggaacucauca

SEQ ID NO: 2553964 - RNA, 22 nt, Chlamydophila pneumoniae J138
agguguuuuggcugcuuuuguu

SEQ ID NO: 2553965 - RNA, 14 nt, Chlamydophila pneumoniae J138
agguuagaagggag

SEQ ID NO: 2553966 - RNA, 16 nt, Chlamydophila pneumoniae J138
agguuauguacuagau

SEQ ID NO: 2553967 - RNA, 18 nt, Chlamydophila pneumoniae J138
agguuauuaucaaaguga

SEQ ID NO: 2553968 - RNA, 21 nt, Chlamydophila pneumoniae J138
agguuccacagagaccuucuc

SEQ ID NO: 2553969 - RNA, 22 nt, Chlamydophila pneumoniae J138
agguuccacagagaccuucucu

SEQ ID NO: 2553970 - RNA, 14 nt, Chlamydophila pneumoniae J138
agguugcuuuucua

SEQ ID NO: 2553971 - RNA, 15 nt, Chlamydophila pneumoniae J138
agguugcuuuucuag

SEQ ID NO: 2553972 - RNA, 23 nt, Chlamydophila pneumoniae J138
agguuugcaauuuucucaauagu

SEQ ID NO: 2553973 - RNA, 22 nt, Chlamydophila pneumoniae J138
agguuuuaaaaugugucuugcu

SEQ ID NO: 2553974 - RNA, 18 nt, Chlamydophila pneumoniae J138
agguuuuaaauuuagagg

SEQ ID NO: 2553975 - RNA, 22 nt, Chlamydophila pneumoniae J138
aguaaaaucauaggcuauaauu

SEQ ID NO: 2553976 - RNA, 15 nt, Chlamydophila pneumoniae J138
aguaaaauuucugua

SEQ ID NO: 2553977 - RNA, 22 nt, Chlamydophila pneumoniae J138
aguaaaauuucuguagugagau

SEQ ID NO: 2553978 - RNA, 12 nt, Chlamydophila pneumoniae J138
aguaaagccaca

SEQ ID NO: 2553979 - RNA, 20 nt, Chlamydophila pneumoniae J138
aguaaagccacauucuucug

SEQ ID NO: 2553980 - RNA, 23 nt, Chlamydophila pneumoniae J138
aguaaccaauacagcauaaaaau

SEQ ID NO: 2553981 - RNA, 15 nt, Chlamydophila pneumoniae J138
aguaacuaucuacac

SEQ ID NO: 2553982 - RNA, 14 nt, Chlamydophila pneumoniae J138
aguaacugcaaaga

SEQ ID NO: 2553983 - RNA, 16 nt, Chlamydophila pneumoniae J138
aguaacugcaaagaga

SEQ ID NO: 2553984 - RNA, 19 nt, Chlamydophila pneumoniae J138
aguaacuuaaucaauccua

SEQ ID NO: 2553985 - RNA, 21 nt, Chlamydophila pneumoniae J138
aguaagcgauuucgacagcag

SEQ ID NO: 2553986 - RNA, 19 nt, Chlamydophila pneumoniae J138
aguaaggaacaauguaaau

SEQ ID NO: 2553987 - RNA, 23 nt, Chlamydophila pneumoniae J138
aguaauaucuccgccauaacacu

SEQ ID NO: 2553988 - RNA, 20 nt, Chlamydophila pneumoniae J138
aguaaucacuucagcacgaa

SEQ ID NO: 2553989 - RNA, 14 nt, Chlamydophila pneumoniae J138
aguaauuacagcuu

SEQ ID NO: 2553990 - RNA, 23 nt, Chlamydophila pneumoniae J138
aguaauuauuuucuacacuguug

SEQ ID NO: 2553991 - RNA, 22 nt, Chlamydophila pneumoniae J138
aguaauuccaaaauaaaaggag

SEQ ID NO: 2553992 - RNA, 23 nt, Chlamydophila pneumoniae J138
aguaauuccaaaauaaaaggagc

SEQ ID NO: 2553993 - RNA, 19 nt, Chlamydophila pneumoniae J138
aguaauuccccuuuaaagc

SEQ ID NO: 2553994 - RNA, 15 nt, Chlamydophila pneumoniae J138
aguaccaagaaaaua

SEQ ID NO: 2553995 - RNA, 15 nt, Chlamydophila pneumoniae J138
aguacccagucaucg

SEQ ID NO: 2553996 - RNA, 16 nt, Chlamydophila pneumoniae J138
aguaccuaggaucuac

SEQ ID NO: 2553997 - RNA, 22 nt, Chlamydophila pneumoniae J138
aguaccuucucgucauucugca

SEQ ID NO: 2553998 - RNA, 23 nt, Chlamydophila pneumoniae J138
aguaccuucucgucauucugcaa

SEQ ID NO: 2553999 - RNA, 18 nt, Chlamydophila pneumoniae J138
aguacgaccaacuccuca

SEQ ID NO: 2554000 - RNA, 14 nt, Chlamydophila pneumoniae J138
aguacgcaaaguac

SEQ ID NO: 2554001 - RNA, 17 nt, Chlamydophila pneumoniae J138
aguacgcaguaucguaa

SEQ ID NO: 2554002 - RNA, 18 nt, Chlamydophila pneumoniae J138
aguacuuauccugaacau

SEQ ID NO: 2554003 - RNA, 19 nt, Chlamydophila pneumoniae J138
aguacuuauccugaacauc

SEQ ID NO: 2554004 - RNA, 15 nt, Chlamydophila pneumoniae J138
aguacuucuuacccu

SEQ ID NO: 2554005 - RNA, 16 nt, Chlamydophila pneumoniae J138
aguagaacugcgaagg

SEQ ID NO: 2554006 - RNA, 17 nt, Chlamydophila pneumoniae J138
aguagaauccuucuccc

SEQ ID NO: 2554007 - RNA, 19 nt, Chlamydophila pneumoniae J138
aguagagccucuaagaaaa

SEQ ID NO: 2554008 - RNA, 18 nt, Chlamydophila pneumoniae J138
aguagaggaauucuggaa

SEQ ID NO: 2554009 - RNA, 15 nt, Chlamydophila pneumoniae J138
aguagaucuucugaa

SEQ ID NO: 2554010 - RNA, 21 nt, Chlamydophila pneumoniae J138
aguagaucuucugaaaucaaa

SEQ ID NO: 2554011 - RNA, 22 nt, Chlamydophila pneumoniae J138
aguagaucuucugaaaucaaaa

SEQ ID NO: 2554012 - RNA, 17 nt, Chlamydophila pneumoniae J138
aguagcauccuguagag

SEQ ID NO: 2554013 - RNA, 21 nt, Chlamydophila pneumoniae J138
aguagccagacuggucuaacu

SEQ ID NO: 2554014 - RNA, 22 nt, Chlamydophila pneumoniae J138
aguagcgaauccagaauuuucu

SEQ ID NO: 2554015 - RNA, 20 nt, Chlamydophila pneumoniae J138
aguagcucucuccuggagag

SEQ ID NO: 2554016 - RNA, 15 nt, Chlamydophila pneumoniae J138
aguagcuugugcuaa

SEQ ID NO: 2554017 - RNA, 12 nt, Chlamydophila pneumoniae J138
aguaggaauuuu

SEQ ID NO: 2554018 - RNA, 15 nt, Chlamydophila pneumoniae J138
aguaggcgaugcaaa

SEQ ID NO: 2554019 - RNA, 20 nt, Chlamydophila pneumoniae J138
aguaggcgaugcaaauucca

SEQ ID NO: 2554020 - RNA, 18 nt, Chlamydophila pneumoniae J138
aguaggucucccuggucu

SEQ ID NO: 2554021 - RNA, 17 nt, Chlamydophila pneumoniae J138
aguagucgauugccgug

SEQ ID NO: 2554022 - RNA, 13 nt, Chlamydophila pneumoniae J138
aguauaaucagaa

SEQ ID NO: 2554023 - RNA, 15 nt, Chlamydophila pneumoniae J138
aguauacaagcgaaa

SEQ ID NO: 2554024 - RNA, 11 nt, Chlamydophila pneumoniae J138
aguauagagaa

SEQ ID NO: 2554025 - RNA, 19 nt, Chlamydophila pneumoniae J138
aguauagcaugaucuuuag

SEQ ID NO: 2554026 - RNA, 14 nt, Chlamydophila pneumoniae J138
aguauagucugguu

SEQ ID NO: 2554027 - RNA, 17 nt, Chlamydophila pneumoniae J138
aguaucgggauuuuguc

SEQ ID NO: 2554028 - RNA, 23 nt, Chlamydophila pneumoniae J138
aguaucgggauuuugucgagaac

SEQ ID NO: 2554029 - RNA, 12 nt, Chlamydophila pneumoniae J138
aguaucuucucu

SEQ ID NO: 2554030 - RNA, 17 nt, Chlamydophila pneumoniae J138
aguaugaggagauaaag

SEQ ID NO: 2554031 - RNA, 19 nt, Chlamydophila pneumoniae J138
aguaugaggagauaaagau

SEQ ID NO: 2554032 - RNA, 16 nt, Chlamydophila pneumoniae J138
aguauggcaaauaaaa

SEQ ID NO: 2554033 - RNA, 14 nt, Chlamydophila pneumoniae J138
aguauggcauucuu

SEQ ID NO: 2554034 - RNA, 22 nt, Chlamydophila pneumoniae J138
aguauggcguuuuuuuugauuu

SEQ ID NO: 2554035 - RNA, 15 nt, Chlamydophila pneumoniae J138
aguauuaaagaugaa

SEQ ID NO: 2554036 - RNA, 21 nt, Chlamydophila pneumoniae J138
aguauuaaagaugaaguuccc

SEQ ID NO: 2554037 - RNA, 14 nt, Chlamydophila pneumoniae J138
aguauuaaucuuau

SEQ ID NO: 2554038 - RNA, 18 nt, Chlamydophila pneumoniae J138
aguauuauaaauagaaau

SEQ ID NO: 2554039 - RNA, 18 nt, Chlamydophila pneumoniae J138
aguauuccaucacaguua

SEQ ID NO: 2554040 - RNA, 15 nt, Chlamydophila pneumoniae J138
aguauucccuccgca

SEQ ID NO: 2554041 - RNA, 19 nt, Chlamydophila pneumoniae J138
aguauucgauuccugaggc

SEQ ID NO: 2554042 - RNA, 21 nt, Chlamydophila pneumoniae J138
aguauucuguggaauaucagg

SEQ ID NO: 2554043 - RNA, 14 nt, Chlamydophila pneumoniae J138
aguauuuuuaaaua

SEQ ID NO: 2554044 - RNA, 21 nt, Chlamydophila pneumoniae J138
aguauuuuuaaauacagauuc

SEQ ID NO: 2554045 - RNA, 13 nt, Chlamydophila pneumoniae J138
agucaaaaauucu

SEQ ID NO: 2554046 - RNA, 12 nt, Chlamydophila pneumoniae J138
agucaaacauca

SEQ ID NO: 2554047 - RNA, 17 nt, Chlamydophila pneumoniae J138
agucaaaggauccauaa

SEQ ID NO: 2554048 - RNA, 20 nt, Chlamydophila pneumoniae J138
agucaaaggauccauaaccu

SEQ ID NO: 2554049 - RNA, 16 nt, Chlamydophila pneumoniae J138
agucaaauacuucucc

SEQ ID NO: 2554050 - RNA, 20 nt, Chlamydophila pneumoniae J138
agucaaauacuucuccugaa

SEQ ID NO: 2554051 - RNA, 22 nt, Chlamydophila pneumoniae J138
agucaaauacuucuccugaacc

SEQ ID NO: 2554052 - RNA, 16 nt, Chlamydophila pneumoniae J138
agucacaaauuuuugc

SEQ ID NO: 2554053 - RNA, 13 nt, Chlamydophila pneumoniae J138
agucacacuuucc

SEQ ID NO: 2554054 - RNA, 16 nt, Chlamydophila pneumoniae J138
agucaccuuacaucca

SEQ ID NO: 2554055 - RNA, 24 nt, Chlamydophila pneumoniae J138
agucacggcgaaagcuacagcuaa

SEQ ID NO: 2554056 - RNA, 17 nt, Chlamydophila pneumoniae J138
agucagguaaagagcuu

SEQ ID NO: 2554057 - RNA, 23 nt, Chlamydophila pneumoniae J138
auuaaaaguucagcaaggaaguu

SEQ ID NO: 2554058 - RNA, 16 nt, Chlamydophila pneumoniae J138
auuaaacgaauacugu

SEQ ID NO: 2554059 - RNA, 17 nt, Chlamydophila pneumoniae J138
auuaaagugaaagcaac

SEQ ID NO: 2554060 - RNA, 18 nt, Chlamydophila pneumoniae J138
auuaaauauauaaagaac

SEQ ID NO: 2554061 - RNA, 18 nt, Chlamydophila pneumoniae J138
auuaaaucguacuucacu

SEQ ID NO: 2554062 - RNA, 19 nt, Chlamydophila pneumoniae J138
auuaaaucguacuucacuu

SEQ ID NO: 2554063 - RNA, 19 nt, Chlamydophila pneumoniae J138
auuaaaucguauugacuuu

SEQ ID NO: 2554064 - RNA, 18 nt, Chlamydophila pneumoniae J138
auuaaauucuuuucuaca

SEQ ID NO: 2554065 - RNA, 24 nt, Chlamydophila pneumoniae J138
auuaaauucuuuucuacaugcuca

SEQ ID NO: 2554066 - RNA, 22 nt, Chlamydophila pneumoniae J138
auuaacuccucggcaacuacug

SEQ ID NO: 2554067 - RNA, 18 nt, Chlamydophila pneumoniae J138
auuaacuuuauacagcug

SEQ ID NO: 2554068 - RNA, 20 nt, Chlamydophila pneumoniae J138
auuaagaagaaccucauuuu

SEQ ID NO: 2554069 - RNA, 14 nt, Chlamydophila pneumoniae J138
auuaagaauggaug

SEQ ID NO: 2554070 - RNA, 17 nt, Chlamydophila pneumoniae J138
auuaagacucaauacuu

SEQ ID NO: 2554071 - RNA, 20 nt, Chlamydophila pneumoniae J138
auuaagacucaauacuucag

SEQ ID NO: 2554072 - RNA, 20 nt, Chlamydophila pneumoniae J138
auuaagauaaacagcacagg

SEQ ID NO: 2554073 - RNA, 18 nt, Chlamydophila pneumoniae J138
auuaagauaaacauuaag

SEQ ID NO: 2554074 - RNA, 19 nt, Chlamydophila pneumoniae J138
auuaagauagacucucacu

SEQ ID NO: 2554075 - RNA, 11 nt, Chlamydophila pneumoniae J138
auuaagauauc

SEQ ID NO: 2554076 - RNA, 18 nt, Chlamydophila pneumoniae J138
auuaagauccuuuaaaga

SEQ ID NO: 2554077 - RNA, 15 nt, Chlamydophila pneumoniae J138
auuaaggcuccagca

SEQ ID NO: 2554078 - RNA, 13 nt, Chlamydophila pneumoniae J138
auuaagucaccuu

SEQ ID NO: 2554079 - RNA, 15 nt, Chlamydophila pneumoniae J138
auuaagucaccuuaa

SEQ ID NO: 2554080 - RNA, 13 nt, Chlamydophila pneumoniae J138
auuaauaaauuua

SEQ ID NO: 2554081 - RNA, 17 nt, Chlamydophila pneumoniae J138
auuaauacuuugccaac

SEQ ID NO: 2554082 - RNA, 16 nt, Chlamydophila pneumoniae J138
auuaauaucccaguuu

SEQ ID NO: 2554083 - RNA, 20 nt, Chlamydophila pneumoniae J138
auuaauaucccaguuuuccc

SEQ ID NO: 2554084 - RNA, 22 nt, Chlamydophila pneumoniae J138
auuaauccuugagggcuaucca

SEQ ID NO: 2554085 - RNA, 23 nt, Chlamydophila pneumoniae J138
auuaauccuugagggcuauccac

SEQ ID NO: 2554086 - RNA, 19 nt, Chlamydophila pneumoniae J138
auuacacaacucuuucccu

SEQ ID NO: 2554087 - RNA, 12 nt, Chlamydophila pneumoniae J138
auuacagaaagg

SEQ ID NO: 2554088 - RNA, 18 nt, Chlamydophila pneumoniae J138
auuacagaaaggcuuuuc

SEQ ID NO: 2554089 - RNA, 21 nt, Chlamydophila pneumoniae J138
auuacagaaaggcuuuucuuu

SEQ ID NO: 2554090 - RNA, 22 nt, Chlamydophila pneumoniae J138
auuacagcaucuauagaauuuc

SEQ ID NO: 2554091 - RNA, 12 nt, Chlamydophila pneumoniae J138
auuacagggaaa

SEQ ID NO: 2554092 - RNA, 18 nt, Chlamydophila pneumoniae J138
auuacaucuaacucuaau

SEQ ID NO: 2554093 - RNA, 17 nt, Chlamydophila pneumoniae J138
auuaccguuuccuccuc

SEQ ID NO: 2554094 - RNA, 14 nt, Chlamydophila pneumoniae J138
auuaccugcuaaac

SEQ ID NO: 2554095 - RNA, 22 nt, Chlamydophila pneumoniae J138
auuaccugcuaaacuuuuuuuc

SEQ ID NO: 2554096 - RNA, 17 nt, Chlamydophila pneumoniae J138
auuaccuuaucgccaac

SEQ ID NO: 2554097 - RNA, 15 nt, Chlamydophila pneumoniae J138
auuaccuugagacaa

SEQ ID NO: 2554098 - RNA, 23 nt, Chlamydophila pneumoniae J138
auuacggcgugccuuuuuuucua

SEQ ID NO: 2554099 - RNA, 17 nt, Chlamydophila pneumoniae J138
auuagaaaagauaaaac

SEQ ID NO: 2554100 - RNA, 15 nt, Chlamydophila pneumoniae J138
auuagaaucucugcc

SEQ ID NO: 2554101 - RNA, 23 nt, Chlamydophila pneumoniae J138
auuagagagugcguacucuucuu

SEQ ID NO: 2554102 - RNA, 15 nt, Chlamydophila pneumoniae J138
auuagaguuugguuu

SEQ ID NO: 2554103 - RNA, 20 nt, Chlamydophila pneumoniae J138
auuaguaaaugccucuuuca

SEQ ID NO: 2554104 - RNA, 18 nt, Chlamydophila pneumoniae J138
auuaguaacuaaauucuu

SEQ ID NO: 2554105 - RNA, 20 nt, Chlamydophila pneumoniae J138
auuaguagcuauucucaaau

SEQ ID NO: 2554106 - RNA, 16 nt, Chlamydophila pneumoniae J138
auuaguuucacauagu

SEQ ID NO: 2554107 - RNA, 17 nt, Chlamydophila pneumoniae J138
auuauaaauagaaaucu

SEQ ID NO: 2554108 - RNA, 15 nt, Chlamydophila pneumoniae J138
auuauacuuuuuuua

SEQ ID NO: 2554109 - RNA, 19 nt, Chlamydophila pneumoniae J138
auuaucaagaaauucuucc

SEQ ID NO: 2554110 - RNA, 21 nt, Chlamydophila pneumoniae J138
auuaucagagacaaguucauc

SEQ ID NO: 2554111 - RNA, 14 nt, Chlamydophila pneumoniae J138
auuaucuaagaaua

SEQ ID NO: 2554112 - RNA, 11 nt, Chlamydophila pneumoniae J138
auuaucuacag

SEQ ID NO: 2554113 - RNA, 18 nt, Chlamydophila pneumoniae J138
auuaucuccaaagaucau

SEQ ID NO: 2554114 - RNA, 15 nt, Chlamydophila pneumoniae J138
auuaucuuagggaau

SEQ ID NO: 2554115 - RNA, 19 nt, Chlamydophila pneumoniae J138
auuaucuucguaauaacua

SEQ ID NO: 2554116 - RNA, 18 nt, Chlamydophila pneumoniae J138
auuauguagaucauaaac

SEQ ID NO: 2554117 - RNA, 17 nt, Chlamydophila pneumoniae J138
auuauguagaucuacaa

SEQ ID NO: 2554118 - RNA, 12 nt, Chlamydophila pneumoniae J138
auuauuaaacuc

SEQ ID NO: 2554119 - RNA, 12 nt, Chlamydophila pneumoniae J138
auuauucccuaa

SEQ ID NO: 2554120 - RNA, 23 nt, Chlamydophila pneumoniae J138
auuauucccuaagguagagucca

SEQ ID NO: 2554121 - RNA, 12 nt, Chlamydophila pneumoniae J138
auuauucuagag

SEQ ID NO: 2554122 - RNA, 15 nt, Chlamydophila pneumoniae J138
auuauucuagaguug

SEQ ID NO: 2554123 - RNA, 13 nt, Chlamydophila pneumoniae J138
auuauugaauaag

SEQ ID NO: 2554124 - RNA, 15 nt, Chlamydophila pneumoniae J138
auuauuucuaaaaaa

SEQ ID NO: 2554125 - RNA, 17 nt, Chlamydophila pneumoniae J138
auuauuucuaaaaaaua

SEQ ID NO: 2554126 - RNA, 18 nt, Chlamydophila pneumoniae J138
auuauuuguuucuuccau

SEQ ID NO: 2554127 - RNA, 13 nt, Chlamydophila pneumoniae J138
auucaaaauagaa

SEQ ID NO: 2554128 - RNA, 18 nt, Chlamydophila pneumoniae J138
auucaaaauagaagccac

SEQ ID NO: 2554129 - RNA, 16 nt, Chlamydophila pneumoniae J138
auucaaacuccuuuua

SEQ ID NO: 2554130 - RNA, 17 nt, Chlamydophila pneumoniae J138
auucaacacggacacua

SEQ ID NO: 2554131 - RNA, 16 nt, Chlamydophila pneumoniae J138
auucaauaauuucaaa

SEQ ID NO: 2554132 - RNA, 15 nt, Chlamydophila pneumoniae J138
auucaaugcagcuaa

SEQ ID NO: 2554133 - RNA, 16 nt, Chlamydophila pneumoniae J138
auucacaucuuaaaaa

SEQ ID NO: 2554134 - RNA, 18 nt, Chlamydophila pneumoniae J138
auucacgccuauagauuc

SEQ ID NO: 2554135 - RNA, 14 nt, Chlamydophila pneumoniae J138
auucacuggaauga

SEQ ID NO: 2554136 - RNA, 17 nt, Chlamydophila pneumoniae J138
auucagauccaaagacg

SEQ ID NO: 2554137 - RNA, 16 nt, Chlamydophila pneumoniae J138
auucaguuccucaucc

SEQ ID NO: 2554138 - RNA, 17 nt, Chlamydophila pneumoniae J138
auucaguuccucauccu

SEQ ID NO: 2554139 - RNA, 17 nt, Chlamydophila pneumoniae J138
auucauaaagaggaaug

SEQ ID NO: 2554140 - RNA, 23 nt, Chlamydophila pneumoniae J138
auucauaaagaggaaugaagaga

SEQ ID NO: 2554141 - RNA, 19 nt, Chlamydophila pneumoniae J138
auucauauuuacgaaaaca

SEQ ID NO: 2554142 - RNA, 13 nt, Chlamydophila pneumoniae J138
auucauccagauu

SEQ ID NO: 2554143 - RNA, 13 nt, Chlamydophila pneumoniae J138
auucaugcaaaac

SEQ ID NO: 2554144 - RNA, 20 nt, Chlamydophila pneumoniae J138
auucaugccgcauuucuuca

SEQ ID NO: 2554145 - RNA, 16 nt, Chlamydophila pneumoniae J138
auucauuaagaacauc

SEQ ID NO: 2554146 - RNA, 16 nt, Chlamydophila pneumoniae J138
auuccaaagcuaggcg

SEQ ID NO: 2554147 - RNA, 13 nt, Chlamydophila pneumoniae J138
auuccaacaggga

SEQ ID NO: 2554148 - RNA, 14 nt, Chlamydophila pneumoniae J138
auuccaacuacaua

SEQ ID NO: 2554149 - RNA, 15 nt, Chlamydophila pneumoniae J138
auuccaauuuuugca

SEQ ID NO: 2554150 - RNA, 12 nt, Chlamydophila pneumoniae J138
auuccagaaaaa

SEQ ID NO: 2554151 - RNA, 21 nt, Chlamydophila pneumoniae J138
auuccagaaaaagaacauaag

SEQ ID NO: 2554152 - RNA, 19 nt, Chlamydophila pneumoniae J138
auuccagcaucuucucgaa

SEQ ID NO: 2554153 - RNA, 18 nt, Chlamydophila pneumoniae J138
auuccagcugagcuaucu

SEQ ID NO: 2554154 - RNA, 22 nt, Chlamydophila pneumoniae J138
auuccagcugagcuaucuucaa

SEQ ID NO: 2554155 - RNA, 23 nt, Chlamydophila pneumoniae J138
auuccagcugagcuaucuucaag

SEQ ID NO: 2554156 - RNA, 21 nt, Chlamydophila pneumoniae J138
auuccaggacguaaaaagaaa

SEQ ID NO: 2554157 - RNA, 17 nt, Chlamydophila pneumoniae J138
auuccaggauucuauaa

SEQ ID NO: 2554158 - RNA, 23 nt, Chlamydophila pneumoniae J138
auuccaggauucuauaacuacaa

SEQ ID NO: 2554159 - RNA, 21 nt, Chlamydophila pneumoniae J138
auuccauaggggaugauuuuc

SEQ ID NO: 2554160 - RNA, 19 nt, Chlamydophila pneumoniae J138
auuccauagguuagaaaug

SEQ ID NO: 2554161 - RNA, 21 nt, Chlamydophila pneumoniae J138
auuccauccugucuauuucuu

SEQ ID NO: 2554162 - RNA, 14 nt, Chlamydophila pneumoniae J138
auucccaagaacuu

SEQ ID NO: 2554163 - RNA, 14 nt, Chlamydophila pneumoniae J138
auuccccaaacuua

SEQ ID NO: 2554164 - RNA, 18 nt, Chlamydophila pneumoniae J138
auuccccagggagaucua

SEQ ID NO: 2554165 - RNA, 14 nt, Chlamydophila pneumoniae J138
auuccccguguuug

SEQ ID NO: 2554166 - RNA, 18 nt, Chlamydophila pneumoniae J138
auucccggaggcaaagau

SEQ ID NO: 2554167 - RNA, 17 nt, Chlamydophila pneumoniae J138
auucccgggaugugguu

SEQ ID NO: 2554168 - RNA, 20 nt, Chlamydophila pneumoniae J138
cgaagacuuguucuucauua

SEQ ID NO: 2554169 - RNA, 22 nt, Chlamydophila pneumoniae J138
cgaagacuuguucuucauuauu

SEQ ID NO: 2554170 - RNA, 22 nt, Chlamydophila pneumoniae J138
cgaagagcccucuucacuuaua

SEQ ID NO: 2554171 - RNA, 20 nt, Chlamydophila pneumoniae J138
cgaagcauucccgacucaau

SEQ ID NO: 2554172 - RNA, 18 nt, Chlamydophila pneumoniae J138
cgaagcgccgcauuacag

SEQ ID NO: 2554173 - RNA, 19 nt, Chlamydophila pneumoniae J138
cgaagcggagcaucuuuuc

SEQ ID NO: 2554174 - RNA, 18 nt, Chlamydophila pneumoniae J138
cgaagcuugcugauuucu

SEQ ID NO: 2554175 - RNA, 23 nt, Chlamydophila pneumoniae J138
cgaagcuugcugauuucuuuuuc

SEQ ID NO: 2554176 - RNA, 23 nt, Chlamydophila pneumoniae J138
cgaagggaguuucccgacauuua

SEQ ID NO: 2554177 - RNA, 19 nt, Chlamydophila pneumoniae J138
cgaaggggaagaggaaugc

SEQ ID NO: 2554178 - RNA, 20 nt, Chlamydophila pneumoniae J138
cgaaggggaagaggaaugcc

SEQ ID NO: 2554179 - RNA, 11 nt, Chlamydophila pneumoniae J138
cgaauaacuac

SEQ ID NO: 2554180 - RNA, 18 nt, Chlamydophila pneumoniae J138
cgaauaaggcuugaggau

SEQ ID NO: 2554181 - RNA, 18 nt, Chlamydophila pneumoniae J138
cgaauagaaaagguauua

SEQ ID NO: 2554182 - RNA, 21 nt, Chlamydophila pneumoniae J138
cgaaucccuguguguuuuuuc

SEQ ID NO: 2554183 - RNA, 13 nt, Chlamydophila pneumoniae J138
cgaaucuaaaaac

SEQ ID NO: 2554184 - RNA, 22 nt, Chlamydophila pneumoniae J138
cgaaucuaaaaacuucccaucu

SEQ ID NO: 2554185 - RNA, 13 nt, Chlamydophila pneumoniae J138
cgaaucucuccag

SEQ ID NO: 2554186 - RNA, 18 nt, Chlamydophila pneumoniae J138
cgaaugucguuaaaaacu

SEQ ID NO: 2554187 - RNA, 13 nt, Chlamydophila pneumoniae J138
cgaauucucagaa

SEQ ID NO: 2554188 - RNA, 23 nt, Chlamydophila pneumoniae J138
cgaauucucagaaagccuuugcu

SEQ ID NO: 2554189 - RNA, 18 nt, Chlamydophila pneumoniae J138
cgaauuucaacagcuuca

SEQ ID NO: 2554190 - RNA, 14 nt, Chlamydophila pneumoniae J138
cgacaaaaaugccu

SEQ ID NO: 2554191 - RNA, 22 nt, Chlamydophila pneumoniae J138
cgacaagauggugagauuucua

SEQ ID NO: 2554192 - RNA, 13 nt, Chlamydophila pneumoniae J138
cgacaaggaagcc

SEQ ID NO: 2554193 - RNA, 21 nt, Chlamydophila pneumoniae J138
cgacacuauguguuuccuuuu

SEQ ID NO: 2554194 - RNA, 20 nt, Chlamydophila pneumoniae J138
cgacagcagcauuuucuaaa

SEQ ID NO: 2554195 - RNA, 14 nt, Chlamydophila pneumoniae J138
cgacauacaucaaa

SEQ ID NO: 2554196 - RNA, 20 nt, Chlamydophila pneumoniae J138
cgacaugcaggccaacucuc

SEQ ID NO: 2554197 - RNA, 21 nt, Chlamydophila pneumoniae J138
cgacaugccuaaauagcucag

SEQ ID NO: 2554198 - RNA, 16 nt, Chlamydophila pneumoniae J138
cgacaugcuuuccuuc

SEQ ID NO: 2554199 - RNA, 17 nt, Chlamydophila pneumoniae J138
cgaccuaggagaaauca

SEQ ID NO: 2554200 - RNA, 17 nt, Chlamydophila pneumoniae J138
cgaccucgaauuccucc

SEQ ID NO: 2554201 - RNA, 23 nt, Chlamydophila pneumoniae J138
cgaccugagguaucaauaaugac

SEQ ID NO: 2554202 - RNA, 22 nt, Chlamydophila pneumoniae J138
cgacgacgucuucuuagaagag

SEQ ID NO: 2554203 - RNA, 15 nt, Chlamydophila pneumoniae J138
cgacgagaaggaaga

SEQ ID NO: 2554204 - RNA, 18 nt, Chlamydophila pneumoniae J138
cgacguuugaucuucucu

SEQ ID NO: 2554205 - RNA, 16 nt, Chlamydophila pneumoniae J138
cgacuacaucuuguuc

SEQ ID NO: 2554206 - RNA, 18 nt, Chlamydophila pneumoniae J138
cgacuacaucuuguucug

SEQ ID NO: 2554207 - RNA, 16 nt, Chlamydophila pneumoniae J138
cgacucugccaugucu

SEQ ID NO: 2554208 - RNA, 22 nt, Chlamydophila pneumoniae J138
cgacuguacaaaugcaucucua

SEQ ID NO: 2554209 - RNA, 23 nt, Chlamydophila pneumoniae J138
cgacuuccuccaauaaucacugu

SEQ ID NO: 2554210 - RNA, 13 nt, Chlamydophila pneumoniae J138
cgagaaccuccac

SEQ ID NO: 2554211 - RNA, 14 nt, Chlamydophila pneumoniae J138
cgagaacguagcag

SEQ ID NO: 2554212 - RNA, 16 nt, Chlamydophila pneumoniae J138
cgagaagcuucaauga

SEQ ID NO: 2554213 - RNA, 15 nt, Chlamydophila pneumoniae J138
cgagacuauuuugga

SEQ ID NO: 2554214 - RNA, 17 nt, Chlamydophila pneumoniae J138
cgagacugcaaaggaag

SEQ ID NO: 2554215 - RNA, 19 nt, Chlamydophila pneumoniae J138
cgagaguugccaggaaacg

SEQ ID NO: 2554216 - RNA, 15 nt, Chlamydophila pneumoniae J138
cgagauaucgauagu

SEQ ID NO: 2554217 - RNA, 16 nt, Chlamydophila pneumoniae J138
cgagaucauuagcauc

SEQ ID NO: 2554218 - RNA, 19 nt, Chlamydophila pneumoniae J138
cgagaucauuagcaucauc

SEQ ID NO: 2554219 - RNA, 22 nt, Chlamydophila pneumoniae J138
cgagaucauuagcaucaucucc

SEQ ID NO: 2554220 - RNA, 16 nt, Chlamydophila pneumoniae J138
cgagaucuuugagauc

SEQ ID NO: 2554221 - RNA, 16 nt, Chlamydophila pneumoniae J138
cgagaugaacauaauu

SEQ ID NO: 2554222 - RNA, 16 nt, Chlamydophila pneumoniae J138
cgagcagaaacuccaa

SEQ ID NO: 2554223 - RNA, 22 nt, Chlamydophila pneumoniae J138
cgagcaucucaagaguaggcaa

SEQ ID NO: 2554224 - RNA, 20 nt, Chlamydophila pneumoniae J138
cgagcuaccagaacaccauc

SEQ ID NO: 2554225 - RNA, 17 nt, Chlamydophila pneumoniae J138
cgagcucgcaaaagcug

SEQ ID NO: 2554226 - RNA, 17 nt, Chlamydophila pneumoniae J138
cgagcugaucuucuaaa

SEQ ID NO: 2554227 - RNA, 23 nt, Chlamydophila pneumoniae J138
cgaggagcgauagcucagcucua

SEQ ID NO: 2554228 - RNA, 17 nt, Chlamydophila pneumoniae J138
cgaggagcuuuuaccuu

SEQ ID NO: 2554229 - RNA, 18 nt, Chlamydophila pneumoniae J138
cgaggucuuuucuuuuua

SEQ ID NO: 2554230 - RNA, 19 nt, Chlamydophila pneumoniae J138
cgaggucuuuucuuuuuag

SEQ ID NO: 2554231 - RNA, 15 nt, Chlamydophila pneumoniae J138
cgaguaguccugacg

SEQ ID NO: 2554232 - RNA, 22 nt, Chlamydophila pneumoniae J138
cgagucccuucuuucaauagcu

SEQ ID NO: 2554233 - RNA, 19 nt, Chlamydophila pneumoniae J138
cgaguucgcggaucuucuu

SEQ ID NO: 2554234 - RNA, 13 nt, Chlamydophila pneumoniae J138
cgauaaaaacucc

SEQ ID NO: 2554235 - RNA, 17 nt, Chlamydophila pneumoniae J138
cgauaccgcuguuuuau

SEQ ID NO: 2554236 - RNA, 17 nt, Chlamydophila pneumoniae J138
cgauagcaaugauguuu

SEQ ID NO: 2554237 - RNA, 15 nt, Chlamydophila pneumoniae J138
cgauaggaucuucua

SEQ ID NO: 2554238 - RNA, 19 nt, Chlamydophila pneumoniae J138
cgauaugggcuuugcuaac

SEQ ID NO: 2554239 - RNA, 20 nt, Chlamydophila pneumoniae J138
cgauauuuagagagaaacau

SEQ ID NO: 2554240 - RNA, 21 nt, Chlamydophila pneumoniae J138
cgauauuuagagagaaacauc

SEQ ID NO: 2554241 - RNA, 22 nt, Chlamydophila pneumoniae J138
cgaucaaauuccuucucagaaa

SEQ ID NO: 2554242 - RNA, 17 nt, Chlamydophila pneumoniae J138
cgaucgcgauaagaagc

SEQ ID NO: 2554243 - RNA, 14 nt, Chlamydophila pneumoniae J138
cgaucgucaguaaa

SEQ ID NO: 2554244 - RNA, 19 nt, Chlamydophila pneumoniae J138
cgaugaaacugaagguaaa

SEQ ID NO: 2554245 - RNA, 22 nt, Chlamydophila pneumoniae J138
cgauggcaguuuuaaugagagc

SEQ ID NO: 2554246 - RNA, 13 nt, Chlamydophila pneumoniae J138
cgaugucuuucca

SEQ ID NO: 2554247 - RNA, 15 nt, Chlamydophila pneumoniae J138
cgauuccugaggcua

SEQ ID NO: 2554248 - RNA, 22 nt, Chlamydophila pneumoniae J138
cgauucucguguagaauucacu

SEQ ID NO: 2554249 - RNA, 16 nt, Chlamydophila pneumoniae J138
cgauuguaauuucuag

SEQ ID NO: 2554250 - RNA, 20 nt, Chlamydophila pneumoniae J138
cgauuuagccguagauagua

SEQ ID NO: 2554251 - RNA, 18 nt, Chlamydophila pneumoniae J138
cgauuugaucuugcucag

SEQ ID NO: 2554252 - RNA, 23 nt, Chlamydophila pneumoniae J138
cgcaaaccgagacuauuuuggaa

SEQ ID NO: 2554253 - RNA, 12 nt, Chlamydophila pneumoniae J138
cgcaaagaacuc

SEQ ID NO: 2554254 - RNA, 24 nt, Chlamydophila pneumoniae J138
cgcaagcacuuguuuuuucuucug

SEQ ID NO: 2554255 - RNA, 20 nt, Chlamydophila pneumoniae J138
cgcagaaacacugaacgcca

SEQ ID NO: 2554256 - RNA, 12 nt, Chlamydophila pneumoniae J138
cgcaguaaugcc

SEQ ID NO: 2554257 - RNA, 20 nt, Chlamydophila pneumoniae J138
cgcaguggacggggagagcc

SEQ ID NO: 2554258 - RNA, 21 nt, Chlamydophila pneumoniae J138
cgcaguggacggggagagcca

SEQ ID NO: 2554259 - RNA, 13 nt, Chlamydophila pneumoniae J138
cgcauaagagaca

SEQ ID NO: 2554260 - RNA, 18 nt, Chlamydophila pneumoniae J138
cgcauaagagacauuucu

SEQ ID NO: 2554261 - RNA, 17 nt, Chlamydophila pneumoniae J138
cgcaucacgaaaaggag

SEQ ID NO: 2554262 - RNA, 16 nt, Chlamydophila pneumoniae J138
cgcaucauggucccua

SEQ ID NO: 2554263 - RNA, 14 nt, Chlamydophila pneumoniae J138
cgcaucuagaagca

SEQ ID NO: 2554264 - RNA, 21 nt, Chlamydophila pneumoniae J138
cgcaugccucuuggugcuuug

SEQ ID NO: 2554265 - RNA, 15 nt, Chlamydophila pneumoniae J138
cgcauuacaaauggc

SEQ ID NO: 2554266 - RNA, 17 nt, Chlamydophila pneumoniae J138
cgccaaacgaauuucuu

SEQ ID NO: 2554267 - RNA, 12 nt, Chlamydophila pneumoniae J138
cgccuacaaguu

SEQ ID NO: 2554268 - RNA, 13 nt, Chlamydophila pneumoniae J138
cgccuagaauggc

SEQ ID NO: 2554269 - RNA, 21 nt, Chlamydophila pneumoniae J138
cgccuauagauuccccaaacu

SEQ ID NO: 2554270 - RNA, 20 nt, Chlamydophila pneumoniae J138
cgccuucaagucgagaaaca

SEQ ID NO: 2554271 - RNA, 12 nt, Chlamydophila pneumoniae J138
cgcgaccuguga

SEQ ID NO: 2554272 - RNA, 15 nt, Chlamydophila pneumoniae J138
cgcgaccugugauuu

SEQ ID NO: 2554273 - RNA, 23 nt, Chlamydophila pneumoniae J138
cgcgagcuauuuuacuuacuaaa

SEQ ID NO: 2554274 - RNA, 23 nt, Chlamydophila pneumoniae J138
cgcgagugugacugcagagaaau

SEQ ID NO: 2554275 - RNA, 21 nt, Chlamydophila pneumoniae J138
cgcgauuuucaaccaagguug

SEQ ID NO: 2554276 - RNA, 12 nt, Chlamydophila pneumoniae J138
cgcggaucuucu

SEQ ID NO: 2554277 - RNA, 17 nt, Chlamydophila pneumoniae J138
cgcgggauggacugaug

SEQ ID NO: 2554278 - RNA, 14 nt, Chlamydophila pneumoniae J138
cgcuaaacaaucuu

SEQ ID NO: 2554279 - RNA, 17 nt, Chlamydophila pneumoniae J138
cgcuaccauaucuugag

SEQ ID NO: 2554280 - RNA, 17 nt, Chlamydophila pneumoniae J138
cgcuacgguacuuuaca

SEQ ID NO: 2554281 - RNA, 17 nt, Chlamydophila pneumoniae J138
cgcuagaggaucuucaa

SEQ ID NO: 2554282 - RNA, 17 nt, Chlamydophila pneumoniae J138
cgcuauagccuuguaaa

SEQ ID NO: 2554283 - RNA, 16 nt, Chlamydophila pneumoniae J138
cgcucuaagcugugca

SEQ ID NO: 2554284 - RNA, 20 nt, Chlamydophila pneumoniae J138
cgcucuaagcugugcauuuu

SEQ ID NO: 2554285 - RNA, 14 nt, Chlamydophila pneumoniae J138
cgcucucuccauga

SEQ ID NO: 2554286 - RNA, 23 nt, Chlamydophila pneumoniae J138
cgcugcuucucuacuaaaaucuc

SEQ ID NO: 2554287 - RNA, 22 nt, Chlamydophila pneumoniae J138
cgcuguaaauucagugauuccu

SEQ ID NO: 2554288 - RNA, 14 nt, Chlamydophila pneumoniae J138
cgcuuccagcuucu

SEQ ID NO: 2554289 - RNA, 12 nt, Chlamydophila pneumoniae J138
cgcuucuuuuug

SEQ ID NO: 2554290 - RNA, 12 nt, Chlamydophila pneumoniae J138
cgcuugcaucuu

SEQ ID NO: 2554291 - RNA, 13 nt, Chlamydophila pneumoniae J138
cgcuugcaucuua

SEQ ID NO: 2554292 - RNA, 19 nt, Chlamydophila pneumoniae J138
cgcuuugauaauagucuuc

SEQ ID NO: 2554293 - RNA, 11 nt, Chlamydophila pneumoniae J138
cgcuuuugcua

SEQ ID NO: 2554294 - RNA, 13 nt, Chlamydophila pneumoniae J138
cgcuuuuuacuga

SEQ ID NO: 2554295 - RNA, 12 nt, Chlamydophila pneumoniae J138
cgcuuuuuuaaa

SEQ ID NO: 2554296 - RNA, 19 nt, Chlamydophila pneumoniae J138
cggaaaauacagccagcag

SEQ ID NO: 2554297 - RNA, 13 nt, Chlamydophila pneumoniae J138
cggaacuaaagag

SEQ ID NO: 2554298 - RNA, 14 nt, Chlamydophila pneumoniae J138
cggaacucauuaag

SEQ ID NO: 2554299 - RNA, 15 nt, Chlamydophila pneumoniae J138
cggaacucauuaaga

SEQ ID NO: 2554300 - RNA, 23 nt, Chlamydophila pneumoniae J138
cggaacucucuucccccagaccu

SEQ ID NO: 2554301 - RNA, 16 nt, Chlamydophila pneumoniae J138
cggaauacuucuccuc

SEQ ID NO: 2554302 - RNA, 22 nt, Chlamydophila pneumoniae J138
cggacuccgucuccuaucagag

SEQ ID NO: 2554303 - RNA, 17 nt, Chlamydophila pneumoniae J138
cggacuccugaugcucc

SEQ ID NO: 2554304 - RNA, 22 nt, Chlamydophila pneumoniae J138
cggacuucacaaagaaccauag

SEQ ID NO: 2554305 - RNA, 17 nt, Chlamydophila pneumoniae J138
cggagaacuuccugauu

SEQ ID NO: 2554306 - RNA, 12 nt, Chlamydophila pneumoniae J138
cggagaccaaaa

SEQ ID NO: 2554307 - RNA, 17 nt, Chlamydophila pneumoniae J138
cggagacucagagaaaa

SEQ ID NO: 2554308 - RNA, 19 nt, Chlamydophila pneumoniae J138
cggagacucagagaaaauc

SEQ ID NO: 2554309 - RNA, 22 nt, Chlamydophila pneumoniae J138
cggagcaucuuuucaaaagaaa

SEQ ID NO: 2554310 - RNA, 17 nt, Chlamydophila pneumoniae J138
cggaguaacuaauaauc

SEQ ID NO: 2554311 - RNA, 16 nt, Chlamydophila pneumoniae J138
cggaguuaucaaaagg

SEQ ID NO: 2554312 - RNA, 17 nt, Chlamydophila pneumoniae J138
cggaucccguaaaagaa

SEQ ID NO: 2554313 - RNA, 16 nt, Chlamydophila pneumoniae J138
cggauccuagaauagg

SEQ ID NO: 2554314 - RNA, 19 nt, Chlamydophila pneumoniae J138
cggaucuucaauuggagga

SEQ ID NO: 2554315 - RNA, 19 nt, Chlamydophila pneumoniae J138
cggaucuuuucuuucuaag

SEQ ID NO: 2554316 - RNA, 23 nt, Chlamydophila pneumoniae J138
cggaugaccuucucaagaucuuc

SEQ ID NO: 2554317 - RNA, 14 nt, Chlamydophila pneumoniae J138
cggauuucaugauu

SEQ ID NO: 2554318 - RNA, 13 nt, Chlamydophila pneumoniae J138
cggauuuucucua

SEQ ID NO: 2554319 - RNA, 15 nt, Chlamydophila pneumoniae J138
cggcaacauaaucau

SEQ ID NO: 2554320 - RNA, 20 nt, Chlamydophila pneumoniae J138
cggcacuuacuucaagaaaa

SEQ ID NO: 2554321 - RNA, 22 nt, Chlamydophila pneumoniae J138
cggcauuucuccacaugccugc

SEQ ID NO: 2554322 - RNA, 14 nt, Chlamydophila pneumoniae J138
cggccaucauuaag

SEQ ID NO: 2554323 - RNA, 19 nt, Chlamydophila pneumoniae J138
cggcggagaauaucaucuu

SEQ ID NO: 2554324 - RNA, 14 nt, Chlamydophila pneumoniae J138
cggcucucuucauu

SEQ ID NO: 2554325 - RNA, 13 nt, Chlamydophila pneumoniae J138
cggcuuuagaaaa

SEQ ID NO: 2554326 - RNA, 21 nt, Chlamydophila pneumoniae J138
cgggaauaauaggauaagaaa

SEQ ID NO: 2554327 - RNA, 19 nt, Chlamydophila pneumoniae J138
cggggucggagauuguuuc

SEQ ID NO: 2554328 - RNA, 16 nt, Chlamydophila pneumoniae J138
cgguaaccugugaaaa

SEQ ID NO: 2554329 - RNA, 20 nt, Chlamydophila pneumoniae J138
cgguaaggaggaaucuugau

SEQ ID NO: 2554330 - RNA, 15 nt, Chlamydophila pneumoniae J138
cggucacuucaauua

SEQ ID NO: 2554331 - RNA, 22 nt, Chlamydophila pneumoniae J138
cggucucgcuguuucaacaccu

SEQ ID NO: 2554332 - RNA, 21 nt, Chlamydophila pneumoniae J138
cgguuuaaacagaucuuuauc

SEQ ID NO: 2554333 - RNA, 12 nt, Chlamydophila pneumoniae J138
cguaaagaaaag

SEQ ID NO: 2554334 - RNA, 14 nt, Chlamydophila pneumoniae J138
cguaaagaaaagca

SEQ ID NO: 2554335 - RNA, 15 nt, Chlamydophila pneumoniae J138
cguaaagaaaagcaa

SEQ ID NO: 2554336 - RNA, 14 nt, Chlamydophila pneumoniae J138
cguaaccacaggau

SEQ ID NO: 2554337 - RNA, 18 nt, Chlamydophila pneumoniae J138
cguaauccuucuuucugc

SEQ ID NO: 2554338 - RNA, 15 nt, Chlamydophila pneumoniae J138
cguaaugcagauagc

SEQ ID NO: 2554339 - RNA, 20 nt, Chlamydophila pneumoniae J138
cguacaaauaauuucccuaa

SEQ ID NO: 2554340 - RNA, 14 nt, Chlamydophila pneumoniae J138
cguacaggacuguu

SEQ ID NO: 2554341 - RNA, 18 nt, Chlamydophila pneumoniae J138
cguacgcaaguaaagaaa

SEQ ID NO: 2554342 - RNA, 17 nt, Chlamydophila pneumoniae J138
cguagacgcucuaaacu

SEQ ID NO: 2554343 - RNA, 21 nt, Chlamydophila pneumoniae J138
cguagacgcucuaaacucucu

SEQ ID NO: 2554344 - RNA, 23 nt, Chlamydophila pneumoniae J138
cguagcuacaaaauuauuaaacu

SEQ ID NO: 2554345 - RNA, 18 nt, Chlamydophila pneumoniae J138
cguagcuugcgagcuucu

SEQ ID NO: 2554346 - RNA, 16 nt, Chlamydophila pneumoniae J138
cguaggguauccugcu

SEQ ID NO: 2554347 - RNA, 15 nt, Chlamydophila pneumoniae J138
cguagguguuaaguu

SEQ ID NO: 2554348 - RNA, 16 nt, Chlamydophila pneumoniae J138
cguagguuugcugcuc

SEQ ID NO: 2554349 - RNA, 21 nt, Chlamydophila pneumoniae J138
cguauacgucccacaaaauuu

SEQ ID NO: 2554350 - RNA, 22 nt, Chlamydophila pneumoniae J138
cguauagguacgcuuuuucuug

SEQ ID NO: 2554351 - RNA, 23 nt, Chlamydophila pneumoniae J138
cguauccaaauugcaauuuucua

SEQ ID NO: 2554352 - RNA, 21 nt, Chlamydophila pneumoniae J138
cguauccuugauuuuaaaaug

SEQ ID NO: 2554353 - RNA, 20 nt, Chlamydophila pneumoniae J138
cguauggauuucuccagcag

SEQ ID NO: 2554354 - RNA, 13 nt, Chlamydophila pneumoniae J138
cguauucccaggu

SEQ ID NO: 2554355 - RNA, 21 nt, Chlamydophila pneumoniae J138
cguauuucacaagcauaaacu

SEQ ID NO: 2554356 - RNA, 16 nt, Chlamydophila pneumoniae J138
cgucaaagguuuuaaa

SEQ ID NO: 2554357 - RNA, 18 nt, Chlamydophila pneumoniae J138
cgucaaauucauuaagaa

SEQ ID NO: 2554358 - RNA, 19 nt, Chlamydophila pneumoniae J138
cgucaaauucauuaagaac

SEQ ID NO: 2554359 - RNA, 17 nt, Chlamydophila pneumoniae J138
cgucacauuuguuguca

SEQ ID NO: 2554360 - RNA, 12 nt, Chlamydophila pneumoniae J138
cgucacugcgca

SEQ ID NO: 2554361 - RNA, 19 nt, Chlamydophila pneumoniae J138
cgucacuguuuuccagaaa

SEQ ID NO: 2554362 - RNA, 16 nt, Chlamydophila pneumoniae J138
cgucaguaaaacacaa

SEQ ID NO: 2554363 - RNA, 14 nt, Chlamydophila pneumoniae J138
cgucauauuuaaaa

SEQ ID NO: 2554364 - RNA, 20 nt, Chlamydophila pneumoniae J138
cgucaucaaccgaagauccu

SEQ ID NO: 2554365 - RNA, 18 nt, Chlamydophila pneumoniae J138
cguccagccugcaccaga

SEQ ID NO: 2554366 - RNA, 19 nt, Chlamydophila pneumoniae J138
cguccagccugcaccagac

SEQ ID NO: 2554367 - RNA, 20 nt, Chlamydophila pneumoniae J138
cguccaguucuucauuccag

SEQ ID NO: 2554368 - RNA, 12 nt, Chlamydophila pneumoniae J138
cgucccacaaaa

SEQ ID NO: 2554369 - RNA, 21 nt, Chlamydophila pneumoniae J138
cguccuccccauacauaggga

SEQ ID NO: 2554370 - RNA, 22 nt, Chlamydophila pneumoniae J138
cgucuaaaauaaccccuccaaa

SEQ ID NO: 2554371 - RNA, 21 nt, Chlamydophila pneumoniae J138
cgucugcgauaggaucuucua

SEQ ID NO: 2554372 - RNA, 15 nt, Chlamydophila pneumoniae J138
cgucuucaauagaac

SEQ ID NO: 2554373 - RNA, 13 nt, Chlamydophila pneumoniae J138
cgugaacaaaaac

SEQ ID NO: 2554374 - RNA, 15 nt, Chlamydophila pneumoniae J138
cgugaacaaaaacug

SEQ ID NO: 2554375 - RNA, 12 nt, Chlamydophila pneumoniae J138
cgugaacaaaau

SEQ ID NO: 2554376 - RNA, 23 nt, Chlamydophila pneumoniae J138
cgugaauauguacugaugugaag

SEQ ID NO: 2554377 - RNA, 13 nt, Chlamydophila pneumoniae J138
cgugacgugguuu

SEQ ID NO: 2554378 - RNA, 20 nt, Chlamydophila pneumoniae J138
cgugacucuuaucuggagau

SEQ ID NO: 2554379 - RNA, 19 nt, Chlamydophila pneumoniae J138
cgugagaggaucgugaagu

SEQ ID NO: 2554380 - RNA, 20 nt, Chlamydophila pneumoniae J138
cgugauugcugucagaacaa

SEQ ID NO: 2554381 - RNA, 20 nt, Chlamydophila pneumoniae J138
cgugcaggagaacaauauca

SEQ ID NO: 2554382 - RNA, 12 nt, Chlamydophila pneumoniae J138
cgugcauaauga

SEQ ID NO: 2554383 - RNA, 21 nt, Chlamydophila pneumoniae J138
cgugcucccauuucuggagaa

SEQ ID NO: 2554384 - RNA, 14 nt, Chlamydophila pneumoniae J138
cgugcucucuucuu

SEQ ID NO: 2554385 - RNA, 16 nt, Chlamydophila pneumoniae J138
cgugcucucuucuucu

SEQ ID NO: 2554386 - RNA, 14 nt, Chlamydophila pneumoniae J138
cgugcucugcaauc

SEQ ID NO: 2554387 - RNA, 12 nt, Chlamydophila pneumoniae J138
cgugcucuuaug

SEQ ID NO: 2554388 - RNA, 13 nt, Chlamydophila pneumoniae J138
cguggagcaucau

SEQ ID NO: 2554389 - RNA, 20 nt, Chlamydophila pneumoniae J138
cgugggcccaagcaagaagu

SEQ ID NO: 2554390 - RNA, 21 nt, Chlamydophila pneumoniae J138
cguguacagaccguccucccc

SEQ ID NO: 2554391 - RNA, 14 nt, Chlamydophila pneumoniae J138
cguuaaaaacuauc

SEQ ID NO: 2554392 - RNA, 16 nt, Chlamydophila pneumoniae J138
cguuaaaaacuauccu

SEQ ID NO: 2554393 - RNA, 13 nt, Chlamydophila pneumoniae J138
cguuaauaaagag

SEQ ID NO: 2554394 - RNA, 19 nt, Chlamydophila pneumoniae J138
cguuaauaagaaccucuaa

SEQ ID NO: 2554395 - RNA, 14 nt, Chlamydophila pneumoniae J138
cguuaccaaaaacu

SEQ ID NO: 2554396 - RNA, 12 nt, Chlamydophila pneumoniae J138
cguuauauuuuu

SEQ ID NO: 2554397 - RNA, 22 nt, Chlamydophila pneumoniae J138
cguucaacuuuguuaauagaag

SEQ ID NO: 2554398 - RNA, 19 nt, Chlamydophila pneumoniae J138
cguuccagccugugagcuc

SEQ ID NO: 2554399 - RNA, 18 nt, Chlamydophila pneumoniae J138
cguucuuucaauaacaga

SEQ ID NO: 2554400 - RNA, 18 nt, Chlamydophila pneumoniae J138
cguuguaucccugugccu

SEQ ID NO: 2554401 - RNA, 18 nt, Chlamydophila pneumoniae J138
cguuuaauuccuuggauu

SEQ ID NO: 2554402 - RNA, 13 nt, Chlamydophila pneumoniae J138
cguuuagcuauuu

SEQ ID NO: 2554403 - RNA, 14 nt, Chlamydophila pneumoniae J138
cguuucaaauagga

SEQ ID NO: 2554404 - RNA, 12 nt, Chlamydophila pneumoniae J138
cguuuccuccuc

SEQ ID NO: 2554405 - RNA, 22 nt, Chlamydophila pneumoniae J138
cguuuguuuugcuuuuugaaug

SEQ ID NO: 2554406 - RNA, 16 nt, Chlamydophila pneumoniae J138
cguuuucuagaaaaga

SEQ ID NO: 2554407 - RNA, 16 nt, Chlamydophila pneumoniae J138
cguuuuuuuugauuuc

SEQ ID NO: 2554408 - RNA, 19 nt, Chlamydophila pneumoniae J138
cuaaaaaugcacuuugaau

SEQ ID NO: 2554409 - RNA, 14 nt, Chlamydophila pneumoniae J138
cuaaaacaagaaga

SEQ ID NO: 2554410 - RNA, 16 nt, Chlamydophila pneumoniae J138
cuaaaacuacaacagg

SEQ ID NO: 2554411 - RNA, 14 nt, Chlamydophila pneumoniae J138
cuaaaacuucuugu

SEQ ID NO: 2554412 - RNA, 21 nt, Chlamydophila pneumoniae J138
cuaaaaucuuucaauguaauu

SEQ ID NO: 2554413 - RNA, 21 nt, Chlamydophila pneumoniae J138
cuaaaauggugaagaauaaua

SEQ ID NO: 2554414 - RNA, 20 nt, Chlamydophila pneumoniae J138
cuaaacaagaaaaagcaucu

SEQ ID NO: 2554415 - RNA, 22 nt, Chlamydophila pneumoniae J138
cuaaacccuguccaacuaaaac

SEQ ID NO: 2554416 - RNA, 15 nt, Chlamydophila pneumoniae J138
cuaaaccuucaauga

SEQ ID NO: 2554417 - RNA, 23 nt, Chlamydophila pneumoniae J138
cuaaaccuucaaugauuucuuua

SEQ ID NO: 2554418 - RNA, 17 nt, Chlamydophila pneumoniae J138
cuaaacgacguuuaauu

SEQ ID NO: 2554419 - RNA, 18 nt, Chlamydophila pneumoniae J138
cuaaacgacguuuaauuc

SEQ ID NO: 2554420 - RNA, 23 nt, Chlamydophila pneumoniae J138
cuaaacgcgagcuauuuuacuua

SEQ ID NO: 2554421 - RNA, 13 nt, Chlamydophila pneumoniae J138
cuaaacucuccaa

SEQ ID NO: 2554422 - RNA, 20 nt, Chlamydophila pneumoniae J138
cuaaacucuccaaaagcucu

SEQ ID NO: 2554423 - RNA, 12 nt, Chlamydophila pneumoniae J138
cuaaacucucuu

SEQ ID NO: 2554424 - RNA, 14 nt, Chlamydophila pneumoniae J138
cuaaacucucuucc

SEQ ID NO: 2554425 - RNA, 20 nt, Chlamydophila pneumoniae J138
cuaaacucucuuccuucucc

SEQ ID NO: 2554426 - RNA, 21 nt, Chlamydophila pneumoniae J138
cuaaacucucuuccuucuccu

SEQ ID NO: 2554427 - RNA, 12 nt, Chlamydophila pneumoniae J138
cuaaacuuuuuu

SEQ ID NO: 2554428 - RNA, 16 nt, Chlamydophila pneumoniae J138
cuaaagaagauucaag

SEQ ID NO: 2554429 - RNA, 23 nt, Chlamydophila pneumoniae J138
cuaaagacgaagggaguuucccg

SEQ ID NO: 2554430 - RNA, 18 nt, Chlamydophila pneumoniae J138
cuaaagagaucacaggga

SEQ ID NO: 2554431 - RNA, 11 nt, Chlamydophila pneumoniae J138
cuaaagagaug

SEQ ID NO: 2554432 - RNA, 19 nt, Chlamydophila pneumoniae J138
cuaaagauacuuaucuuua

SEQ ID NO: 2554433 - RNA, 21 nt, Chlamydophila pneumoniae J138
cuaaagauacuuaucuuuaaa

SEQ ID NO: 2554434 - RNA, 22 nt, Chlamydophila pneumoniae J138
cuaaagcugccagugacauaau

SEQ ID NO: 2554435 - RNA, 18 nt, Chlamydophila pneumoniae J138
cuaaagcugcuuuuucua

SEQ ID NO: 2554436 - RNA, 13 nt, Chlamydophila pneumoniae J138
cuaaaggaacugu

SEQ ID NO: 2554437 - RNA, 19 nt, Chlamydophila pneumoniae J138
cuaaaggaacugugccaua

SEQ ID NO: 2554438 - RNA, 18 nt, Chlamydophila pneumoniae J138
cuaaaggaagauauccuu

SEQ ID NO: 2554439 - RNA, 17 nt, Chlamydophila pneumoniae J138
cuaaaggaaucucggga

SEQ ID NO: 2554440 - RNA, 15 nt, Chlamydophila pneumoniae J138
cuaaagguuuuaaau

SEQ ID NO: 2554441 - RNA, 18 nt, Chlamydophila pneumoniae J138
cuaaaguaacgauaagaa

SEQ ID NO: 2554442 - RNA, 19 nt, Chlamydophila pneumoniae J138
cuaaaguagaauccuucuc

SEQ ID NO: 2554443 - RNA, 18 nt, Chlamydophila pneumoniae J138
cuaaaguaggaauuuuca

SEQ ID NO: 2554444 - RNA, 20 nt, Chlamydophila pneumoniae J138
cuaaauacuuaggaauuuuu

SEQ ID NO: 2554445 - RNA, 23 nt, Chlamydophila pneumoniae J138
cuaaauacuuaggaauuuuucua

SEQ ID NO: 2554446 - RNA, 14 nt, Chlamydophila pneumoniae J138
cuaaauagaaaaca

SEQ ID NO: 2554447 - RNA, 16 nt, Chlamydophila pneumoniae J138
cuaaauagaaaacaua

SEQ ID NO: 2554448 - RNA, 21 nt, Chlamydophila pneumoniae J138
cuaaauagaaaacauagagau

SEQ ID NO: 2554449 - RNA, 21 nt, Chlamydophila pneumoniae J138
cuaaaucaacuacacuuaugu

SEQ ID NO: 2554450 - RNA, 23 nt, Chlamydophila pneumoniae J138
cuaaaucaacuacaucuccaagc

SEQ ID NO: 2554451 - RNA, 14 nt, Chlamydophila pneumoniae J138
cuaaauuaguaaau

SEQ ID NO: 2554452 - RNA, 16 nt, Chlamydophila pneumoniae J138
cuaaauuaguaaaugc

SEQ ID NO: 2554453 - RNA, 17 nt, Chlamydophila pneumoniae J138
cuaaauuugucaucaca

SEQ ID NO: 2554454 - RNA, 18 nt, Chlamydophila pneumoniae J138
cuaaauuugucaucacau

SEQ ID NO: 2554455 - RNA, 12 nt, Chlamydophila pneumoniae J138
cuaacaacuccu

SEQ ID NO: 2554456 - RNA, 13 nt, Chlamydophila pneumoniae J138
cuaacaacuucug

SEQ ID NO: 2554457 - RNA, 16 nt, Chlamydophila pneumoniae J138
cuaacaacuucugaca

SEQ ID NO: 2554458 - RNA, 20 nt, Chlamydophila pneumoniae J138
cuaacaacuucugacaauaa

SEQ ID NO: 2554459 - RNA, 19 nt, Chlamydophila pneumoniae J138
cuaacaagauaaccugaga

SEQ ID NO: 2554460 - RNA, 13 nt, Chlamydophila pneumoniae J138
cuaacacaguccc

SEQ ID NO: 2554461 - RNA, 23 nt, Chlamydophila pneumoniae J138
cuaacgaagugaggagaauagca

SEQ ID NO: 2554462 - RNA, 20 nt, Chlamydophila pneumoniae J138
cuaacgaugcaggccaggag

SEQ ID NO: 2554463 - RNA, 15 nt, Chlamydophila pneumoniae J138
cuaacgcaacaucca

SEQ ID NO: 2554464 - RNA, 16 nt, Chlamydophila pneumoniae J138
cuaacuuagagcgaau

SEQ ID NO: 2554465 - RNA, 15 nt, Chlamydophila pneumoniae J138
cuaacuuauccucag

SEQ ID NO: 2554466 - RNA, 15 nt, Chlamydophila pneumoniae J138
cuaacuuaucgaaug

SEQ ID NO: 2554467 - RNA, 17 nt, Chlamydophila pneumoniae J138
cuaagaagcucacucuu

SEQ ID NO: 2554468 - RNA, 21 nt, Chlamydophila pneumoniae J138
cuaagaagcucacucuuuaaa

SEQ ID NO: 2554469 - RNA, 13 nt, Chlamydophila pneumoniae J138
cuaagaauaugga

SEQ ID NO: 2554470 - RNA, 14 nt, Chlamydophila pneumoniae J138
cuaagaauauggac

SEQ ID NO: 2554471 - RNA, 20 nt, Chlamydophila pneumoniae J138
cuaagaaucuauaaauucaa

SEQ ID NO: 2554472 - RNA, 13 nt, Chlamydophila pneumoniae J138
cuaagacuagauc

SEQ ID NO: 2554473 - RNA, 23 nt, Chlamydophila pneumoniae J138
cuaagacuagaucgucaagcucu

SEQ ID NO: 2554474 - RNA, 13 nt, Chlamydophila pneumoniae J138
cuaagacugucua

SEQ ID NO: 2554475 - RNA, 17 nt, Chlamydophila pneumoniae J138
cuaagauccugagacca

SEQ ID NO: 2554476 - RNA, 23 nt, Chlamydophila pneumoniae J138
cuaagaucuuuagaauaagagcu

SEQ ID NO: 2554477 - RNA, 15 nt, Chlamydophila pneumoniae J138
cuaagaucuuuugua

SEQ ID NO: 2554478 - RNA, 21 nt, Chlamydophila pneumoniae J138
cuaagaucuuuuguaaucguu

SEQ ID NO: 2554479 - RNA, 17 nt, Chlamydophila pneumoniae J138
cuaagauuccuaacuuc

SEQ ID NO: 2554480 - RNA, 13 nt, Chlamydophila pneumoniae J138
cuaagcaaaaacu

SEQ ID NO: 2554481 - RNA, 14 nt, Chlamydophila pneumoniae J138
cuaagcaaaaacuu

SEQ ID NO: 2554482 - RNA, 15 nt, Chlamydophila pneumoniae J138
cuaagcaauauuucu

SEQ ID NO: 2554483 - RNA, 17 nt, Chlamydophila pneumoniae J138
cuaagcagccucuucuc

SEQ ID NO: 2554484 - RNA, 19 nt, Chlamydophila pneumoniae J138
cuaagcagccucuucucua

SEQ ID NO: 2554485 - RNA, 14 nt, Chlamydophila pneumoniae J138
cuaagcaucagaau

SEQ ID NO: 2554486 - RNA, 16 nt, Chlamydophila pneumoniae J138
cuaagcauucgacucu

SEQ ID NO: 2554487 - RNA, 16 nt, Chlamydophila pneumoniae J138
cuaagccaaauaccaa

SEQ ID NO: 2554488 - RNA, 15 nt, Chlamydophila pneumoniae J138
cuaagcgaaccaaag

SEQ ID NO: 2554489 - RNA, 17 nt, Chlamydophila pneumoniae J138
cuaagcgaaccaaaguc

SEQ ID NO: 2554490 - RNA, 16 nt, Chlamydophila pneumoniae J138
cuaagcgcucuucaau

SEQ ID NO: 2554491 - RNA, 21 nt, Chlamydophila pneumoniae J138
cuaagcucuuaauuucugcug

SEQ ID NO: 2554492 - RNA, 20 nt, Chlamydophila pneumoniae J138
cuaagcugugcauuuucuuc

SEQ ID NO: 2554493 - RNA, 19 nt, Chlamydophila pneumoniae J138
cuaaggaaauuacaaucuc

SEQ ID NO: 2554494 - RNA, 19 nt, Chlamydophila pneumoniae J138
cuaagggcucuagauauuc

SEQ ID NO: 2554495 - RNA, 18 nt, Chlamydophila pneumoniae J138
cuaagguuuccaugagaa

SEQ ID NO: 2554496 - RNA, 17 nt, Chlamydophila pneumoniae J138
cuaaguaaaacugcgcu

SEQ ID NO: 2554497 - RNA, 13 nt, Chlamydophila pneumoniae J138
cuaaguaacaguc

SEQ ID NO: 2554498 - RNA, 19 nt, Chlamydophila pneumoniae J138
cuaaguaacaguccucucc

SEQ ID NO: 2554499 - RNA, 20 nt, Chlamydophila pneumoniae J138
cuaaguccaacaucagcugu

SEQ ID NO: 2554500 - RNA, 17 nt, Chlamydophila pneumoniae J138
cuaagugauaaggaaga

SEQ ID NO: 2554501 - RNA, 22 nt, Chlamydophila pneumoniae J138
cuaauaaaauuggcuuuugaga

SEQ ID NO: 2554502 - RNA, 18 nt, Chlamydophila pneumoniae J138
cuaauaagauccaaaaau

SEQ ID NO: 2554503 - RNA, 12 nt, Chlamydophila pneumoniae J138
cuaauauugauu

SEQ ID NO: 2554504 - RNA, 17 nt, Chlamydophila pneumoniae J138
cuaaucaauccaagaau

SEQ ID NO: 2554505 - RNA, 19 nt, Chlamydophila pneumoniae J138
cuaaucacagcgucaggga

SEQ ID NO: 2554506 - RNA, 23 nt, Chlamydophila pneumoniae J138
cuaaucaccuuaggcuuaauaaa

SEQ ID NO: 2554507 - RNA, 15 nt, Chlamydophila pneumoniae J138
cuaaucucaggcauu

SEQ ID NO: 2554508 - RNA, 13 nt, Chlamydophila pneumoniae J138
cuaaucugauuca

SEQ ID NO: 2554509 - RNA, 20 nt, Chlamydophila pneumoniae J138
cuaaugacagcugagaaauu

SEQ ID NO: 2554510 - RNA, 16 nt, Chlamydophila pneumoniae J138
cuaauucuucuacaga

SEQ ID NO: 2554511 - RNA, 15 nt, Chlamydophila pneumoniae J138
cuaauuuaaaugccu

SEQ ID NO: 2554512 - RNA, 12 nt, Chlamydophila pneumoniae J138
cuaauuuccuuc

SEQ ID NO: 2554513 - RNA, 17 nt, Chlamydophila pneumoniae J138
cuaauuuccuucaggau

SEQ ID NO: 2554514 - RNA, 20 nt, Chlamydophila pneumoniae J138
cuacaaaauuauuaaacucg

SEQ ID NO: 2554515 - RNA, 16 nt, Chlamydophila pneumoniae J138
cuacaaauuaccuuga

SEQ ID NO: 2554516 - RNA, 11 nt, Chlamydophila pneumoniae J138
cuacaacaguu

SEQ ID NO: 2554517 - RNA, 19 nt, Chlamydophila pneumoniae J138
cuacaaucccgaguccuaa

SEQ ID NO: 2554518 - RNA, 19 nt, Chlamydophila pneumoniae J138
cuacaaucgccuuacaauu

SEQ ID NO: 2554519 - RNA, 23 nt, Chlamydophila pneumoniae J138
cuacaaucgccuuacaauuuaaa

SEQ ID NO: 2554520 - RNA, 14 nt, Chlamydophila pneumoniae J138
cuacaauuuccuug

SEQ ID NO: 2554521 - RNA, 22 nt, Chlamydophila pneumoniae J138
cuacaauuuccuugguauccca

SEQ ID NO: 2554522 - RNA, 23 nt, Chlamydophila pneumoniae J138
cuacacagacuugaggaaucuga

SEQ ID NO: 2554523 - RNA, 22 nt, Chlamydophila pneumoniae J138
cuacacaguagccuucuucucg

SEQ ID NO: 2554524 - RNA, 21 nt, Chlamydophila pneumoniae J138
cuacacuguuguaauaaaauc

SEQ ID NO: 2554525 - RNA, 15 nt, Chlamydophila pneumoniae J138
cuacagaggaaucua

SEQ ID NO: 2554526 - RNA, 20 nt, Chlamydophila pneumoniae J138
cuacagaggaaucuauccuu

SEQ ID NO: 2554527 - RNA, 21 nt, Chlamydophila pneumoniae J138
cuacagaggaaucuauccuuc

SEQ ID NO: 2554528 - RNA, 19 nt, Chlamydophila pneumoniae J138
cuacagagggcuucauucc

SEQ ID NO: 2554529 - RNA, 20 nt, Chlamydophila pneumoniae J138
cuacagagggcuucauuccu

SEQ ID NO: 2554530 - RNA, 13 nt, Chlamydophila pneumoniae J138
cuacagauaugcu

SEQ ID NO: 2554531 - RNA, 22 nt, Chlamydophila pneumoniae J138
cuacagaucaggauucuaaaaa

SEQ ID NO: 2554532 - RNA, 12 nt, Chlamydophila pneumoniae J138
cuacagcagaaa

SEQ ID NO: 2554533 - RNA, 16 nt, Chlamydophila pneumoniae J138
cuacagcuucuuuucc

SEQ ID NO: 2554534 - RNA, 16 nt, Chlamydophila pneumoniae J138
cuacaggaauucucau

SEQ ID NO: 2554535 - RNA, 17 nt, Chlamydophila pneumoniae J138
cuacauaaaaugagcuc

SEQ ID NO: 2554536 - RNA, 22 nt, Chlamydophila pneumoniae J138
cuacauaguuguucggacaaaa

SEQ ID NO: 2554537 - RNA, 19 nt, Chlamydophila pneumoniae J138
cuacauaguuuuuauuuuu

SEQ ID NO: 2554538 - RNA, 20 nt, Chlamydophila pneumoniae J138
cuacauaguuuuuauuuuua

SEQ ID NO: 2554539 - RNA, 21 nt, Chlamydophila pneumoniae J138
cuacauaguuuuuauuuuuaa

SEQ ID NO: 2554540 - RNA, 15 nt, Chlamydophila pneumoniae J138
cuacaucagacugaa

SEQ ID NO: 2554541 - RNA, 14 nt, Chlamydophila pneumoniae J138
cuacaucugugauu

SEQ ID NO: 2554542 - RNA, 16 nt, Chlamydophila pneumoniae J138
cuacauguaaagcaag

SEQ ID NO: 2554543 - RNA, 13 nt, Chlamydophila pneumoniae J138
cuaccaauucucu

SEQ ID NO: 2554544 - RNA, 14 nt, Chlamydophila pneumoniae J138
cuaccauaucuuga

SEQ ID NO: 2554545 - RNA, 18 nt, Chlamydophila pneumoniae J138
cuaccccacgcuaaacua

SEQ ID NO: 2554546 - RNA, 15 nt, Chlamydophila pneumoniae J138
cuacccucaucaucc

SEQ ID NO: 2554547 - RNA, 17 nt, Chlamydophila pneumoniae J138
cuacccucaucauccuc

SEQ ID NO: 2554548 - RNA, 18 nt, Chlamydophila pneumoniae J138
cuacccucaucauccuca

SEQ ID NO: 2554549 - RNA, 13 nt, Chlamydophila pneumoniae J138
cuaccgaacagag

SEQ ID NO: 2554550 - RNA, 20 nt, Chlamydophila pneumoniae J138
cuaccguucgguuauuugcu

SEQ ID NO: 2554551 - RNA, 19 nt, Chlamydophila pneumoniae J138
cuaccuacguagcauuaaa

SEQ ID NO: 2554552 - RNA, 14 nt, Chlamydophila pneumoniae J138
cuaccuauauuuuu

SEQ ID NO: 2554553 - RNA, 24 nt, Chlamydophila pneumoniae J138
cuaccucugggaagacucucauca

SEQ ID NO: 2554554 - RNA, 23 nt, Chlamydophila pneumoniae J138
cuaccuguguaaugagcuggaag

SEQ ID NO: 2554555 - RNA, 16 nt, Chlamydophila pneumoniae J138
cuacgacuacaucuug

SEQ ID NO: 2554556 - RNA, 20 nt, Chlamydophila pneumoniae J138
cuacggaacggacaaugcua

SEQ ID NO: 2554557 - RNA, 19 nt, Chlamydophila pneumoniae J138
cuacuaggcgcauaugcuc

SEQ ID NO: 2554558 - RNA, 22 nt, Chlamydophila pneumoniae J138
cuacucuacaguaguaaauaau

SEQ ID NO: 2554559 - RNA, 19 nt, Chlamydophila pneumoniae J138
cuacuuaaauccuaagcau

SEQ ID NO: 2554560 - RNA, 18 nt, Chlamydophila pneumoniae J138
cuacuucugcaggacugu

SEQ ID NO: 2554561 - RNA, 21 nt, Chlamydophila pneumoniae J138
cuacuugucugauuaguucuc

SEQ ID NO: 2554562 - RNA, 12 nt, Chlamydophila pneumoniae J138
cuacuuuaaagu

SEQ ID NO: 2554563 - RNA, 19 nt, Chlamydophila pneumoniae J138
cuagaaagauuuauuuugu

SEQ ID NO: 2554564 - RNA, 22 nt, Chlamydophila pneumoniae J138
cuagaaagauuuauuuugucuu

SEQ ID NO: 2554565 - RNA, 16 nt, Chlamydophila pneumoniae J138
cuagaacacucagaga

SEQ ID NO: 2554566 - RNA, 18 nt, Chlamydophila pneumoniae J138
cuagaacacucagagaug

SEQ ID NO: 2554567 - RNA, 22 nt, Chlamydophila pneumoniae J138
cuagaagaugaguguucucaau

SEQ ID NO: 2554568 - RNA, 17 nt, Chlamydophila pneumoniae J138
cuagaaucacauaaaau

SEQ ID NO: 2554569 - RNA, 20 nt, Chlamydophila pneumoniae J138
cuagaaucaccaauuuuuuc

SEQ ID NO: 2554570 - RNA, 23 nt, Chlamydophila pneumoniae J138
cuagaaucaccaauuuuuucccc

SEQ ID NO: 2554571 - RNA, 14 nt, Chlamydophila pneumoniae J138
cccaauuucuuuuu

SEQ ID NO: 2554572 - RNA, 21 nt, Chlamydophila pneumoniae J138
cccaccaaagugacuuccucc

SEQ ID NO: 2554573 - RNA, 11 nt, Chlamydophila pneumoniae J138
cccaccagaag

SEQ ID NO: 2554574 - RNA, 16 nt, Chlamydophila pneumoniae J138
cccaccauucuugaag

SEQ ID NO: 2554575 - RNA, 18 nt, Chlamydophila pneumoniae J138
cccacggcaaguuguggc

SEQ ID NO: 2554576 - RNA, 14 nt, Chlamydophila pneumoniae J138
cccacuagcccuug

SEQ ID NO: 2554577 - RNA, 13 nt, Chlamydophila pneumoniae J138
cccagauuuuuuu

SEQ ID NO: 2554578 - RNA, 17 nt, Chlamydophila pneumoniae J138
cccaguuguauccagcu

SEQ ID NO: 2554579 - RNA, 14 nt, Chlamydophila pneumoniae J138
cccauaaaaauuaa

SEQ ID NO: 2554580 - RNA, 14 nt, Chlamydophila pneumoniae J138
cccauagagccuug

SEQ ID NO: 2554581 - RNA, 14 nt, Chlamydophila pneumoniae J138
cccaugucuucaua

SEQ ID NO: 2554582 - RNA, 11 nt, Chlamydophila pneumoniae J138
cccauuccugc

SEQ ID NO: 2554583 - RNA, 12 nt, Chlamydophila pneumoniae J138
cccauuccugca

SEQ ID NO: 2554584 - RNA, 22 nt, Chlamydophila pneumoniae J138
ccccaaacauggacaauauaga

SEQ ID NO: 2554585 - RNA, 15 nt, Chlamydophila pneumoniae J138
ccccaucuaauccug

SEQ ID NO: 2554586 - RNA, 14 nt, Chlamydophila pneumoniae J138
cccccagcauucac

SEQ ID NO: 2554587 - RNA, 17 nt, Chlamydophila pneumoniae J138
cccccugcugccaugca

SEQ ID NO: 2554588 - RNA, 11 nt, Chlamydophila pneumoniae J138
ccccgcagcuu

SEQ ID NO: 2554589 - RNA, 20 nt, Chlamydophila pneumoniae J138
ccccggguuguccagagaca

SEQ ID NO: 2554590 - RNA, 14 nt, Chlamydophila pneumoniae J138
ccccuacagcagaa

SEQ ID NO: 2554591 - RNA, 15 nt, Chlamydophila pneumoniae J138
ccccuccaacaaaca

SEQ ID NO: 2554592 - RNA, 21 nt, Chlamydophila pneumoniae J138
ccccuggcguucaggauuuag

SEQ ID NO: 2554593 - RNA, 17 nt, Chlamydophila pneumoniae J138
ccccuucuaauacuuua

SEQ ID NO: 2554594 - RNA, 13 nt, Chlamydophila pneumoniae J138
cccgagcuuccau

SEQ ID NO: 2554595 - RNA, 16 nt, Chlamydophila pneumoniae J138
cccggaggcaaagauc

SEQ ID NO: 2554596 - RNA, 12 nt, Chlamydophila pneumoniae J138
cccuaagauucg

SEQ ID NO: 2554597 - RNA, 14 nt, Chlamydophila pneumoniae J138
cccuacagcagaaa

SEQ ID NO: 2554598 - RNA, 12 nt, Chlamydophila pneumoniae J138
cccuacccucau

SEQ ID NO: 2554599 - RNA, 17 nt, Chlamydophila pneumoniae J138
cccuagagguauuuccu

SEQ ID NO: 2554600 - RNA, 22 nt, Chlamydophila pneumoniae J138
cccuauagaacaugaggcacau

SEQ ID NO: 2554601 - RNA, 23 nt, Chlamydophila pneumoniae J138
cccucacaagaagcaaacccaca

SEQ ID NO: 2554602 - RNA, 19 nt, Chlamydophila pneumoniae J138
cccucacaauauaaaugcu

SEQ ID NO: 2554603 - RNA, 14 nt, Chlamydophila pneumoniae J138
cccucauaagauuu

SEQ ID NO: 2554604 - RNA, 21 nt, Chlamydophila pneumoniae J138
cccucauaagauuuccccaag

SEQ ID NO: 2554605 - RNA, 19 nt, Chlamydophila pneumoniae J138
cccuccaaaaucaucagcu

SEQ ID NO: 2554606 - RNA, 13 nt, Chlamydophila pneumoniae J138
cccuccaccagaa

SEQ ID NO: 2554607 - RNA, 22 nt, Chlamydophila pneumoniae J138
cccucccccaccaaagugacuu

SEQ ID NO: 2554608 - RNA, 13 nt, Chlamydophila pneumoniae J138
cccucgccaaacc

SEQ ID NO: 2554609 - RNA, 14 nt, Chlamydophila pneumoniae J138
cccucgccaaacca

SEQ ID NO: 2554610 - RNA, 22 nt, Chlamydophila pneumoniae J138
cccucuaaugacagcugagaaa

SEQ ID NO: 2554611 - RNA, 14 nt, Chlamydophila pneumoniae J138
cccucuccagaagu

SEQ ID NO: 2554612 - RNA, 11 nt, Chlamydophila pneumoniae J138
cccucuucauc

SEQ ID NO: 2554613 - RNA, 12 nt, Chlamydophila pneumoniae J138
cccucuucaucc

SEQ ID NO: 2554614 - RNA, 23 nt, Chlamydophila pneumoniae J138
cccucuucauccgaagacucaaa

SEQ ID NO: 2554615 - RNA, 12 nt, Chlamydophila pneumoniae J138
cccucuucuucc

SEQ ID NO: 2554616 - RNA, 18 nt, Chlamydophila pneumoniae J138
cccucuugcuuuuccguu

SEQ ID NO: 2554617 - RNA, 18 nt, Chlamydophila pneumoniae J138
cccugaaugcaacagagu

SEQ ID NO: 2554618 - RNA, 15 nt, Chlamydophila pneumoniae J138
cccugagccugugau

SEQ ID NO: 2554619 - RNA, 16 nt, Chlamydophila pneumoniae J138
cccugcggacagaaac

SEQ ID NO: 2554620 - RNA, 14 nt, Chlamydophila pneumoniae J138
cccuggaauuucuc

SEQ ID NO: 2554621 - RNA, 23 nt, Chlamydophila pneumoniae J138
cccuggauagcauacgacaguaa

SEQ ID NO: 2554622 - RNA, 14 nt, Chlamydophila pneumoniae J138
cccuggauuucuuc

SEQ ID NO: 2554623 - RNA, 14 nt, Chlamydophila pneumoniae J138
cccuguauuaaaga

SEQ ID NO: 2554624 - RNA, 21 nt, Chlamydophila pneumoniae J138
cccuguccaacuaaaacagcc

SEQ ID NO: 2554625 - RNA, 12 nt, Chlamydophila pneumoniae J138
cccuucuaauac

SEQ ID NO: 2554626 - RNA, 15 nt, Chlamydophila pneumoniae J138
cccuucuucuucagc

SEQ ID NO: 2554627 - RNA, 13 nt, Chlamydophila pneumoniae J138
cccuugaaucaua

SEQ ID NO: 2554628 - RNA, 17 nt, Chlamydophila pneumoniae J138
cccuugcaaaaguuguc

SEQ ID NO: 2554629 - RNA, 23 nt, Chlamydophila pneumoniae J138
cccuuuaaaaguacgaccaacuc

SEQ ID NO: 2554630 - RNA, 13 nt, Chlamydophila pneumoniae J138
cccuuucugcaau

SEQ ID NO: 2554631 - RNA, 16 nt, Chlamydophila pneumoniae J138
ccgaaacuucucagau

SEQ ID NO: 2554632 - RNA, 17 nt, Chlamydophila pneumoniae J138
ccgaagcauucccgacu

SEQ ID NO: 2554633 - RNA, 21 nt, Chlamydophila pneumoniae J138
ccgaagccuucauuccaugag

SEQ ID NO: 2554634 - RNA, 13 nt, Chlamydophila pneumoniae J138
ccgaaucucucca

SEQ ID NO: 2554635 - RNA, 15 nt, Chlamydophila pneumoniae J138
ccgaaucucuccagc

SEQ ID NO: 2554636 - RNA, 18 nt, Chlamydophila pneumoniae J138
ccgaaucuuucaaaagaa

SEQ ID NO: 2554637 - RNA, 17 nt, Chlamydophila pneumoniae J138
ccgacauucacccucau

SEQ ID NO: 2554638 - RNA, 14 nt, Chlamydophila pneumoniae J138
ccgacauuuaacau

SEQ ID NO: 2554639 - RNA, 15 nt, Chlamydophila pneumoniae J138
ccgacuuuccucaaa

SEQ ID NO: 2554640 - RNA, 13 nt, Chlamydophila pneumoniae J138
ccgagaauacaga

SEQ ID NO: 2554641 - RNA, 19 nt, Chlamydophila pneumoniae J138
ccgaggagggaaacaccgu

SEQ ID NO: 2554642 - RNA, 15 nt, Chlamydophila pneumoniae J138
ccgaguccuaaaauu

SEQ ID NO: 2554643 - RNA, 21 nt, Chlamydophila pneumoniae J138
ccgaugaggguaucucgucau

SEQ ID NO: 2554644 - RNA, 16 nt, Chlamydophila pneumoniae J138
ccgcagcaaaaauaug

SEQ ID NO: 2554645 - RNA, 19 nt, Chlamydophila pneumoniae J138
ccgcaggucgcaucaauga

SEQ ID NO: 2554646 - RNA, 14 nt, Chlamydophila pneumoniae J138
ccgcauuuccuagu

SEQ ID NO: 2554647 - RNA, 20 nt, Chlamydophila pneumoniae J138
ccgccuugacggguugugaa

SEQ ID NO: 2554648 - RNA, 16 nt, Chlamydophila pneumoniae J138
ccgccuuuauauaaag

SEQ ID NO: 2554649 - RNA, 20 nt, Chlamydophila pneumoniae J138
ccgcgcauagcaacuacaga

SEQ ID NO: 2554650 - RNA, 23 nt, Chlamydophila pneumoniae J138
ccgcucuaagcugugcauuuucu

SEQ ID NO: 2554651 - RNA, 14 nt, Chlamydophila pneumoniae J138
ccgcuguauuuuca

SEQ ID NO: 2554652 - RNA, 15 nt, Chlamydophila pneumoniae J138
ccggaaggaguucuu

SEQ ID NO: 2554653 - RNA, 14 nt, Chlamydophila pneumoniae J138
ccgggaaacaucag

SEQ ID NO: 2554654 - RNA, 14 nt, Chlamydophila pneumoniae J138
ccguaaaagaacgu

SEQ ID NO: 2554655 - RNA, 18 nt, Chlamydophila pneumoniae J138
ccguaaagaaaagcaauc

SEQ ID NO: 2554656 - RNA, 13 nt, Chlamydophila pneumoniae J138
ccguaacugaggc

SEQ ID NO: 2554657 - RNA, 21 nt, Chlamydophila pneumoniae J138
ccguaggguagccauccacga

SEQ ID NO: 2554658 - RNA, 20 nt, Chlamydophila pneumoniae J138
ccguaggguauccugcucca

SEQ ID NO: 2554659 - RNA, 20 nt, Chlamydophila pneumoniae J138
ccguauuuuuuacguucuuu

SEQ ID NO: 2554660 - RNA, 21 nt, Chlamydophila pneumoniae J138
ccguauuuuuuacguucuuuc

SEQ ID NO: 2554661 - RNA, 17 nt, Chlamydophila pneumoniae J138
ccgucaagaacaagagc

SEQ ID NO: 2554662 - RNA, 18 nt, Chlamydophila pneumoniae J138
ccgucauauuuaaaaggc

SEQ ID NO: 2554663 - RNA, 12 nt, Chlamydophila pneumoniae J138
ccguccucccca

SEQ ID NO: 2554664 - RNA, 14 nt, Chlamydophila pneumoniae J138
ccgugaacaaaaac

SEQ ID NO: 2554665 - RNA, 16 nt, Chlamydophila pneumoniae J138
ccugaaauccugggca

SEQ ID NO: 2554666 - RNA, 12 nt, Chlamydophila pneumoniae J138
ccugaagaugag

SEQ ID NO: 2554667 - RNA, 23 nt, Chlamydophila pneumoniae J138
ccugacgcauagcacuaugaauu

SEQ ID NO: 2554668 - RNA, 12 nt, Chlamydophila pneumoniae J138
ccugagaguguu

SEQ ID NO: 2554669 - RNA, 21 nt, Chlamydophila pneumoniae J138
ccugaggcuauagaauacaca

SEQ ID NO: 2554670 - RNA, 14 nt, Chlamydophila pneumoniae J138
ccugaguaaaauca

SEQ ID NO: 2554671 - RNA, 23 nt, Chlamydophila pneumoniae J138
ccugaguacuuugugauuacagc

SEQ ID NO: 2554672 - RNA, 14 nt, Chlamydophila pneumoniae J138
ccugaucuucuuga

SEQ ID NO: 2554673 - RNA, 17 nt, Chlamydophila pneumoniae J138
ccugcaccagacccucg

SEQ ID NO: 2554674 - RNA, 22 nt, Chlamydophila pneumoniae J138
ccugcaguauuauaaauagaaa

SEQ ID NO: 2554675 - RNA, 13 nt, Chlamydophila pneumoniae J138
ccugcauggcuuu

SEQ ID NO: 2554676 - RNA, 15 nt, Chlamydophila pneumoniae J138
ccugcauucauaaaa

SEQ ID NO: 2554677 - RNA, 19 nt, Chlamydophila pneumoniae J138
ccugcccauuuuuggaaaa

SEQ ID NO: 2554678 - RNA, 16 nt, Chlamydophila pneumoniae J138
ccugcuaaacuuuuuu

SEQ ID NO: 2554679 - RNA, 17 nt, Chlamydophila pneumoniae J138
ccugcuccaaaauggga

SEQ ID NO: 2554680 - RNA, 16 nt, Chlamydophila pneumoniae J138
ccugcuccucuucuuc

SEQ ID NO: 2554681 - RNA, 23 nt, Chlamydophila pneumoniae J138
ccuggaaaugaauauaauuccaa

SEQ ID NO: 2554682 - RNA, 22 nt, Chlamydophila pneumoniae J138
ccuggacugcugacaucuccaa

SEQ ID NO: 2554683 - RNA, 21 nt, Chlamydophila pneumoniae J138
ccuggaggcgguggcaugcca

SEQ ID NO: 2554684 - RNA, 16 nt, Chlamydophila pneumoniae J138
ccuggaugaacuccag

SEQ ID NO: 2554685 - RNA, 14 nt, Chlamydophila pneumoniae J138
ccuggauuuaggau

SEQ ID NO: 2554686 - RNA, 23 nt, Chlamydophila pneumoniae J138
ccugggcucacucuaagcgaaac

SEQ ID NO: 2554687 - RNA, 22 nt, Chlamydophila pneumoniae J138
ccugggcuuauuauugaauaag

SEQ ID NO: 2554688 - RNA, 21 nt, Chlamydophila pneumoniae J138
ccugggggacuucaaaugaaa

SEQ ID NO: 2554689 - RNA, 19 nt, Chlamydophila pneumoniae J138
ccugguuugacuccucgcu

SEQ ID NO: 2554690 - RNA, 15 nt, Chlamydophila pneumoniae J138
ccuguaacacccucc

SEQ ID NO: 2554691 - RNA, 17 nt, Chlamydophila pneumoniae J138
ccuguacgguaaaucca

SEQ ID NO: 2554692 - RNA, 15 nt, Chlamydophila pneumoniae J138
ccuguacuaucuuuu

SEQ ID NO: 2554693 - RNA, 18 nt, Chlamydophila pneumoniae J138
ccuguagcgaagagagua

SEQ ID NO: 2554694 - RNA, 23 nt, Chlamydophila pneumoniae J138
ccuguaguuucuaaaacagaaau

SEQ ID NO: 2554695 - RNA, 13 nt, Chlamydophila pneumoniae J138
ccuguauauucug

SEQ ID NO: 2554696 - RNA, 23 nt, Chlamydophila pneumoniae J138
ccuguauauucugaaauuucuga

SEQ ID NO: 2554697 - RNA, 16 nt, Chlamydophila pneumoniae J138
ccuguauuaaagaauc

SEQ ID NO: 2554698 - RNA, 19 nt, Chlamydophila pneumoniae J138
ccugucacaauaccaucuc

SEQ ID NO: 2554699 - RNA, 17 nt, Chlamydophila pneumoniae J138
ccugucacuaucuucua

SEQ ID NO: 2554700 - RNA, 20 nt, Chlamydophila pneumoniae J138
ccugugagucugaugcccac

SEQ ID NO: 2554701 - RNA, 19 nt, Chlamydophila pneumoniae J138
ccugugauagguagcagcc

SEQ ID NO: 2554702 - RNA, 17 nt, Chlamydophila pneumoniae J138
ccugugauuuccugacu

SEQ ID NO: 2554703 - RNA, 16 nt, Chlamydophila pneumoniae J138
ccuguguguuuuuucc

SEQ ID NO: 2554704 - RNA, 18 nt, Chlamydophila pneumoniae J138
ccuguucuagcaaaucua

SEQ ID NO: 2554705 - RNA, 22 nt, Chlamydophila pneumoniae J138
ccuguuucaacauaacaugaga

SEQ ID NO: 2554706 - RNA, 22 nt, Chlamydophila pneumoniae J138
ccuguuuucuuuucugaagauu

SEQ ID NO: 2554707 - RNA, 18 nt, Chlamydophila pneumoniae J138
ccuuaaagagaaucuccu

SEQ ID NO: 2554708 - RNA, 19 nt, Chlamydophila pneumoniae J138
ccuuaaagagaaucuccuc

SEQ ID NO: 2554709 - RNA, 17 nt, Chlamydophila pneumoniae J138
ccuuaaccuccucaaga

SEQ ID NO: 2554710 - RNA, 18 nt, Chlamydophila pneumoniae J138
ccuuagcauuaggaaagu

SEQ ID NO: 2554711 - RNA, 18 nt, Chlamydophila pneumoniae J138
ccuuaggcuuaauaaaca

SEQ ID NO: 2554712 - RNA, 23 nt, Chlamydophila pneumoniae J138
ccuuaugcucauuaauaauaucu

SEQ ID NO: 2554713 - RNA, 17 nt, Chlamydophila pneumoniae J138
ccuuauugguaacacga

SEQ ID NO: 2554714 - RNA, 20 nt, Chlamydophila pneumoniae J138
ccuucaacacaccauuuuug

SEQ ID NO: 2554715 - RNA, 16 nt, Chlamydophila pneumoniae J138
ccuucaagucgagaaa

SEQ ID NO: 2554716 - RNA, 19 nt, Chlamydophila pneumoniae J138
ccuucacaagaaaacaaag

SEQ ID NO: 2554717 - RNA, 16 nt, Chlamydophila pneumoniae J138
ccuucaggauuuucca

SEQ ID NO: 2554718 - RNA, 22 nt, Chlamydophila pneumoniae J138
ccuucauacguuuuuuuccuuu

SEQ ID NO: 2554719 - RNA, 23 nt, Chlamydophila pneumoniae J138
ccuucauucuuucgauaucucua

SEQ ID NO: 2554720 - RNA, 14 nt, Chlamydophila pneumoniae J138
ccuuccaagugcuc

SEQ ID NO: 2554721 - RNA, 19 nt, Chlamydophila pneumoniae J138
ccuuccaagugcucaguaa

SEQ ID NO: 2554722 - RNA, 23 nt, Chlamydophila pneumoniae J138
ccuucgaagcggagcaucuuuuc

SEQ ID NO: 2554723 - RNA, 11 nt, Chlamydophila pneumoniae J138
ccuucggcuuc

SEQ ID NO: 2554724 - RNA, 18 nt, Chlamydophila pneumoniae J138
ccuucuacagauugaugc

SEQ ID NO: 2554725 - RNA, 15 nt, Chlamydophila pneumoniae J138
ccuucucauugcggc

SEQ ID NO: 2554726 - RNA, 15 nt, Chlamydophila pneumoniae J138
ccuucugcaaucagu

SEQ ID NO: 2554727 - RNA, 22 nt, Chlamydophila pneumoniae J138
ccuucuggaugcccuggauagc

SEQ ID NO: 2554728 - RNA, 16 nt, Chlamydophila pneumoniae J138
ccuucuguuuucacau

SEQ ID NO: 2554729 - RNA, 13 nt, Chlamydophila pneumoniae J138
ccuucuucuucag

SEQ ID NO: 2554730 - RNA, 15 nt, Chlamydophila pneumoniae J138
ccuucuucuuuuaga

SEQ ID NO: 2554731 - RNA, 18 nt, Chlamydophila pneumoniae J138
ccuucuuucaauagcuuc

SEQ ID NO: 2554732 - RNA, 21 nt, Chlamydophila pneumoniae J138
ccuucuuucaauagcuuccaa

SEQ ID NO: 2554733 - RNA, 22 nt, Chlamydophila pneumoniae J138
ccuugaaaaucaagaagagaaa

SEQ ID NO: 2554734 - RNA, 21 nt, Chlamydophila pneumoniae J138
ccuugaaagacucgcucuccu

SEQ ID NO: 2554735 - RNA, 19 nt, Chlamydophila pneumoniae J138
ccuugaaauugcucuugcu

SEQ ID NO: 2554736 - RNA, 22 nt, Chlamydophila pneumoniae J138
ccuugaaucauagagauaucau

SEQ ID NO: 2554737 - RNA, 15 nt, Chlamydophila pneumoniae J138
ccuugacuaaaucca

SEQ ID NO: 2554738 - RNA, 16 nt, Chlamydophila pneumoniae J138
ccuugagacaaagaau

SEQ ID NO: 2554739 - RNA, 13 nt, Chlamydophila pneumoniae J138
ccuugcagcccug

SEQ ID NO: 2554740 - RNA, 13 nt, Chlamydophila pneumoniae J138
ccuugcauuagau

SEQ ID NO: 2554741 - RNA, 22 nt, Chlamydophila pneumoniae J138
ccuugcuaauaccucaaagcca

SEQ ID NO: 2554742 - RNA, 13 nt, Chlamydophila pneumoniae J138
ccuuggaaaucag

SEQ ID NO: 2554743 - RNA, 18 nt, Chlamydophila pneumoniae J138
ccuuggauuucuucuucu

SEQ ID NO: 2554744 - RNA, 23 nt, Chlamydophila pneumoniae J138
ccuuggauuucuucuucuaaagc

SEQ ID NO: 2554745 - RNA, 23 nt, Chlamydophila pneumoniae J138
ccuugggauuccuuaaugguagc

SEQ ID NO: 2554746 - RNA, 15 nt, Chlamydophila pneumoniae J138
ccuuguauaagagca

SEQ ID NO: 2554747 - RNA, 15 nt, Chlamydophila pneumoniae J138
ccuugugagaggguc

SEQ ID NO: 2554748 - RNA, 16 nt, Chlamydophila pneumoniae J138
ccuugugucuuaaagc

SEQ ID NO: 2554749 - RNA, 22 nt, Chlamydophila pneumoniae J138
ccuuguuguauggcagccugga

SEQ ID NO: 2554750 - RNA, 16 nt, Chlamydophila pneumoniae J138
ccuuuaaauaaaaucg

SEQ ID NO: 2554751 - RNA, 23 nt, Chlamydophila pneumoniae J138
ccuuuagagacgcuuuuaucugu

SEQ ID NO: 2554752 - RNA, 15 nt, Chlamydophila pneumoniae J138
ccuuuagcugcugaa

SEQ ID NO: 2554753 - RNA, 16 nt, Chlamydophila pneumoniae J138
ccuuuaggaagcugua

SEQ ID NO: 2554754 - RNA, 23 nt, Chlamydophila pneumoniae J138
ccuuucucuuccgauuaacuuua

SEQ ID NO: 2554755 - RNA, 14 nt, Chlamydophila pneumoniae J138
ccuuucuuuugcuu

SEQ ID NO: 2554756 - RNA, 18 nt, Chlamydophila pneumoniae J138
ccuuucuuuugcuuuucc

SEQ ID NO: 2554757 - RNA, 22 nt, Chlamydophila pneumoniae J138
ccuuugguagaaagacaaaaaa

SEQ ID NO: 2554758 - RNA, 20 nt, Chlamydophila pneumoniae J138
ccuuuguuuuaucuuuaguu

SEQ ID NO: 2554759 - RNA, 13 nt, Chlamydophila pneumoniae J138
ccuuuuuaggaaa

SEQ ID NO: 2554760 - RNA, 15 nt, Chlamydophila pneumoniae J138
cgaaaaaccuucucc

SEQ ID NO: 2554761 - RNA, 19 nt, Chlamydophila pneumoniae J138
cgaaaaacgguaaauaucu

SEQ ID NO: 2554762 - RNA, 18 nt, Chlamydophila pneumoniae J138
cgaaagcuacagcuaacg

SEQ ID NO: 2554763 - RNA, 14 nt, Chlamydophila pneumoniae J138
cgaaauccuaaaaa

SEQ ID NO: 2554764 - RNA, 21 nt, Chlamydophila pneumoniae J138
cgaaauccuaaaaaggguucc

SEQ ID NO: 2554765 - RNA, 16 nt, Chlamydophila pneumoniae J138
cgaaaugucgcuacca

SEQ ID NO: 2554766 - RNA, 15 nt, Chlamydophila pneumoniae J138
cgaaauucauuaaaa

SEQ ID NO: 2554767 - RNA, 15 nt, Chlamydophila pneumoniae J138
cgaacagcuccugga

SEQ ID NO: 2554768 - RNA, 14 nt, Chlamydophila pneumoniae J138
cgaacaugccugaa

SEQ ID NO: 2554769 - RNA, 21 nt, Chlamydophila pneumoniae J138
cgaacuauagcaauccauagu

SEQ ID NO: 2554770 - RNA, 21 nt, Chlamydophila pneumoniae J138
cgaacuccgcccgucuuagaa

SEQ ID NO: 2554771 - RNA, 21 nt, Chlamydophila pneumoniae J138
cgaacuguacgaauuucacac

SEQ ID NO: 2554772 - RNA, 20 nt, Chlamydophila pneumoniae J138
cgaacuucagcaagaaaaua

SEQ ID NO: 2554773 - RNA, 16 nt, Chlamydophila pneumoniae J138
cgaagaacagaggauc

SEQ ID NO: 2554774 - RNA, 18 nt, Chlamydophila pneumoniae J138
auugcuacuguccaucca

SEQ ID NO: 2554775 - RNA, 20 nt, Chlamydophila pneumoniae J138
auugcucguauuagaguuuc

SEQ ID NO: 2554776 - RNA, 22 nt, Chlamydophila pneumoniae J138
auugcucguauuagaguuucuu

SEQ ID NO: 2554777 - RNA, 13 nt, Chlamydophila pneumoniae J138
auugcugucagaa

SEQ ID NO: 2554778 - RNA, 18 nt, Chlamydophila pneumoniae J138
auuggaggauaaaugagu

SEQ ID NO: 2554779 - RNA, 20 nt, Chlamydophila pneumoniae J138
auuggaucuugauaaaagau

SEQ ID NO: 2554780 - RNA, 15 nt, Chlamydophila pneumoniae J138
auuggaugauagcua

SEQ ID NO: 2554781 - RNA, 20 nt, Chlamydophila pneumoniae J138
auuggcauagagccuagaga

SEQ ID NO: 2554782 - RNA, 22 nt, Chlamydophila pneumoniae J138
auugggagguucgcagaacuuc

SEQ ID NO: 2554783 - RNA, 15 nt, Chlamydophila pneumoniae J138
auugguaaggagagu

SEQ ID NO: 2554784 - RNA, 21 nt, Chlamydophila pneumoniae J138
auuguaaaucauuggaaccau

SEQ ID NO: 2554785 - RNA, 16 nt, Chlamydophila pneumoniae J138
auuguaauuuccuuag

SEQ ID NO: 2554786 - RNA, 22 nt, Chlamydophila pneumoniae J138
auuguaauuucuaaauagaaaa

SEQ ID NO: 2554787 - RNA, 13 nt, Chlamydophila pneumoniae J138
auuguagagagua

SEQ ID NO: 2554788 - RNA, 19 nt, Chlamydophila pneumoniae J138
auugucucaacauuucuca

SEQ ID NO: 2554789 - RNA, 12 nt, Chlamydophila pneumoniae J138
auugucuuaaaa

SEQ ID NO: 2554790 - RNA, 17 nt, Chlamydophila pneumoniae J138
auugugcucaauacaga

SEQ ID NO: 2554791 - RNA, 20 nt, Chlamydophila pneumoniae J138
auuguggaacgcauaagaga

SEQ ID NO: 2554792 - RNA, 15 nt, Chlamydophila pneumoniae J138
auuguguguuuucau

SEQ ID NO: 2554793 - RNA, 14 nt, Chlamydophila pneumoniae J138
auuguuaucaggaa

SEQ ID NO: 2554794 - RNA, 15 nt, Chlamydophila pneumoniae J138
auuguucaaaaauag

SEQ ID NO: 2554795 - RNA, 15 nt, Chlamydophila pneumoniae J138
auuguucuugaaguu

SEQ ID NO: 2554796 - RNA, 19 nt, Chlamydophila pneumoniae J138
auuguuggaauugcauuaa

SEQ ID NO: 2554797 - RNA, 21 nt, Chlamydophila pneumoniae J138
auuguuuaaguccuucuuccc

SEQ ID NO: 2554798 - RNA, 14 nt, Chlamydophila pneumoniae J138
auuguuuuugcaaa

SEQ ID NO: 2554799 - RNA, 21 nt, Chlamydophila pneumoniae J138
auuuaaaagguuuugaagcuc

SEQ ID NO: 2554800 - RNA, 17 nt, Chlamydophila pneumoniae J138
auuuaaagcugaaauuc

SEQ ID NO: 2554801 - RNA, 20 nt, Chlamydophila pneumoniae J138
auuuaaaugccuuaaaugua

SEQ ID NO: 2554802 - RNA, 21 nt, Chlamydophila pneumoniae J138
auuuaaaugccuuaaauguau

SEQ ID NO: 2554803 - RNA, 23 nt, Chlamydophila pneumoniae J138
auuuaagauaucgaccuuaaaau

SEQ ID NO: 2554804 - RNA, 20 nt, Chlamydophila pneumoniae J138
auuuacaaggauuuugagac

SEQ ID NO: 2554805 - RNA, 20 nt, Chlamydophila pneumoniae J138
auuuacaauuguguuugcag

SEQ ID NO: 2554806 - RNA, 20 nt, Chlamydophila pneumoniae J138
auuuacuuuuaauccuuuca

SEQ ID NO: 2554807 - RNA, 22 nt, Chlamydophila pneumoniae J138
auuuacuuuuaauccuuucaca

SEQ ID NO: 2554808 - RNA, 17 nt, Chlamydophila pneumoniae J138
auuuagaaucuuuucua

SEQ ID NO: 2554809 - RNA, 18 nt, Chlamydophila pneumoniae J138
auuuagauuaaagagacu

SEQ ID NO: 2554810 - RNA, 23 nt, Chlamydophila pneumoniae J138
auuuaggaugaauccaaaauaaa

SEQ ID NO: 2554811 - RNA, 16 nt, Chlamydophila pneumoniae J138
auuuagggaagaguuc

SEQ ID NO: 2554812 - RNA, 18 nt, Chlamydophila pneumoniae J138
auuuaggucgacuuccuu

SEQ ID NO: 2554813 - RNA, 13 nt, Chlamydophila pneumoniae J138
auuuaguucacca

SEQ ID NO: 2554814 - RNA, 20 nt, Chlamydophila pneumoniae J138
auuuauguuuucucgaagaa

SEQ ID NO: 2554815 - RNA, 14 nt, Chlamydophila pneumoniae J138
auuucaaagaugca

SEQ ID NO: 2554816 - RNA, 18 nt, Chlamydophila pneumoniae J138
auuucauaagagaacuuu

SEQ ID NO: 2554817 - RNA, 15 nt, Chlamydophila pneumoniae J138
auuucauuugaaaua

SEQ ID NO: 2554818 - RNA, 20 nt, Chlamydophila pneumoniae J138
auuuccauaggaucugcaug

SEQ ID NO: 2554819 - RNA, 19 nt, Chlamydophila pneumoniae J138
auuuccccaugaaaauaca

SEQ ID NO: 2554820 - RNA, 15 nt, Chlamydophila pneumoniae J138
auuucccuaaaauga

SEQ ID NO: 2554821 - RNA, 19 nt, Chlamydophila pneumoniae J138
auuuccggguucauuucca

SEQ ID NO: 2554822 - RNA, 19 nt, Chlamydophila pneumoniae J138
auuuccuaccuauauuuuu

SEQ ID NO: 2554823 - RNA, 21 nt, Chlamydophila pneumoniae J138
auuuccuaccuauauuuuuua

SEQ ID NO: 2554824 - RNA, 18 nt, Chlamydophila pneumoniae J138
auuuccuagguucuuuuc

SEQ ID NO: 2554825 - RNA, 18 nt, Chlamydophila pneumoniae J138
auuuccugacuauaaaau

SEQ ID NO: 2554826 - RNA, 13 nt, Chlamydophila pneumoniae J138
auuuccuuagaag

SEQ ID NO: 2554827 - RNA, 16 nt, Chlamydophila pneumoniae J138
auuuccuuauccguca

SEQ ID NO: 2554828 - RNA, 19 nt, Chlamydophila pneumoniae J138
auuuccuucaggauuuucc

SEQ ID NO: 2554829 - RNA, 20 nt, Chlamydophila pneumoniae J138
auuuccuucaggauuuucca

SEQ ID NO: 2554830 - RNA, 16 nt, Chlamydophila pneumoniae J138
auuuccuucuccagag

SEQ ID NO: 2554831 - RNA, 21 nt, Chlamydophila pneumoniae J138
auuucggaguuggaucaagga

SEQ ID NO: 2554832 - RNA, 22 nt, Chlamydophila pneumoniae J138
auuucguauagcuggcaaugau

SEQ ID NO: 2554833 - RNA, 17 nt, Chlamydophila pneumoniae J138
auuucgucaaagguuuu

SEQ ID NO: 2554834 - RNA, 15 nt, Chlamydophila pneumoniae J138
auuucgugaacaaaa

SEQ ID NO: 2554835 - RNA, 21 nt, Chlamydophila pneumoniae J138
auuucuaaaaaauagauaagu

SEQ ID NO: 2554836 - RNA, 23 nt, Chlamydophila pneumoniae J138
auuucuaaauagaaaacauagag

SEQ ID NO: 2554837 - RNA, 16 nt, Chlamydophila pneumoniae J138
auuucuagcuaauaau

SEQ ID NO: 2554838 - RNA, 15 nt, Chlamydophila pneumoniae J138
auuucuaguuguccu

SEQ ID NO: 2554839 - RNA, 22 nt, Chlamydophila pneumoniae J138
auuucuccaguaucuucucuua

SEQ ID NO: 2554840 - RNA, 22 nt, Chlamydophila pneumoniae J138
auuucuccgucaagaacaagag

SEQ ID NO: 2554841 - RNA, 23 nt, Chlamydophila pneumoniae J138
auuucucuaagcagccucuucuc

SEQ ID NO: 2554842 - RNA, 14 nt, Chlamydophila pneumoniae J138
auuucucuccacag

SEQ ID NO: 2554843 - RNA, 15 nt, Chlamydophila pneumoniae J138
auuucugaucguaca

SEQ ID NO: 2554844 - RNA, 18 nt, Chlamydophila pneumoniae J138
auuucuguaguucuugcc

SEQ ID NO: 2554845 - RNA, 20 nt, Chlamydophila pneumoniae J138
auuucuguaguucuugccaa

SEQ ID NO: 2554846 - RNA, 15 nt, Chlamydophila pneumoniae J138
auuucuguucugcuu

SEQ ID NO: 2554847 - RNA, 14 nt, Chlamydophila pneumoniae J138
auuucuuaauuucc

SEQ ID NO: 2554848 - RNA, 16 nt, Chlamydophila pneumoniae J138
auuucuuacaagacaa

SEQ ID NO: 2554849 - RNA, 19 nt, Chlamydophila pneumoniae J138
auuucuucaauaggaauua

SEQ ID NO: 2554850 - RNA, 21 nt, Chlamydophila pneumoniae J138
auuucuucaauaggaauuaga

SEQ ID NO: 2554851 - RNA, 11 nt, Chlamydophila pneumoniae J138
auuucuucuuc

SEQ ID NO: 2554852 - RNA, 19 nt, Chlamydophila pneumoniae J138
auuucuucuucuauacgaa

SEQ ID NO: 2554853 - RNA, 14 nt, Chlamydophila pneumoniae J138
auuucuucuuucca

SEQ ID NO: 2554854 - RNA, 16 nt, Chlamydophila pneumoniae J138
auuucuuucacaucuu

SEQ ID NO: 2554855 - RNA, 18 nt, Chlamydophila pneumoniae J138
auuucuuuuucagcuucu

SEQ ID NO: 2554856 - RNA, 21 nt, Chlamydophila pneumoniae J138
auuucuuuuugccaauuuuca

SEQ ID NO: 2554857 - RNA, 18 nt, Chlamydophila pneumoniae J138
cuagagaaccuccuauuc

SEQ ID NO: 2554858 - RNA, 22 nt, Chlamydophila pneumoniae J138
cuagagaguucuuguaauaaaa

SEQ ID NO: 2554859 - RNA, 16 nt, Chlamydophila pneumoniae J138
cuagagauuguaauuu

SEQ ID NO: 2554860 - RNA, 21 nt, Chlamydophila pneumoniae J138
cuagagauuguaauuuccuua

SEQ ID NO: 2554861 - RNA, 14 nt, Chlamydophila pneumoniae J138
cuagagauuuuucu

SEQ ID NO: 2554862 - RNA, 17 nt, Chlamydophila pneumoniae J138
cuagagauuuuucuagg

SEQ ID NO: 2554863 - RNA, 20 nt, Chlamydophila pneumoniae J138
cuagagcacauagaaacagu

SEQ ID NO: 2554864 - RNA, 20 nt, Chlamydophila pneumoniae J138
cuagagcauuccgagcugca

SEQ ID NO: 2554865 - RNA, 19 nt, Chlamydophila pneumoniae J138
cuagagcuuucagaaaaga

SEQ ID NO: 2554866 - RNA, 18 nt, Chlamydophila pneumoniae J138
cuagaggagcgaugacuu

SEQ ID NO: 2554867 - RNA, 15 nt, Chlamydophila pneumoniae J138
cuagaggaucuucaa

SEQ ID NO: 2554868 - RNA, 17 nt, Chlamydophila pneumoniae J138
cuagagguauuuccuuc

SEQ ID NO: 2554869 - RNA, 13 nt, Chlamydophila pneumoniae J138
cuagaguccaagg

SEQ ID NO: 2554870 - RNA, 14 nt, Chlamydophila pneumoniae J138
cuagaguucauuuu

SEQ ID NO: 2554871 - RNA, 16 nt, Chlamydophila pneumoniae J138
cuagaucaaaacuccg

SEQ ID NO: 2554872 - RNA, 13 nt, Chlamydophila pneumoniae J138
cuagaucacaaga

SEQ ID NO: 2554873 - RNA, 17 nt, Chlamydophila pneumoniae J138
cuagaucacaagaaaga

SEQ ID NO: 2554874 - RNA, 12 nt, Chlamydophila pneumoniae J138
cuagaucuucaa

SEQ ID NO: 2554875 - RNA, 21 nt, Chlamydophila pneumoniae J138
cuagauuuugagaaugaacaa

SEQ ID NO: 2554876 - RNA, 20 nt, Chlamydophila pneumoniae J138
cuagcaaaucuaaaaccuga

SEQ ID NO: 2554877 - RNA, 20 nt, Chlamydophila pneumoniae J138
cuagcagaaguccuaucaaa

SEQ ID NO: 2554878 - RNA, 16 nt, Chlamydophila pneumoniae J138
cuagcaguugcaauac

SEQ ID NO: 2554879 - RNA, 14 nt, Chlamydophila pneumoniae J138
cuagcuccagcauc

SEQ ID NO: 2554880 - RNA, 21 nt, Chlamydophila pneumoniae J138
cuaggaacucuuuaaaagggc

SEQ ID NO: 2554881 - RNA, 17 nt, Chlamydophila pneumoniae J138
cuaggaaucuuuuagag

SEQ ID NO: 2554882 - RNA, 23 nt, Chlamydophila pneumoniae J138
cuaggacguaauuacgcucucca

SEQ ID NO: 2554883 - RNA, 12 nt, Chlamydophila pneumoniae J138
cuaggagagcua

SEQ ID NO: 2554884 - RNA, 12 nt, Chlamydophila pneumoniae J138
cuaggauaucau

SEQ ID NO: 2554885 - RNA, 19 nt, Chlamydophila pneumoniae J138
cuaggcaugguaggagccg

SEQ ID NO: 2554886 - RNA, 20 nt, Chlamydophila pneumoniae J138
cuaggccgggauuuuaauuc

SEQ ID NO: 2554887 - RNA, 21 nt, Chlamydophila pneumoniae J138
cuaggccgggauuuuaauuca

SEQ ID NO: 2554888 - RNA, 19 nt, Chlamydophila pneumoniae J138
cuagggacuucucaaagac

SEQ ID NO: 2554889 - RNA, 19 nt, Chlamydophila pneumoniae J138
cuagggaucccaaaaaaug

SEQ ID NO: 2554890 - RNA, 17 nt, Chlamydophila pneumoniae J138
cuaggguuucuacagga

SEQ ID NO: 2554891 - RNA, 20 nt, Chlamydophila pneumoniae J138
cuaggguuucuacaggauau

SEQ ID NO: 2554892 - RNA, 15 nt, Chlamydophila pneumoniae J138
cuagguauuuguuuc

SEQ ID NO: 2554893 - RNA, 14 nt, Chlamydophila pneumoniae J138
cuagguucuuuucg

SEQ ID NO: 2554894 - RNA, 14 nt, Chlamydophila pneumoniae J138
cuagguucuuuuuu

SEQ ID NO: 2554895 - RNA, 17 nt, Chlamydophila pneumoniae J138
cuaguauuaagauagac

SEQ ID NO: 2554896 - RNA, 23 nt, Chlamydophila pneumoniae J138
cuaguauuaagauagacucucac

SEQ ID NO: 2554897 - RNA, 15 nt, Chlamydophila pneumoniae J138
cuaguccuguacauc

SEQ ID NO: 2554898 - RNA, 12 nt, Chlamydophila pneumoniae J138
cuagucuucuua

SEQ ID NO: 2554899 - RNA, 14 nt, Chlamydophila pneumoniae J138
cuaguucuucuuua

SEQ ID NO: 2554900 - RNA, 12 nt, Chlamydophila pneumoniae J138
cuaguuuuucuu

SEQ ID NO: 2554901 - RNA, 19 nt, Chlamydophila pneumoniae J138
cuaguuuuucuuuagagau

SEQ ID NO: 2554902 - RNA, 12 nt, Chlamydophila pneumoniae J138
cuauaaaauaaa

SEQ ID NO: 2554903 - RNA, 17 nt, Chlamydophila pneumoniae J138
cuauaaagcaaaugccu

SEQ ID NO: 2554904 - RNA, 15 nt, Chlamydophila pneumoniae J138
cuauaacuacaaaau

SEQ ID NO: 2554905 - RNA, 17 nt, Chlamydophila pneumoniae J138
cuauaauuaauccuuga

SEQ ID NO: 2554906 - RNA, 18 nt, Chlamydophila pneumoniae J138
cuauacguaauccagauu

SEQ ID NO: 2554907 - RNA, 20 nt, Chlamydophila pneumoniae J138
cuauacucucuguagcacuu

SEQ ID NO: 2554908 - RNA, 22 nt, Chlamydophila pneumoniae J138
cuauagaauacacagcuaugau

SEQ ID NO: 2554909 - RNA, 19 nt, Chlamydophila pneumoniae J138
cuauagaugccauaagucc

SEQ ID NO: 2554910 - RNA, 17 nt, Chlamydophila pneumoniae J138
cuauagauuuaagaguc

SEQ ID NO: 2554911 - RNA, 15 nt, Chlamydophila pneumoniae J138
cuauagccucuucua

SEQ ID NO: 2554912 - RNA, 19 nt, Chlamydophila pneumoniae J138
cuauagccucuucuacacc

SEQ ID NO: 2554913 - RNA, 20 nt, Chlamydophila pneumoniae J138
cuauagggaucuccuugaga

SEQ ID NO: 2554914 - RNA, 22 nt, Chlamydophila pneumoniae J138
cuauaguauaauagugagcucc

SEQ ID NO: 2554915 - RNA, 16 nt, Chlamydophila pneumoniae J138
cuauauccacaaucuc

SEQ ID NO: 2554916 - RNA, 20 nt, Chlamydophila pneumoniae J138
cuauaugaaugauuuccaua

SEQ ID NO: 2554917 - RNA, 20 nt, Chlamydophila pneumoniae J138
cuaucagcuggguaagucca

SEQ ID NO: 2554918 - RNA, 16 nt, Chlamydophila pneumoniae J138
cuaucauaucuucaaa

SEQ ID NO: 2554919 - RNA, 20 nt, Chlamydophila pneumoniae J138
cuaucaucaaugguuaaaac

SEQ ID NO: 2554920 - RNA, 17 nt, Chlamydophila pneumoniae J138
cuaucccacuaacaaga

SEQ ID NO: 2554921 - RNA, 16 nt, Chlamydophila pneumoniae J138
cuauccgcacucauag

SEQ ID NO: 2554922 - RNA, 13 nt, Chlamydophila pneumoniae J138
cuauccuauuuua

SEQ ID NO: 2554923 - RNA, 14 nt, Chlamydophila pneumoniae J138
cuaucuaucuauag

SEQ ID NO: 2554924 - RNA, 11 nt, Chlamydophila pneumoniae J138
cuaucuccaga

SEQ ID NO: 2554925 - RNA, 12 nt, Chlamydophila pneumoniae J138
cuaucuccagaa

SEQ ID NO: 2554926 - RNA, 13 nt, Chlamydophila pneumoniae J138
cuaucuccagaaa

SEQ ID NO: 2554927 - RNA, 20 nt, Chlamydophila pneumoniae J138
cuaucuccagaaauuuuuac

SEQ ID NO: 2554928 - RNA, 23 nt, Chlamydophila pneumoniae J138
cuaucugccauaggauccaggag

SEQ ID NO: 2554929 - RNA, 18 nt, Chlamydophila pneumoniae J138
cuaucuuuauuuaaauaa

SEQ ID NO: 2554930 - RNA, 23 nt, Chlamydophila pneumoniae J138
cuaucuuuauuuaaauaaaacca

SEQ ID NO: 2554931 - RNA, 18 nt, Chlamydophila pneumoniae J138
cuaugagauaggaacuca

SEQ ID NO: 2554932 - RNA, 23 nt, Chlamydophila pneumoniae J138
cuaugaggaacugggcauagugg

SEQ ID NO: 2554933 - RNA, 15 nt, Chlamydophila pneumoniae J138
cuaugauaucaccag

SEQ ID NO: 2554934 - RNA, 19 nt, Chlamydophila pneumoniae J138
cuaugauccgaaaacucuu

SEQ ID NO: 2554935 - RNA, 21 nt, Chlamydophila pneumoniae J138
cuaugaucgggguuucagaag

SEQ ID NO: 2554936 - RNA, 23 nt, Chlamydophila pneumoniae J138
cuaugaugagaacguccucaccu

SEQ ID NO: 2554937 - RNA, 14 nt, Chlamydophila pneumoniae J138
cuauggaaagaguc

SEQ ID NO: 2554938 - RNA, 14 nt, Chlamydophila pneumoniae J138
cuaugggaggaauu

SEQ ID NO: 2554939 - RNA, 21 nt, Chlamydophila pneumoniae J138
cuaugggaggaauuccucuca

SEQ ID NO: 2554940 - RNA, 15 nt, Chlamydophila pneumoniae J138
cuaugguaaucaccu

SEQ ID NO: 2554941 - RNA, 19 nt, Chlamydophila pneumoniae J138
cuauggucucccucacaag

SEQ ID NO: 2554942 - RNA, 20 nt, Chlamydophila pneumoniae J138
cuauggucucccucacaaga

SEQ ID NO: 2554943 - RNA, 23 nt, Chlamydophila pneumoniae J138
cuaugugaugucgcgaaaguaaa

SEQ ID NO: 2554944 - RNA, 15 nt, Chlamydophila pneumoniae J138
cuauguguucucgaa

SEQ ID NO: 2554945 - RNA, 14 nt, Chlamydophila pneumoniae J138
cuauuauuuuaaag

SEQ ID NO: 2554946 - RNA, 20 nt, Chlamydophila pneumoniae J138
cuauucccgacucggagacc

SEQ ID NO: 2554947 - RNA, 21 nt, Chlamydophila pneumoniae J138
cuauucccgacucggagacca

SEQ ID NO: 2554948 - RNA, 18 nt, Chlamydophila pneumoniae J138
cuauucgcugucuagaac

SEQ ID NO: 2554949 - RNA, 14 nt, Chlamydophila pneumoniae J138
cuauuguuuguccu

SEQ ID NO: 2554950 - RNA, 18 nt, Chlamydophila pneumoniae J138
cuauuucauauaaaguuu

SEQ ID NO: 2554951 - RNA, 13 nt, Chlamydophila pneumoniae J138
cuauuugaaaaga

SEQ ID NO: 2554952 - RNA, 21 nt, Chlamydophila pneumoniae J138
cuauuugcaacaaucuuucuu

SEQ ID NO: 2554953 - RNA, 14 nt, Chlamydophila pneumoniae J138
cuauuuuugaggaa

SEQ ID NO: 2554954 - RNA, 14 nt, Chlamydophila pneumoniae J138
cucaaagaaagucu

SEQ ID NO: 2554955 - RNA, 19 nt, Chlamydophila pneumoniae J138
cucaaaucucauuccagca

SEQ ID NO: 2554956 - RNA, 17 nt, Chlamydophila pneumoniae J138
cucaaaucuuucaagga

SEQ ID NO: 2554957 - RNA, 23 nt, Chlamydophila pneumoniae J138
cucaacuuaaguugaccuuuuuc

SEQ ID NO: 2554958 - RNA, 19 nt, Chlamydophila pneumoniae J138
cucaagaagaugauuggac

SEQ ID NO: 2554959 - RNA, 15 nt, Chlamydophila pneumoniae J138
cucaagaauaugaac

SEQ ID NO: 2554960 - RNA, 20 nt, Chlamydophila pneumoniae J138
cucaagaauaugaacugccu

SEQ ID NO: 2554961 - RNA, 20 nt, Chlamydophila pneumoniae J138
cucaagagcaugcuugagga

SEQ ID NO: 2554962 - RNA, 21 nt, Chlamydophila pneumoniae J138
cucaagagcaugcuugaggaa

SEQ ID NO: 2554963 - RNA, 23 nt, Chlamydophila pneumoniae J138
cucaagauaaaucccacuaucug

SEQ ID NO: 2554964 - RNA, 13 nt, Chlamydophila pneumoniae J138
cucaagaucuuca

SEQ ID NO: 2554965 - RNA, 14 nt, Chlamydophila pneumoniae J138
cucaaggcaucuag

SEQ ID NO: 2554966 - RNA, 20 nt, Chlamydophila pneumoniae J138
cucaaggucacagcauuuuc

SEQ ID NO: 2554967 - RNA, 20 nt, Chlamydophila pneumoniae J138
cucaagucuauuugaaaaga

SEQ ID NO: 2554968 - RNA, 19 nt, Chlamydophila pneumoniae J138
cucaauaguguaacauuga

SEQ ID NO: 2554969 - RNA, 15 nt, Chlamydophila pneumoniae J138
cucaaucaaauucaa

SEQ ID NO: 2554970 - RNA, 14 nt, Chlamydophila pneumoniae J138
cucacaaacaacag

SEQ ID NO: 2554971 - RNA, 15 nt, Chlamydophila pneumoniae J138
cucacaaacaacaga

SEQ ID NO: 2554972 - RNA, 17 nt, Chlamydophila pneumoniae J138
cucacaaacaacagaaa

SEQ ID NO: 2554973 - RNA, 20 nt, Chlamydophila pneumoniae J138
cucacaaacaacagaaaugu

SEQ ID NO: 2554974 - RNA, 15 nt, Chlamydophila pneumoniae J138
cucacaagcauccua

SEQ ID NO: 2554975 - RNA, 18 nt, Chlamydophila pneumoniae J138
cucacacgaauaauuaaa

SEQ ID NO: 2554976 - RNA, 15 nt, Chlamydophila pneumoniae J138
cucacaucuccuuuc

SEQ ID NO: 2554977 - RNA, 16 nt, Chlamydophila pneumoniae J138
cucacauguuucacuu

SEQ ID NO: 2554978 - RNA, 23 nt, Chlamydophila pneumoniae J138
cucaccacggaagauaugucgcu

SEQ ID NO: 2554979 - RNA, 16 nt, Chlamydophila pneumoniae J138
cucaccagaagcaacu

SEQ ID NO: 2554980 - RNA, 19 nt, Chlamydophila pneumoniae J138
cucaccagaagcaacuaaa

SEQ ID NO: 2554981 - RNA, 23 nt, Chlamydophila pneumoniae J138
cucaccagaagcaacuaaacucu

SEQ ID NO: 2554982 - RNA, 14 nt, Chlamydophila pneumoniae J138
cucacgggauagcc

SEQ ID NO: 2554983 - RNA, 14 nt, Chlamydophila pneumoniae J138
cucacuagagauuc

SEQ ID NO: 2554984 - RNA, 13 nt, Chlamydophila pneumoniae J138
cucacucuuuucu

SEQ ID NO: 2554985 - RNA, 22 nt, Chlamydophila pneumoniae J138
cucacuguuuuucguaagcuga

SEQ ID NO: 2554986 - RNA, 23 nt, Chlamydophila pneumoniae J138
cucagaaaggagauccacagacu

SEQ ID NO: 2554987 - RNA, 17 nt, Chlamydophila pneumoniae J138
cucagaauccauuuugc

SEQ ID NO: 2554988 - RNA, 14 nt, Chlamydophila pneumoniae J138
cucagcaaagacau

SEQ ID NO: 2554989 - RNA, 22 nt, Chlamydophila pneumoniae J138
cucagcaaagacauccaagccu

SEQ ID NO: 2554990 - RNA, 18 nt, Chlamydophila pneumoniae J138
cucagcguucgcucucuu

SEQ ID NO: 2554991 - RNA, 16 nt, Chlamydophila pneumoniae J138
cucagcuaauuuaaau

SEQ ID NO: 2554992 - RNA, 13 nt, Chlamydophila pneumoniae J138
cucaggaaaacuu

SEQ ID NO: 2554993 - RNA, 15 nt, Chlamydophila pneumoniae J138
cucaggaaaacuuaa

SEQ ID NO: 2554994 - RNA, 22 nt, Chlamydophila pneumoniae J138
cucaggaaagguaguuuucuuc

SEQ ID NO: 2554995 - RNA, 23 nt, Chlamydophila pneumoniae J138
cucaggaccuaagggcucuccua

SEQ ID NO: 2554996 - RNA, 15 nt, Chlamydophila pneumoniae J138
cucaggauauauaga

SEQ ID NO: 2554997 - RNA, 15 nt, Chlamydophila pneumoniae J138
cucaggcuuuaagug

SEQ ID NO: 2554998 - RNA, 19 nt, Chlamydophila pneumoniae J138
cucaggcuuuaaguguuuc

SEQ ID NO: 2554999 - RNA, 20 nt, Chlamydophila pneumoniae J138
cucaggucugcugaggagag

SEQ ID NO: 2555000 - RNA, 16 nt, Chlamydophila pneumoniae J138
cucaguaggagcagcg

SEQ ID NO: 2555001 - RNA, 15 nt, Chlamydophila pneumoniae J138
cucagucacaauaua

SEQ ID NO: 2555002 - RNA, 19 nt, Chlamydophila pneumoniae J138
cucagugaacucuucaaga

SEQ ID NO: 2555003 - RNA, 23 nt, Chlamydophila pneumoniae J138
cucagugaacucuucaagagcuu

SEQ ID NO: 2555004 - RNA, 15 nt, Chlamydophila pneumoniae J138
cucaguguauuguuu

SEQ ID NO: 2555005 - RNA, 12 nt, Chlamydophila pneumoniae J138
cucaguugagaa

SEQ ID NO: 2555006 - RNA, 14 nt, Chlamydophila pneumoniae J138
cucauagcuuccug

SEQ ID NO: 2555007 - RNA, 16 nt, Chlamydophila pneumoniae J138
cucauagcuuccugua

SEQ ID NO: 2555008 - RNA, 18 nt, Chlamydophila pneumoniae J138
cucauagcuuccuguagu

SEQ ID NO: 2555009 - RNA, 18 nt, Chlamydophila pneumoniae J138
cucaucacaauuuuaaaa

SEQ ID NO: 2555010 - RNA, 18 nt, Chlamydophila pneumoniae J138
cucaucacguaagguguc

SEQ ID NO: 2555011 - RNA, 20 nt, Chlamydophila pneumoniae J138
cucaucagcaaaacucccga

SEQ ID NO: 2555012 - RNA, 14 nt, Chlamydophila pneumoniae J138
cucaucagcaaccu

SEQ ID NO: 2555013 - RNA, 14 nt, Chlamydophila pneumoniae J138
cucaucaucagaaa

SEQ ID NO: 2555014 - RNA, 13 nt, Chlamydophila pneumoniae J138
cucaucauccuca

SEQ ID NO: 2555015 - RNA, 20 nt, Chlamydophila pneumoniae J138
cucaucauccucaggaccua

SEQ ID NO: 2555016 - RNA, 16 nt, Chlamydophila pneumoniae J138
cucauccuaaauuaaa

SEQ ID NO: 2555017 - RNA, 23 nt, Chlamydophila pneumoniae J138
cucaucgaaucuugauauugaaa

SEQ ID NO: 2555018 - RNA, 16 nt, Chlamydophila pneumoniae J138
cucaucggaucuuuuc

SEQ ID NO: 2555019 - RNA, 17 nt, Chlamydophila pneumoniae J138
cucaucggaucuuuucu

SEQ ID NO: 2555020 - RNA, 18 nt, Chlamydophila pneumoniae J138
cucaucggaucuuuucuu

SEQ ID NO: 2555021 - RNA, 21 nt, Chlamydophila pneumoniae J138
cucaucuaacgucagcugucc

SEQ ID NO: 2555022 - RNA, 16 nt, Chlamydophila pneumoniae J138
cucaucuagaaagauu

SEQ ID NO: 2555023 - RNA, 22 nt, Chlamydophila pneumoniae J138
cucaucucgcaguccaaagacu

SEQ ID NO: 2555024 - RNA, 18 nt, Chlamydophila pneumoniae J138
cuucacuuauaagcugcu

SEQ ID NO: 2555025 - RNA, 16 nt, Chlamydophila pneumoniae J138
cuucagaauucucaag

SEQ ID NO: 2555026 - RNA, 11 nt, Chlamydophila pneumoniae J138
cuucagagaga

SEQ ID NO: 2555027 - RNA, 16 nt, Chlamydophila pneumoniae J138
cuucagagagaacagg

SEQ ID NO: 2555028 - RNA, 18 nt, Chlamydophila pneumoniae J138
cuucagagagaacaggag

SEQ ID NO: 2555029 - RNA, 17 nt, Chlamydophila pneumoniae J138
cuucagcaacuaaagca

SEQ ID NO: 2555030 - RNA, 21 nt, Chlamydophila pneumoniae J138
cuucagcacgaauaaagcccu

SEQ ID NO: 2555031 - RNA, 13 nt, Chlamydophila pneumoniae J138
cuucagcuuuuuc

SEQ ID NO: 2555032 - RNA, 15 nt, Chlamydophila pneumoniae J138
cuucaggacaugccu

SEQ ID NO: 2555033 - RNA, 15 nt, Chlamydophila pneumoniae J138
cuucagucugaugua

SEQ ID NO: 2555034 - RNA, 15 nt, Chlamydophila pneumoniae J138
cuucaguuguugcuu

SEQ ID NO: 2555035 - RNA, 15 nt, Chlamydophila pneumoniae J138
cuucauaugcucucc

SEQ ID NO: 2555036 - RNA, 16 nt, Chlamydophila pneumoniae J138
cuucauaugcucuccc

SEQ ID NO: 2555037 - RNA, 17 nt, Chlamydophila pneumoniae J138
cuucauaugcucucccg

SEQ ID NO: 2555038 - RNA, 14 nt, Chlamydophila pneumoniae J138
cuucaucacaaaau

SEQ ID NO: 2555039 - RNA, 12 nt, Chlamydophila pneumoniae J138
cuucaucagaag

SEQ ID NO: 2555040 - RNA, 21 nt, Chlamydophila pneumoniae J138
cuucauccgaagacucaaaga

SEQ ID NO: 2555041 - RNA, 13 nt, Chlamydophila pneumoniae J138
cuucaugcugcuu

SEQ ID NO: 2555042 - RNA, 17 nt, Chlamydophila pneumoniae J138
cuucaugcugcuuugac

SEQ ID NO: 2555043 - RNA, 14 nt, Chlamydophila pneumoniae J138
cuucauuaucuucg

SEQ ID NO: 2555044 - RNA, 14 nt, Chlamydophila pneumoniae J138
cuucauugcaaaaa

SEQ ID NO: 2555045 - RNA, 18 nt, Chlamydophila pneumoniae J138
cuucauuuucuuuuaaga

SEQ ID NO: 2555046 - RNA, 22 nt, Chlamydophila pneumoniae J138
cuuccaaagacugagcuucuau

SEQ ID NO: 2555047 - RNA, 18 nt, Chlamydophila pneumoniae J138
cuuccaacggacauuuuc

SEQ ID NO: 2555048 - RNA, 23 nt, Chlamydophila pneumoniae J138
cuuccaacggacauuuucaagcu

SEQ ID NO: 2555049 - RNA, 16 nt, Chlamydophila pneumoniae J138
cuuccaacuucuguau

SEQ ID NO: 2555050 - RNA, 23 nt, Chlamydophila pneumoniae J138
cuuccacaauguuuagaauuugu

SEQ ID NO: 2555051 - RNA, 21 nt, Chlamydophila pneumoniae J138
cuuccacacaacucguuucag

SEQ ID NO: 2555052 - RNA, 21 nt, Chlamydophila pneumoniae J138
cuuccauagcuuuagaagccc

SEQ ID NO: 2555053 - RNA, 23 nt, Chlamydophila pneumoniae J138
cuuccauaugagguaauccucga

SEQ ID NO: 2555054 - RNA, 14 nt, Chlamydophila pneumoniae J138
cuucccagccuuga

SEQ ID NO: 2555055 - RNA, 16 nt, Chlamydophila pneumoniae J138
cuuccccaaacaugga

SEQ ID NO: 2555056 - RNA, 15 nt, Chlamydophila pneumoniae J138
cuucccccagaccua

SEQ ID NO: 2555057 - RNA, 18 nt, Chlamydophila pneumoniae J138
cuucccucaugaagaauu

SEQ ID NO: 2555058 - RNA, 21 nt, Chlamydophila pneumoniae J138
cuuccuacggcaagaaucgcc

SEQ ID NO: 2555059 - RNA, 14 nt, Chlamydophila pneumoniae J138
cuuccuccaaaauu

SEQ ID NO: 2555060 - RNA, 23 nt, Chlamydophila pneumoniae J138
cuuccucuucaauuucuucauca

SEQ ID NO: 2555061 - RNA, 16 nt, Chlamydophila pneumoniae J138
cuuccucuuuuauaua

SEQ ID NO: 2555062 - RNA, 20 nt, Chlamydophila pneumoniae J138
cuuccugaaucagcuuaucu

SEQ ID NO: 2555063 - RNA, 17 nt, Chlamydophila pneumoniae J138
cuuccugauucuguaua

SEQ ID NO: 2555064 - RNA, 17 nt, Chlamydophila pneumoniae J138
cuuccuucuucuucaaa

SEQ ID NO: 2555065 - RNA, 11 nt, Chlamydophila pneumoniae J138
cuuccuuguug

SEQ ID NO: 2555066 - RNA, 13 nt, Chlamydophila pneumoniae J138
cuuccuuuuucug

SEQ ID NO: 2555067 - RNA, 18 nt, Chlamydophila pneumoniae J138
cuucgaccuauuugcaac

SEQ ID NO: 2555068 - RNA, 18 nt, Chlamydophila pneumoniae J138
cuucgacuucaccuugaa

SEQ ID NO: 2555069 - RNA, 19 nt, Chlamydophila pneumoniae J138
cuucgaugucuuuccaggc

SEQ ID NO: 2555070 - RNA, 17 nt, Chlamydophila pneumoniae J138
cuucgauuguaacuucg

SEQ ID NO: 2555071 - RNA, 14 nt, Chlamydophila pneumoniae J138
cuucgauuucuagu

SEQ ID NO: 2555072 - RNA, 17 nt, Chlamydophila pneumoniae J138
cuucgcaaauauaguuu

SEQ ID NO: 2555073 - RNA, 15 nt, Chlamydophila pneumoniae J138
cuucgcaaauuuuuc

SEQ ID NO: 2555074 - RNA, 22 nt, Chlamydophila pneumoniae J138
cuucgccuuggguuugucucca

SEQ ID NO: 2555075 - RNA, 17 nt, Chlamydophila pneumoniae J138
cuucggaauacugcgca

SEQ ID NO: 2555076 - RNA, 14 nt, Chlamydophila pneumoniae J138
cuucggaucuguaa

SEQ ID NO: 2555077 - RNA, 17 nt, Chlamydophila pneumoniae J138
cuucguggaacuuucug

SEQ ID NO: 2555078 - RNA, 16 nt, Chlamydophila pneumoniae J138
cuuggauuucuucuuc

SEQ ID NO: 2555079 - RNA, 19 nt, Chlamydophila pneumoniae J138
cuuggauuucuucuucuaa

SEQ ID NO: 2555080 - RNA, 16 nt, Chlamydophila pneumoniae J138
cuuggcucuagaaaua

SEQ ID NO: 2555081 - RNA, 15 nt, Chlamydophila pneumoniae J138
cuugggacauuuccc

SEQ ID NO: 2555082 - RNA, 20 nt, Chlamydophila pneumoniae J138
cuugguaggaugucgcuuuu

SEQ ID NO: 2555083 - RNA, 19 nt, Chlamydophila pneumoniae J138
cuuggucgaucaagguguu

SEQ ID NO: 2555084 - RNA, 18 nt, Chlamydophila pneumoniae J138
cuuggucggaguuuuuuu

SEQ ID NO: 2555085 - RNA, 18 nt, Chlamydophila pneumoniae J138
cuugguguauaguauuuu

SEQ ID NO: 2555086 - RNA, 23 nt, Chlamydophila pneumoniae J138
cuugguguauaguauuuuuaaau

SEQ ID NO: 2555087 - RNA, 21 nt, Chlamydophila pneumoniae J138
cuuguaagacuaaaaaagaga

SEQ ID NO: 2555088 - RNA, 14 nt, Chlamydophila pneumoniae J138
cuuguacauccuug

SEQ ID NO: 2555089 - RNA, 13 nt, Chlamydophila pneumoniae J138
cuuguacgaaaau

SEQ ID NO: 2555090 - RNA, 13 nt, Chlamydophila pneumoniae J138
cuuguagcaauua

SEQ ID NO: 2555091 - RNA, 16 nt, Chlamydophila pneumoniae J138
cuuguauaagagcaag

SEQ ID NO: 2555092 - RNA, 14 nt, Chlamydophila pneumoniae J138
cuuguauuguacuu

SEQ ID NO: 2555093 - RNA, 18 nt, Chlamydophila pneumoniae J138
cuuguauuguacuuuuug

SEQ ID NO: 2555094 - RNA, 18 nt, Chlamydophila pneumoniae J138
cuugucgcgacaagacaa

SEQ ID NO: 2555095 - RNA, 19 nt, Chlamydophila pneumoniae J138
cuugucgcgacaagacaau

SEQ ID NO: 2555096 - RNA, 15 nt, Chlamydophila pneumoniae J138
cuugucuaggagcuu

SEQ ID NO: 2555097 - RNA, 21 nt, Chlamydophila pneumoniae J138
cuugucuuccacgaaggaauc

SEQ ID NO: 2555098 - RNA, 13 nt, Chlamydophila pneumoniae J138
cuugugagaugaa

SEQ ID NO: 2555099 - RNA, 14 nt, Chlamydophila pneumoniae J138
cuugugagaugaac

SEQ ID NO: 2555100 - RNA, 22 nt, Chlamydophila pneumoniae J138
cuugugcaucuauaauuaaucc

SEQ ID NO: 2555101 - RNA, 17 nt, Chlamydophila pneumoniae J138
cuugugcuaaagcagga

SEQ ID NO: 2555102 - RNA, 22 nt, Chlamydophila pneumoniae J138
cuugugcuaaagcaggagcauc

SEQ ID NO: 2555103 - RNA, 18 nt, Chlamydophila pneumoniae J138
cuugugguuagaggaagc

SEQ ID NO: 2555104 - RNA, 22 nt, Chlamydophila pneumoniae J138
cuuguuaugaugauccacugcu

SEQ ID NO: 2555105 - RNA, 22 nt, Chlamydophila pneumoniae J138
cuuguucuucuugauuaagauc

SEQ ID NO: 2555106 - RNA, 15 nt, Chlamydophila pneumoniae J138
cuuguugcaauugcc

SEQ ID NO: 2555107 - RNA, 16 nt, Chlamydophila pneumoniae J138
cuuguugcaugggaau

SEQ ID NO: 2555108 - RNA, 18 nt, Chlamydophila pneumoniae J138
cuuguuggauugaaaagc

SEQ ID NO: 2555109 - RNA, 16 nt, Chlamydophila pneumoniae J138
cuuguuggcauagcga

SEQ ID NO: 2555110 - RNA, 22 nt, Chlamydophila pneumoniae J138
cuuguuggcauagcgagaacac

SEQ ID NO: 2555111 - RNA, 17 nt, Chlamydophila pneumoniae J138
cuuuaaaagcauagugu

SEQ ID NO: 2555112 - RNA, 14 nt, Chlamydophila pneumoniae J138
cuuuaaauaaaauc

SEQ ID NO: 2555113 - RNA, 20 nt, Chlamydophila pneumoniae J138
cuuuaaauucgccaaacgaa

SEQ ID NO: 2555114 - RNA, 18 nt, Chlamydophila pneumoniae J138
cuuuaaauuuuuuaggau

SEQ ID NO: 2555115 - RNA, 17 nt, Chlamydophila pneumoniae J138
cuuuaacgaagaaggga

SEQ ID NO: 2555116 - RNA, 16 nt, Chlamydophila pneumoniae J138
cuuuaacuucuaaaag

SEQ ID NO: 2555117 - RNA, 18 nt, Chlamydophila pneumoniae J138
cuuuaagguugcuuuucu

SEQ ID NO: 2555118 - RNA, 21 nt, Chlamydophila pneumoniae J138
cuuuaagguugcuuuucuagg

SEQ ID NO: 2555119 - RNA, 19 nt, Chlamydophila pneumoniae J138
cuuuaaguguuucuucaua

SEQ ID NO: 2555120 - RNA, 17 nt, Chlamydophila pneumoniae J138
cuuuaauccaguuuuuu

SEQ ID NO: 2555121 - RNA, 14 nt, Chlamydophila pneumoniae J138
cuuuaccagaaaug

SEQ ID NO: 2555122 - RNA, 12 nt, Chlamydophila pneumoniae J138
cuuuacuacaug

SEQ ID NO: 2555123 - RNA, 21 nt, Chlamydophila pneumoniae J138
cuuuacuucggaugagaucca

SEQ ID NO: 2555124 - RNA, 17 nt, Chlamydophila pneumoniae J138
cuuuagaaaagugcccu

SEQ ID NO: 2555125 - RNA, 16 nt, Chlamydophila pneumoniae J138
cuuuagcaaucucuuu

SEQ ID NO: 2555126 - RNA, 22 nt, Chlamydophila pneumoniae J138
cuuuagcaaucucuuucacaaa

SEQ ID NO: 2555127 - RNA, 14 nt, Chlamydophila pneumoniae J138
cuuuagcugcugaa

SEQ ID NO: 2555128 - RNA, 17 nt, Chlamydophila pneumoniae J138
cuuuagggaauccccaa

SEQ ID NO: 2555129 - RNA, 16 nt, Chlamydophila pneumoniae J138
cuuuaguuaacuccuu

SEQ ID NO: 2555130 - RNA, 17 nt, Chlamydophila pneumoniae J138
cuuuauacuguuuuucu

SEQ ID NO: 2555131 - RNA, 16 nt, Chlamydophila pneumoniae J138
cuuuauagaaaguaca

SEQ ID NO: 2555132 - RNA, 13 nt, Chlamydophila pneumoniae J138
cuuuauagauaug

SEQ ID NO: 2555133 - RNA, 22 nt, Chlamydophila pneumoniae J138
cuuuauagauaugccucagguc

SEQ ID NO: 2555134 - RNA, 19 nt, Chlamydophila pneumoniae J138
cuuuaugaucucccgugag

SEQ ID NO: 2555135 - RNA, 20 nt, Chlamydophila pneumoniae J138
cuuuauggcucaacuuaagu

SEQ ID NO: 2555136 - RNA, 22 nt, Chlamydophila pneumoniae J138
cuuuauuuugaugcuucuuuca

SEQ ID NO: 2555137 - RNA, 15 nt, Chlamydophila pneumoniae J138
cuuuauuuuuaaaaa

SEQ ID NO: 2555138 - RNA, 11 nt, Chlamydophila pneumoniae J138
cuuucaaggaa

SEQ ID NO: 2555139 - RNA, 15 nt, Chlamydophila pneumoniae J138
cuuucaauagcuucc

SEQ ID NO: 2555140 - RNA, 18 nt, Chlamydophila pneumoniae J138
cuuucaauguaauugcgc

SEQ ID NO: 2555141 - RNA, 23 nt, Chlamydophila pneumoniae J138
cuuucacaaaggcgaucuucuuc

SEQ ID NO: 2555142 - RNA, 12 nt, Chlamydophila pneumoniae J138
cuuucacuuccc

SEQ ID NO: 2555143 - RNA, 12 nt, Chlamydophila pneumoniae J138
cuuucagaaaag

SEQ ID NO: 2555144 - RNA, 12 nt, Chlamydophila pneumoniae J138
cuuucauucccu

SEQ ID NO: 2555145 - RNA, 19 nt, Chlamydophila pneumoniae J138
cuuucauucccuuuuucca

SEQ ID NO: 2555146 - RNA, 22 nt, Chlamydophila pneumoniae J138
cuuuccauaaagccccacccac

SEQ ID NO: 2555147 - RNA, 20 nt, Chlamydophila pneumoniae J138
cuuucccuaagcaaaaacuu

SEQ ID NO: 2555148 - RNA, 21 nt, Chlamydophila pneumoniae J138
cuuuccggguaaguacacauu

SEQ ID NO: 2555149 - RNA, 13 nt, Chlamydophila pneumoniae J138
cuuuccuaaaaua

SEQ ID NO: 2555150 - RNA, 16 nt, Chlamydophila pneumoniae J138
cuuuccuaaaauaauu

SEQ ID NO: 2555151 - RNA, 21 nt, Chlamydophila pneumoniae J138
cuuuccucucuuuauauuuuu

SEQ ID NO: 2555152 - RNA, 15 nt, Chlamydophila pneumoniae J138
cuuucguuuucuagc

SEQ ID NO: 2555153 - RNA, 19 nt, Chlamydophila pneumoniae J138
cuuucuaagaauucuuugc

SEQ ID NO: 2555154 - RNA, 23 nt, Chlamydophila pneumoniae J138
cuuucuaagaauucuuugccaag

SEQ ID NO: 2555155 - RNA, 14 nt, Chlamydophila pneumoniae J138
cuuucuagcugcuc

SEQ ID NO: 2555156 - RNA, 13 nt, Chlamydophila pneumoniae J138
cuuucuaggaucu

SEQ ID NO: 2555157 - RNA, 22 nt, Chlamydophila pneumoniae J138
cuuucuaggccgggauuuuaau

SEQ ID NO: 2555158 - RNA, 21 nt, Chlamydophila pneumoniae J138
cuuucucggucuuucuuuuuu

SEQ ID NO: 2555159 - RNA, 16 nt, Chlamydophila pneumoniae J138
cuuucugcucuucuau

SEQ ID NO: 2555160 - RNA, 14 nt, Chlamydophila pneumoniae J138
cuuucugcuugucu

SEQ ID NO: 2555161 - RNA, 16 nt, Chlamydophila pneumoniae J138
cuuucugcuugucuac

SEQ ID NO: 2555162 - RNA, 11 nt, Chlamydophila pneumoniae J138
cuuucuucucu

SEQ ID NO: 2555163 - RNA, 13 nt, Chlamydophila pneumoniae J138
cuuucuuggauug

SEQ ID NO: 2555164 - RNA, 18 nt, Chlamydophila pneumoniae J138
cuuucuuuuagcuacuuc

SEQ ID NO: 2555165 - RNA, 19 nt, Chlamydophila pneumoniae J138
cuuugaagcucgaccucua

SEQ ID NO: 2555166 - RNA, 15 nt, Chlamydophila pneumoniae J138
cuuugaauaaugcau

SEQ ID NO: 2555167 - RNA, 21 nt, Chlamydophila pneumoniae J138
cuuugaauaaugcaucccccg

SEQ ID NO: 2555168 - RNA, 14 nt, Chlamydophila pneumoniae J138
cuuugaauuuccaa

SEQ ID NO: 2555169 - RNA, 16 nt, Chlamydophila pneumoniae J138
cuuugaauuuccaaag

SEQ ID NO: 2555170 - RNA, 16 nt, Chlamydophila pneumoniae J138
cuuugacaucuaauuu

SEQ ID NO: 2555171 - RNA, 21 nt, Chlamydophila pneumoniae J138
cuuugaccagaugauuuuuug

SEQ ID NO: 2555172 - RNA, 15 nt, Chlamydophila pneumoniae J138
cuuugagaucuugaa

SEQ ID NO: 2555173 - RNA, 20 nt, Chlamydophila pneumoniae J138
cuuugaggauacgaauaagu

SEQ ID NO: 2555174 - RNA, 19 nt, Chlamydophila pneumoniae J138
cuuugaggcaagucucaaa

SEQ ID NO: 2555175 - RNA, 14 nt, Chlamydophila pneumoniae J138
cuuugaguagccag

SEQ ID NO: 2555176 - RNA, 15 nt, Chlamydophila pneumoniae J138
cuuugagucuuuuuc

SEQ ID NO: 2555177 - RNA, 15 nt, Chlamydophila pneumoniae J138
cuuugaguuaagcaa

SEQ ID NO: 2555178 - RNA, 19 nt, Chlamydophila pneumoniae J138
gaaaccauauugcaaagca

SEQ ID NO: 2555179 - RNA, 16 nt, Chlamydophila pneumoniae J138
gaaaccuucagaucga

SEQ ID NO: 2555180 - RNA, 16 nt, Chlamydophila pneumoniae J138
gaaaccuucucucuua

SEQ ID NO: 2555181 - RNA, 13 nt, Chlamydophila pneumoniae J138
gaaacgaaagcag

SEQ ID NO: 2555182 - RNA, 17 nt, Chlamydophila pneumoniae J138
gaaacgcagcuuuccuu

SEQ ID NO: 2555183 - RNA, 16 nt, Chlamydophila pneumoniae J138
gaaacuccaaaauauu

SEQ ID NO: 2555184 - RNA, 21 nt, Chlamydophila pneumoniae J138
gaaacuuaguuuugaaaagau

SEQ ID NO: 2555185 - RNA, 21 nt, Chlamydophila pneumoniae J138
gaaacuucucagauaaaaaga

SEQ ID NO: 2555186 - RNA, 12 nt, Chlamydophila pneumoniae J138
gaaacuucugac

SEQ ID NO: 2555187 - RNA, 17 nt, Chlamydophila pneumoniae J138
gaaacuucugacccugu

SEQ ID NO: 2555188 - RNA, 15 nt, Chlamydophila pneumoniae J138
gaaacuuuaggauuc

SEQ ID NO: 2555189 - RNA, 23 nt, Chlamydophila pneumoniae J138
gaaacuuuugucgcaauaacaaa

SEQ ID NO: 2555190 - RNA, 18 nt, Chlamydophila pneumoniae J138
gaaacuuuuuuucuucuc

SEQ ID NO: 2555191 - RNA, 20 nt, Chlamydophila pneumoniae J138
gaaacuuuuuuucuucucua

SEQ ID NO: 2555192 - RNA, 12 nt, Chlamydophila pneumoniae J138
gaaagaaacaaa

SEQ ID NO: 2555193 - RNA, 13 nt, Chlamydophila pneumoniae J138
gaaagaacuacuu

SEQ ID NO: 2555194 - RNA, 17 nt, Chlamydophila pneumoniae J138
gaaagaacuacuuaaau

SEQ ID NO: 2555195 - RNA, 19 nt, Chlamydophila pneumoniae J138
gaaagaagccuuccuuguu

SEQ ID NO: 2555196 - RNA, 23 nt, Chlamydophila pneumoniae J138
gaaagaaguccuagggagugagg

SEQ ID NO: 2555197 - RNA, 19 nt, Chlamydophila pneumoniae J138
gaaagaauaucuuuugaau

SEQ ID NO: 2555198 - RNA, 14 nt, Chlamydophila pneumoniae J138
gaaagaaugacaca

SEQ ID NO: 2555199 - RNA, 13 nt, Chlamydophila pneumoniae J138
gaaagacucgcuc

SEQ ID NO: 2555200 - RNA, 15 nt, Chlamydophila pneumoniae J138
gaaagagucccugau

SEQ ID NO: 2555201 - RNA, 16 nt, Chlamydophila pneumoniae J138
gaaagagucccugauu

SEQ ID NO: 2555202 - RNA, 22 nt, Chlamydophila pneumoniae J138
gaaagagucucacucuuuucua

SEQ ID NO: 2555203 - RNA, 18 nt, Chlamydophila pneumoniae J138
gaaagagugccaagagca

SEQ ID NO: 2555204 - RNA, 20 nt, Chlamydophila pneumoniae J138
gaaagauaucccaaagcuag

SEQ ID NO: 2555205 - RNA, 23 nt, Chlamydophila pneumoniae J138
gaaagaucagaggaaucuaagaa

SEQ ID NO: 2555206 - RNA, 19 nt, Chlamydophila pneumoniae J138
gaaagauucugcccaaagc

SEQ ID NO: 2555207 - RNA, 17 nt, Chlamydophila pneumoniae J138
gaaagccaagaagaugu

SEQ ID NO: 2555208 - RNA, 16 nt, Chlamydophila pneumoniae J138
gaaagcccaugagaug

SEQ ID NO: 2555209 - RNA, 18 nt, Chlamydophila pneumoniae J138
gaaagcgcgaugaacagc

SEQ ID NO: 2555210 - RNA, 18 nt, Chlamydophila pneumoniae J138
gaaagcuggagggucgcu

SEQ ID NO: 2555211 - RNA, 17 nt, Chlamydophila pneumoniae J138
gaaagcuucuggauuca

SEQ ID NO: 2555212 - RNA, 18 nt, Chlamydophila pneumoniae J138
gaaaggagggcuucaaca

SEQ ID NO: 2555213 - RNA, 20 nt, Chlamydophila pneumoniae J138
gaaaggcacuccaaaacuca

SEQ ID NO: 2555214 - RNA, 18 nt, Chlamydophila pneumoniae J138
gaaaggcugauaagauca

SEQ ID NO: 2555215 - RNA, 21 nt, Chlamydophila pneumoniae J138
gaaaggcuuuucuuuuucuag

SEQ ID NO: 2555216 - RNA, 16 nt, Chlamydophila pneumoniae J138
gaaagguaguuuucuu

SEQ ID NO: 2555217 - RNA, 15 nt, Chlamydophila pneumoniae J138
gaaaguauuccucuu

SEQ ID NO: 2555218 - RNA, 15 nt, Chlamydophila pneumoniae J138
gaaaguucacaagca

SEQ ID NO: 2555219 - RNA, 20 nt, Chlamydophila pneumoniae J138
gaaauaauuuucagucuucc

SEQ ID NO: 2555220 - RNA, 22 nt, Chlamydophila pneumoniae J138
gaaauaccacagcuguacagaa

SEQ ID NO: 2555221 - RNA, 15 nt, Chlamydophila pneumoniae J138
gaaauacgcuuuucu

SEQ ID NO: 2555222 - RNA, 22 nt, Chlamydophila pneumoniae J138
gaaauacguccagccugcacca

SEQ ID NO: 2555223 - RNA, 13 nt, Chlamydophila pneumoniae J138
gaaauauacucuu

SEQ ID NO: 2555224 - RNA, 14 nt, Chlamydophila pneumoniae J138
gaaauauacugcca

SEQ ID NO: 2555225 - RNA, 19 nt, Chlamydophila pneumoniae J138
gaaauauuaacccaccaga

SEQ ID NO: 2555226 - RNA, 15 nt, Chlamydophila pneumoniae J138
gaaaucacacuuaaa

SEQ ID NO: 2555227 - RNA, 18 nt, Chlamydophila pneumoniae J138
gaaauccguaaagguugu

SEQ ID NO: 2555228 - RNA, 20 nt, Chlamydophila pneumoniae J138
gaaauccugggcaaugauca

SEQ ID NO: 2555229 - RNA, 23 nt, Chlamydophila pneumoniae J138
gaaaucgacaggggaguuuucaa

SEQ ID NO: 2555230 - RNA, 18 nt, Chlamydophila pneumoniae J138
gaaaucgcauuacaaaug

SEQ ID NO: 2555231 - RNA, 18 nt, Chlamydophila pneumoniae J138
gaaaucguaucuuuuugc

SEQ ID NO: 2555232 - RNA, 16 nt, Chlamydophila pneumoniae J138
gaaaucugcucuacuu

SEQ ID NO: 2555233 - RNA, 13 nt, Chlamydophila pneumoniae J138
gaaaugagugaga

SEQ ID NO: 2555234 - RNA, 17 nt, Chlamydophila pneumoniae J138
gaaaugcucuucugcag

SEQ ID NO: 2555235 - RNA, 13 nt, Chlamydophila pneumoniae J138
gaaauuaaagcua

SEQ ID NO: 2555236 - RNA, 23 nt, Chlamydophila pneumoniae J138
gaaauuagagggauuuguaggaa

SEQ ID NO: 2555237 - RNA, 19 nt, Chlamydophila pneumoniae J138
gaaauuccgacccagucaa

SEQ ID NO: 2555238 - RNA, 11 nt, Chlamydophila pneumoniae J138
gaaauucuucc

SEQ ID NO: 2555239 - RNA, 14 nt, Chlamydophila pneumoniae J138
gaaauugcucuugc

SEQ ID NO: 2555240 - RNA, 22 nt, Chlamydophila pneumoniae J138
gaaauugucuucagugcaaugu

SEQ ID NO: 2555241 - RNA, 21 nt, Chlamydophila pneumoniae J138
gaaauuuaggucgacuuccuu

SEQ ID NO: 2555242 - RNA, 12 nt, Chlamydophila pneumoniae J138
gaaauuuucuaa

SEQ ID NO: 2555243 - RNA, 21 nt, Chlamydophila pneumoniae J138
gaacaaaaaaucaaucuugau

SEQ ID NO: 2555244 - RNA, 13 nt, Chlamydophila pneumoniae J138
gaacaaaaacugc

SEQ ID NO: 2555245 - RNA, 15 nt, Chlamydophila pneumoniae J138
gaacaaagcucuccu

SEQ ID NO: 2555246 - RNA, 19 nt, Chlamydophila pneumoniae J138
gaacaacgcugcuucucua

SEQ ID NO: 2555247 - RNA, 15 nt, Chlamydophila pneumoniae J138
gaacaacugugguuu

SEQ ID NO: 2555248 - RNA, 21 nt, Chlamydophila pneumoniae J138
gaacaaguugacgcacuucuu

SEQ ID NO: 2555249 - RNA, 15 nt, Chlamydophila pneumoniae J138
gaacaauacucucug

SEQ ID NO: 2555250 - RNA, 17 nt, Chlamydophila pneumoniae J138
gaacaauagaaagacca

SEQ ID NO: 2555251 - RNA, 14 nt, Chlamydophila pneumoniae J138
gaacaaucaacacc

SEQ ID NO: 2555252 - RNA, 21 nt, Chlamydophila pneumoniae J138
gaacaauguaaauugaguauc

SEQ ID NO: 2555253 - RNA, 16 nt, Chlamydophila pneumoniae J138
gaacaccauaaaacaa

SEQ ID NO: 2555254 - RNA, 22 nt, Chlamydophila pneumoniae J138
gaacacccccgcagcuucucua

SEQ ID NO: 2555255 - RNA, 13 nt, Chlamydophila pneumoniae J138
gaacagagaugca

SEQ ID NO: 2555256 - RNA, 21 nt, Chlamydophila pneumoniae J138
gaacagaggaucuagaaaaug

SEQ ID NO: 2555257 - RNA, 22 nt, Chlamydophila pneumoniae J138
gaacagcacucucugcagggaa

SEQ ID NO: 2555258 - RNA, 23 nt, Chlamydophila pneumoniae J138
gaacagcacucucugcagggaau

SEQ ID NO: 2555259 - RNA, 13 nt, Chlamydophila pneumoniae J138
gaacaggaggugu

SEQ ID NO: 2555260 - RNA, 21 nt, Chlamydophila pneumoniae J138
gaacaggagguguauccguag

SEQ ID NO: 2555261 - RNA, 15 nt, Chlamydophila pneumoniae J138
gaacaggggauguga

SEQ ID NO: 2555262 - RNA, 21 nt, Chlamydophila pneumoniae J138
gaacaguauaaucagaaguga

SEQ ID NO: 2555263 - RNA, 17 nt, Chlamydophila pneumoniae J138
gaacaguuugcucugga

SEQ ID NO: 2555264 - RNA, 22 nt, Chlamydophila pneumoniae J138
gaacaguuugcucuggauguag

SEQ ID NO: 2555265 - RNA, 15 nt, Chlamydophila pneumoniae J138
gaacauccuucacuc

SEQ ID NO: 2555266 - RNA, 16 nt, Chlamydophila pneumoniae J138
gaacaucuucccaccc

SEQ ID NO: 2555267 - RNA, 15 nt, Chlamydophila pneumoniae J138
gaacaugccaaauau

SEQ ID NO: 2555268 - RNA, 18 nt, Chlamydophila pneumoniae J138
gaacaugccaaauaucuc

SEQ ID NO: 2555269 - RNA, 23 nt, Chlamydophila pneumoniae J138
gaacaugcccccacaaaaccugg

SEQ ID NO: 2555270 - RNA, 17 nt, Chlamydophila pneumoniae J138
gaacaugccugaaaaca

SEQ ID NO: 2555271 - RNA, 19 nt, Chlamydophila pneumoniae J138
gaacauuguuagcaucgcu

SEQ ID NO: 2555272 - RNA, 13 nt, Chlamydophila pneumoniae J138
gaacccuggauga

SEQ ID NO: 2555273 - RNA, 21 nt, Chlamydophila pneumoniae J138
gaaccgucgagcucgcaaaag

SEQ ID NO: 2555274 - RNA, 17 nt, Chlamydophila pneumoniae J138
gaaccucuaauuugaug

SEQ ID NO: 2555275 - RNA, 13 nt, Chlamydophila pneumoniae J138
gaacgaagaaaac

SEQ ID NO: 2555276 - RNA, 19 nt, Chlamydophila pneumoniae J138
gaacgccaucuccacagcc

SEQ ID NO: 2555277 - RNA, 21 nt, Chlamydophila pneumoniae J138
gaacggacaaugcuaucucca

SEQ ID NO: 2555278 - RNA, 21 nt, Chlamydophila pneumoniae J138
gaaguuccuacuucugcagga

SEQ ID NO: 2555279 - RNA, 15 nt, Chlamydophila pneumoniae J138
gaaguuccuucagga

SEQ ID NO: 2555280 - RNA, 19 nt, Chlamydophila pneumoniae J138
gaaguugaaaugagugaga

SEQ ID NO: 2555281 - RNA, 21 nt, Chlamydophila pneumoniae J138
gaaguugaaaugagugagaau

SEQ ID NO: 2555282 - RNA, 15 nt, Chlamydophila pneumoniae J138
gaaguuuaaacgucu

SEQ ID NO: 2555283 - RNA, 17 nt, Chlamydophila pneumoniae J138
gaaguuuacaaauaaaa

SEQ ID NO: 2555284 - RNA, 20 nt, Chlamydophila pneumoniae J138
gaaguuuuuuaagugcuuuu

SEQ ID NO: 2555285 - RNA, 17 nt, Chlamydophila pneumoniae J138
gaauaacaccaaaagaa

SEQ ID NO: 2555286 - RNA, 19 nt, Chlamydophila pneumoniae J138
gaauaagagcuacaauccc

SEQ ID NO: 2555287 - RNA, 22 nt, Chlamydophila pneumoniae J138
gaauaagauuuugaaaauugca

SEQ ID NO: 2555288 - RNA, 20 nt, Chlamydophila pneumoniae J138
gaauaaguuuugauuuugca

SEQ ID NO: 2555289 - RNA, 12 nt, Chlamydophila pneumoniae J138
gaauaaucaacc

SEQ ID NO: 2555290 - RNA, 14 nt, Chlamydophila pneumoniae J138
gaauaaucaaccaa

SEQ ID NO: 2555291 - RNA, 15 nt, Chlamydophila pneumoniae J138
gaauaaucaaccaaa

SEQ ID NO: 2555292 - RNA, 23 nt, Chlamydophila pneumoniae J138
gaauaaucucuuucauaaauuca

SEQ ID NO: 2555293 - RNA, 15 nt, Chlamydophila pneumoniae J138
gaauaauuaaaucgu

SEQ ID NO: 2555294 - RNA, 15 nt, Chlamydophila pneumoniae J138
gaauacauuccuagc

SEQ ID NO: 2555295 - RNA, 18 nt, Chlamydophila pneumoniae J138
gaauaccguuucaggaaa

SEQ ID NO: 2555296 - RNA, 20 nt, Chlamydophila pneumoniae J138
gaauaccguuucaggaaacu

SEQ ID NO: 2555297 - RNA, 17 nt, Chlamydophila pneumoniae J138
gaauaccucaagaugca

SEQ ID NO: 2555298 - RNA, 21 nt, Chlamydophila pneumoniae J138
gaauagaaagacauccuucuu

SEQ ID NO: 2555299 - RNA, 12 nt, Chlamydophila pneumoniae J138
gaauagaagauc

SEQ ID NO: 2555300 - RNA, 18 nt, Chlamydophila pneumoniae J138
gaauagaauguaugugaa

SEQ ID NO: 2555301 - RNA, 12 nt, Chlamydophila pneumoniae J138
gaauagcaggaa

SEQ ID NO: 2555302 - RNA, 12 nt, Chlamydophila pneumoniae J138
gaauagcucugg

SEQ ID NO: 2555303 - RNA, 12 nt, Chlamydophila pneumoniae J138
gaauauaauucc

SEQ ID NO: 2555304 - RNA, 22 nt, Chlamydophila pneumoniae J138
gaauauaauuccaauugccaug

SEQ ID NO: 2555305 - RNA, 14 nt, Chlamydophila pneumoniae J138
gaauaucaucuucc

SEQ ID NO: 2555306 - RNA, 22 nt, Chlamydophila pneumoniae J138
gaauaucgaguucuuuuugcag

SEQ ID NO: 2555307 - RNA, 14 nt, Chlamydophila pneumoniae J138
gaauaugcuuuuca

SEQ ID NO: 2555308 - RNA, 18 nt, Chlamydophila pneumoniae J138
gaauaugcuuuucaaaua

SEQ ID NO: 2555309 - RNA, 16 nt, Chlamydophila pneumoniae J138
gaauauguacugaugu

SEQ ID NO: 2555310 - RNA, 18 nt, Chlamydophila pneumoniae J138
gaaucacguccacaagcu

SEQ ID NO: 2555311 - RNA, 13 nt, Chlamydophila pneumoniae J138
gaaucacucucua

SEQ ID NO: 2555312 - RNA, 22 nt, Chlamydophila pneumoniae J138
gaaucacuguaucagcaagccc

SEQ ID NO: 2555313 - RNA, 14 nt, Chlamydophila pneumoniae J138
gaaucagauuagag

SEQ ID NO: 2555314 - RNA, 23 nt, Chlamydophila pneumoniae J138
gaaucauagagauaucaucaaaa

SEQ ID NO: 2555315 - RNA, 16 nt, Chlamydophila pneumoniae J138
gaauccaaaaaagagc

SEQ ID NO: 2555316 - RNA, 14 nt, Chlamydophila pneumoniae J138
gaauccaaagacuu

SEQ ID NO: 2555317 - RNA, 13 nt, Chlamydophila pneumoniae J138
gaaucccaaggga

SEQ ID NO: 2555318 - RNA, 17 nt, Chlamydophila pneumoniae J138
gaauccccaauguuuuc

SEQ ID NO: 2555319 - RNA, 21 nt, Chlamydophila pneumoniae J138
gaauccccccuucuaauacuu

SEQ ID NO: 2555320 - RNA, 17 nt, Chlamydophila pneumoniae J138
gaauccgaucauaauua

SEQ ID NO: 2555321 - RNA, 20 nt, Chlamydophila pneumoniae J138
gaauccucuauccaucaucg

SEQ ID NO: 2555322 - RNA, 22 nt, Chlamydophila pneumoniae J138
gaauccuugaaagacucgcucu

SEQ ID NO: 2555323 - RNA, 19 nt, Chlamydophila pneumoniae J138
gaaucuauccauagcgaua

SEQ ID NO: 2555324 - RNA, 18 nt, Chlamydophila pneumoniae J138
gaaucucauaaguauaga

SEQ ID NO: 2555325 - RNA, 23 nt, Chlamydophila pneumoniae J138
gaaucuccauuuagaaugaccgc

SEQ ID NO: 2555326 - RNA, 15 nt, Chlamydophila pneumoniae J138
gaaucuccucaucag

SEQ ID NO: 2555327 - RNA, 17 nt, Chlamydophila pneumoniae J138
gaaucuccucaucagaa

SEQ ID NO: 2555328 - RNA, 21 nt, Chlamydophila pneumoniae J138
gaaucuccucgucugauagag

SEQ ID NO: 2555329 - RNA, 12 nt, Chlamydophila pneumoniae J138
gaaucucuucug

SEQ ID NO: 2555330 - RNA, 14 nt, Chlamydophila pneumoniae J138
gaaucuuucaaaag

SEQ ID NO: 2555331 - RNA, 19 nt, Chlamydophila pneumoniae J138
gaaucuuuucuagaaaacg

SEQ ID NO: 2555332 - RNA, 17 nt, Chlamydophila pneumoniae J138
gaaucuuuuguuuuagc

SEQ ID NO: 2555333 - RNA, 13 nt, Chlamydophila pneumoniae J138
gaaucuuuuucau

SEQ ID NO: 2555334 - RNA, 17 nt, Chlamydophila pneumoniae J138
gaaugacacagagaaca

SEQ ID NO: 2555335 - RNA, 20 nt, Chlamydophila pneumoniae J138
gaaugacacagagaacaaua

SEQ ID NO: 2555336 - RNA, 20 nt, Chlamydophila pneumoniae J138
gaaugacugcagauugcacu

SEQ ID NO: 2555337 - RNA, 18 nt, Chlamydophila pneumoniae J138
gaaugcccuuuagggaau

SEQ ID NO: 2555338 - RNA, 17 nt, Chlamydophila pneumoniae J138
gaaugccugccaaucca

SEQ ID NO: 2555339 - RNA, 14 nt, Chlamydophila pneumoniae J138
gaauggauguugcg

SEQ ID NO: 2555340 - RNA, 19 nt, Chlamydophila pneumoniae J138
gaauguagccaauccuucc

SEQ ID NO: 2555341 - RNA, 20 nt, Chlamydophila pneumoniae J138
gaauguugggggagcucgcu

SEQ ID NO: 2555342 - RNA, 18 nt, Chlamydophila pneumoniae J138
gaauuaaacuuucuucuc

SEQ ID NO: 2555343 - RNA, 20 nt, Chlamydophila pneumoniae J138
gaauuaaacuuucuucucua

SEQ ID NO: 2555344 - RNA, 23 nt, Chlamydophila pneumoniae J138
gaauucaaacuccuuuuaaaauu

SEQ ID NO: 2555345 - RNA, 17 nt, Chlamydophila pneumoniae J138
gaauucauuaagauccu

SEQ ID NO: 2555346 - RNA, 20 nt, Chlamydophila pneumoniae J138
gaauuccucccagcccuaua

SEQ ID NO: 2555347 - RNA, 10 nt, Chlamydophila pneumoniae J138
gaauuccucu

SEQ ID NO: 2555348 - RNA, 16 nt, Chlamydophila pneumoniae J138
gaauuccucugauucc

SEQ ID NO: 2555349 - RNA, 14 nt, Chlamydophila pneumoniae J138
gaauucucaaguaa

SEQ ID NO: 2555350 - RNA, 20 nt, Chlamydophila pneumoniae J138
gaauucucagaaagccuuug

SEQ ID NO: 2555351 - RNA, 14 nt, Chlamydophila pneumoniae J138
gaauucugaugacc

SEQ ID NO: 2555352 - RNA, 23 nt, Chlamydophila pneumoniae J138
gaauugcuugcgcaucagcagcu

SEQ ID NO: 2555353 - RNA, 14 nt, Chlamydophila pneumoniae J138
gaauuguaguucuu

SEQ ID NO: 2555354 - RNA, 23 nt, Chlamydophila pneumoniae J138
gaauuguuuuguuuguuuucuau

SEQ ID NO: 2555355 - RNA, 19 nt, Chlamydophila pneumoniae J138
gaauuucggacgauauuua

SEQ ID NO: 2555356 - RNA, 18 nt, Chlamydophila pneumoniae J138
gaauuuguccuuugcuaa

SEQ ID NO: 2555357 - RNA, 14 nt, Chlamydophila pneumoniae J138
gaauuuuaucagaa

SEQ ID NO: 2555358 - RNA, 23 nt, Chlamydophila pneumoniae J138
ucauaauuagagagaaugcccug

SEQ ID NO: 2555359 - RNA, 23 nt, Chlamydophila pneumoniae J138
ucauacgccgugccuauagaaau

SEQ ID NO: 2555360 - RNA, 22 nt, Chlamydophila pneumoniae J138
ucauagagauaucaucaaaaga

SEQ ID NO: 2555361 - RNA, 19 nt, Chlamydophila pneumoniae J138
ucauauaaaguuuccaagu

SEQ ID NO: 2555362 - RNA, 20 nt, Chlamydophila pneumoniae J138
ucauaucugcgccagcucuc

SEQ ID NO: 2555363 - RNA, 20 nt, Chlamydophila pneumoniae J138
ucauaugaaugacugcagau

SEQ ID NO: 2555364 - RNA, 12 nt, Chlamydophila pneumoniae J138
ucauauuuaaaa

SEQ ID NO: 2555365 - RNA, 13 nt, Chlamydophila pneumoniae J138
ucauauuuaaaag

SEQ ID NO: 2555366 - RNA, 15 nt, Chlamydophila pneumoniae J138
ucauauuuauuuaaa

SEQ ID NO: 2555367 - RNA, 21 nt, Chlamydophila pneumoniae J138
ucauauuuauuuaaaccagga

SEQ ID NO: 2555368 - RNA, 19 nt, Chlamydophila pneumoniae J138
ucauauuuuucuugaaggu

SEQ ID NO: 2555369 - RNA, 20 nt, Chlamydophila pneumoniae J138
ucauauuuuucuugaagguu

SEQ ID NO: 2555370 - RNA, 17 nt, Chlamydophila pneumoniae J138
ucauauuuuuguccugc

SEQ ID NO: 2555371 - RNA, 12 nt, Chlamydophila pneumoniae J138
ucaucaaagcaa

SEQ ID NO: 2555372 - RNA, 15 nt, Chlamydophila pneumoniae J138
ucaucaaagcaaaga

SEQ ID NO: 2555373 - RNA, 18 nt, Chlamydophila pneumoniae J138
ucaucagaaaucaaaggg

SEQ ID NO: 2555374 - RNA, 13 nt, Chlamydophila pneumoniae J138
ucaucagaagcuc

SEQ ID NO: 2555375 - RNA, 12 nt, Chlamydophila pneumoniae J138
ucaucagaagug

SEQ ID NO: 2555376 - RNA, 15 nt, Chlamydophila pneumoniae J138
ucaucagcaaaacuc

SEQ ID NO: 2555377 - RNA, 18 nt, Chlamydophila pneumoniae J138
ucaucagcaaaacucccg

SEQ ID NO: 2555378 - RNA, 21 nt, Chlamydophila pneumoniae J138
ucaucagcuucccaauuguau

SEQ ID NO: 2555379 - RNA, 13 nt, Chlamydophila pneumoniae J138
ucaucauccucag

SEQ ID NO: 2555380 - RNA, 20 nt, Chlamydophila pneumoniae J138
ucauccagauuagaaaagau

SEQ ID NO: 2555381 - RNA, 17 nt, Chlamydophila pneumoniae J138
ucaucccacgggucagg

SEQ ID NO: 2555382 - RNA, 17 nt, Chlamydophila pneumoniae J138
ucauccccucagaaagg

SEQ ID NO: 2555383 - RNA, 14 nt, Chlamydophila pneumoniae J138
ucauccucaucauc

SEQ ID NO: 2555384 - RNA, 18 nt, Chlamydophila pneumoniae J138
ucauccucaucaucagaa

SEQ ID NO: 2555385 - RNA, 23 nt, Chlamydophila pneumoniae J138
ucauccuuuagcuguuucucugu

SEQ ID NO: 2555386 - RNA, 21 nt, Chlamydophila pneumoniae J138
ucaucgcgagaggggaaccaa

SEQ ID NO: 2555387 - RNA, 23 nt, Chlamydophila pneumoniae J138
ucaucgucgcgacugaagucagu

SEQ ID NO: 2555388 - RNA, 18 nt, Chlamydophila pneumoniae J138
ucaucuacgauguuuucu

SEQ ID NO: 2555389 - RNA, 14 nt, Chlamydophila pneumoniae J138
ucaucuagaaagau

SEQ ID NO: 2555390 - RNA, 18 nt, Chlamydophila pneumoniae J138
ucaucucgcaguccaaag

SEQ ID NO: 2555391 - RNA, 21 nt, Chlamydophila pneumoniae J138
ucaucugucauuaaaaauuua

SEQ ID NO: 2555392 - RNA, 11 nt, Chlamydophila pneumoniae J138
ucaucuucuuu

SEQ ID NO: 2555393 - RNA, 13 nt, Chlamydophila pneumoniae J138
ucaugaaaaggau

SEQ ID NO: 2555394 - RNA, 15 nt, Chlamydophila pneumoniae J138
ucaugaagaauuacc

SEQ ID NO: 2555395 - RNA, 23 nt, Chlamydophila pneumoniae J138
ucaugagccgauguugcagaaug

SEQ ID NO: 2555396 - RNA, 10 nt, Chlamydophila pneumoniae J138
ucaugaggac

SEQ ID NO: 2555397 - RNA, 22 nt, Chlamydophila pneumoniae J138
ucaugauaaaaauuuucaggaa

SEQ ID NO: 2555398 - RNA, 20 nt, Chlamydophila pneumoniae J138
ucaugccgcauuucuucaau

SEQ ID NO: 2555399 - RNA, 17 nt, Chlamydophila pneumoniae J138
ucaugcgcuaccuuagu

SEQ ID NO: 2555400 - RNA, 18 nt, Chlamydophila pneumoniae J138
ucauggauuacugaagau

SEQ ID NO: 2555401 - RNA, 21 nt, Chlamydophila pneumoniae J138
ucauguccuccauggaaagaa

SEQ ID NO: 2555402 - RNA, 13 nt, Chlamydophila pneumoniae J138
ucauguccuucaa

SEQ ID NO: 2555403 - RNA, 17 nt, Chlamydophila pneumoniae J138
ucauguccuucaaaaug

SEQ ID NO: 2555404 - RNA, 15 nt, Chlamydophila pneumoniae J138
ucaugucuaagucag

SEQ ID NO: 2555405 - RNA, 15 nt, Chlamydophila pneumoniae J138
ucauuaaaaauuuaa

SEQ ID NO: 2555406 - RNA, 13 nt, Chlamydophila pneumoniae J138
ucauuaagaagau

SEQ ID NO: 2555407 - RNA, 14 nt, Chlamydophila pneumoniae J138
ucauuaagaagauu

SEQ ID NO: 2555408 - RNA, 12 nt, Chlamydophila pneumoniae J138
ucauuaagaucc

SEQ ID NO: 2555409 - RNA, 21 nt, Chlamydophila pneumoniae J138
ucauuaagauccuuuaaagau

SEQ ID NO: 2555410 - RNA, 22 nt, Chlamydophila pneumoniae J138
ucauuaagauccuuuaaagauu

SEQ ID NO: 2555411 - RNA, 14 nt, Chlamydophila pneumoniae J138
ucauuaccugcuaa

SEQ ID NO: 2555412 - RNA, 16 nt, Chlamydophila pneumoniae J138
ucauuacggaggcaua

SEQ ID NO: 2555413 - RNA, 16 nt, Chlamydophila pneumoniae J138
ucauuagcaagagcuc

SEQ ID NO: 2555414 - RNA, 20 nt, Chlamydophila pneumoniae J138
ucauuagcccuacgaaucca

SEQ ID NO: 2555415 - RNA, 18 nt, Chlamydophila pneumoniae J138
ucauuaucaagaaauucu

SEQ ID NO: 2555416 - RNA, 11 nt, Chlamydophila pneumoniae J138
ucauuauuaaa

SEQ ID NO: 2555417 - RNA, 15 nt, Chlamydophila pneumoniae J138
ucauucaccuugauu

SEQ ID NO: 2555418 - RNA, 15 nt, Chlamydophila pneumoniae J138
ucauuccagcaucuu

SEQ ID NO: 2555419 - RNA, 18 nt, Chlamydophila pneumoniae J138
ucauuccagcaucuucuc

SEQ ID NO: 2555420 - RNA, 15 nt, Chlamydophila pneumoniae J138
ucauuccaggauucu

SEQ ID NO: 2555421 - RNA, 18 nt, Chlamydophila pneumoniae J138
ucauugcggcaccaaaga

SEQ ID NO: 2555422 - RNA, 22 nt, Chlamydophila pneumoniae J138
ucauugcuauugaaaaaucccu

SEQ ID NO: 2555423 - RNA, 19 nt, Chlamydophila pneumoniae J138
ucauuuaucugcguuucuu

SEQ ID NO: 2555424 - RNA, 20 nt, Chlamydophila pneumoniae J138
ucauuuaucugcguuucuuu

SEQ ID NO: 2555425 - RNA, 13 nt, Chlamydophila pneumoniae J138
ucauuuuuuaaua

SEQ ID NO: 2555426 - RNA, 12 nt, Chlamydophila pneumoniae J138
uccaaaaaagag

SEQ ID NO: 2555427 - RNA, 21 nt, Chlamydophila pneumoniae J138
uccaaaaaaugcuccugcaaa

SEQ ID NO: 2555428 - RNA, 15 nt, Chlamydophila pneumoniae J138
uccaaaaacuucuaa

SEQ ID NO: 2555429 - RNA, 12 nt, Chlamydophila pneumoniae J138
uccaaaacucaa

SEQ ID NO: 2555430 - RNA, 17 nt, Chlamydophila pneumoniae J138
uccaaaagaccaaaaau

SEQ ID NO: 2555431 - RNA, 16 nt, Chlamydophila pneumoniae J138
uccaaaauaaaaggag

SEQ ID NO: 2555432 - RNA, 17 nt, Chlamydophila pneumoniae J138
uccaaaauaaaaggagc

SEQ ID NO: 2555433 - RNA, 22 nt, Chlamydophila pneumoniae J138
uccaaaauaaucucgcaguccu

SEQ ID NO: 2555434 - RNA, 12 nt, Chlamydophila pneumoniae J138
uccaaaaucauc

SEQ ID NO: 2555435 - RNA, 16 nt, Chlamydophila pneumoniae J138
uccaaacccugggcuc

SEQ ID NO: 2555436 - RNA, 12 nt, Chlamydophila pneumoniae J138
uccaaagacuga

SEQ ID NO: 2555437 - RNA, 17 nt, Chlamydophila pneumoniae J138
uccaaagaucaucuuca

SEQ ID NO: 2555438 - RNA, 20 nt, Chlamydophila pneumoniae J138
uccaaaggaaaauaaucuuc

SEQ ID NO: 2555439 - RNA, 21 nt, Chlamydophila pneumoniae J138
uccaaaggaaaauaaucuuca

SEQ ID NO: 2555440 - RNA, 14 nt, Chlamydophila pneumoniae J138
uccaaauguucucu

SEQ ID NO: 2555441 - RNA, 23 nt, Chlamydophila pneumoniae J138
uccaacaaacaauuccguacgcu

SEQ ID NO: 2555442 - RNA, 22 nt, Chlamydophila pneumoniae J138
uccaacagucugcuuuuuugau

SEQ ID NO: 2555443 - RNA, 13 nt, Chlamydophila pneumoniae J138
uccaacaucagcu

SEQ ID NO: 2555444 - RNA, 18 nt, Chlamydophila pneumoniae J138
uccaaccucgagauccuc

SEQ ID NO: 2555445 - RNA, 12 nt, Chlamydophila pneumoniae J138
uccaacuucaac

SEQ ID NO: 2555446 - RNA, 14 nt, Chlamydophila pneumoniae J138
uccaacuucuguau

SEQ ID NO: 2555447 - RNA, 16 nt, Chlamydophila pneumoniae J138
uccaacuuuugaagau

SEQ ID NO: 2555448 - RNA, 12 nt, Chlamydophila pneumoniae J138
uccaagaaguca

SEQ ID NO: 2555449 - RNA, 21 nt, Chlamydophila pneumoniae J138
uccaagaagucaucgcgagag

SEQ ID NO: 2555450 - RNA, 18 nt, Chlamydophila pneumoniae J138
uccaagaauagccauaau

SEQ ID NO: 2555451 - RNA, 22 nt, Chlamydophila pneumoniae J138
uccaagacaacaccucccacca

SEQ ID NO: 2555452 - RNA, 13 nt, Chlamydophila pneumoniae J138
uccaagacaauaa

SEQ ID NO: 2555453 - RNA, 19 nt, Chlamydophila pneumoniae J138
uccaagacaauaaaaaaga

SEQ ID NO: 2555454 - RNA, 20 nt, Chlamydophila pneumoniae J138
uccaagacaauaaaaaagag

SEQ ID NO: 2555455 - RNA, 21 nt, Chlamydophila pneumoniae J138
uccaagacaauaaaaaagaga

SEQ ID NO: 2555456 - RNA, 14 nt, Chlamydophila pneumoniae J138
uccaagaguucucu

SEQ ID NO: 2555457 - RNA, 16 nt, Chlamydophila pneumoniae J138
uccaagaucaaacgaa

SEQ ID NO: 2555458 - RNA, 13 nt, Chlamydophila pneumoniae J138
uccaagauugaau

SEQ ID NO: 2555459 - RNA, 22 nt, Chlamydophila pneumoniae J138
uccaagugaucagaaaugaagc

SEQ ID NO: 2555460 - RNA, 19 nt, Chlamydophila pneumoniae J138
uccaagugcucaguaaaua

SEQ ID NO: 2555461 - RNA, 15 nt, Chlamydophila pneumoniae J138
uccaauacuaaaacu

SEQ ID NO: 2555462 - RNA, 23 nt, Chlamydophila pneumoniae J138
uccaauaggccagaauguacaua

SEQ ID NO: 2555463 - RNA, 16 nt, Chlamydophila pneumoniae J138
uccaaucugcugaagg

SEQ ID NO: 2555464 - RNA, 17 nt, Chlamydophila pneumoniae J138
uccaaugagagagagac

SEQ ID NO: 2555465 - RNA, 16 nt, Chlamydophila pneumoniae J138
uccaaugcaugaaucu

SEQ ID NO: 2555466 - RNA, 15 nt, Chlamydophila pneumoniae J138
uccaaugcuauugga

SEQ ID NO: 2555467 - RNA, 17 nt, Chlamydophila pneumoniae J138
uccaauggcugagagau

SEQ ID NO: 2555468 - RNA, 17 nt, Chlamydophila pneumoniae J138
uccaauuguaaaucauu

SEQ ID NO: 2555469 - RNA, 14 nt, Chlamydophila pneumoniae J138
uccaauuuucuuca

SEQ ID NO: 2555470 - RNA, 19 nt, Chlamydophila pneumoniae J138
uccaauuuuugcauagaca

SEQ ID NO: 2555471 - RNA, 13 nt, Chlamydophila pneumoniae J138
uccacaagccucc

SEQ ID NO: 2555472 - RNA, 17 nt, Chlamydophila pneumoniae J138
uccacaagcuuuucgca

SEQ ID NO: 2555473 - RNA, 19 nt, Chlamydophila pneumoniae J138
uccacaaucucuuuaaaaa

SEQ ID NO: 2555474 - RNA, 16 nt, Chlamydophila pneumoniae J138
uccacacaacucguuu

SEQ ID NO: 2555475 - RNA, 19 nt, Chlamydophila pneumoniae J138
uccacagagaccuucucuu

SEQ ID NO: 2555476 - RNA, 20 nt, Chlamydophila pneumoniae J138
uccacagagaccuucucuuc

SEQ ID NO: 2555477 - RNA, 18 nt, Chlamydophila pneumoniae J138
uccacagggucuaguuca

SEQ ID NO: 2555478 - RNA, 13 nt, Chlamydophila pneumoniae J138
uccaccaagacug

SEQ ID NO: 2555479 - RNA, 19 nt, Chlamydophila pneumoniae J138
uccaccaggagcuccuccu

SEQ ID NO: 2555480 - RNA, 20 nt, Chlamydophila pneumoniae J138
uccaccaggagcuccuccuu

SEQ ID NO: 2555481 - RNA, 14 nt, Chlamydophila pneumoniae J138
uccacgaaggaauc

SEQ ID NO: 2555482 - RNA, 18 nt, Chlamydophila pneumoniae J138
uccacgaaggaaucugau

SEQ ID NO: 2555483 - RNA, 14 nt, Chlamydophila pneumoniae J138
uccacgaauucuuu

SEQ ID NO: 2555484 - RNA, 22 nt, Chlamydophila pneumoniae J138
uccacgaccugcaaacucccca

SEQ ID NO: 2555485 - RNA, 17 nt, Chlamydophila pneumoniae J138
uccacgagauucugcuu

SEQ ID NO: 2555486 - RNA, 16 nt, Chlamydophila pneumoniae J138
uccacggcggaucucu

SEQ ID NO: 2555487 - RNA, 15 nt, Chlamydophila pneumoniae J138
uccacuacugucaau

SEQ ID NO: 2555488 - RNA, 19 nt, Chlamydophila pneumoniae J138
uccacugcagcagguguca

SEQ ID NO: 2555489 - RNA, 15 nt, Chlamydophila pneumoniae J138
uccacugcuuuaggc

SEQ ID NO: 2555490 - RNA, 15 nt, Chlamydophila pneumoniae J138
uccacuguucuucuu

SEQ ID NO: 2555491 - RNA, 12 nt, Chlamydophila pneumoniae J138
uccagaaaguau

SEQ ID NO: 2555492 - RNA, 15 nt, Chlamydophila pneumoniae J138
uccagaaauuuuuac

SEQ ID NO: 2555493 - RNA, 13 nt, Chlamydophila pneumoniae J138
uccagaagcaaga

SEQ ID NO: 2555494 - RNA, 18 nt, Chlamydophila pneumoniae J138
uccagaucaaugccuugc

SEQ ID NO: 2555495 - RNA, 16 nt, Chlamydophila pneumoniae J138
uccagauuguucaaaa

SEQ ID NO: 2555496 - RNA, 20 nt, Chlamydophila pneumoniae J138
uccagcaaagcgaccugcaa

SEQ ID NO: 2555497 - RNA, 16 nt, Chlamydophila pneumoniae J138
uccagcaacaaccaaa

SEQ ID NO: 2555498 - RNA, 13 nt, Chlamydophila pneumoniae J138
uccagcagcaaau

SEQ ID NO: 2555499 - RNA, 10 nt, Chlamydophila pneumoniae J138
uccagccccc

SEQ ID NO: 2555500 - RNA, 17 nt, Chlamydophila pneumoniae J138
uccagcccccaggcugc

SEQ ID NO: 2555501 - RNA, 17 nt, Chlamydophila pneumoniae J138
uccagccugugagcucu

SEQ ID NO: 2555502 - RNA, 17 nt, Chlamydophila pneumoniae J138
uccagcgaggagaagua

SEQ ID NO: 2555503 - RNA, 13 nt, Chlamydophila pneumoniae J138
uccagcuccauaa

SEQ ID NO: 2555504 - RNA, 22 nt, Chlamydophila pneumoniae J138
uccagcuccauaagcuuuucuu

SEQ ID NO: 2555505 - RNA, 14 nt, Chlamydophila pneumoniae J138
uccagcuguggugg

SEQ ID NO: 2555506 - RNA, 15 nt, Chlamydophila pneumoniae J138
uccagcuucucccau

SEQ ID NO: 2555507 - RNA, 15 nt, Chlamydophila pneumoniae J138
uccagcuucuuucua

SEQ ID NO: 2555508 - RNA, 16 nt, Chlamydophila pneumoniae J138
uccaggaccaaacuuc

SEQ ID NO: 2555509 - RNA, 18 nt, Chlamydophila pneumoniae J138
uccaggacguaaaaagaa

SEQ ID NO: 2555510 - RNA, 16 nt, Chlamydophila pneumoniae J138
uccagggacagaaguc

SEQ ID NO: 2555511 - RNA, 22 nt, Chlamydophila pneumoniae J138
uccaggguagcgcuuuuuuaaa

SEQ ID NO: 2555512 - RNA, 22 nt, Chlamydophila pneumoniae J138
uccagguagcagaguuuuuccc

SEQ ID NO: 2555513 - RNA, 23 nt, Chlamydophila pneumoniae J138
uccagguagcagaguuuuucccu

SEQ ID NO: 2555514 - RNA, 20 nt, Chlamydophila pneumoniae J138
uccagguuguccuauagaga

SEQ ID NO: 2555515 - RNA, 18 nt, Chlamydophila pneumoniae J138
uccaguagaucuucugaa

SEQ ID NO: 2555516 - RNA, 16 nt, Chlamydophila pneumoniae J138
uccaguaucuucucuu

SEQ ID NO: 2555517 - RNA, 13 nt, Chlamydophila pneumoniae J138
uccaguucuucau

SEQ ID NO: 2555518 - RNA, 20 nt, Chlamydophila pneumoniae J138
uccaguuuguugaucucuaa

SEQ ID NO: 2555519 - RNA, 14 nt, Chlamydophila pneumoniae J138
uccaguuuuuuaaa

SEQ ID NO: 2555520 - RNA, 22 nt, Chlamydophila pneumoniae J138
uccauaagcuuuucuuccaaag

SEQ ID NO: 2555521 - RNA, 13 nt, Chlamydophila pneumoniae J138
uccauaauuucuu

SEQ ID NO: 2555522 - RNA, 18 nt, Chlamydophila pneumoniae J138
uccauaauuucuuucaca

SEQ ID NO: 2555523 - RNA, 18 nt, Chlamydophila pneumoniae J138
uccauacccaaauuucuu

SEQ ID NO: 2555524 - RNA, 12 nt, Chlamydophila pneumoniae J138
uccauagagaac

SEQ ID NO: 2555525 - RNA, 21 nt, Chlamydophila pneumoniae J138
uccauagaguaucuaaaacuu

SEQ ID NO: 2555526 - RNA, 18 nt, Chlamydophila pneumoniae J138
uccauagcuuuagaagcc

SEQ ID NO: 2555527 - RNA, 20 nt, Chlamydophila pneumoniae J138
uccauagcuuuagaagcccg

SEQ ID NO: 2555528 - RNA, 13 nt, Chlamydophila pneumoniae J138
uccauaggaacaa

SEQ ID NO: 2555529 - RNA, 18 nt, Chlamydophila pneumoniae J138
uccauaggaacaaagcca

SEQ ID NO: 2555530 - RNA, 18 nt, Chlamydophila pneumoniae J138
uccauaucaaagaucuga

SEQ ID NO: 2555531 - RNA, 18 nt, Chlamydophila pneumoniae J138
uccaucaucgaagaacuu

SEQ ID NO: 2555532 - RNA, 21 nt, Chlamydophila pneumoniae J138
uccaucggaauuugccugaaa

SEQ ID NO: 2555533 - RNA, 21 nt, Chlamydophila pneumoniae J138
uccaucggggcggacuauguu

SEQ ID NO: 2555534 - RNA, 13 nt, Chlamydophila pneumoniae J138
uccaucucuuuaa

SEQ ID NO: 2555535 - RNA, 23 nt, Chlamydophila pneumoniae J138
uccaugacuuuuguugcaauucc

SEQ ID NO: 2555536 - RNA, 18 nt, Chlamydophila pneumoniae J138
uccaugcuaauaauuccu

SEQ ID NO: 2555537 - RNA, 14 nt, Chlamydophila pneumoniae J138
uccauguacagaaa

SEQ ID NO: 2555538 - RNA, 16 nt, Chlamydophila pneumoniae J138
uccauguacaguuugu

SEQ ID NO: 2555539 - RNA, 22 nt, Chlamydophila pneumoniae J138
uccauguacaguuuguaaaaag

SEQ ID NO: 2555540 - RNA, 15 nt, Chlamydophila pneumoniae J138
uccaugucuaaagau

SEQ ID NO: 2555541 - RNA, 22 nt, Chlamydophila pneumoniae J138
uccauucagauggucagucucg

SEQ ID NO: 2555542 - RNA, 18 nt, Chlamydophila pneumoniae J138
uccauucugagaaagaag

SEQ ID NO: 2555543 - RNA, 22 nt, Chlamydophila pneumoniae J138
uccauucuuaauauaaaagaag

SEQ ID NO: 2555544 - RNA, 21 nt, Chlamydophila pneumoniae J138
uccauuggcauagagccuaga

SEQ ID NO: 2555545 - RNA, 14 nt, Chlamydophila pneumoniae J138
uccauuuagaauga

SEQ ID NO: 2555546 - RNA, 13 nt, Chlamydophila pneumoniae J138
ucccaaacuucuu

SEQ ID NO: 2555547 - RNA, 14 nt, Chlamydophila pneumoniae J138
ucccaagucugcuu

SEQ ID NO: 2555548 - RNA, 19 nt, Chlamydophila pneumoniae J138
ucccaaucaagauaaaggc

SEQ ID NO: 2555549 - RNA, 12 nt, Chlamydophila pneumoniae J138
ucccacagaaau

SEQ ID NO: 2555550 - RNA, 16 nt, Chlamydophila pneumoniae J138
ucccaccauauucuca

SEQ ID NO: 2555551 - RNA, 22 nt, Chlamydophila pneumoniae J138
ucccacuggacuucguuuugau

SEQ ID NO: 2555552 - RNA, 18 nt, Chlamydophila pneumoniae J138
ucccagaagaaauuagag

SEQ ID NO: 2555553 - RNA, 16 nt, Chlamydophila pneumoniae J138
ucccagauuacaagag

SEQ ID NO: 2555554 - RNA, 18 nt, Chlamydophila pneumoniae J138
ucccagauuuuuuugguu

SEQ ID NO: 2555555 - RNA, 21 nt, Chlamydophila pneumoniae J138
ucccauaaauguauaggcauu

SEQ ID NO: 2555556 - RNA, 14 nt, Chlamydophila pneumoniae J138
ucccaucaaaggca

SEQ ID NO: 2555557 - RNA, 22 nt, Chlamydophila pneumoniae J138
ucccaucaucgagcugaucuuc

SEQ ID NO: 2555558 - RNA, 16 nt, Chlamydophila pneumoniae J138
ucccaucgucccuaaa

SEQ ID NO: 2555559 - RNA, 19 nt, Chlamydophila pneumoniae J138
ucccaucuuguucuaaaau

SEQ ID NO: 2555560 - RNA, 17 nt, Chlamydophila pneumoniae J138
ucccaugugcugaagac

SEQ ID NO: 2555561 - RNA, 18 nt, Chlamydophila pneumoniae J138
ucccaugugcugaagacc

SEQ ID NO: 2555562 - RNA, 16 nt, Chlamydophila pneumoniae J138
ucccauuucuggagaa

SEQ ID NO: 2555563 - RNA, 20 nt, Chlamydophila pneumoniae J138
uccccauaaccaauaaacuu

SEQ ID NO: 2555564 - RNA, 18 nt, Chlamydophila pneumoniae J138
uccccauucacaaaucuu

SEQ ID NO: 2555565 - RNA, 21 nt, Chlamydophila pneumoniae J138
uccccucugauuauuucuaaa

SEQ ID NO: 2555566 - RNA, 23 nt, Chlamydophila pneumoniae J138
uccccucugauuauuucuaaaaa

SEQ ID NO: 2555567 - RNA, 14 nt, Chlamydophila pneumoniae J138
uccccugcaucucu

SEQ ID NO: 2555568 - RNA, 22 nt, Chlamydophila pneumoniae J138
ucccgaacgcuagggaaaccau

SEQ ID NO: 2555569 - RNA, 13 nt, Chlamydophila pneumoniae J138
ucccgacaagcuu

SEQ ID NO: 2555570 - RNA, 17 nt, Chlamydophila pneumoniae J138
ucccgaguccuaaaauu

SEQ ID NO: 2555571 - RNA, 21 nt, Chlamydophila pneumoniae J138
ucccgguaugaucaagaggag

SEQ ID NO: 2555572 - RNA, 23 nt, Chlamydophila pneumoniae J138
ucccuaaaaugagauuccuauga

SEQ ID NO: 2555573 - RNA, 22 nt, Chlamydophila pneumoniae J138
ucccuaaaguaacgauaagaag

SEQ ID NO: 2555574 - RNA, 20 nt, Chlamydophila pneumoniae J138
ucccuaagaguuccaagaca

SEQ ID NO: 2555575 - RNA, 21 nt, Chlamydophila pneumoniae J138
ucccuagguuuuaucuuuaga

SEQ ID NO: 2555576 - RNA, 20 nt, Chlamydophila pneumoniae J138
ucccuauaaagcaaaugccu

SEQ ID NO: 2555577 - RNA, 22 nt, Chlamydophila pneumoniae J138
ucccuauaaagcaaaugccugu

SEQ ID NO: 2555578 - RNA, 14 nt, Chlamydophila pneumoniae J138
ucccucacaagaag

SEQ ID NO: 2555579 - RNA, 14 nt, Chlamydophila pneumoniae J138
ucccucuagagcuu

SEQ ID NO: 2555580 - RNA, 17 nt, Chlamydophila pneumoniae J138
ucccucuccuugaaaau

SEQ ID NO: 2555581 - RNA, 16 nt, Chlamydophila pneumoniae J138
ucccucuucuuccaau

SEQ ID NO: 2555582 - RNA, 14 nt, Chlamydophila pneumoniae J138
ucccugacacagag

SEQ ID NO: 2555583 - RNA, 19 nt, Chlamydophila pneumoniae J138
ucccugauuccauccuguc

SEQ ID NO: 2555584 - RNA, 15 nt, Chlamydophila pneumoniae J138
ucccugguacuuaug

SEQ ID NO: 2555585 - RNA, 12 nt, Chlamydophila pneumoniae J138
ucccuucuucuu

SEQ ID NO: 2555586 - RNA, 13 nt, Chlamydophila pneumoniae J138
ucccuucuucuuu

SEQ ID NO: 2555587 - RNA, 13 nt, Chlamydophila pneumoniae J138
ucccuuuuuaagu

SEQ ID NO: 2555588 - RNA, 19 nt, Chlamydophila pneumoniae J138
uccgaaaucugacagaccu

SEQ ID NO: 2555589 - RNA, 16 nt, Chlamydophila pneumoniae J138
uccgaauggagaagga

SEQ ID NO: 2555590 - RNA, 17 nt, Chlamydophila pneumoniae J138
uccgacggagagagauu

SEQ ID NO: 2555591 - RNA, 16 nt, Chlamydophila pneumoniae J138
uccgaggagggaaaca

SEQ ID NO: 2555592 - RNA, 18 nt, Chlamydophila pneumoniae J138
uccgaggagggaaacacc

SEQ ID NO: 2555593 - RNA, 12 nt, Chlamydophila pneumoniae J138
uccgauauacuu

SEQ ID NO: 2555594 - RNA, 19 nt, Chlamydophila pneumoniae J138
uccgaucauaauuagagag

SEQ ID NO: 2555595 - RNA, 17 nt, Chlamydophila pneumoniae J138
uccgauuaacuuuauac

SEQ ID NO: 2555596 - RNA, 15 nt, Chlamydophila pneumoniae J138
uccgauuaguaauga

SEQ ID NO: 2555597 - RNA, 17 nt, Chlamydophila pneumoniae J138
uccgcaggucgcaucaa

SEQ ID NO: 2555598 - RNA, 15 nt, Chlamydophila pneumoniae J138
uccgcaguuguacaa

SEQ ID NO: 2555599 - RNA, 20 nt, Chlamydophila pneumoniae J138
uccgcuagaggaucuucaag

SEQ ID NO: 2555600 - RNA, 21 nt, Chlamydophila pneumoniae J138
uccgcuuuuacgaaugagauc

SEQ ID NO: 2555601 - RNA, 17 nt, Chlamydophila pneumoniae J138
uccggaaggaguucuuu

SEQ ID NO: 2555602 - RNA, 20 nt, Chlamydophila pneumoniae J138
uccggauucuuuauccccag

SEQ ID NO: 2555603 - RNA, 20 nt, Chlamydophila pneumoniae J138
uccguaaggacuguagugaa

SEQ ID NO: 2555604 - RNA, 19 nt, Chlamydophila pneumoniae J138
uccguagguguuaaguuca

SEQ ID NO: 2555605 - RNA, 13 nt, Chlamydophila pneumoniae J138
uccguauaaguau

SEQ ID NO: 2555606 - RNA, 14 nt, Chlamydophila pneumoniae J138
uccguauuuuuuac

SEQ ID NO: 2555607 - RNA, 16 nt, Chlamydophila pneumoniae J138
uccgucaagaacaaga

SEQ ID NO: 2555608 - RNA, 23 nt, Chlamydophila pneumoniae J138
uccgugagauacuuuaaagacuu

SEQ ID NO: 2555609 - RNA, 18 nt, Chlamydophila pneumoniae J138
uccguucgagagguuccc

SEQ ID NO: 2555610 - RNA, 17 nt, Chlamydophila pneumoniae J138
uccguugaauuaauaaa

SEQ ID NO: 2555611 - RNA, 16 nt, Chlamydophila pneumoniae J138
uccguuucagaaguca

SEQ ID NO: 2555612 - RNA, 11 nt, Chlamydophila pneumoniae J138
uccuaaaaaaa

SEQ ID NO: 2555613 - RNA, 15 nt, Chlamydophila pneumoniae J138
uccuaaaauuucuag

SEQ ID NO: 2555614 - RNA, 19 nt, Chlamydophila pneumoniae J138
uccuaacuucugaaggaaa

SEQ ID NO: 2555615 - RNA, 19 nt, Chlamydophila pneumoniae J138
uccuaagucguuaacauca

SEQ ID NO: 2555616 - RNA, 16 nt, Chlamydophila pneumoniae J138
uccuacuccuaaagua

SEQ ID NO: 2555617 - RNA, 16 nt, Chlamydophila pneumoniae J138
uccuacuucugcagga

SEQ ID NO: 2555618 - RNA, 20 nt, Chlamydophila pneumoniae J138
uccuagacagccuugacucu

SEQ ID NO: 2555619 - RNA, 22 nt, Chlamydophila pneumoniae J138
uccuagacagccuugacucuaa

SEQ ID NO: 2555620 - RNA, 16 nt, Chlamydophila pneumoniae J138
uccuagacgaucuuca

SEQ ID NO: 2555621 - RNA, 11 nt, Chlamydophila pneumoniae J138
uccuagagaau

SEQ ID NO: 2555622 - RNA, 21 nt, Chlamydophila pneumoniae J138
uccuagagucgaguuucuagu

SEQ ID NO: 2555623 - RNA, 15 nt, Chlamydophila pneumoniae J138
uccuagcagagaaau

SEQ ID NO: 2555624 - RNA, 16 nt, Chlamydophila pneumoniae J138
uccuagggagugagga

SEQ ID NO: 2555625 - RNA, 18 nt, Chlamydophila pneumoniae J138
uccuagggagugaggaau

SEQ ID NO: 2555626 - RNA, 19 nt, Chlamydophila pneumoniae J138
uccuagguucuuuucggau

SEQ ID NO: 2555627 - RNA, 17 nt, Chlamydophila pneumoniae J138
uccuauaguaauuucuc

SEQ ID NO: 2555628 - RNA, 22 nt, Chlamydophila pneumoniae J138
uccuauaugaaugauuuccaua

SEQ ID NO: 2555629 - RNA, 15 nt, Chlamydophila pneumoniae J138
uccuaucaaagcaaa

SEQ ID NO: 2555630 - RNA, 18 nt, Chlamydophila pneumoniae J138
uccuaucaaagcaaaagu

SEQ ID NO: 2555631 - RNA, 14 nt, Chlamydophila pneumoniae J138
uccuauuuuuuaag

SEQ ID NO: 2555632 - RNA, 22 nt, Chlamydophila pneumoniae J138
uccucaaagaguuuuuuagagg

SEQ ID NO: 2555633 - RNA, 13 nt, Chlamydophila pneumoniae J138
uccucaagaauau

SEQ ID NO: 2555634 - RNA, 21 nt, Chlamydophila pneumoniae J138
uccucaagaauaugaacugcc

SEQ ID NO: 2555635 - RNA, 19 nt, Chlamydophila pneumoniae J138
uccucaagauaaaucccac

SEQ ID NO: 2555636 - RNA, 16 nt, Chlamydophila pneumoniae J138
uccucacauguuucac

SEQ ID NO: 2555637 - RNA, 13 nt, Chlamydophila pneumoniae J138
uccucacuauuaa

SEQ ID NO: 2555638 - RNA, 16 nt, Chlamydophila pneumoniae J138
uccucagaauccauuu

SEQ ID NO: 2555639 - RNA, 14 nt, Chlamydophila pneumoniae J138
uccucaucagaagc

SEQ ID NO: 2555640 - RNA, 14 nt, Chlamydophila pneumoniae J138
uccuccaaaagacc

SEQ ID NO: 2555641 - RNA, 18 nt, Chlamydophila pneumoniae J138
uccuccaaugagcucuau

SEQ ID NO: 2555642 - RNA, 16 nt, Chlamydophila pneumoniae J138
uccuccauguacaguu

SEQ ID NO: 2555643 - RNA, 15 nt, Chlamydophila pneumoniae J138
uccuccccauacaua

SEQ ID NO: 2555644 - RNA, 20 nt, Chlamydophila pneumoniae J138
uccuccucgucuaaagaaga

SEQ ID NO: 2555645 - RNA, 16 nt, Chlamydophila pneumoniae J138
uccucgaauggagugc

SEQ ID NO: 2555646 - RNA, 20 nt, Chlamydophila pneumoniae J138
uccucgagaacguagcagag

SEQ ID NO: 2555647 - RNA, 14 nt, Chlamydophila pneumoniae J138
uccucgauacuguu

SEQ ID NO: 2555648 - RNA, 23 nt, Chlamydophila pneumoniae J138
uccucgauacuguugauccuucu

SEQ ID NO: 2555649 - RNA, 23 nt, Chlamydophila pneumoniae J138
uccucgcucagcuaauuuaaaug

SEQ ID NO: 2555650 - RNA, 16 nt, Chlamydophila pneumoniae J138
uccucggcaacuacug

SEQ ID NO: 2555651 - RNA, 16 nt, Chlamydophila pneumoniae J138
uccucguuaauaagaa

SEQ ID NO: 2555652 - RNA, 21 nt, Chlamydophila pneumoniae J138
uccucuaaggacaaaucuccc

SEQ ID NO: 2555653 - RNA, 23 nt, Chlamydophila pneumoniae J138
uccucuaaggacaaaucucccaa

SEQ ID NO: 2555654 - RNA, 22 nt, Chlamydophila pneumoniae J138
uccucuauccaucaucgaagaa

SEQ ID NO: 2555655 - RNA, 14 nt, Chlamydophila pneumoniae J138
uccucucaugaaau

SEQ ID NO: 2555656 - RNA, 16 nt, Chlamydophila pneumoniae J138
uccucucaugaaauuu

SEQ ID NO: 2555657 - RNA, 22 nt, Chlamydophila pneumoniae J138
uccucucaugaaauuuucuaag

SEQ ID NO: 2555658 - RNA, 22 nt, Chlamydophila pneumoniae J138
uccucuccaaaacaaucuaaag

SEQ ID NO: 2555659 - RNA, 16 nt, Chlamydophila pneumoniae J138
uccucucgauucucgu

SEQ ID NO: 2555660 - RNA, 14 nt, Chlamydophila pneumoniae J138
uccucugaaggauu

SEQ ID NO: 2555661 - RNA, 15 nt, Chlamydophila pneumoniae J138
uccucugauuccagu

SEQ ID NO: 2555662 - RNA, 17 nt, Chlamydophila pneumoniae J138
uccucuuaggagagcuu

SEQ ID NO: 2555663 - RNA, 15 nt, Chlamydophila pneumoniae J138
uccucuucaauuucu

SEQ ID NO: 2555664 - RNA, 20 nt, Chlamydophila pneumoniae J138
uccucuucuucaucuucuaa

SEQ ID NO: 2555665 - RNA, 17 nt, Chlamydophila pneumoniae J138
uccucuuucuuaggaaa

SEQ ID NO: 2555666 - RNA, 18 nt, Chlamydophila pneumoniae J138
uccugaacaucuccagca

SEQ ID NO: 2555667 - RNA, 18 nt, Chlamydophila pneumoniae J138
uccugaacggcucuuucu

SEQ ID NO: 2555668 - RNA, 13 nt, Chlamydophila pneumoniae J138
uccugaagaugag

SEQ ID NO: 2555669 - RNA, 13 nt, Chlamydophila pneumoniae J138
uccugaagcagcu

SEQ ID NO: 2555670 - RNA, 21 nt, Chlamydophila pneumoniae J138
uccugaauggcucugucacua

SEQ ID NO: 2555671 - RNA, 16 nt, Chlamydophila pneumoniae J138
uccugacacaacucuu

SEQ ID NO: 2555672 - RNA, 12 nt, Chlamydophila pneumoniae J138
uccugaccagug

SEQ ID NO: 2555673 - RNA, 23 nt, Chlamydophila pneumoniae J138
uccugacgcauagcacuaugaau

SEQ ID NO: 2555674 - RNA, 21 nt, Chlamydophila pneumoniae J138
uccugagagcguuguggaagu

SEQ ID NO: 2555675 - RNA, 19 nt, Chlamydophila pneumoniae J138
uccugagguugggcagaag

SEQ ID NO: 2555676 - RNA, 21 nt, Chlamydophila pneumoniae J138
uccugagguugggcagaagcu

SEQ ID NO: 2555677 - RNA, 22 nt, Chlamydophila pneumoniae J138
uccugcagcagccuuggcucua

SEQ ID NO: 2555678 - RNA, 15 nt, Chlamydophila pneumoniae J138
uccugcuccaaaaug

SEQ ID NO: 2555679 - RNA, 11 nt, Chlamydophila pneumoniae J138
uccugcugcuu

SEQ ID NO: 2555680 - RNA, 19 nt, Chlamydophila pneumoniae J138
uccugcuucuauagagaca

SEQ ID NO: 2555681 - RNA, 22 nt, Chlamydophila pneumoniae J138
uccuggaagaauuucauaagag

SEQ ID NO: 2555682 - RNA, 16 nt, Chlamydophila pneumoniae J138
uccuggagcaugagag

SEQ ID NO: 2555683 - RNA, 22 nt, Chlamydophila pneumoniae J138
uccuggggugcguaucaguuuu

SEQ ID NO: 2555684 - RNA, 16 nt, Chlamydophila pneumoniae J138
uccugggguucucuaa

SEQ ID NO: 2555685 - RNA, 15 nt, Chlamydophila pneumoniae J138
uccuguagagcaaga

SEQ ID NO: 2555686 - RNA, 13 nt, Chlamydophila pneumoniae J138
uccuguagggaaa

SEQ ID NO: 2555687 - RNA, 16 nt, Chlamydophila pneumoniae J138
uccuguaguuuuacuu

SEQ ID NO: 2555688 - RNA, 16 nt, Chlamydophila pneumoniae J138
uccuguauauucugaa

SEQ ID NO: 2555689 - RNA, 23 nt, Chlamydophila pneumoniae J138
uccugucuauuucuuaauuuccu

SEQ ID NO: 2555690 - RNA, 21 nt, Chlamydophila pneumoniae J138
uccuguuucaacauaacauga

SEQ ID NO: 2555691 - RNA, 16 nt, Chlamydophila pneumoniae J138
uccuuaacaacaucac

SEQ ID NO: 2555692 - RNA, 22 nt, Chlamydophila pneumoniae J138
uccuuaacaacaucacuuauau

SEQ ID NO: 2555693 - RNA, 21 nt, Chlamydophila pneumoniae J138
uccuuaacaaccgccuuuaua

SEQ ID NO: 2555694 - RNA, 15 nt, Chlamydophila pneumoniae J138
uccuuaaccuccuca

SEQ ID NO: 2555695 - RNA, 22 nt, Chlamydophila pneumoniae J138
uccuuaaugguagcuuaagaau

SEQ ID NO: 2555696 - RNA, 19 nt, Chlamydophila pneumoniae J138
uccuuaccuauauagcccu

SEQ ID NO: 2555697 - RNA, 17 nt, Chlamydophila pneumoniae J138
uccuuauccgucagccu

SEQ ID NO: 2555698 - RNA, 20 nt, Chlamydophila pneumoniae J138
uccuucaaaauguuuaucga

SEQ ID NO: 2555699 - RNA, 14 nt, Chlamydophila pneumoniae J138
uccuucaaagauau

SEQ ID NO: 2555700 - RNA, 14 nt, Chlamydophila pneumoniae J138
uccuucaacacacc

SEQ ID NO: 2555701 - RNA, 13 nt, Chlamydophila pneumoniae J138
uccuucaggauuu

SEQ ID NO: 2555702 - RNA, 19 nt, Chlamydophila pneumoniae J138
uccuucaggauuuuccauu

SEQ ID NO: 2555703 - RNA, 20 nt, Chlamydophila pneumoniae J138
uccuucaggauuuuccauua

SEQ ID NO: 2555704 - RNA, 18 nt, Chlamydophila pneumoniae J138
uccuucauucacagcagu

SEQ ID NO: 2555705 - RNA, 11 nt, Chlamydophila pneumoniae J138
uccuuccuuaa

SEQ ID NO: 2555706 - RNA, 17 nt, Chlamydophila pneumoniae J138
uccuucgaagcggagca

SEQ ID NO: 2555707 - RNA, 14 nt, Chlamydophila pneumoniae J138
uccuucgaccuauu

SEQ ID NO: 2555708 - RNA, 20 nt, Chlamydophila pneumoniae J138
uccuucuacagauugaugcu

SEQ ID NO: 2555709 - RNA, 15 nt, Chlamydophila pneumoniae J138
uccuucucagaaaga

SEQ ID NO: 2555710 - RNA, 12 nt, Chlamydophila pneumoniae J138
uccuucucccuc

SEQ ID NO: 2555711 - RNA, 20 nt, Chlamydophila pneumoniae J138
uccuucucccucuaaacaua

SEQ ID NO: 2555712 - RNA, 20 nt, Chlamydophila pneumoniae J138
uccuucugcaaucagugcug

SEQ ID NO: 2555713 - RNA, 11 nt, Chlamydophila pneumoniae J138
uccuucuucuu

SEQ ID NO: 2555714 - RNA, 12 nt, Chlamydophila pneumoniae J138
uccuucuugcaa

SEQ ID NO: 2555715 - RNA, 21 nt, Chlamydophila pneumoniae J138
uccuucuuucugcucuucuau

SEQ ID NO: 2555716 - RNA, 13 nt, Chlamydophila pneumoniae J138
uccuugaaaauca

SEQ ID NO: 2555717 - RNA, 20 nt, Chlamydophila pneumoniae J138
uccuugaacuaacugagcaa

SEQ ID NO: 2555718 - RNA, 15 nt, Chlamydophila pneumoniae J138
uccuugacaaauaag

SEQ ID NO: 2555719 - RNA, 20 nt, Chlamydophila pneumoniae J138
uccuugagggcuauccacaa

SEQ ID NO: 2555720 - RNA, 14 nt, Chlamydophila pneumoniae J138
uccuugauuuggga

SEQ ID NO: 2555721 - RNA, 19 nt, Chlamydophila pneumoniae J138
uccuugcaaaacagcauca

SEQ ID NO: 2555722 - RNA, 17 nt, Chlamydophila pneumoniae J138
uccuugcagcccugcau

SEQ ID NO: 2555723 - RNA, 17 nt, Chlamydophila pneumoniae J138
uccuuggauuucuucuu

SEQ ID NO: 2555724 - RNA, 12 nt, Chlamydophila pneumoniae J138
uccuuguagaac

SEQ ID NO: 2555725 - RNA, 20 nt, Chlamydophila pneumoniae J138
uccuuguagaacuucucaag

SEQ ID NO: 2555726 - RNA, 14 nt, Chlamydophila pneumoniae J138
uccuuuaaauaaaa

SEQ ID NO: 2555727 - RNA, 19 nt, Chlamydophila pneumoniae J138
uccuuugagucuuuuucag

SEQ ID NO: 2555728 - RNA, 22 nt, Chlamydophila pneumoniae J138
uccuuugagucuuuuucagaaa

SEQ ID NO: 2555729 - RNA, 14 nt, Chlamydophila pneumoniae J138
uccuuuuuaggaaa

SEQ ID NO: 2555730 - RNA, 21 nt, Chlamydophila pneumoniae J138
uccuuuuuaggacgcuauccu

SEQ ID NO: 2555731 - RNA, 14 nt, Chlamydophila pneumoniae J138
ucgaaaaacgguaa

SEQ ID NO: 2555732 - RNA, 16 nt, Chlamydophila pneumoniae J138
ucgaaacacucaugaa

SEQ ID NO: 2555733 - RNA, 22 nt, Chlamydophila pneumoniae J138
ucgaaacacucaugaaagugcu

SEQ ID NO: 2555734 - RNA, 18 nt, Chlamydophila pneumoniae J138
ucgaaaccacagcaaaga

SEQ ID NO: 2555735 - RNA, 17 nt, Chlamydophila pneumoniae J138
ucgaaacucuuugagga

SEQ ID NO: 2555736 - RNA, 17 nt, Chlamydophila pneumoniae J138
ucgaaauccuaaaaagg

SEQ ID NO: 2555737 - RNA, 18 nt, Chlamydophila pneumoniae J138
ucgaagaaaauaaagauc

SEQ ID NO: 2555738 - RNA, 16 nt, Chlamydophila pneumoniae J138
ucgaagauucaaagaa

SEQ ID NO: 2555739 - RNA, 20 nt, Chlamydophila pneumoniae J138
ucgaagauucaaagaagucg

SEQ ID NO: 2555740 - RNA, 16 nt, Chlamydophila pneumoniae J138
ucgaagcuugcugauu

SEQ ID NO: 2555741 - RNA, 18 nt, Chlamydophila pneumoniae J138
ucgaauagcucuggagau

SEQ ID NO: 2555742 - RNA, 23 nt, Chlamydophila pneumoniae J138
ucgaauccgauagaucacaucaa

SEQ ID NO: 2555743 - RNA, 13 nt, Chlamydophila pneumoniae J138
ucgaaucuaaaaa

SEQ ID NO: 2555744 - RNA, 19 nt, Chlamydophila pneumoniae J138
ucgaaucuaaaaacuuccc

SEQ ID NO: 2555745 - RNA, 19 nt, Chlamydophila pneumoniae J138
ucgaaucuuuauuucugau

SEQ ID NO: 2555746 - RNA, 22 nt, Chlamydophila pneumoniae J138
ucgaauuguguguuuucauaaa

SEQ ID NO: 2555747 - RNA, 15 nt, Chlamydophila pneumoniae J138
ucgaauuuuuguuuu

SEQ ID NO: 2555748 - RNA, 19 nt, Chlamydophila pneumoniae J138
ucgacaggggaguuuucaa

SEQ ID NO: 2555749 - RNA, 20 nt, Chlamydophila pneumoniae J138
ucgacaugcaggccaacucu

SEQ ID NO: 2555750 - RNA, 14 nt, Chlamydophila pneumoniae J138
ucgaccuauuugca

SEQ ID NO: 2555751 - RNA, 16 nt, Chlamydophila pneumoniae J138
ucgaccuauuugcaac

SEQ ID NO: 2555752 - RNA, 21 nt, Chlamydophila pneumoniae J138
ucgacuauaagagguucucuu

SEQ ID NO: 2555753 - RNA, 12 nt, Chlamydophila pneumoniae J138
ucgacucuucca

SEQ ID NO: 2555754 - RNA, 15 nt, Chlamydophila pneumoniae J138
ucgacuuccuucaau

SEQ ID NO: 2555755 - RNA, 21 nt, Chlamydophila pneumoniae J138
ucgacuuuuuuaagagugucu

SEQ ID NO: 2555756 - RNA, 15 nt, Chlamydophila pneumoniae J138
ucgagaaccuccacc

SEQ ID NO: 2555757 - RNA, 18 nt, Chlamydophila pneumoniae J138
ucgagaacguagcagagg

SEQ ID NO: 2555758 - RNA, 20 nt, Chlamydophila pneumoniae J138
ucgagaacguagcagaggca

SEQ ID NO: 2555759 - RNA, 15 nt, Chlamydophila pneumoniae J138
ucgagagaagaaauu

SEQ ID NO: 2555760 - RNA, 17 nt, Chlamydophila pneumoniae J138
ucgagagaagaaauucu

SEQ ID NO: 2555761 - RNA, 16 nt, Chlamydophila pneumoniae J138
ucgagauauugugagg

SEQ ID NO: 2555762 - RNA, 17 nt, Chlamydophila pneumoniae J138
ucgagaucuuuuugcca

SEQ ID NO: 2555763 - RNA, 19 nt, Chlamydophila pneumoniae J138
ucgagcagaaacuccaaaa

SEQ ID NO: 2555764 - RNA, 21 nt, Chlamydophila pneumoniae J138
ucgagcagaaacuccaaaaua

SEQ ID NO: 2555765 - RNA, 16 nt, Chlamydophila pneumoniae J138
ucgagcuuuaagaaga

SEQ ID NO: 2555766 - RNA, 18 nt, Chlamydophila pneumoniae J138
ucgagcuuuaagaagaag

SEQ ID NO: 2555767 - RNA, 20 nt, Chlamydophila pneumoniae J138
ucgaguaccgaccgaaucuc

SEQ ID NO: 2555768 - RNA, 16 nt, Chlamydophila pneumoniae J138
ucgaguucuuuuugca

SEQ ID NO: 2555769 - RNA, 17 nt, Chlamydophila pneumoniae J138
ucgauaacacuucuuuc

SEQ ID NO: 2555770 - RNA, 12 nt, Chlamydophila pneumoniae J138
ucgauaagaacu

SEQ ID NO: 2555771 - RNA, 15 nt, Chlamydophila pneumoniae J138
ucgauacccaaagag

SEQ ID NO: 2555772 - RNA, 17 nt, Chlamydophila pneumoniae J138
ucgauaggaagccaguc

SEQ ID NO: 2555773 - RNA, 13 nt, Chlamydophila pneumoniae J138
ucgaucaaggugu

SEQ ID NO: 2555774 - RNA, 23 nt, Chlamydophila pneumoniae J138
ucgaucccggcuuugggcaucuc

SEQ ID NO: 2555775 - RNA, 15 nt, Chlamydophila pneumoniae J138
ucgaugagggaaaug

SEQ ID NO: 2555776 - RNA, 17 nt, Chlamydophila pneumoniae J138
ucgaugagggaaaugcg

SEQ ID NO: 2555777 - RNA, 14 nt, Chlamydophila pneumoniae J138
ucgauuauuucuug

SEQ ID NO: 2555778 - RNA, 18 nt, Chlamydophila pneumoniae J138
ucgauucucguguagaau

SEQ ID NO: 2555779 - RNA, 18 nt, Chlamydophila pneumoniae J138
ucgauugagauugaggau

SEQ ID NO: 2555780 - RNA, 23 nt, Chlamydophila pneumoniae J138
ucgcaaauauaguuuucauaauc

SEQ ID NO: 2555781 - RNA, 16 nt, Chlamydophila pneumoniae J138
ucgcaauccaggaaua

SEQ ID NO: 2555782 - RNA, 20 nt, Chlamydophila pneumoniae J138
ucgcacuacagcuucauuau

SEQ ID NO: 2555783 - RNA, 17 nt, Chlamydophila pneumoniae J138
ucgcaguccaaagacuu

SEQ ID NO: 2555784 - RNA, 22 nt, Chlamydophila pneumoniae J138
ucgcauuacaaauggcaugaaa

SEQ ID NO: 2555785 - RNA, 13 nt, Chlamydophila pneumoniae J138
ucgccaaaccaug

SEQ ID NO: 2555786 - RNA, 19 nt, Chlamydophila pneumoniae J138
ucgccuuccuuaacaacau

SEQ ID NO: 2555787 - RNA, 20 nt, Chlamydophila pneumoniae J138
ucgccuuggguuugucucca

SEQ ID NO: 2555788 - RNA, 21 nt, Chlamydophila pneumoniae J138
ucgcuaacgcagcuuuagcuu

SEQ ID NO: 2555789 - RNA, 14 nt, Chlamydophila pneumoniae J138
ucgcuaagcaaagc

SEQ ID NO: 2555790 - RNA, 17 nt, Chlamydophila pneumoniae J138
ucgcuagaucacaagaa

SEQ ID NO: 2555791 - RNA, 23 nt, Chlamydophila pneumoniae J138
ucgcucagcuaauuuaaaugccu

SEQ ID NO: 2555792 - RNA, 17 nt, Chlamydophila pneumoniae J138
ucgcuccuaagcuuuua

SEQ ID NO: 2555793 - RNA, 19 nt, Chlamydophila pneumoniae J138
ucgcuccuaauggaaacau

SEQ ID NO: 2555794 - RNA, 14 nt, Chlamydophila pneumoniae J138
ucgcucuccucucg

SEQ ID NO: 2555795 - RNA, 14 nt, Chlamydophila pneumoniae J138
ucgcuuuugcuaga

SEQ ID NO: 2555796 - RNA, 21 nt, Chlamydophila pneumoniae J138
ucggaagauagcccaaguugu

SEQ ID NO: 2555797 - RNA, 18 nt, Chlamydophila pneumoniae J138
ucggaccuacguuuucuc

SEQ ID NO: 2555798 - RNA, 19 nt, Chlamydophila pneumoniae J138
ucggaccuacguuuucucu

SEQ ID NO: 2555799 - RNA, 19 nt, Chlamydophila pneumoniae J138
ucggacgauauuuagagag

SEQ ID NO: 2555800 - RNA, 13 nt, Chlamydophila pneumoniae J138
ucggagaccaaaa

SEQ ID NO: 2555801 - RNA, 17 nt, Chlamydophila pneumoniae J138
ucggagacucagagaaa

SEQ ID NO: 2555802 - RNA, 16 nt, Chlamydophila pneumoniae J138
ucggagguucgaaucc

SEQ ID NO: 2555803 - RNA, 21 nt, Chlamydophila pneumoniae J138
ucggaucuuuucuuucuaaga

SEQ ID NO: 2555804 - RNA, 14 nt, Chlamydophila pneumoniae J138
ucggaugagaucca

SEQ ID NO: 2555805 - RNA, 21 nt, Chlamydophila pneumoniae J138
ucggcaauuguuaaaagaagg

SEQ ID NO: 2555806 - RNA, 15 nt, Chlamydophila pneumoniae J138
ucggcuaaagaaaag

SEQ ID NO: 2555807 - RNA, 22 nt, Chlamydophila pneumoniae J138
ucgggaauaauaggauaagaaa

SEQ ID NO: 2555808 - RNA, 16 nt, Chlamydophila pneumoniae J138
ucggggauugcaaaau

SEQ ID NO: 2555809 - RNA, 12 nt, Chlamydophila pneumoniae J138
ucggucuuuucu

SEQ ID NO: 2555810 - RNA, 18 nt, Chlamydophila pneumoniae J138
ucguaacgcuuuucuaau

SEQ ID NO: 2555811 - RNA, 21 nt, Chlamydophila pneumoniae J138
ucguaacuuccuuuuucugcu

SEQ ID NO: 2555812 - RNA, 15 nt, Chlamydophila pneumoniae J138
ucguaauaacuauaa

SEQ ID NO: 2555813 - RNA, 19 nt, Chlamydophila pneumoniae J138
ucguaauagcgacaugaga

SEQ ID NO: 2555814 - RNA, 22 nt, Chlamydophila pneumoniae J138
ucguaauccuucuuucugcucu

SEQ ID NO: 2555815 - RNA, 19 nt, Chlamydophila pneumoniae J138
ucguaaucuuuuuuaaagc

SEQ ID NO: 2555816 - RNA, 19 nt, Chlamydophila pneumoniae J138
ucguaauugcugaaaauga

SEQ ID NO: 2555817 - RNA, 18 nt, Chlamydophila pneumoniae J138
ucguacaguuuuuuucua

SEQ ID NO: 2555818 - RNA, 18 nt, Chlamydophila pneumoniae J138
ucguagacaacaagucuu

SEQ ID NO: 2555819 - RNA, 21 nt, Chlamydophila pneumoniae J138
ucguagacaacaagucuuccc

SEQ ID NO: 2555820 - RNA, 20 nt, Chlamydophila pneumoniae J138
ucguagcaggcaucacuaau

SEQ ID NO: 2555821 - RNA, 19 nt, Chlamydophila pneumoniae J138
ucguagccccauagagccu

SEQ ID NO: 2555822 - RNA, 17 nt, Chlamydophila pneumoniae J138
ucguagccuuacguaaa

SEQ ID NO: 2555823 - RNA, 14 nt, Chlamydophila pneumoniae J138
ucguagcuaaauug

SEQ ID NO: 2555824 - RNA, 18 nt, Chlamydophila pneumoniae J138
ucguauagguacgcuuuu

SEQ ID NO: 2555825 - RNA, 20 nt, Chlamydophila pneumoniae J138
ucgucaagcucugagaaaga

SEQ ID NO: 2555826 - RNA, 21 nt, Chlamydophila pneumoniae J138
ucguccugacacaacucuuaa

SEQ ID NO: 2555827 - RNA, 18 nt, Chlamydophila pneumoniae J138
ucgucuuagaauccucua

SEQ ID NO: 2555828 - RNA, 13 nt, Chlamydophila pneumoniae J138
ucgugaacaaaau

SEQ ID NO: 2555829 - RNA, 19 nt, Chlamydophila pneumoniae J138
ucgugcaggagaacaauau

SEQ ID NO: 2555830 - RNA, 19 nt, Chlamydophila pneumoniae J138
ucgugggaggaauccuacg

SEQ ID NO: 2555831 - RNA, 13 nt, Chlamydophila pneumoniae J138
ucguguuuuccug

SEQ ID NO: 2555832 - RNA, 22 nt, Chlamydophila pneumoniae J138
ucguuaaaaacuauccuauuuu

SEQ ID NO: 2555833 - RNA, 20 nt, Chlamydophila pneumoniae J138
ucguuagaaaccaugaugca

SEQ ID NO: 2555834 - RNA, 13 nt, Chlamydophila pneumoniae J138
ucguuauccucgu

SEQ ID NO: 2555835 - RNA, 21 nt, Chlamydophila pneumoniae J138
ucguuauccucgucuucaaua

SEQ ID NO: 2555836 - RNA, 20 nt, Chlamydophila pneumoniae J138
ucguugguucaaauccgacu

SEQ ID NO: 2555837 - RNA, 13 nt, Chlamydophila pneumoniae J138
ucguuuauaacau

SEQ ID NO: 2555838 - RNA, 16 nt, Chlamydophila pneumoniae J138
ucguuuccgaucauuu

SEQ ID NO: 2555839 - RNA, 21 nt, Chlamydophila pneumoniae J138
ucguuuccgaucauuuuugcu

SEQ ID NO: 2555840 - RNA, 23 nt, Chlamydophila pneumoniae J138
ucguuucuuugaguuaagcaaua

SEQ ID NO: 2555841 - RNA, 17 nt, Chlamydophila pneumoniae J138
ucguuuucuagcauagu

SEQ ID NO: 2555842 - RNA, 20 nt, Chlamydophila pneumoniae J138
ucguuuuugauaguagacau

SEQ ID NO: 2555843 - RNA, 17 nt, Chlamydophila pneumoniae J138
ucuaaaaaagauaaagc

SEQ ID NO: 2555844 - RNA, 18 nt, Chlamydophila pneumoniae J138
ucuaaaaaugcacuuuga

SEQ ID NO: 2555845 - RNA, 21 nt, Chlamydophila pneumoniae J138
ucuaaaacaccugcccauuuu

SEQ ID NO: 2555846 - RNA, 18 nt, Chlamydophila pneumoniae J138
ucuaaaacagaaauugcu

SEQ ID NO: 2555847 - RNA, 16 nt, Chlamydophila pneumoniae J138
ucuaaaacaucagcaa

SEQ ID NO: 2555848 - RNA, 19 nt, Chlamydophila pneumoniae J138
ucuaaaacaucagcaacau

SEQ ID NO: 2555849 - RNA, 18 nt, Chlamydophila pneumoniae J138
ucuaaaagcacuuaaaaa

SEQ ID NO: 2555850 - RNA, 19 nt, Chlamydophila pneumoniae J138
ucuaaaagcacuuaaaaaa

SEQ ID NO: 2555851 - RNA, 20 nt, Chlamydophila pneumoniae J138
ucuaaaauaaccccuccaaa

SEQ ID NO: 2555852 - RNA, 12 nt, Chlamydophila pneumoniae J138
ucuaaacauaaa

SEQ ID NO: 2555853 - RNA, 20 nt, Chlamydophila pneumoniae J138
ucuaaagaaauguaagaagg

SEQ ID NO: 2555854 - RNA, 16 nt, Chlamydophila pneumoniae J138
ucuaaagauuucguau

SEQ ID NO: 2555855 - RNA, 18 nt, Chlamydophila pneumoniae J138
ucuaaagcugcuuuuucu

SEQ ID NO: 2555856 - RNA, 16 nt, Chlamydophila pneumoniae J138
ucuaaagguuuuaaau

SEQ ID NO: 2555857 - RNA, 18 nt, Chlamydophila pneumoniae J138
ucuaaauggaugaucucc

SEQ ID NO: 2555858 - RNA, 23 nt, Chlamydophila pneumoniae J138
ucuaaccaaccuuguugaaaggc

SEQ ID NO: 2555859 - RNA, 21 nt, Chlamydophila pneumoniae J138
ucuaacucuaaucugauucaa

SEQ ID NO: 2555860 - RNA, 23 nt, Chlamydophila pneumoniae J138
ucuaacucuuguagcugagagau

SEQ ID NO: 2555861 - RNA, 22 nt, Chlamydophila pneumoniae J138
ucuaagaaacuuccaaaacgau

SEQ ID NO: 2555862 - RNA, 21 nt, Chlamydophila pneumoniae J138
ucuaagaaaggcacuccaaaa

SEQ ID NO: 2555863 - RNA, 15 nt, Chlamydophila pneumoniae J138
ucuaagaauauggac

SEQ ID NO: 2555864 - RNA, 18 nt, Chlamydophila pneumoniae J138
ucuaagaaucguucuuag

SEQ ID NO: 2555865 - RNA, 14 nt, Chlamydophila pneumoniae J138
ucuaagauauagag

SEQ ID NO: 2555866 - RNA, 14 nt, Chlamydophila pneumoniae J138
ucuaagaucuuuug

SEQ ID NO: 2555867 - RNA, 21 nt, Chlamydophila pneumoniae J138
ucuaagcagccucuucucuac

SEQ ID NO: 2555868 - RNA, 17 nt, Chlamydophila pneumoniae J138
ucuaagcgcucuucaau

SEQ ID NO: 2555869 - RNA, 12 nt, Chlamydophila pneumoniae J138
ucuaaggaaauu

SEQ ID NO: 2555870 - RNA, 18 nt, Chlamydophila pneumoniae J138
ucuaaggacaaaucuccc

SEQ ID NO: 2555871 - RNA, 20 nt, Chlamydophila pneumoniae J138
ucuaaggacaaaucucccaa

SEQ ID NO: 2555872 - RNA, 19 nt, Chlamydophila pneumoniae J138
ucuaaggcauuggaaaucu

SEQ ID NO: 2555873 - RNA, 16 nt, Chlamydophila pneumoniae J138
ucuaaguccaacauca

SEQ ID NO: 2555874 - RNA, 18 nt, Chlamydophila pneumoniae J138
ucuacaaaaacuagaaua

SEQ ID NO: 2555875 - RNA, 20 nt, Chlamydophila pneumoniae J138
ucuacaaacagauuuuucaa

SEQ ID NO: 2555876 - RNA, 20 nt, Chlamydophila pneumoniae J138
ucuacacacaugacaaauaa

SEQ ID NO: 2555877 - RNA, 18 nt, Chlamydophila pneumoniae J138
ucuacaccauagaacugc

SEQ ID NO: 2555878 - RNA, 12 nt, Chlamydophila pneumoniae J138
ucuacagaauag

SEQ ID NO: 2555879 - RNA, 22 nt, Chlamydophila pneumoniae J138
ucuacagauaggguaagauugc

SEQ ID NO: 2555880 - RNA, 20 nt, Chlamydophila pneumoniae J138
ucuacaucccaagggccaga

SEQ ID NO: 2555881 - RNA, 15 nt, Chlamydophila pneumoniae J138
ucuacaugcucaaga

SEQ ID NO: 2555882 - RNA, 15 nt, Chlamydophila pneumoniae J138
ucuaccaacugagcu

SEQ ID NO: 2555883 - RNA, 16 nt, Chlamydophila pneumoniae J138
ucuacccccagcuucu

SEQ ID NO: 2555884 - RNA, 21 nt, Chlamydophila pneumoniae J138
ucuacccuucagaauucucaa

SEQ ID NO: 2555885 - RNA, 16 nt, Chlamydophila pneumoniae J138
ucuacgauguuuucuu

SEQ ID NO: 2555886 - RNA, 23 nt, Chlamydophila pneumoniae J138
ucuacgauguuuucuuauccuug

SEQ ID NO: 2555887 - RNA, 15 nt, Chlamydophila pneumoniae J138
ucuacuaaaaucuca

SEQ ID NO: 2555888 - RNA, 22 nt, Chlamydophila pneumoniae J138
ucuacuaggcgcauaugcucca

SEQ ID NO: 2555889 - RNA, 24 nt, Chlamydophila pneumoniae J138
ucuacuaggcgcauaugcuccaga

SEQ ID NO: 2555890 - RNA, 21 nt, Chlamydophila pneumoniae J138
ucuacugaaaccuucucucuu

SEQ ID NO: 2555891 - RNA, 22 nt, Chlamydophila pneumoniae J138
ucuacugaaaccuucucucuua

SEQ ID NO: 2555892 - RNA, 21 nt, Chlamydophila pneumoniae J138
ucuagaaaaauucuuuaggga

SEQ ID NO: 2555893 - RNA, 18 nt, Chlamydophila pneumoniae J138
ucuagaaaagauucuaaa

SEQ ID NO: 2555894 - RNA, 22 nt, Chlamydophila pneumoniae J138
ucuagaaaagauucuaaaucaa

SEQ ID NO: 2555895 - RNA, 14 nt, Chlamydophila pneumoniae J138
ucuagaaaaucucu

SEQ ID NO: 2555896 - RNA, 23 nt, Chlamydophila pneumoniae J138
ucuagaaacaacugaaaaaccau

SEQ ID NO: 2555897 - RNA, 13 nt, Chlamydophila pneumoniae J138
ucuagaacacuca

SEQ ID NO: 2555898 - RNA, 17 nt, Chlamydophila pneumoniae J138
ucuagaacacucagaga

SEQ ID NO: 2555899 - RNA, 15 nt, Chlamydophila pneumoniae J138
ucuagagauuuuucu

SEQ ID NO: 2555900 - RNA, 17 nt, Chlamydophila pneumoniae J138
ucuagaguugcuuuaug

SEQ ID NO: 2555901 - RNA, 20 nt, Chlamydophila pneumoniae J138
ucuagauauucugauucucc

SEQ ID NO: 2555902 - RNA, 13 nt, Chlamydophila pneumoniae J138
ucuagaucuucaa

SEQ ID NO: 2555903 - RNA, 14 nt, Chlamydophila pneumoniae J138
ucuagaucuucaau

SEQ ID NO: 2555904 - RNA, 13 nt, Chlamydophila pneumoniae J138
ucuagauuuugag

SEQ ID NO: 2555905 - RNA, 13 nt, Chlamydophila pneumoniae J138
ucuagcaaaucua

SEQ ID NO: 2555906 - RNA, 22 nt, Chlamydophila pneumoniae J138
ucuagccaauauagaagcugcu

SEQ ID NO: 2555907 - RNA, 16 nt, Chlamydophila pneumoniae J138
ucuagcucaaaucuca

SEQ ID NO: 2555908 - RNA, 19 nt, Chlamydophila pneumoniae J138
ucuagcuguuaauucccgu

SEQ ID NO: 2555909 - RNA, 15 nt, Chlamydophila pneumoniae J138
ucuagcuuccucacg

SEQ ID NO: 2555910 - RNA, 15 nt, Chlamydophila pneumoniae J138
ucuagcuuugucucu

SEQ ID NO: 2555911 - RNA, 18 nt, Chlamydophila pneumoniae J138
ucuaggacagcacauaga

SEQ ID NO: 2555912 - RNA, 12 nt, Chlamydophila pneumoniae J138
ucuaggagcuuc

SEQ ID NO: 2555913 - RNA, 15 nt, Chlamydophila pneumoniae J138
ucuagggucaagaac

SEQ ID NO: 2555914 - RNA, 17 nt, Chlamydophila pneumoniae J138
ucuagguuucaggaaau

SEQ ID NO: 2555915 - RNA, 18 nt, Chlamydophila pneumoniae J138
ucuagguuuucucuuccu

SEQ ID NO: 2555916 - RNA, 13 nt, Chlamydophila pneumoniae J138
ucuaguuuuucuu

SEQ ID NO: 2555917 - RNA, 18 nt, Chlamydophila pneumoniae J138
ucuaguuuuucuuuagag

SEQ ID NO: 2555918 - RNA, 15 nt, Chlamydophila pneumoniae J138
ucuauaaauguaggg

SEQ ID NO: 2555919 - RNA, 15 nt, Chlamydophila pneumoniae J138
ucuauaacuacaaaa

SEQ ID NO: 2555920 - RNA, 21 nt, Chlamydophila pneumoniae J138
ucuauacgcuuaacaugaaaa

SEQ ID NO: 2555921 - RNA, 12 nt, Chlamydophila pneumoniae J138
ucuauagaguag

SEQ ID NO: 2555922 - RNA, 16 nt, Chlamydophila pneumoniae J138
ucuauagaguagcuca

SEQ ID NO: 2555923 - RNA, 16 nt, Chlamydophila pneumoniae J138
ucuauagaucuugaaa

SEQ ID NO: 2555924 - RNA, 13 nt, Chlamydophila pneumoniae J138
ucuauauauccug

SEQ ID NO: 2555925 - RNA, 14 nt, Chlamydophila pneumoniae J138
ucuauauauccuga

SEQ ID NO: 2555926 - RNA, 15 nt, Chlamydophila pneumoniae J138
ucuauauauccugag

SEQ ID NO: 2555927 - RNA, 19 nt, Chlamydophila pneumoniae J138
ucuauauuuuuucccacaa

SEQ ID NO: 2555928 - RNA, 13 nt, Chlamydophila pneumoniae J138
ucuauccaucauc

SEQ ID NO: 2555929 - RNA, 19 nt, Chlamydophila pneumoniae J138
ucuaucgauagccauuaga

SEQ ID NO: 2555930 - RNA, 18 nt, Chlamydophila pneumoniae J138
ucuaucuacacacaugac

SEQ ID NO: 2555931 - RNA, 17 nt, Chlamydophila pneumoniae J138
ucuaucugcacuuucuu

SEQ ID NO: 2555932 - RNA, 14 nt, Chlamydophila pneumoniae J138
ucuaucuugaaagu

SEQ ID NO: 2555933 - RNA, 16 nt, Chlamydophila pneumoniae J138
ucuaucuugaaaguac

SEQ ID NO: 2555934 - RNA, 16 nt, Chlamydophila pneumoniae J138
ucuaucuuuauuuaaa

SEQ ID NO: 2555935 - RNA, 22 nt, Chlamydophila pneumoniae J138
ucuaugagaguaaguuuuuaau

SEQ ID NO: 2555936 - RNA, 23 nt, Chlamydophila pneumoniae J138
ucuaugagaguaaguuuuuaauc

SEQ ID NO: 2555937 - RNA, 22 nt, Chlamydophila pneumoniae J138
ucuaugauccaauagccaaaga

SEQ ID NO: 2555938 - RNA, 19 nt, Chlamydophila pneumoniae J138
ucuauggacuaaacaagaa

SEQ ID NO: 2555939 - RNA, 21 nt, Chlamydophila pneumoniae J138
ucuaugguaagggauccauga

SEQ ID NO: 2555940 - RNA, 14 nt, Chlamydophila pneumoniae J138
ucuauguguucucg

SEQ ID NO: 2555941 - RNA, 16 nt, Chlamydophila pneumoniae J138
ucuauguuuugacaua

SEQ ID NO: 2555942 - RNA, 19 nt, Chlamydophila pneumoniae J138
ucuauuaaggauuccuuga

SEQ ID NO: 2555943 - RNA, 14 nt, Chlamydophila pneumoniae J138
ucuauuagauuucc

SEQ ID NO: 2555944 - RNA, 18 nt, Chlamydophila pneumoniae J138
ucuauucgcugucuagaa

SEQ ID NO: 2555945 - RNA, 13 nt, Chlamydophila pneumoniae J138
ucuauuucauaua

SEQ ID NO: 2555946 - RNA, 20 nt, Chlamydophila pneumoniae J138
ucuauuucauauaaaguuuc

SEQ ID NO: 2555947 - RNA, 15 nt, Chlamydophila pneumoniae J138
ucuauuugaaaagaa

SEQ ID NO: 2555948 - RNA, 13 nt, Chlamydophila pneumoniae J138
ucuauuuucagga

SEQ ID NO: 2555949 - RNA, 20 nt, Chlamydophila pneumoniae J138
ucucaaagacaugagggcau

SEQ ID NO: 2555950 - RNA, 16 nt, Chlamydophila pneumoniae J138
ucucaaagaucaucua

SEQ ID NO: 2555951 - RNA, 13 nt, Chlamydophila pneumoniae J138
ucucaaauuucaa

SEQ ID NO: 2555952 - RNA, 16 nt, Chlamydophila pneumoniae J138
ucucaacgcaauagga

SEQ ID NO: 2555953 - RNA, 22 nt, Chlamydophila pneumoniae J138
ucucaagaguaggcaauacaga

SEQ ID NO: 2555954 - RNA, 17 nt, Chlamydophila pneumoniae J138
ucucaagaucuucauca

SEQ ID NO: 2555955 - RNA, 17 nt, Chlamydophila pneumoniae J138
ucucaaguaagaagucu

SEQ ID NO: 2555956 - RNA, 13 nt, Chlamydophila pneumoniae J138
ucucaauaauaga

SEQ ID NO: 2555957 - RNA, 13 nt, Chlamydophila pneumoniae J138
ucucaccagaagc

SEQ ID NO: 2555958 - RNA, 18 nt, Chlamydophila pneumoniae J138
ucucaccagaagcaacua

SEQ ID NO: 2555959 - RNA, 14 nt, Chlamydophila pneumoniae J138
ucucacucuaugag

SEQ ID NO: 2555960 - RNA, 13 nt, Chlamydophila pneumoniae J138
ucucagaaagccu

SEQ ID NO: 2555961 - RNA, 19 nt, Chlamydophila pneumoniae J138
ucucagauaaaaagaagua

SEQ ID NO: 2555962 - RNA, 17 nt, Chlamydophila pneumoniae J138
ucucagcuucaucagaa

SEQ ID NO: 2555963 - RNA, 22 nt, Chlamydophila pneumoniae J138
ucucaggaaagguaguuuucuu

SEQ ID NO: 2555964 - RNA, 14 nt, Chlamydophila pneumoniae J138
ucucagugaacucu

SEQ ID NO: 2555965 - RNA, 15 nt, Chlamydophila pneumoniae J138
ucucaguuaaagagc

SEQ ID NO: 2555966 - RNA, 14 nt, Chlamydophila pneumoniae J138
ucucauaaguauag

SEQ ID NO: 2555967 - RNA, 18 nt, Chlamydophila pneumoniae J138
ucucauccagacaggaca

SEQ ID NO: 2555968 - RNA, 21 nt, Chlamydophila pneumoniae J138
ucucaucggcauaacuuuauc

SEQ ID NO: 2555969 - RNA, 14 nt, Chlamydophila pneumoniae J138
ucucaugaaauuuu

SEQ ID NO: 2555970 - RNA, 20 nt, Chlamydophila pneumoniae J138
ucucaugaaauuuucuaaga

SEQ ID NO: 2555971 - RNA, 20 nt, Chlamydophila pneumoniae J138
ucucauggauuacugaagau

SEQ ID NO: 2555972 - RNA, 14 nt, Chlamydophila pneumoniae J138
ucucauguaacuga

SEQ ID NO: 2555973 - RNA, 17 nt, Chlamydophila pneumoniae J138
ucucauuccagcaucuu

SEQ ID NO: 2555974 - RNA, 22 nt, Chlamydophila pneumoniae J138
ucucauugcggcaccaaagaug

SEQ ID NO: 2555975 - RNA, 21 nt, Chlamydophila pneumoniae J138
ucucauuucguagacgcucua

SEQ ID NO: 2555976 - RNA, 22 nt, Chlamydophila pneumoniae J138
ucucauuucguagacgcucuaa

SEQ ID NO: 2555977 - RNA, 15 nt, Chlamydophila pneumoniae J138
ucuccaaaagcucua

SEQ ID NO: 2555978 - RNA, 14 nt, Chlamydophila pneumoniae J138
ucuccaaagauaca

SEQ ID NO: 2555979 - RNA, 19 nt, Chlamydophila pneumoniae J138
ucuccagaaauuuuuacaa

SEQ ID NO: 2555980 - RNA, 17 nt, Chlamydophila pneumoniae J138
ucuccagcuucuuucua

SEQ ID NO: 2555981 - RNA, 18 nt, Chlamydophila pneumoniae J138
ucuccaguaucuucucuu

SEQ ID NO: 2555982 - RNA, 17 nt, Chlamydophila pneumoniae J138
ucuccauccucagucuc

SEQ ID NO: 2555983 - RNA, 21 nt, Chlamydophila pneumoniae J138
ucuccauccucagucucucua

SEQ ID NO: 2555984 - RNA, 12 nt, Chlamydophila pneumoniae J138
ucucccucuaaa

SEQ ID NO: 2555985 - RNA, 19 nt, Chlamydophila pneumoniae J138
ucucccuguauuaaagaau

SEQ ID NO: 2555986 - RNA, 19 nt, Chlamydophila pneumoniae J138
ucuccggaggucccucuaa

SEQ ID NO: 2555987 - RNA, 18 nt, Chlamydophila pneumoniae J138
ucuccgggaacaacugug

SEQ ID NO: 2555988 - RNA, 19 nt, Chlamydophila pneumoniae J138
ucuccgucauauuuaaaag

SEQ ID NO: 2555989 - RNA, 22 nt, Chlamydophila pneumoniae J138
ucuccgucccccggcucuguug

SEQ ID NO: 2555990 - RNA, 14 nt, Chlamydophila pneumoniae J138
ucuccucaucagaa

SEQ ID NO: 2555991 - RNA, 17 nt, Chlamydophila pneumoniae J138
ucuccugaaccgcaaaa

SEQ ID NO: 2555992 - RNA, 22 nt, Chlamydophila pneumoniae J138
ucuccugaaccgcaaaaagcuu

SEQ ID NO: 2555993 - RNA, 17 nt, Chlamydophila pneumoniae J138
ucuccugacucuuuuaa

SEQ ID NO: 2555994 - RNA, 12 nt, Chlamydophila pneumoniae J138
ucuccugcaaaa

SEQ ID NO: 2555995 - RNA, 13 nt, Chlamydophila pneumoniae J138
ucuccuggaacag

SEQ ID NO: 2555996 - RNA, 19 nt, Chlamydophila pneumoniae J138
ucuccuucuggaugcccug

SEQ ID NO: 2555997 - RNA, 23 nt, Chlamydophila pneumoniae J138
ucuccuugacaaauaaguccugu

SEQ ID NO: 2555998 - RNA, 15 nt, Chlamydophila pneumoniae J138
ucuccuugauuuggg

SEQ ID NO: 2555999 - RNA, 17 nt, Chlamydophila pneumoniae J138
ucuccuuuaaauaaaau

SEQ ID NO: 2556000 - RNA, 18 nt, Chlamydophila pneumoniae J138
ucuccuuuaaauaaaauc

SEQ ID NO: 2556001 - RNA, 22 nt, Chlamydophila pneumoniae J138
ucucgaaaaauuugcgaagucc

SEQ ID NO: 2556002 - RNA, 17 nt, Chlamydophila pneumoniae J138
ucucgaaauccuaaaaa

SEQ ID NO: 2556003 - RNA, 19 nt, Chlamydophila pneumoniae J138
ucucgaacucugaaguaca

SEQ ID NO: 2556004 - RNA, 13 nt, Chlamydophila pneumoniae J138
ucucgaagaaaau

SEQ ID NO: 2556005 - RNA, 14 nt, Chlamydophila pneumoniae J138
ucucgaagaaaaua

SEQ ID NO: 2556006 - RNA, 20 nt, Chlamydophila pneumoniae J138
ucucgaauagaaaagguauu

SEQ ID NO: 2556007 - RNA, 21 nt, Chlamydophila pneumoniae J138
ucucgacacuauguguuuccu

SEQ ID NO: 2556008 - RNA, 17 nt, Chlamydophila pneumoniae J138
ucucgcuauuccauaaa

SEQ ID NO: 2556009 - RNA, 15 nt, Chlamydophila pneumoniae J138
ucucgugcauaauga

SEQ ID NO: 2556010 - RNA, 15 nt, Chlamydophila pneumoniae J138
ucucuaagaaauuuu

SEQ ID NO: 2556011 - RNA, 16 nt, Chlamydophila pneumoniae J138
ucucuaagacuguguu

SEQ ID NO: 2556012 - RNA, 20 nt, Chlamydophila pneumoniae J138
ucucuaagacuguguuuuau

SEQ ID NO: 2556013 - RNA, 18 nt, Chlamydophila pneumoniae J138
ucucuaagcagccucuuc

SEQ ID NO: 2556014 - RNA, 21 nt, Chlamydophila pneumoniae J138
ucucuaagcagccucuucucu

SEQ ID NO: 2556015 - RNA, 22 nt, Chlamydophila pneumoniae J138
ucucuagccaauauagaagcug

SEQ ID NO: 2556016 - RNA, 21 nt, Chlamydophila pneumoniae J138
ucucuagcuguuaauucccgu

SEQ ID NO: 2556017 - RNA, 17 nt, Chlamydophila pneumoniae J138
ucucuaggaagauuuau

SEQ ID NO: 2556018 - RNA, 17 nt, Chlamydophila pneumoniae J138
ucucuaguucuagaaag

SEQ ID NO: 2556019 - RNA, 22 nt, Chlamydophila pneumoniae J138
ucucuaguucuagaaaggcauu

SEQ ID NO: 2556020 - RNA, 22 nt, Chlamydophila pneumoniae J138
ucucuaugaacgauuucuuuua

SEQ ID NO: 2556021 - RNA, 17 nt, Chlamydophila pneumoniae J138
ucucuaugcacaaaaua

SEQ ID NO: 2556022 - RNA, 21 nt, Chlamydophila pneumoniae J138
ucucuaugcacaaaauaaaac

SEQ ID NO: 2556023 - RNA, 16 nt, Chlamydophila pneumoniae J138
ucucuaugcgcucuaa

SEQ ID NO: 2556024 - RNA, 23 nt, Chlamydophila pneumoniae J138
ucucuccacagggucuaguucaa

SEQ ID NO: 2556025 - RNA, 18 nt, Chlamydophila pneumoniae J138
ucucucuccaaagagucu

SEQ ID NO: 2556026 - RNA, 14 nt, Chlamydophila pneumoniae J138
ucucucucugcagc

SEQ ID NO: 2556027 - RNA, 13 nt, Chlamydophila pneumoniae J138
ucucucuuuaaaa

SEQ ID NO: 2556028 - RNA, 13 nt, Chlamydophila pneumoniae J138
ucucucuuuccuu

SEQ ID NO: 2556029 - RNA, 16 nt, Chlamydophila pneumoniae J138
ucucugccuaccaaag

SEQ ID NO: 2556030 - RNA, 15 nt, Chlamydophila pneumoniae J138
ucucuggaauacauu

SEQ ID NO: 2556031 - RNA, 19 nt, Chlamydophila pneumoniae J138
ucucuggcauaauccugaa

SEQ ID NO: 2556032 - RNA, 17 nt, Chlamydophila pneumoniae J138
ucucuguagcacuucuc

SEQ ID NO: 2556033 - RNA, 15 nt, Chlamydophila pneumoniae J138
ucucuguuuuuugaa

SEQ ID NO: 2556034 - RNA, 17 nt, Chlamydophila pneumoniae J138
ucucuucacucuuuuau

SEQ ID NO: 2556035 - RNA, 12 nt, Chlamydophila pneumoniae J138
ucucuuccuucu

SEQ ID NO: 2556036 - RNA, 15 nt, Chlamydophila pneumoniae J138
ucucuuccuucuccu

SEQ ID NO: 2556037 - RNA, 22 nt, Chlamydophila pneumoniae J138
ucucuucgcuggcauguuuaau

SEQ ID NO: 2556038 - RNA, 13 nt, Chlamydophila pneumoniae J138
ucucuucuucuca

SEQ ID NO: 2556039 - RNA, 20 nt, Chlamydophila pneumoniae J138
ucucuugaagcacuuugacu

SEQ ID NO: 2556040 - RNA, 14 nt, Chlamydophila pneumoniae J138
ucucuugauuccuu

SEQ ID NO: 2556041 - RNA, 21 nt, Chlamydophila pneumoniae J138
ucucuugccaaugcauuuguu

SEQ ID NO: 2556042 - RNA, 19 nt, Chlamydophila pneumoniae J138
ucucuuuaaaaauauaucu

SEQ ID NO: 2556043 - RNA, 14 nt, Chlamydophila pneumoniae J138
ucucuuuaaaaauu

SEQ ID NO: 2556044 - RNA, 17 nt, Chlamydophila pneumoniae J138
ucucuuuaacuucuaaa

SEQ ID NO: 2556045 - RNA, 19 nt, Chlamydophila pneumoniae J138
ucucuuuaacuucuaaaag

SEQ ID NO: 2556046 - RNA, 19 nt, Chlamydophila pneumoniae J138
ucucuuuagcaaucucuuu

SEQ ID NO: 2556047 - RNA, 13 nt, Chlamydophila pneumoniae J138
ucucuuucacaaa

SEQ ID NO: 2556048 - RNA, 15 nt, Chlamydophila pneumoniae J138
ucucuuugacaucua

SEQ ID NO: 2556049 - RNA, 15 nt, Chlamydophila pneumoniae J138
ucucuuuuggaagac

SEQ ID NO: 2556050 - RNA, 24 nt, Chlamydophila pneumoniae J138
ucucuuuuggaagaccuuuggauu

SEQ ID NO: 2556051 - RNA, 20 nt, Chlamydophila pneumoniae J138
ucugaaacaaugcaucccug

SEQ ID NO: 2556052 - RNA, 13 nt, Chlamydophila pneumoniae J138
ucugaaacauaag

SEQ ID NO: 2556053 - RNA, 17 nt, Chlamydophila pneumoniae J138
ucugaaaucaaaaaaaa

SEQ ID NO: 2556054 - RNA, 15 nt, Chlamydophila pneumoniae J138
ucugaagagagaaua

SEQ ID NO: 2556055 - RNA, 22 nt, Chlamydophila pneumoniae J138
ucugaagauauauuuuuaaaga

SEQ ID NO: 2556056 - RNA, 23 nt, Chlamydophila pneumoniae J138
ucugaaucucauaaguauagaga

SEQ ID NO: 2556057 - RNA, 22 nt, Chlamydophila pneumoniae J138
ucugacauuccuuaauuacucg

SEQ ID NO: 2556058 - RNA, 19 nt, Chlamydophila pneumoniae J138
ucugacccuguagcgaaga

SEQ ID NO: 2556059 - RNA, 19 nt, Chlamydophila pneumoniae J138
ucugacgucuccaacaguc

SEQ ID NO: 2556060 - RNA, 13 nt, Chlamydophila pneumoniae J138
ucugagaaguuaa

SEQ ID NO: 2556061 - RNA, 14 nt, Chlamydophila pneumoniae J138
ucugagcuugccua

SEQ ID NO: 2556062 - RNA, 18 nt, Chlamydophila pneumoniae J138
ucugagcuugccuaccca

SEQ ID NO: 2556063 - RNA, 16 nt, Chlamydophila pneumoniae J138
ucugaguuagcuuuug

SEQ ID NO: 2556064 - RNA, 15 nt, Chlamydophila pneumoniae J138
ucugauaaagcuaca

SEQ ID NO: 2556065 - RNA, 17 nt, Chlamydophila pneumoniae J138
ucugauagaacaggauu

SEQ ID NO: 2556066 - RNA, 16 nt, Chlamydophila pneumoniae J138
ucugauccgaaaagaa

SEQ ID NO: 2556067 - RNA, 15 nt, Chlamydophila pneumoniae J138
ucugaucguacagga

SEQ ID NO: 2556068 - RNA, 21 nt, Chlamydophila pneumoniae J138
ucugaucguacaggacuguuu

SEQ ID NO: 2556069 - RNA, 16 nt, Chlamydophila pneumoniae J138
ucugauuauuucuaaa

SEQ ID NO: 2556070 - RNA, 20 nt, Chlamydophila pneumoniae J138
ucugauuauuucuaaaaaau

SEQ ID NO: 2556071 - RNA, 18 nt, Chlamydophila pneumoniae J138
ucugcaacaaguugcauu

SEQ ID NO: 2556072 - RNA, 19 nt, Chlamydophila pneumoniae J138
ucugcaaucugaaugccug

SEQ ID NO: 2556073 - RNA, 15 nt, Chlamydophila pneumoniae J138
ucugcacggauauuc

SEQ ID NO: 2556074 - RNA, 12 nt, Chlamydophila pneumoniae J138
ucugcagcagau

SEQ ID NO: 2556075 - RNA, 17 nt, Chlamydophila pneumoniae J138
ucugcaggacugucuag

SEQ ID NO: 2556076 - RNA, 15 nt, Chlamydophila pneumoniae J138
ucugcagguaaggga

SEQ ID NO: 2556077 - RNA, 20 nt, Chlamydophila pneumoniae J138
ucugcagguaagggaugcuc

SEQ ID NO: 2556078 - RNA, 23 nt, Chlamydophila pneumoniae J138
ucugcagguaagggaugcucuag

SEQ ID NO: 2556079 - RNA, 21 nt, Chlamydophila pneumoniae J138
ucugcauauaaagacucucuu

SEQ ID NO: 2556080 - RNA, 16 nt, Chlamydophila pneumoniae J138
ucugcauauugcucuu

SEQ ID NO: 2556081 - RNA, 13 nt, Chlamydophila pneumoniae J138
ucugcccaaagcu

SEQ ID NO: 2556082 - RNA, 16 nt, Chlamydophila pneumoniae J138
ucugcccuuucugcaa

SEQ ID NO: 2556083 - RNA, 20 nt, Chlamydophila pneumoniae J138
ucugcgauaggaucuucuau

SEQ ID NO: 2556084 - RNA, 22 nt, Chlamydophila pneumoniae J138
ucugcgcagcguauaauuggcg

SEQ ID NO: 2556085 - RNA, 22 nt, Chlamydophila pneumoniae J138
ucugcgucuuuaauuaaaaguu

SEQ ID NO: 2556086 - RNA, 22 nt, Chlamydophila pneumoniae J138
ucugcuccugaauaugcuuuuc

SEQ ID NO: 2556087 - RNA, 15 nt, Chlamydophila pneumoniae J138
ucugcucuauauauc

SEQ ID NO: 2556088 - RNA, 15 nt, Chlamydophila pneumoniae J138
ucugcugaagggaca

SEQ ID NO: 2556089 - RNA, 13 nt, Chlamydophila pneumoniae J138
ucugcugaggaga

SEQ ID NO: 2556090 - RNA, 13 nt, Chlamydophila pneumoniae J138
ucugcuugucuac

SEQ ID NO: 2556091 - RNA, 13 nt, Chlamydophila pneumoniae J138
ucuggaaugacua

SEQ ID NO: 2556092 - RNA, 17 nt, Chlamydophila pneumoniae J138
ucuggaccuuauaccca

SEQ ID NO: 2556093 - RNA, 21 nt, Chlamydophila pneumoniae J138
ucuggagaaaaaauaucuccg

SEQ ID NO: 2556094 - RNA, 18 nt, Chlamydophila pneumoniae J138
ucuggauacguuuuuccc

SEQ ID NO: 2556095 - RNA, 18 nt, Chlamydophila pneumoniae J138
ucuggcugagagaagcag

SEQ ID NO: 2556096 - RNA, 14 nt, Chlamydophila pneumoniae J138
ucuggguucuccac

SEQ ID NO: 2556097 - RNA, 16 nt, Chlamydophila pneumoniae J138
ucugguauagaaacac

SEQ ID NO: 2556098 - RNA, 17 nt, Chlamydophila pneumoniae J138
ucugguauagaaacacc

SEQ ID NO: 2556099 - RNA, 18 nt, Chlamydophila pneumoniae J138
ucugguuaagcaccauaa

SEQ ID NO: 2556100 - RNA, 19 nt, Chlamydophila pneumoniae J138
ucuguaaagugaaauugaa

SEQ ID NO: 2556101 - RNA, 20 nt, Chlamydophila pneumoniae J138
ucuguaagaaaaugaggaca

SEQ ID NO: 2556102 - RNA, 20 nt, Chlamydophila pneumoniae J138
ucuguaagaacguggggaaa

SEQ ID NO: 2556103 - RNA, 17 nt, Chlamydophila pneumoniae J138
ucuguaauuuuuuucaa

SEQ ID NO: 2556104 - RNA, 17 nt, Chlamydophila pneumoniae J138
ucuguagauuuucccua

SEQ ID NO: 2556105 - RNA, 15 nt, Chlamydophila pneumoniae J138
ucuguagguuuuucc

SEQ ID NO: 2556106 - RNA, 16 nt, Chlamydophila pneumoniae J138
ucuguagguuuuucca

SEQ ID NO: 2556107 - RNA, 16 nt, Chlamydophila pneumoniae J138
ucuguaguuuguucac

SEQ ID NO: 2556108 - RNA, 13 nt, Chlamydophila pneumoniae J138
ucuguauaguuuu

SEQ ID NO: 2556109 - RNA, 17 nt, Chlamydophila pneumoniae J138
ucuguaucgauaguuuu

SEQ ID NO: 2556110 - RNA, 14 nt, Chlamydophila pneumoniae J138
ucugucacuagaga

SEQ ID NO: 2556111 - RNA, 14 nt, Chlamydophila pneumoniae J138
ucugugagaaauag

SEQ ID NO: 2556112 - RNA, 15 nt, Chlamydophila pneumoniae J138
ucugugaguacccag

SEQ ID NO: 2556113 - RNA, 16 nt, Chlamydophila pneumoniae J138
ucugugcaucagucag

SEQ ID NO: 2556114 - RNA, 17 nt, Chlamydophila pneumoniae J138
ucuguuaaaaacaagau

SEQ ID NO: 2556115 - RNA, 13 nt, Chlamydophila pneumoniae J138
ucuguugggagcu

SEQ ID NO: 2556116 - RNA, 21 nt, Chlamydophila pneumoniae J138
ucuguuggucucuauuuagac

SEQ ID NO: 2556117 - RNA, 14 nt, Chlamydophila pneumoniae J138
ucuguuuuggaaag

SEQ ID NO: 2556118 - RNA, 22 nt, Chlamydophila pneumoniae J138
ucuguuuuggaaagaagagaau

SEQ ID NO: 2556119 - RNA, 12 nt, Chlamydophila pneumoniae J138
ucuuaaaacaug

SEQ ID NO: 2556120 - RNA, 15 nt, Chlamydophila pneumoniae J138
ucuuaaaauuccuga

SEQ ID NO: 2556121 - RNA, 15 nt, Chlamydophila pneumoniae J138
ucuuaacuggcaauc

SEQ ID NO: 2556122 - RNA, 18 nt, Chlamydophila pneumoniae J138
ucuuaacuggcaaucuaa

SEQ ID NO: 2556123 - RNA, 21 nt, Chlamydophila pneumoniae J138
ucuuaacuggcaaucuaaaau

SEQ ID NO: 2556124 - RNA, 14 nt, Chlamydophila pneumoniae J138
ucuuaagaauaaaa

SEQ ID NO: 2556125 - RNA, 16 nt, Chlamydophila pneumoniae J138
ucuuaagaauaaaaua

SEQ ID NO: 2556126 - RNA, 18 nt, Chlamydophila pneumoniae J138
ucuuaauauaaaagaaga

SEQ ID NO: 2556127 - RNA, 23 nt, Chlamydophila pneumoniae J138
ucuuaauauaaaagaagacgcuc

SEQ ID NO: 2556128 - RNA, 23 nt, Chlamydophila pneumoniae J138
ucuuaaugcgaugcggucagaaa

SEQ ID NO: 2556129 - RNA, 14 nt, Chlamydophila pneumoniae J138
ucuuaauuaaaaac

SEQ ID NO: 2556130 - RNA, 22 nt, Chlamydophila pneumoniae J138
ucuuacuaaagaaagagucuca

SEQ ID NO: 2556131 - RNA, 14 nt, Chlamydophila pneumoniae J138
ucuuagaauccaaa

SEQ ID NO: 2556132 - RNA, 14 nt, Chlamydophila pneumoniae J138
ucuuagaauccucu

SEQ ID NO: 2556133 - RNA, 16 nt, Chlamydophila pneumoniae J138
ucuuagccaaaauuuc

SEQ ID NO: 2556134 - RNA, 20 nt, Chlamydophila pneumoniae J138
ucuuagcguauccgcugccc

SEQ ID NO: 2556135 - RNA, 15 nt, Chlamydophila pneumoniae J138
ucuuagggaaucucu

SEQ ID NO: 2556136 - RNA, 17 nt, Chlamydophila pneumoniae J138
ucuuauagggaauuuuu

SEQ ID NO: 2556137 - RNA, 15 nt, Chlamydophila pneumoniae J138
ucuuaucaagagcuc

SEQ ID NO: 2556138 - RNA, 17 nt, Chlamydophila pneumoniae J138
ucuuaucaugaaaagga

SEQ ID NO: 2556139 - RNA, 16 nt, Chlamydophila pneumoniae J138
ucuuaucuaaagaaau

SEQ ID NO: 2556140 - RNA, 23 nt, Chlamydophila pneumoniae J138
ucuuaucugcuauguaggcagau

SEQ ID NO: 2556141 - RNA, 14 nt, Chlamydophila pneumoniae J138
ucuuaucuggagau

SEQ ID NO: 2556142 - RNA, 15 nt, Chlamydophila pneumoniae J138
ucuuaucuggagaug

SEQ ID NO: 2556143 - RNA, 15 nt, Chlamydophila pneumoniae J138
ucuuaucuucuaaaa

SEQ ID NO: 2556144 - RNA, 17 nt, Chlamydophila pneumoniae J138
ucuuaugaccaagaaca

SEQ ID NO: 2556145 - RNA, 17 nt, Chlamydophila pneumoniae J138
ucuuauggucagaagcu

SEQ ID NO: 2556146 - RNA, 18 nt, Chlamydophila pneumoniae J138
ucuuauguuaaaaauacc

SEQ ID NO: 2556147 - RNA, 16 nt, Chlamydophila pneumoniae J138
ucuuauucacuggaau

SEQ ID NO: 2556148 - RNA, 17 nt, Chlamydophila pneumoniae J138
ucuuauucacuggaaug

SEQ ID NO: 2556149 - RNA, 13 nt, Chlamydophila pneumoniae J138
ucuucaaagaacu

SEQ ID NO: 2556150 - RNA, 22 nt, Chlamydophila pneumoniae J138
ucuucaaagucaaauacuucuc

SEQ ID NO: 2556151 - RNA, 13 nt, Chlamydophila pneumoniae J138
ucuucaagagcuu

SEQ ID NO: 2556152 - RNA, 22 nt, Chlamydophila pneumoniae J138
ucuucaagagcuuuuacaaacc

SEQ ID NO: 2556153 - RNA, 21 nt, Chlamydophila pneumoniae J138
ucuucaauaggaauuagagaa

SEQ ID NO: 2556154 - RNA, 13 nt, Chlamydophila pneumoniae J138
ucuucagcccacu

SEQ ID NO: 2556155 - RNA, 22 nt, Chlamydophila pneumoniae J138
ucuucagcccacuguuuugcuu

SEQ ID NO: 2556156 - RNA, 23 nt, Chlamydophila pneumoniae J138
ucuucagcuuuaacaugccaaaa

SEQ ID NO: 2556157 - RNA, 15 nt, Chlamydophila pneumoniae J138
ucuucaggugaagga

SEQ ID NO: 2556158 - RNA, 18 nt, Chlamydophila pneumoniae J138
ucuucauaugcucucccg

SEQ ID NO: 2556159 - RNA, 15 nt, Chlamydophila pneumoniae J138
ucuucaucaauacga

SEQ ID NO: 2556160 - RNA, 15 nt, Chlamydophila pneumoniae J138
ucuucaucacaaaau

SEQ ID NO: 2556161 - RNA, 16 nt, Chlamydophila pneumoniae J138
ucuucauccgaagacu

SEQ ID NO: 2556162 - RNA, 18 nt, Chlamydophila pneumoniae J138
ucuucauuauuaaacgaa

SEQ ID NO: 2556163 - RNA, 16 nt, Chlamydophila pneumoniae J138
ucuucauuccaggauu

SEQ ID NO: 2556164 - RNA, 18 nt, Chlamydophila pneumoniae J138
ucuucauuccaggauucu

SEQ ID NO: 2556165 - RNA, 20 nt, Chlamydophila pneumoniae J138
uagcaaucucuuucacaaag

SEQ ID NO: 2556166 - RNA, 16 nt, Chlamydophila pneumoniae J138
uagcaaugauguuuuu

SEQ ID NO: 2556167 - RNA, 18 nt, Chlamydophila pneumoniae J138
uagcaauucgguagagcu

SEQ ID NO: 2556168 - RNA, 22 nt, Chlamydophila pneumoniae J138
uagcaauucgguagagcuagaa

SEQ ID NO: 2556169 - RNA, 15 nt, Chlamydophila pneumoniae J138
uagcaccuaauaaag

SEQ ID NO: 2556170 - RNA, 22 nt, Chlamydophila pneumoniae J138
uagcagaaguccuaucaaagca

SEQ ID NO: 2556171 - RNA, 13 nt, Chlamydophila pneumoniae J138
uagcagagccuca

SEQ ID NO: 2556172 - RNA, 18 nt, Chlamydophila pneumoniae J138
uagcagaguuuuucccuc

SEQ ID NO: 2556173 - RNA, 23 nt, Chlamydophila pneumoniae J138
uagcaguauagagaagauuucua

SEQ ID NO: 2556174 - RNA, 20 nt, Chlamydophila pneumoniae J138
uagcauaaucuuuaacaaag

SEQ ID NO: 2556175 - RNA, 13 nt, Chlamydophila pneumoniae J138
uagcauacaucgu

SEQ ID NO: 2556176 - RNA, 16 nt, Chlamydophila pneumoniae J138
uagcauaggcuaagac

SEQ ID NO: 2556177 - RNA, 17 nt, Chlamydophila pneumoniae J138
uagcauaggcuaagacu

SEQ ID NO: 2556178 - RNA, 14 nt, Chlamydophila pneumoniae J138
uagcaucaucuccu

SEQ ID NO: 2556179 - RNA, 21 nt, Chlamydophila pneumoniae J138
uagcaucaucuccugaagcca

SEQ ID NO: 2556180 - RNA, 14 nt, Chlamydophila pneumoniae J138
uagcaucucucucc

SEQ ID NO: 2556181 - RNA, 19 nt, Chlamydophila pneumoniae J138
uagcauguucgauuuucuc

SEQ ID NO: 2556182 - RNA, 13 nt, Chlamydophila pneumoniae J138
uagcauugcuugc

SEQ ID NO: 2556183 - RNA, 19 nt, Chlamydophila pneumoniae J138
uagcauugcuugcgcagcu

SEQ ID NO: 2556184 - RNA, 20 nt, Chlamydophila pneumoniae J138
uagcauugcuugcgcagcuu

SEQ ID NO: 2556185 - RNA, 14 nt, Chlamydophila pneumoniae J138
uagcauuucucuau

SEQ ID NO: 2556186 - RNA, 15 nt, Chlamydophila pneumoniae J138
uagcauuucuuucuc

SEQ ID NO: 2556187 - RNA, 17 nt, Chlamydophila pneumoniae J138
uagcauuucuuucucuu

SEQ ID NO: 2556188 - RNA, 13 nt, Chlamydophila pneumoniae J138
uagccaaagacuc

SEQ ID NO: 2556189 - RNA, 20 nt, Chlamydophila pneumoniae J138
uagccaauauagaagcugcu

SEQ ID NO: 2556190 - RNA, 23 nt, Chlamydophila pneumoniae J138
uagccaauauagaagcugcugcu

SEQ ID NO: 2556191 - RNA, 18 nt, Chlamydophila pneumoniae J138
uagccaucauagcaaacg

SEQ ID NO: 2556192 - RNA, 19 nt, Chlamydophila pneumoniae J138
uagccauuagaaucucugc

SEQ ID NO: 2556193 - RNA, 18 nt, Chlamydophila pneumoniae J138
uagcccgaaauucauuaa

SEQ ID NO: 2556194 - RNA, 22 nt, Chlamydophila pneumoniae J138
uagccguaggguagccauccac

SEQ ID NO: 2556195 - RNA, 22 nt, Chlamydophila pneumoniae J138
uagccuggaggcgguggcaugc

SEQ ID NO: 2556196 - RNA, 14 nt, Chlamydophila pneumoniae J138
uagccuuucuuuuu

SEQ ID NO: 2556197 - RNA, 14 nt, Chlamydophila pneumoniae J138
uagcgaaagucaaa

SEQ ID NO: 2556198 - RNA, 14 nt, Chlamydophila pneumoniae J138
uagcgacaugagaa

SEQ ID NO: 2556199 - RNA, 17 nt, Chlamydophila pneumoniae J138
uagcgacaugagaaauc

SEQ ID NO: 2556200 - RNA, 13 nt, Chlamydophila pneumoniae J138
uagcgagaacacc

SEQ ID NO: 2556201 - RNA, 23 nt, Chlamydophila pneumoniae J138
uagcgaucucucuuccugcugcu

SEQ ID NO: 2556202 - RNA, 20 nt, Chlamydophila pneumoniae J138
uagcgcuuccagcuucuccc

SEQ ID NO: 2556203 - RNA, 17 nt, Chlamydophila pneumoniae J138
uagcgcuuuuuuaaagu

SEQ ID NO: 2556204 - RNA, 20 nt, Chlamydophila pneumoniae J138
uagcgucucuucuuccucua

SEQ ID NO: 2556205 - RNA, 20 nt, Chlamydophila pneumoniae J138
uagcuaaaccuucagauccg

SEQ ID NO: 2556206 - RNA, 18 nt, Chlamydophila pneumoniae J138
uagcuaacucggaaaaaa

SEQ ID NO: 2556207 - RNA, 17 nt, Chlamydophila pneumoniae J138
uagcuaugaguugcuug

SEQ ID NO: 2556208 - RNA, 16 nt, Chlamydophila pneumoniae J138
uagcuauuuuugagga

SEQ ID NO: 2556209 - RNA, 18 nt, Chlamydophila pneumoniae J138
uagcucaaaucucauucc

SEQ ID NO: 2556210 - RNA, 19 nt, Chlamydophila pneumoniae J138
uagcucaggaaaacuuaau

SEQ ID NO: 2556211 - RNA, 19 nt, Chlamydophila pneumoniae J138
uagcucaggugguuagagc

SEQ ID NO: 2556212 - RNA, 20 nt, Chlamydophila pneumoniae J138
uagcucaucuagaaagauuu

SEQ ID NO: 2556213 - RNA, 23 nt, Chlamydophila pneumoniae J138
uagcucauuaucaagaaauucuu

SEQ ID NO: 2556214 - RNA, 15 nt, Chlamydophila pneumoniae J138
uagcucucuccugga

SEQ ID NO: 2556215 - RNA, 14 nt, Chlamydophila pneumoniae J138
uagcucuggagauu

SEQ ID NO: 2556216 - RNA, 17 nt, Chlamydophila pneumoniae J138
uagcucuggagauugcu

SEQ ID NO: 2556217 - RNA, 20 nt, Chlamydophila pneumoniae J138
uagcugagagauuuuuucau

SEQ ID NO: 2556218 - RNA, 16 nt, Chlamydophila pneumoniae J138
uagcuguuccaagagu

SEQ ID NO: 2556219 - RNA, 18 nt, Chlamydophila pneumoniae J138
uagcuuacagagaaauuu

SEQ ID NO: 2556220 - RNA, 15 nt, Chlamydophila pneumoniae J138
uagcuuuagaagccc

SEQ ID NO: 2556221 - RNA, 20 nt, Chlamydophila pneumoniae J138
uagcuuuaugcacgcuuucg

SEQ ID NO: 2556222 - RNA, 16 nt, Chlamydophila pneumoniae J138
uagcuuuuuuuaugau

SEQ ID NO: 2556223 - RNA, 22 nt, Chlamydophila pneumoniae J138
uaggaaaagcauagucgucuuu

SEQ ID NO: 2556224 - RNA, 15 nt, Chlamydophila pneumoniae J138
uaggaacaaagccaa

SEQ ID NO: 2556225 - RNA, 16 nt, Chlamydophila pneumoniae J138
uaggaacaaagcucuc

SEQ ID NO: 2556226 - RNA, 23 nt, Chlamydophila pneumoniae J138
uaggaacaaagcucuccuucaga

SEQ ID NO: 2556227 - RNA, 23 nt, Chlamydophila pneumoniae J138
uaggaagaugaauaccagaagca

SEQ ID NO: 2556228 - RNA, 18 nt, Chlamydophila pneumoniae J138
uaggaagcucuucuacuu

SEQ ID NO: 2556229 - RNA, 17 nt, Chlamydophila pneumoniae J138
uaggaagcuuaucaaga

SEQ ID NO: 2556230 - RNA, 20 nt, Chlamydophila pneumoniae J138
uaggaauaacaccaaaagaa

SEQ ID NO: 2556231 - RNA, 13 nt, Chlamydophila pneumoniae J138
uaggaaucuuuua

SEQ ID NO: 2556232 - RNA, 18 nt, Chlamydophila pneumoniae J138
uaggacccguagccccuu

SEQ ID NO: 2556233 - RNA, 13 nt, Chlamydophila pneumoniae J138
uaggagaagcccc

SEQ ID NO: 2556234 - RNA, 18 nt, Chlamydophila pneumoniae J138
uaggagagcuugguuuuc

SEQ ID NO: 2556235 - RNA, 23 nt, Chlamydophila pneumoniae J138
uaggagagcuugguuuucuccuu

SEQ ID NO: 2556236 - RNA, 16 nt, Chlamydophila pneumoniae J138
uaggagcauagacucu

SEQ ID NO: 2556237 - RNA, 21 nt, Chlamydophila pneumoniae J138
uaggagggguaaaccaauuga

SEQ ID NO: 2556238 - RNA, 21 nt, Chlamydophila pneumoniae J138
uaggauagaggccuuuuagag

SEQ ID NO: 2556239 - RNA, 14 nt, Chlamydophila pneumoniae J138
uaggauccaggagu

SEQ ID NO: 2556240 - RNA, 12 nt, Chlamydophila pneumoniae J138
uaggaucccuga

SEQ ID NO: 2556241 - RNA, 16 nt, Chlamydophila pneumoniae J138
uaggaucugacuuccc

SEQ ID NO: 2556242 - RNA, 19 nt, Chlamydophila pneumoniae J138
uaggauucaguuccucauc

SEQ ID NO: 2556243 - RNA, 12 nt, Chlamydophila pneumoniae J138
uaggauuugcau

SEQ ID NO: 2556244 - RNA, 22 nt, Chlamydophila pneumoniae J138
uaggcaagauuaugaugccuca

SEQ ID NO: 2556245 - RNA, 16 nt, Chlamydophila pneumoniae J138
uaggcagauagacaac

SEQ ID NO: 2556246 - RNA, 22 nt, Chlamydophila pneumoniae J138
uaggcauacaguagaaacaugg

SEQ ID NO: 2556247 - RNA, 20 nt, Chlamydophila pneumoniae J138
uaggcccugacuuagagucu

SEQ ID NO: 2556248 - RNA, 19 nt, Chlamydophila pneumoniae J138
uaggcgaugcaaauuccag

SEQ ID NO: 2556249 - RNA, 19 nt, Chlamydophila pneumoniae J138
uaggcucuuuagcaaacau

SEQ ID NO: 2556250 - RNA, 17 nt, Chlamydophila pneumoniae J138
uaggcuuaauaaacauc

SEQ ID NO: 2556251 - RNA, 14 nt, Chlamydophila pneumoniae J138
uagggaaaaaguag

SEQ ID NO: 2556252 - RNA, 19 nt, Chlamydophila pneumoniae J138
uagggaacaaaaaagccaa

SEQ ID NO: 2556253 - RNA, 16 nt, Chlamydophila pneumoniae J138
uagggaagaaauuaac

SEQ ID NO: 2556254 - RNA, 12 nt, Chlamydophila pneumoniae J138
uagggaauuucg

SEQ ID NO: 2556255 - RNA, 15 nt, Chlamydophila pneumoniae J138
uagggaauuucggac

SEQ ID NO: 2556256 - RNA, 21 nt, Chlamydophila pneumoniae J138
uagggaauuuuuucuguuccu

SEQ ID NO: 2556257 - RNA, 18 nt, Chlamydophila pneumoniae J138
uagggacuucucaaagac

SEQ ID NO: 2556258 - RNA, 21 nt, Chlamydophila pneumoniae J138
uagggcaggcggaaaggaagg

SEQ ID NO: 2556259 - RNA, 23 nt, Chlamydophila pneumoniae J138
uaggggaauuaaacuuucuucuc

SEQ ID NO: 2556260 - RNA, 22 nt, Chlamydophila pneumoniae J138
uaggggagguaaaauaaagagc

SEQ ID NO: 2556261 - RNA, 23 nt, Chlamydophila pneumoniae J138
uagggguagugaucugcagcaag

SEQ ID NO: 2556262 - RNA, 14 nt, Chlamydophila pneumoniae J138
uagggguuucccug

SEQ ID NO: 2556263 - RNA, 16 nt, Chlamydophila pneumoniae J138
uaggguaaagaaauau

SEQ ID NO: 2556264 - RNA, 13 nt, Chlamydophila pneumoniae J138
uaggguucucaaa

SEQ ID NO: 2556265 - RNA, 21 nt, Chlamydophila pneumoniae J138
uaggguuugcaugccuauuaa

SEQ ID NO: 2556266 - RNA, 24 nt, Chlamydophila pneumoniae J138
uagguaaggaaacgauuucuucuu

SEQ ID NO: 2556267 - RNA, 18 nt, Chlamydophila pneumoniae J138
uagguagguuguuguuga

SEQ ID NO: 2556268 - RNA, 23 nt, Chlamydophila pneumoniae J138
uagguaucagcaagaucuaacuu

SEQ ID NO: 2556269 - RNA, 22 nt, Chlamydophila pneumoniae J138
uagguaucucuccacagggucu

SEQ ID NO: 2556270 - RNA, 19 nt, Chlamydophila pneumoniae J138
uagguaugagcuccaaaau

SEQ ID NO: 2556271 - RNA, 21 nt, Chlamydophila pneumoniae J138
uaggucuaauccccaauuaua

SEQ ID NO: 2556272 - RNA, 14 nt, Chlamydophila pneumoniae J138
uaggucucuugcca

SEQ ID NO: 2556273 - RNA, 19 nt, Chlamydophila pneumoniae J138
uaggucuuaaaguagccau

SEQ ID NO: 2556274 - RNA, 12 nt, Chlamydophila pneumoniae J138
uaggucuugucu

SEQ ID NO: 2556275 - RNA, 21 nt, Chlamydophila pneumoniae J138
uaggucuugucuauucucuuc

SEQ ID NO: 2556276 - RNA, 20 nt, Chlamydophila pneumoniae J138
uaggugaaauauugaucuuu

SEQ ID NO: 2556277 - RNA, 16 nt, Chlamydophila pneumoniae J138
uaggugacccacgcau

SEQ ID NO: 2556278 - RNA, 19 nt, Chlamydophila pneumoniae J138
uaggugccugaagauggca

SEQ ID NO: 2556279 - RNA, 12 nt, Chlamydophila pneumoniae J138
uagguucuuuuc

SEQ ID NO: 2556280 - RNA, 18 nt, Chlamydophila pneumoniae J138
uagguuguuguugaggaa

SEQ ID NO: 2556281 - RNA, 13 nt, Chlamydophila pneumoniae J138
uagguuucaggaa

SEQ ID NO: 2556282 - RNA, 15 nt, Chlamydophila pneumoniae J138
uagguuugcugcucu

SEQ ID NO: 2556283 - RNA, 23 nt, Chlamydophila pneumoniae J138
uagguuugucgagcuuuaagaag

SEQ ID NO: 2556284 - RNA, 17 nt, Chlamydophila pneumoniae J138
uaguaaaauaagaaauc

SEQ ID NO: 2556285 - RNA, 21 nt, Chlamydophila pneumoniae J138
uaguaaagccacauucuucug

SEQ ID NO: 2556286 - RNA, 20 nt, Chlamydophila pneumoniae J138
uaguaaaugccucuuucaua

SEQ ID NO: 2556287 - RNA, 14 nt, Chlamydophila pneumoniae J138
uaguaacuaaauuc

SEQ ID NO: 2556288 - RNA, 20 nt, Chlamydophila pneumoniae J138
uaguaauuacagcuuuaauc

SEQ ID NO: 2556289 - RNA, 22 nt, Chlamydophila pneumoniae J138
uaguaucgagcucuuuaagaac

SEQ ID NO: 2556290 - RNA, 23 nt, Chlamydophila pneumoniae J138
uaguauggcauucuuuuucuauu

SEQ ID NO: 2556291 - RNA, 13 nt, Chlamydophila pneumoniae J138
uaguauuuuuaaa

SEQ ID NO: 2556292 - RNA, 14 nt, Chlamydophila pneumoniae J138
uaguauuuuuaaau

SEQ ID NO: 2556293 - RNA, 16 nt, Chlamydophila pneumoniae J138
uaguauuuuuaaauac

SEQ ID NO: 2556294 - RNA, 20 nt, Chlamydophila pneumoniae J138
uaguauuuuuaaauacagau

SEQ ID NO: 2556295 - RNA, 12 nt, Chlamydophila pneumoniae J138
uagucaaaaauu

SEQ ID NO: 2556296 - RNA, 18 nt, Chlamydophila pneumoniae J138
uagucgucuuuuaaagag

SEQ ID NO: 2556297 - RNA, 19 nt, Chlamydophila pneumoniae J138
uagucgucuuuuaaagagc

SEQ ID NO: 2556298 - RNA, 14 nt, Chlamydophila pneumoniae J138
uagucguuuucucg

SEQ ID NO: 2556299 - RNA, 18 nt, Chlamydophila pneumoniae J138
uagucuggcauaagucac

SEQ ID NO: 2556300 - RNA, 14 nt, Chlamydophila pneumoniae J138
uagucuucuuagaa

SEQ ID NO: 2556301 - RNA, 16 nt, Chlamydophila pneumoniae J138
uagucuucuuagaaag

SEQ ID NO: 2556302 - RNA, 14 nt, Chlamydophila pneumoniae J138
uagucuuucuaaga

SEQ ID NO: 2556303 - RNA, 15 nt, Chlamydophila pneumoniae J138
uagucuuucuaagaa

SEQ ID NO: 2556304 - RNA, 17 nt, Chlamydophila pneumoniae J138
uagugaacacucucuac

SEQ ID NO: 2556305 - RNA, 21 nt, Chlamydophila pneumoniae J138
uagugaacuuuuguacacaga

SEQ ID NO: 2556306 - RNA, 19 nt, Chlamydophila pneumoniae J138
uagugaagcugcuucuuca

SEQ ID NO: 2556307 - RNA, 21 nt, Chlamydophila pneumoniae J138
uagugaagcugcuucuucaga

SEQ ID NO: 2556308 - RNA, 23 nt, Chlamydophila pneumoniae J138
uagugaggccuccauuucuagga

SEQ ID NO: 2556309 - RNA, 19 nt, Chlamydophila pneumoniae J138
uagugcauaccuuaccauc

SEQ ID NO: 2556310 - RNA, 19 nt, Chlamydophila pneumoniae J138
uagugcgaugggaagagag

SEQ ID NO: 2556311 - RNA, 16 nt, Chlamydophila pneumoniae J138
uaguguauaucagcaa

SEQ ID NO: 2556312 - RNA, 21 nt, Chlamydophila pneumoniae J138
uagugucaucggcuucuccaa

SEQ ID NO: 2556313 - RNA, 16 nt, Chlamydophila pneumoniae J138
uaguguucgagcaucu

SEQ ID NO: 2556314 - RNA, 12 nt, Chlamydophila pneumoniae J138
uaguuagagaag

SEQ ID NO: 2556315 - RNA, 13 nt, Chlamydophila pneumoniae J138
uaguucauggggu

SEQ ID NO: 2556316 - RNA, 12 nt, Chlamydophila pneumoniae J138
uaguucauuagc

SEQ ID NO: 2556317 - RNA, 21 nt, Chlamydophila pneumoniae J138
uaguucauuagcuaaaucaaa

SEQ ID NO: 2556318 - RNA, 17 nt, Chlamydophila pneumoniae J138
uaguucguucaucuguc

SEQ ID NO: 2556319 - RNA, 22 nt, Chlamydophila pneumoniae J138
uaguucguucaucugucauuaa

SEQ ID NO: 2556320 - RNA, 23 nt, Chlamydophila pneumoniae J138
uaguucucuaagacuguguuuua

SEQ ID NO: 2556321 - RNA, 21 nt, Chlamydophila pneumoniae J138
uaguugcaugacuauuuucau

SEQ ID NO: 2556322 - RNA, 12 nt, Chlamydophila pneumoniae J138
uaguuguaauuu

SEQ ID NO: 2556323 - RNA, 16 nt, Chlamydophila pneumoniae J138
uaguuguccuuuauaa

SEQ ID NO: 2556324 - RNA, 18 nt, Chlamydophila pneumoniae J138
uaguugugagacuuucug

SEQ ID NO: 2556325 - RNA, 16 nt, Chlamydophila pneumoniae J138
uaguuucacauaguuu

SEQ ID NO: 2556326 - RNA, 15 nt, Chlamydophila pneumoniae J138
uaguuuuuacaugua

SEQ ID NO: 2556327 - RNA, 18 nt, Chlamydophila pneumoniae J138
uaguuuuuauuuuuaaau

SEQ ID NO: 2556328 - RNA, 21 nt, Chlamydophila pneumoniae J138
uaguuuuugcuguuucuucug

SEQ ID NO: 2556329 - RNA, 12 nt, Chlamydophila pneumoniae J138
uauaaacuccac

SEQ ID NO: 2556330 - RNA, 13 nt, Chlamydophila pneumoniae J138
uauaaagaagaaa

SEQ ID NO: 2556331 - RNA, 21 nt, Chlamydophila pneumoniae J138
uauaaauucaagacuauagaa

SEQ ID NO: 2556332 - RNA, 22 nt, Chlamydophila pneumoniae J138
uauaaauucaagacuauagaaa

SEQ ID NO: 2556333 - RNA, 14 nt, Chlamydophila pneumoniae J138
uauaacaucaagaa

SEQ ID NO: 2556334 - RNA, 15 nt, Chlamydophila pneumoniae J138
uauaacaucuaaaaa

SEQ ID NO: 2556335 - RNA, 20 nt, Chlamydophila pneumoniae J138
uauaacuacaaaauccacau

SEQ ID NO: 2556336 - RNA, 17 nt, Chlamydophila pneumoniae J138
uauaacucucuagagga

SEQ ID NO: 2556337 - RNA, 17 nt, Chlamydophila pneumoniae J138
uauaacugcauacaagg

SEQ ID NO: 2556338 - RNA, 23 nt, Chlamydophila pneumoniae J138
uauaagauaauagagaagaagca

SEQ ID NO: 2556339 - RNA, 23 nt, Chlamydophila pneumoniae J138
uauaagggggaucuucagagaga

SEQ ID NO: 2556340 - RNA, 19 nt, Chlamydophila pneumoniae J138
uauaagugacuuuucuucu

SEQ ID NO: 2556341 - RNA, 19 nt, Chlamydophila pneumoniae J138
uauacaaccacuuccugca

SEQ ID NO: 2556342 - RNA, 19 nt, Chlamydophila pneumoniae J138
uauacguaauccagauugu

SEQ ID NO: 2556343 - RNA, 23 nt, Chlamydophila pneumoniae J138
uauacuaagacugucuaugaucc

SEQ ID NO: 2556344 - RNA, 16 nt, Chlamydophila pneumoniae J138
uauacuguuuuucuuc

SEQ ID NO: 2556345 - RNA, 18 nt, Chlamydophila pneumoniae J138
uauacuguuuuucuucca

SEQ ID NO: 2556346 - RNA, 19 nt, Chlamydophila pneumoniae J138
uauacuguuuuucuuccac

SEQ ID NO: 2556347 - RNA, 22 nt, Chlamydophila pneumoniae J138
uauacuguuuuucuuccacaca

SEQ ID NO: 2556348 - RNA, 15 nt, Chlamydophila pneumoniae J138
uauacuuauaccacc

SEQ ID NO: 2556349 - RNA, 21 nt, Chlamydophila pneumoniae J138
uauagaaaaggaugcaucucu

SEQ ID NO: 2556350 - RNA, 14 nt, Chlamydophila pneumoniae J138
uauagagaagauuu

SEQ ID NO: 2556351 - RNA, 16 nt, Chlamydophila pneumoniae J138
uauagagaagauuucu

SEQ ID NO: 2556352 - RNA, 18 nt, Chlamydophila pneumoniae J138
uauagagaauacauugcu

SEQ ID NO: 2556353 - RNA, 17 nt, Chlamydophila pneumoniae J138
uauagauaugccucagg

SEQ ID NO: 2556354 - RNA, 14 nt, Chlamydophila pneumoniae J138
uauagaucuugaaa

SEQ ID NO: 2556355 - RNA, 14 nt, Chlamydophila pneumoniae J138
uauagcauuauucc

SEQ ID NO: 2556356 - RNA, 23 nt, Chlamydophila pneumoniae J138
uauagcuccuuggcuauggaaag

SEQ ID NO: 2556357 - RNA, 22 nt, Chlamydophila pneumoniae J138
uauagcuggcaaugauauccuc

SEQ ID NO: 2556358 - RNA, 20 nt, Chlamydophila pneumoniae J138
uauagcuuacuuagaacuau

SEQ ID NO: 2556359 - RNA, 12 nt, Chlamydophila pneumoniae J138
uauaggaaacug

SEQ ID NO: 2556360 - RNA, 17 nt, Chlamydophila pneumoniae J138
uauaggaagcucuucua

SEQ ID NO: 2556361 - RNA, 22 nt, Chlamydophila pneumoniae J138
uauaggaauaacaccaaaagaa

SEQ ID NO: 2556362 - RNA, 13 nt, Chlamydophila pneumoniae J138
uauaggauuugca

SEQ ID NO: 2556363 - RNA, 19 nt, Chlamydophila pneumoniae J138
uauaggcgugugaaaucug

SEQ ID NO: 2556364 - RNA, 20 nt, Chlamydophila pneumoniae J138
uauagguuaagccaaucccu

SEQ ID NO: 2556365 - RNA, 20 nt, Chlamydophila pneumoniae J138
ucuucauugcaaaaaugaaa

SEQ ID NO: 2556366 - RNA, 17 nt, Chlamydophila pneumoniae J138
ucuucauuuucuuuuaa

SEQ ID NO: 2556367 - RNA, 20 nt, Chlamydophila pneumoniae J138
ucuucauuuucuuuuaagag

SEQ ID NO: 2556368 - RNA, 17 nt, Chlamydophila pneumoniae J138
ucuuccaaagacugagc

SEQ ID NO: 2556369 - RNA, 14 nt, Chlamydophila pneumoniae J138
ucuuccaacuucug

SEQ ID NO: 2556370 - RNA, 16 nt, Chlamydophila pneumoniae J138
ucuuccacaauguuua

SEQ ID NO: 2556371 - RNA, 13 nt, Chlamydophila pneumoniae J138
ucuuccauaagau

SEQ ID NO: 2556372 - RNA, 16 nt, Chlamydophila pneumoniae J138
ucuuccaucucuuuaa

SEQ ID NO: 2556373 - RNA, 19 nt, Chlamydophila pneumoniae J138
ucuuccaucucuuuaaaug

SEQ ID NO: 2556374 - RNA, 17 nt, Chlamydophila pneumoniae J138
ucuucccagguaaacaa

SEQ ID NO: 2556375 - RNA, 20 nt, Chlamydophila pneumoniae J138
ucuuccugaaucagcuuauc

SEQ ID NO: 2556376 - RNA, 17 nt, Chlamydophila pneumoniae J138
ucuuccuucuucuucaa

SEQ ID NO: 2556377 - RNA, 19 nt, Chlamydophila pneumoniae J138
ucuucgaggccuaaaauca

SEQ ID NO: 2556378 - RNA, 18 nt, Chlamydophila pneumoniae J138
ucuucgauuguaacuucg

SEQ ID NO: 2556379 - RNA, 14 nt, Chlamydophila pneumoniae J138
ucuucgauuucuag

SEQ ID NO: 2556380 - RNA, 22 nt, Chlamydophila pneumoniae J138
ucuucgauuucuaguuguccuu

SEQ ID NO: 2556381 - RNA, 13 nt, Chlamydophila pneumoniae J138
ucuucgcaaauau

SEQ ID NO: 2556382 - RNA, 15 nt, Chlamydophila pneumoniae J138
ucuucgcuggcaugu

SEQ ID NO: 2556383 - RNA, 17 nt, Chlamydophila pneumoniae J138
ucuucggaucuguaaua

SEQ ID NO: 2556384 - RNA, 18 nt, Chlamydophila pneumoniae J138
ucuucguuuauaacauca

SEQ ID NO: 2556385 - RNA, 18 nt, Chlamydophila pneumoniae J138
ucuucguuucuuugaguu

SEQ ID NO: 2556386 - RNA, 20 nt, Chlamydophila pneumoniae J138
ucuucuaaaacuucaguugu

SEQ ID NO: 2556387 - RNA, 13 nt, Chlamydophila pneumoniae J138
ucuucuaccugua

SEQ ID NO: 2556388 - RNA, 18 nt, Chlamydophila pneumoniae J138
ucuucuagagcuucaagu

SEQ ID NO: 2556389 - RNA, 17 nt, Chlamydophila pneumoniae J138
ucuucucuaugaacgau

SEQ ID NO: 2556390 - RNA, 11 nt, Chlamydophila pneumoniae J138
ucuucugaaau

SEQ ID NO: 2556391 - RNA, 16 nt, Chlamydophila pneumoniae J138
ucuucugaaaucaaaa

SEQ ID NO: 2556392 - RNA, 17 nt, Chlamydophila pneumoniae J138
ucuucuggcugagagaa

SEQ ID NO: 2556393 - RNA, 19 nt, Chlamydophila pneumoniae J138
ucuucuggguucuccacau

SEQ ID NO: 2556394 - RNA, 17 nt, Chlamydophila pneumoniae J138
ucuucuguaauuuuuuu

SEQ ID NO: 2556395 - RNA, 21 nt, Chlamydophila pneumoniae J138
ucuucuguaauuuuuuucaaa

SEQ ID NO: 2556396 - RNA, 16 nt, Chlamydophila pneumoniae J138
ucuucuguaggaacaa

SEQ ID NO: 2556397 - RNA, 21 nt, Chlamydophila pneumoniae J138
ucuucuguaggaacaaucgua

SEQ ID NO: 2556398 - RNA, 18 nt, Chlamydophila pneumoniae J138
ucuucuuagaagagaaag

SEQ ID NO: 2556399 - RNA, 15 nt, Chlamydophila pneumoniae J138
ucuucuuagccaaaa

SEQ ID NO: 2556400 - RNA, 18 nt, Chlamydophila pneumoniae J138
ucuucuuagccaaaauuu

SEQ ID NO: 2556401 - RNA, 15 nt, Chlamydophila pneumoniae J138
ucuucuucaaaguca

SEQ ID NO: 2556402 - RNA, 17 nt, Chlamydophila pneumoniae J138
ucuucuucaucuucuaa

SEQ ID NO: 2556403 - RNA, 19 nt, Chlamydophila pneumoniae J138
ucuucuuccaaaaucucua

SEQ ID NO: 2556404 - RNA, 14 nt, Chlamydophila pneumoniae J138
ucuucuucuggcug

SEQ ID NO: 2556405 - RNA, 15 nt, Chlamydophila pneumoniae J138
ucuucuugcaaucuu

SEQ ID NO: 2556406 - RNA, 22 nt, Chlamydophila pneumoniae J138
ucuucuugcaaucuuugaagcu

SEQ ID NO: 2556407 - RNA, 15 nt, Chlamydophila pneumoniae J138
ucuucuuguucuucu

SEQ ID NO: 2556408 - RNA, 18 nt, Chlamydophila pneumoniae J138
ucuucuuugccaaugaga

SEQ ID NO: 2556409 - RNA, 18 nt, Chlamydophila pneumoniae J138
ucuucuuuggaugcuaau

SEQ ID NO: 2556410 - RNA, 13 nt, Chlamydophila pneumoniae J138
ucuucuuuucguu

SEQ ID NO: 2556411 - RNA, 11 nt, Chlamydophila pneumoniae J138
ucuugaaaaaa

SEQ ID NO: 2556412 - RNA, 20 nt, Chlamydophila pneumoniae J138
ucuugaagagauugauuucu

SEQ ID NO: 2556413 - RNA, 22 nt, Chlamydophila pneumoniae J138
ucuugaaguucuucaagaugau

SEQ ID NO: 2556414 - RNA, 18 nt, Chlamydophila pneumoniae J138
ucuugacaacgguguuca

SEQ ID NO: 2556415 - RNA, 23 nt, Chlamydophila pneumoniae J138
ucuugagaguccugggguucucu

SEQ ID NO: 2556416 - RNA, 14 nt, Chlamydophila pneumoniae J138
ucuugauuccuuaa

SEQ ID NO: 2556417 - RNA, 13 nt, Chlamydophila pneumoniae J138
ucuugccaaugug

SEQ ID NO: 2556418 - RNA, 13 nt, Chlamydophila pneumoniae J138
ucuugcucugaca

SEQ ID NO: 2556419 - RNA, 17 nt, Chlamydophila pneumoniae J138
ucuugcugauuuuugcu

SEQ ID NO: 2556420 - RNA, 18 nt, Chlamydophila pneumoniae J138
ucuuggucggaguuuuuu

SEQ ID NO: 2556421 - RNA, 15 nt, Chlamydophila pneumoniae J138
ucuugguguauagua

SEQ ID NO: 2556422 - RNA, 18 nt, Chlamydophila pneumoniae J138
ucuugguguauaguauuu

SEQ ID NO: 2556423 - RNA, 21 nt, Chlamydophila pneumoniae J138
ucuuguaagacuaaaaaagag

SEQ ID NO: 2556424 - RNA, 17 nt, Chlamydophila pneumoniae J138
ucuuguacauccuuguc

SEQ ID NO: 2556425 - RNA, 21 nt, Chlamydophila pneumoniae J138
ucuuguauuccuuggauuucu

SEQ ID NO: 2556426 - RNA, 15 nt, Chlamydophila pneumoniae J138
ucuuguuccaauaga

SEQ ID NO: 2556427 - RNA, 15 nt, Chlamydophila pneumoniae J138
ucuuuaaaaaauucu

SEQ ID NO: 2556428 - RNA, 20 nt, Chlamydophila pneumoniae J138
ucuuuaaaaacccaacuccc

SEQ ID NO: 2556429 - RNA, 16 nt, Chlamydophila pneumoniae J138
ucuuuaaaaggccgau

SEQ ID NO: 2556430 - RNA, 19 nt, Chlamydophila pneumoniae J138
ucuuuaagauuuuuagaau

SEQ ID NO: 2556431 - RNA, 21 nt, Chlamydophila pneumoniae J138
ucuuuaauccaguuuuuuaaa

SEQ ID NO: 2556432 - RNA, 22 nt, Chlamydophila pneumoniae J138
ucuuuaauccaguuuuuuaaau

SEQ ID NO: 2556433 - RNA, 15 nt, Chlamydophila pneumoniae J138
ucuuuaauuccaacu

SEQ ID NO: 2556434 - RNA, 23 nt, Chlamydophila pneumoniae J138
ucuuuacuacaugaggauacacu

SEQ ID NO: 2556435 - RNA, 18 nt, Chlamydophila pneumoniae J138
ucuuuagaauaagagcua

SEQ ID NO: 2556436 - RNA, 14 nt, Chlamydophila pneumoniae J138
ucuuuagcaaacau

SEQ ID NO: 2556437 - RNA, 17 nt, Chlamydophila pneumoniae J138
ucuuuagcaaacauuuu

SEQ ID NO: 2556438 - RNA, 16 nt, Chlamydophila pneumoniae J138
ucuuuagcuacagaaa

SEQ ID NO: 2556439 - RNA, 13 nt, Chlamydophila pneumoniae J138
ucuuuaggagcau

SEQ ID NO: 2556440 - RNA, 22 nt, Chlamydophila pneumoniae J138
ucuuuaggauagaggccuuuua

SEQ ID NO: 2556441 - RNA, 12 nt, Chlamydophila pneumoniae J138
ucuuuauuuaaa

SEQ ID NO: 2556442 - RNA, 14 nt, Chlamydophila pneumoniae J138
ucuuuauuuaaaua

SEQ ID NO: 2556443 - RNA, 15 nt, Chlamydophila pneumoniae J138
ucuuuauuuaaauaa

SEQ ID NO: 2556444 - RNA, 18 nt, Chlamydophila pneumoniae J138
ucuuuauuuuuaaaaaua

SEQ ID NO: 2556445 - RNA, 22 nt, Chlamydophila pneumoniae J138
ucuuucaaccuccgcucuaagc

SEQ ID NO: 2556446 - RNA, 15 nt, Chlamydophila pneumoniae J138
ucuuucaaggaacau

SEQ ID NO: 2556447 - RNA, 14 nt, Chlamydophila pneumoniae J138
ucuuucaauagcuu

SEQ ID NO: 2556448 - RNA, 18 nt, Chlamydophila pneumoniae J138
ucuuucacaucuuuagaa

SEQ ID NO: 2556449 - RNA, 21 nt, Chlamydophila pneumoniae J138
ucuuucacaucuuuagaauca

SEQ ID NO: 2556450 - RNA, 22 nt, Chlamydophila pneumoniae J138
ucuuucaccaacuccucuaagg

SEQ ID NO: 2556451 - RNA, 12 nt, Chlamydophila pneumoniae J138
ucuuucauaaga

SEQ ID NO: 2556452 - RNA, 17 nt, Chlamydophila pneumoniae J138
ucuuucauaagauugcc

SEQ ID NO: 2556453 - RNA, 14 nt, Chlamydophila pneumoniae J138
ucuuucauacuaaa

SEQ ID NO: 2556454 - RNA, 19 nt, Chlamydophila pneumoniae J138
ucuuucaucaaugcgauua

SEQ ID NO: 2556455 - RNA, 14 nt, Chlamydophila pneumoniae J138
ucuuucauucccuu

SEQ ID NO: 2556456 - RNA, 20 nt, Chlamydophila pneumoniae J138
ucuuuccucucaugaaauuu

SEQ ID NO: 2556457 - RNA, 20 nt, Chlamydophila pneumoniae J138
ucuuucuaaaacaucagcaa

SEQ ID NO: 2556458 - RNA, 15 nt, Chlamydophila pneumoniae J138
ucuuucuaagauauc

SEQ ID NO: 2556459 - RNA, 20 nt, Chlamydophila pneumoniae J138
ucuuucuaagauaucuugua

SEQ ID NO: 2556460 - RNA, 21 nt, Chlamydophila pneumoniae J138
ucuuucuaggaucucuaguaa

SEQ ID NO: 2556461 - RNA, 16 nt, Chlamydophila pneumoniae J138
ucuuucuaggccggga

SEQ ID NO: 2556462 - RNA, 15 nt, Chlamydophila pneumoniae J138
ucuuucuauagcucc

SEQ ID NO: 2556463 - RNA, 16 nt, Chlamydophila pneumoniae J138
ucuuucuauagcuccu

SEQ ID NO: 2556464 - RNA, 22 nt, Chlamydophila pneumoniae J138
ucuuucucgaggggacggaaaa

SEQ ID NO: 2556465 - RNA, 15 nt, Chlamydophila pneumoniae J138
ucuuucucuaaaaua

SEQ ID NO: 2556466 - RNA, 17 nt, Chlamydophila pneumoniae J138
ucuuucugauuuaaaag

SEQ ID NO: 2556467 - RNA, 14 nt, Chlamydophila pneumoniae J138
ucuuucugcucuuc

SEQ ID NO: 2556468 - RNA, 15 nt, Chlamydophila pneumoniae J138
ucuuucuucuagagc

SEQ ID NO: 2556469 - RNA, 18 nt, Chlamydophila pneumoniae J138
ucuuucuugcucugacaa

SEQ ID NO: 2556470 - RNA, 12 nt, Chlamydophila pneumoniae J138
ucuuucuuggau

SEQ ID NO: 2556471 - RNA, 21 nt, Chlamydophila pneumoniae J138
ucuuugacaucuaauuuuaaa

SEQ ID NO: 2556472 - RNA, 18 nt, Chlamydophila pneumoniae J138
ucuuugagaucuugaaug

SEQ ID NO: 2556473 - RNA, 22 nt, Chlamydophila pneumoniae J138
ucuuugaggauacgaauaaguu

SEQ ID NO: 2556474 - RNA, 16 nt, Chlamydophila pneumoniae J138
ucuuuggcacaauccu

SEQ ID NO: 2556475 - RNA, 20 nt, Chlamydophila pneumoniae J138
ucuuuggcacaauccucacu

SEQ ID NO: 2556476 - RNA, 16 nt, Chlamydophila pneumoniae J138
ucuuuuaacuuaaaga

SEQ ID NO: 2556477 - RNA, 23 nt, Chlamydophila pneumoniae J138
ucuuuuagacgugcucucuucuu

SEQ ID NO: 2556478 - RNA, 18 nt, Chlamydophila pneumoniae J138
ucuuuuaugauguauaaa

SEQ ID NO: 2556479 - RNA, 17 nt, Chlamydophila pneumoniae J138
ucuuuucggaucagaau

SEQ ID NO: 2556480 - RNA, 24 nt, Chlamydophila pneumoniae J138
ucuuuucggaucagaaugcaucuu

SEQ ID NO: 2556481 - RNA, 12 nt, Chlamydophila pneumoniae J138
ucuuuucuaagc

SEQ ID NO: 2556482 - RNA, 14 nt, Chlamydophila pneumoniae J138
ucuuuucuagaaaa

SEQ ID NO: 2556483 - RNA, 14 nt, Chlamydophila pneumoniae J138
ucuuuucugaagau

SEQ ID NO: 2556484 - RNA, 18 nt, Chlamydophila pneumoniae J138
ucuuuuguaaucuaagaa

SEQ ID NO: 2556485 - RNA, 17 nt, Chlamydophila pneumoniae J138
ucuuuuguuuuagcucu

SEQ ID NO: 2556486 - RNA, 20 nt, Chlamydophila pneumoniae J138
ucuuuuuaagguucucugaa

SEQ ID NO: 2556487 - RNA, 20 nt, Chlamydophila pneumoniae J138
ucuuuuuauugauaaugauu

SEQ ID NO: 2556488 - RNA, 16 nt, Chlamydophila pneumoniae J138
ucuuuuucagcuucua

SEQ ID NO: 2556489 - RNA, 21 nt, Chlamydophila pneumoniae J138
ucuuuuucuagggaucccaaa

SEQ ID NO: 2556490 - RNA, 16 nt, Chlamydophila pneumoniae J138
ucuuuuuuuauaaaga

SEQ ID NO: 2556491 - RNA, 19 nt, Chlamydophila pneumoniae J138
ucuuuuuuuugaagugcuu

SEQ ID NO: 2556492 - RNA, 13 nt, Chlamydophila pneumoniae J138
ugaaaaaauucua

SEQ ID NO: 2556493 - RNA, 17 nt, Chlamydophila pneumoniae J138
ugaaaacaaggcaaaaa

SEQ ID NO: 2556494 - RNA, 13 nt, Chlamydophila pneumoniae J138
ugaaaacuucaaa

SEQ ID NO: 2556495 - RNA, 13 nt, Chlamydophila pneumoniae J138
ugaaaauauccua

SEQ ID NO: 2556496 - RNA, 18 nt, Chlamydophila pneumoniae J138
ugaaaaucaagaagagaa

SEQ ID NO: 2556497 - RNA, 21 nt, Chlamydophila pneumoniae J138
ugaaaaucgcaccuugaccuc

SEQ ID NO: 2556498 - RNA, 19 nt, Chlamydophila pneumoniae J138
ugaaaauucgaauucucag

SEQ ID NO: 2556499 - RNA, 20 nt, Chlamydophila pneumoniae J138
ugaaaccguaacugaggcaa

SEQ ID NO: 2556500 - RNA, 17 nt, Chlamydophila pneumoniae J138
ugaaacuuuaggauuca

SEQ ID NO: 2556501 - RNA, 20 nt, Chlamydophila pneumoniae J138
ugaaacuuuuuuucuucucu

SEQ ID NO: 2556502 - RNA, 21 nt, Chlamydophila pneumoniae J138
ugaaacuuuuuuucuucucua

SEQ ID NO: 2556503 - RNA, 19 nt, Chlamydophila pneumoniae J138
ugaaagaaugccauucuua

SEQ ID NO: 2556504 - RNA, 19 nt, Chlamydophila pneumoniae J138
ugaaagauuauucuagagu

SEQ ID NO: 2556505 - RNA, 13 nt, Chlamydophila pneumoniae J138
ugaaaguacagaa

SEQ ID NO: 2556506 - RNA, 16 nt, Chlamydophila pneumoniae J138
ugaaaguacagaaagg

SEQ ID NO: 2556507 - RNA, 17 nt, Chlamydophila pneumoniae J138
ugaaaguacaggcucca

SEQ ID NO: 2556508 - RNA, 21 nt, Chlamydophila pneumoniae J138
ugaaaguacaggcuccaucac

SEQ ID NO: 2556509 - RNA, 18 nt, Chlamydophila pneumoniae J138
ugaaagucagcaagucau

SEQ ID NO: 2556510 - RNA, 23 nt, Chlamydophila pneumoniae J138
ugaaauacuccacuuuuuucccu

SEQ ID NO: 2556511 - RNA, 17 nt, Chlamydophila pneumoniae J138
ugaaauaguguuucuuu

SEQ ID NO: 2556512 - RNA, 17 nt, Chlamydophila pneumoniae J138
ugaaaucaaaaaaaacg

SEQ ID NO: 2556513 - RNA, 12 nt, Chlamydophila pneumoniae J138
ugaaaucaugga

SEQ ID NO: 2556514 - RNA, 23 nt, Chlamydophila pneumoniae J138
ugaaauccugggcaaugaucaaa

SEQ ID NO: 2556515 - RNA, 19 nt, Chlamydophila pneumoniae J138
ugaaauuucauucucacag

SEQ ID NO: 2556516 - RNA, 19 nt, Chlamydophila pneumoniae J138
ugaaauuucugaaacaaug

SEQ ID NO: 2556517 - RNA, 20 nt, Chlamydophila pneumoniae J138
ugaaauuucugaaacaaugc

SEQ ID NO: 2556518 - RNA, 20 nt, Chlamydophila pneumoniae J138
ugaacaucgguuuccaagac

SEQ ID NO: 2556519 - RNA, 16 nt, Chlamydophila pneumoniae J138
ugaaccuuugguagaa

SEQ ID NO: 2556520 - RNA, 22 nt, Chlamydophila pneumoniae J138
ugaacggcucuuucuaaaacau

SEQ ID NO: 2556521 - RNA, 15 nt, Chlamydophila pneumoniae J138
ugaacuaacugagca

SEQ ID NO: 2556522 - RNA, 17 nt, Chlamydophila pneumoniae J138
ugaagaacaaaaaauca

SEQ ID NO: 2556523 - RNA, 22 nt, Chlamydophila pneumoniae J138
ugaagaacaaaaaaucaaucuu

SEQ ID NO: 2556524 - RNA, 16 nt, Chlamydophila pneumoniae J138
ugaagacaaguaaaca

SEQ ID NO: 2556525 - RNA, 22 nt, Chlamydophila pneumoniae J138
ugaagacaaguaaacagcaaag

SEQ ID NO: 2556526 - RNA, 17 nt, Chlamydophila pneumoniae J138
ugaagaucuccgaagac

SEQ ID NO: 2556527 - RNA, 19 nt, Chlamydophila pneumoniae J138
ugaagaucuccgaagacua

SEQ ID NO: 2556528 - RNA, 17 nt, Chlamydophila pneumoniae J138
ugaagcagaaacuuuaa

SEQ ID NO: 2556529 - RNA, 20 nt, Chlamydophila pneumoniae J138
ugaagcagaggguuccaaga

SEQ ID NO: 2556530 - RNA, 16 nt, Chlamydophila pneumoniae J138
ugaagcagggaaaaug

SEQ ID NO: 2556531 - RNA, 18 nt, Chlamydophila pneumoniae J138
ugaagcagggaaaaugcg

SEQ ID NO: 2556532 - RNA, 15 nt, Chlamydophila pneumoniae J138
ugaagccaugacaaa

SEQ ID NO: 2556533 - RNA, 13 nt, Chlamydophila pneumoniae J138
ugaagcuccucac

SEQ ID NO: 2556534 - RNA, 22 nt, Chlamydophila pneumoniae J138
ugaagcugcuucuucagaguug

SEQ ID NO: 2556535 - RNA, 13 nt, Chlamydophila pneumoniae J138
ugaagcuucuuua

SEQ ID NO: 2556536 - RNA, 13 nt, Chlamydophila pneumoniae J138
ugaaggaucauac

SEQ ID NO: 2556537 - RNA, 22 nt, Chlamydophila pneumoniae J138
ugaaggaucauaccgacaagca

SEQ ID NO: 2556538 - RNA, 17 nt, Chlamydophila pneumoniae J138
ugaagggacagucuccu

SEQ ID NO: 2556539 - RNA, 16 nt, Chlamydophila pneumoniae J138
ugaaguacauuaucac

SEQ ID NO: 2556540 - RNA, 18 nt, Chlamydophila pneumoniae J138
ugaaguccagacuuuccu

SEQ ID NO: 2556541 - RNA, 23 nt, Chlamydophila pneumoniae J138
ugaagucguuuagauuuuucuuu

SEQ ID NO: 2556542 - RNA, 16 nt, Chlamydophila pneumoniae J138
ugaaguucucaaagac

SEQ ID NO: 2556543 - RNA, 16 nt, Chlamydophila pneumoniae J138
ugaaguuugucguaau

SEQ ID NO: 2556544 - RNA, 15 nt, Chlamydophila pneumoniae J138
ugaaguuuuuucucu

SEQ ID NO: 2556545 - RNA, 12 nt, Chlamydophila pneumoniae J138
ugaauaagauuu

SEQ ID NO: 2556546 - RNA, 15 nt, Chlamydophila pneumoniae J138
ugaauaagauuuuga

SEQ ID NO: 2556547 - RNA, 12 nt, Chlamydophila pneumoniae J138
ugaauaaugcau

SEQ ID NO: 2556548 - RNA, 17 nt, Chlamydophila pneumoniae J138
ugaauaccagaagcaaa

SEQ ID NO: 2556549 - RNA, 16 nt, Chlamydophila pneumoniae J138
ugaauaccguuucagg

SEQ ID NO: 2556550 - RNA, 17 nt, Chlamydophila pneumoniae J138
ugaauaccguuucagga

SEQ ID NO: 2556551 - RNA, 19 nt, Chlamydophila pneumoniae J138
ugaauaccguuucaggaaa

SEQ ID NO: 2556552 - RNA, 18 nt, Chlamydophila pneumoniae J138
ugaauagcucuuuucaug

SEQ ID NO: 2556553 - RNA, 20 nt, Chlamydophila pneumoniae J138
ugaauagcucuuuucaugau

SEQ ID NO: 2556554 - RNA, 18 nt, Chlamydophila pneumoniae J138
ugaauauaguuuaaaugu

SEQ ID NO: 2556555 - RNA, 14 nt, Chlamydophila pneumoniae J138
ugaauaucaucacu

SEQ ID NO: 2556556 - RNA, 17 nt, Chlamydophila pneumoniae J138
ugaauaucaucacuaag

SEQ ID NO: 2556557 - RNA, 12 nt, Chlamydophila pneumoniae J138
ugaauauguacu

SEQ ID NO: 2556558 - RNA, 23 nt, Chlamydophila pneumoniae J138
ugaaucacagcgcugugaggaaa

SEQ ID NO: 2556559 - RNA, 14 nt, Chlamydophila pneumoniae J138
ugaaucccaucaaa

SEQ ID NO: 2556560 - RNA, 14 nt, Chlamydophila pneumoniae J138
ugaauccuucuaua

SEQ ID NO: 2556561 - RNA, 21 nt, Chlamydophila pneumoniae J138
ugaauccuugaaagacucgcu

SEQ ID NO: 2556562 - RNA, 22 nt, Chlamydophila pneumoniae J138
ugaaucgaagaacagaggaucu

SEQ ID NO: 2556563 - RNA, 20 nt, Chlamydophila pneumoniae J138
ugaaucucuucuguaggaac

SEQ ID NO: 2556564 - RNA, 13 nt, Chlamydophila pneumoniae J138
ugaaucuucaaga

SEQ ID NO: 2556565 - RNA, 12 nt, Chlamydophila pneumoniae J138
ugaaugauuucc

SEQ ID NO: 2556566 - RNA, 13 nt, Chlamydophila pneumoniae J138
ugaaugauuucca

SEQ ID NO: 2556567 - RNA, 14 nt, Chlamydophila pneumoniae J138
ugaaugauuuccau

SEQ ID NO: 2556568 - RNA, 18 nt, Chlamydophila pneumoniae J138
ugaaugcaacagagucag

SEQ ID NO: 2556569 - RNA, 19 nt, Chlamydophila pneumoniae J138
ugaaugcagcacggaacaa

SEQ ID NO: 2556570 - RNA, 19 nt, Chlamydophila pneumoniae J138
ugaaugccugccaauccaa

SEQ ID NO: 2556571 - RNA, 17 nt, Chlamydophila pneumoniae J138
ugaauggcucugucacu

SEQ ID NO: 2556572 - RNA, 15 nt, Chlamydophila pneumoniae J138
ugaauuaauaaaaga

SEQ ID NO: 2556573 - RNA, 16 nt, Chlamydophila pneumoniae J138
ugaauuaauaaaagag

SEQ ID NO: 2556574 - RNA, 23 nt, Chlamydophila pneumoniae J138
ugaauuacaggcccuaggacgua

SEQ ID NO: 2556575 - RNA, 19 nt, Chlamydophila pneumoniae J138
ugaauuagggcuuuuacuc

SEQ ID NO: 2556576 - RNA, 18 nt, Chlamydophila pneumoniae J138
ugaauuuccaaaggaaaa

SEQ ID NO: 2556577 - RNA, 22 nt, Chlamydophila pneumoniae J138
ugacaaauaaguccuguuugaa

SEQ ID NO: 2556578 - RNA, 17 nt, Chlamydophila pneumoniae J138
ugacaaauagaaaggaa

SEQ ID NO: 2556579 - RNA, 17 nt, Chlamydophila pneumoniae J138
ugacaaguguguuucaa

SEQ ID NO: 2556580 - RNA, 16 nt, Chlamydophila pneumoniae J138
ugacaauccgcauauu

SEQ ID NO: 2556581 - RNA, 23 nt, Chlamydophila pneumoniae J138
ugacaaucgcuguaaauucagug

SEQ ID NO: 2556582 - RNA, 21 nt, Chlamydophila pneumoniae J138
ugacacaacucuuaaaucgcu

SEQ ID NO: 2556583 - RNA, 12 nt, Chlamydophila pneumoniae J138
ugacacagagaa

SEQ ID NO: 2556584 - RNA, 13 nt, Chlamydophila pneumoniae J138
ugacacagagaac

SEQ ID NO: 2556585 - RNA, 17 nt, Chlamydophila pneumoniae J138
ugacacagagaacaaua

SEQ ID NO: 2556586 - RNA, 18 nt, Chlamydophila pneumoniae J138
ugacacagcuaaucaauc

SEQ ID NO: 2556587 - RNA, 16 nt, Chlamydophila pneumoniae J138
ugacacaggagguuca

SEQ ID NO: 2556588 - RNA, 22 nt, Chlamydophila pneumoniae J138
ugacacaggagguucauucuca

SEQ ID NO: 2556589 - RNA, 17 nt, Chlamydophila pneumoniae J138
ugacacucagcucccau

SEQ ID NO: 2556590 - RNA, 22 nt, Chlamydophila pneumoniae J138
ugacacucagcucccaugugcu

SEQ ID NO: 2556591 - RNA, 18 nt, Chlamydophila pneumoniae J138
ugacagaccuugcauuag

SEQ ID NO: 2556592 - RNA, 21 nt, Chlamydophila pneumoniae J138
ugacagcuccauuuaaaugga

SEQ ID NO: 2556593 - RNA, 18 nt, Chlamydophila pneumoniae J138
ugacauaagcacucuuaa

SEQ ID NO: 2556594 - RNA, 11 nt, Chlamydophila pneumoniae J138
ugaccaagaac

SEQ ID NO: 2556595 - RNA, 13 nt, Chlamydophila pneumoniae J138
ugaccaguggcag

SEQ ID NO: 2556596 - RNA, 15 nt, Chlamydophila pneumoniae J138
ugaccaguggcagga

SEQ ID NO: 2556597 - RNA, 23 nt, Chlamydophila pneumoniae J138
ugaccaucaaugagaucugcaaa

SEQ ID NO: 2556598 - RNA, 22 nt, Chlamydophila pneumoniae J138
ugacccagagaauguucccaaa

SEQ ID NO: 2556599 - RNA, 16 nt, Chlamydophila pneumoniae J138
ugaccucaucucgcag

SEQ ID NO: 2556600 - RNA, 20 nt, Chlamydophila pneumoniae J138
ugaccucaucucgcagucca

SEQ ID NO: 2556601 - RNA, 16 nt, Chlamydophila pneumoniae J138
ugaccugcuuuuuuuc

SEQ ID NO: 2556602 - RNA, 23 nt, Chlamydophila pneumoniae J138
ugaccuuauaguccauaugggac

SEQ ID NO: 2556603 - RNA, 20 nt, Chlamydophila pneumoniae J138
ugaccuucucaagaucuuca

SEQ ID NO: 2556604 - RNA, 13 nt, Chlamydophila pneumoniae J138
ugaccuuuuucau

SEQ ID NO: 2556605 - RNA, 13 nt, Chlamydophila pneumoniae J138
ugacgcacuucuu

SEQ ID NO: 2556606 - RNA, 19 nt, Chlamydophila pneumoniae J138
ugacgcacuucuucaagaa

SEQ ID NO: 2556607 - RNA, 18 nt, Chlamydophila pneumoniae J138
ugacgcuuuuccaaagca

SEQ ID NO: 2556608 - RNA, 15 nt, Chlamydophila pneumoniae J138
ugacggcaggacucu

SEQ ID NO: 2556609 - RNA, 21 nt, Chlamydophila pneumoniae J138
ugacggcaggacucuuuaagc

SEQ ID NO: 2556610 - RNA, 14 nt, Chlamydophila pneumoniae J138
ugacguagacgauu

SEQ ID NO: 2556611 - RNA, 12 nt, Chlamydophila pneumoniae J138
ugacgugcauug

SEQ ID NO: 2556612 - RNA, 20 nt, Chlamydophila pneumoniae J138
ugacguuaauaaagaggcuc

SEQ ID NO: 2556613 - RNA, 22 nt, Chlamydophila pneumoniae J138
ugacguugcgaacagcuccugg

SEQ ID NO: 2556614 - RNA, 13 nt, Chlamydophila pneumoniae J138
ugacuauaaaaug

SEQ ID NO: 2556615 - RNA, 21 nt, Chlamydophila pneumoniae J138
ugacuauagggagacucuuga

SEQ ID NO: 2556616 - RNA, 14 nt, Chlamydophila pneumoniae J138
ugacuauuuucauu

SEQ ID NO: 2556617 - RNA, 17 nt, Chlamydophila pneumoniae J138
ugacuccagaaggugug

SEQ ID NO: 2556618 - RNA, 16 nt, Chlamydophila pneumoniae J138
ugacucuaauucagaa

SEQ ID NO: 2556619 - RNA, 17 nt, Chlamydophila pneumoniae J138
ugacucuaauucagaaa

SEQ ID NO: 2556620 - RNA, 12 nt, Chlamydophila pneumoniae J138
ugacucuagagu

SEQ ID NO: 2556621 - RNA, 14 nt, Chlamydophila pneumoniae J138
ugacucuagaguac

SEQ ID NO: 2556622 - RNA, 14 nt, Chlamydophila pneumoniae J138
ugacucuagccacc

SEQ ID NO: 2556623 - RNA, 18 nt, Chlamydophila pneumoniae J138
ugacucuagccaccaaca

SEQ ID NO: 2556624 - RNA, 17 nt, Chlamydophila pneumoniae J138
ugacucuuauugcagaa

SEQ ID NO: 2556625 - RNA, 18 nt, Chlamydophila pneumoniae J138
ugacucuuuuaagacaau

SEQ ID NO: 2556626 - RNA, 19 nt, Chlamydophila pneumoniae J138
ugacugcagauugcacuug

SEQ ID NO: 2556627 - RNA, 15 nt, Chlamydophila pneumoniae J138
ugacugcuagagucc

SEQ ID NO: 2556628 - RNA, 23 nt, Chlamydophila pneumoniae J138
ugacuggcgacuugccaaucuuc

SEQ ID NO: 2556629 - RNA, 17 nt, Chlamydophila pneumoniae J138
ugacuucuuguccuguu

SEQ ID NO: 2556630 - RNA, 16 nt, Chlamydophila pneumoniae J138
ugacuuggcuggcauc

SEQ ID NO: 2556631 - RNA, 18 nt, Chlamydophila pneumoniae J138
ugacuuuagaaauuccaa

SEQ ID NO: 2556632 - RNA, 17 nt, Chlamydophila pneumoniae J138
ugacuuuaugaucuccc

SEQ ID NO: 2556633 - RNA, 21 nt, Chlamydophila pneumoniae J138
ugacuuuauguuagcuagagc

SEQ ID NO: 2556634 - RNA, 19 nt, Chlamydophila pneumoniae J138
ugacuuuggucuucuguaa

SEQ ID NO: 2556635 - RNA, 12 nt, Chlamydophila pneumoniae J138
ugacuuuucuuc

SEQ ID NO: 2556636 - RNA, 20 nt, Chlamydophila pneumoniae J138
ugacuuuuguugcaauucca

SEQ ID NO: 2556637 - RNA, 23 nt, Chlamydophila pneumoniae J138
ugacuuuuucaagguucucuaug

SEQ ID NO: 2556638 - RNA, 19 nt, Chlamydophila pneumoniae J138
ugagaaaaagaaucucuga

SEQ ID NO: 2556639 - RNA, 22 nt, Chlamydophila pneumoniae J138
ugagaaaaguugccuaaagaga

SEQ ID NO: 2556640 - RNA, 15 nt, Chlamydophila pneumoniae J138
ugagaaaaucugcag

SEQ ID NO: 2556641 - RNA, 17 nt, Chlamydophila pneumoniae J138
ugagaaaaucugcagca

SEQ ID NO: 2556642 - RNA, 20 nt, Chlamydophila pneumoniae J138
ugagaaaaucugcagcagau

SEQ ID NO: 2556643 - RNA, 18 nt, Chlamydophila pneumoniae J138
ugagaaaucuuuugauua

SEQ ID NO: 2556644 - RNA, 19 nt, Chlamydophila pneumoniae J138
ugagaacucagcgcaucac

SEQ ID NO: 2556645 - RNA, 10 nt, Chlamydophila pneumoniae J138
ugagaagaua

SEQ ID NO: 2556646 - RNA, 20 nt, Chlamydophila pneumoniae J138
ugagaauacaacccuuuaua

SEQ ID NO: 2556647 - RNA, 21 nt, Chlamydophila pneumoniae J138
ugagaauuuucaugauauuuu

SEQ ID NO: 2556648 - RNA, 22 nt, Chlamydophila pneumoniae J138
ugagacagacagucugugagaa

SEQ ID NO: 2556649 - RNA, 15 nt, Chlamydophila pneumoniae J138
ugagaccauaaaauc

SEQ ID NO: 2556650 - RNA, 17 nt, Chlamydophila pneumoniae J138
ugagacgaaagagauuu

SEQ ID NO: 2556651 - RNA, 15 nt, Chlamydophila pneumoniae J138
ugagagauuuuuuca

SEQ ID NO: 2556652 - RNA, 19 nt, Chlamydophila pneumoniae J138
ugagagcguuguggaagua

SEQ ID NO: 2556653 - RNA, 21 nt, Chlamydophila pneumoniae J138
ugagaggaucgugaaguacau

SEQ ID NO: 2556654 - RNA, 17 nt, Chlamydophila pneumoniae J138
ugagagggucucagcau

SEQ ID NO: 2556655 - RNA, 22 nt, Chlamydophila pneumoniae J138
ugagaguguuguuggagcagaa

SEQ ID NO: 2556656 - RNA, 17 nt, Chlamydophila pneumoniae J138
ugagauacggaggauua

SEQ ID NO: 2556657 - RNA, 18 nt, Chlamydophila pneumoniae J138
ugagauacggaggauuau

SEQ ID NO: 2556658 - RNA, 13 nt, Chlamydophila pneumoniae J138
ugagauagucuug

SEQ ID NO: 2556659 - RNA, 19 nt, Chlamydophila pneumoniae J138
ugagaucgaaucuuuauuu

SEQ ID NO: 2556660 - RNA, 13 nt, Chlamydophila pneumoniae J138
ugagaucugcaaa

SEQ ID NO: 2556661 - RNA, 13 nt, Chlamydophila pneumoniae J138
ugagauucaaaag

SEQ ID NO: 2556662 - RNA, 14 nt, Chlamydophila pneumoniae J138
ugagauugaggaua

SEQ ID NO: 2556663 - RNA, 14 nt, Chlamydophila pneumoniae J138
ugagcauccaaaau

SEQ ID NO: 2556664 - RNA, 23 nt, Chlamydophila pneumoniae J138
ugagccaacagguucacuucauc

SEQ ID NO: 2556665 - RNA, 17 nt, Chlamydophila pneumoniae J138
ugagccccuugcaaaag

SEQ ID NO: 2556666 - RNA, 16 nt, Chlamydophila pneumoniae J138
ugagcgacgacaagga

SEQ ID NO: 2556667 - RNA, 18 nt, Chlamydophila pneumoniae J138
ugagcgucguguuuucac

SEQ ID NO: 2556668 - RNA, 14 nt, Chlamydophila pneumoniae J138
ugagcuaagucucc

SEQ ID NO: 2556669 - RNA, 21 nt, Chlamydophila pneumoniae J138
ugagcugcugguccuaaaaaa

SEQ ID NO: 2556670 - RNA, 22 nt, Chlamydophila pneumoniae J138
ugagcuuugguuucguacaguu

SEQ ID NO: 2556671 - RNA, 20 nt, Chlamydophila pneumoniae J138
ugaggaacgcacgccaagag

SEQ ID NO: 2556672 - RNA, 22 nt, Chlamydophila pneumoniae J138
ugaggaaucauaaccaaaagaa

SEQ ID NO: 2556673 - RNA, 17 nt, Chlamydophila pneumoniae J138
ugaggacacaacucuuu

SEQ ID NO: 2556674 - RNA, 20 nt, Chlamydophila pneumoniae J138
ugaggagcucccucuagagc

SEQ ID NO: 2556675 - RNA, 18 nt, Chlamydophila pneumoniae J138
ugaggauaaguucuucca

SEQ ID NO: 2556676 - RNA, 16 nt, Chlamydophila pneumoniae J138
ugaggauacacuucua

SEQ ID NO: 2556677 - RNA, 21 nt, Chlamydophila pneumoniae J138
ugaggcaaagauuuccaaucc

SEQ ID NO: 2556678 - RNA, 23 nt, Chlamydophila pneumoniae J138
ugaggcaaagauuuccaauccau

SEQ ID NO: 2556679 - RNA, 16 nt, Chlamydophila pneumoniae J138
ugaggcacauguagga

SEQ ID NO: 2556680 - RNA, 17 nt, Chlamydophila pneumoniae J138
ugagggucggauuuaga

SEQ ID NO: 2556681 - RNA, 14 nt, Chlamydophila pneumoniae J138
ugagguaucaauaa

SEQ ID NO: 2556682 - RNA, 17 nt, Chlamydophila pneumoniae J138
ugagguuugugcugcuu

SEQ ID NO: 2556683 - RNA, 20 nt, Chlamydophila pneumoniae J138
ugaguaaaaucauaggcuau

SEQ ID NO: 2556684 - RNA, 16 nt, Chlamydophila pneumoniae J138
ugagucugaacauucu

SEQ ID NO: 2556685 - RNA, 18 nt, Chlamydophila pneumoniae J138
ugaguggguucacuccug

SEQ ID NO: 2556686 - RNA, 18 nt, Chlamydophila pneumoniae J138
ugaguuaagcaauaucug

SEQ ID NO: 2556687 - RNA, 12 nt, Chlamydophila pneumoniae J138
ugaguucuuccu

SEQ ID NO: 2556688 - RNA, 21 nt, Chlamydophila pneumoniae J138
ugaguucuuccuucuucuuca

SEQ ID NO: 2556689 - RNA, 22 nt, Chlamydophila pneumoniae J138
ugaguucuuuuguuugucuucc

SEQ ID NO: 2556690 - RNA, 18 nt, Chlamydophila pneumoniae J138
ugaguuuuuaauuuucug

SEQ ID NO: 2556691 - RNA, 14 nt, Chlamydophila pneumoniae J138
ugauaaaaauuuuc

SEQ ID NO: 2556692 - RNA, 19 nt, Chlamydophila pneumoniae J138
ugauaaaagguauuucucu

SEQ ID NO: 2556693 - RNA, 20 nt, Chlamydophila pneumoniae J138
ugauaaagggaauuuucuca

SEQ ID NO: 2556694 - RNA, 14 nt, Chlamydophila pneumoniae J138
ugauaacuuugcau

SEQ ID NO: 2556695 - RNA, 22 nt, Chlamydophila pneumoniae J138
ugauaaggaagaauuucgucuu

SEQ ID NO: 2556696 - RNA, 19 nt, Chlamydophila pneumoniae J138
ugauaccaccuaaaaugca

SEQ ID NO: 2556697 - RNA, 21 nt, Chlamydophila pneumoniae J138
ugauaccaccuaaaaugcagg

SEQ ID NO: 2556698 - RNA, 22 nt, Chlamydophila pneumoniae J138
ugauacuuguaccguaaagaaa

SEQ ID NO: 2556699 - RNA, 12 nt, Chlamydophila pneumoniae J138
ugauacuuuaga

SEQ ID NO: 2556700 - RNA, 13 nt, Chlamydophila pneumoniae J138
ugauauuccuuga

SEQ ID NO: 2556701 - RNA, 13 nt, Chlamydophila pneumoniae J138
ugauauugcguuu

SEQ ID NO: 2556702 - RNA, 19 nt, Chlamydophila pneumoniae J138
ugaucaaaauuauccagaa

SEQ ID NO: 2556703 - RNA, 12 nt, Chlamydophila pneumoniae J138
ugaucaaagaac

SEQ ID NO: 2556704 - RNA, 15 nt, Chlamydophila pneumoniae J138
ugaucagaaaugaag

SEQ ID NO: 2556705 - RNA, 21 nt, Chlamydophila pneumoniae J138
ugaucagagagaggggagucu

SEQ ID NO: 2556706 - RNA, 13 nt, Chlamydophila pneumoniae J138
ugauccagcucca

SEQ ID NO: 2556707 - RNA, 16 nt, Chlamydophila pneumoniae J138
ugauccagcuccauaa

SEQ ID NO: 2556708 - RNA, 17 nt, Chlamydophila pneumoniae J138
ugauccaucugcucuuu

SEQ ID NO: 2556709 - RNA, 15 nt, Chlamydophila pneumoniae J138
ugauccgaaaacucu

SEQ ID NO: 2556710 - RNA, 18 nt, Chlamydophila pneumoniae J138
ugauccgaaaacucuuag

SEQ ID NO: 2556711 - RNA, 19 nt, Chlamydophila pneumoniae J138
ugauccucggcaucuuugg

SEQ ID NO: 2556712 - RNA, 16 nt, Chlamydophila pneumoniae J138
ugauccuugcaaaaca

SEQ ID NO: 2556713 - RNA, 13 nt, Chlamydophila pneumoniae J138
ugaucuacaaaaa

SEQ ID NO: 2556714 - RNA, 20 nt, Chlamydophila pneumoniae J138
ugaucuacaaaaacuagaau

SEQ ID NO: 2556715 - RNA, 13 nt, Chlamydophila pneumoniae J138
ugaucugaaguug

SEQ ID NO: 2556716 - RNA, 17 nt, Chlamydophila pneumoniae J138
ugaucuucuagaugugu

SEQ ID NO: 2556717 - RNA, 15 nt, Chlamydophila pneumoniae J138
ugaucuuuccucuca

SEQ ID NO: 2556718 - RNA, 18 nt, Chlamydophila pneumoniae J138
ugaugaccucuauaccua

SEQ ID NO: 2556719 - RNA, 21 nt, Chlamydophila pneumoniae J138
ugaugcaaugguugucuuuac

SEQ ID NO: 2556720 - RNA, 15 nt, Chlamydophila pneumoniae J138
ugaugccaagaaaua

SEQ ID NO: 2556721 - RNA, 18 nt, Chlamydophila pneumoniae J138
ugaugcccugacguuuug

SEQ ID NO: 2556722 - RNA, 15 nt, Chlamydophila pneumoniae J138
ugaugccuuuuucuu

SEQ ID NO: 2556723 - RNA, 16 nt, Chlamydophila pneumoniae J138
ugaugcuucuuucaaa

SEQ ID NO: 2556724 - RNA, 20 nt, Chlamydophila pneumoniae J138
ugauguauaaaguuuguaaa

SEQ ID NO: 2556725 - RNA, 16 nt, Chlamydophila pneumoniae J138
ugauguugcccuacaa

SEQ ID NO: 2556726 - RNA, 20 nt, Chlamydophila pneumoniae J138
ugauguuugacuuuauguua

SEQ ID NO: 2556727 - RNA, 16 nt, Chlamydophila pneumoniae J138
ugauuaagaucuucgu

SEQ ID NO: 2556728 - RNA, 20 nt, Chlamydophila pneumoniae J138
ugauuacagcaucuauagaa

SEQ ID NO: 2556729 - RNA, 13 nt, Chlamydophila pneumoniae J138
ugauuaggaacaa

SEQ ID NO: 2556730 - RNA, 18 nt, Chlamydophila pneumoniae J138
ugauuaguuuguuuuaau

SEQ ID NO: 2556731 - RNA, 16 nt, Chlamydophila pneumoniae J138
ugauuauuuaagacca

SEQ ID NO: 2556732 - RNA, 21 nt, Chlamydophila pneumoniae J138
ugauucauaaagaggaaugaa

SEQ ID NO: 2556733 - RNA, 21 nt, Chlamydophila pneumoniae J138
ugauucccggaggcaaagauc

SEQ ID NO: 2556734 - RNA, 23 nt, Chlamydophila pneumoniae J138
ugauucccggaggcaaagaucag

SEQ ID NO: 2556735 - RNA, 15 nt, Chlamydophila pneumoniae J138
ugauucccuccuucc

SEQ ID NO: 2556736 - RNA, 15 nt, Chlamydophila pneumoniae J138
ugauuccgcaaguaa

SEQ ID NO: 2556737 - RNA, 21 nt, Chlamydophila pneumoniae J138
ugauuccuuggcauacucuau

SEQ ID NO: 2556738 - RNA, 15 nt, Chlamydophila pneumoniae J138
ugauugaaaccguaa

SEQ ID NO: 2556739 - RNA, 23 nt, Chlamydophila pneumoniae J138
ugauugaaacuuuuuuucuucuc

SEQ ID NO: 2556740 - RNA, 21 nt, Chlamydophila pneumoniae J138
ugauugaaagucagcaaguca

SEQ ID NO: 2556741 - RNA, 16 nt, Chlamydophila pneumoniae J138
ugauugaaguucagac

SEQ ID NO: 2556742 - RNA, 22 nt, Chlamydophila pneumoniae J138
ugauugaaguucagacgugcuc

SEQ ID NO: 2556743 - RNA, 20 nt, Chlamydophila pneumoniae J138
ugauuggaugauagcuauga

SEQ ID NO: 2556744 - RNA, 12 nt, Chlamydophila pneumoniae J138
ugauuguagaga

SEQ ID NO: 2556745 - RNA, 15 nt, Chlamydophila pneumoniae J138
ugauuguauagcuua

SEQ ID NO: 2556746 - RNA, 19 nt, Chlamydophila pneumoniae J138
ugauuucuuuauucccuuu

SEQ ID NO: 2556747 - RNA, 22 nt, Chlamydophila pneumoniae J138
ugauuuguuuagcauagagcuc

SEQ ID NO: 2556748 - RNA, 19 nt, Chlamydophila pneumoniae J138
ugauuuuucaaucaauaaa

SEQ ID NO: 2556749 - RNA, 19 nt, Chlamydophila pneumoniae J138
ugauuuuuugaauccuguu

SEQ ID NO: 2556750 - RNA, 14 nt, Chlamydophila pneumoniae J138
ugcaaaaaaccagc

SEQ ID NO: 2556751 - RNA, 16 nt, Chlamydophila pneumoniae J138
ugcaaaaaugaaagaa

SEQ ID NO: 2556752 - RNA, 15 nt, Chlamydophila pneumoniae J138
ugcaaaccaaaaaag

SEQ ID NO: 2556753 - RNA, 12 nt, Chlamydophila pneumoniae J138
ugcaaagagaau

SEQ ID NO: 2556754 - RNA, 16 nt, Chlamydophila pneumoniae J138
ugcaaagcaucuugua

SEQ ID NO: 2556755 - RNA, 14 nt, Chlamydophila pneumoniae J138
ugcaaagcccauac

SEQ ID NO: 2556756 - RNA, 14 nt, Chlamydophila pneumoniae J138
ugcaaaggaaggga

SEQ ID NO: 2556757 - RNA, 11 nt, Chlamydophila pneumoniae J138
ugcaaaguacu

SEQ ID NO: 2556758 - RNA, 14 nt, Chlamydophila pneumoniae J138
ugcaaauaagccag

SEQ ID NO: 2556759 - RNA, 18 nt, Chlamydophila pneumoniae J138
ugcaaauccuguagaaac

SEQ ID NO: 2556760 - RNA, 16 nt, Chlamydophila pneumoniae J138
ugcaaaugaaaagaga

SEQ ID NO: 2556761 - RNA, 22 nt, Chlamydophila pneumoniae J138
ugcaaaugaagggaugggaucg

SEQ ID NO: 2556762 - RNA, 12 nt, Chlamydophila pneumoniae J138
ugcaaauuucau

SEQ ID NO: 2556763 - RNA, 12 nt, Chlamydophila pneumoniae J138
ugcaacaaaagg

SEQ ID NO: 2556764 - RNA, 16 nt, Chlamydophila pneumoniae J138
ugcaacaaucuuucuu

SEQ ID NO: 2556765 - RNA, 19 nt, Chlamydophila pneumoniae J138
ugcaacagagucagaagcu

SEQ ID NO: 2556766 - RNA, 19 nt, Chlamydophila pneumoniae J138
ugcaaccacacaggauugu

SEQ ID NO: 2556767 - RNA, 18 nt, Chlamydophila pneumoniae J138
ugcaaccuguaaagacca

SEQ ID NO: 2556768 - RNA, 21 nt, Chlamydophila pneumoniae J138
ugcaagagccggaacuucagg

SEQ ID NO: 2556769 - RNA, 23 nt, Chlamydophila pneumoniae J138
ugcaagauuaucuuuacgaauca

SEQ ID NO: 2556770 - RNA, 22 nt, Chlamydophila pneumoniae J138
ugcaagcagauagagcuucuuu

SEQ ID NO: 2556771 - RNA, 19 nt, Chlamydophila pneumoniae J138
ugcaagcauuguuuguccu

SEQ ID NO: 2556772 - RNA, 18 nt, Chlamydophila pneumoniae J138
ugcaagcuucaucaggag

SEQ ID NO: 2556773 - RNA, 17 nt, Chlamydophila pneumoniae J138
ugcaaggccuaaucuug

SEQ ID NO: 2556774 - RNA, 19 nt, Chlamydophila pneumoniae J138
ugcaaguuugaaugcagca

SEQ ID NO: 2556775 - RNA, 16 nt, Chlamydophila pneumoniae J138
ugcaauagcaauggcu

SEQ ID NO: 2556776 - RNA, 16 nt, Chlamydophila pneumoniae J138
ugcaaucagugcugcc

SEQ ID NO: 2556777 - RNA, 14 nt, Chlamydophila pneumoniae J138
ugcaaucucaaaau

SEQ ID NO: 2556778 - RNA, 17 nt, Chlamydophila pneumoniae J138
ugcaauuccgaagaaga

SEQ ID NO: 2556779 - RNA, 20 nt, Chlamydophila pneumoniae J138
ugcaauucuucaugcugcuu

SEQ ID NO: 2556780 - RNA, 20 nt, Chlamydophila pneumoniae J138
ugcacguuugacaaauuuau

SEQ ID NO: 2556781 - RNA, 23 nt, Chlamydophila pneumoniae J138
ugcacuugcgguuuuggauagaa

SEQ ID NO: 2556782 - RNA, 15 nt, Chlamydophila pneumoniae J138
ugcacuuugaauaau

SEQ ID NO: 2556783 - RNA, 16 nt, Chlamydophila pneumoniae J138
ugcacuuugaauaaug

SEQ ID NO: 2556784 - RNA, 15 nt, Chlamydophila pneumoniae J138
ugcagaaucuaugag

SEQ ID NO: 2556785 - RNA, 18 nt, Chlamydophila pneumoniae J138
ugcagacggggaucuaaa

SEQ ID NO: 2556786 - RNA, 20 nt, Chlamydophila pneumoniae J138
ugcagaguuuuaaacugcua

SEQ ID NO: 2556787 - RNA, 21 nt, Chlamydophila pneumoniae J138
ugcagauacuaaacuccauug

SEQ ID NO: 2556788 - RNA, 20 nt, Chlamydophila pneumoniae J138
ugcagauagcuuacagagaa

SEQ ID NO: 2556789 - RNA, 13 nt, Chlamydophila pneumoniae J138
ugcagaucauauc

SEQ ID NO: 2556790 - RNA, 22 nt, Chlamydophila pneumoniae J138
ugcagcagauaccaaaauacca

SEQ ID NO: 2556791 - RNA, 16 nt, Chlamydophila pneumoniae J138
ugcagcagaugaaacu

SEQ ID NO: 2556792 - RNA, 22 nt, Chlamydophila pneumoniae J138
ugcagcagccuuggcucuagaa

SEQ ID NO: 2556793 - RNA, 14 nt, Chlamydophila pneumoniae J138
ugcagcgcagcacc

SEQ ID NO: 2556794 - RNA, 19 nt, Chlamydophila pneumoniae J138
ugcagcguuucuagggacg

SEQ ID NO: 2556795 - RNA, 22 nt, Chlamydophila pneumoniae J138
ugcagucguauucagguucuga

SEQ ID NO: 2556796 - RNA, 19 nt, Chlamydophila pneumoniae J138
ugcaguuccgauaaagaua

SEQ ID NO: 2556797 - RNA, 16 nt, Chlamydophila pneumoniae J138
ugcaguugaugagaaa

SEQ ID NO: 2556798 - RNA, 18 nt, Chlamydophila pneumoniae J138
ugcaguugaugagaaaaa

SEQ ID NO: 2556799 - RNA, 18 nt, Chlamydophila pneumoniae J138
ugcaguugcuguggcaua

SEQ ID NO: 2556800 - RNA, 18 nt, Chlamydophila pneumoniae J138
ugcauaauuuuucuuagu

SEQ ID NO: 2556801 - RNA, 17 nt, Chlamydophila pneumoniae J138
ugcauacccuucuucuu

SEQ ID NO: 2556802 - RNA, 20 nt, Chlamydophila pneumoniae J138
ugcauacccuucuucuucag

SEQ ID NO: 2556803 - RNA, 22 nt, Chlamydophila pneumoniae J138
ugcauacguuaacaaggauuau

SEQ ID NO: 2556804 - RNA, 16 nt, Chlamydophila pneumoniae J138
ugcauagaauaaagau

SEQ ID NO: 2556805 - RNA, 21 nt, Chlamydophila pneumoniae J138
ugcaucauuuucauagcagcu

SEQ ID NO: 2556806 - RNA, 24 nt, Chlamydophila pneumoniae J138
ugcaucccaccgacaagaugguga

SEQ ID NO: 2556807 - RNA, 18 nt, Chlamydophila pneumoniae J138
ugcaucccuggauuucuu

SEQ ID NO: 2556808 - RNA, 14 nt, Chlamydophila pneumoniae J138
ugcaucucugcaua

SEQ ID NO: 2556809 - RNA, 12 nt, Chlamydophila pneumoniae J138
ugcaucuuauca

SEQ ID NO: 2556810 - RNA, 19 nt, Chlamydophila pneumoniae J138
ugcaucuuaucaagagcuc

SEQ ID NO: 2556811 - RNA, 18 nt, Chlamydophila pneumoniae J138
ugcaucuuauggaagaga

SEQ ID NO: 2556812 - RNA, 22 nt, Chlamydophila pneumoniae J138
ugcaucuugagguauuccuacc

SEQ ID NO: 2556813 - RNA, 17 nt, Chlamydophila pneumoniae J138
ugcaugaauauagguua

SEQ ID NO: 2556814 - RNA, 13 nt, Chlamydophila pneumoniae J138
ugcaugaggagac

SEQ ID NO: 2556815 - RNA, 17 nt, Chlamydophila pneumoniae J138
ugcaugauccuauuuuu

SEQ ID NO: 2556816 - RNA, 22 nt, Chlamydophila pneumoniae J138
ugcauggauccuucaucagcuu

SEQ ID NO: 2556817 - RNA, 20 nt, Chlamydophila pneumoniae J138
ugcauuaagauaaacauuaa

SEQ ID NO: 2556818 - RNA, 22 nt, Chlamydophila pneumoniae J138
ugcauuaucuaagaauauggac

SEQ ID NO: 2556819 - RNA, 15 nt, Chlamydophila pneumoniae J138
ugcauucauaaaaau

SEQ ID NO: 2556820 - RNA, 22 nt, Chlamydophila pneumoniae J138
ugcauuugccccuaacuggcua

SEQ ID NO: 2556821 - RNA, 16 nt, Chlamydophila pneumoniae J138
ugcauuuucuucuugc

SEQ ID NO: 2556822 - RNA, 14 nt, Chlamydophila pneumoniae J138
ugccaaauaucucu

SEQ ID NO: 2556823 - RNA, 13 nt, Chlamydophila pneumoniae J138
ugccaaauccucc

SEQ ID NO: 2556824 - RNA, 12 nt, Chlamydophila pneumoniae J138
ugccaaugugca

SEQ ID NO: 2556825 - RNA, 15 nt, Chlamydophila pneumoniae J138
ugccaaugugcaaua

SEQ ID NO: 2556826 - RNA, 21 nt, Chlamydophila pneumoniae J138
ugccaauguggugauuucuuu

SEQ ID NO: 2556827 - RNA, 22 nt, Chlamydophila pneumoniae J138
ugccacaacucauccuaaauua

SEQ ID NO: 2556828 - RNA, 16 nt, Chlamydophila pneumoniae J138
ugccagagauucuuca

SEQ ID NO: 2556829 - RNA, 11 nt, Chlamydophila pneumoniae J138
ugccagcagaa

SEQ ID NO: 2556830 - RNA, 15 nt, Chlamydophila pneumoniae J138
ugccagcagaaguuc

SEQ ID NO: 2556831 - RNA, 13 nt, Chlamydophila pneumoniae J138
ugccagcuugccc

SEQ ID NO: 2556832 - RNA, 16 nt, Chlamydophila pneumoniae J138
ugccaggcuuaaauau

SEQ ID NO: 2556833 - RNA, 14 nt, Chlamydophila pneumoniae J138
ugccauaaauacag

SEQ ID NO: 2556834 - RNA, 18 nt, Chlamydophila pneumoniae J138
ugccauaaguccaugcua

SEQ ID NO: 2556835 - RNA, 22 nt, Chlamydophila pneumoniae J138
ugccauugaucagaaucuaagu

SEQ ID NO: 2556836 - RNA, 13 nt, Chlamydophila pneumoniae J138
ugcccaaacauca

SEQ ID NO: 2556837 - RNA, 12 nt, Chlamydophila pneumoniae J138
ugcccacuucua

SEQ ID NO: 2556838 - RNA, 16 nt, Chlamydophila pneumoniae J138
ugcccacuucuaccaa

SEQ ID NO: 2556839 - RNA, 17 nt, Chlamydophila pneumoniae J138
ugcccauuuuuggaaaa

SEQ ID NO: 2556840 - RNA, 18 nt, Chlamydophila pneumoniae J138
ugcccuacaauuuccuug

SEQ ID NO: 2556841 - RNA, 19 nt, Chlamydophila pneumoniae J138
ugcccuggauagcauacga

SEQ ID NO: 2556842 - RNA, 15 nt, Chlamydophila pneumoniae J138
ugcccuguucuaugc

SEQ ID NO: 2556843 - RNA, 15 nt, Chlamydophila pneumoniae J138
ugccgagaauacaga

SEQ ID NO: 2556844 - RNA, 15 nt, Chlamydophila pneumoniae J138
ugccgugcucuuaug

SEQ ID NO: 2556845 - RNA, 17 nt, Chlamydophila pneumoniae J138
ugccugaaaauucgaau

SEQ ID NO: 2556846 - RNA, 12 nt, Chlamydophila pneumoniae J138
ugccuucuuauc

SEQ ID NO: 2556847 - RNA, 19 nt, Chlamydophila pneumoniae J138
ugccuucuuaucuucuaaa

SEQ ID NO: 2556848 - RNA, 12 nt, Chlamydophila pneumoniae J138
ugccuucuucaa

SEQ ID NO: 2556849 - RNA, 13 nt, Chlamydophila pneumoniae J138
ugccuucuucuug

SEQ ID NO: 2556850 - RNA, 22 nt, Chlamydophila pneumoniae J138
ugccuugauccuuuccaagaag

SEQ ID NO: 2556851 - RNA, 14 nt, Chlamydophila pneumoniae J138
ugccuuuagggaaa

SEQ ID NO: 2556852 - RNA, 16 nt, Chlamydophila pneumoniae J138
ugccuuuagggaaaaa

SEQ ID NO: 2556853 - RNA, 20 nt, Chlamydophila pneumoniae J138
ugccuuuuuuucuauagagu

SEQ ID NO: 2556854 - RNA, 19 nt, Chlamydophila pneumoniae J138
ugcgaaugucguuaaaaac

SEQ ID NO: 2556855 - RNA, 15 nt, Chlamydophila pneumoniae J138
ugcgacaaaaaugcc

SEQ ID NO: 2556856 - RNA, 22 nt, Chlamydophila pneumoniae J138
ugcgaggaaaaaggaggauguu

SEQ ID NO: 2556857 - RNA, 22 nt, Chlamydophila pneumoniae J138
ugcgauugccggcuaugaggaa

SEQ ID NO: 2556858 - RNA, 22 nt, Chlamydophila pneumoniae J138
ugcgcaaagaacucaacuuuuu

SEQ ID NO: 2556859 - RNA, 20 nt, Chlamydophila pneumoniae J138
ugcgcacaagggauucuugu

SEQ ID NO: 2556860 - RNA, 17 nt, Chlamydophila pneumoniae J138
ugcgcacggauucuaaa

SEQ ID NO: 2556861 - RNA, 20 nt, Chlamydophila pneumoniae J138
ugcgcacggauucuaaaaga

SEQ ID NO: 2556862 - RNA, 18 nt, Chlamydophila pneumoniae J138
ugcgcagcucggauggac

SEQ ID NO: 2556863 - RNA, 23 nt, Chlamydophila pneumoniae J138
ugcgcagcuucuggagaaaaaau

SEQ ID NO: 2556864 - RNA, 18 nt, Chlamydophila pneumoniae J138
ugcgcaguggacggggag

SEQ ID NO: 2556865 - RNA, 14 nt, Chlamydophila pneumoniae J138
ugcgcccgagcuuc

SEQ ID NO: 2556866 - RNA, 16 nt, Chlamydophila pneumoniae J138
ugcgcccgagcuucca

SEQ ID NO: 2556867 - RNA, 13 nt, Chlamydophila pneumoniae J138
ugcgcuagcucca

SEQ ID NO: 2556868 - RNA, 14 nt, Chlamydophila pneumoniae J138
ugcgcuaucaucau

SEQ ID NO: 2556869 - RNA, 16 nt, Chlamydophila pneumoniae J138
ugcggaaggcuaaaac

SEQ ID NO: 2556870 - RNA, 17 nt, Chlamydophila pneumoniae J138
uggaagaauuucauaag

SEQ ID NO: 2556871 - RNA, 18 nt, Chlamydophila pneumoniae J138
uggaagauaaacauacau

SEQ ID NO: 2556872 - RNA, 16 nt, Chlamydophila pneumoniae J138
uggaagauugaaggca

SEQ ID NO: 2556873 - RNA, 16 nt, Chlamydophila pneumoniae J138
uggaaguaaucuggaa

SEQ ID NO: 2556874 - RNA, 19 nt, Chlamydophila pneumoniae J138
uggaaguaaucuggaagca

SEQ ID NO: 2556875 - RNA, 19 nt, Chlamydophila pneumoniae J138
uggaauauagguuuagauu

SEQ ID NO: 2556876 - RNA, 20 nt, Chlamydophila pneumoniae J138
uggaauaucaggacaaugaa

SEQ ID NO: 2556877 - RNA, 18 nt, Chlamydophila pneumoniae J138
uggaaucagggacucuuu

SEQ ID NO: 2556878 - RNA, 15 nt, Chlamydophila pneumoniae J138
uggaaucuaugaaua

SEQ ID NO: 2556879 - RNA, 14 nt, Chlamydophila pneumoniae J138
uggaaugacuaaau

SEQ ID NO: 2556880 - RNA, 18 nt, Chlamydophila pneumoniae J138
uggaaugacuaaaugcga

SEQ ID NO: 2556881 - RNA, 13 nt, Chlamydophila pneumoniae J138
uggaaugccaaau

SEQ ID NO: 2556882 - RNA, 19 nt, Chlamydophila pneumoniae J138
uggaaugccaaauccuccg

SEQ ID NO: 2556883 - RNA, 23 nt, Chlamydophila pneumoniae J138
uggaauggcuuuuguuuuguauu

SEQ ID NO: 2556884 - RNA, 18 nt, Chlamydophila pneumoniae J138
uggaauucaaacuccuuu

SEQ ID NO: 2556885 - RNA, 19 nt, Chlamydophila pneumoniae J138
uggaauucaaacuccuuuu

SEQ ID NO: 2556886 - RNA, 22 nt, Chlamydophila pneumoniae J138
uggaauucaaacuccuuuuaaa

SEQ ID NO: 2556887 - RNA, 13 nt, Chlamydophila pneumoniae J138
uggaauuuuccug

SEQ ID NO: 2556888 - RNA, 18 nt, Chlamydophila pneumoniae J138
uggacaacgcuucuuuuu

SEQ ID NO: 2556889 - RNA, 22 nt, Chlamydophila pneumoniae J138
uggaccagaugcuaaagagucu

SEQ ID NO: 2556890 - RNA, 12 nt, Chlamydophila pneumoniae J138
uggacuccaaga

SEQ ID NO: 2556891 - RNA, 14 nt, Chlamydophila pneumoniae J138
uggacuccaagaau

SEQ ID NO: 2556892 - RNA, 16 nt, Chlamydophila pneumoniae J138
uggagaagagguaaua

SEQ ID NO: 2556893 - RNA, 20 nt, Chlamydophila pneumoniae J138
uggagaauaaucucuuucau

SEQ ID NO: 2556894 - RNA, 15 nt, Chlamydophila pneumoniae J138
uggagagcgaaauag

SEQ ID NO: 2556895 - RNA, 15 nt, Chlamydophila pneumoniae J138
uggaggauaaaugag

SEQ ID NO: 2556896 - RNA, 14 nt, Chlamydophila pneumoniae J138
uggaggccaaagaa

SEQ ID NO: 2556897 - RNA, 15 nt, Chlamydophila pneumoniae J138
uggaggccaaagaac

SEQ ID NO: 2556898 - RNA, 22 nt, Chlamydophila pneumoniae J138
uggaguaucuagcuuugucucu

SEQ ID NO: 2556899 - RNA, 21 nt, Chlamydophila pneumoniae J138
uggauaacacgaguuucgaua

SEQ ID NO: 2556900 - RNA, 17 nt, Chlamydophila pneumoniae J138
uggauaccggcaaauaa

SEQ ID NO: 2556901 - RNA, 18 nt, Chlamydophila pneumoniae J138
uggauacguuuuucccuu

SEQ ID NO: 2556902 - RNA, 16 nt, Chlamydophila pneumoniae J138
uggauagaagcaugaa

SEQ ID NO: 2556903 - RNA, 17 nt, Chlamydophila pneumoniae J138
uggauauugucaagagg

SEQ ID NO: 2556904 - RNA, 14 nt, Chlamydophila pneumoniae J138
uggaucaaggagua

SEQ ID NO: 2556905 - RNA, 18 nt, Chlamydophila pneumoniae J138
uggaucacguaagcuuua

SEQ ID NO: 2556906 - RNA, 20 nt, Chlamydophila pneumoniae J138
uggaucagaaaaaaugcguu

SEQ ID NO: 2556907 - RNA, 22 nt, Chlamydophila pneumoniae J138
uggauccaucggcauuucucca

SEQ ID NO: 2556908 - RNA, 21 nt, Chlamydophila pneumoniae J138
uggauccuucaucagcuuccc

SEQ ID NO: 2556909 - RNA, 16 nt, Chlamydophila pneumoniae J138
uggaugcuaauaaaau

SEQ ID NO: 2556910 - RNA, 17 nt, Chlamydophila pneumoniae J138
uggauguagaggaucua

SEQ ID NO: 2556911 - RNA, 13 nt, Chlamydophila pneumoniae J138
uggcacaauccuc

SEQ ID NO: 2556912 - RNA, 23 nt, Chlamydophila pneumoniae J138
uggcagcaaauccuuuauguaua

SEQ ID NO: 2556913 - RNA, 20 nt, Chlamydophila pneumoniae J138
uggcagcuuggaugggaauc

SEQ ID NO: 2556914 - RNA, 21 nt, Chlamydophila pneumoniae J138
uggcauaaagaccgagaagcu

SEQ ID NO: 2556915 - RNA, 14 nt, Chlamydophila pneumoniae J138
uggcauagcgaaag

SEQ ID NO: 2556916 - RNA, 17 nt, Chlamydophila pneumoniae J138
uggcauagcgaaaguca

SEQ ID NO: 2556917 - RNA, 14 nt, Chlamydophila pneumoniae J138
uggcaucuaagcca

SEQ ID NO: 2556918 - RNA, 18 nt, Chlamydophila pneumoniae J138
uggcauucuuuuucuauu

SEQ ID NO: 2556919 - RNA, 17 nt, Chlamydophila pneumoniae J138
uggcauugggaaggauc

SEQ ID NO: 2556920 - RNA, 20 nt, Chlamydophila pneumoniae J138
uggccaacaguguagccuuu

SEQ ID NO: 2556921 - RNA, 18 nt, Chlamydophila pneumoniae J138
uggccaucaucaccagaa

SEQ ID NO: 2556922 - RNA, 17 nt, Chlamydophila pneumoniae J138
uggccuagcuuucuugg

SEQ ID NO: 2556923 - RNA, 18 nt, Chlamydophila pneumoniae J138
uggcgaauccuagagaac

SEQ ID NO: 2556924 - RNA, 13 nt, Chlamydophila pneumoniae J138
uggcguaauaauu

SEQ ID NO: 2556925 - RNA, 20 nt, Chlamydophila pneumoniae J138
uggcgucugcccuuucugca

SEQ ID NO: 2556926 - RNA, 13 nt, Chlamydophila pneumoniae J138
uggcguucaggau

SEQ ID NO: 2556927 - RNA, 20 nt, Chlamydophila pneumoniae J138
uggcuauagauacuuugcaa

SEQ ID NO: 2556928 - RNA, 14 nt, Chlamydophila pneumoniae J138
uggcuauggaagau

SEQ ID NO: 2556929 - RNA, 14 nt, Chlamydophila pneumoniae J138
uggcucuauagggg

SEQ ID NO: 2556930 - RNA, 23 nt, Chlamydophila pneumoniae J138
uggcuuuuuuugucccaacuaga

SEQ ID NO: 2556931 - RNA, 14 nt, Chlamydophila pneumoniae J138
ugggaaaagaaaag

SEQ ID NO: 2556932 - RNA, 18 nt, Chlamydophila pneumoniae J138
ugggaagacucucaucag

SEQ ID NO: 2556933 - RNA, 21 nt, Chlamydophila pneumoniae J138
ugggaagccuggaaaugaaua

SEQ ID NO: 2556934 - RNA, 22 nt, Chlamydophila pneumoniae J138
ugggaaugcgcaggcaauuuuu

SEQ ID NO: 2556935 - RNA, 17 nt, Chlamydophila pneumoniae J138
ugggaauucuuuuccug

SEQ ID NO: 2556936 - RNA, 22 nt, Chlamydophila pneumoniae J138
ugggaauucuuuuccugcagca

SEQ ID NO: 2556937 - RNA, 21 nt, Chlamydophila pneumoniae J138
ugggaauuguucuugaaguuc

SEQ ID NO: 2556938 - RNA, 19 nt, Chlamydophila pneumoniae J138
ugggauaaaaaguuuuugu

SEQ ID NO: 2556939 - RNA, 20 nt, Chlamydophila pneumoniae J138
ugggauauuggagacuaggg

SEQ ID NO: 2556940 - RNA, 16 nt, Chlamydophila pneumoniae J138
ugggaucggucuuuuc

SEQ ID NO: 2556941 - RNA, 22 nt, Chlamydophila pneumoniae J138
ugggcaaugaucaaaaaugaua

SEQ ID NO: 2556942 - RNA, 19 nt, Chlamydophila pneumoniae J138
ugggcuaggguuucuacag

SEQ ID NO: 2556943 - RNA, 14 nt, Chlamydophila pneumoniae J138
ugggcucacucuaa

SEQ ID NO: 2556944 - RNA, 23 nt, Chlamydophila pneumoniae J138
uggggaaauuaaauucuuuucua

SEQ ID NO: 2556945 - RNA, 18 nt, Chlamydophila pneumoniae J138
uggggaucuuaggaaauu

SEQ ID NO: 2556946 - RNA, 20 nt, Chlamydophila pneumoniae J138
uggggauuaguagcuauucu

SEQ ID NO: 2556947 - RNA, 20 nt, Chlamydophila pneumoniae J138
uggggauuaucccaaacuuc

SEQ ID NO: 2556948 - RNA, 20 nt, Chlamydophila pneumoniae J138
uggggcaguagguaagaagc

SEQ ID NO: 2556949 - RNA, 17 nt, Chlamydophila pneumoniae J138
uggggcauaagaacucu

SEQ ID NO: 2556950 - RNA, 17 nt, Chlamydophila pneumoniae J138
uggggcuuccagaaaca

SEQ ID NO: 2556951 - RNA, 18 nt, Chlamydophila pneumoniae J138
uggguaaggcgaaaucuu

SEQ ID NO: 2556952 - RNA, 13 nt, Chlamydophila pneumoniae J138
uggguucacuccu

SEQ ID NO: 2556953 - RNA, 15 nt, Chlamydophila pneumoniae J138
uggguucacuccuga

SEQ ID NO: 2556954 - RNA, 12 nt, Chlamydophila pneumoniae J138
uggguucuccac

SEQ ID NO: 2556955 - RNA, 13 nt, Chlamydophila pneumoniae J138
ugguaaaaauaua

SEQ ID NO: 2556956 - RNA, 20 nt, Chlamydophila pneumoniae J138
ugguaacacgagugccuucu

SEQ ID NO: 2556957 - RNA, 16 nt, Chlamydophila pneumoniae J138
ugguaagcauuucugu

SEQ ID NO: 2556958 - RNA, 15 nt, Chlamydophila pneumoniae J138
ugguaucccaaucga

SEQ ID NO: 2556959 - RNA, 12 nt, Chlamydophila pneumoniae J138
ugguaucccuga

SEQ ID NO: 2556960 - RNA, 18 nt, Chlamydophila pneumoniae J138
ugguccauaauuucuuuc

SEQ ID NO: 2556961 - RNA, 19 nt, Chlamydophila pneumoniae J138
ugguccauaauuucuuuca

SEQ ID NO: 2556962 - RNA, 13 nt, Chlamydophila pneumoniae J138
uggucuagagauu

SEQ ID NO: 2556963 - RNA, 19 nt, Chlamydophila pneumoniae J138
uggucuagagauuuuucua

SEQ ID NO: 2556964 - RNA, 18 nt, Chlamydophila pneumoniae J138
uggucuguauuuucuuca

SEQ ID NO: 2556965 - RNA, 19 nt, Chlamydophila pneumoniae J138
uggucuguauuuucuucaa

SEQ ID NO: 2556966 - RNA, 22 nt, Chlamydophila pneumoniae J138
ugguguucuucagcccacuguu

SEQ ID NO: 2556967 - RNA, 13 nt, Chlamydophila pneumoniae J138
ugguuaaaauaga

SEQ ID NO: 2556968 - RNA, 13 nt, Chlamydophila pneumoniae J138
ugguuccuggauu

SEQ ID NO: 2556969 - RNA, 15 nt, Chlamydophila pneumoniae J138
ugguuuucuccuucu

SEQ ID NO: 2556970 - RNA, 21 nt, Chlamydophila pneumoniae J138
ugguuuuugcaaccacacagg

SEQ ID NO: 2556971 - RNA, 20 nt, Chlamydophila pneumoniae J138
uuaccaucguuuucauaggg

SEQ ID NO: 2556972 - RNA, 19 nt, Chlamydophila pneumoniae J138
uuacccuaauuugaauagu

SEQ ID NO: 2556973 - RNA, 16 nt, Chlamydophila pneumoniae J138
uuaccguuuccuccuc

SEQ ID NO: 2556974 - RNA, 23 nt, Chlamydophila pneumoniae J138
uuaccucauggagguucucaaug

SEQ ID NO: 2556975 - RNA, 21 nt, Chlamydophila pneumoniae J138
uuacgaacaagacgaaagcac

SEQ ID NO: 2556976 - RNA, 12 nt, Chlamydophila pneumoniae J138
uuacgcucucca

SEQ ID NO: 2556977 - RNA, 23 nt, Chlamydophila pneumoniae J138
uuacuaaagaaagagucucacuc

SEQ ID NO: 2556978 - RNA, 21 nt, Chlamydophila pneumoniae J138
uuacugaagaaguaagcgauu

SEQ ID NO: 2556979 - RNA, 16 nt, Chlamydophila pneumoniae J138
uuacugaggaaaucgc

SEQ ID NO: 2556980 - RNA, 18 nt, Chlamydophila pneumoniae J138
uuacugaggaaaucgcau

SEQ ID NO: 2556981 - RNA, 17 nt, Chlamydophila pneumoniae J138
uuacugucugcaaagag

SEQ ID NO: 2556982 - RNA, 18 nt, Chlamydophila pneumoniae J138
uuacugugguauacaucc

SEQ ID NO: 2556983 - RNA, 22 nt, Chlamydophila pneumoniae J138
uuacuuuaaucaagccuaaauc

SEQ ID NO: 2556984 - RNA, 20 nt, Chlamydophila pneumoniae J138
uuacuuucuuuuagcuacuu

SEQ ID NO: 2556985 - RNA, 15 nt, Chlamydophila pneumoniae J138
uuagaaaagauaaaa

SEQ ID NO: 2556986 - RNA, 12 nt, Chlamydophila pneumoniae J138
uuagaaagcgca

SEQ ID NO: 2556987 - RNA, 13 nt, Chlamydophila pneumoniae J138
uuagaacuucaau

SEQ ID NO: 2556988 - RNA, 23 nt, Chlamydophila pneumoniae J138
uuagaacuucaaugaaagcugua

SEQ ID NO: 2556989 - RNA, 20 nt, Chlamydophila pneumoniae J138
uuagaagggaaaguaccuuu

SEQ ID NO: 2556990 - RNA, 23 nt, Chlamydophila pneumoniae J138
uuagaaguaauccuaauuccuuc

SEQ ID NO: 2556991 - RNA, 17 nt, Chlamydophila pneumoniae J138
uuagaauaagagcuaca

SEQ ID NO: 2556992 - RNA, 21 nt, Chlamydophila pneumoniae J138
uuagaauagaagauccucaaa

SEQ ID NO: 2556993 - RNA, 16 nt, Chlamydophila pneumoniae J138
uuagaaucuaagaucc

SEQ ID NO: 2556994 - RNA, 14 nt, Chlamydophila pneumoniae J138
uuagaaucuuuucu

SEQ ID NO: 2556995 - RNA, 21 nt, Chlamydophila pneumoniae J138
uuagaaucuuuucuagaaaac

SEQ ID NO: 2556996 - RNA, 22 nt, Chlamydophila pneumoniae J138
uuagacaagacaccgaaagaaa

SEQ ID NO: 2556997 - RNA, 18 nt, Chlamydophila pneumoniae J138
uuagacgugcucucuucu

SEQ ID NO: 2556998 - RNA, 23 nt, Chlamydophila pneumoniae J138
uuagagaaauuuuuaauuuuucu

SEQ ID NO: 2556999 - RNA, 16 nt, Chlamydophila pneumoniae J138
uuagagagaaacaucg

SEQ ID NO: 2557000 - RNA, 21 nt, Chlamydophila pneumoniae J138
uuagagaucguaauguauccu

SEQ ID NO: 2557001 - RNA, 18 nt, Chlamydophila pneumoniae J138
uuagagucgauaaaaacu

SEQ ID NO: 2557002 - RNA, 13 nt, Chlamydophila pneumoniae J138
uuagagugacuca

SEQ ID NO: 2557003 - RNA, 16 nt, Chlamydophila pneumoniae J138
uuagaguuuucuguag

SEQ ID NO: 2557004 - RNA, 22 nt, Chlamydophila pneumoniae J138
uuagcauaaggggagucuugga

SEQ ID NO: 2557005 - RNA, 23 nt, Chlamydophila pneumoniae J138
uuagcauaaggggagucuuggau

SEQ ID NO: 2557006 - RNA, 15 nt, Chlamydophila pneumoniae J138
uuagcauagagcucu

SEQ ID NO: 2557007 - RNA, 20 nt, Chlamydophila pneumoniae J138
uuagcauagagcucuaaaaa

SEQ ID NO: 2557008 - RNA, 23 nt, Chlamydophila pneumoniae J138
uuagcauagagcucuaaaaaaga

SEQ ID NO: 2557009 - RNA, 14 nt, Chlamydophila pneumoniae J138
uuagcaucaucucc

SEQ ID NO: 2557010 - RNA, 17 nt, Chlamydophila pneumoniae J138
uuagcaucaucuccuga

SEQ ID NO: 2557011 - RNA, 13 nt, Chlamydophila pneumoniae J138
uuagcauuucucu

SEQ ID NO: 2557012 - RNA, 16 nt, Chlamydophila pneumoniae J138
uuagccaaaauuuccu

SEQ ID NO: 2557013 - RNA, 14 nt, Chlamydophila pneumoniae J138
uuagcgaucucucu

SEQ ID NO: 2557014 - RNA, 14 nt, Chlamydophila pneumoniae J138
uuagcuucuuuuuu

SEQ ID NO: 2557015 - RNA, 22 nt, Chlamydophila pneumoniae J138
uuaggaucccugauuccuuggc

SEQ ID NO: 2557016 - RNA, 16 nt, Chlamydophila pneumoniae J138
uuaggauucaguuccu

SEQ ID NO: 2557017 - RNA, 19 nt, Chlamydophila pneumoniae J138
uuaggauuucgagauauug

SEQ ID NO: 2557018 - RNA, 14 nt, Chlamydophila pneumoniae J138
uuaggcuuaauaaa

SEQ ID NO: 2557019 - RNA, 20 nt, Chlamydophila pneumoniae J138
uuagggaugguuuccucuau

SEQ ID NO: 2557020 - RNA, 23 nt, Chlamydophila pneumoniae J138
uuagguagauagaaauucuguag

SEQ ID NO: 2557021 - RNA, 12 nt, Chlamydophila pneumoniae J138
uuaggucuuaaa

SEQ ID NO: 2557022 - RNA, 14 nt, Chlamydophila pneumoniae J138
uuaggugaaauauu

SEQ ID NO: 2557023 - RNA, 23 nt, Chlamydophila pneumoniae J138
uuaguaaaugccucuuucauacu

SEQ ID NO: 2557024 - RNA, 18 nt, Chlamydophila pneumoniae J138
uuaguuuaccugaaaaaa

SEQ ID NO: 2557025 - RNA, 12 nt, Chlamydophila pneumoniae J138
uuauaaagaaga

SEQ ID NO: 2557026 - RNA, 13 nt, Chlamydophila pneumoniae J138
uuauaaagaagaa

SEQ ID NO: 2557027 - RNA, 15 nt, Chlamydophila pneumoniae J138
uuauaaagaagaaac

SEQ ID NO: 2557028 - RNA, 14 nt, Chlamydophila pneumoniae J138
uuauacacuccaau

SEQ ID NO: 2557029 - RNA, 17 nt, Chlamydophila pneumoniae J138
ugugggauggucaggaa

SEQ ID NO: 2557030 - RNA, 13 nt, Chlamydophila pneumoniae J138
uguguaaaaguua

SEQ ID NO: 2557031 - RNA, 18 nt, Chlamydophila pneumoniae J138
uguguaugaaucacaucu

SEQ ID NO: 2557032 - RNA, 20 nt, Chlamydophila pneumoniae J138
uguguauuuaagaaaugcaa

SEQ ID NO: 2557033 - RNA, 23 nt, Chlamydophila pneumoniae J138
uguguuuuauccaccaagacuga

SEQ ID NO: 2557034 - RNA, 19 nt, Chlamydophila pneumoniae J138
uguuaacaagauucucagc

SEQ ID NO: 2557035 - RNA, 21 nt, Chlamydophila pneumoniae J138
uguuaacaaguaccaagaaaa

SEQ ID NO: 2557036 - RNA, 23 nt, Chlamydophila pneumoniae J138
uguuaacaaguaccaagaaaaua

SEQ ID NO: 2557037 - RNA, 22 nt, Chlamydophila pneumoniae J138
uguuaagauguggucuuccgua

SEQ ID NO: 2557038 - RNA, 20 nt, Chlamydophila pneumoniae J138
uguuaaggcuuccaaugcua

SEQ ID NO: 2557039 - RNA, 15 nt, Chlamydophila pneumoniae J138
uguuaagggaucucc

SEQ ID NO: 2557040 - RNA, 15 nt, Chlamydophila pneumoniae J138
uguuaauagaagauc

SEQ ID NO: 2557041 - RNA, 20 nt, Chlamydophila pneumoniae J138
uguuaauagaagaucauuaa

SEQ ID NO: 2557042 - RNA, 18 nt, Chlamydophila pneumoniae J138
uguuagaccagggagacc

SEQ ID NO: 2557043 - RNA, 20 nt, Chlamydophila pneumoniae J138
uguuauaagugacuuuucuu

SEQ ID NO: 2557044 - RNA, 17 nt, Chlamydophila pneumoniae J138
uguuaugaguuuuuaau

SEQ ID NO: 2557045 - RNA, 18 nt, Chlamydophila pneumoniae J138
uguuaugaguuuuuaauu

SEQ ID NO: 2557046 - RNA, 14 nt, Chlamydophila pneumoniae J138
uguucaaaaauaga

SEQ ID NO: 2557047 - RNA, 21 nt, Chlamydophila pneumoniae J138
uguucaaaaauagauaagauc

SEQ ID NO: 2557048 - RNA, 13 nt, Chlamydophila pneumoniae J138
uguuccaauagag

SEQ ID NO: 2557049 - RNA, 23 nt, Chlamydophila pneumoniae J138
uguuccauaauuuuagcuucuuu

SEQ ID NO: 2557050 - RNA, 18 nt, Chlamydophila pneumoniae J138
uguucccaaauagaaaau

SEQ ID NO: 2557051 - RNA, 18 nt, Chlamydophila pneumoniae J138
uguucccucuucuuccaa

SEQ ID NO: 2557052 - RNA, 15 nt, Chlamydophila pneumoniae J138
uguucgaguucuuua

SEQ ID NO: 2557053 - RNA, 13 nt, Chlamydophila pneumoniae J138
uguucgauuuucu

SEQ ID NO: 2557054 - RNA, 18 nt, Chlamydophila pneumoniae J138
uguucgcuccuaauggaa

SEQ ID NO: 2557055 - RNA, 17 nt, Chlamydophila pneumoniae J138
uguucuaaagcugcuuc

SEQ ID NO: 2557056 - RNA, 17 nt, Chlamydophila pneumoniae J138
uguucugcacguggcuu

SEQ ID NO: 2557057 - RNA, 21 nt, Chlamydophila pneumoniae J138
uguucugcacguggcuuuugu

SEQ ID NO: 2557058 - RNA, 13 nt, Chlamydophila pneumoniae J138
uguucuuccaacu

SEQ ID NO: 2557059 - RNA, 20 nt, Chlamydophila pneumoniae J138
uguucuucuucagucauucu

SEQ ID NO: 2557060 - RNA, 15 nt, Chlamydophila pneumoniae J138
uguucuuuacuacau

SEQ ID NO: 2557061 - RNA, 21 nt, Chlamydophila pneumoniae J138
uguugauaaaagguauuucuc

SEQ ID NO: 2557062 - RNA, 17 nt, Chlamydophila pneumoniae J138
uguugauccuucuuaug

SEQ ID NO: 2557063 - RNA, 18 nt, Chlamydophila pneumoniae J138
uguugaucucuaaaugga

SEQ ID NO: 2557064 - RNA, 19 nt, Chlamydophila pneumoniae J138
uguugcggauuugcauuac

SEQ ID NO: 2557065 - RNA, 13 nt, Chlamydophila pneumoniae J138
uguugcuuucugu

SEQ ID NO: 2557066 - RNA, 16 nt, Chlamydophila pneumoniae J138
uguuguaauaaaagaa

SEQ ID NO: 2557067 - RNA, 16 nt, Chlamydophila pneumoniae J138
uguugucagcuuugcu

SEQ ID NO: 2557068 - RNA, 15 nt, Chlamydophila pneumoniae J138
uguuguggaucagaa

SEQ ID NO: 2557069 - RNA, 13 nt, Chlamydophila pneumoniae J138
uguuguuuuugcu

SEQ ID NO: 2557070 - RNA, 18 nt, Chlamydophila pneumoniae J138
uguuuagaaaaagaucua

SEQ ID NO: 2557071 - RNA, 21 nt, Chlamydophila pneumoniae J138
uguuuagcauagagcucuaaa

SEQ ID NO: 2557072 - RNA, 15 nt, Chlamydophila pneumoniae J138
uguuuauuuagcauu

SEQ ID NO: 2557073 - RNA, 16 nt, Chlamydophila pneumoniae J138
uguuucaacaccucaa

SEQ ID NO: 2557074 - RNA, 22 nt, Chlamydophila pneumoniae J138
uguuucaacauaacaugagaaa

SEQ ID NO: 2557075 - RNA, 12 nt, Chlamydophila pneumoniae J138
uguuucacuuaa

SEQ ID NO: 2557076 - RNA, 20 nt, Chlamydophila pneumoniae J138
uguuucuagaaaaucucuaa

SEQ ID NO: 2557077 - RNA, 14 nt, Chlamydophila pneumoniae J138
uguuucuucugaau

SEQ ID NO: 2557078 - RNA, 19 nt, Chlamydophila pneumoniae J138
uguuucuucugaauagcuc

SEQ ID NO: 2557079 - RNA, 12 nt, Chlamydophila pneumoniae J138
uguuucuuguag

SEQ ID NO: 2557080 - RNA, 17 nt, Chlamydophila pneumoniae J138
uguuucuuguagcuccc

SEQ ID NO: 2557081 - RNA, 15 nt, Chlamydophila pneumoniae J138
uguuucuuuaucuaa

SEQ ID NO: 2557082 - RNA, 18 nt, Chlamydophila pneumoniae J138
uguuucuuugacuuucau

SEQ ID NO: 2557083 - RNA, 22 nt, Chlamydophila pneumoniae J138
uguuucuuugacuuucauauga

SEQ ID NO: 2557084 - RNA, 21 nt, Chlamydophila pneumoniae J138
uguuuggccaacagcuaauac

SEQ ID NO: 2557085 - RNA, 18 nt, Chlamydophila pneumoniae J138
uguuuuagauggaucuau

SEQ ID NO: 2557086 - RNA, 21 nt, Chlamydophila pneumoniae J138
uguuuuagauggaucuauaag

SEQ ID NO: 2557087 - RNA, 12 nt, Chlamydophila pneumoniae J138
uguuuuauagau

SEQ ID NO: 2557088 - RNA, 12 nt, Chlamydophila pneumoniae J138
uguuuuccagaa

SEQ ID NO: 2557089 - RNA, 12 nt, Chlamydophila pneumoniae J138
uguuuuccugag

SEQ ID NO: 2557090 - RNA, 16 nt, Chlamydophila pneumoniae J138
uguuuucguaaauaug

SEQ ID NO: 2557091 - RNA, 13 nt, Chlamydophila pneumoniae J138
uguuuucuaucag

SEQ ID NO: 2557092 - RNA, 15 nt, Chlamydophila pneumoniae J138
uguuuucuucuaccu

SEQ ID NO: 2557093 - RNA, 21 nt, Chlamydophila pneumoniae J138
uguuuugcuucuauuuuagaa

SEQ ID NO: 2557094 - RNA, 13 nt, Chlamydophila pneumoniae J138
uguuuuucuucca

SEQ ID NO: 2557095 - RNA, 18 nt, Chlamydophila pneumoniae J138
uguuuuucuuccacacaa

SEQ ID NO: 2557096 - RNA, 16 nt, Chlamydophila pneumoniae J138
uguuuuugcugaagau

SEQ ID NO: 2557097 - RNA, 13 nt, Chlamydophila pneumoniae J138
uuaaaaaacuucc

SEQ ID NO: 2557098 - RNA, 19 nt, Chlamydophila pneumoniae J138
uuaaaaaauuaucuccaaa

SEQ ID NO: 2557099 - RNA, 16 nt, Chlamydophila pneumoniae J138
uuaaaaagucugaauc

SEQ ID NO: 2557100 - RNA, 15 nt, Chlamydophila pneumoniae J138
uuaaaaauuuaaaag

SEQ ID NO: 2557101 - RNA, 14 nt, Chlamydophila pneumoniae J138
uuaaaacccauguu

SEQ ID NO: 2557102 - RNA, 15 nt, Chlamydophila pneumoniae J138
uuaaaacccauguuu

SEQ ID NO: 2557103 - RNA, 19 nt, Chlamydophila pneumoniae J138
uuaaaacccauguuucuuc

SEQ ID NO: 2557104 - RNA, 14 nt, Chlamydophila pneumoniae J138
uuaaaaguucagca

SEQ ID NO: 2557105 - RNA, 14 nt, Chlamydophila pneumoniae J138
uuaaaauagacauu

SEQ ID NO: 2557106 - RNA, 13 nt, Chlamydophila pneumoniae J138
uuaaacuaagaau

SEQ ID NO: 2557107 - RNA, 15 nt, Chlamydophila pneumoniae J138
uuaaacuaagaauac

SEQ ID NO: 2557108 - RNA, 15 nt, Chlamydophila pneumoniae J138
uuaaagagaaucucc

SEQ ID NO: 2557109 - RNA, 11 nt, Chlamydophila pneumoniae J138
uuaaagagcau

SEQ ID NO: 2557110 - RNA, 24 nt, Chlamydophila pneumoniae J138
uuaaagagcauccuguagccacua

SEQ ID NO: 2557111 - RNA, 17 nt, Chlamydophila pneumoniae J138
uuaaagauuuucauaac

SEQ ID NO: 2557112 - RNA, 14 nt, Chlamydophila pneumoniae J138
uuaaagcaaaaauu

SEQ ID NO: 2557113 - RNA, 16 nt, Chlamydophila pneumoniae J138
uuaaagcuugagaaaa

SEQ ID NO: 2557114 - RNA, 15 nt, Chlamydophila pneumoniae J138
uuaaagguaaaacua

SEQ ID NO: 2557115 - RNA, 17 nt, Chlamydophila pneumoniae J138
uuaaaguccaagaucaa

SEQ ID NO: 2557116 - RNA, 17 nt, Chlamydophila pneumoniae J138
uuaaaguggcaaucuuu

SEQ ID NO: 2557117 - RNA, 21 nt, Chlamydophila pneumoniae J138
uuaaaguuaaacaaaguagga

SEQ ID NO: 2557118 - RNA, 22 nt, Chlamydophila pneumoniae J138
uuaaaucguacuucacuucuga

SEQ ID NO: 2557119 - RNA, 17 nt, Chlamydophila pneumoniae J138
uuaaauuaucagagaca

SEQ ID NO: 2557120 - RNA, 17 nt, Chlamydophila pneumoniae J138
uuaaauuuccaaagauc

SEQ ID NO: 2557121 - RNA, 18 nt, Chlamydophila pneumoniae J138
uuaaauuuuguuuuucca

SEQ ID NO: 2557122 - RNA, 13 nt, Chlamydophila pneumoniae J138
uuaacaacaucac

SEQ ID NO: 2557123 - RNA, 17 nt, Chlamydophila pneumoniae J138
uuaacaaguaccaagaa

SEQ ID NO: 2557124 - RNA, 19 nt, Chlamydophila pneumoniae J138
uuaacaaguaccaagaaaa

SEQ ID NO: 2557125 - RNA, 13 nt, Chlamydophila pneumoniae J138
uuaacagagcgcc

SEQ ID NO: 2557126 - RNA, 14 nt, Chlamydophila pneumoniae J138
uuaacccaccagaa

SEQ ID NO: 2557127 - RNA, 15 nt, Chlamydophila pneumoniae J138
uuaacccaccagaag

SEQ ID NO: 2557128 - RNA, 19 nt, Chlamydophila pneumoniae J138
uuaaccgagcuuuuugcuu

SEQ ID NO: 2557129 - RNA, 14 nt, Chlamydophila pneumoniae J138
uuaaccucuuuucu

SEQ ID NO: 2557130 - RNA, 16 nt, Chlamydophila pneumoniae J138
uuaacgcuaagcucuu

SEQ ID NO: 2557131 - RNA, 19 nt, Chlamydophila pneumoniae J138
uuaucaugagaauuuucau

SEQ ID NO: 2557132 - RNA, 17 nt, Chlamydophila pneumoniae J138
uuauccaccaagacuga

SEQ ID NO: 2557133 - RNA, 21 nt, Chlamydophila pneumoniae J138
uuauccaccaagacugaauau

SEQ ID NO: 2557134 - RNA, 15 nt, Chlamydophila pneumoniae J138
uuaucccaaacuucu

SEQ ID NO: 2557135 - RNA, 18 nt, Chlamydophila pneumoniae J138
uuaucccagauaaagaca

SEQ ID NO: 2557136 - RNA, 22 nt, Chlamydophila pneumoniae J138
uuauccccuauaguagaagaaa

SEQ ID NO: 2557137 - RNA, 19 nt, Chlamydophila pneumoniae J138
uuauccugaacaucuccag

SEQ ID NO: 2557138 - RNA, 21 nt, Chlamydophila pneumoniae J138
uuauccugaacaucuccagca

SEQ ID NO: 2557139 - RNA, 18 nt, Chlamydophila pneumoniae J138
uuaucgggggugccaaaa

SEQ ID NO: 2557140 - RNA, 20 nt, Chlamydophila pneumoniae J138
uuaucgggggugccaaaaaa

SEQ ID NO: 2557141 - RNA, 19 nt, Chlamydophila pneumoniae J138
uuaucgugacucuuaucug

SEQ ID NO: 2557142 - RNA, 19 nt, Chlamydophila pneumoniae J138
uuaucuaagaauauggaca

SEQ ID NO: 2557143 - RNA, 14 nt, Chlamydophila pneumoniae J138
uuaucuagcucuuc

SEQ ID NO: 2557144 - RNA, 15 nt, Chlamydophila pneumoniae J138
uuaucuagcucuuca

SEQ ID NO: 2557145 - RNA, 21 nt, Chlamydophila pneumoniae J138
uuaucuaggucgauaucccac

SEQ ID NO: 2557146 - RNA, 13 nt, Chlamydophila pneumoniae J138
uuaucucccaaga

SEQ ID NO: 2557147 - RNA, 22 nt, Chlamydophila pneumoniae J138
uuaucucccaagacgagaacau

SEQ ID NO: 2557148 - RNA, 19 nt, Chlamydophila pneumoniae J138
uuaucuccccauucacaaa

SEQ ID NO: 2557149 - RNA, 19 nt, Chlamydophila pneumoniae J138
uuaucugcguuucuuucug

SEQ ID NO: 2557150 - RNA, 17 nt, Chlamydophila pneumoniae J138
uuaucuggagaugcgcu

SEQ ID NO: 2557151 - RNA, 15 nt, Chlamydophila pneumoniae J138
uuaucuguuaaaaac

SEQ ID NO: 2557152 - RNA, 15 nt, Chlamydophila pneumoniae J138
uuaugaguuuuuaau

SEQ ID NO: 2557153 - RNA, 20 nt, Chlamydophila pneumoniae J138
uuaugaguuuuuaauuuucu

SEQ ID NO: 2557154 - RNA, 20 nt, Chlamydophila pneumoniae J138
uuauggaugcuaaauuuguc

SEQ ID NO: 2557155 - RNA, 22 nt, Chlamydophila pneumoniae J138
uuauguagaucauaaacagcag

SEQ ID NO: 2557156 - RNA, 21 nt, Chlamydophila pneumoniae J138
uuauguagaucuacaagacua

SEQ ID NO: 2557157 - RNA, 21 nt, Chlamydophila pneumoniae J138
uuauguagauugauccagccc

SEQ ID NO: 2557158 - RNA, 21 nt, Chlamydophila pneumoniae J138
uuauguuaaaaauaccaagau

SEQ ID NO: 2557159 - RNA, 22 nt, Chlamydophila pneumoniae J138
uuauguuaaaaauaccaagaug

SEQ ID NO: 2557160 - RNA, 16 nt, Chlamydophila pneumoniae J138
uuauguuuucucgaag

SEQ ID NO: 2557161 - RNA, 20 nt, Chlamydophila pneumoniae J138
uuauguuuucucgaagaaaa

SEQ ID NO: 2557162 - RNA, 22 nt, Chlamydophila pneumoniae J138
uuauguuuucucgaagaaaaua

SEQ ID NO: 2557163 - RNA, 11 nt, Chlamydophila pneumoniae J138
uuauuaaaauc

SEQ ID NO: 2557164 - RNA, 15 nt, Chlamydophila pneumoniae J138
uuauuaucaaaguga

SEQ ID NO: 2557165 - RNA, 21 nt, Chlamydophila pneumoniae J138
uuauucccuaagguagagucc

SEQ ID NO: 2557166 - RNA, 17 nt, Chlamydophila pneumoniae J138
uuauugauaaugauucc

SEQ ID NO: 2557167 - RNA, 14 nt, Chlamydophila pneumoniae J138
uuauuguucuuggu

SEQ ID NO: 2557168 - RNA, 15 nt, Chlamydophila pneumoniae J138
uuauuuaaaauuucu

SEQ ID NO: 2557169 - RNA, 21 nt, Chlamydophila pneumoniae J138
uuauuucuaaaaaauagauaa

SEQ ID NO: 2557170 - RNA, 22 nt, Chlamydophila pneumoniae J138
uuauuuggacguacuaagauac

SEQ ID NO: 2557171 - RNA, 13 nt, Chlamydophila pneumoniae J138
uuauuuuaaaguc

SEQ ID NO: 2557172 - RNA, 15 nt, Chlamydophila pneumoniae J138
uuauuuuaaagucac

SEQ ID NO: 2557173 - RNA, 18 nt, Chlamydophila pneumoniae J138
uuauuuuaaagucacuuu

SEQ ID NO: 2557174 - RNA, 22 nt, Chlamydophila pneumoniae J138
uuauuuuaggaggaguauagca

SEQ ID NO: 2557175 - RNA, 14 nt, Chlamydophila pneumoniae J138
uuauuuuuaaauaa

SEQ ID NO: 2557176 - RNA, 13 nt, Chlamydophila pneumoniae J138
uucaaaagaaaag

SEQ ID NO: 2557177 - RNA, 14 nt, Chlamydophila pneumoniae J138
uucaaaagaaaaga

SEQ ID NO: 2557178 - RNA, 15 nt, Chlamydophila pneumoniae J138
uucaaaauagaagcc

SEQ ID NO: 2557179 - RNA, 17 nt, Chlamydophila pneumoniae J138
uucaaaauagaagccac

SEQ ID NO: 2557180 - RNA, 13 nt, Chlamydophila pneumoniae J138
uucaaacuccuuu

SEQ ID NO: 2557181 - RNA, 18 nt, Chlamydophila pneumoniae J138
uucaaacuccuuuuaaaa

SEQ ID NO: 2557182 - RNA, 12 nt, Chlamydophila pneumoniae J138
uucaaagauaua

SEQ ID NO: 2557183 - RNA, 22 nt, Chlamydophila pneumoniae J138
uucaaagauauagauucaugaa

SEQ ID NO: 2557184 - RNA, 12 nt, Chlamydophila pneumoniae J138
uucaaagauugc

SEQ ID NO: 2557185 - RNA, 12 nt, Chlamydophila pneumoniae J138
uucaaagccauu

SEQ ID NO: 2557186 - RNA, 14 nt, Chlamydophila pneumoniae J138
uucaaagucaaaua

SEQ ID NO: 2557187 - RNA, 21 nt, Chlamydophila pneumoniae J138
uucaaauauugcgaacuuuug

SEQ ID NO: 2557188 - RNA, 18 nt, Chlamydophila pneumoniae J138
uucaaaucaucaaaaaga

SEQ ID NO: 2557189 - RNA, 19 nt, Chlamydophila pneumoniae J138
uucaaaucaucaaaaagau

SEQ ID NO: 2557190 - RNA, 17 nt, Chlamydophila pneumoniae J138
uucaaauuugcucuccu

SEQ ID NO: 2557191 - RNA, 16 nt, Chlamydophila pneumoniae J138
uucaaccaaacgucag

SEQ ID NO: 2557192 - RNA, 20 nt, Chlamydophila pneumoniae J138
uucaacucuaucgaagagcc

SEQ ID NO: 2557193 - RNA, 21 nt, Chlamydophila pneumoniae J138
uucaacuuuguuaauagaaga

SEQ ID NO: 2557194 - RNA, 23 nt, Chlamydophila pneumoniae J138
uucaacuuuguuaauagaagauc

SEQ ID NO: 2557195 - RNA, 12 nt, Chlamydophila pneumoniae J138
uucaagcuuucg

SEQ ID NO: 2557196 - RNA, 20 nt, Chlamydophila pneumoniae J138
uucaagguacuuuauagaaa

SEQ ID NO: 2557197 - RNA, 19 nt, Chlamydophila pneumoniae J138
uucaagucgagaaacaaaa

SEQ ID NO: 2557198 - RNA, 13 nt, Chlamydophila pneumoniae J138
uucaagucuguaa

SEQ ID NO: 2557199 - RNA, 12 nt, Chlamydophila pneumoniae J138
uucaaguuucuu

SEQ ID NO: 2557200 - RNA, 23 nt, Chlamydophila pneumoniae J138
uucaauaauaucgguuccuauau

SEQ ID NO: 2557201 - RNA, 21 nt, Chlamydophila pneumoniae J138
uucaauaauuucaaagaugca

SEQ ID NO: 2557202 - RNA, 21 nt, Chlamydophila pneumoniae J138
uucaauacgcuagcucuuaaa

SEQ ID NO: 2557203 - RNA, 22 nt, Chlamydophila pneumoniae J138
uucaauacgcuagcucuuaaau

SEQ ID NO: 2557204 - RNA, 19 nt, Chlamydophila pneumoniae J138
uucaauagcaaagauuucu

SEQ ID NO: 2557205 - RNA, 23 nt, Chlamydophila pneumoniae J138
uucaauaggaauuagagaaauuu

SEQ ID NO: 2557206 - RNA, 13 nt, Chlamydophila pneumoniae J138
uucaaucucuccu

SEQ ID NO: 2557207 - RNA, 19 nt, Chlamydophila pneumoniae J138
uucaaucucuccuugacaa

SEQ ID NO: 2557208 - RNA, 13 nt, Chlamydophila pneumoniae J138
uucaaugaaagcu

SEQ ID NO: 2557209 - RNA, 21 nt, Chlamydophila pneumoniae J138
uucaaugauuucuuuagcuuu

SEQ ID NO: 2557210 - RNA, 14 nt, Chlamydophila pneumoniae J138
uucaauguaauugc

SEQ ID NO: 2557211 - RNA, 22 nt, Chlamydophila pneumoniae J138
uucaauuacaggagcuagaaga

SEQ ID NO: 2557212 - RNA, 12 nt, Chlamydophila pneumoniae J138
uucaauuucuau

SEQ ID NO: 2557213 - RNA, 23 nt, Chlamydophila pneumoniae J138
uucacaaaucuuccccuaaaaau

SEQ ID NO: 2557214 - RNA, 15 nt, Chlamydophila pneumoniae J138
uucacaagaaaacaa

SEQ ID NO: 2557215 - RNA, 17 nt, Chlamydophila pneumoniae J138
uucacauacauucuauu

SEQ ID NO: 2557216 - RNA, 17 nt, Chlamydophila pneumoniae J138
uucacauaguuuaauaa

SEQ ID NO: 2557217 - RNA, 21 nt, Chlamydophila pneumoniae J138
uucacaucuuucucuaaaaua

SEQ ID NO: 2557218 - RNA, 22 nt, Chlamydophila pneumoniae J138
uucaccacaaaccucuaaaaac

SEQ ID NO: 2557219 - RNA, 20 nt, Chlamydophila pneumoniae J138
uucaccagaagcauugagga

SEQ ID NO: 2557220 - RNA, 16 nt, Chlamydophila pneumoniae J138
uucaccauuaagauau

SEQ ID NO: 2557221 - RNA, 22 nt, Chlamydophila pneumoniae J138
uucacccucauuaagaggaguc

SEQ ID NO: 2557222 - RNA, 15 nt, Chlamydophila pneumoniae J138
uucacgacauacauc

SEQ ID NO: 2557223 - RNA, 23 nt, Chlamydophila pneumoniae J138
uucacgacauacaucaaaaugcu

SEQ ID NO: 2557224 - RNA, 20 nt, Chlamydophila pneumoniae J138
uguaaaaacuguguuuucua

SEQ ID NO: 2557225 - RNA, 14 nt, Chlamydophila pneumoniae J138
uguaaaaguagcau

SEQ ID NO: 2557226 - RNA, 11 nt, Chlamydophila pneumoniae J138
uguaaaaguua

SEQ ID NO: 2557227 - RNA, 23 nt, Chlamydophila pneumoniae J138
uguaaagagcaacaguaauuauu

SEQ ID NO: 2557228 - RNA, 16 nt, Chlamydophila pneumoniae J138
uguaaauacaaaacaa

SEQ ID NO: 2557229 - RNA, 20 nt, Chlamydophila pneumoniae J138
uguaaauaguauacaagcga

SEQ ID NO: 2557230 - RNA, 17 nt, Chlamydophila pneumoniae J138
uguaaaugucgguuugu

SEQ ID NO: 2557231 - RNA, 14 nt, Chlamydophila pneumoniae J138
uguaaauuucauuu

SEQ ID NO: 2557232 - RNA, 21 nt, Chlamydophila pneumoniae J138
uguaaccaacaucaaagaauu

SEQ ID NO: 2557233 - RNA, 11 nt, Chlamydophila pneumoniae J138
uguaacucaag

SEQ ID NO: 2557234 - RNA, 19 nt, Chlamydophila pneumoniae J138
uguaagaaggcagagaacu

SEQ ID NO: 2557235 - RNA, 17 nt, Chlamydophila pneumoniae J138
uguaagacuaaaaaaga

SEQ ID NO: 2557236 - RNA, 16 nt, Chlamydophila pneumoniae J138
uguaagcgugcaaguu

SEQ ID NO: 2557237 - RNA, 18 nt, Chlamydophila pneumoniae J138
uguaauaaaagaacauua

SEQ ID NO: 2557238 - RNA, 20 nt, Chlamydophila pneumoniae J138
uguaaucauaaaaaaagcua

SEQ ID NO: 2557239 - RNA, 14 nt, Chlamydophila pneumoniae J138
uguaauuuuuucau

SEQ ID NO: 2557240 - RNA, 16 nt, Chlamydophila pneumoniae J138
uguaauuuuuuucaaa

SEQ ID NO: 2557241 - RNA, 16 nt, Chlamydophila pneumoniae J138
uguacaauuugcuccu

SEQ ID NO: 2557242 - RNA, 13 nt, Chlamydophila pneumoniae J138
uguacacagagau

SEQ ID NO: 2557243 - RNA, 21 nt, Chlamydophila pneumoniae J138
uguacgguaaauccauuuggg

SEQ ID NO: 2557244 - RNA, 21 nt, Chlamydophila pneumoniae J138
uguacuagauaguucacaagu

SEQ ID NO: 2557245 - RNA, 22 nt, Chlamydophila pneumoniae J138
uguacuuccccaaacauggaca

SEQ ID NO: 2557246 - RNA, 18 nt, Chlamydophila pneumoniae J138
uguacuugauauuguucu

SEQ ID NO: 2557247 - RNA, 21 nt, Chlamydophila pneumoniae J138
uguagacaauaccagauaaag

SEQ ID NO: 2557248 - RNA, 12 nt, Chlamydophila pneumoniae J138
uguagauuuucc

SEQ ID NO: 2557249 - RNA, 17 nt, Chlamydophila pneumoniae J138
uguagcagcaagaacau

SEQ ID NO: 2557250 - RNA, 17 nt, Chlamydophila pneumoniae J138
uguagccuuucuuuuua

SEQ ID NO: 2557251 - RNA, 21 nt, Chlamydophila pneumoniae J138
uguaggaacaugccaaauauc

SEQ ID NO: 2557252 - RNA, 14 nt, Chlamydophila pneumoniae J138
uguaguaaauuccu

SEQ ID NO: 2557253 - RNA, 16 nt, Chlamydophila pneumoniae J138
uguaguaaauuccucu

SEQ ID NO: 2557254 - RNA, 13 nt, Chlamydophila pneumoniae J138
uguaguucuugcc

SEQ ID NO: 2557255 - RNA, 21 nt, Chlamydophila pneumoniae J138
uguaguucuuugaauuuccaa

SEQ ID NO: 2557256 - RNA, 20 nt, Chlamydophila pneumoniae J138
uguaguuucuaaaacagaaa

SEQ ID NO: 2557257 - RNA, 20 nt, Chlamydophila pneumoniae J138
uguaguuugggaugacuggc

SEQ ID NO: 2557258 - RNA, 16 nt, Chlamydophila pneumoniae J138
uguaguuuguucacuu

SEQ ID NO: 2557259 - RNA, 23 nt, Chlamydophila pneumoniae J138
uguauaaacuccacgaauucuuu

SEQ ID NO: 2557260 - RNA, 23 nt, Chlamydophila pneumoniae J138
uguauaacaucuaaaaaugcacu

SEQ ID NO: 2557261 - RNA, 15 nt, Chlamydophila pneumoniae J138
uguauacauaucucc

SEQ ID NO: 2557262 - RNA, 23 nt, Chlamydophila pneumoniae J138
uguauacauaucuccuuuaaaua

SEQ ID NO: 2557263 - RNA, 16 nt, Chlamydophila pneumoniae J138
uguauaugcuuggcaa

SEQ ID NO: 2557264 - RNA, 22 nt, Chlamydophila pneumoniae J138
uguauaugcuuggcaauagcuu

SEQ ID NO: 2557265 - RNA, 13 nt, Chlamydophila pneumoniae J138
uguauauucugaa

SEQ ID NO: 2557266 - RNA, 14 nt, Chlamydophila pneumoniae J138
uguauauucugaaa

SEQ ID NO: 2557267 - RNA, 15 nt, Chlamydophila pneumoniae J138
uguauccagcucaag

SEQ ID NO: 2557268 - RNA, 18 nt, Chlamydophila pneumoniae J138
uguauccagcucaaggca

SEQ ID NO: 2557269 - RNA, 22 nt, Chlamydophila pneumoniae J138
uguaucgauaacgauuucuuga

SEQ ID NO: 2557270 - RNA, 16 nt, Chlamydophila pneumoniae J138
uguaucuguauccuuc

SEQ ID NO: 2557271 - RNA, 15 nt, Chlamydophila pneumoniae J138
uguauggcagccugg

SEQ ID NO: 2557272 - RNA, 13 nt, Chlamydophila pneumoniae J138
uguaugugaaaga

SEQ ID NO: 2557273 - RNA, 18 nt, Chlamydophila pneumoniae J138
uguauucagugucuugaa

SEQ ID NO: 2557274 - RNA, 13 nt, Chlamydophila pneumoniae J138
uguauugggaaug

SEQ ID NO: 2557275 - RNA, 18 nt, Chlamydophila pneumoniae J138
uguauuguguucccucuu

SEQ ID NO: 2557276 - RNA, 19 nt, Chlamydophila pneumoniae J138
uguauuugcagaagcauug

SEQ ID NO: 2557277 - RNA, 15 nt, Chlamydophila pneumoniae J138
uguauuuucuucaac

SEQ ID NO: 2557278 - RNA, 20 nt, Chlamydophila pneumoniae J138
ugucaaguaagucuucgaaa

SEQ ID NO: 2557279 - RNA, 14 nt, Chlamydophila pneumoniae J138
ugucacuagagaaa

SEQ ID NO: 2557280 - RNA, 19 nt, Chlamydophila pneumoniae J138
ugucacuaucuucuaaaac

SEQ ID NO: 2557281 - RNA, 12 nt, Chlamydophila pneumoniae J138
ugucagaacaag

SEQ ID NO: 2557282 - RNA, 18 nt, Chlamydophila pneumoniae J138
ugucaucggcuucuccaa

SEQ ID NO: 2557283 - RNA, 20 nt, Chlamydophila pneumoniae J138
ugucauuaaaaauuuaaaag

SEQ ID NO: 2557284 - RNA, 18 nt, Chlamydophila pneumoniae J138
uguccagagacaaagcca

SEQ ID NO: 2557285 - RNA, 19 nt, Chlamydophila pneumoniae J138
uguccaugcacgagauucu

SEQ ID NO: 2557286 - RNA, 21 nt, Chlamydophila pneumoniae J138
ugucccauggcuggaaagcca

SEQ ID NO: 2557287 - RNA, 13 nt, Chlamydophila pneumoniae J138
uguccguauuuuu

SEQ ID NO: 2557288 - RNA, 17 nt, Chlamydophila pneumoniae J138
uguccgugagcaacaag

SEQ ID NO: 2557289 - RNA, 21 nt, Chlamydophila pneumoniae J138
uguccuccauggaaagaaaca

SEQ ID NO: 2557290 - RNA, 17 nt, Chlamydophila pneumoniae J138
uguccuguuaagaugug

SEQ ID NO: 2557291 - RNA, 18 nt, Chlamydophila pneumoniae J138
ugucgcuuuugcuagaga

SEQ ID NO: 2557292 - RNA, 15 nt, Chlamydophila pneumoniae J138
ugucguaauaacccc

SEQ ID NO: 2557293 - RNA, 13 nt, Chlamydophila pneumoniae J138
ugucguuaaaaac

SEQ ID NO: 2557294 - RNA, 14 nt, Chlamydophila pneumoniae J138
ugucuaaagauugg

SEQ ID NO: 2557295 - RNA, 18 nt, Chlamydophila pneumoniae J138
ugucuaggagcuucgccu

SEQ ID NO: 2557296 - RNA, 20 nt, Chlamydophila pneumoniae J138
ugucuagugaagcugcuucu

SEQ ID NO: 2557297 - RNA, 23 nt, Chlamydophila pneumoniae J138
ugucuauuucuuaauuuccuucu

SEQ ID NO: 2557298 - RNA, 14 nt, Chlamydophila pneumoniae J138
ugucuccaaagaua

SEQ ID NO: 2557299 - RNA, 21 nt, Chlamydophila pneumoniae J138
ugucuccaaauguucucucca

SEQ ID NO: 2557300 - RNA, 15 nt, Chlamydophila pneumoniae J138
ugucuccauacagcg

SEQ ID NO: 2557301 - RNA, 19 nt, Chlamydophila pneumoniae J138
ugucucugaagaccccucu

SEQ ID NO: 2557302 - RNA, 17 nt, Chlamydophila pneumoniae J138
ugucugcaaagagcaaa

SEQ ID NO: 2557303 - RNA, 15 nt, Chlamydophila pneumoniae J138
ugucuuaaagcacua

SEQ ID NO: 2557304 - RNA, 13 nt, Chlamydophila pneumoniae J138
ugucuuaucuaaa

SEQ ID NO: 2557305 - RNA, 22 nt, Chlamydophila pneumoniae J138
ugucuugaagagauugauuucu

SEQ ID NO: 2557306 - RNA, 15 nt, Chlamydophila pneumoniae J138
ugucuugcugauuuu

SEQ ID NO: 2557307 - RNA, 12 nt, Chlamydophila pneumoniae J138
ugucuuuccagg

SEQ ID NO: 2557308 - RNA, 12 nt, Chlamydophila pneumoniae J138
ugucuuuuuaag

SEQ ID NO: 2557309 - RNA, 15 nt, Chlamydophila pneumoniae J138
ugugacgacaaauca

SEQ ID NO: 2557310 - RNA, 15 nt, Chlamydophila pneumoniae J138
ugugaguucuuccuu

SEQ ID NO: 2557311 - RNA, 23 nt, Chlamydophila pneumoniae J138
ugugauaccuccuccaaucugcu

SEQ ID NO: 2557312 - RNA, 14 nt, Chlamydophila pneumoniae J138
ugugauauucuugg

SEQ ID NO: 2557313 - RNA, 20 nt, Chlamydophila pneumoniae J138
ugugauccuugcaaaacagc

SEQ ID NO: 2557314 - RNA, 15 nt, Chlamydophila pneumoniae J138
ugugcaauaggaaaa

SEQ ID NO: 2557315 - RNA, 21 nt, Chlamydophila pneumoniae J138
ugugcacccaaucgguaugau

SEQ ID NO: 2557316 - RNA, 22 nt, Chlamydophila pneumoniae J138
ugugcacccaaucgguaugaua

SEQ ID NO: 2557317 - RNA, 12 nt, Chlamydophila pneumoniae J138
ugugcaucaguc

SEQ ID NO: 2557318 - RNA, 15 nt, Chlamydophila pneumoniae J138
ugugcauuuucuucu

SEQ ID NO: 2557319 - RNA, 16 nt, Chlamydophila pneumoniae J138
ugugcauuuucuucuu

SEQ ID NO: 2557320 - RNA, 14 nt, Chlamydophila pneumoniae J138
ugugccagaauaua

SEQ ID NO: 2557321 - RNA, 22 nt, Chlamydophila pneumoniae J138
ugugcgcacaagggauucuugu

SEQ ID NO: 2557322 - RNA, 17 nt, Chlamydophila pneumoniae J138
ugugcggcgagcucuag

SEQ ID NO: 2557323 - RNA, 17 nt, Chlamydophila pneumoniae J138
ugugcucaauacagaua

SEQ ID NO: 2557324 - RNA, 18 nt, Chlamydophila pneumoniae J138
uguggaauaucaggacaa

SEQ ID NO: 2557325 - RNA, 23 nt, Chlamydophila pneumoniae J138
ugcggaugugccgugacuccaga

SEQ ID NO: 2557326 - RNA, 15 nt, Chlamydophila pneumoniae J138
ugcggauuugcauua

SEQ ID NO: 2557327 - RNA, 21 nt, Chlamydophila pneumoniae J138
ugcggcaaguaucucaucacg

SEQ ID NO: 2557328 - RNA, 15 nt, Chlamydophila pneumoniae J138
ugcgggcucaaagaa

SEQ ID NO: 2557329 - RNA, 21 nt, Chlamydophila pneumoniae J138
ugcguauagauccaagaauga

SEQ ID NO: 2557330 - RNA, 17 nt, Chlamydophila pneumoniae J138
ugcgucacauuuguugu

SEQ ID NO: 2557331 - RNA, 18 nt, Chlamydophila pneumoniae J138
ugcgucuuuaauuaaaag

SEQ ID NO: 2557332 - RNA, 12 nt, Chlamydophila pneumoniae J138
ugcguuuccaug

SEQ ID NO: 2557333 - RNA, 18 nt, Chlamydophila pneumoniae J138
ugcguuugagcuaagucu

SEQ ID NO: 2557334 - RNA, 16 nt, Chlamydophila pneumoniae J138
ugcuaaaacuaaaguu

SEQ ID NO: 2557335 - RNA, 20 nt, Chlamydophila pneumoniae J138
ugcuaaacaaugcaaaauaa

SEQ ID NO: 2557336 - RNA, 17 nt, Chlamydophila pneumoniae J138
ugcuaaacuuuuuuuca

SEQ ID NO: 2557337 - RNA, 20 nt, Chlamydophila pneumoniae J138
ugcuaaacuuuuuuucaaau

SEQ ID NO: 2557338 - RNA, 13 nt, Chlamydophila pneumoniae J138
ugcuaaauuuguc

SEQ ID NO: 2557339 - RNA, 17 nt, Chlamydophila pneumoniae J138
ugcuaagaucuuuagaa

SEQ ID NO: 2557340 - RNA, 17 nt, Chlamydophila pneumoniae J138
ugcuaagccaaauacca

SEQ ID NO: 2557341 - RNA, 20 nt, Chlamydophila pneumoniae J138
ugcuaagcgaaccaaaguca

SEQ ID NO: 2557342 - RNA, 15 nt, Chlamydophila pneumoniae J138
ugcuacaaacucuuc

SEQ ID NO: 2557343 - RNA, 13 nt, Chlamydophila pneumoniae J138
ugcuacagcuucu

SEQ ID NO: 2557344 - RNA, 17 nt, Chlamydophila pneumoniae J138
ugcuacagcuucuuuuc

SEQ ID NO: 2557345 - RNA, 19 nt, Chlamydophila pneumoniae J138
ugcuacuguccauccaaau

SEQ ID NO: 2557346 - RNA, 20 nt, Chlamydophila pneumoniae J138
ugcuacuuuaaaguggcaau

SEQ ID NO: 2557347 - RNA, 18 nt, Chlamydophila pneumoniae J138
ugcuaucuccagaaauuu

SEQ ID NO: 2557348 - RNA, 14 nt, Chlamydophila pneumoniae J138
ugcuauuuacugaa

SEQ ID NO: 2557349 - RNA, 15 nt, Chlamydophila pneumoniae J138
ugcuauuuuccucua

SEQ ID NO: 2557350 - RNA, 23 nt, Chlamydophila pneumoniae J138
ugcucaauacagauaucaaagca

SEQ ID NO: 2557351 - RNA, 15 nt, Chlamydophila pneumoniae J138
ugcucacuucuuugc

SEQ ID NO: 2557352 - RNA, 20 nt, Chlamydophila pneumoniae J138
ugcucaggagauacaaguaa

SEQ ID NO: 2557353 - RNA, 18 nt, Chlamydophila pneumoniae J138
ugcuccagaaacgcagcu

SEQ ID NO: 2557354 - RNA, 23 nt, Chlamydophila pneumoniae J138
ugcuccuaagugauaaggaagaa

SEQ ID NO: 2557355 - RNA, 15 nt, Chlamydophila pneumoniae J138
ugcucggacagaaag

SEQ ID NO: 2557356 - RNA, 18 nt, Chlamydophila pneumoniae J138
ugcucggacagaaagauu

SEQ ID NO: 2557357 - RNA, 16 nt, Chlamydophila pneumoniae J138
ugcucgugcgacugcu

SEQ ID NO: 2557358 - RNA, 17 nt, Chlamydophila pneumoniae J138
ugcucuaaguugauacu

SEQ ID NO: 2557359 - RNA, 16 nt, Chlamydophila pneumoniae J138
ugcucuaccaacugag

SEQ ID NO: 2557360 - RNA, 16 nt, Chlamydophila pneumoniae J138
ugcucuagucuuucaa

SEQ ID NO: 2557361 - RNA, 19 nt, Chlamydophila pneumoniae J138
ugcucuccugcaaaaaguu

SEQ ID NO: 2557362 - RNA, 17 nt, Chlamydophila pneumoniae J138
ugcucucuacuucugua

SEQ ID NO: 2557363 - RNA, 15 nt, Chlamydophila pneumoniae J138
ugcucucuucuucuc

SEQ ID NO: 2557364 - RNA, 14 nt, Chlamydophila pneumoniae J138
ugcucugacaagug

SEQ ID NO: 2557365 - RNA, 15 nt, Chlamydophila pneumoniae J138
ugcucugacaagugu

SEQ ID NO: 2557366 - RNA, 16 nt, Chlamydophila pneumoniae J138
ugcucuguauuggaaa

SEQ ID NO: 2557367 - RNA, 22 nt, Chlamydophila pneumoniae J138
ugcucuuuuaacuuaaagacuu

SEQ ID NO: 2557368 - RNA, 14 nt, Chlamydophila pneumoniae J138
ugcucuuuugcaag

SEQ ID NO: 2557369 - RNA, 22 nt, Chlamydophila pneumoniae J138
ugcugaaccuuugguagaaaga

SEQ ID NO: 2557370 - RNA, 17 nt, Chlamydophila pneumoniae J138
ugcugaagauuuuuucu

SEQ ID NO: 2557371 - RNA, 21 nt, Chlamydophila pneumoniae J138
ugcugaagauuuuuucuuggu

SEQ ID NO: 2557372 - RNA, 14 nt, Chlamydophila pneumoniae J138
ugcugaagggacag

SEQ ID NO: 2557373 - RNA, 13 nt, Chlamydophila pneumoniae J138
ugcugaauuccuc

SEQ ID NO: 2557374 - RNA, 21 nt, Chlamydophila pneumoniae J138
ugcugacagcuccauuuaaau

SEQ ID NO: 2557375 - RNA, 21 nt, Chlamydophila pneumoniae J138
ugcugaggacgcagagaugcu

SEQ ID NO: 2557376 - RNA, 20 nt, Chlamydophila pneumoniae J138
ugcugagggaucuucucuau

SEQ ID NO: 2557377 - RNA, 21 nt, Chlamydophila pneumoniae J138
ugcugagggaucuucucuaug

SEQ ID NO: 2557378 - RNA, 18 nt, Chlamydophila pneumoniae J138
ugcugauuucuuuuucag

SEQ ID NO: 2557379 - RNA, 23 nt, Chlamydophila pneumoniae J138
ugcugcagcaaaacuaggaaaag

SEQ ID NO: 2557380 - RNA, 15 nt, Chlamydophila pneumoniae J138
ugcugccaugacaua

SEQ ID NO: 2557381 - RNA, 20 nt, Chlamydophila pneumoniae J138
ugcugccaugacauaggcaa

SEQ ID NO: 2557382 - RNA, 10 nt, Chlamydophila pneumoniae J138
ugcugcccaa

SEQ ID NO: 2557383 - RNA, 12 nt, Chlamydophila pneumoniae J138
ugcugcucucca

SEQ ID NO: 2557384 - RNA, 13 nt, Chlamydophila pneumoniae J138
ugcugcucuccaa

SEQ ID NO: 2557385 - RNA, 14 nt, Chlamydophila pneumoniae J138
ugcugcuucagaaa

SEQ ID NO: 2557386 - RNA, 21 nt, Chlamydophila pneumoniae J138
ugcugcuuccccuaauagggg

SEQ ID NO: 2557387 - RNA, 20 nt, Chlamydophila pneumoniae J138
ugcuguagauuguuagugag

SEQ ID NO: 2557388 - RNA, 15 nt, Chlamydophila pneumoniae J138
ugcugucagaacaag

SEQ ID NO: 2557389 - RNA, 16 nt, Chlamydophila pneumoniae J138
ugcuguuccauaauuu

SEQ ID NO: 2557390 - RNA, 13 nt, Chlamydophila pneumoniae J138
ugcuguuguaaua

SEQ ID NO: 2557391 - RNA, 17 nt, Chlamydophila pneumoniae J138
ugcuguuguaauaaaag

SEQ ID NO: 2557392 - RNA, 16 nt, Chlamydophila pneumoniae J138
ugcuuaaaauucugua

SEQ ID NO: 2557393 - RNA, 19 nt, Chlamydophila pneumoniae J138
ugcuuaagaguuuuacauc

SEQ ID NO: 2557394 - RNA, 20 nt, Chlamydophila pneumoniae J138
ugcuuagcgaucucucuucc

SEQ ID NO: 2557395 - RNA, 12 nt, Chlamydophila pneumoniae J138
ugcuuauuuccc

SEQ ID NO: 2557396 - RNA, 17 nt, Chlamydophila pneumoniae J138
ugcuucgggaacgugcu

SEQ ID NO: 2557397 - RNA, 18 nt, Chlamydophila pneumoniae J138
ugcuucgggaucuaaaag

SEQ ID NO: 2557398 - RNA, 17 nt, Chlamydophila pneumoniae J138
ugcuucuauuuuagaau

SEQ ID NO: 2557399 - RNA, 12 nt, Chlamydophila pneumoniae J138
ugcuucuccaaa

SEQ ID NO: 2557400 - RNA, 23 nt, Chlamydophila pneumoniae J138
ugcuucuccaaauaaagcaacug

SEQ ID NO: 2557401 - RNA, 18 nt, Chlamydophila pneumoniae J138
ugcuucuguaaagauucu

SEQ ID NO: 2557402 - RNA, 11 nt, Chlamydophila pneumoniae J138
ugcuucuucag

SEQ ID NO: 2557403 - RNA, 14 nt, Chlamydophila pneumoniae J138
ugcuucuucagagu

SEQ ID NO: 2557404 - RNA, 17 nt, Chlamydophila pneumoniae J138
ugcuucuuggcguucca

SEQ ID NO: 2557405 - RNA, 17 nt, Chlamydophila pneumoniae J138
ugcuuggcaauagcuuu

SEQ ID NO: 2557406 - RNA, 22 nt, Chlamydophila pneumoniae J138
ugcuuguauaaaugcuguagau

SEQ ID NO: 2557407 - RNA, 14 nt, Chlamydophila pneumoniae J138
ugcuuguugguuaa

SEQ ID NO: 2557408 - RNA, 20 nt, Chlamydophila pneumoniae J138
ugcuuguugguuaaaauaga

SEQ ID NO: 2557409 - RNA, 15 nt, Chlamydophila pneumoniae J138
ugcuuuaauccugca

SEQ ID NO: 2557410 - RNA, 20 nt, Chlamydophila pneumoniae J138
ugcuuuauggcucaacuuaa

SEQ ID NO: 2557411 - RNA, 23 nt, Chlamydophila pneumoniae J138
ugcuuucaggaguucuugauucu

SEQ ID NO: 2557412 - RNA, 19 nt, Chlamydophila pneumoniae J138
ugcuuugccgccucagcac

SEQ ID NO: 2557413 - RNA, 19 nt, Chlamydophila pneumoniae J138
ugcuuugugaguucuuccu

SEQ ID NO: 2557414 - RNA, 22 nt, Chlamydophila pneumoniae J138
ugcuuugugaguucuuccuucu

SEQ ID NO: 2557415 - RNA, 23 nt, Chlamydophila pneumoniae J138
ugcuuuuagaucccgaagcaauc

SEQ ID NO: 2557416 - RNA, 15 nt, Chlamydophila pneumoniae J138
ugcuuuuugaaugau

SEQ ID NO: 2557417 - RNA, 14 nt, Chlamydophila pneumoniae J138
uggaaacuuuucca

SEQ ID NO: 2557418 - RNA, 18 nt, Chlamydophila pneumoniae J138
uggaaacuuuuccaaauu

SEQ ID NO: 2557419 - RNA, 18 nt, Chlamydophila pneumoniae J138
uggaaagagucccugauu

SEQ ID NO: 2557420 - RNA, 14 nt, Chlamydophila pneumoniae J138
uggaaauagagaaa

SEQ ID NO: 2557421 - RNA, 15 nt, Chlamydophila pneumoniae J138
uggaaauagagaaac

SEQ ID NO: 2557422 - RNA, 15 nt, Chlamydophila pneumoniae J138
uggaaauugugaaaa

SEQ ID NO: 2557423 - RNA, 18 nt, Chlamydophila pneumoniae J138
uggaaauugugaaaaaaa

SEQ ID NO: 2557424 - RNA, 22 nt, Chlamydophila pneumoniae J138
uggaacaguauaaucagaagug

SEQ ID NO: 2557425 - RNA, 19 nt, Chlamydophila pneumoniae J138
uggaacgcauaagagacau

SEQ ID NO: 2557426 - RNA, 22 nt, Chlamydophila pneumoniae J138
gcuggaggccaaagaacagcac

SEQ ID NO: 2557427 - RNA, 13 nt, Chlamydophila pneumoniae J138
gcuggaucuucug

SEQ ID NO: 2557428 - RNA, 22 nt, Chlamydophila pneumoniae J138
gcuguaaucgagagaagaaauu

SEQ ID NO: 2557429 - RNA, 15 nt, Chlamydophila pneumoniae J138
gcuguacagaacaau

SEQ ID NO: 2557430 - RNA, 15 nt, Chlamydophila pneumoniae J138
gcuguacuugauauu

SEQ ID NO: 2557431 - RNA, 21 nt, Chlamydophila pneumoniae J138
gcuguacuugauauuguucuu

SEQ ID NO: 2557432 - RNA, 20 nt, Chlamydophila pneumoniae J138
gcuguagugauacuuuagaa

SEQ ID NO: 2557433 - RNA, 17 nt, Chlamydophila pneumoniae J138
gcugucuugaccaauac

SEQ ID NO: 2557434 - RNA, 13 nt, Chlamydophila pneumoniae J138
gcugugcauuuuc

SEQ ID NO: 2557435 - RNA, 19 nt, Chlamydophila pneumoniae J138
gcugugcauuuucuucuug

SEQ ID NO: 2557436 - RNA, 19 nt, Chlamydophila pneumoniae J138
gcuguggaauuuuccugag

SEQ ID NO: 2557437 - RNA, 13 nt, Chlamydophila pneumoniae J138
gcuguuccaagag

SEQ ID NO: 2557438 - RNA, 18 nt, Chlamydophila pneumoniae J138
gcuguuuacuuuucucuu

SEQ ID NO: 2557439 - RNA, 22 nt, Chlamydophila pneumoniae J138
gcuguuucuucugaauagcucu

SEQ ID NO: 2557440 - RNA, 14 nt, Chlamydophila pneumoniae J138
gcuuagccauggca

SEQ ID NO: 2557441 - RNA, 20 nt, Chlamydophila pneumoniae J138
gcuuagccauggcaucuaag

SEQ ID NO: 2557442 - RNA, 14 nt, Chlamydophila pneumoniae J138
gcuuauagagagaa

SEQ ID NO: 2557443 - RNA, 13 nt, Chlamydophila pneumoniae J138
gcuuauccguggg

SEQ ID NO: 2557444 - RNA, 14 nt, Chlamydophila pneumoniae J138
gcuuauuauugaau

SEQ ID NO: 2557445 - RNA, 20 nt, Chlamydophila pneumoniae J138
gcuuauuauugaauaagcuu

SEQ ID NO: 2557446 - RNA, 23 nt, Chlamydophila pneumoniae J138
gcuuauuucuguaguucuugcca

SEQ ID NO: 2557447 - RNA, 18 nt, Chlamydophila pneumoniae J138
gcuucaaggcaucuucuu

SEQ ID NO: 2557448 - RNA, 15 nt, Chlamydophila pneumoniae J138
gcuucacaucuuucu

SEQ ID NO: 2557449 - RNA, 18 nt, Chlamydophila pneumoniae J138
gcuucaccauuaagauau

SEQ ID NO: 2557450 - RNA, 19 nt, Chlamydophila pneumoniae J138
gcuucaccauuaagauauc

SEQ ID NO: 2557451 - RNA, 21 nt, Chlamydophila pneumoniae J138
gcuucagaguggucauugccu

SEQ ID NO: 2557452 - RNA, 16 nt, Chlamydophila pneumoniae J138
gcuucaucaaaacaua

SEQ ID NO: 2557453 - RNA, 18 nt, Chlamydophila pneumoniae J138
gcuucauuaucuucguaa

SEQ ID NO: 2557454 - RNA, 19 nt, Chlamydophila pneumoniae J138
gcuucauuccuacaucugu

SEQ ID NO: 2557455 - RNA, 20 nt, Chlamydophila pneumoniae J138
gcuucauuccuacaucugug

SEQ ID NO: 2557456 - RNA, 21 nt, Chlamydophila pneumoniae J138
gcuuccaacuuuugaagaucc

SEQ ID NO: 2557457 - RNA, 15 nt, Chlamydophila pneumoniae J138
gcuuccagcuucucc

SEQ ID NO: 2557458 - RNA, 22 nt, Chlamydophila pneumoniae J138
gcuuccauagcuuuagaagccc

SEQ ID NO: 2557459 - RNA, 19 nt, Chlamydophila pneumoniae J138
gcuuccccuaauaggggac

SEQ ID NO: 2557460 - RNA, 13 nt, Chlamydophila pneumoniae J138
gcuuccuguagug

SEQ ID NO: 2557461 - RNA, 21 nt, Chlamydophila pneumoniae J138
gcuuccuuggucuuauugaag

SEQ ID NO: 2557462 - RNA, 13 nt, Chlamydophila pneumoniae J138
gcuucgcaaucuu

SEQ ID NO: 2557463 - RNA, 16 nt, Chlamydophila pneumoniae J138
gcuucuacagcaucgg

SEQ ID NO: 2557464 - RNA, 18 nt, Chlamydophila pneumoniae J138
gcuucuacgguaagaucu

SEQ ID NO: 2557465 - RNA, 14 nt, Chlamydophila pneumoniae J138
gcuucuaucuugaa

SEQ ID NO: 2557466 - RNA, 16 nt, Chlamydophila pneumoniae J138
gcuucuauuuuagaau

SEQ ID NO: 2557467 - RNA, 15 nt, Chlamydophila pneumoniae J138
gcuucuccaaauaaa

SEQ ID NO: 2557468 - RNA, 16 nt, Chlamydophila pneumoniae J138
gcuucuggagaaaaaa

SEQ ID NO: 2557469 - RNA, 12 nt, Chlamydophila pneumoniae J138
gcuucuguaaag

SEQ ID NO: 2557470 - RNA, 22 nt, Chlamydophila pneumoniae J138
gcuucuucuauagaauccacua

SEQ ID NO: 2557471 - RNA, 18 nt, Chlamydophila pneumoniae J138
gcuucuuguuuuugugga

SEQ ID NO: 2557472 - RNA, 22 nt, Chlamydophila pneumoniae J138
gcuucuuuaucuagcucuucaa

SEQ ID NO: 2557473 - RNA, 14 nt, Chlamydophila pneumoniae J138
gcuucuuucaaagc

SEQ ID NO: 2557474 - RNA, 15 nt, Chlamydophila pneumoniae J138
gcuucuuucaaagcc

SEQ ID NO: 2557475 - RNA, 15 nt, Chlamydophila pneumoniae J138
gcuucuuucuuacua

SEQ ID NO: 2557476 - RNA, 16 nt, Chlamydophila pneumoniae J138
gcuugccagcagaagu

SEQ ID NO: 2557477 - RNA, 15 nt, Chlamydophila pneumoniae J138
gcuugcgagcuucuu

SEQ ID NO: 2557478 - RNA, 15 nt, Chlamydophila pneumoniae J138
gcuugcguuuccuag

SEQ ID NO: 2557479 - RNA, 23 nt, Chlamydophila pneumoniae J138
gcuugcugauuucuuuuucagcu

SEQ ID NO: 2557480 - RNA, 18 nt, Chlamydophila pneumoniae J138
gcuugggcaaauaggaga

SEQ ID NO: 2557481 - RNA, 17 nt, Chlamydophila pneumoniae J138
gcuugucgcgacaagac

SEQ ID NO: 2557482 - RNA, 21 nt, Chlamydophila pneumoniae J138
gcuugucuacagaggaaucua

SEQ ID NO: 2557483 - RNA, 18 nt, Chlamydophila pneumoniae J138
gcuugugcuaaagcagga

SEQ ID NO: 2557484 - RNA, 14 nt, Chlamydophila pneumoniae J138
gcuuuaaauuuuuu

SEQ ID NO: 2557485 - RNA, 15 nt, Chlamydophila pneumoniae J138
gcuuuaaauuuuuua

SEQ ID NO: 2557486 - RNA, 15 nt, Chlamydophila pneumoniae J138
gcuuuaaguguuucu

SEQ ID NO: 2557487 - RNA, 18 nt, Chlamydophila pneumoniae J138
gcuuuacgaugagguuga

SEQ ID NO: 2557488 - RNA, 16 nt, Chlamydophila pneumoniae J138
gcuuuagaaaagugcc

SEQ ID NO: 2557489 - RNA, 15 nt, Chlamydophila pneumoniae J138
gcuuuccuaaccauu

SEQ ID NO: 2557490 - RNA, 15 nt, Chlamydophila pneumoniae J138
gcuuucuagcugcuc

SEQ ID NO: 2557491 - RNA, 20 nt, Chlamydophila pneumoniae J138
gcuuucuagggcaucuuuua

SEQ ID NO: 2557492 - RNA, 16 nt, Chlamydophila pneumoniae J138
gcuuugauaauagucu

SEQ ID NO: 2557493 - RNA, 18 nt, Chlamydophila pneumoniae J138
gcuuugugaguucuuccu

SEQ ID NO: 2557494 - RNA, 20 nt, Chlamydophila pneumoniae J138
gcuuugugaguucuuccuuc

SEQ ID NO: 2557495 - RNA, 21 nt, Chlamydophila pneumoniae J138
gcuuuuaauguguucuuaucg

SEQ ID NO: 2557496 - RNA, 20 nt, Chlamydophila pneumoniae J138
gcuuuucauuuuuaggaucu

SEQ ID NO: 2557497 - RNA, 12 nt, Chlamydophila pneumoniae J138
gcuuuucuuuuu

SEQ ID NO: 2557498 - RNA, 18 nt, Chlamydophila pneumoniae J138
gcuuuugagauucaaaag

SEQ ID NO: 2557499 - RNA, 16 nt, Chlamydophila pneumoniae J138
gcuuuugcuacagcuu

SEQ ID NO: 2557500 - RNA, 16 nt, Chlamydophila pneumoniae J138
gcuuuuguagauuagg

SEQ ID NO: 2557501 - RNA, 17 nt, Chlamydophila pneumoniae J138
gcuuuugugauaccucc

SEQ ID NO: 2557502 - RNA, 14 nt, Chlamydophila pneumoniae J138
gcuuuuguuguuuu

SEQ ID NO: 2557503 - RNA, 10 nt, Chlamydophila pneumoniae J138
gcuuuuugcu

SEQ ID NO: 2557504 - RNA, 22 nt, Chlamydophila pneumoniae J138
gcuuuuuuaaaguguguaaaug

SEQ ID NO: 2557505 - RNA, 14 nt, Chlamydophila pneumoniae J138
gcuuuuuucucuug

SEQ ID NO: 2557506 - RNA, 18 nt, Chlamydophila pneumoniae J138
gcuuuuuugaaagcugga

SEQ ID NO: 2557507 - RNA, 15 nt, Chlamydophila pneumoniae J138
gcuuuuuuucuagag

SEQ ID NO: 2557508 - RNA, 12 nt, Chlamydophila pneumoniae J138
ggaaaaagccuu

SEQ ID NO: 2557509 - RNA, 22 nt, Chlamydophila pneumoniae J138
ggaaaaccaugaguuuuucaga

SEQ ID NO: 2557510 - RNA, 12 nt, Chlamydophila pneumoniae J138
ggaaaagaaaag

SEQ ID NO: 2557511 - RNA, 13 nt, Chlamydophila pneumoniae J138
ggaaaaggaggag

SEQ ID NO: 2557512 - RNA, 22 nt, Chlamydophila pneumoniae J138
ggaaaauucaguauaagaugcu

SEQ ID NO: 2557513 - RNA, 17 nt, Chlamydophila pneumoniae J138
ggaaacauagaaucauu

SEQ ID NO: 2557514 - RNA, 16 nt, Chlamydophila pneumoniae J138
ggaaacguucuuucaa

SEQ ID NO: 2557515 - RNA, 19 nt, Chlamydophila pneumoniae J138
ggaaagaaacuacacgcac

SEQ ID NO: 2557516 - RNA, 22 nt, Chlamydophila pneumoniae J138
ggaaaguugcaacucucuuuaa

SEQ ID NO: 2557517 - RNA, 23 nt, Chlamydophila pneumoniae J138
ggaaaguugcaacucucuuuaaa

SEQ ID NO: 2557518 - RNA, 14 nt, Chlamydophila pneumoniae J138
ggaacaaagcucuc

SEQ ID NO: 2557519 - RNA, 21 nt, Chlamydophila pneumoniae J138
ggaacaaagcucuccuucaga

SEQ ID NO: 2557520 - RNA, 11 nt, Chlamydophila pneumoniae J138
ggaacaacugu

SEQ ID NO: 2557521 - RNA, 14 nt, Chlamydophila pneumoniae J138
ggaacaguauaauc

SEQ ID NO: 2557522 - RNA, 14 nt, Chlamydophila pneumoniae J138
ggaacgcucucuag

SEQ ID NO: 2557523 - RNA, 21 nt, Chlamydophila pneumoniae J138
ggaacuaaaaguuuuuuauuu

SEQ ID NO: 2557524 - RNA, 19 nt, Chlamydophila pneumoniae J138
ggaacuacaggaauucuca

SEQ ID NO: 2557525 - RNA, 21 nt, Chlamydophila pneumoniae J138
ggaagaaaggauuggaugaga

SEQ ID NO: 2557526 - RNA, 17 nt, Chlamydophila pneumoniae J138
ggaagaaauuaacaaca

SEQ ID NO: 2557527 - RNA, 12 nt, Chlamydophila pneumoniae J138
uucaucuucuuu

SEQ ID NO: 2557528 - RNA, 12 nt, Chlamydophila pneumoniae J138
uucaugcaaaac

SEQ ID NO: 2557529 - RNA, 14 nt, Chlamydophila pneumoniae J138
uucauguccuccau

SEQ ID NO: 2557530 - RNA, 22 nt, Chlamydophila pneumoniae J138
uucauguccuccauggaaagaa

SEQ ID NO: 2557531 - RNA, 16 nt, Chlamydophila pneumoniae J138
uucauuaagaacaucu

SEQ ID NO: 2557532 - RNA, 13 nt, Chlamydophila pneumoniae J138
uucauuaagaucc

SEQ ID NO: 2557533 - RNA, 13 nt, Chlamydophila pneumoniae J138
uucauucacagca

SEQ ID NO: 2557534 - RNA, 15 nt, Chlamydophila pneumoniae J138
uucauucacagcagu

SEQ ID NO: 2557535 - RNA, 15 nt, Chlamydophila pneumoniae J138
uucauucuuucgaua

SEQ ID NO: 2557536 - RNA, 13 nt, Chlamydophila pneumoniae J138
uucauugcaaaaa

SEQ ID NO: 2557537 - RNA, 22 nt, Chlamydophila pneumoniae J138
uucauuucgauaacacuucuuu

SEQ ID NO: 2557538 - RNA, 16 nt, Chlamydophila pneumoniae J138
uuccaaaauaaaagga

SEQ ID NO: 2557539 - RNA, 18 nt, Chlamydophila pneumoniae J138
uuccaaaauaaaaggagc

SEQ ID NO: 2557540 - RNA, 14 nt, Chlamydophila pneumoniae J138
uuccaaaggaaaau

SEQ ID NO: 2557541 - RNA, 21 nt, Chlamydophila pneumoniae J138
uuccaagacaauaaaaaagag

SEQ ID NO: 2557542 - RNA, 12 nt, Chlamydophila pneumoniae J138
uuccaagugauc

SEQ ID NO: 2557543 - RNA, 14 nt, Chlamydophila pneumoniae J138
uuccaauaauuuuc

SEQ ID NO: 2557544 - RNA, 17 nt, Chlamydophila pneumoniae J138
uuccaauagagucucuu

SEQ ID NO: 2557545 - RNA, 20 nt, Chlamydophila pneumoniae J138
uuccaggacguaaaaagaaa

SEQ ID NO: 2557546 - RNA, 15 nt, Chlamydophila pneumoniae J138
uuccaggcucuagga

SEQ ID NO: 2557547 - RNA, 21 nt, Chlamydophila pneumoniae J138
uuccauaauuuuagcuucuuu

SEQ ID NO: 2557548 - RNA, 23 nt, Chlamydophila pneumoniae J138
uuccauaauuuuagcuucuuuuu

SEQ ID NO: 2557549 - RNA, 18 nt, Chlamydophila pneumoniae J138
uuccauacccaaauuucu

SEQ ID NO: 2557550 - RNA, 20 nt, Chlamydophila pneumoniae J138
uuccauagccaaggagcuau

SEQ ID NO: 2557551 - RNA, 21 nt, Chlamydophila pneumoniae J138
uuccauagguuagaaaugaaa

SEQ ID NO: 2557552 - RNA, 19 nt, Chlamydophila pneumoniae J138
uuccauggauauggaaugg

SEQ ID NO: 2557553 - RNA, 13 nt, Chlamydophila pneumoniae J138
uuccauguagaag

SEQ ID NO: 2557554 - RNA, 19 nt, Chlamydophila pneumoniae J138
uuccauuagggcauucugu

SEQ ID NO: 2557555 - RNA, 21 nt, Chlamydophila pneumoniae J138
uuccauuagggcauucuguaa

SEQ ID NO: 2557556 - RNA, 17 nt, Chlamydophila pneumoniae J138
uuccauuauacuuuuuu

SEQ ID NO: 2557557 - RNA, 15 nt, Chlamydophila pneumoniae J138
uuccauuuucaggcu

SEQ ID NO: 2557558 - RNA, 12 nt, Chlamydophila pneumoniae J138
uuccauuuuucc

SEQ ID NO: 2557559 - RNA, 14 nt, Chlamydophila pneumoniae J138
uucccaauauccuc

SEQ ID NO: 2557560 - RNA, 17 nt, Chlamydophila pneumoniae J138
uucccacuaagaaugag

SEQ ID NO: 2557561 - RNA, 18 nt, Chlamydophila pneumoniae J138
uucccaucuuguucuaaa

SEQ ID NO: 2557562 - RNA, 13 nt, Chlamydophila pneumoniae J138
uuccccugaaaau

SEQ ID NO: 2557563 - RNA, 21 nt, Chlamydophila pneumoniae J138
uuccccuucagaggcuagaaa

SEQ ID NO: 2557564 - RNA, 23 nt, Chlamydophila pneumoniae J138
uucccgaaggggaagaggaaugc

SEQ ID NO: 2557565 - RNA, 18 nt, Chlamydophila pneumoniae J138
uucccgacucaaucaaau

SEQ ID NO: 2557566 - RNA, 15 nt, Chlamydophila pneumoniae J138
uucccuaccugagga

SEQ ID NO: 2557567 - RNA, 14 nt, Chlamydophila pneumoniae J138
uucccucuucuucc

SEQ ID NO: 2557568 - RNA, 17 nt, Chlamydophila pneumoniae J138
uucccugacacagagcu

SEQ ID NO: 2557569 - RNA, 21 nt, Chlamydophila pneumoniae J138
uucccuuguuaugaaaaucuu

SEQ ID NO: 2557570 - RNA, 23 nt, Chlamydophila pneumoniae J138
uucccuuuaaaaguacgaccaac

SEQ ID NO: 2557571 - RNA, 14 nt, Chlamydophila pneumoniae J138
uuccgaagaagaaa

SEQ ID NO: 2557572 - RNA, 23 nt, Chlamydophila pneumoniae J138
uuccgaauugcgaauccugagga

SEQ ID NO: 2557573 - RNA, 21 nt, Chlamydophila pneumoniae J138
uuccgauuaguaaugauguag

SEQ ID NO: 2557574 - RNA, 19 nt, Chlamydophila pneumoniae J138
uuccggggagaacuucaac

SEQ ID NO: 2557575 - RNA, 17 nt, Chlamydophila pneumoniae J138
uuccggguucauuucca

SEQ ID NO: 2557576 - RNA, 16 nt, Chlamydophila pneumoniae J138
uuccuaaaacaagaag

SEQ ID NO: 2557577 - RNA, 18 nt, Chlamydophila pneumoniae J138
uuccuaaaacaagaagau

SEQ ID NO: 2557578 - RNA, 19 nt, Chlamydophila pneumoniae J138
uuccuaacuaucucuguuu

SEQ ID NO: 2557579 - RNA, 21 nt, Chlamydophila pneumoniae J138
uuccuaacuaucucuguuuuu

SEQ ID NO: 2557580 - RNA, 21 nt, Chlamydophila pneumoniae J138
uuccuacaucugugauuaauc

SEQ ID NO: 2557581 - RNA, 12 nt, Chlamydophila pneumoniae J138
uuccuaccuaua

SEQ ID NO: 2557582 - RNA, 18 nt, Chlamydophila pneumoniae J138
uuccuacgacaugccuaa

SEQ ID NO: 2557583 - RNA, 16 nt, Chlamydophila pneumoniae J138
uuccuacuucugcagg

SEQ ID NO: 2557584 - RNA, 20 nt, Chlamydophila pneumoniae J138
uuccuaguccucuaugguuu

SEQ ID NO: 2557585 - RNA, 17 nt, Chlamydophila pneumoniae J138
uuccucgagcuaccaga

SEQ ID NO: 2557586 - RNA, 16 nt, Chlamydophila pneumoniae J138
uuccucucaugaaauu

SEQ ID NO: 2557587 - RNA, 17 nt, Chlamydophila pneumoniae J138
uuccucuucaauuucuu

SEQ ID NO: 2557588 - RNA, 19 nt, Chlamydophila pneumoniae J138
uuccucuucaauuucuuca

SEQ ID NO: 2557589 - RNA, 17 nt, Chlamydophila pneumoniae J138
uuccugaagaugagaaa

SEQ ID NO: 2557590 - RNA, 18 nt, Chlamydophila pneumoniae J138
uuccugaagcagcuucug

SEQ ID NO: 2557591 - RNA, 16 nt, Chlamydophila pneumoniae J138
uuccugacuauaaaau

SEQ ID NO: 2557592 - RNA, 18 nt, Chlamydophila pneumoniae J138
uuccugacuauaaaaugc

SEQ ID NO: 2557593 - RNA, 23 nt, Chlamydophila pneumoniae J138
uuccugcauggcuuugugagcug

SEQ ID NO: 2557594 - RNA, 19 nt, Chlamydophila pneumoniae J138
uuccugcuugauuuccuga

SEQ ID NO: 2557595 - RNA, 15 nt, Chlamydophila pneumoniae J138
uuccuuaaagaguuu

SEQ ID NO: 2557596 - RNA, 23 nt, Chlamydophila pneumoniae J138
uuccuuaagggaagaucugaaau

SEQ ID NO: 2557597 - RNA, 23 nt, Chlamydophila pneumoniae J138
uuccuuaaugagaguuucuaaug

SEQ ID NO: 2557598 - RNA, 19 nt, Chlamydophila pneumoniae J138
uuccuuaaugguagcuuaa

SEQ ID NO: 2557599 - RNA, 22 nt, Chlamydophila pneumoniae J138
uuccuuacaagcuuccuugguc

SEQ ID NO: 2557600 - RNA, 19 nt, Chlamydophila pneumoniae J138
uuccuuauccgucagccuu

SEQ ID NO: 2557601 - RNA, 16 nt, Chlamydophila pneumoniae J138
uuccuucgaagcggag

SEQ ID NO: 2557602 - RNA, 12 nt, Chlamydophila pneumoniae J138
uuccuucucaga

SEQ ID NO: 2557603 - RNA, 12 nt, Chlamydophila pneumoniae J138
uuccuucuccug

SEQ ID NO: 2557604 - RNA, 23 nt, Chlamydophila pneumoniae J138
uuccuugacuaugguaagcauuu

SEQ ID NO: 2557605 - RNA, 17 nt, Chlamydophila pneumoniae J138
uuccuuggauuucuucu

SEQ ID NO: 2557606 - RNA, 22 nt, Chlamydophila pneumoniae J138
uuccuuggauuucuucuucuaa

SEQ ID NO: 2557607 - RNA, 22 nt, Chlamydophila pneumoniae J138
uuccuuggcauacucuauuaag

SEQ ID NO: 2557608 - RNA, 17 nt, Chlamydophila pneumoniae J138
uuccuugggaggaggag

SEQ ID NO: 2557609 - RNA, 15 nt, Chlamydophila pneumoniae J138
uuccuuggucuuauu

SEQ ID NO: 2557610 - RNA, 17 nt, Chlamydophila pneumoniae J138
uucgaaaaacgguaaau

SEQ ID NO: 2557611 - RNA, 14 nt, Chlamydophila pneumoniae J138
uucgaauucucaga

SEQ ID NO: 2557612 - RNA, 22 nt, Chlamydophila pneumoniae J138
uucgacaacaacauaaagaagg

SEQ ID NO: 2557613 - RNA, 15 nt, Chlamydophila pneumoniae J138
uucgaccuauuugca

SEQ ID NO: 2557614 - RNA, 13 nt, Chlamydophila pneumoniae J138
uucgacucuccac

SEQ ID NO: 2557615 - RNA, 22 nt, Chlamydophila pneumoniae J138
uucgauaucucuaccgaacaga

SEQ ID NO: 2557616 - RNA, 18 nt, Chlamydophila pneumoniae J138
uucgauguuaaggcuucc

SEQ ID NO: 2557617 - RNA, 17 nt, Chlamydophila pneumoniae J138
uucgcacuaauuuccuu

SEQ ID NO: 2557618 - RNA, 15 nt, Chlamydophila pneumoniae J138
uucgcacuacagcuu

SEQ ID NO: 2557619 - RNA, 21 nt, Chlamydophila pneumoniae J138
uucgccaaacgaauuucuugu

SEQ ID NO: 2557620 - RNA, 17 nt, Chlamydophila pneumoniae J138
uucgcggaucuucuucu

SEQ ID NO: 2557621 - RNA, 17 nt, Chlamydophila pneumoniae J138
uucgcuacauaaaauga

SEQ ID NO: 2557622 - RNA, 20 nt, Chlamydophila pneumoniae J138
uucguaacgcuuuucuaaua

SEQ ID NO: 2557623 - RNA, 19 nt, Chlamydophila pneumoniae J138
uucguagacgcucuaaacu

SEQ ID NO: 2557624 - RNA, 20 nt, Chlamydophila pneumoniae J138
uucgucuaaaauaaccccuc

SEQ ID NO: 2557625 - RNA, 22 nt, Chlamydophila pneumoniae J138
uucgugaacaaaaucgaacaga

SEQ ID NO: 2557626 - RNA, 13 nt, Chlamydophila pneumoniae J138
uucguuucgcuuu

SEQ ID NO: 2557627 - RNA, 21 nt, Chlamydophila pneumoniae J138
uucucugagcagcuucgcaau

SEQ ID NO: 2557628 - RNA, 18 nt, Chlamydophila pneumoniae J138
uucucuguugggagcuuc

SEQ ID NO: 2557629 - RNA, 16 nt, Chlamydophila pneumoniae J138
uucucuucauuuucuu

SEQ ID NO: 2557630 - RNA, 14 nt, Chlamydophila pneumoniae J138
uucugaaacaaugc

SEQ ID NO: 2557631 - RNA, 15 nt, Chlamydophila pneumoniae J138
uucugaaauugucuu

SEQ ID NO: 2557632 - RNA, 19 nt, Chlamydophila pneumoniae J138
uucugaaauugucuucagu

SEQ ID NO: 2557633 - RNA, 20 nt, Chlamydophila pneumoniae J138
uucugaaauuucugaaacaa

SEQ ID NO: 2557634 - RNA, 14 nt, Chlamydophila pneumoniae J138
uucugacaauaaca

SEQ ID NO: 2557635 - RNA, 15 nt, Chlamydophila pneumoniae J138
uucugauacaucauc

SEQ ID NO: 2557636 - RNA, 22 nt, Chlamydophila pneumoniae J138
uucugaugacguuaauaaagag

SEQ ID NO: 2557637 - RNA, 20 nt, Chlamydophila pneumoniae J138
uucugcaaucagugcugcca

SEQ ID NO: 2557638 - RNA, 15 nt, Chlamydophila pneumoniae J138
uucugcaaucugaau

SEQ ID NO: 2557639 - RNA, 21 nt, Chlamydophila pneumoniae J138
uucugcaggauuuguagcucc

SEQ ID NO: 2557640 - RNA, 16 nt, Chlamydophila pneumoniae J138
uucugccuuaugcuca

SEQ ID NO: 2557641 - RNA, 22 nt, Chlamydophila pneumoniae J138
uucugcuucuccaaauaaagca

SEQ ID NO: 2557642 - RNA, 14 nt, Chlamydophila pneumoniae J138
uucugcuucuguaa

SEQ ID NO: 2557643 - RNA, 19 nt, Chlamydophila pneumoniae J138
uucuggagaaaaaauaucu

SEQ ID NO: 2557644 - RNA, 19 nt, Chlamydophila pneumoniae J138
uucuggauacguuuuuccc

SEQ ID NO: 2557645 - RNA, 13 nt, Chlamydophila pneumoniae J138
uucuggauucaaa

SEQ ID NO: 2557646 - RNA, 15 nt, Chlamydophila pneumoniae J138
uucuguaaagauucu

SEQ ID NO: 2557647 - RNA, 21 nt, Chlamydophila pneumoniae J138
uucuguaauuuuuuucaaagg

SEQ ID NO: 2557648 - RNA, 22 nt, Chlamydophila pneumoniae J138
uucuguagugagauacggagga

SEQ ID NO: 2557649 - RNA, 17 nt, Chlamydophila pneumoniae J138
uucuguaguucuugcca

SEQ ID NO: 2557650 - RNA, 14 nt, Chlamydophila pneumoniae J138
uucuuaacaauaua

SEQ ID NO: 2557651 - RNA, 16 nt, Chlamydophila pneumoniae J138
uucuuaauuuccuucu

SEQ ID NO: 2557652 - RNA, 23 nt, Chlamydophila pneumoniae J138
uucuuacuaaagaaagagucuca

SEQ ID NO: 2557653 - RNA, 14 nt, Chlamydophila pneumoniae J138
uucuuagaagagaa

SEQ ID NO: 2557654 - RNA, 15 nt, Chlamydophila pneumoniae J138
uucuuagaagagaaa

SEQ ID NO: 2557655 - RNA, 22 nt, Chlamydophila pneumoniae J138
uucuuagaagagaaaguagaga

SEQ ID NO: 2557656 - RNA, 15 nt, Chlamydophila pneumoniae J138
uucuuagcgcaugua

SEQ ID NO: 2557657 - RNA, 22 nt, Chlamydophila pneumoniae J138
uucuuagcgcauguauuguguu

SEQ ID NO: 2557658 - RNA, 18 nt, Chlamydophila pneumoniae J138
uucuuaucacaaauuguc

SEQ ID NO: 2557659 - RNA, 15 nt, Chlamydophila pneumoniae J138
uucuuaucuucuaaa

SEQ ID NO: 2557660 - RNA, 15 nt, Chlamydophila pneumoniae J138
uucuuauuacagaaa

SEQ ID NO: 2557661 - RNA, 17 nt, Chlamydophila pneumoniae J138
uucuucaaagcuacuaa

SEQ ID NO: 2557662 - RNA, 23 nt, Chlamydophila pneumoniae J138
uucuucaaagucaaauacuucuc

SEQ ID NO: 2557663 - RNA, 16 nt, Chlamydophila pneumoniae J138
uucuucaagaaaugcc

SEQ ID NO: 2557664 - RNA, 22 nt, Chlamydophila pneumoniae J138
uucuucaauaggaauuagagaa

SEQ ID NO: 2557665 - RNA, 13 nt, Chlamydophila pneumoniae J138
uucuucacaaucu

SEQ ID NO: 2557666 - RNA, 21 nt, Chlamydophila pneumoniae J138
uucuucagaguugucaaguaa

SEQ ID NO: 2557667 - RNA, 18 nt, Chlamydophila pneumoniae J138
uucuucagcacuuuuauu

SEQ ID NO: 2557668 - RNA, 18 nt, Chlamydophila pneumoniae J138
uucuucaucuucuaaauc

SEQ ID NO: 2557669 - RNA, 23 nt, Chlamydophila pneumoniae J138
uucuuccaaagacugagcuucua

SEQ ID NO: 2557670 - RNA, 14 nt, Chlamydophila pneumoniae J138
uucuuccaauaauu

SEQ ID NO: 2557671 - RNA, 14 nt, Chlamydophila pneumoniae J138
uucuucccagguaa

SEQ ID NO: 2557672 - RNA, 20 nt, Chlamydophila pneumoniae J138
uucuuccuguuccauaucaa

SEQ ID NO: 2557673 - RNA, 17 nt, Chlamydophila pneumoniae J138
uucuucgguguagaucu

SEQ ID NO: 2557674 - RNA, 11 nt, Chlamydophila pneumoniae J138
uucuucuaaag

SEQ ID NO: 2557675 - RNA, 19 nt, Chlamydophila pneumoniae J138
uucuucugaauagcucuuu

SEQ ID NO: 2557676 - RNA, 15 nt, Chlamydophila pneumoniae J138
uucuucuucagagcu

SEQ ID NO: 2557677 - RNA, 18 nt, Chlamydophila pneumoniae J138
uucuucuucggaucugua

SEQ ID NO: 2557678 - RNA, 12 nt, Chlamydophila pneumoniae J138
uucuucuucuaa

SEQ ID NO: 2557679 - RNA, 21 nt, Chlamydophila pneumoniae J138
uucuucuuuccauagaucccu

SEQ ID NO: 2557680 - RNA, 14 nt, Chlamydophila pneumoniae J138
uucuugaaaaaucc

SEQ ID NO: 2557681 - RNA, 14 nt, Chlamydophila pneumoniae J138
uucuugacggcagg

SEQ ID NO: 2557682 - RNA, 20 nt, Chlamydophila pneumoniae J138
uucuugauccaucugcucuu

SEQ ID NO: 2557683 - RNA, 16 nt, Chlamydophila pneumoniae J138
uucuugauuagagaau

SEQ ID NO: 2557684 - RNA, 15 nt, Chlamydophila pneumoniae J138
uucuugcaaagauaa

SEQ ID NO: 2557685 - RNA, 22 nt, Chlamydophila pneumoniae J138
uucuugcucugacaaguguguu

SEQ ID NO: 2557686 - RNA, 22 nt, Chlamydophila pneumoniae J138
uucuuggagaagagguaauaau

SEQ ID NO: 2557687 - RNA, 21 nt, Chlamydophila pneumoniae J138
uucuugguaggaugucgcuuu

SEQ ID NO: 2557688 - RNA, 22 nt, Chlamydophila pneumoniae J138
uucuuggucggaguuuuuuucu

SEQ ID NO: 2557689 - RNA, 21 nt, Chlamydophila pneumoniae J138
uucuugguguauaguauuuuu

SEQ ID NO: 2557690 - RNA, 18 nt, Chlamydophila pneumoniae J138
uucuuguaauaaaagaac

SEQ ID NO: 2557691 - RNA, 19 nt, Chlamydophila pneumoniae J138
uucuuuauccccagaucuc

SEQ ID NO: 2557692 - RNA, 17 nt, Chlamydophila pneumoniae J138
uucuuucuaggccggga

SEQ ID NO: 2557693 - RNA, 19 nt, Chlamydophila pneumoniae J138
uucuuucucggucuuucuu

SEQ ID NO: 2557694 - RNA, 12 nt, Chlamydophila pneumoniae J138
uucuuucuuacu

SEQ ID NO: 2557695 - RNA, 12 nt, Chlamydophila pneumoniae J138
uucuuucuugcu

SEQ ID NO: 2557696 - RNA, 20 nt, Chlamydophila pneumoniae J138
uucuuugaagaacaaaaaau

SEQ ID NO: 2557697 - RNA, 21 nt, Chlamydophila pneumoniae J138
uucuuugaagaacaaaaaauc

SEQ ID NO: 2557698 - RNA, 13 nt, Chlamydophila pneumoniae J138
uucuuuuccugca

SEQ ID NO: 2557699 - RNA, 14 nt, Chlamydophila pneumoniae J138
uucuuuuccugcag

SEQ ID NO: 2557700 - RNA, 15 nt, Chlamydophila pneumoniae J138
uucuuuucugaagau

SEQ ID NO: 2557701 - RNA, 22 nt, Chlamydophila pneumoniae J138
uucuuuuuuuauaaagaagaaa

SEQ ID NO: 2557702 - RNA, 21 nt, Chlamydophila pneumoniae J138
uugaaaccguaacugaggcaa

SEQ ID NO: 2557703 - RNA, 20 nt, Chlamydophila pneumoniae J138
uugaaacgcccuucaggaca

SEQ ID NO: 2557704 - RNA, 20 nt, Chlamydophila pneumoniae J138
uugaaacuuuuuuucuucuc

SEQ ID NO: 2557705 - RNA, 13 nt, Chlamydophila pneumoniae J138
uugaaauugcucu

SEQ ID NO: 2557706 - RNA, 20 nt, Chlamydophila pneumoniae J138
uugaacaacuccuuaaacuu

SEQ ID NO: 2557707 - RNA, 19 nt, Chlamydophila pneumoniae J138
uugaacguagcuacaaaau

SEQ ID NO: 2557708 - RNA, 15 nt, Chlamydophila pneumoniae J138
uugaagaacaaaaaa

SEQ ID NO: 2557709 - RNA, 20 nt, Chlamydophila pneumoniae J138
uugaagaacaaaaaaucaau

SEQ ID NO: 2557710 - RNA, 15 nt, Chlamydophila pneumoniae J138
uugaaguucuucaag

SEQ ID NO: 2557711 - RNA, 21 nt, Chlamydophila pneumoniae J138
uugaaguuuugcucucuagau

SEQ ID NO: 2557712 - RNA, 19 nt, Chlamydophila pneumoniae J138
uugaauaagauuuugaaaa

SEQ ID NO: 2557713 - RNA, 16 nt, Chlamydophila pneumoniae J138
uugaauaaugcauccc

SEQ ID NO: 2557714 - RNA, 23 nt, Chlamydophila pneumoniae J138
uugaaugcagcacggaacaaguc

SEQ ID NO: 2557715 - RNA, 14 nt, Chlamydophila pneumoniae J138
uugacaauaagaaa

SEQ ID NO: 2557716 - RNA, 19 nt, Chlamydophila pneumoniae J138
uugacaauaagaaaauccu

SEQ ID NO: 2557717 - RNA, 18 nt, Chlamydophila pneumoniae J138
uugacaauaggcacccaa

SEQ ID NO: 2557718 - RNA, 19 nt, Chlamydophila pneumoniae J138
uugacaaucgcuguaaauu

SEQ ID NO: 2557719 - RNA, 14 nt, Chlamydophila pneumoniae J138
uugacaucuguagu

SEQ ID NO: 2557720 - RNA, 23 nt, Chlamydophila pneumoniae J138
uugacuaaauccaccaaugauaa

SEQ ID NO: 2557721 - RNA, 16 nt, Chlamydophila pneumoniae J138
uugacuagcucucuug

SEQ ID NO: 2557722 - RNA, 12 nt, Chlamydophila pneumoniae J138
uugacugaaacu

SEQ ID NO: 2557723 - RNA, 15 nt, Chlamydophila pneumoniae J138
uugagaaaagaacag

SEQ ID NO: 2557724 - RNA, 22 nt, Chlamydophila pneumoniae J138
uugagaaugaacaauagaaaga

SEQ ID NO: 2557725 - RNA, 14 nt, Chlamydophila pneumoniae J138
uugagcacauuguu

SEQ ID NO: 2557726 - RNA, 19 nt, Chlamydophila pneumoniae J138
uugagccaacagguucacu

SEQ ID NO: 2557727 - RNA, 19 nt, Chlamydophila pneumoniae J138
uugagcuaacgacauugaa

SEQ ID NO: 2557728 - RNA, 10 nt, Chlamydophila pneumoniae J138
uugagcucuc

SEQ ID NO: 2557729 - RNA, 13 nt, Chlamydophila pneumoniae J138
uugagcucucuag

SEQ ID NO: 2557730 - RNA, 11 nt, Chlamydophila pneumoniae J138
uugaggaaagg

SEQ ID NO: 2557731 - RNA, 18 nt, Chlamydophila pneumoniae J138
uugaggaacgcacgccaa

SEQ ID NO: 2557732 - RNA, 22 nt, Chlamydophila pneumoniae J138
uugaggauacgaauaaguuuug

SEQ ID NO: 2557733 - RNA, 20 nt, Chlamydophila pneumoniae J138
uugaggauuucuugcaagga

SEQ ID NO: 2557734 - RNA, 19 nt, Chlamydophila pneumoniae J138
uugaggcaagucucaaagg

SEQ ID NO: 2557735 - RNA, 16 nt, Chlamydophila pneumoniae J138
uugagucuuuuucaga

SEQ ID NO: 2557736 - RNA, 19 nt, Chlamydophila pneumoniae J138
uugaguuccgaauaggcau

SEQ ID NO: 2557737 - RNA, 15 nt, Chlamydophila pneumoniae J138
uugaguugguuuugu

SEQ ID NO: 2557738 - RNA, 13 nt, Chlamydophila pneumoniae J138
uugauaaaacgcu

SEQ ID NO: 2557739 - RNA, 23 nt, Chlamydophila pneumoniae J138
uugauaacuuugcaugaggagac

SEQ ID NO: 2557740 - RNA, 14 nt, Chlamydophila pneumoniae J138
uugauaauagucuu

SEQ ID NO: 2557741 - RNA, 16 nt, Chlamydophila pneumoniae J138
uugauaauuacagaag

SEQ ID NO: 2557742 - RNA, 17 nt, Chlamydophila pneumoniae J138
uugauaguguucgagca

SEQ ID NO: 2557743 - RNA, 21 nt, Chlamydophila pneumoniae J138
uugauaguguucgagcaucuc

SEQ ID NO: 2557744 - RNA, 13 nt, Chlamydophila pneumoniae J138
uugauauccaggg

SEQ ID NO: 2557745 - RNA, 17 nt, Chlamydophila pneumoniae J138
uugauauuaucuuguaa

SEQ ID NO: 2557746 - RNA, 14 nt, Chlamydophila pneumoniae J138
uugauauuguucuu

SEQ ID NO: 2557747 - RNA, 18 nt, Chlamydophila pneumoniae J138
uugauccuuuccaagaag

SEQ ID NO: 2557748 - RNA, 21 nt, Chlamydophila pneumoniae J138
uugaucuacaaaaacuagaau

SEQ ID NO: 2557749 - RNA, 12 nt, Chlamydophila pneumoniae J138
uugaugagaaaa

SEQ ID NO: 2557750 - RNA, 13 nt, Chlamydophila pneumoniae J138
uugaugagaaaaa

SEQ ID NO: 2557751 - RNA, 21 nt, Chlamydophila pneumoniae J138
uugaugagaaaaagaaucucu

SEQ ID NO: 2557752 - RNA, 19 nt, Chlamydophila pneumoniae J138
uugauguacaguaaaguau

SEQ ID NO: 2557753 - RNA, 23 nt, Chlamydophila pneumoniae J138
uugaugugcggcgagcucuagga

SEQ ID NO: 2557754 - RNA, 14 nt, Chlamydophila pneumoniae J138
uugauuauucccaa

SEQ ID NO: 2557755 - RNA, 12 nt, Chlamydophila pneumoniae J138
uugauucauaaa

SEQ ID NO: 2557756 - RNA, 15 nt, Chlamydophila pneumoniae J138
uugauugaaacuuuu

SEQ ID NO: 2557757 - RNA, 16 nt, Chlamydophila pneumoniae J138
uugauugaacagucuu

SEQ ID NO: 2557758 - RNA, 21 nt, Chlamydophila pneumoniae J138
uugauuggaucuugauaaaag

SEQ ID NO: 2557759 - RNA, 15 nt, Chlamydophila pneumoniae J138
uugauuuuaaaauga

SEQ ID NO: 2557760 - RNA, 17 nt, Chlamydophila pneumoniae J138
uugcaaaaaugaaagaa

SEQ ID NO: 2557761 - RNA, 17 nt, Chlamydophila pneumoniae J138
uugcaaaugaaaagaga

SEQ ID NO: 2557762 - RNA, 22 nt, Chlamydophila pneumoniae J138
uugcaacaaaaggcccaacucu

SEQ ID NO: 2557763 - RNA, 10 nt, Chlamydophila pneumoniae J138
uugcaacucu

SEQ ID NO: 2557764 - RNA, 21 nt, Chlamydophila pneumoniae J138
uugcaauaccaauugggcuag

SEQ ID NO: 2557765 - RNA, 19 nt, Chlamydophila pneumoniae J138
uugcacucgauuauuucuu

SEQ ID NO: 2557766 - RNA, 20 nt, Chlamydophila pneumoniae J138
uugcagaagcauuguauucc

SEQ ID NO: 2557767 - RNA, 18 nt, Chlamydophila pneumoniae J138
uugcagauugaaucccau

SEQ ID NO: 2557768 - RNA, 16 nt, Chlamydophila pneumoniae J138
uugcagcaaggagagu

SEQ ID NO: 2557769 - RNA, 19 nt, Chlamydophila pneumoniae J138
uugcagcucggaaugcucu

SEQ ID NO: 2557770 - RNA, 16 nt, Chlamydophila pneumoniae J138
uugcauagacaugcga

SEQ ID NO: 2557771 - RNA, 18 nt, Chlamydophila pneumoniae J138
uugcauagcggcaacaag

SEQ ID NO: 2557772 - RNA, 13 nt, Chlamydophila pneumoniae J138
uugcaugaggaga

SEQ ID NO: 2557773 - RNA, 14 nt, Chlamydophila pneumoniae J138
uugcaugaggagac

SEQ ID NO: 2557774 - RNA, 18 nt, Chlamydophila pneumoniae J138
uugcaugaugcuguugau

SEQ ID NO: 2557775 - RNA, 17 nt, Chlamydophila pneumoniae J138
uugcaugcaacggagaa

SEQ ID NO: 2557776 - RNA, 22 nt, Chlamydophila pneumoniae J138
uugcaugcuugaaguucucaaa

SEQ ID NO: 2557777 - RNA, 22 nt, Chlamydophila pneumoniae J138
uugcauguccauuaauauccca

SEQ ID NO: 2557778 - RNA, 21 nt, Chlamydophila pneumoniae J138
uugcauuaaaucguacuucac

SEQ ID NO: 2557779 - RNA, 22 nt, Chlamydophila pneumoniae J138
uugccaaucuuccuuaaccucc

SEQ ID NO: 2557780 - RNA, 22 nt, Chlamydophila pneumoniae J138
uugccaggaaacguucuuucaa

SEQ ID NO: 2557781 - RNA, 17 nt, Chlamydophila pneumoniae J138
uugccguauagauuuuc

SEQ ID NO: 2557782 - RNA, 14 nt, Chlamydophila pneumoniae J138
uugccuucuuaucu

SEQ ID NO: 2557783 - RNA, 12 nt, Chlamydophila pneumoniae J138
uugccuucuucu

SEQ ID NO: 2557784 - RNA, 22 nt, Chlamydophila pneumoniae J138
uugccuuuagggaaaaaguagu

SEQ ID NO: 2557785 - RNA, 14 nt, Chlamydophila pneumoniae J138
uugcgacauaacca

SEQ ID NO: 2557786 - RNA, 15 nt, Chlamydophila pneumoniae J138
uugcgccagcaaaga

SEQ ID NO: 2557787 - RNA, 16 nt, Chlamydophila pneumoniae J138
uugcggaaauugaaua

SEQ ID NO: 2557788 - RNA, 20 nt, Chlamydophila pneumoniae J138
uugcuaagagcucuuucccu

SEQ ID NO: 2557789 - RNA, 15 nt, Chlamydophila pneumoniae J138
uugcuaagcauuuua

SEQ ID NO: 2557790 - RNA, 20 nt, Chlamydophila pneumoniae J138
uugcuaagcgaaccaaaguc

SEQ ID NO: 2557791 - RNA, 14 nt, Chlamydophila pneumoniae J138
uugcuacagcuucu

SEQ ID NO: 2557792 - RNA, 22 nt, Chlamydophila pneumoniae J138
uugcuacagcuucuuuuccagc

SEQ ID NO: 2557793 - RNA, 18 nt, Chlamydophila pneumoniae J138
uugcuagaucuggagagg

SEQ ID NO: 2557794 - RNA, 14 nt, Chlamydophila pneumoniae J138
uugcuauacagaaa

SEQ ID NO: 2557795 - RNA, 15 nt, Chlamydophila pneumoniae J138
uugcuauugaaaaau

SEQ ID NO: 2557796 - RNA, 20 nt, Chlamydophila pneumoniae J138
uugcuauugaaaaaucccug

SEQ ID NO: 2557797 - RNA, 20 nt, Chlamydophila pneumoniae J138
uugcucuggauguagaggau

SEQ ID NO: 2557798 - RNA, 14 nt, Chlamydophila pneumoniae J138
uugcugaaaaugau

SEQ ID NO: 2557799 - RNA, 15 nt, Chlamydophila pneumoniae J138
uugcugaaaaugauu

SEQ ID NO: 2557800 - RNA, 20 nt, Chlamydophila pneumoniae J138
uugcugaagauuuuuucuug

SEQ ID NO: 2557801 - RNA, 13 nt, Chlamydophila pneumoniae J138
uugcugauuucuu

SEQ ID NO: 2557802 - RNA, 22 nt, Chlamydophila pneumoniae J138
uugcugcagcaaaacuaggaaa

SEQ ID NO: 2557803 - RNA, 15 nt, Chlamydophila pneumoniae J138
uugcugcucuccaaa

SEQ ID NO: 2557804 - RNA, 19 nt, Chlamydophila pneumoniae J138
uugcuguagcgcuuccagc

SEQ ID NO: 2557805 - RNA, 14 nt, Chlamydophila pneumoniae J138
uugcuguggaauuu

SEQ ID NO: 2557806 - RNA, 19 nt, Chlamydophila pneumoniae J138
uugcuguggaauuuuccug

SEQ ID NO: 2557807 - RNA, 19 nt, Chlamydophila pneumoniae J138
uugcuuaaaaagucugaau

SEQ ID NO: 2557808 - RNA, 12 nt, Chlamydophila pneumoniae J138
uugcuuccaacg

SEQ ID NO: 2557809 - RNA, 14 nt, Chlamydophila pneumoniae J138
uugcuucuaagaaa

SEQ ID NO: 2557810 - RNA, 20 nt, Chlamydophila pneumoniae J138
uugcuucuaagaaacuucca

SEQ ID NO: 2557811 - RNA, 22 nt, Chlamydophila pneumoniae J138
uugcuucuccccgagauacggg

SEQ ID NO: 2557812 - RNA, 16 nt, Chlamydophila pneumoniae J138
uugcuugaaguuuguc

SEQ ID NO: 2557813 - RNA, 13 nt, Chlamydophila pneumoniae J138
uugcuuuucccuu

SEQ ID NO: 2557814 - RNA, 14 nt, Chlamydophila pneumoniae J138
uuggaaaaccauga

SEQ ID NO: 2557815 - RNA, 14 nt, Chlamydophila pneumoniae J138
uuggaaaucagaau

SEQ ID NO: 2557816 - RNA, 15 nt, Chlamydophila pneumoniae J138
uuggaaaucagaauc

SEQ ID NO: 2557817 - RNA, 23 nt, Chlamydophila pneumoniae J138
uuggacucuagggucaagaacag

SEQ ID NO: 2557818 - RNA, 22 nt, Chlamydophila pneumoniae J138
uuggaggaacaauacucucugc

SEQ ID NO: 2557819 - RNA, 15 nt, Chlamydophila pneumoniae J138
uuggauuucuucuuc

SEQ ID NO: 2557820 - RNA, 18 nt, Chlamydophila pneumoniae J138
uuggauuucuucuucuaa

SEQ ID NO: 2557821 - RNA, 14 nt, Chlamydophila pneumoniae J138
uuggcaauagcuuu

SEQ ID NO: 2557822 - RNA, 19 nt, Chlamydophila pneumoniae J138
uuggcuauggaaagagucc

SEQ ID NO: 2557823 - RNA, 23 nt, Chlamydophila pneumoniae J138
uuggcuccuguuauuguuucuau

SEQ ID NO: 2557824 - RNA, 16 nt, Chlamydophila pneumoniae J138
uuggcucuagaaauau

SEQ ID NO: 2557825 - RNA, 19 nt, Chlamydophila pneumoniae J138
uugggagaugcuauuuacu

SEQ ID NO: 2557826 - RNA, 13 nt, Chlamydophila pneumoniae J138
uugggaggaggag

SEQ ID NO: 2557827 - RNA, 16 nt, Chlamydophila pneumoniae J138
uugggauaaaaaguuu

SEQ ID NO: 2557828 - RNA, 17 nt, Chlamydophila pneumoniae J138
uugggcaucucucuuua

SEQ ID NO: 2557829 - RNA, 21 nt, Chlamydophila pneumoniae J138
uugguagagcaacacauucgu

SEQ ID NO: 2557830 - RNA, 21 nt, Chlamydophila pneumoniae J138
uugguaugccgcaucuagaag

SEQ ID NO: 2557831 - RNA, 15 nt, Chlamydophila pneumoniae J138
uuggucgaucaaggu

SEQ ID NO: 2557832 - RNA, 14 nt, Chlamydophila pneumoniae J138
uuggugcuuugccu

SEQ ID NO: 2557833 - RNA, 14 nt, Chlamydophila pneumoniae J138
uuguaaauacaaaa

SEQ ID NO: 2557834 - RNA, 20 nt, Chlamydophila pneumoniae J138
uuguaaauaguauacaagcg

SEQ ID NO: 2557835 - RNA, 23 nt, Chlamydophila pneumoniae J138
uuguaacgcugcuaauguugucu

SEQ ID NO: 2557836 - RNA, 18 nt, Chlamydophila pneumoniae J138
uuguaacuucguuagaaa

SEQ ID NO: 2557837 - RNA, 17 nt, Chlamydophila pneumoniae J138
uuguaagaaucauaaca

SEQ ID NO: 2557838 - RNA, 19 nt, Chlamydophila pneumoniae J138
uuguaagacuaaaaaagag

SEQ ID NO: 2557839 - RNA, 22 nt, Chlamydophila pneumoniae J138
uuguaagcgugcaaguucacac

SEQ ID NO: 2557840 - RNA, 14 nt, Chlamydophila pneumoniae J138
uuguaauaaaauca

SEQ ID NO: 2557841 - RNA, 14 nt, Chlamydophila pneumoniae J138
uuguaauuuccuua

SEQ ID NO: 2557842 - RNA, 20 nt, Chlamydophila pneumoniae J138
uuguaauuucuaaauagaaa

SEQ ID NO: 2557843 - RNA, 16 nt, Chlamydophila pneumoniae J138
uuguacuuuuugccac

SEQ ID NO: 2557844 - RNA, 21 nt, Chlamydophila pneumoniae J138
uuguagagacauagccuauau

SEQ ID NO: 2557845 - RNA, 18 nt, Chlamydophila pneumoniae J138
uuguagcagcaagaacau

SEQ ID NO: 2557846 - RNA, 23 nt, Chlamydophila pneumoniae J138
uuguaggaacaugccaaauaucu

SEQ ID NO: 2557847 - RNA, 23 nt, Chlamydophila pneumoniae J138
uuguaguaaggagagacuguguu

SEQ ID NO: 2557848 - RNA, 17 nt, Chlamydophila pneumoniae J138
uuguaguccacaucuug

SEQ ID NO: 2557849 - RNA, 13 nt, Chlamydophila pneumoniae J138
uuguaguucuuug

SEQ ID NO: 2557850 - RNA, 14 nt, Chlamydophila pneumoniae J138
uuguauaagagcaa

SEQ ID NO: 2557851 - RNA, 19 nt, Chlamydophila pneumoniae J138
uuguauggcagccuggaaa

SEQ ID NO: 2557852 - RNA, 11 nt, Chlamydophila pneumoniae J138
uuguauuaaag

SEQ ID NO: 2557853 - RNA, 12 nt, Chlamydophila pneumoniae J138
uugucccuuuca

SEQ ID NO: 2557854 - RNA, 21 nt, Chlamydophila pneumoniae J138
uuguccuuugcuaagaacuag

SEQ ID NO: 2557855 - RNA, 19 nt, Chlamydophila pneumoniae J138
uugucuacagaggaaucua

SEQ ID NO: 2557856 - RNA, 19 nt, Chlamydophila pneumoniae J138
uugucucaauugaaucaga

SEQ ID NO: 2557857 - RNA, 20 nt, Chlamydophila pneumoniae J138
uugucucgaaacucuuugag

SEQ ID NO: 2557858 - RNA, 14 nt, Chlamydophila pneumoniae J138
uugucugaggacag

SEQ ID NO: 2557859 - RNA, 23 nt, Chlamydophila pneumoniae J138
uugucugaggacaguauucccuc

SEQ ID NO: 2557860 - RNA, 20 nt, Chlamydophila pneumoniae J138
uugucugauuaguucucuaa

SEQ ID NO: 2557861 - RNA, 13 nt, Chlamydophila pneumoniae J138
uugucuuccauaa

SEQ ID NO: 2557862 - RNA, 15 nt, Chlamydophila pneumoniae J138
uugucuuugauuuuc

SEQ ID NO: 2557863 - RNA, 22 nt, Chlamydophila pneumoniae J138
uugugaagauaagaccagaaag

SEQ ID NO: 2557864 - RNA, 17 nt, Chlamydophila pneumoniae J138
uugugauccuugcaaaa

SEQ ID NO: 2557865 - RNA, 22 nt, Chlamydophila pneumoniae J138
uugugcaucuauaauuaauccu

SEQ ID NO: 2557866 - RNA, 19 nt, Chlamydophila pneumoniae J138
uugugcuaaagcaggagca

SEQ ID NO: 2557867 - RNA, 21 nt, Chlamydophila pneumoniae J138
uugugcuaggcucucgacacu

SEQ ID NO: 2557868 - RNA, 19 nt, Chlamydophila pneumoniae J138
uugugcuagguaguguggu

SEQ ID NO: 2557869 - RNA, 12 nt, Chlamydophila pneumoniae J138
uuguggaaguaa

SEQ ID NO: 2557870 - RNA, 23 nt, Chlamydophila pneumoniae J138
uuguggacaacgauuguaaaagu

SEQ ID NO: 2557871 - RNA, 16 nt, Chlamydophila pneumoniae J138
uuguggcuuuucuaaa

SEQ ID NO: 2557872 - RNA, 22 nt, Chlamydophila pneumoniae J138
uuguggcuuuucuaaagcguuu

SEQ ID NO: 2557873 - RNA, 22 nt, Chlamydophila pneumoniae J138
uuguguaagacugaaauugaau

SEQ ID NO: 2557874 - RNA, 17 nt, Chlamydophila pneumoniae J138
uuguguucccucuucuu

SEQ ID NO: 2557875 - RNA, 18 nt, Chlamydophila pneumoniae J138
uuguguucccucuucuuc

SEQ ID NO: 2557876 - RNA, 22 nt, Chlamydophila pneumoniae J138
uuguguuuuuggcauaaagacc

SEQ ID NO: 2557877 - RNA, 21 nt, Chlamydophila pneumoniae J138
uuguuaaaguaaaaaauacag

SEQ ID NO: 2557878 - RNA, 18 nt, Chlamydophila pneumoniae J138
uuguuaauggcagcuugg

SEQ ID NO: 2557879 - RNA, 13 nt, Chlamydophila pneumoniae J138
uuguuaucaggaa

SEQ ID NO: 2557880 - RNA, 17 nt, Chlamydophila pneumoniae J138
uuguucuugaaguucuu

SEQ ID NO: 2557881 - RNA, 21 nt, Chlamydophila pneumoniae J138
uuguugaggaauuggcaggua

SEQ ID NO: 2557882 - RNA, 22 nt, Chlamydophila pneumoniae J138
uuguuggcauagcgagaacacc

SEQ ID NO: 2557883 - RNA, 19 nt, Chlamydophila pneumoniae J138
uuguugucagcuuugcuua

SEQ ID NO: 2557884 - RNA, 13 nt, Chlamydophila pneumoniae J138
uuguuucaucuuc

SEQ ID NO: 2557885 - RNA, 17 nt, Chlamydophila pneumoniae J138
uuguuucaucuucuuuc

SEQ ID NO: 2557886 - RNA, 13 nt, Chlamydophila pneumoniae J138
uuguuucuagaaa

SEQ ID NO: 2557887 - RNA, 13 nt, Chlamydophila pneumoniae J138
uuguuuguuuucu

SEQ ID NO: 2557888 - RNA, 19 nt, Chlamydophila pneumoniae J138
uuguuuugcuuuuugaaug

SEQ ID NO: 2557889 - RNA, 21 nt, Chlamydophila pneumoniae J138
uuuaaaaacucuuucauaaga

SEQ ID NO: 2557890 - RNA, 16 nt, Chlamydophila pneumoniae J138
uuuaaaaauagaaaua

SEQ ID NO: 2557891 - RNA, 23 nt, Chlamydophila pneumoniae J138
uuuaaaagauuccuuaccuauau

SEQ ID NO: 2557892 - RNA, 21 nt, Chlamydophila pneumoniae J138
uuuaaaaguacgaccaacucc

SEQ ID NO: 2557893 - RNA, 12 nt, Chlamydophila pneumoniae J138
uuuaaagccucc

SEQ ID NO: 2557894 - RNA, 17 nt, Chlamydophila pneumoniae J138
uuuaaaguguguaaaug

SEQ ID NO: 2557895 - RNA, 19 nt, Chlamydophila pneumoniae J138
uuuaaaguguguaaauguu

SEQ ID NO: 2557896 - RNA, 22 nt, Chlamydophila pneumoniae J138
uuuaaauagcaucccuucuucu

SEQ ID NO: 2557897 - RNA, 13 nt, Chlamydophila pneumoniae J138
uuuaaaugccuua

SEQ ID NO: 2557898 - RNA, 14 nt, Chlamydophila pneumoniae J138
uuuaaaugccuuaa

SEQ ID NO: 2557899 - RNA, 17 nt, Chlamydophila pneumoniae J138
uuuaaaugccuuaaaug

SEQ ID NO: 2557900 - RNA, 19 nt, Chlamydophila pneumoniae J138
uuuaaaugccuuaaaugua

SEQ ID NO: 2557901 - RNA, 22 nt, Chlamydophila pneumoniae J138
uuuaaauucgccaaacgaauuu

SEQ ID NO: 2557902 - RNA, 17 nt, Chlamydophila pneumoniae J138
uuuaaccucuuuucuua

SEQ ID NO: 2557903 - RNA, 16 nt, Chlamydophila pneumoniae J138
uuuaacucuagaucuu

SEQ ID NO: 2557904 - RNA, 11 nt, Chlamydophila pneumoniae J138
uuuaagaagaa

SEQ ID NO: 2557905 - RNA, 18 nt, Chlamydophila pneumoniae J138
uuuaagaagaagaaaaau

SEQ ID NO: 2557906 - RNA, 12 nt, Chlamydophila pneumoniae J138
uuuaagauuuuu

SEQ ID NO: 2557907 - RNA, 18 nt, Chlamydophila pneumoniae J138
uuuaagguugcuuuucua

SEQ ID NO: 2557908 - RNA, 16 nt, Chlamydophila pneumoniae J138
uuuaaguccuucuucc

SEQ ID NO: 2557909 - RNA, 14 nt, Chlamydophila pneumoniae J138
uuuaauacaaaaaa

SEQ ID NO: 2557910 - RNA, 20 nt, Chlamydophila pneumoniae J138
uuuaaucaagccuaaaucua

SEQ ID NO: 2557911 - RNA, 13 nt, Chlamydophila pneumoniae J138
uuuaaucagagga

SEQ ID NO: 2557912 - RNA, 23 nt, Chlamydophila pneumoniae J138
uuuaauccaaaaacuucuaacug

SEQ ID NO: 2557913 - RNA, 15 nt, Chlamydophila pneumoniae J138
uuuaauccaguuuuu

SEQ ID NO: 2557914 - RNA, 21 nt, Chlamydophila pneumoniae J138
uuuaaucgauacgguuuuuau

SEQ ID NO: 2557915 - RNA, 15 nt, Chlamydophila pneumoniae J138
uuuaaugaucacgug

SEQ ID NO: 2557916 - RNA, 13 nt, Chlamydophila pneumoniae J138
uuuaauuuuucua

SEQ ID NO: 2557917 - RNA, 18 nt, Chlamydophila pneumoniae J138
uuuaauuuuucuaagaaa

SEQ ID NO: 2557918 - RNA, 16 nt, Chlamydophila pneumoniae J138
uuuacaaucucugcga

SEQ ID NO: 2557919 - RNA, 22 nt, Chlamydophila pneumoniae J138
uuuacaaucucugcgagaaucg

SEQ ID NO: 2557920 - RNA, 17 nt, Chlamydophila pneumoniae J138
uuuaccagaaaugggca

SEQ ID NO: 2557921 - RNA, 13 nt, Chlamydophila pneumoniae J138
uuuacgaaaacau

SEQ ID NO: 2557922 - RNA, 17 nt, Chlamydophila pneumoniae J138
uuuacgaaucuuuuuca

SEQ ID NO: 2557923 - RNA, 13 nt, Chlamydophila pneumoniae J138
uuuacugaaauua

SEQ ID NO: 2557924 - RNA, 22 nt, Chlamydophila pneumoniae J138
uuuacuuuuaauccuuucacaa

SEQ ID NO: 2557925 - RNA, 14 nt, Chlamydophila pneumoniae J138
uuuagaaaaagauc

SEQ ID NO: 2557926 - RNA, 16 nt, Chlamydophila pneumoniae J138
uuuagaaaaagaucua

SEQ ID NO: 2557927 - RNA, 19 nt, Chlamydophila pneumoniae J138
uuuagaaauuccaauuuuu

SEQ ID NO: 2557928 - RNA, 13 nt, Chlamydophila pneumoniae J138
uuuagaacuucaa

SEQ ID NO: 2557929 - RNA, 14 nt, Chlamydophila pneumoniae J138
uuuagaauaagagc

SEQ ID NO: 2557930 - RNA, 16 nt, Chlamydophila pneumoniae J138
uuuagaauuuguccuu

SEQ ID NO: 2557931 - RNA, 18 nt, Chlamydophila pneumoniae J138
uuuagagaacggaugucu

SEQ ID NO: 2557932 - RNA, 15 nt, Chlamydophila pneumoniae J138
uuuagagagaaacau

SEQ ID NO: 2557933 - RNA, 17 nt, Chlamydophila pneumoniae J138
uuuagagccuuuucaga

SEQ ID NO: 2557934 - RNA, 21 nt, Chlamydophila pneumoniae J138
uuuagaguacacagcacaaga

SEQ ID NO: 2557935 - RNA, 15 nt, Chlamydophila pneumoniae J138
uuuagauggaucuau

SEQ ID NO: 2557936 - RNA, 21 nt, Chlamydophila pneumoniae J138
uuuagcaaucucuuucacaaa

SEQ ID NO: 2557937 - RNA, 15 nt, Chlamydophila pneumoniae J138
uuuagccuggucuca

SEQ ID NO: 2557938 - RNA, 16 nt, Chlamydophila pneumoniae J138
uuuagcuacagaaaga

SEQ ID NO: 2557939 - RNA, 13 nt, Chlamydophila pneumoniae J138
uuuaggaagcugu

SEQ ID NO: 2557940 - RNA, 23 nt, Chlamydophila pneumoniae J138
uuuaggagcauagacucuuccuu

SEQ ID NO: 2557941 - RNA, 19 nt, Chlamydophila pneumoniae J138
uuuaguggaaauugugaaa

SEQ ID NO: 2557942 - RNA, 15 nt, Chlamydophila pneumoniae J138
uuuaguucaccacua

SEQ ID NO: 2557943 - RNA, 18 nt, Chlamydophila pneumoniae J138
uuuauaacaucaagaauu

SEQ ID NO: 2557944 - RNA, 18 nt, Chlamydophila pneumoniae J138
uuuauagcggaguguuuu

SEQ ID NO: 2557945 - RNA, 23 nt, Chlamydophila pneumoniae J138
uuuauauuuuuugagaaauauaa

SEQ ID NO: 2557946 - RNA, 14 nt, Chlamydophila pneumoniae J138
uuuaucauugcuau

SEQ ID NO: 2557947 - RNA, 20 nt, Chlamydophila pneumoniae J138
uuuaucauugcuauugaaaa

SEQ ID NO: 2557948 - RNA, 13 nt, Chlamydophila pneumoniae J138
uuuauccaccaag

SEQ ID NO: 2557949 - RNA, 22 nt, Chlamydophila pneumoniae J138
uuuaucccagauaaagacaucu

SEQ ID NO: 2557950 - RNA, 16 nt, Chlamydophila pneumoniae J138
uuuaucgacucuucca

SEQ ID NO: 2557951 - RNA, 13 nt, Chlamydophila pneumoniae J138
uuuaucugcuucu

SEQ ID NO: 2557952 - RNA, 22 nt, Chlamydophila pneumoniae J138
uuuaugacacagcuaaucaauc

SEQ ID NO: 2557953 - RNA, 14 nt, Chlamydophila pneumoniae J138
uuuaugauguauaa

SEQ ID NO: 2557954 - RNA, 14 nt, Chlamydophila pneumoniae J138
uuuauguuuucucg

SEQ ID NO: 2557955 - RNA, 12 nt, Chlamydophila pneumoniae J138
uuuauuuaaaau

SEQ ID NO: 2557956 - RNA, 18 nt, Chlamydophila pneumoniae J138
uuuauuuaaauaaaacca

SEQ ID NO: 2557957 - RNA, 19 nt, Chlamydophila pneumoniae J138
uuuauuuugaugcuucuuu

SEQ ID NO: 2557958 - RNA, 14 nt, Chlamydophila pneumoniae J138
uuucaaacaauagu

SEQ ID NO: 2557959 - RNA, 9 nt, Chlamydophila pneumoniae J138
uuucaaagg

SEQ ID NO: 2557960 - RNA, 14 nt, Chlamydophila pneumoniae J138
uuucaaauucugaa

SEQ ID NO: 2557961 - RNA, 16 nt, Chlamydophila pneumoniae J138
uuucaagaacuccuuu

SEQ ID NO: 2557962 - RNA, 20 nt, Chlamydophila pneumoniae J138
uuucaagcuuucguuuucua

SEQ ID NO: 2557963 - RNA, 12 nt, Chlamydophila pneumoniae J138
uuucaauagcuu

SEQ ID NO: 2557964 - RNA, 15 nt, Chlamydophila pneumoniae J138
uuucaauccuuccuu

SEQ ID NO: 2557965 - RNA, 16 nt, Chlamydophila pneumoniae J138
uuucaaucucuccuug

SEQ ID NO: 2557966 - RNA, 18 nt, Chlamydophila pneumoniae J138
uuucacauacauucuauu

SEQ ID NO: 2557967 - RNA, 19 nt, Chlamydophila pneumoniae J138
uuucacauaguuuaauaaa

SEQ ID NO: 2557968 - RNA, 17 nt, Chlamydophila pneumoniae J138
uuucaccaacuccucua

SEQ ID NO: 2557969 - RNA, 21 nt, Chlamydophila pneumoniae J138
uuucaccaacuccucuaagga

SEQ ID NO: 2557970 - RNA, 14 nt, Chlamydophila pneumoniae J138
uuucagaaaagaaa

SEQ ID NO: 2557971 - RNA, 24 nt, Chlamydophila pneumoniae J138
uuucagaagucacaaauuuuugca

SEQ ID NO: 2557972 - RNA, 14 nt, Chlamydophila pneumoniae J138
uuucagauguacaa

SEQ ID NO: 2557973 - RNA, 14 nt, Chlamydophila pneumoniae J138
uuucagauuuuuua

SEQ ID NO: 2557974 - RNA, 19 nt, Chlamydophila pneumoniae J138
uuucaggaaacucaaucuc

SEQ ID NO: 2557975 - RNA, 22 nt, Chlamydophila pneumoniae J138
uuucaggaaacucaaucucuuu

SEQ ID NO: 2557976 - RNA, 22 nt, Chlamydophila pneumoniae J138
uuucaguuguuucuagaaaauc

SEQ ID NO: 2557977 - RNA, 21 nt, Chlamydophila pneumoniae J138
uuucaguuuuaucggcaauug

SEQ ID NO: 2557978 - RNA, 13 nt, Chlamydophila pneumoniae J138
uuucauaagagaa

SEQ ID NO: 2557979 - RNA, 18 nt, Chlamydophila pneumoniae J138
uuucauguaagaauguag

SEQ ID NO: 2557980 - RNA, 12 nt, Chlamydophila pneumoniae J138
uuucauucccuu

SEQ ID NO: 2557981 - RNA, 13 nt, Chlamydophila pneumoniae J138
uuucauucccuuu

SEQ ID NO: 2557982 - RNA, 19 nt, Chlamydophila pneumoniae J138
uuucauucccuuuuuccau

SEQ ID NO: 2557983 - RNA, 23 nt, Chlamydophila pneumoniae J138
uuucauucccuuuuuccauaccc

SEQ ID NO: 2557984 - RNA, 17 nt, Chlamydophila pneumoniae J138
uuucauuugaaauauga

SEQ ID NO: 2557985 - RNA, 20 nt, Chlamydophila pneumoniae J138
uuucauuuuuaggaucuuug

SEQ ID NO: 2557986 - RNA, 17 nt, Chlamydophila pneumoniae J138
uuuccaaagaucgaucu

SEQ ID NO: 2557987 - RNA, 13 nt, Chlamydophila pneumoniae J138
uuuccaacuucaa

SEQ ID NO: 2557988 - RNA, 23 nt, Chlamydophila pneumoniae J138
uuuccaagugaucagaaaugaag

SEQ ID NO: 2557989 - RNA, 20 nt, Chlamydophila pneumoniae J138
uuuccacguacgagaucaga

SEQ ID NO: 2557990 - RNA, 13 nt, Chlamydophila pneumoniae J138
uuuccagcaaagc

SEQ ID NO: 2557991 - RNA, 23 nt, Chlamydophila pneumoniae J138
uuuccauacccaaauuucuucug

SEQ ID NO: 2557992 - RNA, 18 nt, Chlamydophila pneumoniae J138
uuuccauaggaucugcau

SEQ ID NO: 2557993 - RNA, 22 nt, Chlamydophila pneumoniae J138
uuuccauuagggcauucuguaa

SEQ ID NO: 2557994 - RNA, 19 nt, Chlamydophila pneumoniae J138
uuuccccuuggaaaucaga

SEQ ID NO: 2557995 - RNA, 22 nt, Chlamydophila pneumoniae J138
uuucccgacauuuaacaucuuu

SEQ ID NO: 2557996 - RNA, 22 nt, Chlamydophila pneumoniae J138
uuucccgcucuuuauuaacucc

SEQ ID NO: 2557997 - RNA, 23 nt, Chlamydophila pneumoniae J138
uuucccuaaaaugagauuccuau

SEQ ID NO: 2557998 - RNA, 21 nt, Chlamydophila pneumoniae J138
uuucccuaagcaaaaacuuuc

SEQ ID NO: 2557999 - RNA, 16 nt, Chlamydophila pneumoniae J138
uuucccuccaccagaa

SEQ ID NO: 2558000 - RNA, 17 nt, Chlamydophila pneumoniae J138
uuucccuccaccagaag

SEQ ID NO: 2558001 - RNA, 16 nt, Chlamydophila pneumoniae J138
uuucccucguugcuua

SEQ ID NO: 2558002 - RNA, 15 nt, Chlamydophila pneumoniae J138
uuucccuucuaagga

SEQ ID NO: 2558003 - RNA, 19 nt, Chlamydophila pneumoniae J138
uuuccggggagaacuucaa

SEQ ID NO: 2558004 - RNA, 23 nt, Chlamydophila pneumoniae J138
uuuccguaaguaaccaauacagc

SEQ ID NO: 2558005 - RNA, 12 nt, Chlamydophila pneumoniae J138
uuuccuaaaaua

SEQ ID NO: 2558006 - RNA, 14 nt, Chlamydophila pneumoniae J138
uuuccuaguccucu

SEQ ID NO: 2558007 - RNA, 15 nt, Chlamydophila pneumoniae J138
uuuccuaguccucua

SEQ ID NO: 2558008 - RNA, 22 nt, Chlamydophila pneumoniae J138
uuuccuccaaauacgaacugua

SEQ ID NO: 2558009 - RNA, 14 nt, Chlamydophila pneumoniae J138
uuuccuccucuucu

SEQ ID NO: 2558010 - RNA, 22 nt, Chlamydophila pneumoniae J138
uuuccucuaucagggagcggaa

SEQ ID NO: 2558011 - RNA, 16 nt, Chlamydophila pneumoniae J138
uuuccucucaugaaau

SEQ ID NO: 2558012 - RNA, 20 nt, Chlamydophila pneumoniae J138
uuuccugaagaugagaaaau

SEQ ID NO: 2558013 - RNA, 18 nt, Chlamydophila pneumoniae J138
uuuccuggucuccagaag

SEQ ID NO: 2558014 - RNA, 15 nt, Chlamydophila pneumoniae J138
uuuccuucuccagag

SEQ ID NO: 2558015 - RNA, 19 nt, Chlamydophila pneumoniae J138
uuuccuugguaucccaauc

SEQ ID NO: 2558016 - RNA, 17 nt, Chlamydophila pneumoniae J138
uuuccuuuucuccuucu

SEQ ID NO: 2558017 - RNA, 18 nt, Chlamydophila pneumoniae J138
uuuccuuuucuccuucug

SEQ ID NO: 2558018 - RNA, 19 nt, Chlamydophila pneumoniae J138
uuuccuuuucuccuucugg

SEQ ID NO: 2558019 - RNA, 22 nt, Chlamydophila pneumoniae J138
uuucgaacacgucgaacaugac

SEQ ID NO: 2558020 - RNA, 22 nt, Chlamydophila pneumoniae J138
uuucgaagcgcucuacaaaugc

SEQ ID NO: 2558021 - RNA, 23 nt, Chlamydophila pneumoniae J138
uuucgaagcguuaacaacuucua

SEQ ID NO: 2558022 - RNA, 16 nt, Chlamydophila pneumoniae J138
uuucgcagauacuucu

SEQ ID NO: 2558023 - RNA, 14 nt, Chlamydophila pneumoniae J138
uuucgcuaacuuau

SEQ ID NO: 2558024 - RNA, 14 nt, Chlamydophila pneumoniae J138
uuucgucuaaaaua

SEQ ID NO: 2558025 - RNA, 19 nt, Chlamydophila pneumoniae J138
uuucuaaauagaaaacaua

SEQ ID NO: 2558026 - RNA, 19 nt, Chlamydophila pneumoniae J138
uuucuaagagaucuacaaa

SEQ ID NO: 2558027 - RNA, 20 nt, Chlamydophila pneumoniae J138
uuucuaagauuccuaacuuc

SEQ ID NO: 2558028 - RNA, 22 nt, Chlamydophila pneumoniae J138
uuucuaagauuccuaacuucug

SEQ ID NO: 2558029 - RNA, 14 nt, Chlamydophila pneumoniae J138
uuucuaauguaggg

SEQ ID NO: 2558030 - RNA, 17 nt, Chlamydophila pneumoniae J138
uuucuacugaaaccuuc

SEQ ID NO: 2558031 - RNA, 22 nt, Chlamydophila pneumoniae J138
uuucucaccacggaagauaugu

SEQ ID NO: 2558032 - RNA, 15 nt, Chlamydophila pneumoniae J138
uuucucauagcuucc

SEQ ID NO: 2558033 - RNA, 16 nt, Chlamydophila pneumoniae J138
uuucucauagguaaua

SEQ ID NO: 2558034 - RNA, 16 nt, Chlamydophila pneumoniae J138
uuucuccuucucccug

SEQ ID NO: 2558035 - RNA, 21 nt, Chlamydophila pneumoniae J138
uuucucggauccuccaagauc

SEQ ID NO: 2558036 - RNA, 15 nt, Chlamydophila pneumoniae J138
uuucucuaaaauaug

SEQ ID NO: 2558037 - RNA, 21 nt, Chlamydophila pneumoniae J138
uuucucuaagcagccucuucu

SEQ ID NO: 2558038 - RNA, 13 nt, Chlamydophila pneumoniae J138
uuucucuccacag

SEQ ID NO: 2558039 - RNA, 13 nt, Chlamydophila pneumoniae J138
uuucugaagauuu

SEQ ID NO: 2558040 - RNA, 18 nt, Chlamydophila pneumoniae J138
uuucugauuuaaaagguu

SEQ ID NO: 2558041 - RNA, 22 nt, Chlamydophila pneumoniae J138
uuucuguacaacaaaauuugca

SEQ ID NO: 2558042 - RNA, 13 nt, Chlamydophila pneumoniae J138
uuucuguuccuga

SEQ ID NO: 2558043 - RNA, 17 nt, Chlamydophila pneumoniae J138
uuucuguugcacuuucc

SEQ ID NO: 2558044 - RNA, 14 nt, Chlamydophila pneumoniae J138
uuucuuaauuuccu

SEQ ID NO: 2558045 - RNA, 22 nt, Chlamydophila pneumoniae J138
uuucuuacuaaagaaagagucu

SEQ ID NO: 2558046 - RNA, 20 nt, Chlamydophila pneumoniae J138
uuucuuauagcuuuggaacg

SEQ ID NO: 2558047 - RNA, 16 nt, Chlamydophila pneumoniae J138
uuucuucaacauacac

SEQ ID NO: 2558048 - RNA, 22 nt, Chlamydophila pneumoniae J138
uuucuuccaaagacugagcuuc

SEQ ID NO: 2558049 - RNA, 24 nt, Chlamydophila pneumoniae J138
uuucuuccacacaacucguuucag
